United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 95

SEQ ID NO: 4018912 - DNA, 20 bp, Homo sapiens
cctgggcatgggtccagggc

SEQ ID NO: 4018913 - DNA, 14 bp, Homo sapiens
cctgggcattgctt

SEQ ID NO: 4018914 - DNA, 17 bp, Homo sapiens
cctgggcattgctttcc

SEQ ID NO: 4018915 - DNA, 23 bp, Homo sapiens
cctgggccacagggcgagactcc

SEQ ID NO: 4018916 - DNA, 14 bp, Homo sapiens
cctgggccagggtc

SEQ ID NO: 4018917 - DNA, 22 bp, Homo sapiens
cctgggcccctccacgcctcct

SEQ ID NO: 4018918 - DNA, 12 bp, Homo sapiens
cctgggccctgg

SEQ ID NO: 4018919 - DNA, 22 bp, Homo sapiens
cctgggcctcagttcaacctgg

SEQ ID NO: 4018920 - DNA, 16 bp, Homo sapiens
cctgggcctgcccctg

SEQ ID NO: 4018921 - DNA, 19 bp, Homo sapiens
cctgggctattgctgctgc

SEQ ID NO: 4018922 - DNA, 14 bp, Homo sapiens
cctgggctcggagg

SEQ ID NO: 4018923 - DNA, 17 bp, Homo sapiens
cctgggctgccaccagc

SEQ ID NO: 4018924 - DNA, 19 bp, Homo sapiens
cctgggctggggccaccat

SEQ ID NO: 4018925 - DNA, 24 bp, Homo sapiens
cctgggctggggccaccatccctg

SEQ ID NO: 4018926 - DNA, 17 bp, Homo sapiens
cctgggctgggtgctgg

SEQ ID NO: 4018927 - DNA, 13 bp, Homo sapiens
cctgggcttggcc

SEQ ID NO: 4018928 - DNA, 15 bp, Homo sapiens
cctgggcttggcctg

SEQ ID NO: 4018929 - DNA, 16 bp, Homo sapiens
cctgggcttggcctgc

SEQ ID NO: 4018930 - DNA, 17 bp, Homo sapiens
cctgggcttggcctgct

SEQ ID NO: 4018931 - DNA, 18 bp, Homo sapiens
cctgggcttggcctgctg

SEQ ID NO: 4018932 - DNA, 18 bp, Homo sapiens
cctggggaaggagccagt

SEQ ID NO: 4018933 - DNA, 18 bp, Homo sapiens
cctggggactgttccaaa

SEQ ID NO: 4018934 - DNA, 13 bp, Homo sapiens
cctggggcccagc

SEQ ID NO: 4018935 - DNA, 13 bp, Homo sapiens
cctggggcctctt

SEQ ID NO: 4018936 - DNA, 16 bp, Homo sapiens
cctggggcctgagaga

SEQ ID NO: 4018937 - DNA, 21 bp, Homo sapiens
cctggggcctggacctgcctc

SEQ ID NO: 4018938 - DNA, 15 bp, Homo sapiens
cctggggctcctttc

SEQ ID NO: 4018939 - DNA, 22 bp, Homo sapiens
cctggggctcctttctccagcc

SEQ ID NO: 4018940 - DNA, 17 bp, Homo sapiens
cctggggctggcctccc

SEQ ID NO: 4018941 - DNA, 14 bp, Homo sapiens
cctggggctgtgca

SEQ ID NO: 4018942 - DNA, 18 bp, Homo sapiens
cctgggggagttttcctc

SEQ ID NO: 4018943 - DNA, 20 bp, Homo sapiens
cctgggggagttttcctcta

SEQ ID NO: 4018944 - DNA, 19 bp, Homo sapiens
cctgggggccttgggtgag

SEQ ID NO: 4018945 - DNA, 15 bp, Homo sapiens
cctgggggctggagc

SEQ ID NO: 4018946 - DNA, 15 bp, Homo sapiens
cctgggggtggcagg

SEQ ID NO: 4018947 - DNA, 17 bp, Homo sapiens
cctgggggtttcacctg

SEQ ID NO: 4018948 - DNA, 21 bp, Homo sapiens
cctgggggtttcacctgggcc

SEQ ID NO: 4018949 - DNA, 20 bp, Homo sapiens
cctggggtcaggccgggcag

SEQ ID NO: 4018950 - DNA, 22 bp, Homo sapiens
cctggggtcaggccgggcagag

SEQ ID NO: 4018951 - DNA, 14 bp, Homo sapiens
cctggggtctggag

SEQ ID NO: 4018952 - DNA, 15 bp, Homo sapiens
cctggggtgcatctc

SEQ ID NO: 4018953 - DNA, 17 bp, Homo sapiens
cctggggtgcatctcct

SEQ ID NO: 4018954 - DNA, 19 bp, Homo sapiens
cctgggtcaaaaaaaagaa

SEQ ID NO: 4018955 - DNA, 15 bp, Homo sapiens
cctgggtcagtctgg

SEQ ID NO: 4018956 - DNA, 15 bp, Homo sapiens
cctgggtctgtgtct

SEQ ID NO: 4018957 - DNA, 15 bp, Homo sapiens
cctgggtgacatttg

SEQ ID NO: 4018958 - DNA, 16 bp, Homo sapiens
cctgggtgctggctgc

SEQ ID NO: 4018959 - DNA, 15 bp, Homo sapiens
cctgggtgggctctg

SEQ ID NO: 4018960 - DNA, 17 bp, Homo sapiens
cctgggtgggctctgtg

SEQ ID NO: 4018961 - DNA, 13 bp, Homo sapiens
cctgggttccctt

SEQ ID NO: 4018962 - DNA, 13 bp, Homo sapiens
cctgggtttcttt

SEQ ID NO: 4018963 - DNA, 21 bp, Homo sapiens
cctgggtttcttttttctttc

SEQ ID NO: 4018964 - DNA, 15 bp, Homo sapiens
cctggtaccctcctg

SEQ ID NO: 4018965 - DNA, 21 bp, Homo sapiens
cctggtccagggaagctggcc

SEQ ID NO: 4018966 - DNA, 22 bp, Homo sapiens
cctggtccagggaagctggccg

SEQ ID NO: 4018967 - DNA, 14 bp, Homo sapiens
cctggtccctggga

SEQ ID NO: 4018968 - DNA, 16 bp, Homo sapiens
cctggtccctgggagg

SEQ ID NO: 4018969 - DNA, 16 bp, Homo sapiens
cctggtcgccttccac

SEQ ID NO: 4018970 - DNA, 21 bp, Homo sapiens
cctggtctgaggatgtagaga

SEQ ID NO: 4018971 - DNA, 13 bp, Homo sapiens
cggaggagaccag

SEQ ID NO: 4018972 - DNA, 16 bp, Homo sapiens
cggaggagctgcctgc

SEQ ID NO: 4018973 - DNA, 20 bp, Homo sapiens
cggaggagggatgctgctcc

SEQ ID NO: 4018974 - DNA, 17 bp, Homo sapiens
cggaggatagtatgagc

SEQ ID NO: 4018975 - DNA, 18 bp, Homo sapiens
cggaggatagtatgagcc

SEQ ID NO: 4018976 - DNA, 18 bp, Homo sapiens
cggaggccccactgatgc

SEQ ID NO: 4018977 - DNA, 13 bp, Homo sapiens
cggaggctgcccc

SEQ ID NO: 4018978 - DNA, 22 bp, Homo sapiens
cggaggctgcccccggccccct

SEQ ID NO: 4018979 - DNA, 22 bp, Homo sapiens
cggaggctgggcccctgggatg

SEQ ID NO: 4018980 - DNA, 14 bp, Homo sapiens
cggaggggagtaga

SEQ ID NO: 4018981 - DNA, 16 bp, Homo sapiens
cggaggggcctggcag

SEQ ID NO: 4018982 - DNA, 21 bp, Homo sapiens
cggagggggacggggctcagc

SEQ ID NO: 4018983 - DNA, 12 bp, Homo sapiens
cggattccagcc

SEQ ID NO: 4018984 - DNA, 17 bp, Homo sapiens
cggcaagcagcgggcta

SEQ ID NO: 4018985 - DNA, 13 bp, Homo sapiens
cggcacagcctgg

SEQ ID NO: 4018986 - DNA, 18 bp, Homo sapiens
cggcacagggtctgctct

SEQ ID NO: 4018987 - DNA, 22 bp, Homo sapiens
cggcagaggaacccccaccaga

SEQ ID NO: 4018988 - DNA, 20 bp, Homo sapiens
cggcaggctcactgccaggc

SEQ ID NO: 4018989 - DNA, 20 bp, Homo sapiens
cggcagggcgggcagagggc

SEQ ID NO: 4018990 - DNA, 23 bp, Homo sapiens
cggcagggcgggcagagggctgg

SEQ ID NO: 4018991 - DNA, 21 bp, Homo sapiens
cggcatgggaaagccacctct

SEQ ID NO: 4018992 - DNA, 21 bp, Homo sapiens
cggccacgcactgggccacgg

SEQ ID NO: 4018993 - DNA, 14 bp, Homo sapiens
cggccagcgggcac

SEQ ID NO: 4018994 - DNA, 17 bp, Homo sapiens
cggccagcgggcacagg

SEQ ID NO: 4018995 - DNA, 23 bp, Homo sapiens
cggccagcgggcacagggcacca

SEQ ID NO: 4018996 - DNA, 17 bp, Homo sapiens
cggccaggcacagggcc

SEQ ID NO: 4018997 - DNA, 20 bp, Homo sapiens
cggccaggcacagggcccgc

SEQ ID NO: 4018998 - DNA, 22 bp, Homo sapiens
cggccatctctttgtacaggaa

SEQ ID NO: 4018999 - DNA, 15 bp, Homo sapiens
cggcccacacccagg

SEQ ID NO: 4019000 - DNA, 12 bp, Homo sapiens
cggcccccagga

SEQ ID NO: 4019001 - DNA, 23 bp, Homo sapiens
cggccccccgcgctcgcccagca

SEQ ID NO: 4019002 - DNA, 15 bp, Homo sapiens
cggccccctggtctc

SEQ ID NO: 4019003 - DNA, 14 bp, Homo sapiens
cggcccctccccct

SEQ ID NO: 4019004 - DNA, 14 bp, Homo sapiens
cggcccggccagcg

SEQ ID NO: 4019005 - DNA, 12 bp, Homo sapiens
cggccctaaggg

SEQ ID NO: 4019006 - DNA, 19 bp, Homo sapiens
cggccctgcagccagctca

SEQ ID NO: 4019007 - DNA, 16 bp, Homo sapiens
cggccggccagcccct

SEQ ID NO: 4019008 - DNA, 13 bp, Homo sapiens
cggccggcctggc

SEQ ID NO: 4019009 - DNA, 20 bp, Homo sapiens
cggcctcccaaagtgctggg

SEQ ID NO: 4019010 - DNA, 17 bp, Homo sapiens
cggcctcctcggagagc

SEQ ID NO: 4019011 - DNA, 18 bp, Homo sapiens
cggcctcctcggagagca

SEQ ID NO: 4019012 - DNA, 14 bp, Homo sapiens
cggcctctctgccc

SEQ ID NO: 4019013 - DNA, 19 bp, Homo sapiens
cggcctctctgccccaccc

SEQ ID NO: 4019014 - DNA, 15 bp, Homo sapiens
cggcctgatgctccc

SEQ ID NO: 4019015 - DNA, 12 bp, Homo sapiens
cggcctggcacc

SEQ ID NO: 4019016 - DNA, 16 bp, Homo sapiens
cggcctggctgcagct

SEQ ID NO: 4019017 - DNA, 15 bp, Homo sapiens
cggcctgtcctccaa

SEQ ID NO: 4019018 - DNA, 22 bp, Homo sapiens
cggcggccaggcacagggcccg

SEQ ID NO: 4019019 - DNA, 16 bp, Homo sapiens
cggctcaggctctgct

SEQ ID NO: 4019020 - DNA, 19 bp, Homo sapiens
cggctcaggctctgctggt

SEQ ID NO: 4019021 - DNA, 17 bp, Homo sapiens
cggctccccatgtgtcc

SEQ ID NO: 4019022 - DNA, 12 bp, Homo sapiens
cggctcctcaga

SEQ ID NO: 4019023 - DNA, 20 bp, Homo sapiens
cggctcggaggaagccccca

SEQ ID NO: 4019024 - DNA, 12 bp, Homo sapiens
cggctgagcctt

SEQ ID NO: 4019025 - DNA, 12 bp, Homo sapiens
cggctgtggagc

SEQ ID NO: 4019026 - DNA, 13 bp, Homo sapiens
cggctgtggagca

SEQ ID NO: 4019027 - DNA, 14 bp, Homo sapiens
cggctgtggagcaa

SEQ ID NO: 4019028 - DNA, 21 bp, Homo sapiens
cggctgttccccctgccgcag

SEQ ID NO: 4019029 - DNA, 19 bp, Homo sapiens
cggcttgtgggctggtgcc

SEQ ID NO: 4019030 - DNA, 16 bp, Homo sapiens
cgggaaggtcaccagc

SEQ ID NO: 4019031 - DNA, 21 bp, Homo sapiens
cgggagaatcatgtgaacccg

SEQ ID NO: 4019032 - DNA, 15 bp, Homo sapiens
cgggagcagtgtctt

SEQ ID NO: 4019033 - DNA, 22 bp, Homo sapiens
cgggagcatctcttgaggccag

SEQ ID NO: 4019034 - DNA, 18 bp, Homo sapiens
cgggagcctccccctcag

SEQ ID NO: 4019035 - DNA, 19 bp, Homo sapiens
cgggagcctccccctcaga

SEQ ID NO: 4019036 - DNA, 13 bp, Homo sapiens
cgggaggaggtgt

SEQ ID NO: 4019037 - DNA, 20 bp, Homo sapiens
cgggaggcagaggttgcagt

SEQ ID NO: 4019038 - DNA, 14 bp, Homo sapiens
cgggaggcagagtt

SEQ ID NO: 4019039 - DNA, 16 bp, Homo sapiens
cgggaggcagagtttg

SEQ ID NO: 4019040 - DNA, 14 bp, Homo sapiens
cgggcacagacacg

SEQ ID NO: 4019041 - DNA, 12 bp, Homo sapiens
cgggcacagggc

SEQ ID NO: 4019042 - DNA, 16 bp, Homo sapiens
cgggcacagggcacca

SEQ ID NO: 4019043 - DNA, 17 bp, Homo sapiens
cgggcacagggcaccag

SEQ ID NO: 4019044 - DNA, 19 bp, Homo sapiens
cgggcacagggcaccagag

SEQ ID NO: 4019045 - DNA, 21 bp, Homo sapiens
ctaaccaagctgagtttccta

SEQ ID NO: 4019046 - DNA, 21 bp, Homo sapiens
ctaaccagggaagctgtccct

SEQ ID NO: 4019047 - DNA, 18 bp, Homo sapiens
ctaaccattaagtcatgt

SEQ ID NO: 4019048 - DNA, 17 bp, Homo sapiens
ctaacctgggttccctt

SEQ ID NO: 4019049 - DNA, 14 bp, Homo sapiens
ctaaccttgaatgc

SEQ ID NO: 4019050 - DNA, 19 bp, Homo sapiens
ctaaccttgaatgctgcca

SEQ ID NO: 4019051 - DNA, 20 bp, Homo sapiens
ctaacgacttcagggcaggg

SEQ ID NO: 4019052 - DNA, 19 bp, Homo sapiens
ctaacgggaggctgggcac

SEQ ID NO: 4019053 - DNA, 15 bp, Homo sapiens
ctaacgtaaatacac

SEQ ID NO: 4019054 - DNA, 20 bp, Homo sapiens
ctaactgctacaaatactct

SEQ ID NO: 4019055 - DNA, 23 bp, Homo sapiens
ctaactttagaagtgcatttctg

SEQ ID NO: 4019056 - DNA, 19 bp, Homo sapiens
ctaacttttcaatgacatt

SEQ ID NO: 4019057 - DNA, 23 bp, Homo sapiens
ctaagaaaagatacgactttatt

SEQ ID NO: 4019058 - DNA, 21 bp, Homo sapiens
ctaagaaaagattttaatcaa

SEQ ID NO: 4019059 - DNA, 16 bp, Homo sapiens
ctaagaaatatgtgag

SEQ ID NO: 4019060 - DNA, 16 bp, Homo sapiens
ctaagaacctggaact

SEQ ID NO: 4019061 - DNA, 13 bp, Homo sapiens
ctaagacatgtga

SEQ ID NO: 4019062 - DNA, 16 bp, Homo sapiens
ctaagagaagttattt

SEQ ID NO: 4019063 - DNA, 19 bp, Homo sapiens
ctaagagaagttattttct

SEQ ID NO: 4019064 - DNA, 16 bp, Homo sapiens
ctaagatagtaacaat

SEQ ID NO: 4019065 - DNA, 13 bp, Homo sapiens
ctaagcaatttct

SEQ ID NO: 4019066 - DNA, 19 bp, Homo sapiens
ctaagcatgtgtcccagga

SEQ ID NO: 4019067 - DNA, 24 bp, Homo sapiens
ctaagcatgtgtcccaggagcagg

SEQ ID NO: 4019068 - DNA, 16 bp, Homo sapiens
ctaagcccccagggcc

SEQ ID NO: 4019069 - DNA, 17 bp, Homo sapiens
ctaagcccccagggcct

SEQ ID NO: 4019070 - DNA, 18 bp, Homo sapiens
ctaagcccccagggcctc

SEQ ID NO: 4019071 - DNA, 12 bp, Homo sapiens
ctaagccctgtc

SEQ ID NO: 4019072 - DNA, 15 bp, Homo sapiens
ctaagctaaccccct

SEQ ID NO: 4019073 - DNA, 21 bp, Homo sapiens
ctaagctattcagtaataact

SEQ ID NO: 4019074 - DNA, 13 bp, Homo sapiens
ctaagctggctct

SEQ ID NO: 4019075 - DNA, 17 bp, Homo sapiens
ctaagctggctctgttt

SEQ ID NO: 4019076 - DNA, 18 bp, Homo sapiens
ctaaggataatgaaataa

SEQ ID NO: 4019077 - DNA, 20 bp, Homo sapiens
ctaaggatctctcaggagca

SEQ ID NO: 4019078 - DNA, 15 bp, Homo sapiens
cctctcgagcccaga

SEQ ID NO: 4019079 - DNA, 15 bp, Homo sapiens
cctctctcagagcat

SEQ ID NO: 4019080 - DNA, 21 bp, Homo sapiens
cctctctcagagcatctggct

SEQ ID NO: 4019081 - DNA, 22 bp, Homo sapiens
cctctctcagagcatctggctg

SEQ ID NO: 4019082 - DNA, 14 bp, Homo sapiens
cctctctcagcaca

SEQ ID NO: 4019083 - DNA, 15 bp, Homo sapiens
cctctctcagcacag

SEQ ID NO: 4019084 - DNA, 20 bp, Homo sapiens
cctctctcagcacagcctgg

SEQ ID NO: 4019085 - DNA, 21 bp, Homo sapiens
cctctctcagcacagcctggg

SEQ ID NO: 4019086 - DNA, 16 bp, Homo sapiens
cctctctcccatttca

SEQ ID NO: 4019087 - DNA, 12 bp, Homo sapiens
cctctctctggg

SEQ ID NO: 4019088 - DNA, 23 bp, Homo sapiens
cctctctctgggcccaggggctg

SEQ ID NO: 4019089 - DNA, 14 bp, Homo sapiens
cctgaaccatgtgg

SEQ ID NO: 4019090 - DNA, 13 bp, Homo sapiens
cctgaagaaccag

SEQ ID NO: 4019091 - DNA, 17 bp, Homo sapiens
cctgaagaaccagtccc

SEQ ID NO: 4019092 - DNA, 18 bp, Homo sapiens
cctgaagaattaagatac

SEQ ID NO: 4019093 - DNA, 15 bp, Homo sapiens
cctgaagactgagga

SEQ ID NO: 4019094 - DNA, 18 bp, Homo sapiens
cctgaagccagctgccct

SEQ ID NO: 4019095 - DNA, 21 bp, Homo sapiens
cctgaaggaacattccttagt

SEQ ID NO: 4019096 - DNA, 22 bp, Homo sapiens
cctgaatcatgagcctgctgga

SEQ ID NO: 4019097 - DNA, 21 bp, Homo sapiens
cctgaatggttccatgcctga

SEQ ID NO: 4019098 - DNA, 19 bp, Homo sapiens
cctgacaagcactgctagg

SEQ ID NO: 4019099 - DNA, 23 bp, Homo sapiens
cctgacacactaaccaagctgag

SEQ ID NO: 4019100 - DNA, 17 bp, Homo sapiens
cctgacactgagcccca

SEQ ID NO: 4019101 - DNA, 21 bp, Homo sapiens
cctgacactgagccccacctc

SEQ ID NO: 4019102 - DNA, 20 bp, Homo sapiens
cctgacagatgtcagccgag

SEQ ID NO: 4019103 - DNA, 13 bp, Homo sapiens
cctgacagccaga

SEQ ID NO: 4019104 - DNA, 20 bp, Homo sapiens
cctgacagccagaactctgt

SEQ ID NO: 4019105 - DNA, 23 bp, Homo sapiens
cctgacaggtgaggtctgttcct

SEQ ID NO: 4019106 - DNA, 13 bp, Homo sapiens
cctgacatcacag

SEQ ID NO: 4019107 - DNA, 17 bp, Homo sapiens
cctgaccccattcctga

SEQ ID NO: 4019108 - DNA, 18 bp, Homo sapiens
cctgaccccattcctgat

SEQ ID NO: 4019109 - DNA, 14 bp, Homo sapiens
cctgaccccttgct

SEQ ID NO: 4019110 - DNA, 16 bp, Homo sapiens
cctgacctcactgtga

SEQ ID NO: 4019111 - DNA, 12 bp, Homo sapiens
cctgacctcttg

SEQ ID NO: 4019112 - DNA, 19 bp, Homo sapiens
cctgacctcttgctgtctc

SEQ ID NO: 4019113 - DNA, 21 bp, Homo sapiens
cctgacctcttgctgtctctg

SEQ ID NO: 4019114 - DNA, 14 bp, Homo sapiens
cctgacctgtgagc

SEQ ID NO: 4019115 - DNA, 20 bp, Homo sapiens
cctgactaatttttgtattt

SEQ ID NO: 4019116 - DNA, 21 bp, Homo sapiens
cctgactcaattatttgcata

SEQ ID NO: 4019117 - DNA, 19 bp, Homo sapiens
cctgactcccccagtcccc

SEQ ID NO: 4019118 - DNA, 15 bp, Homo sapiens
cctgactcctctaag

SEQ ID NO: 4019119 - DNA, 14 bp, Homo sapiens
cctgactcctctgg

SEQ ID NO: 4019120 - DNA, 12 bp, Homo sapiens
cctgactctgcc

SEQ ID NO: 4019121 - DNA, 13 bp, Homo sapiens
cctgactctgccc

SEQ ID NO: 4019122 - DNA, 14 bp, Homo sapiens
cctgactctgcccc

SEQ ID NO: 4019123 - DNA, 15 bp, Homo sapiens
cctgactctgccccc

SEQ ID NO: 4019124 - DNA, 13 bp, Homo sapiens
cctgactggcctg

SEQ ID NO: 4019125 - DNA, 12 bp, Homo sapiens
cctgacttgagt

SEQ ID NO: 4019126 - DNA, 14 bp, Homo sapiens
cctgagaaatgtta

SEQ ID NO: 4019127 - DNA, 22 bp, Homo sapiens
cctgagaagctgctccaggcct

SEQ ID NO: 4019128 - DNA, 22 bp, Homo sapiens
cctgagactgtcggagaggctg

SEQ ID NO: 4019129 - DNA, 18 bp, Homo sapiens
cctgagagaattggctca

SEQ ID NO: 4019130 - DNA, 12 bp, Homo sapiens
cctgagaggcag

SEQ ID NO: 4019131 - DNA, 13 bp, Homo sapiens
cctgagaggcagg

SEQ ID NO: 4019132 - DNA, 17 bp, Homo sapiens
cctgagaggcaggcata

SEQ ID NO: 4019133 - DNA, 15 bp, Homo sapiens
cctgagaggggaagc

SEQ ID NO: 4019134 - DNA, 20 bp, Homo sapiens
cctgagaggggaagcggccc

SEQ ID NO: 4019135 - DNA, 18 bp, Homo sapiens
cctgagatcccctgagcc

SEQ ID NO: 4019136 - DNA, 18 bp, Homo sapiens
cctgagcaactcttgatt

SEQ ID NO: 4019137 - DNA, 13 bp, Homo sapiens
cctgagccaagga

SEQ ID NO: 4019138 - DNA, 14 bp, Homo sapiens
cctgagccagcagg

SEQ ID NO: 4019139 - DNA, 21 bp, Homo sapiens
cctgagccccagggtgcccag

SEQ ID NO: 4019140 - DNA, 18 bp, Homo sapiens
cctgagctattttcctct

SEQ ID NO: 4019141 - DNA, 21 bp, Homo sapiens
cctgagctattttcctctggc

SEQ ID NO: 4019142 - DNA, 13 bp, Homo sapiens
cctgagctgggga

SEQ ID NO: 4019143 - DNA, 16 bp, Homo sapiens
cctgagctggggaagc

SEQ ID NO: 4019144 - DNA, 18 bp, Homo sapiens
cctgaggacatggcttct

SEQ ID NO: 4019145 - DNA, 20 bp, Homo sapiens
cctgaggatgggtcagagct

SEQ ID NO: 4019146 - DNA, 16 bp, Homo sapiens
cctgaggcaaggagtt

SEQ ID NO: 4019147 - DNA, 16 bp, Homo sapiens
cctgaggccctgggct

SEQ ID NO: 4019148 - DNA, 20 bp, Homo sapiens
cctgaggccctgggctgggt

SEQ ID NO: 4019149 - DNA, 20 bp, Homo sapiens
cctgaggcggaggctgtgct

SEQ ID NO: 4019150 - DNA, 22 bp, Homo sapiens
cctgaggggcatctgcccctcc

SEQ ID NO: 4019151 - DNA, 19 bp, Homo sapiens
cctgagggtccccacctgg

SEQ ID NO: 4019152 - DNA, 13 bp, Homo sapiens
cctgagggtggag

SEQ ID NO: 4019153 - DNA, 20 bp, Homo sapiens
cctgaggtgaaagggagcta

SEQ ID NO: 4019154 - DNA, 22 bp, Homo sapiens
cctgaggttaaacggtgcccat

SEQ ID NO: 4019155 - DNA, 21 bp, Homo sapiens
cctgagtagctgggattacag

SEQ ID NO: 4019156 - DNA, 14 bp, Homo sapiens
cctgagtggatctc

SEQ ID NO: 4019157 - DNA, 18 bp, Homo sapiens
cctgagtggatctccaag

SEQ ID NO: 4019158 - DNA, 19 bp, Homo sapiens
cctgagtggatctccaagg

SEQ ID NO: 4019159 - DNA, 20 bp, Homo sapiens
cctgagtggatctccaagga

SEQ ID NO: 4019160 - DNA, 14 bp, Homo sapiens
cctgagttcatcca

SEQ ID NO: 4019161 - DNA, 20 bp, Homo sapiens
cctgagttcatccaggccca

SEQ ID NO: 4019162 - DNA, 18 bp, Homo sapiens
cctgataaagcacagctg

SEQ ID NO: 4019163 - DNA, 13 bp, Homo sapiens
cctgatcctggag

SEQ ID NO: 4019164 - DNA, 15 bp, Homo sapiens
cctgatcctggaggc

SEQ ID NO: 4019165 - DNA, 23 bp, Homo sapiens
cctgatcgccaacctttccccca

SEQ ID NO: 4019166 - DNA, 16 bp, Homo sapiens
cctgatcttgcctgtc

SEQ ID NO: 4019167 - DNA, 21 bp, Homo sapiens
cctgatgacacccaccctgtg

SEQ ID NO: 4019168 - DNA, 22 bp, Homo sapiens
cctgatgacacccaccctgtgc

SEQ ID NO: 4019169 - DNA, 13 bp, Homo sapiens
cctgatgctccct

SEQ ID NO: 4019170 - DNA, 19 bp, Homo sapiens
cctgatgctccctcccctg

SEQ ID NO: 4019171 - DNA, 21 bp, Homo sapiens
cctgatgctgacattcacctg

SEQ ID NO: 4019172 - DNA, 23 bp, Homo sapiens
cctgatgctgacattcacctgcc

SEQ ID NO: 4019173 - DNA, 16 bp, Homo sapiens
cctgatgttaaaattc

SEQ ID NO: 4019174 - DNA, 17 bp, Homo sapiens
cctgattgacctgctcc

SEQ ID NO: 4019175 - DNA, 20 bp, Homo sapiens
cctgattgtgtatattcata

SEQ ID NO: 4019176 - DNA, 19 bp, Homo sapiens
cctgcaaacagaacagggt

SEQ ID NO: 4019177 - DNA, 13 bp, Homo sapiens
cctgcaaggacta

SEQ ID NO: 4019178 - DNA, 17 bp, Homo sapiens
cctgcaagtcagtccag

SEQ ID NO: 4019179 - DNA, 13 bp, Homo sapiens
cctgcaatatttg

SEQ ID NO: 4019180 - DNA, 14 bp, Homo sapiens
cctgcaatgaaagg

SEQ ID NO: 4019181 - DNA, 16 bp, Homo sapiens
cctgcaattctacagt

SEQ ID NO: 4019182 - DNA, 13 bp, Homo sapiens
cctgcacactcca

SEQ ID NO: 4019183 - DNA, 16 bp, Homo sapiens
cctgcagagagaagcc

SEQ ID NO: 4019184 - DNA, 22 bp, Homo sapiens
cctgcagcatggtccctgcctt

SEQ ID NO: 4019185 - DNA, 22 bp, Homo sapiens
cctgcagcccaaaacccagggc

SEQ ID NO: 4019186 - DNA, 10 bp, Homo sapiens
cctgcagctc

SEQ ID NO: 4019187 - DNA, 23 bp, Homo sapiens
cctgcaggagagagcagcactcc

SEQ ID NO: 4019188 - DNA, 16 bp, Homo sapiens
cctgcaggctgagcca

SEQ ID NO: 4019189 - DNA, 19 bp, Homo sapiens
cctgccacagccagaggag

SEQ ID NO: 4019190 - DNA, 14 bp, Homo sapiens
cctgccacctccct

SEQ ID NO: 4019191 - DNA, 12 bp, Homo sapiens
cctgccagctgc

SEQ ID NO: 4019192 - DNA, 14 bp, Homo sapiens
cctgccagctgcac

SEQ ID NO: 4019193 - DNA, 23 bp, Homo sapiens
cctgccagctgcactgatgctgc

SEQ ID NO: 4019194 - DNA, 12 bp, Homo sapiens
cctgccaggcac

SEQ ID NO: 4019195 - DNA, 13 bp, Homo sapiens
cctgccaggcagg

SEQ ID NO: 4019196 - DNA, 15 bp, Homo sapiens
cctgccaggcagggg

SEQ ID NO: 4019197 - DNA, 19 bp, Homo sapiens
cctgccaggcaggggtggg

SEQ ID NO: 4019198 - DNA, 19 bp, Homo sapiens
cctgcccagatcagccaga

SEQ ID NO: 4019199 - DNA, 14 bp, Homo sapiens
cctgcccagcctgg

SEQ ID NO: 4019200 - DNA, 23 bp, Homo sapiens
cctgcccagtgttgtttgtaaat

SEQ ID NO: 4019201 - DNA, 16 bp, Homo sapiens
cctgcccatgccccag

SEQ ID NO: 4019202 - DNA, 17 bp, Homo sapiens
cctgcccatgccccagt

SEQ ID NO: 4019203 - DNA, 20 bp, Homo sapiens
cctgccccaatccctttatt

SEQ ID NO: 4019204 - DNA, 16 bp, Homo sapiens
cctgccccacacggac

SEQ ID NO: 4019205 - DNA, 17 bp, Homo sapiens
cctgccccacacggact

SEQ ID NO: 4019206 - DNA, 15 bp, Homo sapiens
cctgccccacactcc

SEQ ID NO: 4019207 - DNA, 16 bp, Homo sapiens
cctgccccacactccc

SEQ ID NO: 4019208 - DNA, 22 bp, Homo sapiens
cctgccccacactccccgcctt

SEQ ID NO: 4019209 - DNA, 13 bp, Homo sapiens
cctgccccagcgc

SEQ ID NO: 4019210 - DNA, 15 bp, Homo sapiens
cctgcccctctcccg

SEQ ID NO: 4019211 - DNA, 14 bp, Homo sapiens
cctgcccctttcag

SEQ ID NO: 4019212 - DNA, 22 bp, Homo sapiens
cctgcccgggcgcggccagccc

SEQ ID NO: 4019213 - DNA, 15 bp, Homo sapiens
cctgcccgtgccctg

SEQ ID NO: 4019214 - DNA, 16 bp, Homo sapiens
cctgcccgtgccctgg

SEQ ID NO: 4019215 - DNA, 17 bp, Homo sapiens
cctgcccgtgccctggt

SEQ ID NO: 4019216 - DNA, 18 bp, Homo sapiens
cctgccctcaagggtgtg

SEQ ID NO: 4019217 - DNA, 15 bp, Homo sapiens
cctgccctggtccag

SEQ ID NO: 4019218 - DNA, 15 bp, Homo sapiens
cctgccctgtccctg

SEQ ID NO: 4019219 - DNA, 14 bp, Homo sapiens
cctgccgcagacgg

SEQ ID NO: 4019220 - DNA, 19 bp, Homo sapiens
cctgccgcagacgggcaca

SEQ ID NO: 4019221 - DNA, 22 bp, Homo sapiens
cctgccgcagacgggcacagac

SEQ ID NO: 4019222 - DNA, 17 bp, Homo sapiens
cctgcctcagccttcca

SEQ ID NO: 4019223 - DNA, 13 bp, Homo sapiens
cctgcctcccaag

SEQ ID NO: 4019224 - DNA, 14 bp, Homo sapiens
cctgcctcctggga

SEQ ID NO: 4019225 - DNA, 21 bp, Homo sapiens
cctgcctctaatctgagctgc

SEQ ID NO: 4019226 - DNA, 12 bp, Homo sapiens
cctgcctgaggg

SEQ ID NO: 4019227 - DNA, 20 bp, Homo sapiens
cctgcctgagtttccagcct

SEQ ID NO: 4019228 - DNA, 15 bp, Homo sapiens
cctgcctgcagcagg

SEQ ID NO: 4019229 - DNA, 12 bp, Homo sapiens
cctgcctgctgg

SEQ ID NO: 4019230 - DNA, 12 bp, Homo sapiens
cctgcctggagc

SEQ ID NO: 4019231 - DNA, 12 bp, Homo sapiens
cctgcctggcac

SEQ ID NO: 4019232 - DNA, 13 bp, Homo sapiens
cctgcctggccag

SEQ ID NO: 4019233 - DNA, 23 bp, Homo sapiens
cctgcctggccaggcagatctgt

SEQ ID NO: 4019234 - DNA, 15 bp, Homo sapiens
cctgcctggccccca

SEQ ID NO: 4019235 - DNA, 14 bp, Homo sapiens
cctgcctggcccct

SEQ ID NO: 4019236 - DNA, 14 bp, Homo sapiens
cctgcctgtctgcc

SEQ ID NO: 4019237 - DNA, 17 bp, Homo sapiens
cctgccttaggcctacc

SEQ ID NO: 4019238 - DNA, 16 bp, Homo sapiens
cctgccttatcttgca

SEQ ID NO: 4019239 - DNA, 15 bp, Homo sapiens
cctgccttggcctcc

SEQ ID NO: 4019240 - DNA, 20 bp, Homo sapiens
cctgccttggcctcccaaag

SEQ ID NO: 4019241 - DNA, 18 bp, Homo sapiens
cctgcgagacgcacacag

SEQ ID NO: 4019242 - DNA, 15 bp, Homo sapiens
cctgcgcctgtgatg

SEQ ID NO: 4019243 - DNA, 17 bp, Homo sapiens
cctgcgggccaggcact

SEQ ID NO: 4019244 - DNA, 16 bp, Homo sapiens
cctgcgggttttaatt

SEQ ID NO: 4019245 - DNA, 17 bp, Homo sapiens
cctgcggtcaggctggg

SEQ ID NO: 4019246 - DNA, 13 bp, Homo sapiens
cctgcgtgggggc

SEQ ID NO: 4019247 - DNA, 18 bp, Homo sapiens
cctgcgttggtccagagc

SEQ ID NO: 4019248 - DNA, 22 bp, Homo sapiens
cctgcgttttggaagctctgaa

SEQ ID NO: 4019249 - DNA, 16 bp, Homo sapiens
cctgctaaggctcctc

SEQ ID NO: 4019250 - DNA, 18 bp, Homo sapiens
cctgctaaggctcctcct

SEQ ID NO: 4019251 - DNA, 19 bp, Homo sapiens
cctgctacaacttcagcag

SEQ ID NO: 4019252 - DNA, 14 bp, Homo sapiens
cctgctacaggagg

SEQ ID NO: 4019253 - DNA, 22 bp, Homo sapiens
cctgctcaactctacccctgct

SEQ ID NO: 4019254 - DNA, 17 bp, Homo sapiens
cctgctcaccacctgcc

SEQ ID NO: 4019255 - DNA, 23 bp, Homo sapiens
cctgctcattatgccacttcctt

SEQ ID NO: 4019256 - DNA, 13 bp, Homo sapiens
cctgctccaccag

SEQ ID NO: 4019257 - DNA, 16 bp, Homo sapiens
cctgctccaccagcag

SEQ ID NO: 4019258 - DNA, 22 bp, Homo sapiens
cctgctccacgaagccttaagc

SEQ ID NO: 4019259 - DNA, 14 bp, Homo sapiens
cctgctccagacct

SEQ ID NO: 4019260 - DNA, 12 bp, Homo sapiens
cctgctcccagc

SEQ ID NO: 4019261 - DNA, 13 bp, Homo sapiens
cctgctcccagca

SEQ ID NO: 4019262 - DNA, 18 bp, Homo sapiens
cctgctcccagcctgctg

SEQ ID NO: 4019263 - DNA, 19 bp, Homo sapiens
cctgctcccattcctccct

SEQ ID NO: 4019264 - DNA, 22 bp, Homo sapiens
cctgctcccattcctccctccg

SEQ ID NO: 4019265 - DNA, 14 bp, Homo sapiens
cctgctccctccag

SEQ ID NO: 4019266 - DNA, 16 bp, Homo sapiens
cctgctccctccagaa

SEQ ID NO: 4019267 - DNA, 19 bp, Homo sapiens
cctgctccctgctttggct

SEQ ID NO: 4019268 - DNA, 15 bp, Homo sapiens
cctgctccgctgctc

SEQ ID NO: 4019269 - DNA, 21 bp, Homo sapiens
cctgctccgctgctccttggc

SEQ ID NO: 4019270 - DNA, 12 bp, Homo sapiens
cctgctcctcct

SEQ ID NO: 4019271 - DNA, 22 bp, Homo sapiens
cctgctcctcctgccctgtccc

SEQ ID NO: 4019272 - DNA, 15 bp, Homo sapiens
cctgctcctctgcct

SEQ ID NO: 4019273 - DNA, 15 bp, Homo sapiens
cctgctcctgcagca

SEQ ID NO: 4019274 - DNA, 16 bp, Homo sapiens
cctgctctacccatga

SEQ ID NO: 4019275 - DNA, 18 bp, Homo sapiens
cctgctctagtgggacag

SEQ ID NO: 4019276 - DNA, 19 bp, Homo sapiens
cctgctctagtgggacagc

SEQ ID NO: 4019277 - DNA, 23 bp, Homo sapiens
cctgctctttctacatgactggg

SEQ ID NO: 4019278 - DNA, 17 bp, Homo sapiens
cctgctgagagccccca

SEQ ID NO: 4019279 - DNA, 20 bp, Homo sapiens
cctgctgagagcccccacct

SEQ ID NO: 4019280 - DNA, 23 bp, Homo sapiens
cctgctgagatgaggaggggagc

SEQ ID NO: 4019281 - DNA, 14 bp, Homo sapiens
cctgctgcaccctg

SEQ ID NO: 4019282 - DNA, 15 bp, Homo sapiens
cctgctgcaccctgc

SEQ ID NO: 4019283 - DNA, 19 bp, Homo sapiens
cctgctgccagtaccagcc

SEQ ID NO: 4019284 - DNA, 16 bp, Homo sapiens
cctgctgccagtgcag

SEQ ID NO: 4019285 - DNA, 19 bp, Homo sapiens
cctgctgccagtgcagcca

SEQ ID NO: 4019286 - DNA, 22 bp, Homo sapiens
cctgctgccccagctgactgtg

SEQ ID NO: 4019287 - DNA, 17 bp, Homo sapiens
cctgctgcggaggagct

SEQ ID NO: 4019288 - DNA, 22 bp, Homo sapiens
cctgctgcggaggagctgcctg

SEQ ID NO: 4019289 - DNA, 13 bp, Homo sapiens
cctgctggaagcc

SEQ ID NO: 4019290 - DNA, 15 bp, Homo sapiens
cctgctggcacccac

SEQ ID NO: 4019291 - DNA, 23 bp, Homo sapiens
cctgctggcttccagcttcaggc

SEQ ID NO: 4019292 - DNA, 14 bp, Homo sapiens
cctgctgggctccc

SEQ ID NO: 4019293 - DNA, 23 bp, Homo sapiens
cctgctgtgattccactacacct

SEQ ID NO: 4019294 - DNA, 20 bp, Homo sapiens
cctgctgtgccatgctgggc

SEQ ID NO: 4019295 - DNA, 16 bp, Homo sapiens
cctgcttcatgctcag

SEQ ID NO: 4019296 - DNA, 17 bp, Homo sapiens
cctgcttcatgctcagc

SEQ ID NO: 4019297 - DNA, 14 bp, Homo sapiens
cctgcttccaggaa

SEQ ID NO: 4019298 - DNA, 22 bp, Homo sapiens
cctgcttccaggaaactccaca

SEQ ID NO: 4019299 - DNA, 15 bp, Homo sapiens
cctgcttctctgccc

SEQ ID NO: 4019300 - DNA, 16 bp, Homo sapiens
cctgcttgcaggaggc

SEQ ID NO: 4019301 - DNA, 19 bp, Homo sapiens
cctgcttgcaggaggccaa

SEQ ID NO: 4019302 - DNA, 11 bp, Homo sapiens
cctgctttgca

SEQ ID NO: 4019303 - DNA, 12 bp, Homo sapiens
cctgctttgcaa

SEQ ID NO: 4019304 - DNA, 14 bp, Homo sapiens
cctgctttgcatct

SEQ ID NO: 4019305 - DNA, 21 bp, Homo sapiens
cctgctttggctgaggggctt

SEQ ID NO: 4019306 - DNA, 23 bp, Homo sapiens
cctgctttgggctgccctggtgc

SEQ ID NO: 4019307 - DNA, 22 bp, Homo sapiens
cctgctttgtctcctctatcct

SEQ ID NO: 4019308 - DNA, 12 bp, Homo sapiens
cctgcttttctg

SEQ ID NO: 4019309 - DNA, 16 bp, Homo sapiens
cctgcttttctgtcct

SEQ ID NO: 4019310 - DNA, 15 bp, Homo sapiens
cctggaactcctggc

SEQ ID NO: 4019311 - DNA, 16 bp, Homo sapiens
cctggaacttggggag

SEQ ID NO: 4019312 - DNA, 16 bp, Homo sapiens
cctggaagagcccagt

SEQ ID NO: 4019313 - DNA, 22 bp, Homo sapiens
cctggaaggacatccatgttcc

SEQ ID NO: 4019314 - DNA, 18 bp, Homo sapiens
cctggaaggcccagcacc

SEQ ID NO: 4019315 - DNA, 16 bp, Homo sapiens
cctggacacccctgct

SEQ ID NO: 4019316 - DNA, 18 bp, Homo sapiens
cctggacacccctgctct

SEQ ID NO: 4019317 - DNA, 20 bp, Homo sapiens
cctggacatcctcttctgct

SEQ ID NO: 4019318 - DNA, 21 bp, Homo sapiens
cctggacatttgccttgctgg

SEQ ID NO: 4019319 - DNA, 21 bp, Homo sapiens
cctggacctgccctgggccac

SEQ ID NO: 4019320 - DNA, 20 bp, Homo sapiens
cctggacctgcctcctgcct

SEQ ID NO: 4019321 - DNA, 23 bp, Homo sapiens
cctggacctgcctcctgcctgcc

SEQ ID NO: 4019322 - DNA, 13 bp, Homo sapiens
cctggacctggga

SEQ ID NO: 4019323 - DNA, 12 bp, Homo sapiens
cctggactctgc

SEQ ID NO: 4019324 - DNA, 15 bp, Homo sapiens
cctggactctgcccc

SEQ ID NO: 4019325 - DNA, 14 bp, Homo sapiens
cctggactgggagg

SEQ ID NO: 4019326 - DNA, 14 bp, Homo sapiens
cctggactttcctg

SEQ ID NO: 4019327 - DNA, 17 bp, Homo sapiens
cctggactttcctgcaa

SEQ ID NO: 4019328 - DNA, 19 bp, Homo sapiens
cctggactttcctgcaact

SEQ ID NO: 4019329 - DNA, 21 bp, Homo sapiens
cctggactttggttctctcca

SEQ ID NO: 4019330 - DNA, 17 bp, Homo sapiens
cctggagacgtggaacc

SEQ ID NO: 4019331 - DNA, 20 bp, Homo sapiens
cctggagagggtctcgctgt

SEQ ID NO: 4019332 - DNA, 14 bp, Homo sapiens
cctggagcagagga

SEQ ID NO: 4019333 - DNA, 17 bp, Homo sapiens
cctggagcagaggaggg

SEQ ID NO: 4019334 - DNA, 15 bp, Homo sapiens
cctggagcaggagcc

SEQ ID NO: 4019335 - DNA, 23 bp, Homo sapiens
cctggagcaggagccccgccaca

SEQ ID NO: 4019336 - DNA, 20 bp, Homo sapiens
cctggaggaattcagctcag

SEQ ID NO: 4019337 - DNA, 22 bp, Homo sapiens
cctggaggaattcagctcagct

SEQ ID NO: 4019338 - DNA, 14 bp, Homo sapiens
cctggaggcactga

SEQ ID NO: 4019339 - DNA, 12 bp, Homo sapiens
cctggaggccca

SEQ ID NO: 4019340 - DNA, 14 bp, Homo sapiens
cctggagtgcagtt

SEQ ID NO: 4019341 - DNA, 21 bp, Homo sapiens
cctggagtgtggctgaggagg

SEQ ID NO: 4019342 - DNA, 19 bp, Homo sapiens
cctggatcacgacgctgca

SEQ ID NO: 4019343 - DNA, 23 bp, Homo sapiens
cctggatcacgacgctgcagagc

SEQ ID NO: 4019344 - DNA, 16 bp, Homo sapiens
cctggatctaccagca

SEQ ID NO: 4019345 - DNA, 22 bp, Homo sapiens
cctggatctaccagcataaata

SEQ ID NO: 4019346 - DNA, 17 bp, Homo sapiens
cctggatctatccctgc

SEQ ID NO: 4019347 - DNA, 20 bp, Homo sapiens
cctggatgccagctgtgtcc

SEQ ID NO: 4019348 - DNA, 22 bp, Homo sapiens
cctggatgccagctgtgtcctt

SEQ ID NO: 4019349 - DNA, 15 bp, Homo sapiens
cctggattaccaggg

SEQ ID NO: 4019350 - DNA, 17 bp, Homo sapiens
cctggcaaaaatgcaac

SEQ ID NO: 4019351 - DNA, 19 bp, Homo sapiens
cctggcaatagtgtgttct

SEQ ID NO: 4019352 - DNA, 13 bp, Homo sapiens
cctggcactggga

SEQ ID NO: 4019353 - DNA, 22 bp, Homo sapiens
cctggcactgggaggcagggct

SEQ ID NO: 4019354 - DNA, 22 bp, Homo sapiens
cctggcagccgtgccttcagct

SEQ ID NO: 4019355 - DNA, 12 bp, Homo sapiens
cctggcagctct

SEQ ID NO: 4019356 - DNA, 17 bp, Homo sapiens
cctggcagctctggaca

SEQ ID NO: 4019357 - DNA, 19 bp, Homo sapiens
cctggcagctctggacagc

SEQ ID NO: 4019358 - DNA, 21 bp, Homo sapiens
cctggcagctctggacagccc

SEQ ID NO: 4019359 - DNA, 15 bp, Homo sapiens
cctggcaggccagtg

SEQ ID NO: 4019360 - DNA, 13 bp, Homo sapiens
cctggccaccagc

SEQ ID NO: 4019361 - DNA, 21 bp, Homo sapiens
cctggccaccagccatcctcc

SEQ ID NO: 4019362 - DNA, 20 bp, Homo sapiens
cctggccactaaagcttcag

SEQ ID NO: 4019363 - DNA, 13 bp, Homo sapiens
cctggccagacac

SEQ ID NO: 4019364 - DNA, 15 bp, Homo sapiens
cctggccaggaccct

SEQ ID NO: 4019365 - DNA, 13 bp, Homo sapiens
cctggccaggagc

SEQ ID NO: 4019366 - DNA, 22 bp, Homo sapiens
cctggccaggagctcttcaggc

SEQ ID NO: 4019367 - DNA, 14 bp, Homo sapiens
cctggccaggcaga

SEQ ID NO: 4019368 - DNA, 16 bp, Homo sapiens
cctggcccatctcagc

SEQ ID NO: 4019369 - DNA, 19 bp, Homo sapiens
cctggcccatctcagcctc

SEQ ID NO: 4019370 - DNA, 20 bp, Homo sapiens
cctggcccatctcagcctcc

SEQ ID NO: 4019371 - DNA, 22 bp, Homo sapiens
cctggcccatctcagcctcctg

SEQ ID NO: 4019372 - DNA, 17 bp, Homo sapiens
cctggccccagcctggg

SEQ ID NO: 4019373 - DNA, 18 bp, Homo sapiens
cctggccccagcctgggc

SEQ ID NO: 4019374 - DNA, 21 bp, Homo sapiens
cctggccccaggccccagaca

SEQ ID NO: 4019375 - DNA, 22 bp, Homo sapiens
cctggccgccccctgcccccca

SEQ ID NO: 4019376 - DNA, 23 bp, Homo sapiens
cctggcctatccgctgccagcct

SEQ ID NO: 4019377 - DNA, 11 bp, Homo sapiens
cctggcctctg

SEQ ID NO: 4019378 - DNA, 13 bp, Homo sapiens
cctggcctctgtg

SEQ ID NO: 4019379 - DNA, 16 bp, Homo sapiens
cctggcctgagagtca

SEQ ID NO: 4019380 - DNA, 13 bp, Homo sapiens
cctggcctgtctc

SEQ ID NO: 4019381 - DNA, 14 bp, Homo sapiens
cctggccttttgtg

SEQ ID NO: 4019382 - DNA, 22 bp, Homo sapiens
cctcaaggacttgaaagcatcc

SEQ ID NO: 4019383 - DNA, 18 bp, Homo sapiens
cctcaataaacatttcat

SEQ ID NO: 4019384 - DNA, 21 bp, Homo sapiens
cctcacacacacagctgggca

SEQ ID NO: 4019385 - DNA, 22 bp, Homo sapiens
cctcacacacacagctgggcaa

SEQ ID NO: 4019386 - DNA, 12 bp, Homo sapiens
cctcacacccct

SEQ ID NO: 4019387 - DNA, 15 bp, Homo sapiens
cctcacacccctgtc

SEQ ID NO: 4019388 - DNA, 16 bp, Homo sapiens
cctcaccattgtgaag

SEQ ID NO: 4019389 - DNA, 16 bp, Homo sapiens
cctcacccacccctgc

SEQ ID NO: 4019390 - DNA, 21 bp, Homo sapiens
cctcacccacccctgcacagt

SEQ ID NO: 4019391 - DNA, 14 bp, Homo sapiens
cctcacccccagca

SEQ ID NO: 4019392 - DNA, 21 bp, Homo sapiens
cctcacccggcctcttcgcct

SEQ ID NO: 4019393 - DNA, 11 bp, Homo sapiens
cctcaccctgc

SEQ ID NO: 4019394 - DNA, 18 bp, Homo sapiens
cctcaccgagtgggggca

SEQ ID NO: 4019395 - DNA, 19 bp, Homo sapiens
cctcacctcatgcccaccc

SEQ ID NO: 4019396 - DNA, 13 bp, Homo sapiens
cctcacctctcca

SEQ ID NO: 4019397 - DNA, 18 bp, Homo sapiens
cctcacctctccaggtgc

SEQ ID NO: 4019398 - DNA, 19 bp, Homo sapiens
cctcacctctccaggtgct

SEQ ID NO: 4019399 - DNA, 13 bp, Homo sapiens
cctcacctctgga

SEQ ID NO: 4019400 - DNA, 18 bp, Homo sapiens
cctcacctctggactggc

SEQ ID NO: 4019401 - DNA, 20 bp, Homo sapiens
cctcacctctggactggcta

SEQ ID NO: 4019402 - DNA, 15 bp, Homo sapiens
cctcaccttcctgtg

SEQ ID NO: 4019403 - DNA, 20 bp, Homo sapiens
cctcaccttgggctggggga

SEQ ID NO: 4019404 - DNA, 17 bp, Homo sapiens
cctcacgcaggctgagt

SEQ ID NO: 4019405 - DNA, 19 bp, Homo sapiens
cctcactaaaaaggaaact

SEQ ID NO: 4019406 - DNA, 20 bp, Homo sapiens
cctcactatgacactgagca

SEQ ID NO: 4019407 - DNA, 21 bp, Homo sapiens
cctcactatggtatgctggcc

SEQ ID NO: 4019408 - DNA, 16 bp, Homo sapiens
cctcactccacagagt

SEQ ID NO: 4019409 - DNA, 15 bp, Homo sapiens
cctcactccccaggg

SEQ ID NO: 4019410 - DNA, 19 bp, Homo sapiens
cctcactccccagggagct

SEQ ID NO: 4019411 - DNA, 17 bp, Homo sapiens
cctcactctggcctcag

SEQ ID NO: 4019412 - DNA, 14 bp, Homo sapiens
cctcactctgtcag

SEQ ID NO: 4019413 - DNA, 16 bp, Homo sapiens
cctcactctgtcagcc

SEQ ID NO: 4019414 - DNA, 14 bp, Homo sapiens
cctccagaccacca

SEQ ID NO: 4019415 - DNA, 16 bp, Homo sapiens
cctccagaccaccagc

SEQ ID NO: 4019416 - DNA, 17 bp, Homo sapiens
cctccagaccaccagcc

SEQ ID NO: 4019417 - DNA, 18 bp, Homo sapiens
cctccagaccaccagccg

SEQ ID NO: 4019418 - DNA, 14 bp, Homo sapiens
cctccagcccctgt

SEQ ID NO: 4019419 - DNA, 17 bp, Homo sapiens
cctccagcccctgtccc

SEQ ID NO: 4019420 - DNA, 17 bp, Homo sapiens
cctccagcctccctgtc

SEQ ID NO: 4019421 - DNA, 22 bp, Homo sapiens
cctccagcctccctgtctccag

SEQ ID NO: 4019422 - DNA, 16 bp, Homo sapiens
cctccagcctgaacag

SEQ ID NO: 4019423 - DNA, 16 bp, Homo sapiens
cctccagctgcaccag

SEQ ID NO: 4019424 - DNA, 20 bp, Homo sapiens
cctccagctgcaccagagca

SEQ ID NO: 4019425 - DNA, 20 bp, Homo sapiens
cctccaggaagaagcagggg

SEQ ID NO: 4019426 - DNA, 21 bp, Homo sapiens
cctccaggagggaccaccctc

SEQ ID NO: 4019427 - DNA, 16 bp, Homo sapiens
cctccaggcctgcctc

SEQ ID NO: 4019428 - DNA, 18 bp, Homo sapiens
cctccaggcctgcctccc

SEQ ID NO: 4019429 - DNA, 21 bp, Homo sapiens
cctccaggcctgcctcccact

SEQ ID NO: 4019430 - DNA, 13 bp, Homo sapiens
cctccaggcctgt

SEQ ID NO: 4019431 - DNA, 16 bp, Homo sapiens
cctccagggaaggtgg

SEQ ID NO: 4019432 - DNA, 19 bp, Homo sapiens
cctccagggaaggtggcca

SEQ ID NO: 4019433 - DNA, 22 bp, Homo sapiens
cctccagggaaggtggccacag

SEQ ID NO: 4019434 - DNA, 12 bp, Homo sapiens
cctccagggccc

SEQ ID NO: 4019435 - DNA, 14 bp, Homo sapiens
cctccagggccccc

SEQ ID NO: 4019436 - DNA, 22 bp, Homo sapiens
cctccagggctcaacactgtga

SEQ ID NO: 4019437 - DNA, 22 bp, Homo sapiens
cctccagtattgccccctctca

SEQ ID NO: 4019438 - DNA, 16 bp, Homo sapiens
cctccagtgtgggctt

SEQ ID NO: 4019439 - DNA, 16 bp, Homo sapiens
cctccatctttctaca

SEQ ID NO: 4019440 - DNA, 21 bp, Homo sapiens
cctccattaaagtctgaatca

SEQ ID NO: 4019441 - DNA, 22 bp, Homo sapiens
cctccattcatccttccatcca

SEQ ID NO: 4019442 - DNA, 19 bp, Homo sapiens
cctccattggctcccaagt

SEQ ID NO: 4019443 - DNA, 16 bp, Homo sapiens
cctccatttgagaaaa

SEQ ID NO: 4019444 - DNA, 14 bp, Homo sapiens
cctccatttttctc

SEQ ID NO: 4019445 - DNA, 18 bp, Homo sapiens
cctcccaacccagccgtc

SEQ ID NO: 4019446 - DNA, 22 bp, Homo sapiens
cctcccaaggggcccaaattct

SEQ ID NO: 4019447 - DNA, 15 bp, Homo sapiens
cctcccaaggtcctc

SEQ ID NO: 4019448 - DNA, 19 bp, Homo sapiens
cctcccaatttcagactcc

SEQ ID NO: 4019449 - DNA, 12 bp, Homo sapiens
cctcccaccccc

SEQ ID NO: 4019450 - DNA, 17 bp, Homo sapiens
cctcccagaacctcagc

SEQ ID NO: 4019451 - DNA, 23 bp, Homo sapiens
cctcccagcttaaatcctagcag

SEQ ID NO: 4019452 - DNA, 23 bp, Homo sapiens
cctccccaaggccccctgcctgc

SEQ ID NO: 4019453 - DNA, 13 bp, Homo sapiens
cctccccagaatc

SEQ ID NO: 4019454 - DNA, 17 bp, Homo sapiens
cctccccatctgtccag

SEQ ID NO: 4019455 - DNA, 23 bp, Homo sapiens
cctccccatttcccatctgcacc

SEQ ID NO: 4019456 - DNA, 18 bp, Homo sapiens
cctcccccaacccccacc

SEQ ID NO: 4019457 - DNA, 19 bp, Homo sapiens
cctcccccaacccccaccc

SEQ ID NO: 4019458 - DNA, 22 bp, Homo sapiens
cctcccccaacccccaccccac

SEQ ID NO: 4019459 - DNA, 14 bp, Homo sapiens
cctcccccattccc

SEQ ID NO: 4019460 - DNA, 15 bp, Homo sapiens
cctcccccccatgca

SEQ ID NO: 4019461 - DNA, 12 bp, Homo sapiens
cctccccctgag

SEQ ID NO: 4019462 - DNA, 14 bp, Homo sapiens
cctcccccttcccc

SEQ ID NO: 4019463 - DNA, 13 bp, Homo sapiens
cctccccgcccct

SEQ ID NO: 4019464 - DNA, 23 bp, Homo sapiens
cctccccgcccctgtggccctgg

SEQ ID NO: 4019465 - DNA, 17 bp, Homo sapiens
cctccccgtctcattcc

SEQ ID NO: 4019466 - DNA, 19 bp, Homo sapiens
cctcccggcatgggaaagc

SEQ ID NO: 4019467 - DNA, 17 bp, Homo sapiens
cctcccggccctgcctg

SEQ ID NO: 4019468 - DNA, 18 bp, Homo sapiens
cctcccggccctgcctgc

SEQ ID NO: 4019469 - DNA, 20 bp, Homo sapiens
cctccctcactgaaggacct

SEQ ID NO: 4019470 - DNA, 22 bp, Homo sapiens
cctccctcagctctctgggacc

SEQ ID NO: 4019471 - DNA, 13 bp, Homo sapiens
cctccctcccaca

SEQ ID NO: 4019472 - DNA, 23 bp, Homo sapiens
cctccctccggccatactgcctt

SEQ ID NO: 4019473 - DNA, 22 bp, Homo sapiens
cctccctctcagaggcctgctg

SEQ ID NO: 4019474 - DNA, 23 bp, Homo sapiens
cctccctctcagaggcctgctgc

SEQ ID NO: 4019475 - DNA, 21 bp, Homo sapiens
cctccctgactccctgtgggg

SEQ ID NO: 4019476 - DNA, 18 bp, Homo sapiens
cctccctgcccctccctt

SEQ ID NO: 4019477 - DNA, 21 bp, Homo sapiens
cctccctgcccctcccttcaa

SEQ ID NO: 4019478 - DNA, 15 bp, Homo sapiens
cctccctgctgtgcc

SEQ ID NO: 4019479 - DNA, 23 bp, Homo sapiens
cctccctgctgtgccatgctggg

SEQ ID NO: 4019480 - DNA, 20 bp, Homo sapiens
cctccctggagcctccactg

SEQ ID NO: 4019481 - DNA, 13 bp, Homo sapiens
cctccctggagtg

SEQ ID NO: 4019482 - DNA, 16 bp, Homo sapiens
cctccctggctcccat

SEQ ID NO: 4019483 - DNA, 23 bp, Homo sapiens
cctccctgtcaaagctgtcactt

SEQ ID NO: 4019484 - DNA, 17 bp, Homo sapiens
cctcccttacagagcat

SEQ ID NO: 4019485 - DNA, 12 bp, Homo sapiens
cctcccttgctg

SEQ ID NO: 4019486 - DNA, 15 bp, Homo sapiens
ccctgaccttggctg

SEQ ID NO: 4019487 - DNA, 18 bp, Homo sapiens
ccctgactccctgtgggg

SEQ ID NO: 4019488 - DNA, 12 bp, Homo sapiens
ccctgactcctc

SEQ ID NO: 4019489 - DNA, 14 bp, Homo sapiens
ccctgactcctctg

SEQ ID NO: 4019490 - DNA, 18 bp, Homo sapiens
ccctgactcctctggctt

SEQ ID NO: 4019491 - DNA, 15 bp, Homo sapiens
ccctgacttgcttta

SEQ ID NO: 4019492 - DNA, 17 bp, Homo sapiens
ccctgagagtctggtct

SEQ ID NO: 4019493 - DNA, 18 bp, Homo sapiens
ccctgagccccagggtgc

SEQ ID NO: 4019494 - DNA, 21 bp, Homo sapiens
ccctgaggatgggtcagagct

SEQ ID NO: 4019495 - DNA, 14 bp, Homo sapiens
ccctgaggccctgg

SEQ ID NO: 4019496 - DNA, 14 bp, Homo sapiens
ccctgagtgcgggc

SEQ ID NO: 4019497 - DNA, 15 bp, Homo sapiens
ccctgagtgcgggct

SEQ ID NO: 4019498 - DNA, 15 bp, Homo sapiens
ccctgatcccttcca

SEQ ID NO: 4019499 - DNA, 20 bp, Homo sapiens
ccctgatgtgtcctcaggga

SEQ ID NO: 4019500 - DNA, 19 bp, Homo sapiens
ccctgattgacctgctccg

SEQ ID NO: 4019501 - DNA, 21 bp, Homo sapiens
ccctgatttaggagaagccag

SEQ ID NO: 4019502 - DNA, 23 bp, Homo sapiens
ccctgatttaggagaagccagga

SEQ ID NO: 4019503 - DNA, 19 bp, Homo sapiens
ccctgcacagatatttcca

SEQ ID NO: 4019504 - DNA, 20 bp, Homo sapiens
ccctgcacagatatttccat

SEQ ID NO: 4019505 - DNA, 14 bp, Homo sapiens
ccctgcacccttgt

SEQ ID NO: 4019506 - DNA, 13 bp, Homo sapiens
ccctgcacgtcat

SEQ ID NO: 4019507 - DNA, 15 bp, Homo sapiens
ccctgcacgtcatgg

SEQ ID NO: 4019508 - DNA, 22 bp, Homo sapiens
ccctgcactttcctccacctcc

SEQ ID NO: 4019509 - DNA, 14 bp, Homo sapiens
ccctgcagcccaaa

SEQ ID NO: 4019510 - DNA, 13 bp, Homo sapiens
ccctgcagcccac

SEQ ID NO: 4019511 - DNA, 21 bp, Homo sapiens
ccctgcagctctcatgctgcc

SEQ ID NO: 4019512 - DNA, 14 bp, Homo sapiens
ccctgccacagcca

SEQ ID NO: 4019513 - DNA, 17 bp, Homo sapiens
ccctgccacatacaggt

SEQ ID NO: 4019514 - DNA, 18 bp, Homo sapiens
ccctgccacatacaggtg

SEQ ID NO: 4019515 - DNA, 14 bp, Homo sapiens
ccctgcccaagggc

SEQ ID NO: 4019516 - DNA, 21 bp, Homo sapiens
ccctgccccccagcctctggc

SEQ ID NO: 4019517 - DNA, 23 bp, Homo sapiens
ccctgcccctcccttcaaccatt

SEQ ID NO: 4019518 - DNA, 14 bp, Homo sapiens
ccctgccctggtcc

SEQ ID NO: 4019519 - DNA, 17 bp, Homo sapiens
ccctgcctggcccccaa

SEQ ID NO: 4019520 - DNA, 22 bp, Homo sapiens
ccctgccttatcttgcacccca

SEQ ID NO: 4019521 - DNA, 17 bp, Homo sapiens
ccctgcgcctccagagg

SEQ ID NO: 4019522 - DNA, 22 bp, Homo sapiens
ccctgcgcctgtgatgctgggc

SEQ ID NO: 4019523 - DNA, 20 bp, Homo sapiens
ccctgcggcctccacacctg

SEQ ID NO: 4019524 - DNA, 21 bp, Homo sapiens
ccctgcggtcaggctgggcag

SEQ ID NO: 4019525 - DNA, 14 bp, Homo sapiens
ccctgctccaccag

SEQ ID NO: 4019526 - DNA, 18 bp, Homo sapiens
ccctgctccaccagcagc

SEQ ID NO: 4019527 - DNA, 11 bp, Homo sapiens
ccctgctccct

SEQ ID NO: 4019528 - DNA, 15 bp, Homo sapiens
ccctgctcctgcagc

SEQ ID NO: 4019529 - DNA, 16 bp, Homo sapiens
ccctgctcctgcagca

SEQ ID NO: 4019530 - DNA, 18 bp, Homo sapiens
ccctgctcctgcagcatg

SEQ ID NO: 4019531 - DNA, 19 bp, Homo sapiens
ccctgctctacccatgagc

SEQ ID NO: 4019532 - DNA, 23 bp, Homo sapiens
ccctgctctacccatgagcctgc

SEQ ID NO: 4019533 - DNA, 11 bp, Homo sapiens
ccctgctgccc

SEQ ID NO: 4019534 - DNA, 15 bp, Homo sapiens
ccctgctggctcttc

SEQ ID NO: 4019535 - DNA, 20 bp, Homo sapiens
ccctgctgtcattgcttctt

SEQ ID NO: 4019536 - DNA, 13 bp, Homo sapiens
ccctgctgtgcca

SEQ ID NO: 4019537 - DNA, 21 bp, Homo sapiens
ccctgctgtgccatgctgggc

SEQ ID NO: 4019538 - DNA, 14 bp, Homo sapiens
ccctgcttccagga

SEQ ID NO: 4019539 - DNA, 15 bp, Homo sapiens
ccctgcttccaggaa

SEQ ID NO: 4019540 - DNA, 13 bp, Homo sapiens
ccctgctttgcaa

SEQ ID NO: 4019541 - DNA, 14 bp, Homo sapiens
ccctgctttgcaaa

SEQ ID NO: 4019542 - DNA, 16 bp, Homo sapiens
cctagaattttctccc

SEQ ID NO: 4019543 - DNA, 19 bp, Homo sapiens
cctagactgtaaacctctc

SEQ ID NO: 4019544 - DNA, 21 bp, Homo sapiens
cctagacttcccaacagcctt

SEQ ID NO: 4019545 - DNA, 20 bp, Homo sapiens
cctagagaacgcagccctag

SEQ ID NO: 4019546 - DNA, 14 bp, Homo sapiens
cctagagcctgcct

SEQ ID NO: 4019547 - DNA, 18 bp, Homo sapiens
cctagagcctgcctggag

SEQ ID NO: 4019548 - DNA, 19 bp, Homo sapiens
cctagagcctgcctggagc

SEQ ID NO: 4019549 - DNA, 23 bp, Homo sapiens
cctagcagcaccgttctgtgcac

SEQ ID NO: 4019550 - DNA, 13 bp, Homo sapiens
cctagcaggctgt

SEQ ID NO: 4019551 - DNA, 17 bp, Homo sapiens
cctagcaggctgttcca

SEQ ID NO: 4019552 - DNA, 14 bp, Homo sapiens
cctagccaccagtg

SEQ ID NO: 4019553 - DNA, 16 bp, Homo sapiens
cctagcccttccctga

SEQ ID NO: 4019554 - DNA, 16 bp, Homo sapiens
cctagcggagcccagc

SEQ ID NO: 4019555 - DNA, 18 bp, Homo sapiens
cctagcggagcccagcct

SEQ ID NO: 4019556 - DNA, 20 bp, Homo sapiens
cctagcggagcccagcctgg

SEQ ID NO: 4019557 - DNA, 14 bp, Homo sapiens
cctagctgaccccg

SEQ ID NO: 4019558 - DNA, 17 bp, Homo sapiens
cctagctgtgttattcc

SEQ ID NO: 4019559 - DNA, 22 bp, Homo sapiens
cctaggaaactcacactcccct

SEQ ID NO: 4019560 - DNA, 14 bp, Homo sapiens
cctaggcccaggcc

SEQ ID NO: 4019561 - DNA, 16 bp, Homo sapiens
cctaggcccaggcctg

SEQ ID NO: 4019562 - DNA, 18 bp, Homo sapiens
cctaggggaacagaccag

SEQ ID NO: 4019563 - DNA, 19 bp, Homo sapiens
cctaggggaacagaccagt

SEQ ID NO: 4019564 - DNA, 21 bp, Homo sapiens
cctagggtcttgggggtcagg

SEQ ID NO: 4019565 - DNA, 23 bp, Homo sapiens
cctaggtagccccctcttccctg

SEQ ID NO: 4019566 - DNA, 15 bp, Homo sapiens
cctaggtccaagccc

SEQ ID NO: 4019567 - DNA, 20 bp, Homo sapiens
cctagtagctgggatgacag

SEQ ID NO: 4019568 - DNA, 16 bp, Homo sapiens
cctagtcccttcccct

SEQ ID NO: 4019569 - DNA, 17 bp, Homo sapiens
cctagtggatgactgtt

SEQ ID NO: 4019570 - DNA, 18 bp, Homo sapiens
cctagtggatgactgttg

SEQ ID NO: 4019571 - DNA, 20 bp, Homo sapiens
cctagtggatgactgttgat

SEQ ID NO: 4019572 - DNA, 21 bp, Homo sapiens
cctagttcatccaatcctcac

SEQ ID NO: 4019573 - DNA, 21 bp, Homo sapiens
cctagttcatcccttctcttc

SEQ ID NO: 4019574 - DNA, 21 bp, Homo sapiens
cctagttccctctgctcagcc

SEQ ID NO: 4019575 - DNA, 22 bp, Homo sapiens
cctagttccctctgctcagcca

SEQ ID NO: 4019576 - DNA, 14 bp, Homo sapiens
cctagtttccctga

SEQ ID NO: 4019577 - DNA, 14 bp, Homo sapiens
cctataagaggaat

SEQ ID NO: 4019578 - DNA, 22 bp, Homo sapiens
cctatattatcataagaatttt

SEQ ID NO: 4019579 - DNA, 13 bp, Homo sapiens
cctatcatttatt

SEQ ID NO: 4019580 - DNA, 16 bp, Homo sapiens
cctatcctaaataaaa

SEQ ID NO: 4019581 - DNA, 22 bp, Homo sapiens
cctatcgccccctacgcgcctt

SEQ ID NO: 4019582 - DNA, 17 bp, Homo sapiens
cctatctattaaagtga

SEQ ID NO: 4019583 - DNA, 20 bp, Homo sapiens
cctatctattaaagtgactt

SEQ ID NO: 4019584 - DNA, 22 bp, Homo sapiens
cctatctattaaagtgactttc

SEQ ID NO: 4019585 - DNA, 20 bp, Homo sapiens
cctatctccttcccacccct

SEQ ID NO: 4019586 - DNA, 21 bp, Homo sapiens
cctatctccttcccaccccta

SEQ ID NO: 4019587 - DNA, 16 bp, Homo sapiens
cctatctcgtgggaga

SEQ ID NO: 4019588 - DNA, 15 bp, Homo sapiens
cctatgcccaggtac

SEQ ID NO: 4019589 - DNA, 17 bp, Homo sapiens
cctatggaagtggttct

SEQ ID NO: 4019590 - DNA, 21 bp, Homo sapiens
cctatggaagtggttctatgt

SEQ ID NO: 4019591 - DNA, 19 bp, Homo sapiens
cctatgtcctaaggacaca

SEQ ID NO: 4019592 - DNA, 22 bp, Homo sapiens
cctatgtcctaaggacacacta

SEQ ID NO: 4019593 - DNA, 24 bp, Homo sapiens
cctatgtcctaaggacacactaat

SEQ ID NO: 4019594 - DNA, 17 bp, Homo sapiens
cctattaaaacacagct

SEQ ID NO: 4019595 - DNA, 13 bp, Homo sapiens
cctattgtcatta

SEQ ID NO: 4019596 - DNA, 16 bp, Homo sapiens
cctatttacctgcagg

SEQ ID NO: 4019597 - DNA, 16 bp, Homo sapiens
cctatttccagaaata

SEQ ID NO: 4019598 - DNA, 22 bp, Homo sapiens
cctcaaattttttgactttttt

SEQ ID NO: 4019599 - DNA, 17 bp, Homo sapiens
cctcaacaagggagaga

SEQ ID NO: 4019600 - DNA, 18 bp, Homo sapiens
cctcaacaagggagagac

SEQ ID NO: 4019601 - DNA, 19 bp, Homo sapiens
cctcaacagccaagtgtga

SEQ ID NO: 4019602 - DNA, 14 bp, Homo sapiens
cctcaacaggccca

SEQ ID NO: 4019603 - DNA, 17 bp, Homo sapiens
cctcaacaggcccaggg

SEQ ID NO: 4019604 - DNA, 22 bp, Homo sapiens
cctcaacaggcccagggaggga

SEQ ID NO: 4019605 - DNA, 18 bp, Homo sapiens
cctcaacgtattgtttcg

SEQ ID NO: 4019606 - DNA, 17 bp, Homo sapiens
cctcaagatgaaggcaa

SEQ ID NO: 4019607 - DNA, 13 bp, Homo sapiens
cctcaagcaatcc

SEQ ID NO: 4019608 - DNA, 12 bp, Homo sapiens
cctcaagccatc

SEQ ID NO: 4019609 - DNA, 13 bp, Homo sapiens
cctcaagccccag

SEQ ID NO: 4019610 - DNA, 13 bp, Homo sapiens
cctcaaggacttg

SEQ ID NO: 4019611 - DNA, 19 bp, Homo sapiens
cctcctcttcaccaggtgc

SEQ ID NO: 4019612 - DNA, 14 bp, Homo sapiens
cctcctgagcctgt

SEQ ID NO: 4019613 - DNA, 17 bp, Homo sapiens
cctcctgagcctgtggg

SEQ ID NO: 4019614 - DNA, 15 bp, Homo sapiens
cctcctgcctcagcc

SEQ ID NO: 4019615 - DNA, 21 bp, Homo sapiens
cctcctggaaccttgctgtcc

SEQ ID NO: 4019616 - DNA, 12 bp, Homo sapiens
cctcctggccag

SEQ ID NO: 4019617 - DNA, 16 bp, Homo sapiens
cctcctggccagacgc

SEQ ID NO: 4019618 - DNA, 22 bp, Homo sapiens
cctcctggccagacgctgccgc

SEQ ID NO: 4019619 - DNA, 22 bp, Homo sapiens
cctcctgtaaatggtgtacata

SEQ ID NO: 4019620 - DNA, 20 bp, Homo sapiens
cctcctgtgcctggccccag

SEQ ID NO: 4019621 - DNA, 23 bp, Homo sapiens
cctcctgtgcctggccccagcct

SEQ ID NO: 4019622 - DNA, 17 bp, Homo sapiens
cctcctgtggcctgcca

SEQ ID NO: 4019623 - DNA, 18 bp, Homo sapiens
cctcctgtggcctgccag

SEQ ID NO: 4019624 - DNA, 15 bp, Homo sapiens
cctccttcagacacc

SEQ ID NO: 4019625 - DNA, 14 bp, Homo sapiens
cctccttccctcac

SEQ ID NO: 4019626 - DNA, 21 bp, Homo sapiens
cctccttgggtcattgacctc

SEQ ID NO: 4019627 - DNA, 16 bp, Homo sapiens
cctccttgtccaccca

SEQ ID NO: 4019628 - DNA, 13 bp, Homo sapiens
cctcctttatcac

SEQ ID NO: 4019629 - DNA, 21 bp, Homo sapiens
cctcctttttccatgccctaa

SEQ ID NO: 4019630 - DNA, 16 bp, Homo sapiens
cctcgaactcctggca

SEQ ID NO: 4019631 - DNA, 16 bp, Homo sapiens
cctcgacagcgcccct

SEQ ID NO: 4019632 - DNA, 17 bp, Homo sapiens
cctcgacagcgcccctg

SEQ ID NO: 4019633 - DNA, 19 bp, Homo sapiens
cctcgacagcgcccctgct

SEQ ID NO: 4019634 - DNA, 20 bp, Homo sapiens
cctcgacagcgcccctgctg

SEQ ID NO: 4019635 - DNA, 17 bp, Homo sapiens
cctcgacagggcctgga

SEQ ID NO: 4019636 - DNA, 19 bp, Homo sapiens
cctcgacagggcctggagc

SEQ ID NO: 4019637 - DNA, 21 bp, Homo sapiens
cctcgcaggcctccctgccag

SEQ ID NO: 4019638 - DNA, 22 bp, Homo sapiens
cctcgcaggcctccctgccagt

SEQ ID NO: 4019639 - DNA, 23 bp, Homo sapiens
cctcgcaggcctccctgccagta

SEQ ID NO: 4019640 - DNA, 13 bp, Homo sapiens
cctcgcctgtgga

SEQ ID NO: 4019641 - DNA, 21 bp, Homo sapiens
cctcgcctgtggagctcagcc

SEQ ID NO: 4019642 - DNA, 15 bp, Homo sapiens
cctcgctcaccgctg

SEQ ID NO: 4019643 - DNA, 20 bp, Homo sapiens
cctcgctcaccgctggccct

SEQ ID NO: 4019644 - DNA, 14 bp, Homo sapiens
cctcgcttctttca

SEQ ID NO: 4019645 - DNA, 15 bp, Homo sapiens
cctcggatcagctga

SEQ ID NO: 4019646 - DNA, 17 bp, Homo sapiens
cctcggatcagctgagc

SEQ ID NO: 4019647 - DNA, 20 bp, Homo sapiens
cctcggatcagctgagcctt

SEQ ID NO: 4019648 - DNA, 13 bp, Homo sapiens
cctcgggaagcag

SEQ ID NO: 4019649 - DNA, 17 bp, Homo sapiens
cctcgggaagcagccag

SEQ ID NO: 4019650 - DNA, 19 bp, Homo sapiens
cctcgggaagcagccagct

SEQ ID NO: 4019651 - DNA, 18 bp, Homo sapiens
cctcgtccaccccccaca

SEQ ID NO: 4019652 - DNA, 17 bp, Homo sapiens
cctcgtccctccctcac

SEQ ID NO: 4019653 - DNA, 13 bp, Homo sapiens
cctctaaagcaga

SEQ ID NO: 4019654 - DNA, 16 bp, Homo sapiens
cctctaaagcagaggc

SEQ ID NO: 4019655 - DNA, 19 bp, Homo sapiens
cctctaaggttgggcaggg

SEQ ID NO: 4019656 - DNA, 16 bp, Homo sapiens
cctctaatctgagctg

SEQ ID NO: 4019657 - DNA, 15 bp, Homo sapiens
cctctagaagccaag

SEQ ID NO: 4019658 - DNA, 14 bp, Homo sapiens
cctctagaggcaag

SEQ ID NO: 4019659 - DNA, 17 bp, Homo sapiens
cctctagccctgcccgg

SEQ ID NO: 4019660 - DNA, 18 bp, Homo sapiens
cctctagccctgcccgga

SEQ ID NO: 4019661 - DNA, 20 bp, Homo sapiens
cctctagttccagaaggatc

SEQ ID NO: 4019662 - DNA, 13 bp, Homo sapiens
cctctatacatct

SEQ ID NO: 4019663 - DNA, 15 bp, Homo sapiens
cctctatacatctct

SEQ ID NO: 4019664 - DNA, 18 bp, Homo sapiens
cctctatacatctctccc

SEQ ID NO: 4019665 - DNA, 19 bp, Homo sapiens
cctctatacatctctcccc

SEQ ID NO: 4019666 - DNA, 20 bp, Homo sapiens
cctctcaagctagtgtttct

SEQ ID NO: 4019667 - DNA, 13 bp, Homo sapiens
cctctcagctcca

SEQ ID NO: 4019668 - DNA, 18 bp, Homo sapiens
cctctcagctccaggtgg

SEQ ID NO: 4019669 - DNA, 12 bp, Homo sapiens
cctctcagggcc

SEQ ID NO: 4019670 - DNA, 19 bp, Homo sapiens
cctctcagggcctggcagg

SEQ ID NO: 4019671 - DNA, 20 bp, Homo sapiens
cctctcagggcctggcaggc

SEQ ID NO: 4019672 - DNA, 13 bp, Homo sapiens
cctctcagtgttt

SEQ ID NO: 4019673 - DNA, 12 bp, Homo sapiens
cctctccactgc

SEQ ID NO: 4019674 - DNA, 16 bp, Homo sapiens
cctctccactgccttc

SEQ ID NO: 4019675 - DNA, 13 bp, Homo sapiens
cctctccaggtgc

SEQ ID NO: 4019676 - DNA, 14 bp, Homo sapiens
cctctccaggtgct

SEQ ID NO: 4019677 - DNA, 17 bp, Homo sapiens
cctctccaggtgctcat

SEQ ID NO: 4019678 - DNA, 20 bp, Homo sapiens
cctctccagtttgcacctgt

SEQ ID NO: 4019679 - DNA, 12 bp, Homo sapiens
cctctcccatca

SEQ ID NO: 4019680 - DNA, 18 bp, Homo sapiens
cctctccccagcccagag

SEQ ID NO: 4019681 - DNA, 17 bp, Homo sapiens
cctctccccctcctcca

SEQ ID NO: 4019682 - DNA, 13 bp, Homo sapiens
cctctcccctcca

SEQ ID NO: 4019683 - DNA, 15 bp, Homo sapiens
cctctcccctccagc

SEQ ID NO: 4019684 - DNA, 16 bp, Homo sapiens
cctctcccctccagcc

SEQ ID NO: 4019685 - DNA, 17 bp, Homo sapiens
cctctccctcaacaagg

SEQ ID NO: 4019686 - DNA, 15 bp, Homo sapiens
cctctcctgccctgt

SEQ ID NO: 4019687 - DNA, 14 bp, Homo sapiens
cctctcctggagga

SEQ ID NO: 4019688 - DNA, 21 bp, Homo sapiens
cccctgggcttggcctgctgt

SEQ ID NO: 4019689 - DNA, 14 bp, Homo sapiens
cccctggggcccag

SEQ ID NO: 4019690 - DNA, 13 bp, Homo sapiens
cccctggggtggc

SEQ ID NO: 4019691 - DNA, 20 bp, Homo sapiens
cccctggggtggccaccagt

SEQ ID NO: 4019692 - DNA, 21 bp, Homo sapiens
cccctgggtcagtctggtggg

SEQ ID NO: 4019693 - DNA, 15 bp, Homo sapiens
cccctgggtttcttt

SEQ ID NO: 4019694 - DNA, 14 bp, Homo sapiens
cccctgtactccag

SEQ ID NO: 4019695 - DNA, 12 bp, Homo sapiens
cccctgtgcata

SEQ ID NO: 4019696 - DNA, 20 bp, Homo sapiens
cccctgtgtattcaccacca

SEQ ID NO: 4019697 - DNA, 13 bp, Homo sapiens
cccctgttctaag

SEQ ID NO: 4019698 - DNA, 23 bp, Homo sapiens
ccccttaaacacaggctgtcctt

SEQ ID NO: 4019699 - DNA, 17 bp, Homo sapiens
ccccttccatttctgcc

SEQ ID NO: 4019700 - DNA, 11 bp, Homo sapiens
ccccttcccat

SEQ ID NO: 4019701 - DNA, 12 bp, Homo sapiens
ccccttccccct

SEQ ID NO: 4019702 - DNA, 16 bp, Homo sapiens
ccccttccccttctgt

SEQ ID NO: 4019703 - DNA, 10 bp, Homo sapiens
ccccttccct

SEQ ID NO: 4019704 - DNA, 10 bp, Homo sapiens
ccccttcctg

SEQ ID NO: 4019705 - DNA, 14 bp, Homo sapiens
ccccttgccacccc

SEQ ID NO: 4019706 - DNA, 14 bp, Homo sapiens
ccccttggctggat

SEQ ID NO: 4019707 - DNA, 18 bp, Homo sapiens
ccccttgtcctttccctt

SEQ ID NO: 4019708 - DNA, 19 bp, Homo sapiens
cccctttactcgtgcatta

SEQ ID NO: 4019709 - DNA, 23 bp, Homo sapiens
cccctttcctggacactcagacc

SEQ ID NO: 4019710 - DNA, 14 bp, Homo sapiens
cccctttcttcctc

SEQ ID NO: 4019711 - DNA, 22 bp, Homo sapiens
ccccttttcagctgagccctgg

SEQ ID NO: 4019712 - DNA, 23 bp, Homo sapiens
ccccttttcagctgagccctggg

SEQ ID NO: 4019713 - DNA, 17 bp, Homo sapiens
cccgaggggagggcagg

SEQ ID NO: 4019714 - DNA, 20 bp, Homo sapiens
cccgaggggccggggaagct

SEQ ID NO: 4019715 - DNA, 21 bp, Homo sapiens
cccgagtcattcgttctgtgg

SEQ ID NO: 4019716 - DNA, 15 bp, Homo sapiens
cccgatcgccagcaa

SEQ ID NO: 4019717 - DNA, 20 bp, Homo sapiens
cccgcagtgctgggaccaga

SEQ ID NO: 4019718 - DNA, 15 bp, Homo sapiens
cccgccacctcaggg

SEQ ID NO: 4019719 - DNA, 12 bp, Homo sapiens
cccgccagggct

SEQ ID NO: 4019720 - DNA, 16 bp, Homo sapiens
cccgccagggctgggg

SEQ ID NO: 4019721 - DNA, 13 bp, Homo sapiens
cccgccccagagt

SEQ ID NO: 4019722 - DNA, 15 bp, Homo sapiens
cccgcccctgtggcc

SEQ ID NO: 4019723 - DNA, 20 bp, Homo sapiens
cccgcccctgtggccctggc

SEQ ID NO: 4019724 - DNA, 13 bp, Homo sapiens
cccgcctccctct

SEQ ID NO: 4019725 - DNA, 20 bp, Homo sapiens
cccgcctttagttctccact

SEQ ID NO: 4019726 - DNA, 16 bp, Homo sapiens
cccgcgcaccccacgc

SEQ ID NO: 4019727 - DNA, 17 bp, Homo sapiens
cccgcgctcgcccagca

SEQ ID NO: 4019728 - DNA, 19 bp, Homo sapiens
cccgcgctcgcccagcagg

SEQ ID NO: 4019729 - DNA, 13 bp, Homo sapiens
cccgctcagccct

SEQ ID NO: 4019730 - DNA, 15 bp, Homo sapiens
cccgctcagccctcc

SEQ ID NO: 4019731 - DNA, 14 bp, Homo sapiens
cccgctcccaggtt

SEQ ID NO: 4019732 - DNA, 16 bp, Homo sapiens
cccgctcctgccgcag

SEQ ID NO: 4019733 - DNA, 18 bp, Homo sapiens
cccgctcctgccgcagac

SEQ ID NO: 4019734 - DNA, 19 bp, Homo sapiens
cccgctcctgccgcagacg

SEQ ID NO: 4019735 - DNA, 18 bp, Homo sapiens
cccgctgagctgagtggc

SEQ ID NO: 4019736 - DNA, 20 bp, Homo sapiens
cccgctgcaatgcctagact

SEQ ID NO: 4019737 - DNA, 12 bp, Homo sapiens
cccgctgctgct

SEQ ID NO: 4019738 - DNA, 16 bp, Homo sapiens
cccgctgctgctgctg

SEQ ID NO: 4019739 - DNA, 20 bp, Homo sapiens
cccgctttcttgctggttgt

SEQ ID NO: 4019740 - DNA, 19 bp, Homo sapiens
cccggaattccgtcaccac

SEQ ID NO: 4019741 - DNA, 12 bp, Homo sapiens
cccggcagggcg

SEQ ID NO: 4019742 - DNA, 21 bp, Homo sapiens
cccggcagggcgggcagaggg

SEQ ID NO: 4019743 - DNA, 17 bp, Homo sapiens
cccggcatgggaaagcc

SEQ ID NO: 4019744 - DNA, 18 bp, Homo sapiens
cccggccagcgggcacag

SEQ ID NO: 4019745 - DNA, 21 bp, Homo sapiens
cccggccagcgggcacagggc

SEQ ID NO: 4019746 - DNA, 22 bp, Homo sapiens
cccggccagcgggcacagggca

SEQ ID NO: 4019747 - DNA, 13 bp, Homo sapiens
cccggccccctgg

SEQ ID NO: 4019748 - DNA, 13 bp, Homo sapiens
cccggcctctctg

SEQ ID NO: 4019749 - DNA, 14 bp, Homo sapiens
cccggcctctctgc

SEQ ID NO: 4019750 - DNA, 17 bp, Homo sapiens
cccggcctgctcccagc

SEQ ID NO: 4019751 - DNA, 20 bp, Homo sapiens
cccggcctgctcccagcagc

SEQ ID NO: 4019752 - DNA, 14 bp, Homo sapiens
ccctggtgctgcca

SEQ ID NO: 4019753 - DNA, 21 bp, Homo sapiens
ccctggtgctgccacacttca

SEQ ID NO: 4019754 - DNA, 16 bp, Homo sapiens
ccctggtgggccaaca

SEQ ID NO: 4019755 - DNA, 15 bp, Homo sapiens
ccctgtacagtgtta

SEQ ID NO: 4019756 - DNA, 17 bp, Homo sapiens
ccctgtacctcatccca

SEQ ID NO: 4019757 - DNA, 19 bp, Homo sapiens
ccctgtagactagtgccgt

SEQ ID NO: 4019758 - DNA, 14 bp, Homo sapiens
ccctgtcaggaggc

SEQ ID NO: 4019759 - DNA, 22 bp, Homo sapiens
ccctgtccaaaagcgccctcac

SEQ ID NO: 4019760 - DNA, 23 bp, Homo sapiens
ccctgtccaaaagcgccctcact

SEQ ID NO: 4019761 - DNA, 19 bp, Homo sapiens
ccctgtcccacccacacag

SEQ ID NO: 4019762 - DNA, 22 bp, Homo sapiens
ccctgtcccacccacacagctg

SEQ ID NO: 4019763 - DNA, 15 bp, Homo sapiens
ccctgtcccaccccc

SEQ ID NO: 4019764 - DNA, 15 bp, Homo sapiens
ccctgtcccaggccg

SEQ ID NO: 4019765 - DNA, 16 bp, Homo sapiens
ccctgtcccaggccgg

SEQ ID NO: 4019766 - DNA, 21 bp, Homo sapiens
ccctgtcccaggccggcccag

SEQ ID NO: 4019767 - DNA, 15 bp, Homo sapiens
ccctgtcccatgcag

SEQ ID NO: 4019768 - DNA, 19 bp, Homo sapiens
ccctgtcccatgcaggccc

SEQ ID NO: 4019769 - DNA, 16 bp, Homo sapiens
ccctgtcgagacactt

SEQ ID NO: 4019770 - DNA, 20 bp, Homo sapiens
ccctgtcgagacacttgcct

SEQ ID NO: 4019771 - DNA, 14 bp, Homo sapiens
ccctgtctaaaaaa

SEQ ID NO: 4019772 - DNA, 13 bp, Homo sapiens
ccctgtctccagc

SEQ ID NO: 4019773 - DNA, 16 bp, Homo sapiens
ccctgtctccagctgc

SEQ ID NO: 4019774 - DNA, 18 bp, Homo sapiens
ccctgtctccagctgcct

SEQ ID NO: 4019775 - DNA, 16 bp, Homo sapiens
ccctgtcttctgggca

SEQ ID NO: 4019776 - DNA, 20 bp, Homo sapiens
ccctgtcttctgggcacagt

SEQ ID NO: 4019777 - DNA, 21 bp, Homo sapiens
ccctgtcttctgggcacagtg

SEQ ID NO: 4019778 - DNA, 16 bp, Homo sapiens
ccctgtcttgctgtca

SEQ ID NO: 4019779 - DNA, 17 bp, Homo sapiens
ccctgtgacatggtgcc

SEQ ID NO: 4019780 - DNA, 18 bp, Homo sapiens
ccctgtgacatggtgcct

SEQ ID NO: 4019781 - DNA, 22 bp, Homo sapiens
ccctgtgacatggtgcctgaga

SEQ ID NO: 4019782 - DNA, 17 bp, Homo sapiens
ccctgtggccctggcca

SEQ ID NO: 4019783 - DNA, 18 bp, Homo sapiens
ccctgtggccctggccac

SEQ ID NO: 4019784 - DNA, 19 bp, Homo sapiens
ccctgtgggggtggccatc

SEQ ID NO: 4019785 - DNA, 13 bp, Homo sapiens
ccctgtgttgtct

SEQ ID NO: 4019786 - DNA, 13 bp, Homo sapiens
ccctgttaaacag

SEQ ID NO: 4019787 - DNA, 22 bp, Homo sapiens
ccctgttcactctacttagcat

SEQ ID NO: 4019788 - DNA, 16 bp, Homo sapiens
ccctgttccccagaga

SEQ ID NO: 4019789 - DNA, 23 bp, Homo sapiens
ccctgttctaagggggaggggaa

SEQ ID NO: 4019790 - DNA, 20 bp, Homo sapiens
ccctgttcttcctccagctg

SEQ ID NO: 4019791 - DNA, 11 bp, Homo sapiens
ccctgtttaat

SEQ ID NO: 4019792 - DNA, 17 bp, Homo sapiens
ccctgtttaatatttaa

SEQ ID NO: 4019793 - DNA, 17 bp, Homo sapiens
ccctgtttactggttct

SEQ ID NO: 4019794 - DNA, 22 bp, Homo sapiens
ccctgttttcccacgaggaatc

SEQ ID NO: 4019795 - DNA, 15 bp, Homo sapiens
ccctgttttctgttt

SEQ ID NO: 4019796 - DNA, 18 bp, Homo sapiens
cccttacacactcaggcc

SEQ ID NO: 4019797 - DNA, 21 bp, Homo sapiens
cccttacagccctaagtggct

SEQ ID NO: 4019798 - DNA, 13 bp, Homo sapiens
cccttatccagga

SEQ ID NO: 4019799 - DNA, 14 bp, Homo sapiens
cccttatccaggac

SEQ ID NO: 4019800 - DNA, 20 bp, Homo sapiens
cccttcacaccccaggccct

SEQ ID NO: 4019801 - DNA, 22 bp, Homo sapiens
cccttcacaccccaggcccttc

SEQ ID NO: 4019802 - DNA, 12 bp, Homo sapiens
cccttcagcccc

SEQ ID NO: 4019803 - DNA, 20 bp, Homo sapiens
cccttcagcccccagcccct

SEQ ID NO: 4019804 - DNA, 22 bp, Homo sapiens
cccttcagcccccagcccctcc

SEQ ID NO: 4019805 - DNA, 16 bp, Homo sapiens
cccttccacctgctct

SEQ ID NO: 4019806 - DNA, 16 bp, Homo sapiens
cccttccatgtgcctt

SEQ ID NO: 4019807 - DNA, 16 bp, Homo sapiens
cccttcccacatgcct

SEQ ID NO: 4019808 - DNA, 16 bp, Homo sapiens
cccttcccactggagg

SEQ ID NO: 4019809 - DNA, 14 bp, Homo sapiens
cccttcccagggca

SEQ ID NO: 4019810 - DNA, 19 bp, Homo sapiens
cccttcccatttcttccca

SEQ ID NO: 4019811 - DNA, 16 bp, Homo sapiens
cccttcccccagccca

SEQ ID NO: 4019812 - DNA, 21 bp, Homo sapiens
cccttcccccagcccatccat

SEQ ID NO: 4019813 - DNA, 12 bp, Homo sapiens
cccttcccctcc

SEQ ID NO: 4019814 - DNA, 16 bp, Homo sapiens
cccttcccctccctgg

SEQ ID NO: 4019815 - DNA, 18 bp, Homo sapiens
cccttccccttccttctt

SEQ ID NO: 4019816 - DNA, 19 bp, Homo sapiens
cccttccccttctgtgtca

SEQ ID NO: 4019817 - DNA, 13 bp, Homo sapiens
cccttcctctcca

SEQ ID NO: 4019818 - DNA, 16 bp, Homo sapiens
cccttcctctctcctt

SEQ ID NO: 4019819 - DNA, 11 bp, Homo sapiens
cccttcctgaa

SEQ ID NO: 4019820 - DNA, 10 bp, Homo sapiens
cccttcctgt

SEQ ID NO: 4019821 - DNA, 19 bp, Homo sapiens
cccttccttttccctgctt

SEQ ID NO: 4019822 - DNA, 13 bp, Homo sapiens
cccttctctgctc

SEQ ID NO: 4019823 - DNA, 23 bp, Homo sapiens
cccttctctgctccaccacatcc

SEQ ID NO: 4019824 - DNA, 13 bp, Homo sapiens
cccttctcttcca

SEQ ID NO: 4019825 - DNA, 17 bp, Homo sapiens
cccttctgtgtcacagt

SEQ ID NO: 4019826 - DNA, 17 bp, Homo sapiens
cccttcttgcctgctgg

SEQ ID NO: 4019827 - DNA, 14 bp, Homo sapiens
cccttcttgggccc

SEQ ID NO: 4019828 - DNA, 18 bp, Homo sapiens
cccttcttgggccccaga

SEQ ID NO: 4019829 - DNA, 15 bp, Homo sapiens
cccttgacaccgggg

SEQ ID NO: 4019830 - DNA, 15 bp, Homo sapiens
cccttgacacctgct

SEQ ID NO: 4019831 - DNA, 12 bp, Homo sapiens
cccttgacctgc

SEQ ID NO: 4019832 - DNA, 15 bp, Homo sapiens
cccttgacctgctga

SEQ ID NO: 4019833 - DNA, 21 bp, Homo sapiens
cccttgcagttcagcaccacc

SEQ ID NO: 4019834 - DNA, 23 bp, Homo sapiens
cccttgcagttcagcaccaccct

SEQ ID NO: 4019835 - DNA, 18 bp, Homo sapiens
cccttgcctccccatttc

SEQ ID NO: 4019836 - DNA, 13 bp, Homo sapiens
cccttgcctctgc

SEQ ID NO: 4019837 - DNA, 16 bp, Homo sapiens
cccttgcctctgccct

SEQ ID NO: 4019838 - DNA, 20 bp, Homo sapiens
cccttgcctctgccctggat

SEQ ID NO: 4019839 - DNA, 13 bp, Homo sapiens
cccttgctccctt

SEQ ID NO: 4019840 - DNA, 15 bp, Homo sapiens
cccttgctctcagct

SEQ ID NO: 4019841 - DNA, 19 bp, Homo sapiens
cccttgctgaacacacaca

SEQ ID NO: 4019842 - DNA, 22 bp, Homo sapiens
cccttggacaagacaaaccaag

SEQ ID NO: 4019843 - DNA, 14 bp, Homo sapiens
cccttggcctcaga

SEQ ID NO: 4019844 - DNA, 12 bp, Homo sapiens
cccttggcctgt

SEQ ID NO: 4019845 - DNA, 14 bp, Homo sapiens
cccttggctgtgag

SEQ ID NO: 4019846 - DNA, 22 bp, Homo sapiens
cccttggctgtgaggcccctgg

SEQ ID NO: 4019847 - DNA, 16 bp, Homo sapiens
cccttgggacagccag

SEQ ID NO: 4019848 - DNA, 19 bp, Homo sapiens
cccttgggacagccagagc

SEQ ID NO: 4019849 - DNA, 12 bp, Homo sapiens
cccttgggcagt

SEQ ID NO: 4019850 - DNA, 13 bp, Homo sapiens
cccttgggcagtt

SEQ ID NO: 4019851 - DNA, 17 bp, Homo sapiens
cccttggtggcaagagc

SEQ ID NO: 4019852 - DNA, 21 bp, Homo sapiens
ccctttagccaaacccttgtc

SEQ ID NO: 4019853 - DNA, 21 bp, Homo sapiens
ccctttcaggcctacagccac

SEQ ID NO: 4019854 - DNA, 14 bp, Homo sapiens
ccctttcctaggcc

SEQ ID NO: 4019855 - DNA, 13 bp, Homo sapiens
ccctttccttcca

SEQ ID NO: 4019856 - DNA, 13 bp, Homo sapiens
cccatttccttgg

SEQ ID NO: 4019857 - DNA, 19 bp, Homo sapiens
cccatttctatttatttac

SEQ ID NO: 4019858 - DNA, 20 bp, Homo sapiens
cccatttctatttatttact

SEQ ID NO: 4019859 - DNA, 14 bp, Homo sapiens
cccatttctctaca

SEQ ID NO: 4019860 - DNA, 14 bp, Homo sapiens
cccatttctgcctc

SEQ ID NO: 4019861 - DNA, 15 bp, Homo sapiens
ccccaaaatccaaaa

SEQ ID NO: 4019862 - DNA, 18 bp, Homo sapiens
ccccaaacaccttccagc

SEQ ID NO: 4019863 - DNA, 22 bp, Homo sapiens
ccccaaacaccttccagctcct

SEQ ID NO: 4019864 - DNA, 16 bp, Homo sapiens
ccccaaacatagcccc

SEQ ID NO: 4019865 - DNA, 20 bp, Homo sapiens
ccccaaagagcctggagaag

SEQ ID NO: 4019866 - DNA, 22 bp, Homo sapiens
ccccaaagagcctggagaagct

SEQ ID NO: 4019867 - DNA, 18 bp, Homo sapiens
ccccaaagctttcctgcc

SEQ ID NO: 4019868 - DNA, 19 bp, Homo sapiens
ccccaaagctttcctgccc

SEQ ID NO: 4019869 - DNA, 23 bp, Homo sapiens
ccccaaaggcatcccagcctggg

SEQ ID NO: 4019870 - DNA, 14 bp, Homo sapiens
ccccaaccacagag

SEQ ID NO: 4019871 - DNA, 18 bp, Homo sapiens
ccccaattactattccct

SEQ ID NO: 4019872 - DNA, 15 bp, Homo sapiens
ccccaattctcccct

SEQ ID NO: 4019873 - DNA, 13 bp, Homo sapiens
ccccacacacact

SEQ ID NO: 4019874 - DNA, 16 bp, Homo sapiens
ccccacaccccagccc

SEQ ID NO: 4019875 - DNA, 13 bp, Homo sapiens
ccccacagaacct

SEQ ID NO: 4019876 - DNA, 13 bp, Homo sapiens
ccccaccagctcg

SEQ ID NO: 4019877 - DNA, 14 bp, Homo sapiens
ccccaccagctcgt

SEQ ID NO: 4019878 - DNA, 14 bp, Homo sapiens
ccccaccagctgca

SEQ ID NO: 4019879 - DNA, 14 bp, Homo sapiens
ccccacccaagccc

SEQ ID NO: 4019880 - DNA, 19 bp, Homo sapiens
ccccacccaagcccaaact

SEQ ID NO: 4019881 - DNA, 21 bp, Homo sapiens
ccccacccacctccacccagc

SEQ ID NO: 4019882 - DNA, 23 bp, Homo sapiens
ccccacccacctccacccagccc

SEQ ID NO: 4019883 - DNA, 13 bp, Homo sapiens
ccccacccaggag

SEQ ID NO: 4019884 - DNA, 14 bp, Homo sapiens
ccccaccccacact

SEQ ID NO: 4019885 - DNA, 19 bp, Homo sapiens
ccccaccccggggaccctg

SEQ ID NO: 4019886 - DNA, 22 bp, Homo sapiens
ccccaccccggggaccctgtga

SEQ ID NO: 4019887 - DNA, 13 bp, Homo sapiens
ccccacgagggct

SEQ ID NO: 4019888 - DNA, 14 bp, Homo sapiens
ccccacgagggctg

SEQ ID NO: 4019889 - DNA, 15 bp, Homo sapiens
ccccacgagggctgg

SEQ ID NO: 4019890 - DNA, 19 bp, Homo sapiens
ccccacggagacagaggaa

SEQ ID NO: 4019891 - DNA, 19 bp, Homo sapiens
ccccactactgcagcacct

SEQ ID NO: 4019892 - DNA, 21 bp, Homo sapiens
ccccactactgcagcacctcc

SEQ ID NO: 4019893 - DNA, 18 bp, Homo sapiens
ccccactcaccagtgtcc

SEQ ID NO: 4019894 - DNA, 23 bp, Homo sapiens
ccccactccctggctctcagaag

SEQ ID NO: 4019895 - DNA, 15 bp, Homo sapiens
ccccactctccccac

SEQ ID NO: 4019896 - DNA, 15 bp, Homo sapiens
ccccactgacagcct

SEQ ID NO: 4019897 - DNA, 14 bp, Homo sapiens
ccccactgatgctg

SEQ ID NO: 4019898 - DNA, 12 bp, Homo sapiens
ccccactgggca

SEQ ID NO: 4019899 - DNA, 13 bp, Homo sapiens
ccccactgggcac

SEQ ID NO: 4019900 - DNA, 13 bp, Homo sapiens
ccccactgggcca

SEQ ID NO: 4019901 - DNA, 15 bp, Homo sapiens
ccccactgggccagc

SEQ ID NO: 4019902 - DNA, 22 bp, Homo sapiens
ccccactgggccagccctgcag

SEQ ID NO: 4019903 - DNA, 21 bp, Homo sapiens
ccccagagagaggatgtggaa

SEQ ID NO: 4019904 - DNA, 22 bp, Homo sapiens
ccccagagctgtttatggcctc

SEQ ID NO: 4019905 - DNA, 15 bp, Homo sapiens
ccccagagtggccca

SEQ ID NO: 4019906 - DNA, 18 bp, Homo sapiens
ccccagatagagctgggt

SEQ ID NO: 4019907 - DNA, 20 bp, Homo sapiens
ccccagatagagctgggtgg

SEQ ID NO: 4019908 - DNA, 22 bp, Homo sapiens
ccccagcactaaggccgtgtct

SEQ ID NO: 4019909 - DNA, 22 bp, Homo sapiens
ccccagcagaggcaggctggga

SEQ ID NO: 4019910 - DNA, 13 bp, Homo sapiens
ccccagcagccct

SEQ ID NO: 4019911 - DNA, 20 bp, Homo sapiens
ccccagcagccctcaacagg

SEQ ID NO: 4019912 - DNA, 20 bp, Homo sapiens
ccccagcatcactccccaag

SEQ ID NO: 4019913 - DNA, 12 bp, Homo sapiens
ccccagcccacc

SEQ ID NO: 4019914 - DNA, 12 bp, Homo sapiens
ccccagcccaga

SEQ ID NO: 4019915 - DNA, 13 bp, Homo sapiens
ccccagccccggg

SEQ ID NO: 4019916 - DNA, 18 bp, Homo sapiens
ccccagcccctcccccat

SEQ ID NO: 4019917 - DNA, 20 bp, Homo sapiens
ccccagcccttcctctgctc

SEQ ID NO: 4019918 - DNA, 14 bp, Homo sapiens
ccccagcctctggc

SEQ ID NO: 4019919 - DNA, 19 bp, Homo sapiens
ccccagcctgacctgagac

SEQ ID NO: 4019920 - DNA, 13 bp, Homo sapiens
ccccagcctgggc

SEQ ID NO: 4019921 - DNA, 18 bp, Homo sapiens
ccccagcgtcccagtctc

SEQ ID NO: 4019922 - DNA, 17 bp, Homo sapiens
ccccagctaagaacctg

SEQ ID NO: 4019923 - DNA, 10 bp, Homo sapiens
ccccagctcc

SEQ ID NO: 4019924 - DNA, 18 bp, Homo sapiens
ccccagctgactgtggcc

SEQ ID NO: 4019925 - DNA, 12 bp, Homo sapiens
cccctcactctg

SEQ ID NO: 4019926 - DNA, 14 bp, Homo sapiens
cccctcactctggc

SEQ ID NO: 4019927 - DNA, 15 bp, Homo sapiens
cccctcactctgtca

SEQ ID NO: 4019928 - DNA, 20 bp, Homo sapiens
cccctccaaacctccagcct

SEQ ID NO: 4019929 - DNA, 20 bp, Homo sapiens
cccctccacatcccagcagc

SEQ ID NO: 4019930 - DNA, 13 bp, Homo sapiens
cccctccaggaag

SEQ ID NO: 4019931 - DNA, 14 bp, Homo sapiens
cccctccaggaaga

SEQ ID NO: 4019932 - DNA, 13 bp, Homo sapiens
cccctccaggagg

SEQ ID NO: 4019933 - DNA, 13 bp, Homo sapiens
cccctcccacctc

SEQ ID NO: 4019934 - DNA, 15 bp, Homo sapiens
cccctcccccaaccc

SEQ ID NO: 4019935 - DNA, 18 bp, Homo sapiens
cccctcccccaaccccca

SEQ ID NO: 4019936 - DNA, 20 bp, Homo sapiens
cccctccccctgagattcag

SEQ ID NO: 4019937 - DNA, 17 bp, Homo sapiens
cccctcccgccccttcc

SEQ ID NO: 4019938 - DNA, 22 bp, Homo sapiens
cccctccctggctcccatgacc

SEQ ID NO: 4019939 - DNA, 15 bp, Homo sapiens
cccctcccttcaacc

SEQ ID NO: 4019940 - DNA, 13 bp, Homo sapiens
cccctcctccagg

SEQ ID NO: 4019941 - DNA, 17 bp, Homo sapiens
cccctcctctagctgtg

SEQ ID NO: 4019942 - DNA, 18 bp, Homo sapiens
cccctccttccctcaccc

SEQ ID NO: 4019943 - DNA, 15 bp, Homo sapiens
cccctctgctctgtc

SEQ ID NO: 4019944 - DNA, 19 bp, Homo sapiens
cccctcttattcctctagg

SEQ ID NO: 4019945 - DNA, 20 bp, Homo sapiens
cccctgacctgtgagcccag

SEQ ID NO: 4019946 - DNA, 17 bp, Homo sapiens
cccctgagccagcaggg

SEQ ID NO: 4019947 - DNA, 18 bp, Homo sapiens
cccctgccacctccctga

SEQ ID NO: 4019948 - DNA, 23 bp, Homo sapiens
cccctgcccagatcagccagaag

SEQ ID NO: 4019949 - DNA, 14 bp, Homo sapiens
cccctgccctgcac

SEQ ID NO: 4019950 - DNA, 19 bp, Homo sapiens
cccctgcctgccctgtcag

SEQ ID NO: 4019951 - DNA, 21 bp, Homo sapiens
cccctgcgtgggggccagtca

SEQ ID NO: 4019952 - DNA, 14 bp, Homo sapiens
cccctgctcagcaa

SEQ ID NO: 4019953 - DNA, 20 bp, Homo sapiens
cccctgctccaccagcagca

SEQ ID NO: 4019954 - DNA, 17 bp, Homo sapiens
cccctgctcccagcctg

SEQ ID NO: 4019955 - DNA, 18 bp, Homo sapiens
cccctgctcccagcctgc

SEQ ID NO: 4019956 - DNA, 15 bp, Homo sapiens
cccctgctcccattc

SEQ ID NO: 4019957 - DNA, 11 bp, Homo sapiens
cccctgctgtc

SEQ ID NO: 4019958 - DNA, 22 bp, Homo sapiens
cccctggaagagcccagtctgt

SEQ ID NO: 4019959 - DNA, 15 bp, Homo sapiens
cccctggagagaagt

SEQ ID NO: 4019960 - DNA, 21 bp, Homo sapiens
cccctggcccatctcagcctc

SEQ ID NO: 4019961 - DNA, 22 bp, Homo sapiens
cccctggctgggacgtggctca

SEQ ID NO: 4019962 - DNA, 20 bp, Homo sapiens
cccctggcttttcactgctg

SEQ ID NO: 4019963 - DNA, 13 bp, Homo sapiens
ccatgcccacctg

SEQ ID NO: 4019964 - DNA, 15 bp, Homo sapiens
ccatgcccacctgcc

SEQ ID NO: 4019965 - DNA, 12 bp, Homo sapiens
ccatgcccactg

SEQ ID NO: 4019966 - DNA, 14 bp, Homo sapiens
ccatgcccactgct

SEQ ID NO: 4019967 - DNA, 19 bp, Homo sapiens
ccatgcccactgctggtgc

SEQ ID NO: 4019968 - DNA, 23 bp, Homo sapiens
ccatgcctagcagagtgctggca

SEQ ID NO: 4019969 - DNA, 16 bp, Homo sapiens
ccatgcctgagggtgg

SEQ ID NO: 4019970 - DNA, 17 bp, Homo sapiens
ccatgcctgtccagcct

SEQ ID NO: 4019971 - DNA, 18 bp, Homo sapiens
ccatgcctgtccagcctg

SEQ ID NO: 4019972 - DNA, 17 bp, Homo sapiens
ccatgctcaaccactgt

SEQ ID NO: 4019973 - DNA, 18 bp, Homo sapiens
ccatgctcaaccactgtg

SEQ ID NO: 4019974 - DNA, 16 bp, Homo sapiens
ccatgctcctcacctg

SEQ ID NO: 4019975 - DNA, 12 bp, Homo sapiens
ccatgctgggcc

SEQ ID NO: 4019976 - DNA, 20 bp, Homo sapiens
ccatgctgggccactgggga

SEQ ID NO: 4019977 - DNA, 14 bp, Homo sapiens
ccatggacactcca

SEQ ID NO: 4019978 - DNA, 15 bp, Homo sapiens
ccatggacactccag

SEQ ID NO: 4019979 - DNA, 19 bp, Homo sapiens
ccatggacactccagtgcc

SEQ ID NO: 4019980 - DNA, 22 bp, Homo sapiens
ccatggagccagctccctctat

SEQ ID NO: 4019981 - DNA, 17 bp, Homo sapiens
ccatggcctttctaata

SEQ ID NO: 4019982 - DNA, 21 bp, Homo sapiens
ccatggctgggcgtgctagag

SEQ ID NO: 4019983 - DNA, 17 bp, Homo sapiens
ccatgggagccagctgc

SEQ ID NO: 4019984 - DNA, 21 bp, Homo sapiens
ccatgggagccagctgctttt

SEQ ID NO: 4019985 - DNA, 13 bp, Homo sapiens
ccatgggcttcac

SEQ ID NO: 4019986 - DNA, 16 bp, Homo sapiens
ccatgggggcacttga

SEQ ID NO: 4019987 - DNA, 22 bp, Homo sapiens
ccatgtagccccctggcctctg

SEQ ID NO: 4019988 - DNA, 23 bp, Homo sapiens
ccatgtatggaatcccactgtat

SEQ ID NO: 4019989 - DNA, 20 bp, Homo sapiens
ccatgtcaccggtcagtgcc

SEQ ID NO: 4019990 - DNA, 21 bp, Homo sapiens
ccatgtcaccggtcagtgcct

SEQ ID NO: 4019991 - DNA, 13 bp, Homo sapiens
ccatgtccaaaga

SEQ ID NO: 4019992 - DNA, 18 bp, Homo sapiens
ccatgtccaaagaggctg

SEQ ID NO: 4019993 - DNA, 19 bp, Homo sapiens
ccatgtccaaagaggctgc

SEQ ID NO: 4019994 - DNA, 23 bp, Homo sapiens
ccatgtccaaagaggctgcccct

SEQ ID NO: 4019995 - DNA, 15 bp, Homo sapiens
ccatgtctttctcca

SEQ ID NO: 4019996 - DNA, 13 bp, Homo sapiens
ccatgtgagccac

SEQ ID NO: 4019997 - DNA, 22 bp, Homo sapiens
ccatgtgagctgctgccatgaa

SEQ ID NO: 4019998 - DNA, 14 bp, Homo sapiens
ccatgtgcacccgg

SEQ ID NO: 4019999 - DNA, 16 bp, Homo sapiens
ccatgtgcacccggcc

SEQ ID NO: 4020000 - DNA, 18 bp, Homo sapiens
ccatgtgcacccggcctg

SEQ ID NO: 4020001 - DNA, 13 bp, Homo sapiens
ccatgtgcctttc

SEQ ID NO: 4020002 - DNA, 17 bp, Homo sapiens
ccatgtggtggcacagg

SEQ ID NO: 4020003 - DNA, 12 bp, Homo sapiens
ccatgtgtcact

SEQ ID NO: 4020004 - DNA, 12 bp, Homo sapiens
ccatgtgtcccc

SEQ ID NO: 4020005 - DNA, 15 bp, Homo sapiens
ccatgtgtcccctca

SEQ ID NO: 4020006 - DNA, 17 bp, Homo sapiens
ccatgttctatttttga

SEQ ID NO: 4020007 - DNA, 13 bp, Homo sapiens
ccatgtttcaaat

SEQ ID NO: 4020008 - DNA, 13 bp, Homo sapiens
ccattaaagtctg

SEQ ID NO: 4020009 - DNA, 15 bp, Homo sapiens
ccattaagtcatgtg

SEQ ID NO: 4020010 - DNA, 16 bp, Homo sapiens
ccattacctccatcca

SEQ ID NO: 4020011 - DNA, 20 bp, Homo sapiens
ccattcagagctatggtgct

SEQ ID NO: 4020012 - DNA, 14 bp, Homo sapiens
ccattcattctggt

SEQ ID NO: 4020013 - DNA, 16 bp, Homo sapiens
ccattccaaagcttta

SEQ ID NO: 4020014 - DNA, 13 bp, Homo sapiens
ccattccactcca

SEQ ID NO: 4020015 - DNA, 16 bp, Homo sapiens
ccattccagaatatct

SEQ ID NO: 4020016 - DNA, 19 bp, Homo sapiens
ccattccctccatttttct

SEQ ID NO: 4020017 - DNA, 13 bp, Homo sapiens
ccattcctgaaga

SEQ ID NO: 4020018 - DNA, 18 bp, Homo sapiens
ccattccttgcgcctcag

SEQ ID NO: 4020019 - DNA, 19 bp, Homo sapiens
ccattccttgcgcctcagc

SEQ ID NO: 4020020 - DNA, 15 bp, Homo sapiens
ccattctccacagca

SEQ ID NO: 4020021 - DNA, 12 bp, Homo sapiens
ccattctcccag

SEQ ID NO: 4020022 - DNA, 13 bp, Homo sapiens
ccattctcccagg

SEQ ID NO: 4020023 - DNA, 14 bp, Homo sapiens
ccattctcccaggt

SEQ ID NO: 4020024 - DNA, 12 bp, Homo sapiens
ccattctcctgc

SEQ ID NO: 4020025 - DNA, 19 bp, Homo sapiens
ccattctgttttcccccag

SEQ ID NO: 4020026 - DNA, 16 bp, Homo sapiens
ccattcttggcccagg

SEQ ID NO: 4020027 - DNA, 21 bp, Homo sapiens
ccattgaaactaagagctctc

SEQ ID NO: 4020028 - DNA, 16 bp, Homo sapiens
ccattgccccagacct

SEQ ID NO: 4020029 - DNA, 16 bp, Homo sapiens
ccattgcggccccagg

SEQ ID NO: 4020030 - DNA, 17 bp, Homo sapiens
ccattgcggccccagga

SEQ ID NO: 4020031 - DNA, 21 bp, Homo sapiens
ccattgcggccccaggagggg

SEQ ID NO: 4020032 - DNA, 19 bp, Homo sapiens
ccattggctatttaaaact

SEQ ID NO: 4020033 - DNA, 22 bp, Homo sapiens
ccattgggcacagtccagaccc

SEQ ID NO: 4020034 - DNA, 19 bp, Homo sapiens
ccatttaataaagaaatat

SEQ ID NO: 4020035 - DNA, 18 bp, Homo sapiens
ccatttacgtgtctgaat

SEQ ID NO: 4020036 - DNA, 14 bp, Homo sapiens
ccatttactaacag

SEQ ID NO: 4020037 - DNA, 21 bp, Homo sapiens
ccatttataaccccagcctga

SEQ ID NO: 4020038 - DNA, 17 bp, Homo sapiens
ccatttcccacatcttt

SEQ ID NO: 4020039 - DNA, 14 bp, Homo sapiens
ccatttcccatctg

SEQ ID NO: 4020040 - DNA, 12 bp, Homo sapiens
ccatttccttgg

SEQ ID NO: 4020041 - DNA, 21 bp, Homo sapiens
ccatttccttttctctgccct

SEQ ID NO: 4020042 - DNA, 12 bp, Homo sapiens
ccatttctattt

SEQ ID NO: 4020043 - DNA, 13 bp, Homo sapiens
ccatttctattta

SEQ ID NO: 4020044 - DNA, 20 bp, Homo sapiens
ccatttctcactagtgtcag

SEQ ID NO: 4020045 - DNA, 14 bp, Homo sapiens
ccatttctctacac

SEQ ID NO: 4020046 - DNA, 15 bp, Homo sapiens
ccatttctctacact

SEQ ID NO: 4020047 - DNA, 13 bp, Homo sapiens
ccatttctgcctt

SEQ ID NO: 4020048 - DNA, 13 bp, Homo sapiens
ccatttcttcctc

SEQ ID NO: 4020049 - DNA, 16 bp, Homo sapiens
ccatttcttcctcact

SEQ ID NO: 4020050 - DNA, 21 bp, Homo sapiens
cccaaaggcatcccagcctgg

SEQ ID NO: 4020051 - DNA, 20 bp, Homo sapiens
cccaaagtgctgagattgca

SEQ ID NO: 4020052 - DNA, 23 bp, Homo sapiens
cccaaagttgttgtaacctgctg

SEQ ID NO: 4020053 - DNA, 14 bp, Homo sapiens
cccaaatcaataca

SEQ ID NO: 4020054 - DNA, 15 bp, Homo sapiens
cccaacagccttagc

SEQ ID NO: 4020055 - DNA, 20 bp, Homo sapiens
cccaaccctggcttggggtc

SEQ ID NO: 4020056 - DNA, 17 bp, Homo sapiens
cccaacccttccctcac

SEQ ID NO: 4020057 - DNA, 13 bp, Homo sapiens
cccaacctcagag

SEQ ID NO: 4020058 - DNA, 13 bp, Homo sapiens
cccaacctcaggg

SEQ ID NO: 4020059 - DNA, 16 bp, Homo sapiens
cccaacctcctgacct

SEQ ID NO: 4020060 - DNA, 19 bp, Homo sapiens
cccaactactgagctgaga

SEQ ID NO: 4020061 - DNA, 18 bp, Homo sapiens
cccaactccaggaaagag

SEQ ID NO: 4020062 - DNA, 20 bp, Homo sapiens
cccaacttctcttgctttct

SEQ ID NO: 4020063 - DNA, 21 bp, Homo sapiens
cccaagaatagatgctgactg

SEQ ID NO: 4020064 - DNA, 16 bp, Homo sapiens
cccaagagcagagtct

SEQ ID NO: 4020065 - DNA, 21 bp, Homo sapiens
cccaagagcagagtctgggcc

SEQ ID NO: 4020066 - DNA, 23 bp, Homo sapiens
cccaagagcagagtctgggcctc

SEQ ID NO: 4020067 - DNA, 23 bp, Homo sapiens
cccaagaggtcaaggctgcagtg

SEQ ID NO: 4020068 - DNA, 19 bp, Homo sapiens
cccaagataggggcacact

SEQ ID NO: 4020069 - DNA, 16 bp, Homo sapiens
cccaaggactgaggga

SEQ ID NO: 4020070 - DNA, 22 bp, Homo sapiens
cccaaggccccctgcctgccct

SEQ ID NO: 4020071 - DNA, 19 bp, Homo sapiens
cccaaggctcccggaattc

SEQ ID NO: 4020072 - DNA, 16 bp, Homo sapiens
cccaagggcctcccac

SEQ ID NO: 4020073 - DNA, 21 bp, Homo sapiens
cccaaggttctgggtgcagga

SEQ ID NO: 4020074 - DNA, 16 bp, Homo sapiens
cccaagtcacacagct

SEQ ID NO: 4020075 - DNA, 21 bp, Homo sapiens
cccaataaacattaagattga

SEQ ID NO: 4020076 - DNA, 13 bp, Homo sapiens
cccaatctgcaca

SEQ ID NO: 4020077 - DNA, 14 bp, Homo sapiens
cccaattagcttgg

SEQ ID NO: 4020078 - DNA, 15 bp, Homo sapiens
cccaattaggaagtg

SEQ ID NO: 4020079 - DNA, 19 bp, Homo sapiens
cccaattaggaagtgtaac

SEQ ID NO: 4020080 - DNA, 11 bp, Homo sapiens
cccaatttccc

SEQ ID NO: 4020081 - DNA, 21 bp, Homo sapiens
cccacacagctgccctagctg

SEQ ID NO: 4020082 - DNA, 13 bp, Homo sapiens
cccacaccccagc

SEQ ID NO: 4020083 - DNA, 15 bp, Homo sapiens
cccacaccccagccc

SEQ ID NO: 4020084 - DNA, 15 bp, Homo sapiens
cccacaccgtgtaaa

SEQ ID NO: 4020085 - DNA, 13 bp, Homo sapiens
cccacacctcagt

SEQ ID NO: 4020086 - DNA, 16 bp, Homo sapiens
cccacacctctgccag

SEQ ID NO: 4020087 - DNA, 13 bp, Homo sapiens
cccacactcgcca

SEQ ID NO: 4020088 - DNA, 22 bp, Homo sapiens
cccacaggaagcctgcagtcct

SEQ ID NO: 4020089 - DNA, 16 bp, Homo sapiens
cccacatcccaggctt

SEQ ID NO: 4020090 - DNA, 20 bp, Homo sapiens
cccacatcccaggcttcacc

SEQ ID NO: 4020091 - DNA, 16 bp, Homo sapiens
cccacatctttcctca

SEQ ID NO: 4020092 - DNA, 14 bp, Homo sapiens
cccacatgaggcca

SEQ ID NO: 4020093 - DNA, 23 bp, Homo sapiens
cccacatgaggccatctcaggag

SEQ ID NO: 4020094 - DNA, 21 bp, Homo sapiens
cccaccagacgtcaggccctg

SEQ ID NO: 4020095 - DNA, 16 bp, Homo sapiens
cccaccatatgaattg

SEQ ID NO: 4020096 - DNA, 16 bp, Homo sapiens
cccaccattctacctg

SEQ ID NO: 4020097 - DNA, 12 bp, Homo sapiens
cccacccacctc

SEQ ID NO: 4020098 - DNA, 23 bp, Homo sapiens
cccacccaggatgacccctgggc

SEQ ID NO: 4020099 - DNA, 14 bp, Homo sapiens
cccaccccacactt

SEQ ID NO: 4020100 - DNA, 16 bp, Homo sapiens
cccaccccctgccctg

SEQ ID NO: 4020101 - DNA, 17 bp, Homo sapiens
cccaccccctgccctgc

SEQ ID NO: 4020102 - DNA, 19 bp, Homo sapiens
cccaccccctgccctgcac

SEQ ID NO: 4020103 - DNA, 13 bp, Homo sapiens
cccaccccgggga

SEQ ID NO: 4020104 - DNA, 20 bp, Homo sapiens
cccaccccggggaccctgtg

SEQ ID NO: 4020105 - DNA, 21 bp, Homo sapiens
cccaccccggggaccctgtga

SEQ ID NO: 4020106 - DNA, 12 bp, Homo sapiens
cccacccctcac

SEQ ID NO: 4020107 - DNA, 15 bp, Homo sapiens
cccacccctcactcc

SEQ ID NO: 4020108 - DNA, 21 bp, Homo sapiens
cccacccctcactccccaggg

SEQ ID NO: 4020109 - DNA, 15 bp, Homo sapiens
cccacccctgcacag

SEQ ID NO: 4020110 - DNA, 16 bp, Homo sapiens
cccacccctgccccca

SEQ ID NO: 4020111 - DNA, 16 bp, Homo sapiens
cccaccctccctggag

SEQ ID NO: 4020112 - DNA, 14 bp, Homo sapiens
cccaccctcctgcc

SEQ ID NO: 4020113 - DNA, 18 bp, Homo sapiens
cccaccctcctgccccac

SEQ ID NO: 4020114 - DNA, 19 bp, Homo sapiens
cccaccctgacccccttcc

SEQ ID NO: 4020115 - DNA, 22 bp, Homo sapiens
cccaccctgcactttcctccac

SEQ ID NO: 4020116 - DNA, 12 bp, Homo sapiens
cccaccctggga

SEQ ID NO: 4020117 - DNA, 17 bp, Homo sapiens
cccaccctgtgccatca

SEQ ID NO: 4020118 - DNA, 16 bp, Homo sapiens
cccaccgagctggagc

SEQ ID NO: 4020119 - DNA, 16 bp, Homo sapiens
cccaccgggagcctcc

SEQ ID NO: 4020120 - DNA, 16 bp, Homo sapiens
cccacctccacccagc

SEQ ID NO: 4020121 - DNA, 17 bp, Homo sapiens
cccacctccacccagcc

SEQ ID NO: 4020122 - DNA, 12 bp, Homo sapiens
cccacctccact

SEQ ID NO: 4020123 - DNA, 17 bp, Homo sapiens
cccacctccactcccac

SEQ ID NO: 4020124 - DNA, 17 bp, Homo sapiens
cccacctcggtcactcc

SEQ ID NO: 4020125 - DNA, 14 bp, Homo sapiens
cccacctctcctgc

SEQ ID NO: 4020126 - DNA, 18 bp, Homo sapiens
cccacctcttgtgcaagg

SEQ ID NO: 4020127 - DNA, 13 bp, Homo sapiens
cccacctgggacc

SEQ ID NO: 4020128 - DNA, 22 bp, Homo sapiens
cccacgtcttcttgctgcagcc

SEQ ID NO: 4020129 - DNA, 12 bp, Homo sapiens
cccacgtgggag

SEQ ID NO: 4020130 - DNA, 19 bp, Homo sapiens
cccacgtgtcttccacttt

SEQ ID NO: 4020131 - DNA, 13 bp, Homo sapiens
cccactcaccccc

SEQ ID NO: 4020132 - DNA, 18 bp, Homo sapiens
cccactccaagccagcaa

SEQ ID NO: 4020133 - DNA, 24 bp, Homo sapiens
cccactcccccgtttctccttttc

SEQ ID NO: 4020134 - DNA, 18 bp, Homo sapiens
ccagtgttgtttgtaaat

SEQ ID NO: 4020135 - DNA, 21 bp, Homo sapiens
ccagtgttgtttgtaaataag

SEQ ID NO: 4020136 - DNA, 21 bp, Homo sapiens
ccagtgtttgggatgaccagg

SEQ ID NO: 4020137 - DNA, 23 bp, Homo sapiens
ccagttactttccaattctcctt

SEQ ID NO: 4020138 - DNA, 14 bp, Homo sapiens
ccagttcaggagtc

SEQ ID NO: 4020139 - DNA, 21 bp, Homo sapiens
ccagttcaggagtcccaagga

SEQ ID NO: 4020140 - DNA, 11 bp, Homo sapiens
ccagttcctgt

SEQ ID NO: 4020141 - DNA, 12 bp, Homo sapiens
ccagttcctgta

SEQ ID NO: 4020142 - DNA, 23 bp, Homo sapiens
ccagttctaggggagaagagccc

SEQ ID NO: 4020143 - DNA, 18 bp, Homo sapiens
ccagttgatcaatgaata

SEQ ID NO: 4020144 - DNA, 15 bp, Homo sapiens
ccagttgccatctgc

SEQ ID NO: 4020145 - DNA, 19 bp, Homo sapiens
ccagttgccctagcccaga

SEQ ID NO: 4020146 - DNA, 19 bp, Homo sapiens
ccagttggcagacagccgt

SEQ ID NO: 4020147 - DNA, 18 bp, Homo sapiens
ccagttgggagcactgga

SEQ ID NO: 4020148 - DNA, 19 bp, Homo sapiens
ccagttgggagcactggag

SEQ ID NO: 4020149 - DNA, 17 bp, Homo sapiens
ccagtttgaagcctgtg

SEQ ID NO: 4020150 - DNA, 20 bp, Homo sapiens
ccagtttgggtaaaatactt

SEQ ID NO: 4020151 - DNA, 22 bp, Homo sapiens
ccagtttgggtaaaatactttt

SEQ ID NO: 4020152 - DNA, 14 bp, Homo sapiens
ccagttttccctgg

SEQ ID NO: 4020153 - DNA, 21 bp, Homo sapiens
ccataagcctccatttagttc

SEQ ID NO: 4020154 - DNA, 15 bp, Homo sapiens
ccataaggaatgtag

SEQ ID NO: 4020155 - DNA, 20 bp, Homo sapiens
ccataattatgacagttata

SEQ ID NO: 4020156 - DNA, 21 bp, Homo sapiens
ccataattttcttcatgcaat

SEQ ID NO: 4020157 - DNA, 12 bp, Homo sapiens
ccatacacagag

SEQ ID NO: 4020158 - DNA, 13 bp, Homo sapiens
ccatacagctcta

SEQ ID NO: 4020159 - DNA, 14 bp, Homo sapiens
ccataccagctcgc

SEQ ID NO: 4020160 - DNA, 21 bp, Homo sapiens
ccataccttttctcttttctt

SEQ ID NO: 4020161 - DNA, 16 bp, Homo sapiens
ccatacttttggctcc

SEQ ID NO: 4020162 - DNA, 20 bp, Homo sapiens
ccatagataggcccctgggg

SEQ ID NO: 4020163 - DNA, 21 bp, Homo sapiens
ccatagatgggtctggctgag

SEQ ID NO: 4020164 - DNA, 16 bp, Homo sapiens
ccatagctgatcatgt

SEQ ID NO: 4020165 - DNA, 16 bp, Homo sapiens
ccataggtttctctcc

SEQ ID NO: 4020166 - DNA, 15 bp, Homo sapiens
ccatagtaccattta

SEQ ID NO: 4020167 - DNA, 19 bp, Homo sapiens
ccatagtaccatttataca

SEQ ID NO: 4020168 - DNA, 17 bp, Homo sapiens
ccatagttctgaggtcc

SEQ ID NO: 4020169 - DNA, 15 bp, Homo sapiens
ccatatatgaccaga

SEQ ID NO: 4020170 - DNA, 19 bp, Homo sapiens
ccatatcagaactgtgcca

SEQ ID NO: 4020171 - DNA, 15 bp, Homo sapiens
ccatatcctggtgcc

SEQ ID NO: 4020172 - DNA, 12 bp, Homo sapiens
ccatatgaattg

SEQ ID NO: 4020173 - DNA, 22 bp, Homo sapiens
ccatatggattttctattgtta

SEQ ID NO: 4020174 - DNA, 14 bp, Homo sapiens
ccatatgttacact

SEQ ID NO: 4020175 - DNA, 19 bp, Homo sapiens
ccatatttacattctagtt

SEQ ID NO: 4020176 - DNA, 12 bp, Homo sapiens
ccatatttattc

SEQ ID NO: 4020177 - DNA, 12 bp, Homo sapiens
ccatcaataaat

SEQ ID NO: 4020178 - DNA, 16 bp, Homo sapiens
ccatcactagaagaaa

SEQ ID NO: 4020179 - DNA, 18 bp, Homo sapiens
ccatcactagaagaaaag

SEQ ID NO: 4020180 - DNA, 12 bp, Homo sapiens
ccatcagcccaa

SEQ ID NO: 4020181 - DNA, 16 bp, Homo sapiens
ccatcagttcccccag

SEQ ID NO: 4020182 - DNA, 20 bp, Homo sapiens
ccatcagttcccccagtacc

SEQ ID NO: 4020183 - DNA, 18 bp, Homo sapiens
ccatcatatgcctgaccc

SEQ ID NO: 4020184 - DNA, 20 bp, Homo sapiens
ccatcatctatagaaagcta

SEQ ID NO: 4020185 - DNA, 19 bp, Homo sapiens
ccatccactctaccctccc

SEQ ID NO: 4020186 - DNA, 22 bp, Homo sapiens
ccatccactctaccctcccacc

SEQ ID NO: 4020187 - DNA, 18 bp, Homo sapiens
ccatccacttacatatat

SEQ ID NO: 4020188 - DNA, 18 bp, Homo sapiens
ccatccagacctggctcc

SEQ ID NO: 4020189 - DNA, 13 bp, Homo sapiens
ccatccaggtctt

SEQ ID NO: 4020190 - DNA, 16 bp, Homo sapiens
ccatccatcagctccc

SEQ ID NO: 4020191 - DNA, 16 bp, Homo sapiens
ccatccattaggccag

SEQ ID NO: 4020192 - DNA, 18 bp, Homo sapiens
ccatccattaggccagca

SEQ ID NO: 4020193 - DNA, 16 bp, Homo sapiens
ccatcccacaccctgg

SEQ ID NO: 4020194 - DNA, 13 bp, Homo sapiens
ccatccccaccag

SEQ ID NO: 4020195 - DNA, 18 bp, Homo sapiens
ccatccccaccagctcgt

SEQ ID NO: 4020196 - DNA, 16 bp, Homo sapiens
ccatccctccccagtt

SEQ ID NO: 4020197 - DNA, 14 bp, Homo sapiens
ccatccctgccaca

SEQ ID NO: 4020198 - DNA, 15 bp, Homo sapiens
ccatccctgccacat

SEQ ID NO: 4020199 - DNA, 17 bp, Homo sapiens
ccatccctgggcccctc

SEQ ID NO: 4020200 - DNA, 22 bp, Homo sapiens
ccatcctcaaacgacagaggag

SEQ ID NO: 4020201 - DNA, 12 bp, Homo sapiens
ccatcctccaga

SEQ ID NO: 4020202 - DNA, 18 bp, Homo sapiens
ccatcctcctccttccta

SEQ ID NO: 4020203 - DNA, 13 bp, Homo sapiens
ccatcctggctgc

SEQ ID NO: 4020204 - DNA, 18 bp, Homo sapiens
ccatccttcaccagagcc

SEQ ID NO: 4020205 - DNA, 22 bp, Homo sapiens
ccatccttccgccaatctggcc

SEQ ID NO: 4020206 - DNA, 15 bp, Homo sapiens
ccatcggccaagaat

SEQ ID NO: 4020207 - DNA, 14 bp, Homo sapiens
ccatctcagcctcc

SEQ ID NO: 4020208 - DNA, 18 bp, Homo sapiens
ccatctcagcctcctgag

SEQ ID NO: 4020209 - DNA, 21 bp, Homo sapiens
ccatctcaggacacttccgta

SEQ ID NO: 4020210 - DNA, 23 bp, Homo sapiens
ccatctcaggagatggagggctt

SEQ ID NO: 4020211 - DNA, 21 bp, Homo sapiens
ccatctcatgcccctggctgg

SEQ ID NO: 4020212 - DNA, 14 bp, Homo sapiens
ccatctccagggag

SEQ ID NO: 4020213 - DNA, 21 bp, Homo sapiens
ccatctccagggagcaagaca

SEQ ID NO: 4020214 - DNA, 15 bp, Homo sapiens
ccatctcccaccctg

SEQ ID NO: 4020215 - DNA, 14 bp, Homo sapiens
ccatctccctgcct

SEQ ID NO: 4020216 - DNA, 16 bp, Homo sapiens
ccatctccctgcctgg

SEQ ID NO: 4020217 - DNA, 20 bp, Homo sapiens
ccatctcgggcacaggccca

SEQ ID NO: 4020218 - DNA, 16 bp, Homo sapiens
ccatctctaccatcat

SEQ ID NO: 4020219 - DNA, 17 bp, Homo sapiens
ccatctctaccatcatc

SEQ ID NO: 4020220 - DNA, 22 bp, Homo sapiens
ccatctctaggatgtcgtcttt

SEQ ID NO: 4020221 - DNA, 21 bp, Homo sapiens
ccatctcttcctacccaacca

SEQ ID NO: 4020222 - DNA, 17 bp, Homo sapiens
ccatctgcaccccttct

SEQ ID NO: 4020223 - DNA, 23 bp, Homo sapiens
ccatctgcttttattaaatttgt

SEQ ID NO: 4020224 - DNA, 16 bp, Homo sapiens
ccatctgggctcctcc

SEQ ID NO: 4020225 - DNA, 14 bp, Homo sapiens
ccatctgtacatat

SEQ ID NO: 4020226 - DNA, 20 bp, Homo sapiens
ccatgaaaacgttttattgt

SEQ ID NO: 4020227 - DNA, 21 bp, Homo sapiens
ccatgaaaacgttttattgtg

SEQ ID NO: 4020228 - DNA, 19 bp, Homo sapiens
ccatgaccttggggtacaa

SEQ ID NO: 4020229 - DNA, 17 bp, Homo sapiens
ccatgactgcacccagc

SEQ ID NO: 4020230 - DNA, 21 bp, Homo sapiens
ccatgactgcacccagctcca

SEQ ID NO: 4020231 - DNA, 18 bp, Homo sapiens
ccatgactgtgaccacct

SEQ ID NO: 4020232 - DNA, 21 bp, Homo sapiens
ccatgactgtgaccaccttct

SEQ ID NO: 4020233 - DNA, 18 bp, Homo sapiens
ccatgagaagagggcctg

SEQ ID NO: 4020234 - DNA, 20 bp, Homo sapiens
ccatgagaccctggtgcctg

SEQ ID NO: 4020235 - DNA, 21 bp, Homo sapiens
ccatgagcaccccaaggctgc

SEQ ID NO: 4020236 - DNA, 13 bp, Homo sapiens
ccatgagcctgcc

SEQ ID NO: 4020237 - DNA, 18 bp, Homo sapiens
ccatgagggacagggtct

SEQ ID NO: 4020238 - DNA, 22 bp, Homo sapiens
ccatgagttggggtctggcagc

SEQ ID NO: 4020239 - DNA, 14 bp, Homo sapiens
ccatgatccctgtg

SEQ ID NO: 4020240 - DNA, 22 bp, Homo sapiens
ccatgatccctgtgttgtctct

SEQ ID NO: 4020241 - DNA, 19 bp, Homo sapiens
ccatgatctgtatttaatg

SEQ ID NO: 4020242 - DNA, 14 bp, Homo sapiens
ccatgatggcaaca

SEQ ID NO: 4020243 - DNA, 21 bp, Homo sapiens
ccatgatggcaacagatctgg

SEQ ID NO: 4020244 - DNA, 21 bp, Homo sapiens
ccatgcaccctcatacacaga

SEQ ID NO: 4020245 - DNA, 13 bp, Homo sapiens
ccatgcactgtga

SEQ ID NO: 4020246 - DNA, 19 bp, Homo sapiens
ccatgcactgtgaaggacc

SEQ ID NO: 4020247 - DNA, 21 bp, Homo sapiens
ccatgcactgtgaaggaccct

SEQ ID NO: 4020248 - DNA, 20 bp, Homo sapiens
ccatgccaaagctagggtgg

SEQ ID NO: 4020249 - DNA, 22 bp, Homo sapiens
ccatgccagattctgcctctct

SEQ ID NO: 4020250 - DNA, 12 bp, Homo sapiens
ccatgccagccg

SEQ ID NO: 4020251 - DNA, 17 bp, Homo sapiens
cattgctgagcctctgc

SEQ ID NO: 4020252 - DNA, 21 bp, Homo sapiens
cattgctgagcctctgctccc

SEQ ID NO: 4020253 - DNA, 17 bp, Homo sapiens
cattgctgttatgtctg

SEQ ID NO: 4020254 - DNA, 12 bp, Homo sapiens
cattgctttctg

SEQ ID NO: 4020255 - DNA, 15 bp, Homo sapiens
cattgcttttatttt

SEQ ID NO: 4020256 - DNA, 17 bp, Homo sapiens
cattgcttttattttga

SEQ ID NO: 4020257 - DNA, 19 bp, Homo sapiens
cattgcttttattttgaaa

SEQ ID NO: 4020258 - DNA, 20 bp, Homo sapiens
cattgcttttattttgaaaa

SEQ ID NO: 4020259 - DNA, 11 bp, Homo sapiens
cattgcttttc

SEQ ID NO: 4020260 - DNA, 18 bp, Homo sapiens
cattggcaagatgaaata

SEQ ID NO: 4020261 - DNA, 14 bp, Homo sapiens
cattggctatttaa

SEQ ID NO: 4020262 - DNA, 17 bp, Homo sapiens
cattgggcacagtccag

SEQ ID NO: 4020263 - DNA, 19 bp, Homo sapiens
cattgggcacagtccagac

SEQ ID NO: 4020264 - DNA, 22 bp, Homo sapiens
cattgggcacagtccagaccca

SEQ ID NO: 4020265 - DNA, 18 bp, Homo sapiens
cattgggtgggtaaattc

SEQ ID NO: 4020266 - DNA, 19 bp, Homo sapiens
cattgggtgggtaaattca

SEQ ID NO: 4020267 - DNA, 20 bp, Homo sapiens
cattgtaaccatttctcact

SEQ ID NO: 4020268 - DNA, 15 bp, Homo sapiens
cattgtaatgttact

SEQ ID NO: 4020269 - DNA, 14 bp, Homo sapiens
cattgtccagagct

SEQ ID NO: 4020270 - DNA, 22 bp, Homo sapiens
cattgtccagagctgcttcccc

SEQ ID NO: 4020271 - DNA, 21 bp, Homo sapiens
cattgtgggatgttcagcact

SEQ ID NO: 4020272 - DNA, 21 bp, Homo sapiens
cattgtggtgtgagcttcaga

SEQ ID NO: 4020273 - DNA, 15 bp, Homo sapiens
cattgttatttatac

SEQ ID NO: 4020274 - DNA, 16 bp, Homo sapiens
cattgttcaattagaa

SEQ ID NO: 4020275 - DNA, 19 bp, Homo sapiens
cattgttcttattctggca

SEQ ID NO: 4020276 - DNA, 20 bp, Homo sapiens
cattgttcttattctggcat

SEQ ID NO: 4020277 - DNA, 13 bp, Homo sapiens
cattgttgagcta

SEQ ID NO: 4020278 - DNA, 17 bp, Homo sapiens
cattgtttgcttattgt

SEQ ID NO: 4020279 - DNA, 20 bp, Homo sapiens
cattgtttgcttattgttcc

SEQ ID NO: 4020280 - DNA, 19 bp, Homo sapiens
cattgtttggatttccttt

SEQ ID NO: 4020281 - DNA, 18 bp, Homo sapiens
cattgtttgtctgtcttc

SEQ ID NO: 4020282 - DNA, 12 bp, Homo sapiens
catttaaaaaaa

SEQ ID NO: 4020283 - DNA, 16 bp, Homo sapiens
catttaaaattgctat

SEQ ID NO: 4020284 - DNA, 18 bp, Homo sapiens
catttaaatgtaacttat

SEQ ID NO: 4020285 - DNA, 16 bp, Homo sapiens
catttaaatgtgtaca

SEQ ID NO: 4020286 - DNA, 14 bp, Homo sapiens
catttaataaagaa

SEQ ID NO: 4020287 - DNA, 15 bp, Homo sapiens
catttaataaagaaa

SEQ ID NO: 4020288 - DNA, 17 bp, Homo sapiens
catttaataaagaaata

SEQ ID NO: 4020289 - DNA, 21 bp, Homo sapiens
catttaatggcagctagtgcc

SEQ ID NO: 4020290 - DNA, 12 bp, Homo sapiens
catttaatttag

SEQ ID NO: 4020291 - DNA, 15 bp, Homo sapiens
catttactaaacata

SEQ ID NO: 4020292 - DNA, 17 bp, Homo sapiens
catttactaaacatatg

SEQ ID NO: 4020293 - DNA, 21 bp, Homo sapiens
catttactaaacatatgattt

SEQ ID NO: 4020294 - DNA, 18 bp, Homo sapiens
catttactctaaaaactg

SEQ ID NO: 4020295 - DNA, 15 bp, Homo sapiens
catttagaaaataga

SEQ ID NO: 4020296 - DNA, 12 bp, Homo sapiens
catttagaactt

SEQ ID NO: 4020297 - DNA, 22 bp, Homo sapiens
catttagctaaacggattccaa

SEQ ID NO: 4020298 - DNA, 15 bp, Homo sapiens
catttagtcatgtga

SEQ ID NO: 4020299 - DNA, 20 bp, Homo sapiens
catttataaccccagcctga

SEQ ID NO: 4020300 - DNA, 17 bp, Homo sapiens
catttataattgcatct

SEQ ID NO: 4020301 - DNA, 17 bp, Homo sapiens
catttatacaaattaga

SEQ ID NO: 4020302 - DNA, 20 bp, Homo sapiens
catttatacaaattagaaaa

SEQ ID NO: 4020303 - DNA, 12 bp, Homo sapiens
catttatatatg

SEQ ID NO: 4020304 - DNA, 20 bp, Homo sapiens
catttatatatgaaaactat

SEQ ID NO: 4020305 - DNA, 13 bp, Homo sapiens
catttatatgtac

SEQ ID NO: 4020306 - DNA, 18 bp, Homo sapiens
catttatccacaggaaag

SEQ ID NO: 4020307 - DNA, 23 bp, Homo sapiens
catttatgagtaactattattat

SEQ ID NO: 4020308 - DNA, 18 bp, Homo sapiens
catttatgatttaataaa

SEQ ID NO: 4020309 - DNA, 20 bp, Homo sapiens
catttatggtcaacacttaa

SEQ ID NO: 4020310 - DNA, 18 bp, Homo sapiens
catttattgtttatgtaa

SEQ ID NO: 4020311 - DNA, 23 bp, Homo sapiens
catttatttatacagtgccttgc

SEQ ID NO: 4020312 - DNA, 15 bp, Homo sapiens
catttatttattact

SEQ ID NO: 4020313 - DNA, 15 bp, Homo sapiens
catttcaagcagctg

SEQ ID NO: 4020314 - DNA, 17 bp, Homo sapiens
catttcatcattgtttc

SEQ ID NO: 4020315 - DNA, 12 bp, Homo sapiens
catttcattcca

SEQ ID NO: 4020316 - DNA, 18 bp, Homo sapiens
catttccaacaccacaga

SEQ ID NO: 4020317 - DNA, 19 bp, Homo sapiens
catttccaacaccacagac

SEQ ID NO: 4020318 - DNA, 18 bp, Homo sapiens
catttccaagaggctgta

SEQ ID NO: 4020319 - DNA, 13 bp, Homo sapiens
catttccagctgt

SEQ ID NO: 4020320 - DNA, 15 bp, Homo sapiens
catttcccccaaagg

SEQ ID NO: 4020321 - DNA, 21 bp, Homo sapiens
catttcccccgagctcttggc

SEQ ID NO: 4020322 - DNA, 15 bp, Homo sapiens
catttcccctccttc

SEQ ID NO: 4020323 - DNA, 13 bp, Homo sapiens
catttcctgacag

SEQ ID NO: 4020324 - DNA, 12 bp, Homo sapiens
catttccttgga

SEQ ID NO: 4020325 - DNA, 16 bp, Homo sapiens
catttccttggaggcc

SEQ ID NO: 4020326 - DNA, 20 bp, Homo sapiens
catttccttttctctgccct

SEQ ID NO: 4020327 - DNA, 12 bp, Homo sapiens
catttctattaa

SEQ ID NO: 4020328 - DNA, 18 bp, Homo sapiens
catttctatttatttact

SEQ ID NO: 4020329 - DNA, 23 bp, Homo sapiens
catttctatttatttactgagct

SEQ ID NO: 4020330 - DNA, 17 bp, Homo sapiens
catttctgaatagaaat

SEQ ID NO: 4020331 - DNA, 17 bp, Homo sapiens
catttctgatcagaggt

SEQ ID NO: 4020332 - DNA, 18 bp, Homo sapiens
catttctgatcagaggtg

SEQ ID NO: 4020333 - DNA, 12 bp, Homo sapiens
catttctgcctc

SEQ ID NO: 4020334 - DNA, 18 bp, Homo sapiens
catttctgccttttgttc

SEQ ID NO: 4020335 - DNA, 17 bp, Homo sapiens
catttctgctctcagct

SEQ ID NO: 4020336 - DNA, 22 bp, Homo sapiens
catttctgctctcagctccggg

SEQ ID NO: 4020337 - DNA, 22 bp, Homo sapiens
catttcttacgttctttcactt

SEQ ID NO: 4020338 - DNA, 22 bp, Homo sapiens
catttcttcagtcagaaaactt

SEQ ID NO: 4020339 - DNA, 13 bp, Homo sapiens
catttcttcctca

SEQ ID NO: 4020340 - DNA, 19 bp, Homo sapiens
catttcttttctttttaca

SEQ ID NO: 4020341 - DNA, 21 bp, Homo sapiens
catttcttttctttttacata

SEQ ID NO: 4020342 - DNA, 18 bp, Homo sapiens
catttgaagtgtacctgt

SEQ ID NO: 4020343 - DNA, 15 bp, Homo sapiens
catttgagagaagcc

SEQ ID NO: 4020344 - DNA, 16 bp, Homo sapiens
catttgagagaagcca

SEQ ID NO: 4020345 - DNA, 15 bp, Homo sapiens
ccagaagcctctggc

SEQ ID NO: 4020346 - DNA, 16 bp, Homo sapiens
ccagaagtagctttgc

SEQ ID NO: 4020347 - DNA, 17 bp, Homo sapiens
ccagaagtagctttgca

SEQ ID NO: 4020348 - DNA, 19 bp, Homo sapiens
ccagaatcttgactttctg

SEQ ID NO: 4020349 - DNA, 20 bp, Homo sapiens
ccagaatcttgactttctga

SEQ ID NO: 4020350 - DNA, 15 bp, Homo sapiens
ccagaatggagcctg

SEQ ID NO: 4020351 - DNA, 13 bp, Homo sapiens
ccagacacccagg

SEQ ID NO: 4020352 - DNA, 16 bp, Homo sapiens
ccagacacccaggact

SEQ ID NO: 4020353 - DNA, 11 bp, Homo sapiens
ccagacagacc

SEQ ID NO: 4020354 - DNA, 15 bp, Homo sapiens
ccagacatcaccctt

SEQ ID NO: 4020355 - DNA, 17 bp, Homo sapiens
ccagacccctctggcca

SEQ ID NO: 4020356 - DNA, 20 bp, Homo sapiens
ccagacccctctggccagga

SEQ ID NO: 4020357 - DNA, 14 bp, Homo sapiens
ccagacccctggct

SEQ ID NO: 4020358 - DNA, 14 bp, Homo sapiens
ccagacccttcttg

SEQ ID NO: 4020359 - DNA, 19 bp, Homo sapiens
ccagacccttcttgcctgc

SEQ ID NO: 4020360 - DNA, 15 bp, Homo sapiens
ccagacctgatcctg

SEQ ID NO: 4020361 - DNA, 17 bp, Homo sapiens
ccagacctgatcctgga

SEQ ID NO: 4020362 - DNA, 24 bp, Homo sapiens
ccagacctgatcctggaggcccag

SEQ ID NO: 4020363 - DNA, 13 bp, Homo sapiens
ccagacctggctc

SEQ ID NO: 4020364 - DNA, 22 bp, Homo sapiens
ccagactaaaggatccagagag

SEQ ID NO: 4020365 - DNA, 14 bp, Homo sapiens
ccagactacagggc

SEQ ID NO: 4020366 - DNA, 17 bp, Homo sapiens
ccagactactattttct

SEQ ID NO: 4020367 - DNA, 22 bp, Homo sapiens
ccagactctgagctgctcaccg

SEQ ID NO: 4020368 - DNA, 20 bp, Homo sapiens
ccagagaaaggggagcccac

SEQ ID NO: 4020369 - DNA, 17 bp, Homo sapiens
ccagagacatacttgaa

SEQ ID NO: 4020370 - DNA, 20 bp, Homo sapiens
ccagagacccaacagcagtg

SEQ ID NO: 4020371 - DNA, 14 bp, Homo sapiens
ccagagacgcccag

SEQ ID NO: 4020372 - DNA, 16 bp, Homo sapiens
ccagagacgcccagcc

SEQ ID NO: 4020373 - DNA, 14 bp, Homo sapiens
ccagagagaggatg

SEQ ID NO: 4020374 - DNA, 15 bp, Homo sapiens
ccagagagcagctcc

SEQ ID NO: 4020375 - DNA, 21 bp, Homo sapiens
ccagagagcctggtgctgctg

SEQ ID NO: 4020376 - DNA, 22 bp, Homo sapiens
ccagagagcctggtgctgctgc

SEQ ID NO: 4020377 - DNA, 14 bp, Homo sapiens
ccagagagtggctc

SEQ ID NO: 4020378 - DNA, 16 bp, Homo sapiens
ccagagcaacctctca

SEQ ID NO: 4020379 - DNA, 23 bp, Homo sapiens
ccagagcaccccctgctccacca

SEQ ID NO: 4020380 - DNA, 15 bp, Homo sapiens
ccagagcagatgcag

SEQ ID NO: 4020381 - DNA, 17 bp, Homo sapiens
ccagagcagatgcagag

SEQ ID NO: 4020382 - DNA, 23 bp, Homo sapiens
ccagagcagatgcagagagccat

SEQ ID NO: 4020383 - DNA, 15 bp, Homo sapiens
ccagagcaggaagca

SEQ ID NO: 4020384 - DNA, 20 bp, Homo sapiens
ccagagcagtttcatctggt

SEQ ID NO: 4020385 - DNA, 20 bp, Homo sapiens
ccagagcattacgtgagcca

SEQ ID NO: 4020386 - DNA, 21 bp, Homo sapiens
ccagagcattacgtgagccag

SEQ ID NO: 4020387 - DNA, 23 bp, Homo sapiens
ccagagcattacgtgagccaggt

SEQ ID NO: 4020388 - DNA, 18 bp, Homo sapiens
ccagagcattccagtcag

SEQ ID NO: 4020389 - DNA, 21 bp, Homo sapiens
ccagagcattccagtcaggct

SEQ ID NO: 4020390 - DNA, 18 bp, Homo sapiens
ccagagcatttccaacac

SEQ ID NO: 4020391 - DNA, 18 bp, Homo sapiens
ccagagccacctggatct

SEQ ID NO: 4020392 - DNA, 12 bp, Homo sapiens
ccagagccagat

SEQ ID NO: 4020393 - DNA, 20 bp, Homo sapiens
ccagagccagatgcaggaca

SEQ ID NO: 4020394 - DNA, 22 bp, Homo sapiens
ccagagccaggggggtgaggag

SEQ ID NO: 4020395 - DNA, 11 bp, Homo sapiens
ccagagcccag

SEQ ID NO: 4020396 - DNA, 12 bp, Homo sapiens
ccagagcccagc

SEQ ID NO: 4020397 - DNA, 16 bp, Homo sapiens
ccagagcccagctcca

SEQ ID NO: 4020398 - DNA, 17 bp, Homo sapiens
ccagagcccagctccaa

SEQ ID NO: 4020399 - DNA, 16 bp, Homo sapiens
ccagagcccatgctca

SEQ ID NO: 4020400 - DNA, 10 bp, Homo sapiens
ccagagcccc

SEQ ID NO: 4020401 - DNA, 14 bp, Homo sapiens
ccagagccccaagc

SEQ ID NO: 4020402 - DNA, 17 bp, Homo sapiens
ccagagccccaagcagg

SEQ ID NO: 4020403 - DNA, 21 bp, Homo sapiens
ccagagccccccacaatgatg

SEQ ID NO: 4020404 - DNA, 21 bp, Homo sapiens
ccagagcccctcctccagccc

SEQ ID NO: 4020405 - DNA, 21 bp, Homo sapiens
ccagagcctggctgcccatca

SEQ ID NO: 4020406 - DNA, 22 bp, Homo sapiens
ccagagcggaggctgtgtgcct

SEQ ID NO: 4020407 - DNA, 13 bp, Homo sapiens
ccagagctgccag

SEQ ID NO: 4020408 - DNA, 20 bp, Homo sapiens
ccagagctgtttatggcctc

SEQ ID NO: 4020409 - DNA, 16 bp, Homo sapiens
ccagaggagggcagag

SEQ ID NO: 4020410 - DNA, 12 bp, Homo sapiens
ccagaggcaggc

SEQ ID NO: 4020411 - DNA, 20 bp, Homo sapiens
ccagaggccgaaggtgcctc

SEQ ID NO: 4020412 - DNA, 18 bp, Homo sapiens
ccagaggctgggagtccc

SEQ ID NO: 4020413 - DNA, 13 bp, Homo sapiens
ccagagggagcag

SEQ ID NO: 4020414 - DNA, 13 bp, Homo sapiens
ccagagggcagtg

SEQ ID NO: 4020415 - DNA, 14 bp, Homo sapiens
ccagaggggaagga

SEQ ID NO: 4020416 - DNA, 17 bp, Homo sapiens
ccagagggtgtggcttt

SEQ ID NO: 4020417 - DNA, 21 bp, Homo sapiens
ccagagggtgtggctttccag

SEQ ID NO: 4020418 - DNA, 21 bp, Homo sapiens
ccagaggtaacagaacagctt

SEQ ID NO: 4020419 - DNA, 19 bp, Homo sapiens
ccagaggtgggatcctccc

SEQ ID NO: 4020420 - DNA, 21 bp, Homo sapiens
ccagaggtgggatcctccctc

SEQ ID NO: 4020421 - DNA, 22 bp, Homo sapiens
ccagagtctagcgtagtgcagc

SEQ ID NO: 4020422 - DNA, 14 bp, Homo sapiens
ccagagtggcccac

SEQ ID NO: 4020423 - DNA, 14 bp, Homo sapiens
ccagagtggcctgg

SEQ ID NO: 4020424 - DNA, 17 bp, Homo sapiens
ccagagtggcctggcca

SEQ ID NO: 4020425 - DNA, 16 bp, Homo sapiens
ccagataaatagaact

SEQ ID NO: 4020426 - DNA, 17 bp, Homo sapiens
ccagataaatagaacta

SEQ ID NO: 4020427 - DNA, 20 bp, Homo sapiens
ccagataaatagaactatct

SEQ ID NO: 4020428 - DNA, 21 bp, Homo sapiens
ccagatacttcccattttgga

SEQ ID NO: 4020429 - DNA, 14 bp, Homo sapiens
ccagatagagaaat

SEQ ID NO: 4020430 - DNA, 18 bp, Homo sapiens
ccagatagagctgggtgg

SEQ ID NO: 4020431 - DNA, 21 bp, Homo sapiens
ccagatcaccagcccggcctg

SEQ ID NO: 4020432 - DNA, 13 bp, Homo sapiens
ccagatcagtcag

SEQ ID NO: 4020433 - DNA, 13 bp, Homo sapiens
ccagatccagcct

SEQ ID NO: 4020434 - DNA, 13 bp, Homo sapiens
ccagatcctgggt

SEQ ID NO: 4020435 - DNA, 12 bp, Homo sapiens
ccagatctccca

SEQ ID NO: 4020436 - DNA, 19 bp, Homo sapiens
ccagatctggtcccttgca

SEQ ID NO: 4020437 - DNA, 18 bp, Homo sapiens
ccagatgcaggacaggag

SEQ ID NO: 4020438 - DNA, 22 bp, Homo sapiens
ccagatgcaggacaggaggcgg

SEQ ID NO: 4020439 - DNA, 18 bp, Homo sapiens
ccagatgcagggcagtca

SEQ ID NO: 4020440 - DNA, 23 bp, Homo sapiens
ccagatggcccggatgctgcttc

SEQ ID NO: 4020441 - DNA, 18 bp, Homo sapiens
ccagatgtgacagtgttg

SEQ ID NO: 4020442 - DNA, 21 bp, Homo sapiens
ccagatgtgtcccccccaggc

SEQ ID NO: 4020443 - DNA, 18 bp, Homo sapiens
ccagattattggctgctt

SEQ ID NO: 4020444 - DNA, 23 bp, Homo sapiens
ccaggatggcccttcccactgga

SEQ ID NO: 4020445 - DNA, 20 bp, Homo sapiens
ccaggattattgtcaaagaa

SEQ ID NO: 4020446 - DNA, 17 bp, Homo sapiens
ccaggattgaagagcat

SEQ ID NO: 4020447 - DNA, 13 bp, Homo sapiens
ccaggatttctaa

SEQ ID NO: 4020448 - DNA, 15 bp, Homo sapiens
ccaggcacacacagc

SEQ ID NO: 4020449 - DNA, 16 bp, Homo sapiens
ccaggcacacacagcc

SEQ ID NO: 4020450 - DNA, 17 bp, Homo sapiens
ccaggcacacacagccc

SEQ ID NO: 4020451 - DNA, 13 bp, Homo sapiens
cagcgggcaggtt

SEQ ID NO: 4020452 - DNA, 20 bp, Homo sapiens
cagcgggcaggttctgcctg

SEQ ID NO: 4020453 - DNA, 12 bp, Homo sapiens
cagcgggccagg

SEQ ID NO: 4020454 - DNA, 17 bp, Homo sapiens
cagcgtaaaatggtgaa

SEQ ID NO: 4020455 - DNA, 21 bp, Homo sapiens
cagcgtcccagtctctggcag

SEQ ID NO: 4020456 - DNA, 13 bp, Homo sapiens
cagcgtccctggc

SEQ ID NO: 4020457 - DNA, 19 bp, Homo sapiens
cagctaatctgtagggctg

SEQ ID NO: 4020458 - DNA, 15 bp, Homo sapiens
cagctacagctttct

SEQ ID NO: 4020459 - DNA, 20 bp, Homo sapiens
cagctacagctttcttgctc

SEQ ID NO: 4020460 - DNA, 18 bp, Homo sapiens
cagctacccactatcctt

SEQ ID NO: 4020461 - DNA, 23 bp, Homo sapiens
cagctaccccttctttgcagggc

SEQ ID NO: 4020462 - DNA, 21 bp, Homo sapiens
cagctaccctttttctccagc

SEQ ID NO: 4020463 - DNA, 24 bp, Homo sapiens
cagctaccctttttctccagctgg

SEQ ID NO: 4020464 - DNA, 12 bp, Homo sapiens
cagctacctgag

SEQ ID NO: 4020465 - DNA, 13 bp, Homo sapiens
cagctacctgaga

SEQ ID NO: 4020466 - DNA, 20 bp, Homo sapiens
cagctactaaggtgctagga

SEQ ID NO: 4020467 - DNA, 23 bp, Homo sapiens
cagctactctccccacgagggct

SEQ ID NO: 4020468 - DNA, 15 bp, Homo sapiens
cagctacttgggaag

SEQ ID NO: 4020469 - DNA, 16 bp, Homo sapiens
cagctacttgggaggc

SEQ ID NO: 4020470 - DNA, 17 bp, Homo sapiens
cagctacttggtttgtg

SEQ ID NO: 4020471 - DNA, 16 bp, Homo sapiens
cagctaggaagagcag

SEQ ID NO: 4020472 - DNA, 20 bp, Homo sapiens
cagctaggaagagcaggact

SEQ ID NO: 4020473 - DNA, 20 bp, Homo sapiens
cagctagtgaagaccagagc

SEQ ID NO: 4020474 - DNA, 17 bp, Homo sapiens
cagctatctgcactcta

SEQ ID NO: 4020475 - DNA, 22 bp, Homo sapiens
cagctatctgtcatctctctgg

SEQ ID NO: 4020476 - DNA, 13 bp, Homo sapiens
cagctatgggagc

SEQ ID NO: 4020477 - DNA, 21 bp, Homo sapiens
cagctatgggagccccagggt

SEQ ID NO: 4020478 - DNA, 16 bp, Homo sapiens
cagctcaatggactgg

SEQ ID NO: 4020479 - DNA, 13 bp, Homo sapiens
cagctcacagtgc

SEQ ID NO: 4020480 - DNA, 14 bp, Homo sapiens
cagctcacccctgg

SEQ ID NO: 4020481 - DNA, 18 bp, Homo sapiens
cagctcacccctgggcag

SEQ ID NO: 4020482 - DNA, 19 bp, Homo sapiens
cagctcacccctgggcagg

SEQ ID NO: 4020483 - DNA, 17 bp, Homo sapiens
cagctcagaggcccagg

SEQ ID NO: 4020484 - DNA, 18 bp, Homo sapiens
cagctcagaggcccagga

SEQ ID NO: 4020485 - DNA, 11 bp, Homo sapiens
cagctcagcgc

SEQ ID NO: 4020486 - DNA, 13 bp, Homo sapiens
cagctcagcgcca

SEQ ID NO: 4020487 - DNA, 18 bp, Homo sapiens
cagctcagcgccagcctg

SEQ ID NO: 4020488 - DNA, 13 bp, Homo sapiens
cagctcaggacag

SEQ ID NO: 4020489 - DNA, 16 bp, Homo sapiens
cagctcaggacagatg

SEQ ID NO: 4020490 - DNA, 13 bp, Homo sapiens
cagctcatctcca

SEQ ID NO: 4020491 - DNA, 20 bp, Homo sapiens
cagctccaacctgcaaagat

SEQ ID NO: 4020492 - DNA, 14 bp, Homo sapiens
cagctccaggggcc

SEQ ID NO: 4020493 - DNA, 14 bp, Homo sapiens
cagctccattttct

SEQ ID NO: 4020494 - DNA, 14 bp, Homo sapiens
cagctcccccagct

SEQ ID NO: 4020495 - DNA, 16 bp, Homo sapiens
cagctcccccaggctg

SEQ ID NO: 4020496 - DNA, 13 bp, Homo sapiens
cagctccctagac

SEQ ID NO: 4020497 - DNA, 16 bp, Homo sapiens
cagctccctagactgc

SEQ ID NO: 4020498 - DNA, 15 bp, Homo sapiens
cagctccctaggaga

SEQ ID NO: 4020499 - DNA, 14 bp, Homo sapiens
cagctcccttctgt

SEQ ID NO: 4020500 - DNA, 16 bp, Homo sapiens
cagctccctttctcag

SEQ ID NO: 4020501 - DNA, 20 bp, Homo sapiens
cagctccctttctcaggagc

SEQ ID NO: 4020502 - DNA, 21 bp, Homo sapiens
cagctccctttctcaggagct

SEQ ID NO: 4020503 - DNA, 21 bp, Homo sapiens
cagctccggcctgtcctccaa

SEQ ID NO: 4020504 - DNA, 21 bp, Homo sapiens
cagctcctacctctgtgccag

SEQ ID NO: 4020505 - DNA, 14 bp, Homo sapiens
cagctcctcccaca

SEQ ID NO: 4020506 - DNA, 15 bp, Homo sapiens
cagctcctgtaacat

SEQ ID NO: 4020507 - DNA, 13 bp, Homo sapiens
cagctccttttcc

SEQ ID NO: 4020508 - DNA, 19 bp, Homo sapiens
cagctcgaattaagaatat

SEQ ID NO: 4020509 - DNA, 16 bp, Homo sapiens
cagctctaataaaaca

SEQ ID NO: 4020510 - DNA, 19 bp, Homo sapiens
cagctctcatgctgcccct

SEQ ID NO: 4020511 - DNA, 23 bp, Homo sapiens
cagctctcatgctgcccctgcct

SEQ ID NO: 4020512 - DNA, 14 bp, Homo sapiens
cagctctctgccct

SEQ ID NO: 4020513 - DNA, 20 bp, Homo sapiens
cagctctctgggacctcctt

SEQ ID NO: 4020514 - DNA, 22 bp, Homo sapiens
cagctctgagacccttttctca

SEQ ID NO: 4020515 - DNA, 22 bp, Homo sapiens
cagctctgggccattctccaca

SEQ ID NO: 4020516 - DNA, 15 bp, Homo sapiens
cagctcttaaatgta

SEQ ID NO: 4020517 - DNA, 12 bp, Homo sapiens
cagctcttcctg

SEQ ID NO: 4020518 - DNA, 20 bp, Homo sapiens
cagctgaagaaaaaatcaga

SEQ ID NO: 4020519 - DNA, 21 bp, Homo sapiens
cagctgaagaaaaaatcagaa

SEQ ID NO: 4020520 - DNA, 17 bp, Homo sapiens
cagctgaatgcctcctg

SEQ ID NO: 4020521 - DNA, 20 bp, Homo sapiens
cagctgaatgcctcctgtgg

SEQ ID NO: 4020522 - DNA, 23 bp, Homo sapiens
cagctgaatgcctcctgtgggga

SEQ ID NO: 4020523 - DNA, 17 bp, Homo sapiens
cagctgacccggcctct

SEQ ID NO: 4020524 - DNA, 13 bp, Homo sapiens
cagctgactgtgg

SEQ ID NO: 4020525 - DNA, 22 bp, Homo sapiens
cagctgagcacttagcaggcac

SEQ ID NO: 4020526 - DNA, 15 bp, Homo sapiens
cagctgagccctggg

SEQ ID NO: 4020527 - DNA, 13 bp, Homo sapiens
cagctgagcctga

SEQ ID NO: 4020528 - DNA, 18 bp, Homo sapiens
cagctgagccttctgagc

SEQ ID NO: 4020529 - DNA, 18 bp, Homo sapiens
cagctgagcgccaggatg

SEQ ID NO: 4020530 - DNA, 19 bp, Homo sapiens
cagctgaggacacacccca

SEQ ID NO: 4020531 - DNA, 20 bp, Homo sapiens
cagctgaggtctcttgaggg

SEQ ID NO: 4020532 - DNA, 15 bp, Homo sapiens
cagctgattttaaca

SEQ ID NO: 4020533 - DNA, 14 bp, Homo sapiens
cagctgcaccagag

SEQ ID NO: 4020534 - DNA, 14 bp, Homo sapiens
cagctgcagcccct

SEQ ID NO: 4020535 - DNA, 19 bp, Homo sapiens
cagctgccctagctgaccc

SEQ ID NO: 4020536 - DNA, 15 bp, Homo sapiens
cagctgccctatggg

SEQ ID NO: 4020537 - DNA, 19 bp, Homo sapiens
cagctgccctatgggcctg

SEQ ID NO: 4020538 - DNA, 22 bp, Homo sapiens
cagctgccgggcctgatttggt

SEQ ID NO: 4020539 - DNA, 14 bp, Homo sapiens
cagctgcctcactt

SEQ ID NO: 4020540 - DNA, 17 bp, Homo sapiens
cagctgcctcacttcct

SEQ ID NO: 4020541 - DNA, 11 bp, Homo sapiens
cagctgcctgg

SEQ ID NO: 4020542 - DNA, 13 bp, Homo sapiens
cagctgcctggag

SEQ ID NO: 4020543 - DNA, 23 bp, Homo sapiens
cagctgctatccccatctccctg

SEQ ID NO: 4020544 - DNA, 13 bp, Homo sapiens
cagctgctgtctt

SEQ ID NO: 4020545 - DNA, 18 bp, Homo sapiens
cagctgctgttctcagga

SEQ ID NO: 4020546 - DNA, 14 bp, Homo sapiens
cagctgctttttgt

SEQ ID NO: 4020547 - DNA, 23 bp, Homo sapiens
cagctggactctgcatcccagca

SEQ ID NO: 4020548 - DNA, 17 bp, Homo sapiens
cagctggatctgcttgt

SEQ ID NO: 4020549 - DNA, 13 bp, Homo sapiens
cagctgggagcac

SEQ ID NO: 4020550 - DNA, 16 bp, Homo sapiens
cagctgggagcactgg

SEQ ID NO: 4020551 - DNA, 21 bp, Homo sapiens
cagctggggccagaggctggg

SEQ ID NO: 4020552 - DNA, 15 bp, Homo sapiens
cagctgggtcaggca

SEQ ID NO: 4020553 - DNA, 18 bp, Homo sapiens
cagctgggtcaggcaggg

SEQ ID NO: 4020554 - DNA, 14 bp, Homo sapiens
cagctggtccagac

SEQ ID NO: 4020555 - DNA, 18 bp, Homo sapiens
catagatgttttggtaga

SEQ ID NO: 4020556 - DNA, 14 bp, Homo sapiens
catagcaagacaca

SEQ ID NO: 4020557 - DNA, 15 bp, Homo sapiens
catagcaagacacat

SEQ ID NO: 4020558 - DNA, 20 bp, Homo sapiens
catagcaagacacatcccta

SEQ ID NO: 4020559 - DNA, 15 bp, Homo sapiens
catagcattaactaa

SEQ ID NO: 4020560 - DNA, 16 bp, Homo sapiens
catagcattaactaat

SEQ ID NO: 4020561 - DNA, 23 bp, Homo sapiens
catagcattaactaatctattgg

SEQ ID NO: 4020562 - DNA, 15 bp, Homo sapiens
catagccaggaaact

SEQ ID NO: 4020563 - DNA, 16 bp, Homo sapiens
catagctatcaagtgt

SEQ ID NO: 4020564 - DNA, 20 bp, Homo sapiens
catagctatcaagtgtgctt

SEQ ID NO: 4020565 - DNA, 17 bp, Homo sapiens
catagctcactgcagcc

SEQ ID NO: 4020566 - DNA, 21 bp, Homo sapiens
catagctccttggagcaggca

SEQ ID NO: 4020567 - DNA, 18 bp, Homo sapiens
catagcttattattgaag

SEQ ID NO: 4020568 - DNA, 13 bp, Homo sapiens
catagcttccatg

SEQ ID NO: 4020569 - DNA, 17 bp, Homo sapiens
cataggaggcttctgtt

SEQ ID NO: 4020570 - DNA, 18 bp, Homo sapiens
cataggcctgggtgctgg

SEQ ID NO: 4020571 - DNA, 19 bp, Homo sapiens
cataggcctgggtgctggc

SEQ ID NO: 4020572 - DNA, 17 bp, Homo sapiens
catagggtctcttcagg

SEQ ID NO: 4020573 - DNA, 18 bp, Homo sapiens
cataggtaagctgtgcct

SEQ ID NO: 4020574 - DNA, 16 bp, Homo sapiens
cataggtttctctccc

SEQ ID NO: 4020575 - DNA, 22 bp, Homo sapiens
catagtaacttcttatggaatt

SEQ ID NO: 4020576 - DNA, 23 bp, Homo sapiens
catagtaacttcttatggaattg

SEQ ID NO: 4020577 - DNA, 18 bp, Homo sapiens
catagtaccaatcatttt

SEQ ID NO: 4020578 - DNA, 16 bp, Homo sapiens
catagtaccatttata

SEQ ID NO: 4020579 - DNA, 22 bp, Homo sapiens
catagtaccatttatacaaatt

SEQ ID NO: 4020580 - DNA, 20 bp, Homo sapiens
catagtagtttttacagctg

SEQ ID NO: 4020581 - DNA, 15 bp, Homo sapiens
catagtattggagca

SEQ ID NO: 4020582 - DNA, 22 bp, Homo sapiens
catagtcacctgactaagaaat

SEQ ID NO: 4020583 - DNA, 23 bp, Homo sapiens
catagtcgggatgtcagcagaca

SEQ ID NO: 4020584 - DNA, 15 bp, Homo sapiens
catagttatgtgatt

SEQ ID NO: 4020585 - DNA, 18 bp, Homo sapiens
catagttctgaggtccct

SEQ ID NO: 4020586 - DNA, 18 bp, Homo sapiens
catagttttaaactcatt

SEQ ID NO: 4020587 - DNA, 19 bp, Homo sapiens
catagttttaaactcattt

SEQ ID NO: 4020588 - DNA, 19 bp, Homo sapiens
catataaacatcacacaca

SEQ ID NO: 4020589 - DNA, 20 bp, Homo sapiens
catataaacatcacacacac

SEQ ID NO: 4020590 - DNA, 18 bp, Homo sapiens
catataatgttgttattt

SEQ ID NO: 4020591 - DNA, 16 bp, Homo sapiens
catatactgattctgt

SEQ ID NO: 4020592 - DNA, 21 bp, Homo sapiens
catatactgttcttcatttta

SEQ ID NO: 4020593 - DNA, 19 bp, Homo sapiens
catatagccattgatcata

SEQ ID NO: 4020594 - DNA, 19 bp, Homo sapiens
catataggtgatgtttgct

SEQ ID NO: 4020595 - DNA, 19 bp, Homo sapiens
catatatgaccagaagcct

SEQ ID NO: 4020596 - DNA, 14 bp, Homo sapiens
catatatttattga

SEQ ID NO: 4020597 - DNA, 21 bp, Homo sapiens
catatcaattggcagtgactt

SEQ ID NO: 4020598 - DNA, 22 bp, Homo sapiens
catatcaattggcagtgacttt

SEQ ID NO: 4020599 - DNA, 23 bp, Homo sapiens
catatcctgagccatcggtgaaa

SEQ ID NO: 4020600 - DNA, 17 bp, Homo sapiens
catatcgctgacttcat

SEQ ID NO: 4020601 - DNA, 18 bp, Homo sapiens
catatcgctgacttcatg

SEQ ID NO: 4020602 - DNA, 18 bp, Homo sapiens
catatctccatggccctg

SEQ ID NO: 4020603 - DNA, 18 bp, Homo sapiens
catatgaaaatacaactt

SEQ ID NO: 4020604 - DNA, 13 bp, Homo sapiens
catatgaaatcct

SEQ ID NO: 4020605 - DNA, 15 bp, Homo sapiens
catatgaattgtaca

SEQ ID NO: 4020606 - DNA, 20 bp, Homo sapiens
catatgatttcactagaaaa

SEQ ID NO: 4020607 - DNA, 23 bp, Homo sapiens
catatgctgtatatcctttctaa

SEQ ID NO: 4020608 - DNA, 18 bp, Homo sapiens
catatggattttctattg

SEQ ID NO: 4020609 - DNA, 23 bp, Homo sapiens
catatggattttctattgttact

SEQ ID NO: 4020610 - DNA, 22 bp, Homo sapiens
catatgggatattcccaagccg

SEQ ID NO: 4020611 - DNA, 21 bp, Homo sapiens
catatgtaccatgtacatgaa

SEQ ID NO: 4020612 - DNA, 12 bp, Homo sapiens
catatgtagata

SEQ ID NO: 4020613 - DNA, 17 bp, Homo sapiens
catatgtattcctgatc

SEQ ID NO: 4020614 - DNA, 16 bp, Homo sapiens
catatgtcactagaat

SEQ ID NO: 4020615 - DNA, 20 bp, Homo sapiens
catattaagcactttaagct

SEQ ID NO: 4020616 - DNA, 20 bp, Homo sapiens
catattagaggggaaaagct

SEQ ID NO: 4020617 - DNA, 14 bp, Homo sapiens
catattatgcctga

SEQ ID NO: 4020618 - DNA, 20 bp, Homo sapiens
catattggtatatccttttc

SEQ ID NO: 4020619 - DNA, 19 bp, Homo sapiens
catattgttgcattgcttt

SEQ ID NO: 4020620 - DNA, 17 bp, Homo sapiens
catatttacattctagt

SEQ ID NO: 4020621 - DNA, 14 bp, Homo sapiens
catatttacttctt

SEQ ID NO: 4020622 - DNA, 20 bp, Homo sapiens
catatttacttcttatacat

SEQ ID NO: 4020623 - DNA, 21 bp, Homo sapiens
catatttatccaaaatgtgta

SEQ ID NO: 4020624 - DNA, 18 bp, Homo sapiens
catatttattttcttttg

SEQ ID NO: 4020625 - DNA, 11 bp, Homo sapiens
catcaaagagg

SEQ ID NO: 4020626 - DNA, 16 bp, Homo sapiens
catcaaccaccatgga

SEQ ID NO: 4020627 - DNA, 24 bp, Homo sapiens
catcaatatccctcttgtaagtca

SEQ ID NO: 4020628 - DNA, 19 bp, Homo sapiens
catcaatcaaataagtatt

SEQ ID NO: 4020629 - DNA, 11 bp, Homo sapiens
catcaatgttc

SEQ ID NO: 4020630 - DNA, 18 bp, Homo sapiens
catcaatgttcattgtaa

SEQ ID NO: 4020631 - DNA, 16 bp, Homo sapiens
catcacagcagcctcc

SEQ ID NO: 4020632 - DNA, 19 bp, Homo sapiens
catcaccctttgccttagc

SEQ ID NO: 4020633 - DNA, 18 bp, Homo sapiens
catcacgtaccccactgg

SEQ ID NO: 4020634 - DNA, 23 bp, Homo sapiens
catcacgtaccccactgggccag

SEQ ID NO: 4020635 - DNA, 12 bp, Homo sapiens
catcacttccct

SEQ ID NO: 4020636 - DNA, 20 bp, Homo sapiens
cagagtgctggcacttagta

SEQ ID NO: 4020637 - DNA, 14 bp, Homo sapiens
cagagtggcccacc

SEQ ID NO: 4020638 - DNA, 16 bp, Homo sapiens
cagagtggcctccctg

SEQ ID NO: 4020639 - DNA, 23 bp, Homo sapiens
cagagtggcctccctgctgtgcc

SEQ ID NO: 4020640 - DNA, 13 bp, Homo sapiens
cagagtggcctgg

SEQ ID NO: 4020641 - DNA, 21 bp, Homo sapiens
cagagtggcctggccaggagc

SEQ ID NO: 4020642 - DNA, 21 bp, Homo sapiens
cagagtggtctttctggagag

SEQ ID NO: 4020643 - DNA, 16 bp, Homo sapiens
cagagttcacaggagg

SEQ ID NO: 4020644 - DNA, 20 bp, Homo sapiens
cagagttcacaggaggccag

SEQ ID NO: 4020645 - DNA, 12 bp, Homo sapiens
cagagttcacta

SEQ ID NO: 4020646 - DNA, 19 bp, Homo sapiens
cagagttctgtgaagagga

SEQ ID NO: 4020647 - DNA, 20 bp, Homo sapiens
cagagttctgtgaagaggaa

SEQ ID NO: 4020648 - DNA, 22 bp, Homo sapiens
cagagttcttaaagtttaaagt

SEQ ID NO: 4020649 - DNA, 17 bp, Homo sapiens
cagagtttgccttcctt

SEQ ID NO: 4020650 - DNA, 19 bp, Homo sapiens
cagagtttgccttcctttc

SEQ ID NO: 4020651 - DNA, 14 bp, Homo sapiens
cagataaatagaac

SEQ ID NO: 4020652 - DNA, 15 bp, Homo sapiens
cagataaatagaact

SEQ ID NO: 4020653 - DNA, 17 bp, Homo sapiens
cagataacaatgcagca

SEQ ID NO: 4020654 - DNA, 20 bp, Homo sapiens
cagataacaatgcagcaagg

SEQ ID NO: 4020655 - DNA, 21 bp, Homo sapiens
cagataagaatgctggttttc

SEQ ID NO: 4020656 - DNA, 20 bp, Homo sapiens
cagataagacatatctctaa

SEQ ID NO: 4020657 - DNA, 20 bp, Homo sapiens
cagataagcaagagagatgt

SEQ ID NO: 4020658 - DNA, 19 bp, Homo sapiens
cagatacatcactgcttga

SEQ ID NO: 4020659 - DNA, 17 bp, Homo sapiens
cagatacatggttgtga

SEQ ID NO: 4020660 - DNA, 20 bp, Homo sapiens
cagatacgtagttgtgcttt

SEQ ID NO: 4020661 - DNA, 18 bp, Homo sapiens
cagatactggaagttttg

SEQ ID NO: 4020662 - DNA, 22 bp, Homo sapiens
cagatactggaagttttgcatt

SEQ ID NO: 4020663 - DNA, 16 bp, Homo sapiens
cagatagaatcaatca

SEQ ID NO: 4020664 - DNA, 23 bp, Homo sapiens
cagatatatttaagccttataaa

SEQ ID NO: 4020665 - DNA, 14 bp, Homo sapiens
cagatatatttttc

SEQ ID NO: 4020666 - DNA, 18 bp, Homo sapiens
cagatatatttttcacag

SEQ ID NO: 4020667 - DNA, 15 bp, Homo sapiens
cagatatcaaaattc

SEQ ID NO: 4020668 - DNA, 16 bp, Homo sapiens
cagatatcaaaattct

SEQ ID NO: 4020669 - DNA, 18 bp, Homo sapiens
cagatatgatatgtaaac

SEQ ID NO: 4020670 - DNA, 16 bp, Homo sapiens
cagatatttatatttt

SEQ ID NO: 4020671 - DNA, 22 bp, Homo sapiens
cagatatttatatttttatttt

SEQ ID NO: 4020672 - DNA, 15 bp, Homo sapiens
cagatattttttcag

SEQ ID NO: 4020673 - DNA, 21 bp, Homo sapiens
cagatcaccagcccggcctgc

SEQ ID NO: 4020674 - DNA, 13 bp, Homo sapiens
cagatccagcctg

SEQ ID NO: 4020675 - DNA, 14 bp, Homo sapiens
cagatcccatccat

SEQ ID NO: 4020676 - DNA, 14 bp, Homo sapiens
cagatcctcttggt

SEQ ID NO: 4020677 - DNA, 14 bp, Homo sapiens
cagatctcccactg

SEQ ID NO: 4020678 - DNA, 13 bp, Homo sapiens
cagatctgtgccc

SEQ ID NO: 4020679 - DNA, 14 bp, Homo sapiens
cagatctgtgcccc

SEQ ID NO: 4020680 - DNA, 20 bp, Homo sapiens
cagatgaaatgttctgttca

SEQ ID NO: 4020681 - DNA, 23 bp, Homo sapiens
cagatgaactctttctggcctgc

SEQ ID NO: 4020682 - DNA, 15 bp, Homo sapiens
cagatgaatgtattt

SEQ ID NO: 4020683 - DNA, 19 bp, Homo sapiens
cagatgaatgtatttattt

SEQ ID NO: 4020684 - DNA, 18 bp, Homo sapiens
cagatgacccctgcccag

SEQ ID NO: 4020685 - DNA, 19 bp, Homo sapiens
cagatgacccctgcccaga

SEQ ID NO: 4020686 - DNA, 15 bp, Homo sapiens
cagatgagcaaggac

SEQ ID NO: 4020687 - DNA, 17 bp, Homo sapiens
cagatgagcaaggacat

SEQ ID NO: 4020688 - DNA, 19 bp, Homo sapiens
cagatgagcaaggacattg

SEQ ID NO: 4020689 - DNA, 20 bp, Homo sapiens
cagatgagcagtcacactgt

SEQ ID NO: 4020690 - DNA, 22 bp, Homo sapiens
cagatgagcagtcacactgtta

SEQ ID NO: 4020691 - DNA, 19 bp, Homo sapiens
cagatgaggtgaaaaggcc

SEQ ID NO: 4020692 - DNA, 15 bp, Homo sapiens
cagatgatctctcca

SEQ ID NO: 4020693 - DNA, 22 bp, Homo sapiens
cagatgatgagaatttctaaaa

SEQ ID NO: 4020694 - DNA, 16 bp, Homo sapiens
cagatgcaacctcact

SEQ ID NO: 4020695 - DNA, 19 bp, Homo sapiens
cagatgcaacctcactatg

SEQ ID NO: 4020696 - DNA, 15 bp, Homo sapiens
cagatgcaatgtgct

SEQ ID NO: 4020697 - DNA, 20 bp, Homo sapiens
cagatgcagagagccatttt

SEQ ID NO: 4020698 - DNA, 15 bp, Homo sapiens
cagatgcagctcttc

SEQ ID NO: 4020699 - DNA, 23 bp, Homo sapiens
cagatgcagctcttcctggacag

SEQ ID NO: 4020700 - DNA, 16 bp, Homo sapiens
cagatgcaggacagga

SEQ ID NO: 4020701 - DNA, 21 bp, Homo sapiens
cagatgcaggacaggaggcgg

SEQ ID NO: 4020702 - DNA, 11 bp, Homo sapiens
cagatgccctt

SEQ ID NO: 4020703 - DNA, 15 bp, Homo sapiens
cagatgctaataaac

SEQ ID NO: 4020704 - DNA, 16 bp, Homo sapiens
catcgcacactggggc

SEQ ID NO: 4020705 - DNA, 23 bp, Homo sapiens
catcgcacactggggccccgggt

SEQ ID NO: 4020706 - DNA, 17 bp, Homo sapiens
catcgcaggagtctctg

SEQ ID NO: 4020707 - DNA, 23 bp, Homo sapiens
catcgcaggagtctctgccaccc

SEQ ID NO: 4020708 - DNA, 19 bp, Homo sapiens
catcggacaagacccccag

SEQ ID NO: 4020709 - DNA, 21 bp, Homo sapiens
catcggaggctgggcccctgg

SEQ ID NO: 4020710 - DNA, 20 bp, Homo sapiens
catcggccaagaatacttga

SEQ ID NO: 4020711 - DNA, 21 bp, Homo sapiens
catcggccaagaatacttgaa

SEQ ID NO: 4020712 - DNA, 19 bp, Homo sapiens
catcgggagcacccagagc

SEQ ID NO: 4020713 - DNA, 23 bp, Homo sapiens
catctaaaaatagacttaaatct

SEQ ID NO: 4020714 - DNA, 15 bp, Homo sapiens
catctacttaataaa

SEQ ID NO: 4020715 - DNA, 12 bp, Homo sapiens
catctagccagc

SEQ ID NO: 4020716 - DNA, 14 bp, Homo sapiens
catctatcgagttt

SEQ ID NO: 4020717 - DNA, 16 bp, Homo sapiens
catctatctcaatcct

SEQ ID NO: 4020718 - DNA, 18 bp, Homo sapiens
catctcagcctcctgagc

SEQ ID NO: 4020719 - DNA, 23 bp, Homo sapiens
catctcagcctcctgagcctgtg

SEQ ID NO: 4020720 - DNA, 20 bp, Homo sapiens
catctcaggacacttccgta

SEQ ID NO: 4020721 - DNA, 17 bp, Homo sapiens
catctcaggagatggag

SEQ ID NO: 4020722 - DNA, 15 bp, Homo sapiens
catctcaggggccag

SEQ ID NO: 4020723 - DNA, 19 bp, Homo sapiens
catctcatgaggggagagg

SEQ ID NO: 4020724 - DNA, 23 bp, Homo sapiens
catctcatgaggggagaggagac

SEQ ID NO: 4020725 - DNA, 20 bp, Homo sapiens
catctcatgtatcatctgga

SEQ ID NO: 4020726 - DNA, 16 bp, Homo sapiens
catctccatcagctgt

SEQ ID NO: 4020727 - DNA, 19 bp, Homo sapiens
catctccatcatatgcctg

SEQ ID NO: 4020728 - DNA, 15 bp, Homo sapiens
catctccctgcctgg

SEQ ID NO: 4020729 - DNA, 16 bp, Homo sapiens
catctcctgctcacca

SEQ ID NO: 4020730 - DNA, 19 bp, Homo sapiens
catctcctgctcaccacct

SEQ ID NO: 4020731 - DNA, 15 bp, Homo sapiens
catctctaccatcat

SEQ ID NO: 4020732 - DNA, 21 bp, Homo sapiens
catctctaccatcatccggtt

SEQ ID NO: 4020733 - DNA, 17 bp, Homo sapiens
catctctcatcctccag

SEQ ID NO: 4020734 - DNA, 16 bp, Homo sapiens
catctctctgcccaac

SEQ ID NO: 4020735 - DNA, 12 bp, Homo sapiens
catctctgaagg

SEQ ID NO: 4020736 - DNA, 15 bp, Homo sapiens
catctcttccccaga

SEQ ID NO: 4020737 - DNA, 17 bp, Homo sapiens
catctcttccccagaga

SEQ ID NO: 4020738 - DNA, 15 bp, Homo sapiens
catctcttctgcaag

SEQ ID NO: 4020739 - DNA, 20 bp, Homo sapiens
catctcttgaggccaggagt

SEQ ID NO: 4020740 - DNA, 14 bp, Homo sapiens
catctctttgtaca

SEQ ID NO: 4020741 - DNA, 22 bp, Homo sapiens
catctgaaacccacagatgtct

SEQ ID NO: 4020742 - DNA, 14 bp, Homo sapiens
catctgaaagtaga

SEQ ID NO: 4020743 - DNA, 18 bp, Homo sapiens
catctgagaggctctccg

SEQ ID NO: 4020744 - DNA, 12 bp, Homo sapiens
catctgcaaaag

SEQ ID NO: 4020745 - DNA, 20 bp, Homo sapiens
catctgcaaaaggcctcttg

SEQ ID NO: 4020746 - DNA, 22 bp, Homo sapiens
catctgcaaaaggcctcttgta

SEQ ID NO: 4020747 - DNA, 23 bp, Homo sapiens
catctgcaaaaggcctcttgtaa

SEQ ID NO: 4020748 - DNA, 21 bp, Homo sapiens
catctgcacacacctccgaga

SEQ ID NO: 4020749 - DNA, 22 bp, Homo sapiens
catctgcaccccttctctcctc

SEQ ID NO: 4020750 - DNA, 20 bp, Homo sapiens
catctgcattttcaccccac

SEQ ID NO: 4020751 - DNA, 14 bp, Homo sapiens
catctgccagacct

SEQ ID NO: 4020752 - DNA, 11 bp, Homo sapiens
catctgcccct

SEQ ID NO: 4020753 - DNA, 14 bp, Homo sapiens
catctgcccctccc

SEQ ID NO: 4020754 - DNA, 15 bp, Homo sapiens
catctgcccctcccc

SEQ ID NO: 4020755 - DNA, 19 bp, Homo sapiens
catctgcccctcccccaac

SEQ ID NO: 4020756 - DNA, 21 bp, Homo sapiens
catctgccggcccccaggaca

SEQ ID NO: 4020757 - DNA, 20 bp, Homo sapiens
catctgcctgttctgaggat

SEQ ID NO: 4020758 - DNA, 18 bp, Homo sapiens
catctgccttaaaaccaa

SEQ ID NO: 4020759 - DNA, 19 bp, Homo sapiens
catctgcgtgacaataaaa

SEQ ID NO: 4020760 - DNA, 23 bp, Homo sapiens
catctgcgtgacaataaaacatt

SEQ ID NO: 4020761 - DNA, 12 bp, Homo sapiens
catctgctaata

SEQ ID NO: 4020762 - DNA, 22 bp, Homo sapiens
catctggaagagctaggcaggg

SEQ ID NO: 4020763 - DNA, 23 bp, Homo sapiens
catctggataggagcctgctggt

SEQ ID NO: 4020764 - DNA, 20 bp, Homo sapiens
catctggctgtttagcagaa

SEQ ID NO: 4020765 - DNA, 21 bp, Homo sapiens
catctggctgtttagcagaac

SEQ ID NO: 4020766 - DNA, 15 bp, Homo sapiens
catctgggattccca

SEQ ID NO: 4020767 - DNA, 16 bp, Homo sapiens
catctgggctcctcca

SEQ ID NO: 4020768 - DNA, 21 bp, Homo sapiens
catctggggttggcaacagga

SEQ ID NO: 4020769 - DNA, 18 bp, Homo sapiens
catctgtataccctctgt

SEQ ID NO: 4020770 - DNA, 20 bp, Homo sapiens
catctgtataccctctgttt

SEQ ID NO: 4020771 - DNA, 14 bp, Homo sapiens
catctgtcaacagg

SEQ ID NO: 4020772 - DNA, 14 bp, Homo sapiens
catctgtccagctg

SEQ ID NO: 4020773 - DNA, 21 bp, Homo sapiens
catctgtccatggcctttcta

SEQ ID NO: 4020774 - DNA, 14 bp, Homo sapiens
catctgtgatggga

SEQ ID NO: 4020775 - DNA, 13 bp, Homo sapiens
catctgtgcaggg

SEQ ID NO: 4020776 - DNA, 16 bp, Homo sapiens
catcttcactgcaatt

SEQ ID NO: 4020777 - DNA, 15 bp, Homo sapiens
catcttcataatttg

SEQ ID NO: 4020778 - DNA, 17 bp, Homo sapiens
catcttctgtgaaatat

SEQ ID NO: 4020779 - DNA, 16 bp, Homo sapiens
catcttggagggacca

SEQ ID NO: 4020780 - DNA, 17 bp, Homo sapiens
catcttgtatacacata

SEQ ID NO: 4020781 - DNA, 17 bp, Homo sapiens
catctttatctgttctt

SEQ ID NO: 4020782 - DNA, 17 bp, Homo sapiens
catctttgccttgggct

SEQ ID NO: 4020783 - DNA, 17 bp, Homo sapiens
catctttgcgaaaagat

SEQ ID NO: 4020784 - DNA, 13 bp, Homo sapiens
catcttttacatt

SEQ ID NO: 4020785 - DNA, 23 bp, Homo sapiens
catgaaaaagcagctaccaggtg

SEQ ID NO: 4020786 - DNA, 22 bp, Homo sapiens
catgaaaacgttttattgtgtt

SEQ ID NO: 4020787 - DNA, 11 bp, Homo sapiens
catgaaaattt

SEQ ID NO: 4020788 - DNA, 14 bp, Homo sapiens
catgaaaattttaa

SEQ ID NO: 4020789 - DNA, 19 bp, Homo sapiens
catgaaaattttaaaaata

SEQ ID NO: 4020790 - DNA, 16 bp, Homo sapiens
catgaaagttttgcaa

SEQ ID NO: 4020791 - DNA, 12 bp, Homo sapiens
catgaagagaag

SEQ ID NO: 4020792 - DNA, 20 bp, Homo sapiens
catgaagagcttgtgtcctg

SEQ ID NO: 4020793 - DNA, 19 bp, Homo sapiens
catgaagcaacgataaaat

SEQ ID NO: 4020794 - DNA, 21 bp, Homo sapiens
catgaagtaaattatgtaact

SEQ ID NO: 4020795 - DNA, 16 bp, Homo sapiens
catgaatgcacactag

SEQ ID NO: 4020796 - DNA, 17 bp, Homo sapiens
catgaatgtatcaggaa

SEQ ID NO: 4020797 - DNA, 18 bp, Homo sapiens
catgaatgtatcaggaaa

SEQ ID NO: 4020798 - DNA, 13 bp, Homo sapiens
catgaattttaca

SEQ ID NO: 4020799 - DNA, 15 bp, Homo sapiens
catgaattttacatg

SEQ ID NO: 4020800 - DNA, 13 bp, Homo sapiens
catgacagcctgc

SEQ ID NO: 4020801 - DNA, 20 bp, Homo sapiens
catgacagcctgcagcagga

SEQ ID NO: 4020802 - DNA, 23 bp, Homo sapiens
catgacagttcattcagggccga

SEQ ID NO: 4020803 - DNA, 22 bp, Homo sapiens
catgacccccacccctctgcca

SEQ ID NO: 4020804 - DNA, 17 bp, Homo sapiens
catgacctgtgaccagc

SEQ ID NO: 4020805 - DNA, 18 bp, Homo sapiens
catgacctgtgaccagca

SEQ ID NO: 4020806 - DNA, 18 bp, Homo sapiens
catgactgcacccagctc

SEQ ID NO: 4020807 - DNA, 13 bp, Homo sapiens
catgaggagggtg

SEQ ID NO: 4020808 - DNA, 24 bp, Homo sapiens
catgaggcaatgtcaggaacagaa

SEQ ID NO: 4020809 - DNA, 19 bp, Homo sapiens
catgaggccatctcaggag

SEQ ID NO: 4020810 - DNA, 16 bp, Homo sapiens
catgagggacagggtc

SEQ ID NO: 4020811 - DNA, 15 bp, Homo sapiens
catgaggttctctct

SEQ ID NO: 4020812 - DNA, 21 bp, Homo sapiens
catgatcatagctcactgcag

SEQ ID NO: 4020813 - DNA, 20 bp, Homo sapiens
catgatggcaacagatctgg

SEQ ID NO: 4020814 - DNA, 18 bp, Homo sapiens
catgatgggaaaatattt

SEQ ID NO: 4020815 - DNA, 23 bp, Homo sapiens
catgatgggaaaatatttcctga

SEQ ID NO: 4020816 - DNA, 22 bp, Homo sapiens
catgatgggaatagggagacag

SEQ ID NO: 4020817 - DNA, 19 bp, Homo sapiens
catgatgttaaccagaata

SEQ ID NO: 4020818 - DNA, 22 bp, Homo sapiens
catgatgttaaccagaataaag

SEQ ID NO: 4020819 - DNA, 12 bp, Homo sapiens
catgattagcaa

SEQ ID NO: 4020820 - DNA, 16 bp, Homo sapiens
catgatttccttgaat

SEQ ID NO: 4020821 - DNA, 17 bp, Homo sapiens
catgatttccttgaatg

SEQ ID NO: 4020822 - DNA, 16 bp, Homo sapiens
catgcaaaatatgttt

SEQ ID NO: 4020823 - DNA, 17 bp, Homo sapiens
catgcaaaatatgttta

SEQ ID NO: 4020824 - DNA, 11 bp, Homo sapiens
catgcacacac

SEQ ID NO: 4020825 - DNA, 10 bp, Homo sapiens
catgcactgt

SEQ ID NO: 4020826 - DNA, 13 bp, Homo sapiens
catgcactgtgaa

SEQ ID NO: 4020827 - DNA, 19 bp, Homo sapiens
catgcagcccatgcccacc

SEQ ID NO: 4020828 - DNA, 15 bp, Homo sapiens
catgcataaaagggt

SEQ ID NO: 4020829 - DNA, 22 bp, Homo sapiens
catgcataaaagggtcaaacct

SEQ ID NO: 4020830 - DNA, 12 bp, Homo sapiens
catgcataaata

SEQ ID NO: 4020831 - DNA, 18 bp, Homo sapiens
catgcataaatatgcagt

SEQ ID NO: 4020832 - DNA, 17 bp, Homo sapiens
catgcattgttgaggtg

SEQ ID NO: 4020833 - DNA, 17 bp, Homo sapiens
catgcattgttggctat

SEQ ID NO: 4020834 - DNA, 19 bp, Homo sapiens
catgcattgttggctattt

SEQ ID NO: 4020835 - DNA, 21 bp, Homo sapiens
catgcattgttggctatttga

SEQ ID NO: 4020836 - DNA, 14 bp, Homo sapiens
catgcatttcaagc

SEQ ID NO: 4020837 - DNA, 16 bp, Homo sapiens
catgccaaccctgggc

SEQ ID NO: 4020838 - DNA, 20 bp, Homo sapiens
catgccaaccctgggctatt

SEQ ID NO: 4020839 - DNA, 15 bp, Homo sapiens
catgccaaggcctcc

SEQ ID NO: 4020840 - DNA, 17 bp, Homo sapiens
catgccacaaggacttc

SEQ ID NO: 4020841 - DNA, 17 bp, Homo sapiens
catgccacgttccacag

SEQ ID NO: 4020842 - DNA, 13 bp, Homo sapiens
catgccactgcct

SEQ ID NO: 4020843 - DNA, 19 bp, Homo sapiens
catgcccaccccctgccct

SEQ ID NO: 4020844 - DNA, 20 bp, Homo sapiens
catgcccaccccctgccctg

SEQ ID NO: 4020845 - DNA, 14 bp, Homo sapiens
catgcccacctgcc

SEQ ID NO: 4020846 - DNA, 21 bp, Homo sapiens
catgcccacctgcccatcaca

SEQ ID NO: 4020847 - DNA, 14 bp, Homo sapiens
catgcccctggctg

SEQ ID NO: 4020848 - DNA, 14 bp, Homo sapiens
catgccccttggct

SEQ ID NO: 4020849 - DNA, 15 bp, Homo sapiens
catgccccttggctg

SEQ ID NO: 4020850 - DNA, 13 bp, Homo sapiens
catgccctctctg

SEQ ID NO: 4020851 - DNA, 18 bp, Homo sapiens
catgccctctctgagtct

SEQ ID NO: 4020852 - DNA, 23 bp, Homo sapiens
catgccctctctgagtctggact

SEQ ID NO: 4020853 - DNA, 23 bp, Homo sapiens
catgccctgtgcaacctcttggc

SEQ ID NO: 4020854 - DNA, 18 bp, Homo sapiens
catgcctagcagagtgct

SEQ ID NO: 4020855 - DNA, 15 bp, Homo sapiens
catgcctgagggtgg

SEQ ID NO: 4020856 - DNA, 16 bp, Homo sapiens
catgcctgcgcctgct

SEQ ID NO: 4020857 - DNA, 19 bp, Homo sapiens
catgcctgcgcctgctgcc

SEQ ID NO: 4020858 - DNA, 24 bp, Homo sapiens
catgcctgcgcctgctgcctgctg

SEQ ID NO: 4020859 - DNA, 13 bp, Homo sapiens
catgcggtagcca

SEQ ID NO: 4020860 - DNA, 17 bp, Homo sapiens
catgcggtagccagcac

SEQ ID NO: 4020861 - DNA, 18 bp, Homo sapiens
catgcggtgggtgctgcc

SEQ ID NO: 4020862 - DNA, 13 bp, Homo sapiens
catgctcacctct

SEQ ID NO: 4020863 - DNA, 15 bp, Homo sapiens
catgctcacctctag

SEQ ID NO: 4020864 - DNA, 20 bp, Homo sapiens
catgctcagccctgactggt

SEQ ID NO: 4020865 - DNA, 14 bp, Homo sapiens
catgctccaaatat

SEQ ID NO: 4020866 - DNA, 15 bp, Homo sapiens
catgctcccctgtgc

SEQ ID NO: 4020867 - DNA, 16 bp, Homo sapiens
catgctcccctgtgcc

SEQ ID NO: 4020868 - DNA, 19 bp, Homo sapiens
catgctgggatttccaact

SEQ ID NO: 4020869 - DNA, 20 bp, Homo sapiens
catgctgggccactggggac

SEQ ID NO: 4020870 - DNA, 13 bp, Homo sapiens
catggaaaaatgg

SEQ ID NO: 4020871 - DNA, 16 bp, Homo sapiens
catggaataacatgta

SEQ ID NO: 4020872 - DNA, 21 bp, Homo sapiens
catggacaccccttatccagg

SEQ ID NO: 4020873 - DNA, 15 bp, Homo sapiens
catggacctaacatt

SEQ ID NO: 4020874 - DNA, 16 bp, Homo sapiens
catggacctaacattc

SEQ ID NO: 4020875 - DNA, 17 bp, Homo sapiens
catggacttgtatattt

SEQ ID NO: 4020876 - DNA, 22 bp, Homo sapiens
catggacttgtatatttgtaca

SEQ ID NO: 4020877 - DNA, 18 bp, Homo sapiens
catggagaaaatgggcgg

SEQ ID NO: 4020878 - DNA, 16 bp, Homo sapiens
catggagactcctgcc

SEQ ID NO: 4020879 - DNA, 20 bp, Homo sapiens
catggagactcctgccctgt

SEQ ID NO: 4020880 - DNA, 10 bp, Homo sapiens
catggagcca

SEQ ID NO: 4020881 - DNA, 15 bp, Homo sapiens
catggagctgtcatc

SEQ ID NO: 4020882 - DNA, 17 bp, Homo sapiens
catggaggtttgaagat

SEQ ID NO: 4020883 - DNA, 16 bp, Homo sapiens
catggagtatatgtca

SEQ ID NO: 4020884 - DNA, 17 bp, Homo sapiens
catggagtgtgtattgt

SEQ ID NO: 4020885 - DNA, 20 bp, Homo sapiens
catggattttggataaatca

SEQ ID NO: 4020886 - DNA, 12 bp, Homo sapiens
catggcagctgt

SEQ ID NO: 4020887 - DNA, 17 bp, Homo sapiens
catggcatagccccggc

SEQ ID NO: 4020888 - DNA, 13 bp, Homo sapiens
catggccaggtgg

SEQ ID NO: 4020889 - DNA, 14 bp, Homo sapiens
catggccaggtggc

SEQ ID NO: 4020890 - DNA, 16 bp, Homo sapiens
catggcccccaggggc

SEQ ID NO: 4020891 - DNA, 16 bp, Homo sapiens
catggcccctctgacc

SEQ ID NO: 4020892 - DNA, 17 bp, Homo sapiens
catggcccctctgacct

SEQ ID NO: 4020893 - DNA, 18 bp, Homo sapiens
catggccctgtcccaggc

SEQ ID NO: 4020894 - DNA, 21 bp, Homo sapiens
catggcctttctaataaactg

SEQ ID NO: 4020895 - DNA, 19 bp, Homo sapiens
catggcgaaaacatctcct

SEQ ID NO: 4020896 - DNA, 16 bp, Homo sapiens
catgggtccagggcct

SEQ ID NO: 4020897 - DNA, 17 bp, Homo sapiens
catggtcaaccctcagg

SEQ ID NO: 4020898 - DNA, 15 bp, Homo sapiens
catggtcacacactg

SEQ ID NO: 4020899 - DNA, 14 bp, Homo sapiens
catggtccattctc

SEQ ID NO: 4020900 - DNA, 19 bp, Homo sapiens
catggtgcagttgacagca

SEQ ID NO: 4020901 - DNA, 17 bp, Homo sapiens
catggtgccccaggacc

SEQ ID NO: 4020902 - DNA, 20 bp, Homo sapiens
catggtgccccaggaccagc

SEQ ID NO: 4020903 - DNA, 17 bp, Homo sapiens
catggtgcctgagaggc

SEQ ID NO: 4020904 - DNA, 21 bp, Homo sapiens
catggtgctagtgggccctct

SEQ ID NO: 4020905 - DNA, 13 bp, Homo sapiens
catggtgtaataa

SEQ ID NO: 4020906 - DNA, 14 bp, Homo sapiens
catggtgtaataag

SEQ ID NO: 4020907 - DNA, 19 bp, Homo sapiens
catggtgtaataagacata

SEQ ID NO: 4020908 - DNA, 22 bp, Homo sapiens
catggtgtaataagacataacg

SEQ ID NO: 4020909 - DNA, 15 bp, Homo sapiens
catggtgtggggggc

SEQ ID NO: 4020910 - DNA, 16 bp, Homo sapiens
catggtgtggggggct

SEQ ID NO: 4020911 - DNA, 13 bp, Homo sapiens
catggtgttgcgt

SEQ ID NO: 4020912 - DNA, 18 bp, Homo sapiens
catgtaaagaaatgtctt

SEQ ID NO: 4020913 - DNA, 21 bp, Homo sapiens
catgtaaatccccactgggac

SEQ ID NO: 4020914 - DNA, 17 bp, Homo sapiens
catgtaacacataaaca

SEQ ID NO: 4020915 - DNA, 18 bp, Homo sapiens
catgtaacacataaacaa

SEQ ID NO: 4020916 - DNA, 23 bp, Homo sapiens
catgtaatgttaatgttatatca

SEQ ID NO: 4020917 - DNA, 20 bp, Homo sapiens
catgtacatgaagaagctaa

SEQ ID NO: 4020918 - DNA, 22 bp, Homo sapiens
catgtactagttttagttttct

SEQ ID NO: 4020919 - DNA, 22 bp, Homo sapiens
catgtactgagccttgtaattc

SEQ ID NO: 4020920 - DNA, 14 bp, Homo sapiens
catgtactgtagtt

SEQ ID NO: 4020921 - DNA, 16 bp, Homo sapiens
catgtagactgtgcca

SEQ ID NO: 4020922 - DNA, 16 bp, Homo sapiens
catgtagagaaaagca

SEQ ID NO: 4020923 - DNA, 21 bp, Homo sapiens
catgtagccccctggcctctg

SEQ ID NO: 4020924 - DNA, 16 bp, Homo sapiens
catgtaggaccctgca

SEQ ID NO: 4020925 - DNA, 15 bp, Homo sapiens
catgtataaatgtga

SEQ ID NO: 4020926 - DNA, 16 bp, Homo sapiens
catgtataaatgtgat

SEQ ID NO: 4020927 - DNA, 17 bp, Homo sapiens
catgtatgttatgatat

SEQ ID NO: 4020928 - DNA, 22 bp, Homo sapiens
catgtatgttatgatattgttt

SEQ ID NO: 4020929 - DNA, 17 bp, Homo sapiens
catgtattgcacattgt

SEQ ID NO: 4020930 - DNA, 18 bp, Homo sapiens
catgtattgcacattgta

SEQ ID NO: 4020931 - DNA, 18 bp, Homo sapiens
catgtcaacttctggctc

SEQ ID NO: 4020932 - DNA, 20 bp, Homo sapiens
catgtcaccggtcagtgcct

SEQ ID NO: 4020933 - DNA, 14 bp, Homo sapiens
catgtcactgtggt

SEQ ID NO: 4020934 - DNA, 16 bp, Homo sapiens
catgtcactgtggtcc

SEQ ID NO: 4020935 - DNA, 19 bp, Homo sapiens
catgtccaaagaggctgcc

SEQ ID NO: 4020936 - DNA, 16 bp, Homo sapiens
catgtccctaccgagt

SEQ ID NO: 4020937 - DNA, 23 bp, Homo sapiens
catgtccctaccgagtctcttct

SEQ ID NO: 4020938 - DNA, 14 bp, Homo sapiens
catgtcctgctggc

SEQ ID NO: 4020939 - DNA, 19 bp, Homo sapiens
catgtcctttgcgcctgtg

SEQ ID NO: 4020940 - DNA, 16 bp, Homo sapiens
catgtctgcctggagt

SEQ ID NO: 4020941 - DNA, 23 bp, Homo sapiens
catgtctgcctggagtgctgtgc

SEQ ID NO: 4020942 - DNA, 21 bp, Homo sapiens
catgtctttctccaaagttat

SEQ ID NO: 4020943 - DNA, 12 bp, Homo sapiens
catgtgaaacct

SEQ ID NO: 4020944 - DNA, 18 bp, Homo sapiens
catgtgaaacctttttta

SEQ ID NO: 4020945 - DNA, 22 bp, Homo sapiens
catgtgaaaccttttttaagat

SEQ ID NO: 4020946 - DNA, 15 bp, Homo sapiens
catgtgaacccggga

SEQ ID NO: 4020947 - DNA, 14 bp, Homo sapiens
catgtgacatttat

SEQ ID NO: 4020948 - DNA, 16 bp, Homo sapiens
catgtgacatttatat

SEQ ID NO: 4020949 - DNA, 18 bp, Homo sapiens
catgtgaccactctgtct

SEQ ID NO: 4020950 - DNA, 18 bp, Homo sapiens
catgtgagctgctgccat

SEQ ID NO: 4020951 - DNA, 20 bp, Homo sapiens
catgtgagctgctgccatga

SEQ ID NO: 4020952 - DNA, 14 bp, Homo sapiens
catgtgaggaggaa

SEQ ID NO: 4020953 - DNA, 16 bp, Homo sapiens
catgtgaggaggaaaa

SEQ ID NO: 4020954 - DNA, 18 bp, Homo sapiens
catgtgaggaggaaaagg

SEQ ID NO: 4020955 - DNA, 21 bp, Homo sapiens
catgtgcaattgtgagggaca

SEQ ID NO: 4020956 - DNA, 18 bp, Homo sapiens
catgtgcacccggcctgg

SEQ ID NO: 4020957 - DNA, 22 bp, Homo sapiens
catgtgccagggcaatgatgaa

SEQ ID NO: 4020958 - DNA, 14 bp, Homo sapiens
catgtgccatctgt

SEQ ID NO: 4020959 - DNA, 19 bp, Homo sapiens
catgtgccatctgtacata

SEQ ID NO: 4020960 - DNA, 16 bp, Homo sapiens
catgtgccgaatgtgc

SEQ ID NO: 4020961 - DNA, 12 bp, Homo sapiens
catgtgcctttc

SEQ ID NO: 4020962 - DNA, 14 bp, Homo sapiens
catgtgcctttctt

SEQ ID NO: 4020963 - DNA, 17 bp, Homo sapiens
catgtgcctttctttgc

SEQ ID NO: 4020964 - DNA, 23 bp, Homo sapiens
catgtgctgtgaccatttataat

SEQ ID NO: 4020965 - DNA, 20 bp, Homo sapiens
catgtggcaaaatatggttt

SEQ ID NO: 4020966 - DNA, 21 bp, Homo sapiens
catgtggcttttttaaaaaag

SEQ ID NO: 4020967 - DNA, 20 bp, Homo sapiens
catgtgggtgagccagtgga

SEQ ID NO: 4020968 - DNA, 15 bp, Homo sapiens
catgtgtagcctatg

SEQ ID NO: 4020969 - DNA, 15 bp, Homo sapiens
catgtgtatgtgtct

SEQ ID NO: 4020970 - DNA, 22 bp, Homo sapiens
catgtgtcacttgtgctttgct

SEQ ID NO: 4020971 - DNA, 20 bp, Homo sapiens
catgtgtcccctcactctgt

SEQ ID NO: 4020972 - DNA, 16 bp, Homo sapiens
catgtgtgaacacata

SEQ ID NO: 4020973 - DNA, 12 bp, Homo sapiens
catgtgtggaag

SEQ ID NO: 4020974 - DNA, 13 bp, Homo sapiens
catgtgtggaagt

SEQ ID NO: 4020975 - DNA, 15 bp, Homo sapiens
catgttactcagtgt

SEQ ID NO: 4020976 - DNA, 22 bp, Homo sapiens
catgttactgcttcattttgga

SEQ ID NO: 4020977 - DNA, 22 bp, Homo sapiens
catgttctccattttcaagctg

SEQ ID NO: 4020978 - DNA, 12 bp, Homo sapiens
catgtttaatgg

SEQ ID NO: 4020979 - DNA, 19 bp, Homo sapiens
catgtttatttttcttgtc

SEQ ID NO: 4020980 - DNA, 23 bp, Homo sapiens
catgtttgatgtatctgagcagg

SEQ ID NO: 4020981 - DNA, 13 bp, Homo sapiens
cattaaacttttt

SEQ ID NO: 4020982 - DNA, 13 bp, Homo sapiens
cattaaattcaca

SEQ ID NO: 4020983 - DNA, 17 bp, Homo sapiens
cattaaattcacaaact

SEQ ID NO: 4020984 - DNA, 20 bp, Homo sapiens
cattaacagttttccatgaa

SEQ ID NO: 4020985 - DNA, 22 bp, Homo sapiens
cattaacagttttccatgaaaa

SEQ ID NO: 4020986 - DNA, 15 bp, Homo sapiens
tcaacgcctccccct

SEQ ID NO: 4020987 - DNA, 17 bp, Homo sapiens
tcaactctacccctgct

SEQ ID NO: 4020988 - DNA, 18 bp, Homo sapiens
tcaactctacccctgctc

SEQ ID NO: 4020989 - DNA, 14 bp, Homo sapiens
tcaactctgagccc

SEQ ID NO: 4020990 - DNA, 17 bp, Homo sapiens
tcaactctgagcccata

SEQ ID NO: 4020991 - DNA, 19 bp, Homo sapiens
tcaactgaggttcttggga

SEQ ID NO: 4020992 - DNA, 16 bp, Homo sapiens
tcaactggttgtatat

SEQ ID NO: 4020993 - DNA, 16 bp, Homo sapiens
tcaactgtcttcctca

SEQ ID NO: 4020994 - DNA, 16 bp, Homo sapiens
tcaacttctggctcct

SEQ ID NO: 4020995 - DNA, 17 bp, Homo sapiens
tcaagaaaacaacttca

SEQ ID NO: 4020996 - DNA, 12 bp, Homo sapiens
tcaagaaacagc

SEQ ID NO: 4020997 - DNA, 15 bp, Homo sapiens
tcaagaaacagccag

SEQ ID NO: 4020998 - DNA, 17 bp, Homo sapiens
tcaagaaacagccagca

SEQ ID NO: 4020999 - DNA, 20 bp, Homo sapiens
tcaagaaacagccagcaaga

SEQ ID NO: 4021000 - DNA, 14 bp, Homo sapiens
tcaagaacaaacac

SEQ ID NO: 4021001 - DNA, 22 bp, Homo sapiens
tcaagaacacagccctgcttct

SEQ ID NO: 4021002 - DNA, 19 bp, Homo sapiens
tcaagaagacatggagact

SEQ ID NO: 4021003 - DNA, 22 bp, Homo sapiens
tcaagaagtgaagaatgcacaa

SEQ ID NO: 4021004 - DNA, 14 bp, Homo sapiens
tcaagaccagagac

SEQ ID NO: 4021005 - DNA, 11 bp, Homo sapiens
tcaagaccccc

SEQ ID NO: 4021006 - DNA, 23 bp, Homo sapiens
tcaagacccccatttgtcccaga

SEQ ID NO: 4021007 - DNA, 17 bp, Homo sapiens
tcaagagctgccctcct

SEQ ID NO: 4021008 - DNA, 19 bp, Homo sapiens
tcaagaggtgggagggccc

SEQ ID NO: 4021009 - DNA, 22 bp, Homo sapiens
tcaagcaatccacctgccttgg

SEQ ID NO: 4021010 - DNA, 15 bp, Homo sapiens
tcaagcaatcctcct

SEQ ID NO: 4021011 - DNA, 18 bp, Homo sapiens
tcaagcaatcctcctgcc

SEQ ID NO: 4021012 - DNA, 20 bp, Homo sapiens
tcaagcaatcctcctgcctc

SEQ ID NO: 4021013 - DNA, 22 bp, Homo sapiens
tcaagcaatcctcctgcctcag

SEQ ID NO: 4021014 - DNA, 23 bp, Homo sapiens
tcaagcaatcctcctgcctcagc

SEQ ID NO: 4021015 - DNA, 15 bp, Homo sapiens
tcaagcccaggaggg

SEQ ID NO: 4021016 - DNA, 16 bp, Homo sapiens
tcaagccccagcagcc

SEQ ID NO: 4021017 - DNA, 19 bp, Homo sapiens
tcaagcctttatggctgct

SEQ ID NO: 4021018 - DNA, 14 bp, Homo sapiens
tcaagctgctctga

SEQ ID NO: 4021019 - DNA, 20 bp, Homo sapiens
tcaagctgttatttcttccc

SEQ ID NO: 4021020 - DNA, 16 bp, Homo sapiens
tcaaggagaatatgat

SEQ ID NO: 4021021 - DNA, 16 bp, Homo sapiens
tatgattttatttgac

SEQ ID NO: 4021022 - DNA, 14 bp, Homo sapiens
tatgcaaaatggaa

SEQ ID NO: 4021023 - DNA, 18 bp, Homo sapiens
tatgcaatcaaatctgct

SEQ ID NO: 4021024 - DNA, 14 bp, Homo sapiens
tatgcacagtaaaa

SEQ ID NO: 4021025 - DNA, 17 bp, Homo sapiens
tatgcagatagaatcaa

SEQ ID NO: 4021026 - DNA, 21 bp, Homo sapiens
tatgcatggtgccccaggacc

SEQ ID NO: 4021027 - DNA, 23 bp, Homo sapiens
tatgcatggtgccccaggaccag

SEQ ID NO: 4021028 - DNA, 14 bp, Homo sapiens
tatgccacttcctt

SEQ ID NO: 4021029 - DNA, 18 bp, Homo sapiens
tatgcccaggtaccaccc

SEQ ID NO: 4021030 - DNA, 16 bp, Homo sapiens
tatgcctctgtattta

SEQ ID NO: 4021031 - DNA, 13 bp, Homo sapiens
tatgcctgacccc

SEQ ID NO: 4021032 - DNA, 14 bp, Homo sapiens
tatgccttcttatt

SEQ ID NO: 4021033 - DNA, 20 bp, Homo sapiens
tatgctgatcatcgccagag

SEQ ID NO: 4021034 - DNA, 19 bp, Homo sapiens
tatgctggccagcaccctc

SEQ ID NO: 4021035 - DNA, 13 bp, Homo sapiens
tatgcttaaaata

SEQ ID NO: 4021036 - DNA, 16 bp, Homo sapiens
tatgcttaaaataagc

SEQ ID NO: 4021037 - DNA, 15 bp, Homo sapiens
tatgcttatacactt

SEQ ID NO: 4021038 - DNA, 21 bp, Homo sapiens
tatggaaaaaccatttgaagt

SEQ ID NO: 4021039 - DNA, 15 bp, Homo sapiens
tatggaaaactgtgt

SEQ ID NO: 4021040 - DNA, 20 bp, Homo sapiens
tatggaaccttccctccaaa

SEQ ID NO: 4021041 - DNA, 14 bp, Homo sapiens
tatggaatacagtg

SEQ ID NO: 4021042 - DNA, 23 bp, Homo sapiens
tatggaatacagtgttattttct

SEQ ID NO: 4021043 - DNA, 18 bp, Homo sapiens
tatggaattacatgtaaa

SEQ ID NO: 4021044 - DNA, 11 bp, Homo sapiens
tatggaattga

SEQ ID NO: 4021045 - DNA, 18 bp, Homo sapiens
tatggacagcattgccag

SEQ ID NO: 4021046 - DNA, 18 bp, Homo sapiens
tatggaggaacaactctc

SEQ ID NO: 4021047 - DNA, 20 bp, Homo sapiens
tatggagtgagtcacctgct

SEQ ID NO: 4021048 - DNA, 21 bp, Homo sapiens
tatggagtgagtcacctgctc

SEQ ID NO: 4021049 - DNA, 20 bp, Homo sapiens
tatggatgattcagaaattg

SEQ ID NO: 4021050 - DNA, 15 bp, Homo sapiens
tatggatttgttaca

SEQ ID NO: 4021051 - DNA, 21 bp, Homo sapiens
tatggattttctattgttact

SEQ ID NO: 4021052 - DNA, 16 bp, Homo sapiens
tatggcagaagacacc

SEQ ID NO: 4021053 - DNA, 13 bp, Homo sapiens
tatggcccagcct

SEQ ID NO: 4021054 - DNA, 19 bp, Homo sapiens
tatggcctcagctgcctca

SEQ ID NO: 4021055 - DNA, 23 bp, Homo sapiens
tatggcctcagctgcctcacttc

SEQ ID NO: 4021056 - DNA, 22 bp, Homo sapiens
tatggctctgcacccctctgcc

SEQ ID NO: 4021057 - DNA, 15 bp, Homo sapiens
tatgggagccccagg

SEQ ID NO: 4021058 - DNA, 19 bp, Homo sapiens
tatgggagcttaactttat

SEQ ID NO: 4021059 - DNA, 17 bp, Homo sapiens
tatgggcattgtagtta

SEQ ID NO: 4021060 - DNA, 18 bp, Homo sapiens
tatgggtagggtaaatca

SEQ ID NO: 4021061 - DNA, 14 bp, Homo sapiens
tatgggtcctgcaa

SEQ ID NO: 4021062 - DNA, 19 bp, Homo sapiens
tatgggtgggattttgcaa

SEQ ID NO: 4021063 - DNA, 16 bp, Homo sapiens
tatggtatgctggcca

SEQ ID NO: 4021064 - DNA, 17 bp, Homo sapiens
tatggtatgctggccag

SEQ ID NO: 4021065 - DNA, 14 bp, Homo sapiens
tatggtatgtagcc

SEQ ID NO: 4021066 - DNA, 22 bp, Homo sapiens
tatggtatgtagccagctgtgc

SEQ ID NO: 4021067 - DNA, 21 bp, Homo sapiens
tatggtccagaaactcctgtt

SEQ ID NO: 4021068 - DNA, 16 bp, Homo sapiens
tatggtgaacccacaa

SEQ ID NO: 4021069 - DNA, 16 bp, Homo sapiens
tatggtggaaaagaac

SEQ ID NO: 4021070 - DNA, 16 bp, Homo sapiens
tatggttcccaataaa

SEQ ID NO: 4021071 - DNA, 22 bp, Homo sapiens
tatggttcccaataaaagtgac

SEQ ID NO: 4021072 - DNA, 15 bp, Homo sapiens
tatgtaagagcacct

SEQ ID NO: 4021073 - DNA, 21 bp, Homo sapiens
tatgtaatgcttccaatcttg

SEQ ID NO: 4021074 - DNA, 15 bp, Homo sapiens
tatgtaatttatgca

SEQ ID NO: 4021075 - DNA, 15 bp, Homo sapiens
tatgtacatttgtct

SEQ ID NO: 4021076 - DNA, 17 bp, Homo sapiens
tatgtacatttgtcttt

SEQ ID NO: 4021077 - DNA, 21 bp, Homo sapiens
tatgtaccatatgatctgttt

SEQ ID NO: 4021078 - DNA, 20 bp, Homo sapiens
tatgtactcctctttacact

SEQ ID NO: 4021079 - DNA, 12 bp, Homo sapiens
tatgtagatgtg

SEQ ID NO: 4021080 - DNA, 20 bp, Homo sapiens
tatgtatggaatacagtgtt

SEQ ID NO: 4021081 - DNA, 12 bp, Homo sapiens
tatgtatttata

SEQ ID NO: 4021082 - DNA, 15 bp, Homo sapiens
tatttataaaacttc

SEQ ID NO: 4021083 - DNA, 17 bp, Homo sapiens
tatttataaaacttctc

SEQ ID NO: 4021084 - DNA, 16 bp, Homo sapiens
tatttataaatatatt

SEQ ID NO: 4021085 - DNA, 14 bp, Homo sapiens
tatttataacagca

SEQ ID NO: 4021086 - DNA, 18 bp, Homo sapiens
tatttataacagcattct

SEQ ID NO: 4021087 - DNA, 22 bp, Homo sapiens
tatttataatagcaacttttgt

SEQ ID NO: 4021088 - DNA, 17 bp, Homo sapiens
tatttatacagtgcctt

SEQ ID NO: 4021089 - DNA, 23 bp, Homo sapiens
tatttataggccagggcatgtgt

SEQ ID NO: 4021090 - DNA, 18 bp, Homo sapiens
tatttatatatttataac

SEQ ID NO: 4021091 - DNA, 15 bp, Homo sapiens
tatttatatgtacat

SEQ ID NO: 4021092 - DNA, 21 bp, Homo sapiens
tatttatctgattaagttgtc

SEQ ID NO: 4021093 - DNA, 13 bp, Homo sapiens
tatttatgccttg

SEQ ID NO: 4021094 - DNA, 19 bp, Homo sapiens
tatttatgccttgatgatt

SEQ ID NO: 4021095 - DNA, 21 bp, Homo sapiens
tatttatgccttgatgattta

SEQ ID NO: 4021096 - DNA, 21 bp, Homo sapiens
tatttatgtctatttaagcct

SEQ ID NO: 4021097 - DNA, 13 bp, Homo sapiens
tatttatgtttgc

SEQ ID NO: 4021098 - DNA, 15 bp, Homo sapiens
tatttattaaataaa

SEQ ID NO: 4021099 - DNA, 13 bp, Homo sapiens
tatttattaatat

SEQ ID NO: 4021100 - DNA, 15 bp, Homo sapiens
tatttattaatttga

SEQ ID NO: 4021101 - DNA, 15 bp, Homo sapiens
tatttattacctctg

SEQ ID NO: 4021102 - DNA, 15 bp, Homo sapiens
tatttattactgtcc

SEQ ID NO: 4021103 - DNA, 24 bp, Homo sapiens
tatttattgttagaaaatgactta

SEQ ID NO: 4021104 - DNA, 16 bp, Homo sapiens
tatttattgtttattt

SEQ ID NO: 4021105 - DNA, 16 bp, Homo sapiens
tatttatttaaagcat

SEQ ID NO: 4021106 - DNA, 16 bp, Homo sapiens
tatttatttaagctta

SEQ ID NO: 4021107 - DNA, 13 bp, Homo sapiens
tatttatttgtga

SEQ ID NO: 4021108 - DNA, 12 bp, Homo sapiens
tatttattttgt

SEQ ID NO: 4021109 - DNA, 14 bp, Homo sapiens
tatttattttgtaa

SEQ ID NO: 4021110 - DNA, 17 bp, Homo sapiens
tatttcaataaatcttt

SEQ ID NO: 4021111 - DNA, 22 bp, Homo sapiens
tatttcaataaatctttcaaaa

SEQ ID NO: 4021112 - DNA, 23 bp, Homo sapiens
tatttcactatcttcttcaaata

SEQ ID NO: 4021113 - DNA, 19 bp, Homo sapiens
tatttcacttttgttctgc

SEQ ID NO: 4021114 - DNA, 20 bp, Homo sapiens
tatttcagatatcaaaattc

SEQ ID NO: 4021115 - DNA, 21 bp, Homo sapiens
tatttcagatatcaaaattct

SEQ ID NO: 4021116 - DNA, 17 bp, Homo sapiens
tatttcagtgttacctg

SEQ ID NO: 4021117 - DNA, 20 bp, Homo sapiens
tatttcagtgttacctgtgt

SEQ ID NO: 4021118 - DNA, 12 bp, Homo sapiens
tatttcatttct

SEQ ID NO: 4021119 - DNA, 13 bp, Homo sapiens
tatttcatttctt

SEQ ID NO: 4021120 - DNA, 15 bp, Homo sapiens
tattttggatatatt

SEQ ID NO: 4021121 - DNA, 19 bp, Homo sapiens
tattttggatatattattg

SEQ ID NO: 4021122 - DNA, 20 bp, Homo sapiens
tattttgtgatgatgctgtg

SEQ ID NO: 4021123 - DNA, 19 bp, Homo sapiens
tattttgtggttctatttt

SEQ ID NO: 4021124 - DNA, 23 bp, Homo sapiens
tattttgtgtcctccaggagctt

SEQ ID NO: 4021125 - DNA, 17 bp, Homo sapiens
tattttgttgctttctt

SEQ ID NO: 4021126 - DNA, 24 bp, Homo sapiens
tattttgttttttttgactaaagc

SEQ ID NO: 4021127 - DNA, 15 bp, Homo sapiens
tatttttaaaaagaa

SEQ ID NO: 4021128 - DNA, 17 bp, Homo sapiens
tatttttacctaaagac

SEQ ID NO: 4021129 - DNA, 21 bp, Homo sapiens
tatttttatactcttcctatt

SEQ ID NO: 4021130 - DNA, 16 bp, Homo sapiens
tatttttatatttcct

SEQ ID NO: 4021131 - DNA, 20 bp, Homo sapiens
tatttttcaataaagcattt

SEQ ID NO: 4021132 - DNA, 15 bp, Homo sapiens
tatttttcacagttt

SEQ ID NO: 4021133 - DNA, 13 bp, Homo sapiens
tatttttcagaga

SEQ ID NO: 4021134 - DNA, 21 bp, Homo sapiens
tatttttcagagatttatata

SEQ ID NO: 4021135 - DNA, 15 bp, Homo sapiens
tatttttctctttgt

SEQ ID NO: 4021136 - DNA, 12 bp, Homo sapiens
tatttttgtaat

SEQ ID NO: 4021137 - DNA, 17 bp, Homo sapiens
tatttttgtacttgatt

SEQ ID NO: 4021138 - DNA, 12 bp, Homo sapiens
tatttttgttag

SEQ ID NO: 4021139 - DNA, 15 bp, Homo sapiens
tattttttcttttgt

SEQ ID NO: 4021140 - DNA, 13 bp, Homo sapiens
tattttttgcaag

SEQ ID NO: 4021141 - DNA, 22 bp, Homo sapiens
tatttttttaactgaaaatgta

SEQ ID NO: 4021142 - DNA, 20 bp, Homo sapiens
tatttttttaatttaacatg

SEQ ID NO: 4021143 - DNA, 19 bp, Homo sapiens
tcaaaaaaaaaaaaagata

SEQ ID NO: 4021144 - DNA, 16 bp, Homo sapiens
tcaaaaaaaagaaaaa

SEQ ID NO: 4021145 - DNA, 16 bp, Homo sapiens
tcaaaaaaacactagt

SEQ ID NO: 4021146 - DNA, 22 bp, Homo sapiens
tcaaaaactttggagtcccctc

SEQ ID NO: 4021147 - DNA, 15 bp, Homo sapiens
tcaaaaatacaaaat

SEQ ID NO: 4021148 - DNA, 15 bp, Homo sapiens
tcaaaaatataactt

SEQ ID NO: 4021149 - DNA, 16 bp, Homo sapiens
tcaaaaatataactta

SEQ ID NO: 4021150 - DNA, 18 bp, Homo sapiens
tcaaaaattgaagagaga

SEQ ID NO: 4021151 - DNA, 18 bp, Homo sapiens
tcaaaacggggcagccaa

SEQ ID NO: 4021152 - DNA, 17 bp, Homo sapiens
tcaaaagcatttatcat

SEQ ID NO: 4021153 - DNA, 15 bp, Homo sapiens
tcaaaagtctatttt

SEQ ID NO: 4021154 - DNA, 20 bp, Homo sapiens
tcaaaataaaaagtgacaca

SEQ ID NO: 4021155 - DNA, 15 bp, Homo sapiens
tcaaaatattactca

SEQ ID NO: 4021156 - DNA, 21 bp, Homo sapiens
tcaaaatcactatctttctga

SEQ ID NO: 4021157 - DNA, 21 bp, Homo sapiens
tattcctttgggcctctgctt

SEQ ID NO: 4021158 - DNA, 15 bp, Homo sapiens
tattctaaaaccatt

SEQ ID NO: 4021159 - DNA, 14 bp, Homo sapiens
tattctatatgaat

SEQ ID NO: 4021160 - DNA, 20 bp, Homo sapiens
tattctattacattttcagt

SEQ ID NO: 4021161 - DNA, 16 bp, Homo sapiens
tattctattgtattat

SEQ ID NO: 4021162 - DNA, 22 bp, Homo sapiens
tattctattgtattatttggag

SEQ ID NO: 4021163 - DNA, 14 bp, Homo sapiens
tattctcaaagcag

SEQ ID NO: 4021164 - DNA, 16 bp, Homo sapiens
tattctcaaagcagga

SEQ ID NO: 4021165 - DNA, 15 bp, Homo sapiens
tattctcaccaggaa

SEQ ID NO: 4021166 - DNA, 12 bp, Homo sapiens
tattctcagagc

SEQ ID NO: 4021167 - DNA, 15 bp, Homo sapiens
tattctctgcaattt

SEQ ID NO: 4021168 - DNA, 15 bp, Homo sapiens
tattcttataaaaat

SEQ ID NO: 4021169 - DNA, 14 bp, Homo sapiens
tattcttcataaca

SEQ ID NO: 4021170 - DNA, 13 bp, Homo sapiens
tattcttccagaa

SEQ ID NO: 4021171 - DNA, 14 bp, Homo sapiens
tattcttccagaat

SEQ ID NO: 4021172 - DNA, 13 bp, Homo sapiens
tattcttctttct

SEQ ID NO: 4021173 - DNA, 18 bp, Homo sapiens
tattctttggttgtgaat

SEQ ID NO: 4021174 - DNA, 14 bp, Homo sapiens
tattgaagacaatt

SEQ ID NO: 4021175 - DNA, 21 bp, Homo sapiens
tattgaagacaatttgataca

SEQ ID NO: 4021176 - DNA, 22 bp, Homo sapiens
tattgaagacaatttgatacat

SEQ ID NO: 4021177 - DNA, 18 bp, Homo sapiens
tattgacacagaaaatgt

SEQ ID NO: 4021178 - DNA, 13 bp, Homo sapiens
tattgacactgaa

SEQ ID NO: 4021179 - DNA, 14 bp, Homo sapiens
tattgacactgaac

SEQ ID NO: 4021180 - DNA, 18 bp, Homo sapiens
tattgacactgtccctct

SEQ ID NO: 4021181 - DNA, 19 bp, Homo sapiens
tattgacactgtccctctt

SEQ ID NO: 4021182 - DNA, 16 bp, Homo sapiens
tattgacatttgtagt

SEQ ID NO: 4021183 - DNA, 17 bp, Homo sapiens
tattgacttgtatattt

SEQ ID NO: 4021184 - DNA, 22 bp, Homo sapiens
tattgagaatcccttaaaatta

SEQ ID NO: 4021185 - DNA, 14 bp, Homo sapiens
tattgagatttctt

SEQ ID NO: 4021186 - DNA, 15 bp, Homo sapiens
tattgaggctttgtg

SEQ ID NO: 4021187 - DNA, 16 bp, Homo sapiens
tattgaggctttgtgt

SEQ ID NO: 4021188 - DNA, 20 bp, Homo sapiens
tattgaggctttgtgttgta

SEQ ID NO: 4021189 - DNA, 14 bp, Homo sapiens
tattgatagtactc

SEQ ID NO: 4021190 - DNA, 20 bp, Homo sapiens
tattgatatgcttatacact

SEQ ID NO: 4021191 - DNA, 21 bp, Homo sapiens
tattgatgataacacttaaaa

SEQ ID NO: 4021192 - DNA, 14 bp, Homo sapiens
tattgattgctttt

SEQ ID NO: 4021193 - DNA, 17 bp, Homo sapiens
tattgcacattgtaaaa

SEQ ID NO: 4021194 - DNA, 15 bp, Homo sapiens
tattgcattaatttt

SEQ ID NO: 4021195 - DNA, 17 bp, Homo sapiens
tattgcatttatatgta

SEQ ID NO: 4021196 - DNA, 16 bp, Homo sapiens
tattgcccatgggata

SEQ ID NO: 4021197 - DNA, 15 bp, Homo sapiens
tattgctagtatttg

SEQ ID NO: 4021198 - DNA, 19 bp, Homo sapiens
tattgctgagagaaatatg

SEQ ID NO: 4021199 - DNA, 16 bp, Homo sapiens
tattgctgattttaaa

SEQ ID NO: 4021200 - DNA, 20 bp, Homo sapiens
tattgctgctgtgcgtggaa

SEQ ID NO: 4021201 - DNA, 20 bp, Homo sapiens
tattggaggtgagatcacag

SEQ ID NO: 4021202 - DNA, 20 bp, Homo sapiens
tattggcaaagtttaaatgt

SEQ ID NO: 4021203 - DNA, 20 bp, Homo sapiens
tattgggcacagcctagggt

SEQ ID NO: 4021204 - DNA, 14 bp, Homo sapiens
tattgggttcatta

SEQ ID NO: 4021205 - DNA, 19 bp, Homo sapiens
tattggtgcgtttttacag

SEQ ID NO: 4021206 - DNA, 14 bp, Homo sapiens
tattgtaaatatgt

SEQ ID NO: 4021207 - DNA, 14 bp, Homo sapiens
tattgtacataaaa

SEQ ID NO: 4021208 - DNA, 22 bp, Homo sapiens
tattgtatcaatctttagaaaa

SEQ ID NO: 4021209 - DNA, 18 bp, Homo sapiens
tattgtattgctgctgtg

SEQ ID NO: 4021210 - DNA, 16 bp, Homo sapiens
tattgtcagatatttt

SEQ ID NO: 4021211 - DNA, 19 bp, Homo sapiens
tattgtgaagtacatatta

SEQ ID NO: 4021212 - DNA, 22 bp, Homo sapiens
tattgtgccaactgccaggctg

SEQ ID NO: 4021213 - DNA, 15 bp, Homo sapiens
tattgttagaaaatg

SEQ ID NO: 4021214 - DNA, 22 bp, Homo sapiens
tattgttagaaaatgacttatt

SEQ ID NO: 4021215 - DNA, 18 bp, Homo sapiens
tattgttccaagacattg

SEQ ID NO: 4021216 - DNA, 19 bp, Homo sapiens
tattgttccaagacattgt

SEQ ID NO: 4021217 - DNA, 21 bp, Homo sapiens
tattgttccaagacattgtca

SEQ ID NO: 4021218 - DNA, 17 bp, Homo sapiens
tattgttccagcagttt

SEQ ID NO: 4021219 - DNA, 13 bp, Homo sapiens
tattgttggtaat

SEQ ID NO: 4021220 - DNA, 14 bp, Homo sapiens
tattgttgtataat

SEQ ID NO: 4021221 - DNA, 12 bp, Homo sapiens
tattgtttaaaa

SEQ ID NO: 4021222 - DNA, 20 bp, Homo sapiens
tattgtttaaaattcagttt

SEQ ID NO: 4021223 - DNA, 20 bp, Homo sapiens
tattgtttctttaagaaagt

SEQ ID NO: 4021224 - DNA, 17 bp, Homo sapiens
tattgttttctgtaaat

SEQ ID NO: 4021225 - DNA, 20 bp, Homo sapiens
tattgttttctgtaaataac

SEQ ID NO: 4021226 - DNA, 22 bp, Homo sapiens
tattgttttctgtaaataacct

SEQ ID NO: 4021227 - DNA, 16 bp, Homo sapiens
tattgtttttgtattt

SEQ ID NO: 4021228 - DNA, 16 bp, Homo sapiens
tatttaaaaatatttc

SEQ ID NO: 4021229 - DNA, 20 bp, Homo sapiens
tatttaaaaatatttcagat

SEQ ID NO: 4021230 - DNA, 16 bp, Homo sapiens
tatttaaaataaattc

SEQ ID NO: 4021231 - DNA, 17 bp, Homo sapiens
tatttaaaattccatta

SEQ ID NO: 4021232 - DNA, 21 bp, Homo sapiens
tatttaaacttataaatcata

SEQ ID NO: 4021233 - DNA, 15 bp, Homo sapiens
tatttaagaaaagca

SEQ ID NO: 4021234 - DNA, 19 bp, Homo sapiens
tatttaagaaaatacaata

SEQ ID NO: 4021235 - DNA, 18 bp, Homo sapiens
tatttaagcctcatattt

SEQ ID NO: 4021236 - DNA, 12 bp, Homo sapiens
tatttaagcctt

SEQ ID NO: 4021237 - DNA, 21 bp, Homo sapiens
tatttaagccttataaaccaa

SEQ ID NO: 4021238 - DNA, 21 bp, Homo sapiens
tatttaaggtagcttcagcta

SEQ ID NO: 4021239 - DNA, 20 bp, Homo sapiens
tatttaagttatcaacttta

SEQ ID NO: 4021240 - DNA, 10 bp, Homo sapiens
tatttaataa

SEQ ID NO: 4021241 - DNA, 15 bp, Homo sapiens
tatttaataacatta

SEQ ID NO: 4021242 - DNA, 14 bp, Homo sapiens
tatttaatatttaa

SEQ ID NO: 4021243 - DNA, 19 bp, Homo sapiens
tatttaatgataagtaaat

SEQ ID NO: 4021244 - DNA, 21 bp, Homo sapiens
tatttaatgccgatatactct

SEQ ID NO: 4021245 - DNA, 15 bp, Homo sapiens
tatttaatgttatgt

SEQ ID NO: 4021246 - DNA, 20 bp, Homo sapiens
tatttaattaaatctcaaat

SEQ ID NO: 4021247 - DNA, 14 bp, Homo sapiens
tatttaattattaa

SEQ ID NO: 4021248 - DNA, 15 bp, Homo sapiens
tatttacaataaatg

SEQ ID NO: 4021249 - DNA, 10 bp, Homo sapiens
tatttacatt

SEQ ID NO: 4021250 - DNA, 17 bp, Homo sapiens
tatttacccctccccta

SEQ ID NO: 4021251 - DNA, 22 bp, Homo sapiens
tatttacgctttgattcatagt

SEQ ID NO: 4021252 - DNA, 14 bp, Homo sapiens
tatttactgagctt

SEQ ID NO: 4021253 - DNA, 16 bp, Homo sapiens
tatttactgagcttct

SEQ ID NO: 4021254 - DNA, 23 bp, Homo sapiens
tatttactgagcttctctgtgaa

SEQ ID NO: 4021255 - DNA, 20 bp, Homo sapiens
tatttagacaagagatggga

SEQ ID NO: 4021256 - DNA, 18 bp, Homo sapiens
tatttagatataacacta

SEQ ID NO: 4021257 - DNA, 23 bp, Homo sapiens
tatttagatgataaagagacagt

SEQ ID NO: 4021258 - DNA, 15 bp, Homo sapiens
tatttaggaagtgtt

SEQ ID NO: 4021259 - DNA, 18 bp, Homo sapiens
tatttagtctaagatgat

SEQ ID NO: 4021260 - DNA, 12 bp, Homo sapiens
tagtgcagctga

SEQ ID NO: 4021261 - DNA, 17 bp, Homo sapiens
tagtgcagctgatttta

SEQ ID NO: 4021262 - DNA, 19 bp, Homo sapiens
tagtgcagctgattttaac

SEQ ID NO: 4021263 - DNA, 22 bp, Homo sapiens
tagtgcctgagagtatttaggc

SEQ ID NO: 4021264 - DNA, 19 bp, Homo sapiens
tagtgcggacaagttttaa

SEQ ID NO: 4021265 - DNA, 12 bp, Homo sapiens
tagtgctgggat

SEQ ID NO: 4021266 - DNA, 15 bp, Homo sapiens
tagtggatgttctga

SEQ ID NO: 4021267 - DNA, 14 bp, Homo sapiens
tagtggcttcaaaa

SEQ ID NO: 4021268 - DNA, 14 bp, Homo sapiens
tagtgggccagggc

SEQ ID NO: 4021269 - DNA, 15 bp, Homo sapiens
tagtgggccagggct

SEQ ID NO: 4021270 - DNA, 15 bp, Homo sapiens
tagtggtctttgtaa

SEQ ID NO: 4021271 - DNA, 21 bp, Homo sapiens
tagtggtctttgtaagagtgt

SEQ ID NO: 4021272 - DNA, 23 bp, Homo sapiens
tagtgtaacttgcttaaatttct

SEQ ID NO: 4021273 - DNA, 14 bp, Homo sapiens
tagtgtaataagac

SEQ ID NO: 4021274 - DNA, 16 bp, Homo sapiens
tagtgtagtcaggtgc

SEQ ID NO: 4021275 - DNA, 19 bp, Homo sapiens
tagtgtgttctgattagaa

SEQ ID NO: 4021276 - DNA, 19 bp, Homo sapiens
tagtgttagttataaatag

SEQ ID NO: 4021277 - DNA, 16 bp, Homo sapiens
tagtgttctgctcctg

SEQ ID NO: 4021278 - DNA, 23 bp, Homo sapiens
tagtgttctgctcctgcttttct

SEQ ID NO: 4021279 - DNA, 15 bp, Homo sapiens
tagtgttctgtttgt

SEQ ID NO: 4021280 - DNA, 12 bp, Homo sapiens
tagttaatttat

SEQ ID NO: 4021281 - DNA, 14 bp, Homo sapiens
tagttaatttatct

SEQ ID NO: 4021282 - DNA, 15 bp, Homo sapiens
tagttaatttatcta

SEQ ID NO: 4021283 - DNA, 15 bp, Homo sapiens
tagttacatttctat

SEQ ID NO: 4021284 - DNA, 16 bp, Homo sapiens
tagttacctactgagt

SEQ ID NO: 4021285 - DNA, 15 bp, Homo sapiens
tagttagtagcatgt

SEQ ID NO: 4021286 - DNA, 16 bp, Homo sapiens
tagttccctctgctca

SEQ ID NO: 4021287 - DNA, 18 bp, Homo sapiens
tagttccctctgctcagc

SEQ ID NO: 4021288 - DNA, 19 bp, Homo sapiens
tagttccctctgctcagcc

SEQ ID NO: 4021289 - DNA, 20 bp, Homo sapiens
tagttccctctgctcagcca

SEQ ID NO: 4021290 - DNA, 12 bp, Homo sapiens
tagttcctgcta

SEQ ID NO: 4021291 - DNA, 16 bp, Homo sapiens
tagttcctgctacaac

SEQ ID NO: 4021292 - DNA, 12 bp, Homo sapiens
tagttctgccag

SEQ ID NO: 4021293 - DNA, 14 bp, Homo sapiens
tagttgactcacag

SEQ ID NO: 4021294 - DNA, 19 bp, Homo sapiens
tagttgcagaaacattttg

SEQ ID NO: 4021295 - DNA, 23 bp, Homo sapiens
tagttgcagactcagtttgtcag

SEQ ID NO: 4021296 - DNA, 17 bp, Homo sapiens
tagttgccttaaaataa

SEQ ID NO: 4021297 - DNA, 15 bp, Homo sapiens
tagttggtgttcaaa

SEQ ID NO: 4021298 - DNA, 18 bp, Homo sapiens
tagttgtaaaccaagtga

SEQ ID NO: 4021299 - DNA, 18 bp, Homo sapiens
tagtttaggagaaaccag

SEQ ID NO: 4021300 - DNA, 11 bp, Homo sapiens
tagtttcaagc

SEQ ID NO: 4021301 - DNA, 15 bp, Homo sapiens
tagtttggatatttt

SEQ ID NO: 4021302 - DNA, 20 bp, Homo sapiens
tagtttggatatttttgtac

SEQ ID NO: 4021303 - DNA, 22 bp, Homo sapiens
tagtttggatatttttgtactt

SEQ ID NO: 4021304 - DNA, 18 bp, Homo sapiens
tagtttggggcaaaaatc

SEQ ID NO: 4021305 - DNA, 17 bp, Homo sapiens
tagttttagttgcagaa

SEQ ID NO: 4021306 - DNA, 16 bp, Homo sapiens
tataaaaaatggttca

SEQ ID NO: 4021307 - DNA, 20 bp, Homo sapiens
tataaaaaccccaaactgtt

SEQ ID NO: 4021308 - DNA, 14 bp, Homo sapiens
tataaaaagccact

SEQ ID NO: 4021309 - DNA, 18 bp, Homo sapiens
tataaaaagcttccatga

SEQ ID NO: 4021310 - DNA, 12 bp, Homo sapiens
tataaaagcctt

SEQ ID NO: 4021311 - DNA, 12 bp, Homo sapiens
tataaaatagac

SEQ ID NO: 4021312 - DNA, 19 bp, Homo sapiens
tataaaatagacaaataga

SEQ ID NO: 4021313 - DNA, 18 bp, Homo sapiens
tataaacacattgaatgc

SEQ ID NO: 4021314 - DNA, 20 bp, Homo sapiens
tataaacagacaatatgtga

SEQ ID NO: 4021315 - DNA, 14 bp, Homo sapiens
tataaacatcacac

SEQ ID NO: 4021316 - DNA, 15 bp, Homo sapiens
tataaaccaatctta

SEQ ID NO: 4021317 - DNA, 17 bp, Homo sapiens
tataaaccaatcttaaa

SEQ ID NO: 4021318 - DNA, 20 bp, Homo sapiens
tataaaccaatcttaaacat

SEQ ID NO: 4021319 - DNA, 20 bp, Homo sapiens
tataaaccgtggtctcatgt

SEQ ID NO: 4021320 - DNA, 21 bp, Homo sapiens
tataaactttagagtagcatg

SEQ ID NO: 4021321 - DNA, 15 bp, Homo sapiens
tataaagaacaaggt

SEQ ID NO: 4021322 - DNA, 18 bp, Homo sapiens
tataaagaagaacttgca

SEQ ID NO: 4021323 - DNA, 16 bp, Homo sapiens
tataaaggttgacaat

SEQ ID NO: 4021324 - DNA, 21 bp, Homo sapiens
tataaatacaaatctgtataa

SEQ ID NO: 4021325 - DNA, 17 bp, Homo sapiens
tataaataggagaggat

SEQ ID NO: 4021326 - DNA, 15 bp, Homo sapiens
tataaatatatttaa

SEQ ID NO: 4021327 - DNA, 15 bp, Homo sapiens
tataaatgaaatttg

SEQ ID NO: 4021328 - DNA, 22 bp, Homo sapiens
tataaatgtctattattatgaa

SEQ ID NO: 4021329 - DNA, 15 bp, Homo sapiens
tataaatgtgatatg

SEQ ID NO: 4021330 - DNA, 14 bp, Homo sapiens
tataaatgttagtt

SEQ ID NO: 4021331 - DNA, 17 bp, Homo sapiens
tataacatatgtacata

SEQ ID NO: 4021332 - DNA, 18 bp, Homo sapiens
tataaccatgagaatttt

SEQ ID NO: 4021333 - DNA, 21 bp, Homo sapiens
tataactcatcataaaataaa

SEQ ID NO: 4021334 - DNA, 19 bp, Homo sapiens
tataacttaaaaaaatgac

SEQ ID NO: 4021335 - DNA, 20 bp, Homo sapiens
tataacttaaaaatgtaaat

SEQ ID NO: 4021336 - DNA, 15 bp, Homo sapiens
tataagacatttgtt

SEQ ID NO: 4021337 - DNA, 19 bp, Homo sapiens
tataagacatttgtttgct

SEQ ID NO: 4021338 - DNA, 16 bp, Homo sapiens
tataagcatgctttct

SEQ ID NO: 4021339 - DNA, 22 bp, Homo sapiens
tataaggaaagcaataaatgaa

SEQ ID NO: 4021340 - DNA, 18 bp, Homo sapiens
tataagtactagatgcat

SEQ ID NO: 4021341 - DNA, 18 bp, Homo sapiens
tataagtcattgtatgtt

SEQ ID NO: 4021342 - DNA, 18 bp, Homo sapiens
tataagtggaggcacttt

SEQ ID NO: 4021343 - DNA, 19 bp, Homo sapiens
tataagttatttttgtaca

SEQ ID NO: 4021344 - DNA, 12 bp, Homo sapiens
tataataaaagg

SEQ ID NO: 4021345 - DNA, 21 bp, Homo sapiens
tataataaaaggaaaagcaaa

SEQ ID NO: 4021346 - DNA, 22 bp, Homo sapiens
tataataaaaggaaaagcaaat

SEQ ID NO: 4021347 - DNA, 14 bp, Homo sapiens
tataataaacataa

SEQ ID NO: 4021348 - DNA, 14 bp, Homo sapiens
tataatgtaagctc

SEQ ID NO: 4021349 - DNA, 16 bp, Homo sapiens
tataatgtttaaatca

SEQ ID NO: 4021350 - DNA, 17 bp, Homo sapiens
tataatgtttaaatcat

SEQ ID NO: 4021351 - DNA, 20 bp, Homo sapiens
tataattcactcaagcactg

SEQ ID NO: 4021352 - DNA, 12 bp, Homo sapiens
tataattctgta

SEQ ID NO: 4021353 - DNA, 22 bp, Homo sapiens
tataatttaacttcagagggaa

SEQ ID NO: 4021354 - DNA, 20 bp, Homo sapiens
tataatttcgagatttgtag

SEQ ID NO: 4021355 - DNA, 17 bp, Homo sapiens
tataattttatgaatgt

SEQ ID NO: 4021356 - DNA, 13 bp, Homo sapiens
tataattttatgg

SEQ ID NO: 4021357 - DNA, 21 bp, Homo sapiens
tataatttttttcaatattta

SEQ ID NO: 4021358 - DNA, 14 bp, Homo sapiens
tatacaaagtgtac

SEQ ID NO: 4021359 - DNA, 18 bp, Homo sapiens
tatacaaattagaaaatg

SEQ ID NO: 4021360 - DNA, 23 bp, Homo sapiens
tatacaaattttcagaaggttat

SEQ ID NO: 4021361 - DNA, 21 bp, Homo sapiens
tatacaccatatactgttctt

SEQ ID NO: 4021362 - DNA, 21 bp, Homo sapiens
tatacacttacactttatgca

SEQ ID NO: 4021363 - DNA, 13 bp, Homo sapiens
tatacagaggaaa

SEQ ID NO: 4021364 - DNA, 20 bp, Homo sapiens
tatacagaggaaatctgtaa

SEQ ID NO: 4021365 - DNA, 20 bp, Homo sapiens
tatacagctgtattgtctga

SEQ ID NO: 4021366 - DNA, 18 bp, Homo sapiens
tatacaggcataaaatag

SEQ ID NO: 4021367 - DNA, 13 bp, Homo sapiens
tatacagttattt

SEQ ID NO: 4021368 - DNA, 17 bp, Homo sapiens
tatacagttattttgga

SEQ ID NO: 4021369 - DNA, 19 bp, Homo sapiens
tatacatgaaaattttaaa

SEQ ID NO: 4021370 - DNA, 23 bp, Homo sapiens
tatacattagtaaatgtctttgt

SEQ ID NO: 4021371 - DNA, 17 bp, Homo sapiens
tataccagcaatatatc

SEQ ID NO: 4021372 - DNA, 19 bp, Homo sapiens
tataccaggatttattttg

SEQ ID NO: 4021373 - DNA, 15 bp, Homo sapiens
tatactaagaaaaga

SEQ ID NO: 4021374 - DNA, 17 bp, Homo sapiens
tatactctttctgtata

SEQ ID NO: 4021375 - DNA, 19 bp, Homo sapiens
tatactctttctgtatata

SEQ ID NO: 4021376 - DNA, 12 bp, Homo sapiens
tatactgaagga

SEQ ID NO: 4021377 - DNA, 20 bp, Homo sapiens
tatactgattatgtctttta

SEQ ID NO: 4021378 - DNA, 19 bp, Homo sapiens
tatactgtgaagttacatg

SEQ ID NO: 4021379 - DNA, 13 bp, Homo sapiens
tatactgttcttc

SEQ ID NO: 4021380 - DNA, 13 bp, Homo sapiens
tatagaaaaggaa

SEQ ID NO: 4021381 - DNA, 13 bp, Homo sapiens
tatagaaagctat

SEQ ID NO: 4021382 - DNA, 23 bp, Homo sapiens
tatagacagtccttaaaaatcac

SEQ ID NO: 4021383 - DNA, 11 bp, Homo sapiens
tatagactcta

SEQ ID NO: 4021384 - DNA, 21 bp, Homo sapiens
tatagaggctagcttctgctt

SEQ ID NO: 4021385 - DNA, 16 bp, Homo sapiens
tatagattagaaaaat

SEQ ID NO: 4021386 - DNA, 17 bp, Homo sapiens
tatagattagaaaaatt

SEQ ID NO: 4021387 - DNA, 16 bp, Homo sapiens
tatagcaacaacaatt

SEQ ID NO: 4021388 - DNA, 13 bp, Homo sapiens
tatagcaatccat

SEQ ID NO: 4021389 - DNA, 19 bp, Homo sapiens
tatagcactgagctcacat

SEQ ID NO: 4021390 - DNA, 16 bp, Homo sapiens
tatagctacaggaagc

SEQ ID NO: 4021391 - DNA, 17 bp, Homo sapiens
tataggacaaaatgtta

SEQ ID NO: 4021392 - DNA, 12 bp, Homo sapiens
tataggagagga

SEQ ID NO: 4021393 - DNA, 14 bp, Homo sapiens
tataggctggagaa

SEQ ID NO: 4021394 - DNA, 17 bp, Homo sapiens
tataggtcactcctggg

SEQ ID NO: 4021395 - DNA, 14 bp, Homo sapiens
tatagtacatgata

SEQ ID NO: 4021396 - DNA, 21 bp, Homo sapiens
tatagtgatggggctcagatg

SEQ ID NO: 4021397 - DNA, 12 bp, Homo sapiens
tatataaaaaga

SEQ ID NO: 4021398 - DNA, 19 bp, Homo sapiens
tatataaaaagaaaagata

SEQ ID NO: 4021399 - DNA, 22 bp, Homo sapiens
tatataaccctaggaatttaga

SEQ ID NO: 4021400 - DNA, 23 bp, Homo sapiens
tatataagagcatgaaattttta

SEQ ID NO: 4021401 - DNA, 13 bp, Homo sapiens
tatataattcact

SEQ ID NO: 4021402 - DNA, 21 bp, Homo sapiens
tatataattcactcaagcact

SEQ ID NO: 4021403 - DNA, 23 bp, Homo sapiens
tatatacagaggaaatctgtaac

SEQ ID NO: 4021404 - DNA, 12 bp, Homo sapiens
tatatacagtta

SEQ ID NO: 4021405 - DNA, 19 bp, Homo sapiens
tatatacctgcgcttgttt

SEQ ID NO: 4021406 - DNA, 12 bp, Homo sapiens
tatatatagaat

SEQ ID NO: 4021407 - DNA, 13 bp, Homo sapiens
tatatatatctgt

SEQ ID NO: 4021408 - DNA, 21 bp, Homo sapiens
tatatatgtgtatgcacagta

SEQ ID NO: 4021409 - DNA, 14 bp, Homo sapiens
tatatatttataac

SEQ ID NO: 4021410 - DNA, 13 bp, Homo sapiens
tatatatttctaa

SEQ ID NO: 4021411 - DNA, 19 bp, Homo sapiens
tatatatttctaactatat

SEQ ID NO: 4021412 - DNA, 14 bp, Homo sapiens
tatatcatgcaaaa

SEQ ID NO: 4021413 - DNA, 15 bp, Homo sapiens
tatatcattctacag

SEQ ID NO: 4021414 - DNA, 16 bp, Homo sapiens
tatatcattctacaga

SEQ ID NO: 4021415 - DNA, 20 bp, Homo sapiens
tatatcattctacagaataa

SEQ ID NO: 4021416 - DNA, 15 bp, Homo sapiens
tatatccatgtactg

SEQ ID NO: 4021417 - DNA, 16 bp, Homo sapiens
tatatccatgtactgt

SEQ ID NO: 4021418 - DNA, 20 bp, Homo sapiens
tatatcctttctaacaaaaa

SEQ ID NO: 4021419 - DNA, 15 bp, Homo sapiens
tatatctaaatctgt

SEQ ID NO: 4021420 - DNA, 19 bp, Homo sapiens
tatatctgggttaagtgtt

SEQ ID NO: 4021421 - DNA, 16 bp, Homo sapiens
tatatgaataaagtgt

SEQ ID NO: 4021422 - DNA, 22 bp, Homo sapiens
tatatgaatttaaatataattc

SEQ ID NO: 4021423 - DNA, 17 bp, Homo sapiens
tatatgaccagaagcct

SEQ ID NO: 4021424 - DNA, 13 bp, Homo sapiens
tatatgatggggg

SEQ ID NO: 4021425 - DNA, 19 bp, Homo sapiens
tatatggatgattcagaaa

SEQ ID NO: 4021426 - DNA, 21 bp, Homo sapiens
tatatgtatatttttttaatt

SEQ ID NO: 4021427 - DNA, 23 bp, Homo sapiens
tatatgtgaaaaaaatgagactt

SEQ ID NO: 4021428 - DNA, 22 bp, Homo sapiens
tatatgtggactaaatatctgt

SEQ ID NO: 4021429 - DNA, 13 bp, Homo sapiens
tatatgtgtgtgt

SEQ ID NO: 4021430 - DNA, 22 bp, Homo sapiens
tatatgtgtgtgtatgtttgca

SEQ ID NO: 4021431 - DNA, 15 bp, Homo sapiens
tatattaatgtactt

SEQ ID NO: 4021432 - DNA, 21 bp, Homo sapiens
tatattacacatttgtacaga

SEQ ID NO: 4021433 - DNA, 15 bp, Homo sapiens
tatattagtgaagat

SEQ ID NO: 4021434 - DNA, 16 bp, Homo sapiens
tatattagtgaagatg

SEQ ID NO: 4021435 - DNA, 22 bp, Homo sapiens
tatattagtgaagatggtttca

SEQ ID NO: 4021436 - DNA, 12 bp, Homo sapiens
tatattatcata

SEQ ID NO: 4021437 - DNA, 15 bp, Homo sapiens
tatattatcataaga

SEQ ID NO: 4021438 - DNA, 23 bp, Homo sapiens
tatattattgtaagttgtacaaa

SEQ ID NO: 4021439 - DNA, 19 bp, Homo sapiens
tatattgtgtttgtgtatt

SEQ ID NO: 4021440 - DNA, 20 bp, Homo sapiens
tatatttaagcaacatcttt

SEQ ID NO: 4021441 - DNA, 15 bp, Homo sapiens
tatatttaattatta

SEQ ID NO: 4021442 - DNA, 17 bp, Homo sapiens
tatatttacaaataaaa

SEQ ID NO: 4021443 - DNA, 12 bp, Homo sapiens
tatatttacaat

SEQ ID NO: 4021444 - DNA, 16 bp, Homo sapiens
tatatttacaataaat

SEQ ID NO: 4021445 - DNA, 15 bp, Homo sapiens
tatatttataactca

SEQ ID NO: 4021446 - DNA, 13 bp, Homo sapiens
tatatttccttta

SEQ ID NO: 4021447 - DNA, 18 bp, Homo sapiens
tatatttcctttatgtga

SEQ ID NO: 4021448 - DNA, 14 bp, Homo sapiens
tatatttctttgtt

SEQ ID NO: 4021449 - DNA, 13 bp, Homo sapiens
tatatttgtagga

SEQ ID NO: 4021450 - DNA, 17 bp, Homo sapiens
tatatttgtaggagaaa

SEQ ID NO: 4021451 - DNA, 13 bp, Homo sapiens
tatatttgtatcg

SEQ ID NO: 4021452 - DNA, 21 bp, Homo sapiens
tatatttgtgatagcactttc

SEQ ID NO: 4021453 - DNA, 13 bp, Homo sapiens
tatattttaatag

SEQ ID NO: 4021454 - DNA, 21 bp, Homo sapiens
tatatttttaaaaaatgaaat

SEQ ID NO: 4021455 - DNA, 21 bp, Homo sapiens
tatatttttataataaacata

SEQ ID NO: 4021456 - DNA, 18 bp, Homo sapiens
tatatttttggttgtcaa

SEQ ID NO: 4021457 - DNA, 22 bp, Homo sapiens
tatattttttaatttgatgaaa

SEQ ID NO: 4021458 - DNA, 21 bp, Homo sapiens
tatcaaaaaaagactcagcca

SEQ ID NO: 4021459 - DNA, 13 bp, Homo sapiens
tatcaaaattcta

SEQ ID NO: 4021460 - DNA, 18 bp, Homo sapiens
tatcaaaccctagccttg

SEQ ID NO: 4021461 - DNA, 23 bp, Homo sapiens
tatcaaaccctagccttgcttgt

SEQ ID NO: 4021462 - DNA, 14 bp, Homo sapiens
tatcaagcaacatt

SEQ ID NO: 4021463 - DNA, 16 bp, Homo sapiens
tatcaagcaacattct

SEQ ID NO: 4021464 - DNA, 18 bp, Homo sapiens
tatcaagtggcatgtgct

SEQ ID NO: 4021465 - DNA, 18 bp, Homo sapiens
tatcaatatctaatatat

SEQ ID NO: 4021466 - DNA, 23 bp, Homo sapiens
tatcacaaccaccgttacaagta

SEQ ID NO: 4021467 - DNA, 23 bp, Homo sapiens
tagaaattagaaaaaaattacta

SEQ ID NO: 4021468 - DNA, 13 bp, Homo sapiens
tagaaattttgta

SEQ ID NO: 4021469 - DNA, 15 bp, Homo sapiens
tagaaattttgtaag

SEQ ID NO: 4021470 - DNA, 18 bp, Homo sapiens
tagaaattttgtaagaag

SEQ ID NO: 4021471 - DNA, 22 bp, Homo sapiens
tagaaattttgtaagaaggcaa

SEQ ID NO: 4021472 - DNA, 22 bp, Homo sapiens
tagaaatttttcagatgcttct

SEQ ID NO: 4021473 - DNA, 15 bp, Homo sapiens
tagaacactaattca

SEQ ID NO: 4021474 - DNA, 17 bp, Homo sapiens
tagaacagataatcagt

SEQ ID NO: 4021475 - DNA, 23 bp, Homo sapiens
tagaacaggttcttaaaaaggaa

SEQ ID NO: 4021476 - DNA, 16 bp, Homo sapiens
tagaacctttctgtgt

SEQ ID NO: 4021477 - DNA, 23 bp, Homo sapiens
tagaacgccagggaccccagaat

SEQ ID NO: 4021478 - DNA, 22 bp, Homo sapiens
tagaacgtccagggtttacatt

SEQ ID NO: 4021479 - DNA, 14 bp, Homo sapiens
tagaactatctgca

SEQ ID NO: 4021480 - DNA, 16 bp, Homo sapiens
tagaactatctgcatt

SEQ ID NO: 4021481 - DNA, 19 bp, Homo sapiens
tagaactcactctgggctg

SEQ ID NO: 4021482 - DNA, 15 bp, Homo sapiens
tagaactgtctgtga

SEQ ID NO: 4021483 - DNA, 21 bp, Homo sapiens
tagaacttgcagctgatgttg

SEQ ID NO: 4021484 - DNA, 19 bp, Homo sapiens
tagaactttaagcaacaag

SEQ ID NO: 4021485 - DNA, 16 bp, Homo sapiens
tagaagaaaagcccat

SEQ ID NO: 4021486 - DNA, 17 bp, Homo sapiens
tagaagaaaagcccatt

SEQ ID NO: 4021487 - DNA, 21 bp, Homo sapiens
tagaagcattccttctttgat

SEQ ID NO: 4021488 - DNA, 23 bp, Homo sapiens
tagaagcattccttctttgataa

SEQ ID NO: 4021489 - DNA, 16 bp, Homo sapiens
tagaagtcttagatgt

SEQ ID NO: 4021490 - DNA, 20 bp, Homo sapiens
tagaagtcttagatgtatat

SEQ ID NO: 4021491 - DNA, 16 bp, Homo sapiens
tagaagtgcatttctg

SEQ ID NO: 4021492 - DNA, 17 bp, Homo sapiens
tagaagtgcatttctga

SEQ ID NO: 4021493 - DNA, 12 bp, Homo sapiens
tagaataaaagc

SEQ ID NO: 4021494 - DNA, 16 bp, Homo sapiens
tagaataaaagctgtg

SEQ ID NO: 4021495 - DNA, 12 bp, Homo sapiens
tagaatatttat

SEQ ID NO: 4021496 - DNA, 14 bp, Homo sapiens
tagaatgagatctg

SEQ ID NO: 4021497 - DNA, 17 bp, Homo sapiens
tagaatgagatctgaat

SEQ ID NO: 4021498 - DNA, 21 bp, Homo sapiens
tagaatggataaaataatgct

SEQ ID NO: 4021499 - DNA, 19 bp, Homo sapiens
tagaatgtcagatttctgg

SEQ ID NO: 4021500 - DNA, 21 bp, Homo sapiens
tagaatgtcagatttctggtt

SEQ ID NO: 4021501 - DNA, 20 bp, Homo sapiens
tagaatgtgttttctgaata

SEQ ID NO: 4021502 - DNA, 15 bp, Homo sapiens
tagaatgttgaaaag

SEQ ID NO: 4021503 - DNA, 17 bp, Homo sapiens
tagaattataagtcaca

SEQ ID NO: 4021504 - DNA, 16 bp, Homo sapiens
tagaattatttaaaca

SEQ ID NO: 4021505 - DNA, 21 bp, Homo sapiens
tagaattctgtattggatata

SEQ ID NO: 4021506 - DNA, 15 bp, Homo sapiens
tagaattttctccct

SEQ ID NO: 4021507 - DNA, 18 bp, Homo sapiens
tagacaaaaggaaaggtc

SEQ ID NO: 4021508 - DNA, 20 bp, Homo sapiens
tagacaagatattgtacata

SEQ ID NO: 4021509 - DNA, 15 bp, Homo sapiens
tagacaattgaggta

SEQ ID NO: 4021510 - DNA, 18 bp, Homo sapiens
tagacaattgaggtaagt

SEQ ID NO: 4021511 - DNA, 16 bp, Homo sapiens
tagaccaaagcaaaga

SEQ ID NO: 4021512 - DNA, 20 bp, Homo sapiens
tagaccaaagcaaagaaaat

SEQ ID NO: 4021513 - DNA, 16 bp, Homo sapiens
tagaccaggatttcta

SEQ ID NO: 4021514 - DNA, 21 bp, Homo sapiens
tagacccaggtggagggcaca

SEQ ID NO: 4021515 - DNA, 20 bp, Homo sapiens
tagactattccttttctgta

SEQ ID NO: 4021516 - DNA, 16 bp, Homo sapiens
tagactcttcactgtt

SEQ ID NO: 4021517 - DNA, 20 bp, Homo sapiens
tagactggcctgaaccacag

SEQ ID NO: 4021518 - DNA, 14 bp, Homo sapiens
atggagcctgctct

SEQ ID NO: 4021519 - DNA, 16 bp, Homo sapiens
atggagctttctgtat

SEQ ID NO: 4021520 - DNA, 13 bp, Homo sapiens
atggaggaatatg

SEQ ID NO: 4021521 - DNA, 19 bp, Homo sapiens
atggagggcttggcccagc

SEQ ID NO: 4021522 - DNA, 15 bp, Homo sapiens
atggaggggaattca

SEQ ID NO: 4021523 - DNA, 17 bp, Homo sapiens
atggaggggagtgttgg

SEQ ID NO: 4021524 - DNA, 22 bp, Homo sapiens
atggaggggtggtcctgactca

SEQ ID NO: 4021525 - DNA, 22 bp, Homo sapiens
atggagtgagtcacctgctcca

SEQ ID NO: 4021526 - DNA, 18 bp, Homo sapiens
atggagtgtgtattgttc

SEQ ID NO: 4021527 - DNA, 16 bp, Homo sapiens
atggataaactgagcc

SEQ ID NO: 4021528 - DNA, 13 bp, Homo sapiens
atggatgattcag

SEQ ID NO: 4021529 - DNA, 13 bp, Homo sapiens
atggatgccaata

SEQ ID NO: 4021530 - DNA, 14 bp, Homo sapiens
atggatttcagaag

SEQ ID NO: 4021531 - DNA, 19 bp, Homo sapiens
atggatttcgtttttcttg

SEQ ID NO: 4021532 - DNA, 14 bp, Homo sapiens
atggatttgaagca

SEQ ID NO: 4021533 - DNA, 15 bp, Homo sapiens
atggatttgaagcaa

SEQ ID NO: 4021534 - DNA, 18 bp, Homo sapiens
atggattttctattgtta

SEQ ID NO: 4021535 - DNA, 16 bp, Homo sapiens
atggatttttacaaga

SEQ ID NO: 4021536 - DNA, 12 bp, Homo sapiens
atggcaaatgca

SEQ ID NO: 4021537 - DNA, 14 bp, Homo sapiens
atggcaacagatct

SEQ ID NO: 4021538 - DNA, 17 bp, Homo sapiens
atggcaacagatctgga

SEQ ID NO: 4021539 - DNA, 24 bp, Homo sapiens
atggcaacagatctggaacctcag

SEQ ID NO: 4021540 - DNA, 18 bp, Homo sapiens
atggcaatagggtagaat

SEQ ID NO: 4021541 - DNA, 19 bp, Homo sapiens
atggcagaagacaccagag

SEQ ID NO: 4021542 - DNA, 12 bp, Homo sapiens
atggcagaaggg

SEQ ID NO: 4021543 - DNA, 12 bp, Homo sapiens
atggcagtattt

SEQ ID NO: 4021544 - DNA, 16 bp, Homo sapiens
atggcagtatttcatt

SEQ ID NO: 4021545 - DNA, 20 bp, Homo sapiens
atggcatcaaccaccatgga

SEQ ID NO: 4021546 - DNA, 14 bp, Homo sapiens
atggccacatttaa

SEQ ID NO: 4021547 - DNA, 22 bp, Homo sapiens
atggccagcccctggggcccag

SEQ ID NO: 4021548 - DNA, 16 bp, Homo sapiens
atggccaggtggccac

SEQ ID NO: 4021549 - DNA, 22 bp, Homo sapiens
atggccaggtggccactccaga

SEQ ID NO: 4021550 - DNA, 16 bp, Homo sapiens
atggccataggagagg

SEQ ID NO: 4021551 - DNA, 11 bp, Homo sapiens
atggcccctct

SEQ ID NO: 4021552 - DNA, 23 bp, Homo sapiens
atggcccctctgacctgcactgg

SEQ ID NO: 4021553 - DNA, 17 bp, Homo sapiens
atggcccggatgctgct

SEQ ID NO: 4021554 - DNA, 18 bp, Homo sapiens
atggccggagaggaccgg

SEQ ID NO: 4021555 - DNA, 16 bp, Homo sapiens
atggccgtggatggcc

SEQ ID NO: 4021556 - DNA, 13 bp, Homo sapiens
atggcctcagctg

SEQ ID NO: 4021557 - DNA, 14 bp, Homo sapiens
atggcctcagctgc

SEQ ID NO: 4021558 - DNA, 15 bp, Homo sapiens
atggcctcagctgcc

SEQ ID NO: 4021559 - DNA, 19 bp, Homo sapiens
atggcctcagctgcctcac

SEQ ID NO: 4021560 - DNA, 21 bp, Homo sapiens
atggcctcttactaatgtaaa

SEQ ID NO: 4021561 - DNA, 14 bp, Homo sapiens
atggcctggaggga

SEQ ID NO: 4021562 - DNA, 19 bp, Homo sapiens
atggccttaatttcctttt

SEQ ID NO: 4021563 - DNA, 13 bp, Homo sapiens
atggcctttgctt

SEQ ID NO: 4021564 - DNA, 21 bp, Homo sapiens
atggcgcctgctccctccaga

SEQ ID NO: 4021565 - DNA, 22 bp, Homo sapiens
atggcgcctgctccctccagaa

SEQ ID NO: 4021566 - DNA, 18 bp, Homo sapiens
atggctactttggtttct

SEQ ID NO: 4021567 - DNA, 15 bp, Homo sapiens
atggctagcctttct

SEQ ID NO: 4021568 - DNA, 13 bp, Homo sapiens
atggctataaata

SEQ ID NO: 4021569 - DNA, 14 bp, Homo sapiens
atggctatgcttaa

SEQ ID NO: 4021570 - DNA, 21 bp, Homo sapiens
atggctcagagcttgaagatt

SEQ ID NO: 4021571 - DNA, 14 bp, Homo sapiens
atggctcatcagat

SEQ ID NO: 4021572 - DNA, 14 bp, Homo sapiens
atggctctgcaccc

SEQ ID NO: 4021573 - DNA, 12 bp, Homo sapiens
atggctgcccag

SEQ ID NO: 4021574 - DNA, 20 bp, Homo sapiens
atggctgtgtttgcagcctg

SEQ ID NO: 4021575 - DNA, 20 bp, Homo sapiens
tatccttataggcctgtccc

SEQ ID NO: 4021576 - DNA, 14 bp, Homo sapiens
tatccttccttcag

SEQ ID NO: 4021577 - DNA, 21 bp, Homo sapiens
tatcgaaataacaatgttaag

SEQ ID NO: 4021578 - DNA, 16 bp, Homo sapiens
tatcgagtttgcaatg

SEQ ID NO: 4021579 - DNA, 16 bp, Homo sapiens
tatcgatctcttattt

SEQ ID NO: 4021580 - DNA, 16 bp, Homo sapiens
tatcgatgttttatta

SEQ ID NO: 4021581 - DNA, 22 bp, Homo sapiens
tatcgatgttttattatttcta

SEQ ID NO: 4021582 - DNA, 20 bp, Homo sapiens
tatcgcaccactgtgtattt

SEQ ID NO: 4021583 - DNA, 14 bp, Homo sapiens
tatcggaagcagtg

SEQ ID NO: 4021584 - DNA, 18 bp, Homo sapiens
tatcgggagcagtgtctt

SEQ ID NO: 4021585 - DNA, 21 bp, Homo sapiens
tatcgtaaccagccagatcct

SEQ ID NO: 4021586 - DNA, 16 bp, Homo sapiens
tatcgtattcaccttc

SEQ ID NO: 4021587 - DNA, 18 bp, Homo sapiens
tatcgttattataaatgt

SEQ ID NO: 4021588 - DNA, 15 bp, Homo sapiens
tatctaaagtttgtt

SEQ ID NO: 4021589 - DNA, 15 bp, Homo sapiens
tatctaaatgttgaa

SEQ ID NO: 4021590 - DNA, 16 bp, Homo sapiens
tatctattaaagtgac

SEQ ID NO: 4021591 - DNA, 13 bp, Homo sapiens
tatctattaatat

SEQ ID NO: 4021592 - DNA, 18 bp, Homo sapiens
tatctattaatatatgta

SEQ ID NO: 4021593 - DNA, 19 bp, Homo sapiens
tatctattaatatatgtat

SEQ ID NO: 4021594 - DNA, 13 bp, Homo sapiens
tatctcagaaagt

SEQ ID NO: 4021595 - DNA, 19 bp, Homo sapiens
tatctcagaaagtgcctga

SEQ ID NO: 4021596 - DNA, 22 bp, Homo sapiens
tatctcagtcatgcataaatat

SEQ ID NO: 4021597 - DNA, 14 bp, Homo sapiens
tatctcatttaatt

SEQ ID NO: 4021598 - DNA, 18 bp, Homo sapiens
tatctcatttaatttgtt

SEQ ID NO: 4021599 - DNA, 20 bp, Homo sapiens
tatctcatttaatttgttat

SEQ ID NO: 4021600 - DNA, 19 bp, Homo sapiens
tatctccatggccctgtcc

SEQ ID NO: 4021601 - DNA, 22 bp, Homo sapiens
tatctccatggccctgtcccag

SEQ ID NO: 4021602 - DNA, 13 bp, Homo sapiens
tatctcctgctct

SEQ ID NO: 4021603 - DNA, 16 bp, Homo sapiens
tatctcgtgggagagc

SEQ ID NO: 4021604 - DNA, 16 bp, Homo sapiens
tatctctatttaatat

SEQ ID NO: 4021605 - DNA, 17 bp, Homo sapiens
tatctctatttaatatt

SEQ ID NO: 4021606 - DNA, 16 bp, Homo sapiens
tatctcttttatattt

SEQ ID NO: 4021607 - DNA, 15 bp, Homo sapiens
tatctgaaaactgga

SEQ ID NO: 4021608 - DNA, 16 bp, Homo sapiens
tatctgaaaactggaa

SEQ ID NO: 4021609 - DNA, 14 bp, Homo sapiens
tatctgaaaatgta

SEQ ID NO: 4021610 - DNA, 15 bp, Homo sapiens
tatctgaaaatgtat

SEQ ID NO: 4021611 - DNA, 22 bp, Homo sapiens
tatctgcaagtgaggtgtgtca

SEQ ID NO: 4021612 - DNA, 11 bp, Homo sapiens
tatctgcagaa

SEQ ID NO: 4021613 - DNA, 20 bp, Homo sapiens
tatctggaggccttccagct

SEQ ID NO: 4021614 - DNA, 16 bp, Homo sapiens
tatctgggttaagtgt

SEQ ID NO: 4021615 - DNA, 17 bp, Homo sapiens
tatctgggttaagtgtt

SEQ ID NO: 4021616 - DNA, 20 bp, Homo sapiens
tatctgggttaagtgtttat

SEQ ID NO: 4021617 - DNA, 13 bp, Homo sapiens
tatctgtaatggt

SEQ ID NO: 4021618 - DNA, 18 bp, Homo sapiens
tatctgtcatatagtaaa

SEQ ID NO: 4021619 - DNA, 21 bp, Homo sapiens
tatctgtcatctctctggggc

SEQ ID NO: 4021620 - DNA, 22 bp, Homo sapiens
tatctgtccgtggaaaatttca

SEQ ID NO: 4021621 - DNA, 19 bp, Homo sapiens
tatctgtgcgtgaaacaca

SEQ ID NO: 4021622 - DNA, 20 bp, Homo sapiens
tatctgtgcgtgaaacacac

SEQ ID NO: 4021623 - DNA, 14 bp, Homo sapiens
tatcttagttacat

SEQ ID NO: 4021624 - DNA, 17 bp, Homo sapiens
tatcttattaaagtatt

SEQ ID NO: 4021625 - DNA, 14 bp, Homo sapiens
tatcttcaaacttt

SEQ ID NO: 4021626 - DNA, 18 bp, Homo sapiens
tatcttcagctctttttg

SEQ ID NO: 4021627 - DNA, 17 bp, Homo sapiens
tatcttccatatttgga

SEQ ID NO: 4021628 - DNA, 17 bp, Homo sapiens
tatcttgtctctgggct

SEQ ID NO: 4021629 - DNA, 14 bp, Homo sapiens
tatcttttctttca

SEQ ID NO: 4021630 - DNA, 16 bp, Homo sapiens
tatcttttctttcaaa

SEQ ID NO: 4021631 - DNA, 18 bp, Homo sapiens
tatgaaaaacaaaaataa

SEQ ID NO: 4021632 - DNA, 17 bp, Homo sapiens
tatgaaaactatacaac

SEQ ID NO: 4021633 - DNA, 22 bp, Homo sapiens
tatgaaaactatacaacaaagg

SEQ ID NO: 4021634 - DNA, 15 bp, Homo sapiens
gtgtggttatgaact

SEQ ID NO: 4021635 - DNA, 11 bp, Homo sapiens
gtgtgtaaata

SEQ ID NO: 4021636 - DNA, 20 bp, Homo sapiens
gtgtgtagagttaagaagct

SEQ ID NO: 4021637 - DNA, 21 bp, Homo sapiens
gtgtgtagagttaagaagctg

SEQ ID NO: 4021638 - DNA, 14 bp, Homo sapiens
gttgattctctcca

SEQ ID NO: 4021639 - DNA, 22 bp, Homo sapiens
gttgatttttttttttttttcc

SEQ ID NO: 4021640 - DNA, 16 bp, Homo sapiens
gttgcaagatgtgaat

SEQ ID NO: 4021641 - DNA, 18 bp, Homo sapiens
gttgcaagatgtgaatta

SEQ ID NO: 4021642 - DNA, 20 bp, Homo sapiens
gttgcagatgaaatgttctg

SEQ ID NO: 4021643 - DNA, 19 bp, Homo sapiens
gttgcagatgtattgactg

SEQ ID NO: 4021644 - DNA, 15 bp, Homo sapiens
gttgcagtggagagg

SEQ ID NO: 4021645 - DNA, 16 bp, Homo sapiens
gttgcatttagaaatc

SEQ ID NO: 4021646 - DNA, 20 bp, Homo sapiens
gttgccaaatatgtcctggg

SEQ ID NO: 4021647 - DNA, 20 bp, Homo sapiens
gttgccaaatctggctcctt

SEQ ID NO: 4021648 - DNA, 21 bp, Homo sapiens
gttgccacatttagtcctgta

SEQ ID NO: 4021649 - DNA, 17 bp, Homo sapiens
gttgccaccatgtattc

SEQ ID NO: 4021650 - DNA, 18 bp, Homo sapiens
gttgcccagcctctttcc

SEQ ID NO: 4021651 - DNA, 21 bp, Homo sapiens
gttgcccgaaactaagccagg

SEQ ID NO: 4021652 - DNA, 19 bp, Homo sapiens
gttgccctagcccagactc

SEQ ID NO: 4021653 - DNA, 15 bp, Homo sapiens
gttgcctttatttgc

SEQ ID NO: 4021654 - DNA, 20 bp, Homo sapiens
gttgcgacggagagaaaaaa

SEQ ID NO: 4021655 - DNA, 17 bp, Homo sapiens
gttgcgttcctttcttt

SEQ ID NO: 4021656 - DNA, 22 bp, Homo sapiens
gttgctaagaagcgagcactga

SEQ ID NO: 4021657 - DNA, 22 bp, Homo sapiens
gttttaaacacatgccttaaat

SEQ ID NO: 4021658 - DNA, 23 bp, Homo sapiens
gttttaaacattaatagcagcct

SEQ ID NO: 4021659 - DNA, 19 bp, Homo sapiens
gttttaaatttatttcaaa

SEQ ID NO: 4021660 - DNA, 17 bp, Homo sapiens
gttttaagcaaatgcat

SEQ ID NO: 4021661 - DNA, 22 bp, Homo sapiens
gttttaagcaaatgcattctat

SEQ ID NO: 4021662 - DNA, 18 bp, Homo sapiens
gttttaatctgaaattct

SEQ ID NO: 4021663 - DNA, 15 bp, Homo sapiens
gttttaatgtaattt

SEQ ID NO: 4021664 - DNA, 12 bp, Homo sapiens
gttttacattgt

SEQ ID NO: 4021665 - DNA, 18 bp, Homo sapiens
gttttagaggcattgtta

SEQ ID NO: 4021666 - DNA, 17 bp, Homo sapiens
gttttaggtagaaaaac

SEQ ID NO: 4021667 - DNA, 15 bp, Homo sapiens
gttttatactgaagg

SEQ ID NO: 4021668 - DNA, 23 bp, Homo sapiens
gttttatactgtacttaataaat

SEQ ID NO: 4021669 - DNA, 11 bp, Homo sapiens
gttttatcaag

SEQ ID NO: 4021670 - DNA, 23 bp, Homo sapiens
gttttattattatcgctttatgt

SEQ ID NO: 4021671 - DNA, 21 bp, Homo sapiens
gttttatttatcaaaatgtag

SEQ ID NO: 4021672 - DNA, 17 bp, Homo sapiens
gttttatttgtcagttt

SEQ ID NO: 4021673 - DNA, 17 bp, Homo sapiens
gttttcaaattggactt

SEQ ID NO: 4021674 - DNA, 13 bp, Homo sapiens
gttttcaagtcaa

SEQ ID NO: 4021675 - DNA, 17 bp, Homo sapiens
gttttcatttggttcat

SEQ ID NO: 4021676 - DNA, 13 bp, Homo sapiens
gttttccatgaaa

SEQ ID NO: 4021677 - DNA, 20 bp, Homo sapiens
gttttcctctatacatctct

SEQ ID NO: 4021678 - DNA, 22 bp, Homo sapiens
gttttcggtgccatcagtgccc

SEQ ID NO: 4021679 - DNA, 18 bp, Homo sapiens
gttttctatttatgcctt

SEQ ID NO: 4021680 - DNA, 13 bp, Homo sapiens
gttttctctctat

SEQ ID NO: 4021681 - DNA, 17 bp, Homo sapiens
gttttctgaaaatataa

SEQ ID NO: 4021682 - DNA, 16 bp, Homo sapiens
taaacatttgttcctg

SEQ ID NO: 4021683 - DNA, 21 bp, Homo sapiens
taaaccaacctttaaaattgt

SEQ ID NO: 4021684 - DNA, 23 bp, Homo sapiens
taaaccaacctttaaaattgtca

SEQ ID NO: 4021685 - DNA, 15 bp, Homo sapiens
taaaccaaggactga

SEQ ID NO: 4021686 - DNA, 14 bp, Homo sapiens
taaaccactgtgcg

SEQ ID NO: 4021687 - DNA, 20 bp, Homo sapiens
taaacccgaatcattgtttt

SEQ ID NO: 4021688 - DNA, 20 bp, Homo sapiens
taaaccgtcccctccttccc

SEQ ID NO: 4021689 - DNA, 23 bp, Homo sapiens
taaacctttttcttgatcttaaa

SEQ ID NO: 4021690 - DNA, 16 bp, Homo sapiens
taaacgcattatcagc

SEQ ID NO: 4021691 - DNA, 17 bp, Homo sapiens
taaacgtgatgatcagc

SEQ ID NO: 4021692 - DNA, 14 bp, Homo sapiens
taaactaaataatg

SEQ ID NO: 4021693 - DNA, 14 bp, Homo sapiens
taaactactctttg

SEQ ID NO: 4021694 - DNA, 15 bp, Homo sapiens
taaactactctttga

SEQ ID NO: 4021695 - DNA, 18 bp, Homo sapiens
taaactactctttgattt

SEQ ID NO: 4021696 - DNA, 15 bp, Homo sapiens
taaactagagaaggg

SEQ ID NO: 4021697 - DNA, 17 bp, Homo sapiens
taaactattggaaagta

SEQ ID NO: 4021698 - DNA, 11 bp, Homo sapiens
taaactcaggg

SEQ ID NO: 4021699 - DNA, 23 bp, Homo sapiens
taaactgaatataaagcttaata

SEQ ID NO: 4021700 - DNA, 12 bp, Homo sapiens
taaactgagcct

SEQ ID NO: 4021701 - DNA, 16 bp, Homo sapiens
taaactgcaaacagaa

SEQ ID NO: 4021702 - DNA, 19 bp, Homo sapiens
taaacttagaggaaaatga

SEQ ID NO: 4021703 - DNA, 18 bp, Homo sapiens
taaacttccccatcttct

SEQ ID NO: 4021704 - DNA, 16 bp, Homo sapiens
taaacttgaagcagtc

SEQ ID NO: 4021705 - DNA, 15 bp, Homo sapiens
taaacttgtcttttc

SEQ ID NO: 4021706 - DNA, 17 bp, Homo sapiens
taaacttttaattcatt

SEQ ID NO: 4021707 - DNA, 13 bp, Homo sapiens
taaagaaaacttc

SEQ ID NO: 4021708 - DNA, 17 bp, Homo sapiens
taaagaaatatttacct

SEQ ID NO: 4021709 - DNA, 18 bp, Homo sapiens
taaagaaatatttaccta

SEQ ID NO: 4021710 - DNA, 18 bp, Homo sapiens
taaatagtatttgagagt

SEQ ID NO: 4021711 - DNA, 13 bp, Homo sapiens
taaatataacact

SEQ ID NO: 4021712 - DNA, 14 bp, Homo sapiens
taaatataagcctt

SEQ ID NO: 4021713 - DNA, 22 bp, Homo sapiens
taaatataagccttttatactg

SEQ ID NO: 4021714 - DNA, 16 bp, Homo sapiens
taaatataattctgta

SEQ ID NO: 4021715 - DNA, 18 bp, Homo sapiens
taaatataattctgtaaa

SEQ ID NO: 4021716 - DNA, 19 bp, Homo sapiens
taaatataattctgtaaat

SEQ ID NO: 4021717 - DNA, 16 bp, Homo sapiens
taaatatagattagaa

SEQ ID NO: 4021718 - DNA, 17 bp, Homo sapiens
taaatatagattagaaa

SEQ ID NO: 4021719 - DNA, 21 bp, Homo sapiens
taaatatatattttgtacttt

SEQ ID NO: 4021720 - DNA, 17 bp, Homo sapiens
taaatatcttctgattt

SEQ ID NO: 4021721 - DNA, 18 bp, Homo sapiens
taaatatcttctgatttg

SEQ ID NO: 4021722 - DNA, 21 bp, Homo sapiens
taaatatcttttatgtttgaa

SEQ ID NO: 4021723 - DNA, 23 bp, Homo sapiens
taaatatcttttatgtttgaata

SEQ ID NO: 4021724 - DNA, 23 bp, Homo sapiens
taaatatgaatctgctcacttta

SEQ ID NO: 4021725 - DNA, 14 bp, Homo sapiens
taaatatgcagtga

SEQ ID NO: 4021726 - DNA, 17 bp, Homo sapiens
taaatatgcagtgatat

SEQ ID NO: 4021727 - DNA, 18 bp, Homo sapiens
taaatatgttttttagat

SEQ ID NO: 4021728 - DNA, 19 bp, Homo sapiens
taaatattagttaatggat

SEQ ID NO: 4021729 - DNA, 21 bp, Homo sapiens
taaatattagttaatggatta

SEQ ID NO: 4021730 - DNA, 17 bp, Homo sapiens
taaatatttatttatgt

SEQ ID NO: 4021731 - DNA, 14 bp, Homo sapiens
taaatatttcctta

SEQ ID NO: 4021732 - DNA, 14 bp, Homo sapiens
taaatcaatgtcac

SEQ ID NO: 4021733 - DNA, 23 bp, Homo sapiens
taaatcaatgtcacttaaaggct

SEQ ID NO: 4021734 - DNA, 16 bp, Homo sapiens
taaatcacacattcag

SEQ ID NO: 4021735 - DNA, 18 bp, Homo sapiens
taaatcagtaagaggtgt

SEQ ID NO: 4021736 - DNA, 14 bp, Homo sapiens
taaatcagttggag

SEQ ID NO: 4021737 - DNA, 16 bp, Homo sapiens
taaatcagttggagtt

SEQ ID NO: 4021738 - DNA, 21 bp, Homo sapiens
taaatcatattagtattaata

SEQ ID NO: 4021739 - DNA, 14 bp, Homo sapiens
taaatcatgtatgt

SEQ ID NO: 4021740 - DNA, 17 bp, Homo sapiens
taacaaatatgctaatt

SEQ ID NO: 4021741 - DNA, 18 bp, Homo sapiens
taacaaatatgctaattt

SEQ ID NO: 4021742 - DNA, 12 bp, Homo sapiens
taacaaattatg

SEQ ID NO: 4021743 - DNA, 16 bp, Homo sapiens
taacaagatctttcag

SEQ ID NO: 4021744 - DNA, 18 bp, Homo sapiens
taacaaggaatgcctgtg

SEQ ID NO: 4021745 - DNA, 20 bp, Homo sapiens
taacaaggaatgcctgtgcc

SEQ ID NO: 4021746 - DNA, 16 bp, Homo sapiens
taacaagtaccaaagt

SEQ ID NO: 4021747 - DNA, 16 bp, Homo sapiens
taacaataactactgt

SEQ ID NO: 4021748 - DNA, 17 bp, Homo sapiens
taacaataactactgtg

SEQ ID NO: 4021749 - DNA, 23 bp, Homo sapiens
taacaataactactgtgttcctg

SEQ ID NO: 4021750 - DNA, 13 bp, Homo sapiens
taacaatacaaat

SEQ ID NO: 4021751 - DNA, 16 bp, Homo sapiens
taacaatacaaatgga

SEQ ID NO: 4021752 - DNA, 20 bp, Homo sapiens
taacaatacaaatggatttt

SEQ ID NO: 4021753 - DNA, 21 bp, Homo sapiens
taacaatgacactagaaaact

SEQ ID NO: 4021754 - DNA, 21 bp, Homo sapiens
taacaatgcagcaaggccctg

SEQ ID NO: 4021755 - DNA, 13 bp, Homo sapiens
taacaatgttaag

SEQ ID NO: 4021756 - DNA, 14 bp, Homo sapiens
taacaatgttaagg

SEQ ID NO: 4021757 - DNA, 14 bp, Homo sapiens
taacaattgtgtag

SEQ ID NO: 4021758 - DNA, 22 bp, Homo sapiens
taacaatttctgtccttcagat

SEQ ID NO: 4021759 - DNA, 18 bp, Homo sapiens
taacaattttaatgctat

SEQ ID NO: 4021760 - DNA, 18 bp, Homo sapiens
taacacaaatgctcaaag

SEQ ID NO: 4021761 - DNA, 21 bp, Homo sapiens
taacacacacagaaaagcata

SEQ ID NO: 4021762 - DNA, 16 bp, Homo sapiens
taacacagagagacag

SEQ ID NO: 4021763 - DNA, 17 bp, Homo sapiens
taacacataaacaattc

SEQ ID NO: 4021764 - DNA, 11 bp, Homo sapiens
taacacattat

SEQ ID NO: 4021765 - DNA, 22 bp, Homo sapiens
taacacattatcgggagcagtg

SEQ ID NO: 4021766 - DNA, 17 bp, Homo sapiens
taacacatttgattctg

SEQ ID NO: 4021767 - DNA, 20 bp, Homo sapiens
taacaccaatcccagggctg

SEQ ID NO: 4021768 - DNA, 12 bp, Homo sapiens
taacagaacagc

SEQ ID NO: 4021769 - DNA, 14 bp, Homo sapiens
taacagaacagctt

SEQ ID NO: 4021770 - DNA, 21 bp, Homo sapiens
taacagaacagcttcaggtta

SEQ ID NO: 4021771 - DNA, 12 bp, Homo sapiens
taacagatgcaa

SEQ ID NO: 4021772 - DNA, 23 bp, Homo sapiens
taacagcattcttgtcacaataa

SEQ ID NO: 4021773 - DNA, 15 bp, Homo sapiens
taacagccgctccag

SEQ ID NO: 4021774 - DNA, 18 bp, Homo sapiens
taacagccgctccagagt

SEQ ID NO: 4021775 - DNA, 18 bp, Homo sapiens
taactgtgaagtttacat

SEQ ID NO: 4021776 - DNA, 18 bp, Homo sapiens
taactgtgccagttcttt

SEQ ID NO: 4021777 - DNA, 13 bp, Homo sapiens
taactgtggtgtt

SEQ ID NO: 4021778 - DNA, 18 bp, Homo sapiens
taactgtgtatgtacata

SEQ ID NO: 4021779 - DNA, 20 bp, Homo sapiens
taactgtgtatgtacatata

SEQ ID NO: 4021780 - DNA, 22 bp, Homo sapiens
taactgttaactatgacagata

SEQ ID NO: 4021781 - DNA, 18 bp, Homo sapiens
taacttaaaaaaatgaca

SEQ ID NO: 4021782 - DNA, 19 bp, Homo sapiens
taacttaaaaatgtaaata

SEQ ID NO: 4021783 - DNA, 23 bp, Homo sapiens
taacttaaaaatgtaaatattct

SEQ ID NO: 4021784 - DNA, 15 bp, Homo sapiens
taacttagcatgtgt

SEQ ID NO: 4021785 - DNA, 14 bp, Homo sapiens
taacttatattgaa

SEQ ID NO: 4021786 - DNA, 16 bp, Homo sapiens
taacttatttagagat

SEQ ID NO: 4021787 - DNA, 23 bp, Homo sapiens
taacttatttatgttaaaagatt

SEQ ID NO: 4021788 - DNA, 11 bp, Homo sapiens
taacttcctgc

SEQ ID NO: 4021789 - DNA, 18 bp, Homo sapiens
taacttcctgctgcaccc

SEQ ID NO: 4021790 - DNA, 22 bp, Homo sapiens
taacttcctgctgcaccctgcg

SEQ ID NO: 4021791 - DNA, 22 bp, Homo sapiens
taacttctatattttaatagaa

SEQ ID NO: 4021792 - DNA, 22 bp, Homo sapiens
taacttgaatttggtctgtata

SEQ ID NO: 4021793 - DNA, 22 bp, Homo sapiens
taacttgagagtagatggtttg

SEQ ID NO: 4021794 - DNA, 21 bp, Homo sapiens
taacttgagttttatttattt

SEQ ID NO: 4021795 - DNA, 13 bp, Homo sapiens
taacttggggagg

SEQ ID NO: 4021796 - DNA, 15 bp, Homo sapiens
taactttaagtttca

SEQ ID NO: 4021797 - DNA, 22 bp, Homo sapiens
taactttaattctctttcaaag

SEQ ID NO: 4021798 - DNA, 17 bp, Homo sapiens
taactttatcacattat

SEQ ID NO: 4021799 - DNA, 19 bp, Homo sapiens
taacttttttttctctctt

SEQ ID NO: 4021800 - DNA, 20 bp, Homo sapiens
taacttttttttctctcttt

SEQ ID NO: 4021801 - DNA, 22 bp, Homo sapiens
taacttttttttctctcttttg

SEQ ID NO: 4021802 - DNA, 22 bp, Homo sapiens
taagaaaagagatattttaaaa

SEQ ID NO: 4021803 - DNA, 12 bp, Homo sapiens
taagaaaagatt

SEQ ID NO: 4021804 - DNA, 15 bp, Homo sapiens
taagaaaagcacttt

SEQ ID NO: 4021805 - DNA, 21 bp, Homo sapiens
taagaaaagcacttttgttat

SEQ ID NO: 4021806 - DNA, 19 bp, Homo sapiens
taagaaaagtattttgaag

SEQ ID NO: 4021807 - DNA, 14 bp, Homo sapiens
taagaaaatacaat

SEQ ID NO: 4021808 - DNA, 17 bp, Homo sapiens
taagaaaatacaataaa

SEQ ID NO: 4021809 - DNA, 18 bp, Homo sapiens
taagaaagtgaagcaaat

SEQ ID NO: 4021810 - DNA, 16 bp, Homo sapiens
taagaaatatgtgaga

SEQ ID NO: 4021811 - DNA, 22 bp, Homo sapiens
taagggctggtctctgctgaag

SEQ ID NO: 4021812 - DNA, 13 bp, Homo sapiens
taagggtgggtgc

SEQ ID NO: 4021813 - DNA, 23 bp, Homo sapiens
taaggtatttcgaaactgccaag

SEQ ID NO: 4021814 - DNA, 16 bp, Homo sapiens
taagtaaatctcttct

SEQ ID NO: 4021815 - DNA, 13 bp, Homo sapiens
taagtaaatgcta

SEQ ID NO: 4021816 - DNA, 20 bp, Homo sapiens
taagtaacttcacattaaaa

SEQ ID NO: 4021817 - DNA, 20 bp, Homo sapiens
taagtaatcaataaagaaaa

SEQ ID NO: 4021818 - DNA, 16 bp, Homo sapiens
taagtagaacaaaaaa

SEQ ID NO: 4021819 - DNA, 19 bp, Homo sapiens
taagtagaacaaaaaaccc

SEQ ID NO: 4021820 - DNA, 20 bp, Homo sapiens
taagtatacagttcaataaa

SEQ ID NO: 4021821 - DNA, 19 bp, Homo sapiens
taagtattcttatttaatg

SEQ ID NO: 4021822 - DNA, 20 bp, Homo sapiens
taagtattcttatttaatga

SEQ ID NO: 4021823 - DNA, 17 bp, Homo sapiens
taagtatttatatattt

SEQ ID NO: 4021824 - DNA, 23 bp, Homo sapiens
taagtatttatatatttataact

SEQ ID NO: 4021825 - DNA, 14 bp, Homo sapiens
taagtatttctgat

SEQ ID NO: 4021826 - DNA, 16 bp, Homo sapiens
taagtctcctgtctta

SEQ ID NO: 4021827 - DNA, 16 bp, Homo sapiens
taagtgaaaaggtcat

SEQ ID NO: 4021828 - DNA, 17 bp, Homo sapiens
taagtgcgtgtgtagag

SEQ ID NO: 4021829 - DNA, 19 bp, Homo sapiens
taagtggggcaaaaccttg

SEQ ID NO: 4021830 - DNA, 20 bp, Homo sapiens
taagtggggttgcaaccact

SEQ ID NO: 4021831 - DNA, 21 bp, Homo sapiens
taagtggggttgcaaccactg

SEQ ID NO: 4021832 - DNA, 18 bp, Homo sapiens
taagtggttttcttcagg

SEQ ID NO: 4021833 - DNA, 14 bp, Homo sapiens
taagtgtacatatg

SEQ ID NO: 4021834 - DNA, 18 bp, Homo sapiens
taagtgtacatatgtgct

SEQ ID NO: 4021835 - DNA, 13 bp, Homo sapiens
taagtgtattttt

SEQ ID NO: 4021836 - DNA, 23 bp, Homo sapiens
taagtgtatttttcaataaagca

SEQ ID NO: 4021837 - DNA, 22 bp, Homo sapiens
taagtgtgtcttcctagaattc

SEQ ID NO: 4021838 - DNA, 13 bp, Homo sapiens
taagttaataatg

SEQ ID NO: 4021839 - DNA, 15 bp, Homo sapiens
taagttatcaacttt

SEQ ID NO: 4021840 - DNA, 16 bp, Homo sapiens
taagttcacattagaa

SEQ ID NO: 4021841 - DNA, 12 bp, Homo sapiens
taagttcttatg

SEQ ID NO: 4021842 - DNA, 21 bp, Homo sapiens
taagttcttatgaggagggga

SEQ ID NO: 4021843 - DNA, 18 bp, Homo sapiens
taagttgtacaaatgtat

SEQ ID NO: 4021844 - DNA, 23 bp, Homo sapiens
taagttgtacaaatgtattttga

SEQ ID NO: 4021845 - DNA, 17 bp, Homo sapiens
taagtttaaaaaacaga

SEQ ID NO: 4021846 - DNA, 20 bp, Homo sapiens
taagtttcaaacttactatt

SEQ ID NO: 4021847 - DNA, 23 bp, Homo sapiens
taagtttcaaacttactattttg

SEQ ID NO: 4021848 - DNA, 16 bp, Homo sapiens
taagtttcaggtgaca

SEQ ID NO: 4021849 - DNA, 18 bp, Homo sapiens
taagtttcaggtgacatg

SEQ ID NO: 4021850 - DNA, 19 bp, Homo sapiens
taagtttcaggtgacatgt

SEQ ID NO: 4021851 - DNA, 14 bp, Homo sapiens
taagtttctgggac

SEQ ID NO: 4021852 - DNA, 16 bp, Homo sapiens
taagtttgatttcatt

SEQ ID NO: 4021853 - DNA, 15 bp, Homo sapiens
taataaaaaatggaa

SEQ ID NO: 4021854 - DNA, 19 bp, Homo sapiens
taataaaaagctttttcct

SEQ ID NO: 4021855 - DNA, 19 bp, Homo sapiens
taataaacataatgaaaat

SEQ ID NO: 4021856 - DNA, 22 bp, Homo sapiens
taataaacatccttcaagaact

SEQ ID NO: 4021857 - DNA, 15 bp, Homo sapiens
taataaactgtgttt

SEQ ID NO: 4021858 - DNA, 13 bp, Homo sapiens
taataaactgttt

SEQ ID NO: 4021859 - DNA, 13 bp, Homo sapiens
taataaagaaata

SEQ ID NO: 4021860 - DNA, 14 bp, Homo sapiens
taataaagaaatat

SEQ ID NO: 4021861 - DNA, 16 bp, Homo sapiens
taataaagctactgat

SEQ ID NO: 4021862 - DNA, 17 bp, Homo sapiens
taataaatgtacattaa

SEQ ID NO: 4021863 - DNA, 12 bp, Homo sapiens
taataacattac

SEQ ID NO: 4021864 - DNA, 15 bp, Homo sapiens
taataacattacctt

SEQ ID NO: 4021865 - DNA, 17 bp, Homo sapiens
taataagacataacgtt

SEQ ID NO: 4021866 - DNA, 22 bp, Homo sapiens
taataagacataacgtttttcc

SEQ ID NO: 4021867 - DNA, 17 bp, Homo sapiens
taataagagaatgttcc

SEQ ID NO: 4021868 - DNA, 19 bp, Homo sapiens
taataagagaatgttccta

SEQ ID NO: 4021869 - DNA, 18 bp, Homo sapiens
taataagctaaagaggct

SEQ ID NO: 4021870 - DNA, 23 bp, Homo sapiens
taataatcttattagggagaaaa

SEQ ID NO: 4021871 - DNA, 16 bp, Homo sapiens
taataatggcatcaat

SEQ ID NO: 4021872 - DNA, 20 bp, Homo sapiens
taataattgctcataagcaa

SEQ ID NO: 4021873 - DNA, 20 bp, Homo sapiens
taataatttttaagaaataa

SEQ ID NO: 4021874 - DNA, 18 bp, Homo sapiens
taatttttatttcttcct

SEQ ID NO: 4021875 - DNA, 16 bp, Homo sapiens
taatttttcctatatt

SEQ ID NO: 4021876 - DNA, 19 bp, Homo sapiens
taatttttggggaaaaaag

SEQ ID NO: 4021877 - DNA, 16 bp, Homo sapiens
taattttttgtaatgt

SEQ ID NO: 4021878 - DNA, 17 bp, Homo sapiens
taatttttttatgtttt

SEQ ID NO: 4021879 - DNA, 21 bp, Homo sapiens
taatttttttatgttttgttt

SEQ ID NO: 4021880 - DNA, 13 bp, Homo sapiens
taattttttttaa

SEQ ID NO: 4021881 - DNA, 13 bp, Homo sapiens
tacaaaaagaaaa

SEQ ID NO: 4021882 - DNA, 17 bp, Homo sapiens
tacaaaaatataaaata

SEQ ID NO: 4021883 - DNA, 21 bp, Homo sapiens
tacaaaagaagggctggtatt

SEQ ID NO: 4021884 - DNA, 16 bp, Homo sapiens
tacaaactggtattct

SEQ ID NO: 4021885 - DNA, 21 bp, Homo sapiens
tacaaagcgtttctttacttc

SEQ ID NO: 4021886 - DNA, 13 bp, Homo sapiens
tacaaagtaaata

SEQ ID NO: 4021887 - DNA, 15 bp, Homo sapiens
tacaaagtaaataca

SEQ ID NO: 4021888 - DNA, 14 bp, Homo sapiens
tacaaagtgtacca

SEQ ID NO: 4021889 - DNA, 17 bp, Homo sapiens
tacaaatactcttagga

SEQ ID NO: 4021890 - DNA, 12 bp, Homo sapiens
tacaaatctgta

SEQ ID NO: 4021891 - DNA, 16 bp, Homo sapiens
tacaaatctgtataaa

SEQ ID NO: 4021892 - DNA, 19 bp, Homo sapiens
tacaaatctgtataaatgt

SEQ ID NO: 4021893 - DNA, 13 bp, Homo sapiens
tacaaattataaa

SEQ ID NO: 4021894 - DNA, 23 bp, Homo sapiens
tacaacaaaggcaagttaagaga

SEQ ID NO: 4021895 - DNA, 15 bp, Homo sapiens
tacaaccagagcccc

SEQ ID NO: 4021896 - DNA, 16 bp, Homo sapiens
tacaaccagagccccc

SEQ ID NO: 4021897 - DNA, 16 bp, Homo sapiens
tacaacttaatggaaa

SEQ ID NO: 4021898 - DNA, 19 bp, Homo sapiens
tacaacttgattttttcaa

SEQ ID NO: 4021899 - DNA, 15 bp, Homo sapiens
tacaagaagtttatt

SEQ ID NO: 4021900 - DNA, 22 bp, Homo sapiens
tacaagaagtttattctcattt

SEQ ID NO: 4021901 - DNA, 14 bp, Homo sapiens
tacaagactgttgt

SEQ ID NO: 4021902 - DNA, 18 bp, Homo sapiens
tacaagactgttgtgatc

SEQ ID NO: 4021903 - DNA, 23 bp, Homo sapiens
tacaagagcagcctgtggcatct

SEQ ID NO: 4021904 - DNA, 15 bp, Homo sapiens
tacaagatattgatg

SEQ ID NO: 4021905 - DNA, 20 bp, Homo sapiens
tacaagattgaaaatcttgt

SEQ ID NO: 4021906 - DNA, 12 bp, Homo sapiens
tacaataaacta

SEQ ID NO: 4021907 - DNA, 13 bp, Homo sapiens
tacaataaactat

SEQ ID NO: 4021908 - DNA, 19 bp, Homo sapiens
tacaataaactattggaaa

SEQ ID NO: 4021909 - DNA, 13 bp, Homo sapiens
tacaataaataat

SEQ ID NO: 4021910 - DNA, 17 bp, Homo sapiens
tacaataccgttaagat

SEQ ID NO: 4021911 - DNA, 18 bp, Homo sapiens
tacaataccgttaagata

SEQ ID NO: 4021912 - DNA, 13 bp, Homo sapiens
tacaatgtagatg

SEQ ID NO: 4021913 - DNA, 15 bp, Homo sapiens
tacaatgtgaacttt

SEQ ID NO: 4021914 - DNA, 18 bp, Homo sapiens
tacaattaaaaaaaaaga

SEQ ID NO: 4021915 - DNA, 21 bp, Homo sapiens
tacaattaaaggtcctgccct

SEQ ID NO: 4021916 - DNA, 14 bp, Homo sapiens
tacacaataagcaa

SEQ ID NO: 4021917 - DNA, 9 bp, Homo sapiens
tacacacac

SEQ ID NO: 4021918 - DNA, 13 bp, Homo sapiens
tacataactgcct

SEQ ID NO: 4021919 - DNA, 16 bp, Homo sapiens
tacataactgccttga

SEQ ID NO: 4021920 - DNA, 22 bp, Homo sapiens
tacataactgccttgaacctgt

SEQ ID NO: 4021921 - DNA, 20 bp, Homo sapiens
tacatagttatttttctctt

SEQ ID NO: 4021922 - DNA, 21 bp, Homo sapiens
tacatagttttaaactcattt

SEQ ID NO: 4021923 - DNA, 14 bp, Homo sapiens
tacatatattttta

SEQ ID NO: 4021924 - DNA, 14 bp, Homo sapiens
tacatatgtaaaca

SEQ ID NO: 4021925 - DNA, 19 bp, Homo sapiens
tacatcactgcttgatgaa

SEQ ID NO: 4021926 - DNA, 15 bp, Homo sapiens
tacatctctccccaa

SEQ ID NO: 4021927 - DNA, 19 bp, Homo sapiens
tacatctgcaatatgaatt

SEQ ID NO: 4021928 - DNA, 13 bp, Homo sapiens
tacatctgtgcag

SEQ ID NO: 4021929 - DNA, 20 bp, Homo sapiens
tacatctgtgcagggctggt

SEQ ID NO: 4021930 - DNA, 14 bp, Homo sapiens
tacatcttctgcct

SEQ ID NO: 4021931 - DNA, 17 bp, Homo sapiens
tacatcttctgccttag

SEQ ID NO: 4021932 - DNA, 23 bp, Homo sapiens
tacatcttctgtgaaatataatt

SEQ ID NO: 4021933 - DNA, 16 bp, Homo sapiens
tacatcttcttcccag

SEQ ID NO: 4021934 - DNA, 16 bp, Homo sapiens
tacatctttaaacagt

SEQ ID NO: 4021935 - DNA, 21 bp, Homo sapiens
tacatgaaaattttaaaaata

SEQ ID NO: 4021936 - DNA, 18 bp, Homo sapiens
tacatgaattgcatttta

SEQ ID NO: 4021937 - DNA, 15 bp, Homo sapiens
tacatgactgggcct

SEQ ID NO: 4021938 - DNA, 16 bp, Homo sapiens
tacatgagaaggaact

SEQ ID NO: 4021939 - DNA, 18 bp, Homo sapiens
tacatgcaaaaagaaatg

SEQ ID NO: 4021940 - DNA, 14 bp, Homo sapiens
tacatgcatttgag

SEQ ID NO: 4021941 - DNA, 20 bp, Homo sapiens
tacatggcagtgttttagtt

SEQ ID NO: 4021942 - DNA, 16 bp, Homo sapiens
tacatggttgtgacct

SEQ ID NO: 4021943 - DNA, 13 bp, Homo sapiens
tacatgtagtagt

SEQ ID NO: 4021944 - DNA, 20 bp, Homo sapiens
tacatgtattgcacattgta

SEQ ID NO: 4021945 - DNA, 22 bp, Homo sapiens
tacatgtattgcacattgtaaa

SEQ ID NO: 4021946 - DNA, 14 bp, Homo sapiens
tacatgtgtaaagg

SEQ ID NO: 4021947 - DNA, 21 bp, Homo sapiens
tacatgtgtttattcatccag

SEQ ID NO: 4021948 - DNA, 23 bp, Homo sapiens
tacatgtgtttattcatccagca

SEQ ID NO: 4021949 - DNA, 22 bp, Homo sapiens
tacattaaaactaggtaatgtt

SEQ ID NO: 4021950 - DNA, 15 bp, Homo sapiens
tacattaatgttaat

SEQ ID NO: 4021951 - DNA, 12 bp, Homo sapiens
tacattagtaaa

SEQ ID NO: 4021952 - DNA, 21 bp, Homo sapiens
tacattagtaaatgtctttgt

SEQ ID NO: 4021953 - DNA, 22 bp, Homo sapiens
tacattagtaaatgtctttgta

SEQ ID NO: 4021954 - DNA, 23 bp, Homo sapiens
tacattagtaaatgtctttgtaa

SEQ ID NO: 4021955 - DNA, 14 bp, Homo sapiens
tacattcatcaata

SEQ ID NO: 4021956 - DNA, 13 bp, Homo sapiens
tacattcatttag

SEQ ID NO: 4021957 - DNA, 21 bp, Homo sapiens
tacattccctctcctgcccag

SEQ ID NO: 4021958 - DNA, 22 bp, Homo sapiens
tacattccctctcctgcccaga

SEQ ID NO: 4021959 - DNA, 18 bp, Homo sapiens
tacattctagttcagagc

SEQ ID NO: 4021960 - DNA, 17 bp, Homo sapiens
tacattgtaaatagtat

SEQ ID NO: 4021961 - DNA, 23 bp, Homo sapiens
tacattgtgggatgttcagcact

SEQ ID NO: 4021962 - DNA, 13 bp, Homo sapiens
tacatttaaaatt

SEQ ID NO: 4021963 - DNA, 21 bp, Homo sapiens
tacatttaaaattgctatgtt

SEQ ID NO: 4021964 - DNA, 14 bp, Homo sapiens
tacatttaaagcat

SEQ ID NO: 4021965 - DNA, 18 bp, Homo sapiens
tacatttaaagcattgct

SEQ ID NO: 4021966 - DNA, 19 bp, Homo sapiens
tacatttataatgtttgct

SEQ ID NO: 4021967 - DNA, 16 bp, Homo sapiens
tacatttataattgca

SEQ ID NO: 4021968 - DNA, 22 bp, Homo sapiens
tacatttatgatttaataaaat

SEQ ID NO: 4021969 - DNA, 20 bp, Homo sapiens
tacatttatttattactgtc

SEQ ID NO: 4021970 - DNA, 23 bp, Homo sapiens
tacatttctatcagtacttttat

SEQ ID NO: 4021971 - DNA, 23 bp, Homo sapiens
tacatttggagacacaactattt

SEQ ID NO: 4021972 - DNA, 14 bp, Homo sapiens
tacatttttattta

SEQ ID NO: 4021973 - DNA, 16 bp, Homo sapiens
tacatttttatttatg

SEQ ID NO: 4021974 - DNA, 13 bp, Homo sapiens
taccaaaggatag

SEQ ID NO: 4021975 - DNA, 17 bp, Homo sapiens
taccaaagttttatcaa

SEQ ID NO: 4021976 - DNA, 19 bp, Homo sapiens
taccaaatctgacatatta

SEQ ID NO: 4021977 - DNA, 11 bp, Homo sapiens
taccaagagaa

SEQ ID NO: 4021978 - DNA, 13 bp, Homo sapiens
taccaagagaagg

SEQ ID NO: 4021979 - DNA, 15 bp, Homo sapiens
taccaagagtaactt

SEQ ID NO: 4021980 - DNA, 19 bp, Homo sapiens
taccaatcattttaattat

SEQ ID NO: 4021981 - DNA, 13 bp, Homo sapiens
taccacagtgtct

SEQ ID NO: 4021982 - DNA, 21 bp, Homo sapiens
taccaccatcccgtgctttta

SEQ ID NO: 4021983 - DNA, 23 bp, Homo sapiens
taccacccttcagaccccagttc

SEQ ID NO: 4021984 - DNA, 19 bp, Homo sapiens
taccacggcctcctttccg

SEQ ID NO: 4021985 - DNA, 18 bp, Homo sapiens
taccactatttaagttat

SEQ ID NO: 4021986 - DNA, 13 bp, Homo sapiens
taccagaagggaa

SEQ ID NO: 4021987 - DNA, 22 bp, Homo sapiens
taccagacaaaaaaatttaaaa

SEQ ID NO: 4021988 - DNA, 21 bp, Homo sapiens
taccagagacgcccagcccca

SEQ ID NO: 4021989 - DNA, 20 bp, Homo sapiens
taccagagctctatccccat

SEQ ID NO: 4021990 - DNA, 13 bp, Homo sapiens
taccagctgcgct

SEQ ID NO: 4021991 - DNA, 22 bp, Homo sapiens
taccagctgcgcttgcttttct

SEQ ID NO: 4021992 - DNA, 20 bp, Homo sapiens
taccagggactatctttgct

SEQ ID NO: 4021993 - DNA, 18 bp, Homo sapiens
taccaggtgtgcctggaa

SEQ ID NO: 4021994 - DNA, 19 bp, Homo sapiens
taccaggtgtgcctggaag

SEQ ID NO: 4021995 - DNA, 14 bp, Homo sapiens
taccaggtgttcta

SEQ ID NO: 4021996 - DNA, 16 bp, Homo sapiens
taccaggttgaaagac

SEQ ID NO: 4021997 - DNA, 15 bp, Homo sapiens
taccagttgccctag

SEQ ID NO: 4021998 - DNA, 19 bp, Homo sapiens
taccagttgccttttatcc

SEQ ID NO: 4021999 - DNA, 20 bp, Homo sapiens
taccatagtaccatttatac

SEQ ID NO: 4022000 - DNA, 13 bp, Homo sapiens
taccatcatctct

SEQ ID NO: 4022001 - DNA, 15 bp, Homo sapiens
taccattcagatcac

SEQ ID NO: 4022002 - DNA, 20 bp, Homo sapiens
taccattcagatcactgaat

SEQ ID NO: 4022003 - DNA, 13 bp, Homo sapiens
taccatttacatg

SEQ ID NO: 4022004 - DNA, 15 bp, Homo sapiens
taccatttatacaaa

SEQ ID NO: 4022005 - DNA, 13 bp, Homo sapiens
taccatttcagta

SEQ ID NO: 4022006 - DNA, 15 bp, Homo sapiens
taccatttgcctccc

SEQ ID NO: 4022007 - DNA, 14 bp, Homo sapiens
taccatttgtaata

SEQ ID NO: 4022008 - DNA, 20 bp, Homo sapiens
taccatttgtaataaagtat

SEQ ID NO: 4022009 - DNA, 23 bp, Homo sapiens
taccatttgtaataaagtatata

SEQ ID NO: 4022010 - DNA, 12 bp, Homo sapiens
taccattttcta

SEQ ID NO: 4022011 - DNA, 16 bp, Homo sapiens
taccatttttctggat

SEQ ID NO: 4022012 - DNA, 23 bp, Homo sapiens
tacccaacggccctgcagccagc

SEQ ID NO: 4022013 - DNA, 17 bp, Homo sapiens
tacccacacctctgcca

SEQ ID NO: 4022014 - DNA, 19 bp, Homo sapiens
tacccacacctctgccaga

SEQ ID NO: 4022015 - DNA, 18 bp, Homo sapiens
tacccacatgtacagaca

SEQ ID NO: 4022016 - DNA, 17 bp, Homo sapiens
tacccacccgacctggc

SEQ ID NO: 4022017 - DNA, 17 bp, Homo sapiens
tacccaccgatggagcc

SEQ ID NO: 4022018 - DNA, 21 bp, Homo sapiens
tacccacttctaaatagcaat

SEQ ID NO: 4022019 - DNA, 21 bp, Homo sapiens
tactatatttacaaataaaat

SEQ ID NO: 4022020 - DNA, 13 bp, Homo sapiens
tactatatttgct

SEQ ID NO: 4022021 - DNA, 14 bp, Homo sapiens
tactatgtgctggg

SEQ ID NO: 4022022 - DNA, 22 bp, Homo sapiens
tactattcagtggcgagaaata

SEQ ID NO: 4022023 - DNA, 23 bp, Homo sapiens
tactattccctttgacttcagct

SEQ ID NO: 4022024 - DNA, 22 bp, Homo sapiens
tactattgttgctgaaacttgc

SEQ ID NO: 4022025 - DNA, 23 bp, Homo sapiens
tactattgttgctgaaacttgct

SEQ ID NO: 4022026 - DNA, 17 bp, Homo sapiens
tactcaaatgagtaaca

SEQ ID NO: 4022027 - DNA, 15 bp, Homo sapiens
tactcactgaagcct

SEQ ID NO: 4022028 - DNA, 12 bp, Homo sapiens
tactcagcctgc

SEQ ID NO: 4022029 - DNA, 19 bp, Homo sapiens
tactcagggttcatctgtc

SEQ ID NO: 4022030 - DNA, 21 bp, Homo sapiens
tactcagtttatgttgtacaa

SEQ ID NO: 4022031 - DNA, 13 bp, Homo sapiens
tactcctgactcc

SEQ ID NO: 4022032 - DNA, 22 bp, Homo sapiens
tactccttaagaacacaaagcg

SEQ ID NO: 4022033 - DNA, 14 bp, Homo sapiens
tactctagagaagt

SEQ ID NO: 4022034 - DNA, 20 bp, Homo sapiens
tactctccccacgagggctg

SEQ ID NO: 4022035 - DNA, 13 bp, Homo sapiens
tactctgaaacac

SEQ ID NO: 4022036 - DNA, 17 bp, Homo sapiens
tactctggttctttgtt

SEQ ID NO: 4022037 - DNA, 15 bp, Homo sapiens
tactctgtcagatgg

SEQ ID NO: 4022038 - DNA, 15 bp, Homo sapiens
tactctgtgtttaaa

SEQ ID NO: 4022039 - DNA, 16 bp, Homo sapiens
tactctgtgtttaaaa

SEQ ID NO: 4022040 - DNA, 20 bp, Homo sapiens
tactctgtgtttaaaaagta

SEQ ID NO: 4022041 - DNA, 21 bp, Homo sapiens
tactcttaggaagagaaacca

SEQ ID NO: 4022042 - DNA, 18 bp, Homo sapiens
tactcttctctctgctct

SEQ ID NO: 4022043 - DNA, 16 bp, Homo sapiens
tactcttgatgtgaag

SEQ ID NO: 4022044 - DNA, 14 bp, Homo sapiens
tactctttctgtat

SEQ ID NO: 4022045 - DNA, 16 bp, Homo sapiens
tactctttctgtatat

SEQ ID NO: 4022046 - DNA, 12 bp, Homo sapiens
tactctttgaaa

SEQ ID NO: 4022047 - DNA, 14 bp, Homo sapiens
tactctttgaaagc

SEQ ID NO: 4022048 - DNA, 13 bp, Homo sapiens
tactgaaagcctt

SEQ ID NO: 4022049 - DNA, 15 bp, Homo sapiens
tactgaatataaaaa

SEQ ID NO: 4022050 - DNA, 12 bp, Homo sapiens
tactgaattttt

SEQ ID NO: 4022051 - DNA, 16 bp, Homo sapiens
tactgaatttttttgt

SEQ ID NO: 4022052 - DNA, 15 bp, Homo sapiens
tactgacaacattat

SEQ ID NO: 4022053 - DNA, 13 bp, Homo sapiens
tactgacatgtgg

SEQ ID NO: 4022054 - DNA, 22 bp, Homo sapiens
tactgacatgtggggccaggtc

SEQ ID NO: 4022055 - DNA, 18 bp, Homo sapiens
tactgactttgcttgctt

SEQ ID NO: 4022056 - DNA, 20 bp, Homo sapiens
tactgactttgcttgctttg

SEQ ID NO: 4022057 - DNA, 22 bp, Homo sapiens
tactgactttgcttgctttgaa

SEQ ID NO: 4022058 - DNA, 16 bp, Homo sapiens
tactgataaagaaaga

SEQ ID NO: 4022059 - DNA, 17 bp, Homo sapiens
tactgatcatgcattgt

SEQ ID NO: 4022060 - DNA, 18 bp, Homo sapiens
tactgatcatgcattgtt

SEQ ID NO: 4022061 - DNA, 15 bp, Homo sapiens
tactgatgaaatctg

SEQ ID NO: 4022062 - DNA, 21 bp, Homo sapiens
tactgattctgtgtatctttt

SEQ ID NO: 4022063 - DNA, 11 bp, Homo sapiens
tactgatttta

SEQ ID NO: 4022064 - DNA, 19 bp, Homo sapiens
tactgcactccagcctggg

SEQ ID NO: 4022065 - DNA, 20 bp, Homo sapiens
tactgcactccagcctgggg

SEQ ID NO: 4022066 - DNA, 21 bp, Homo sapiens
tactgcagcacctccaggcct

SEQ ID NO: 4022067 - DNA, 20 bp, Homo sapiens
tactgcagcctttgcctccc

SEQ ID NO: 4022068 - DNA, 22 bp, Homo sapiens
tactgcagcctttgcctccccg

SEQ ID NO: 4022069 - DNA, 17 bp, Homo sapiens
tactgcatatgaaagga

SEQ ID NO: 4022070 - DNA, 11 bp, Homo sapiens
tactgccaaag

SEQ ID NO: 4022071 - DNA, 15 bp, Homo sapiens
tactgctactgtaat

SEQ ID NO: 4022072 - DNA, 21 bp, Homo sapiens
tactggaataatttgtaaatg

SEQ ID NO: 4022073 - DNA, 23 bp, Homo sapiens
tactggaataatttgtaaatgat

SEQ ID NO: 4022074 - DNA, 18 bp, Homo sapiens
tactggaattcttctgca

SEQ ID NO: 4022075 - DNA, 22 bp, Homo sapiens
tactgggtgtcatttcattcca

SEQ ID NO: 4022076 - DNA, 19 bp, Homo sapiens
tactggtgcagtcattatg

SEQ ID NO: 4022077 - DNA, 15 bp, Homo sapiens
tactgtaattcctca

SEQ ID NO: 4022078 - DNA, 20 bp, Homo sapiens
tactgtaattttatatgaag

SEQ ID NO: 4022079 - DNA, 15 bp, Homo sapiens
tactgtagtttttct

SEQ ID NO: 4022080 - DNA, 16 bp, Homo sapiens
tactgtcaataaacag

SEQ ID NO: 4022081 - DNA, 17 bp, Homo sapiens
tactgtcgtatttttga

SEQ ID NO: 4022082 - DNA, 18 bp, Homo sapiens
tactgtctgttatgattt

SEQ ID NO: 4022083 - DNA, 15 bp, Homo sapiens
tactgtgaaactggc

SEQ ID NO: 4022084 - DNA, 23 bp, Homo sapiens
tactgtgaagttacatgcataaa

SEQ ID NO: 4022085 - DNA, 13 bp, Homo sapiens
tactgtgcagaat

SEQ ID NO: 4022086 - DNA, 17 bp, Homo sapiens
tactgtgcagaataatg

SEQ ID NO: 4022087 - DNA, 14 bp, Homo sapiens
tactgtggaggaag

SEQ ID NO: 4022088 - DNA, 19 bp, Homo sapiens
tactgtgtgtgtgaatgaa

SEQ ID NO: 4022089 - DNA, 12 bp, Homo sapiens
tactgtgttcct

SEQ ID NO: 4022090 - DNA, 13 bp, Homo sapiens
tactgtgttcctg

SEQ ID NO: 4022091 - DNA, 16 bp, Homo sapiens
tactgtgttcctggca

SEQ ID NO: 4022092 - DNA, 18 bp, Homo sapiens
tactgttaaccatttaag

SEQ ID NO: 4022093 - DNA, 20 bp, Homo sapiens
tactgttaggaacagcagtg

SEQ ID NO: 4022094 - DNA, 22 bp, Homo sapiens
tactgttaggaacagcagtgtt

SEQ ID NO: 4022095 - DNA, 23 bp, Homo sapiens
tacttaaaaatagtcttccacaa

SEQ ID NO: 4022096 - DNA, 14 bp, Homo sapiens
tacttaataaattc

SEQ ID NO: 4022097 - DNA, 19 bp, Homo sapiens
tacttaataaattcagata

SEQ ID NO: 4022098 - DNA, 18 bp, Homo sapiens
tacttagagtttctgttt

SEQ ID NO: 4022099 - DNA, 20 bp, Homo sapiens
tacttagagtttctgtttga

SEQ ID NO: 4022100 - DNA, 14 bp, Homo sapiens
tacttagcatccta

SEQ ID NO: 4022101 - DNA, 21 bp, Homo sapiens
tacttagcatcctaagaaata

SEQ ID NO: 4022102 - DNA, 14 bp, Homo sapiens
tacttataaagaag

SEQ ID NO: 4022103 - DNA, 23 bp, Homo sapiens
tacttcaagttaaagtgaataac

SEQ ID NO: 4022104 - DNA, 23 bp, Homo sapiens
tacttccataggacatactgcat

SEQ ID NO: 4022105 - DNA, 20 bp, Homo sapiens
tacttccattatacatcaat

SEQ ID NO: 4022106 - DNA, 19 bp, Homo sapiens
tacttcctatcaagccagt

SEQ ID NO: 4022107 - DNA, 16 bp, Homo sapiens
tacttcctcctcccca

SEQ ID NO: 4022108 - DNA, 14 bp, Homo sapiens
tacttcttatacat

SEQ ID NO: 4022109 - DNA, 22 bp, Homo sapiens
tacttcttttttcaaaagaaag

SEQ ID NO: 4022110 - DNA, 20 bp, Homo sapiens
tacttgaaaagaaagtgttt

SEQ ID NO: 4022111 - DNA, 24 bp, Homo sapiens
tacttgaagaaacagagtggcctc

SEQ ID NO: 4022112 - DNA, 12 bp, Homo sapiens
tacttgaagggc

SEQ ID NO: 4022113 - DNA, 16 bp, Homo sapiens
tacttgaagggccaga

SEQ ID NO: 4022114 - DNA, 19 bp, Homo sapiens
tacttgaagggccagagcc

SEQ ID NO: 4022115 - DNA, 17 bp, Homo sapiens
tacttggtcacagccag

SEQ ID NO: 4022116 - DNA, 20 bp, Homo sapiens
tacttgtcaatatttaaaca

SEQ ID NO: 4022117 - DNA, 14 bp, Homo sapiens
tacttgtctttctg

SEQ ID NO: 4022118 - DNA, 21 bp, Homo sapiens
tacttgtgaaacacagctgtt

SEQ ID NO: 4022119 - DNA, 18 bp, Homo sapiens
tacttgtgtttgcttaaa

SEQ ID NO: 4022120 - DNA, 16 bp, Homo sapiens
tacttgtttcatctgg

SEQ ID NO: 4022121 - DNA, 20 bp, Homo sapiens
tacttgtttcatctggtttt

SEQ ID NO: 4022122 - DNA, 20 bp, Homo sapiens
tacttgtttctctgttgtaa

SEQ ID NO: 4022123 - DNA, 20 bp, Homo sapiens
tactttaaaggaaaaaatgt

SEQ ID NO: 4022124 - DNA, 14 bp, Homo sapiens
tactttaagtgata

SEQ ID NO: 4022125 - DNA, 18 bp, Homo sapiens
tactttacacaattctta

SEQ ID NO: 4022126 - DNA, 19 bp, Homo sapiens
tactttattaatatgagtt

SEQ ID NO: 4022127 - DNA, 20 bp, Homo sapiens
tactttcatcctgactctgc

SEQ ID NO: 4022128 - DNA, 15 bp, Homo sapiens
tactttccaattctc

SEQ ID NO: 4022129 - DNA, 17 bp, Homo sapiens
tactttccaattctcct

SEQ ID NO: 4022130 - DNA, 19 bp, Homo sapiens
tactttccaattctccttt

SEQ ID NO: 4022131 - DNA, 16 bp, Homo sapiens
tactttccacaaatct

SEQ ID NO: 4022132 - DNA, 18 bp, Homo sapiens
tactttccacaaatctat

SEQ ID NO: 4022133 - DNA, 17 bp, Homo sapiens
tactttcgtacattggc

SEQ ID NO: 4022134 - DNA, 17 bp, Homo sapiens
tactttctatgtgacat

SEQ ID NO: 4022135 - DNA, 23 bp, Homo sapiens
tactttgatattttcaacgcagc

SEQ ID NO: 4022136 - DNA, 14 bp, Homo sapiens
tactttgcttcata

SEQ ID NO: 4022137 - DNA, 17 bp, Homo sapiens
tactttgcttcatagta

SEQ ID NO: 4022138 - DNA, 20 bp, Homo sapiens
tactttgcttgagaatcctc

SEQ ID NO: 4022139 - DNA, 21 bp, Homo sapiens
tactttgtaatttttggggaa

SEQ ID NO: 4022140 - DNA, 12 bp, Homo sapiens
tactttgtactt

SEQ ID NO: 4022141 - DNA, 22 bp, Homo sapiens
tacttttagttgactcacaggc

SEQ ID NO: 4022142 - DNA, 22 bp, Homo sapiens
tacttttataataaaaggaaaa

SEQ ID NO: 4022143 - DNA, 19 bp, Homo sapiens
tacttttatgatgtatatt

SEQ ID NO: 4022144 - DNA, 21 bp, Homo sapiens
tacttttatttgcaacattta

SEQ ID NO: 4022145 - DNA, 18 bp, Homo sapiens
tacttttcccctgttaaa

SEQ ID NO: 4022146 - DNA, 16 bp, Homo sapiens
tacttttgagtgtgtg

SEQ ID NO: 4022147 - DNA, 13 bp, Homo sapiens
tactttttgttat

SEQ ID NO: 4022148 - DNA, 13 bp, Homo sapiens
tacttttttatag

SEQ ID NO: 4022149 - DNA, 20 bp, Homo sapiens
tagaaaaattcagcaaacca

SEQ ID NO: 4022150 - DNA, 20 bp, Homo sapiens
tagaaaagctgatcataagt

SEQ ID NO: 4022151 - DNA, 20 bp, Homo sapiens
tagaaaagttgcagatgtat

SEQ ID NO: 4022152 - DNA, 22 bp, Homo sapiens
tagaaaagttgcagatgtattg

SEQ ID NO: 4022153 - DNA, 23 bp, Homo sapiens
tagaaaagttgcagatgtattga

SEQ ID NO: 4022154 - DNA, 17 bp, Homo sapiens
tagaaaatgacttattt

SEQ ID NO: 4022155 - DNA, 21 bp, Homo sapiens
tagaaaatgacttatttctgc

SEQ ID NO: 4022156 - DNA, 22 bp, Homo sapiens
tagaaaatgacttatttctgct

SEQ ID NO: 4022157 - DNA, 16 bp, Homo sapiens
tagaaaattagactgt

SEQ ID NO: 4022158 - DNA, 23 bp, Homo sapiens
tagaaaatttagccctttaaaac

SEQ ID NO: 4022159 - DNA, 23 bp, Homo sapiens
tagaaacatggttttgaaatgct

SEQ ID NO: 4022160 - DNA, 19 bp, Homo sapiens
tagaaactcaccatgtaaa

SEQ ID NO: 4022161 - DNA, 16 bp, Homo sapiens
tagaaactgatttctt

SEQ ID NO: 4022162 - DNA, 22 bp, Homo sapiens
tagaaactgatttcttcagaat

SEQ ID NO: 4022163 - DNA, 14 bp, Homo sapiens
tagaaagaagccca

SEQ ID NO: 4022164 - DNA, 21 bp, Homo sapiens
tagaaataaaagtgaatgaaa

SEQ ID NO: 4022165 - DNA, 21 bp, Homo sapiens
tagaaatatctgaaaatgtat

SEQ ID NO: 4022166 - DNA, 23 bp, Homo sapiens
tagaaatatctgaaaatgtatgt

SEQ ID NO: 4022167 - DNA, 18 bp, Homo sapiens
tagaaatgaccaatatta

SEQ ID NO: 4022168 - DNA, 22 bp, Homo sapiens
tagaaattagaaaaaaattact

SEQ ID NO: 4022169 - DNA, 12 bp, Homo sapiens
gtgccaggagca

SEQ ID NO: 4022170 - DNA, 18 bp, Homo sapiens
gtgccagggcagcatttt

SEQ ID NO: 4022171 - DNA, 17 bp, Homo sapiens
gtgccagggcccacccc

SEQ ID NO: 4022172 - DNA, 15 bp, Homo sapiens
gtgccagttcctgta

SEQ ID NO: 4022173 - DNA, 14 bp, Homo sapiens
gtgccatgctgggc

SEQ ID NO: 4022174 - DNA, 22 bp, Homo sapiens
gtgccatgtaaatccccactgg

SEQ ID NO: 4022175 - DNA, 21 bp, Homo sapiens
gtgcccacaggccgccctgcg

SEQ ID NO: 4022176 - DNA, 15 bp, Homo sapiens
gtgcccacatcccag

SEQ ID NO: 4022177 - DNA, 15 bp, Homo sapiens
gtgcccatcctgcca

SEQ ID NO: 4022178 - DNA, 13 bp, Homo sapiens
gtgccccacagct

SEQ ID NO: 4022179 - DNA, 15 bp, Homo sapiens
gtgccccaggaccag

SEQ ID NO: 4022180 - DNA, 12 bp, Homo sapiens
gtgccccaggga

SEQ ID NO: 4022181 - DNA, 19 bp, Homo sapiens
gtggattgcacgtggcctc

SEQ ID NO: 4022182 - DNA, 22 bp, Homo sapiens
gtggatttgattcattttcctg

SEQ ID NO: 4022183 - DNA, 17 bp, Homo sapiens
gtggcaagagtgtggag

SEQ ID NO: 4022184 - DNA, 21 bp, Homo sapiens
gtggcaagctgtgacttctcc

SEQ ID NO: 4022185 - DNA, 16 bp, Homo sapiens
gtggcaatctgtgggc

SEQ ID NO: 4022186 - DNA, 12 bp, Homo sapiens
gtggcacaggcc

SEQ ID NO: 4022187 - DNA, 14 bp, Homo sapiens
gtggcacctgtctg

SEQ ID NO: 4022188 - DNA, 15 bp, Homo sapiens
gtggcacctgtctgc

SEQ ID NO: 4022189 - DNA, 20 bp, Homo sapiens
gtggcacctgtctgctccag

SEQ ID NO: 4022190 - DNA, 18 bp, Homo sapiens
gtggcagatgtcttccct

SEQ ID NO: 4022191 - DNA, 18 bp, Homo sapiens
gtggcagattttacaaaa

SEQ ID NO: 4022192 - DNA, 18 bp, Homo sapiens
gtggcagggggccccgcc

SEQ ID NO: 4022193 - DNA, 22 bp, Homo sapiens
gtggcatgttcatcgtataaca

SEQ ID NO: 4022194 - DNA, 15 bp, Homo sapiens
gtggcattgaaatga

SEQ ID NO: 4022195 - DNA, 19 bp, Homo sapiens
gtggccaaaagctagacag

SEQ ID NO: 4022196 - DNA, 17 bp, Homo sapiens
gtggccatccctgggcc

SEQ ID NO: 4022197 - DNA, 19 bp, Homo sapiens
gtggccatccctgggcccc

SEQ ID NO: 4022198 - DNA, 12 bp, Homo sapiens
gtggccccaccc

SEQ ID NO: 4022199 - DNA, 16 bp, Homo sapiens
gtggccccttttactt

SEQ ID NO: 4022200 - DNA, 11 bp, Homo sapiens
gtggccctggc

SEQ ID NO: 4022201 - DNA, 11 bp, Homo sapiens
gtggcccttgc

SEQ ID NO: 4022202 - DNA, 13 bp, Homo sapiens
gtggccgtctcct

SEQ ID NO: 4022203 - DNA, 11 bp, Homo sapiens
gtggcctcaga

SEQ ID NO: 4022204 - DNA, 12 bp, Homo sapiens
gtggcctcagcc

SEQ ID NO: 4022205 - DNA, 17 bp, Homo sapiens
gtggcctcagccctcag

SEQ ID NO: 4022206 - DNA, 13 bp, Homo sapiens
gtggcctccctgc

SEQ ID NO: 4022207 - DNA, 14 bp, Homo sapiens
gtggcctccctgct

SEQ ID NO: 4022208 - DNA, 19 bp, Homo sapiens
gtggcctccctgctgtgcc

SEQ ID NO: 4022209 - DNA, 20 bp, Homo sapiens
gtggcctcttgagcagtggc

SEQ ID NO: 4022210 - DNA, 18 bp, Homo sapiens
gtggcctgactcccccag

SEQ ID NO: 4022211 - DNA, 22 bp, Homo sapiens
gtggcctgctaaggctcctcct

SEQ ID NO: 4022212 - DNA, 16 bp, Homo sapiens
gtggcctggccaggag

SEQ ID NO: 4022213 - DNA, 15 bp, Homo sapiens
gtggcctggtccctg

SEQ ID NO: 4022214 - DNA, 13 bp, Homo sapiens
gtggcctgtttct

SEQ ID NO: 4022215 - DNA, 14 bp, Homo sapiens
gtggcgggcacctg

SEQ ID NO: 4022216 - DNA, 16 bp, Homo sapiens
gtggcgtctccctcgc

SEQ ID NO: 4022217 - DNA, 18 bp, Homo sapiens
gtggcgtgggagccagcc

SEQ ID NO: 4022218 - DNA, 20 bp, Homo sapiens
gtggctcaagtctggcccca

SEQ ID NO: 4022219 - DNA, 23 bp, Homo sapiens
gtggctcacgcctgtaatcccag

SEQ ID NO: 4022220 - DNA, 13 bp, Homo sapiens
gtggctccttccc

SEQ ID NO: 4022221 - DNA, 13 bp, Homo sapiens
gtggctctccagt

SEQ ID NO: 4022222 - DNA, 17 bp, Homo sapiens
gtggctgaggaggcctc

SEQ ID NO: 4022223 - DNA, 15 bp, Homo sapiens
gtggctgccccggcc

SEQ ID NO: 4022224 - DNA, 12 bp, Homo sapiens
gtggctggctct

SEQ ID NO: 4022225 - DNA, 21 bp, Homo sapiens
gtggctggctctaccttcctg

SEQ ID NO: 4022226 - DNA, 19 bp, Homo sapiens
gtggctgggtgggcccaga

SEQ ID NO: 4022227 - DNA, 22 bp, Homo sapiens
gtggctgggtgggcccagaact

SEQ ID NO: 4022228 - DNA, 20 bp, Homo sapiens
gtggcttcccgctcagccct

SEQ ID NO: 4022229 - DNA, 22 bp, Homo sapiens
gtggctttccaggcaccctcag

SEQ ID NO: 4022230 - DNA, 16 bp, Homo sapiens
gtggctttgttttctt

SEQ ID NO: 4022231 - DNA, 23 bp, Homo sapiens
gtgggaagagggggctggccatg

SEQ ID NO: 4022232 - DNA, 20 bp, Homo sapiens
gtgggaaggacttggcgcgc

SEQ ID NO: 4022233 - DNA, 18 bp, Homo sapiens
gtgggacagcccagagcc

SEQ ID NO: 4022234 - DNA, 19 bp, Homo sapiens
gtgggagcagcggtttggg

SEQ ID NO: 4022235 - DNA, 19 bp, Homo sapiens
gtgggagggagcagacagg

SEQ ID NO: 4022236 - DNA, 14 bp, Homo sapiens
gtgggagggttggc

SEQ ID NO: 4022237 - DNA, 14 bp, Homo sapiens
gtgggatcctccct

SEQ ID NO: 4022238 - DNA, 16 bp, Homo sapiens
gtgggatgaaccagcc

SEQ ID NO: 4022239 - DNA, 14 bp, Homo sapiens
gtgggcacctcaga

SEQ ID NO: 4022240 - DNA, 15 bp, Homo sapiens
gtgggcactggagca

SEQ ID NO: 4022241 - DNA, 14 bp, Homo sapiens
gtgggcagcaccct

SEQ ID NO: 4022242 - DNA, 14 bp, Homo sapiens
gtgggcagctgagg

SEQ ID NO: 4022243 - DNA, 13 bp, Homo sapiens
gtgggccagggct

SEQ ID NO: 4022244 - DNA, 14 bp, Homo sapiens
gtgggccagggctg

SEQ ID NO: 4022245 - DNA, 19 bp, Homo sapiens
gtgggccagggctgccctg

SEQ ID NO: 4022246 - DNA, 21 bp, Homo sapiens
gtgggccagggctgccctgag

SEQ ID NO: 4022247 - DNA, 19 bp, Homo sapiens
gtgggcccagaactgcccc

SEQ ID NO: 4022248 - DNA, 19 bp, Homo sapiens
gtgggcctcaaggacttga

SEQ ID NO: 4022249 - DNA, 17 bp, Homo sapiens
gtgggcctgtcgtgcca

SEQ ID NO: 4022250 - DNA, 22 bp, Homo sapiens
gtgggcctgtcgtgccagtcct

SEQ ID NO: 4022251 - DNA, 19 bp, Homo sapiens
gtgggctacatgctggggt

SEQ ID NO: 4022252 - DNA, 18 bp, Homo sapiens
gtgggctctgtgcagtca

SEQ ID NO: 4022253 - DNA, 17 bp, Homo sapiens
gtgggctggacttctac

SEQ ID NO: 4022254 - DNA, 15 bp, Homo sapiens
gtgggctgggccctc

SEQ ID NO: 4022255 - DNA, 20 bp, Homo sapiens
gtgggctgggccctctcttc

SEQ ID NO: 4022256 - DNA, 14 bp, Homo sapiens
gtgggctgtgagtg

SEQ ID NO: 4022257 - DNA, 23 bp, Homo sapiens
gtgggcttcctgcccttccctct

SEQ ID NO: 4022258 - DNA, 15 bp, Homo sapiens
gtgggggggcagagc

SEQ ID NO: 4022259 - DNA, 17 bp, Homo sapiens
gtggggggtctgtgtca

SEQ ID NO: 4022260 - DNA, 12 bp, Homo sapiens
gtggggggtgac

SEQ ID NO: 4022261 - DNA, 18 bp, Homo sapiens
gtggggggtgcaggtggg

SEQ ID NO: 4022262 - DNA, 15 bp, Homo sapiens
gtgggggtggaggct

SEQ ID NO: 4022263 - DNA, 12 bp, Homo sapiens
gtggggtggggt

SEQ ID NO: 4022264 - DNA, 15 bp, Homo sapiens
gtggggttctaggca

SEQ ID NO: 4022265 - DNA, 21 bp, Homo sapiens
gtgggtcatgatgctctttcc

SEQ ID NO: 4022266 - DNA, 13 bp, Homo sapiens
gtgggtctgggat

SEQ ID NO: 4022267 - DNA, 16 bp, Homo sapiens
gtgggtgaaggcctgg

SEQ ID NO: 4022268 - DNA, 15 bp, Homo sapiens
gtgggtgctcagaat

SEQ ID NO: 4022269 - DNA, 14 bp, Homo sapiens
gtgggtgctgccct

SEQ ID NO: 4022270 - DNA, 17 bp, Homo sapiens
gtgggtggaagggctgg

SEQ ID NO: 4022271 - DNA, 18 bp, Homo sapiens
gtgggtggaagggctggg

SEQ ID NO: 4022272 - DNA, 14 bp, Homo sapiens
gtgggtgtagccag

SEQ ID NO: 4022273 - DNA, 15 bp, Homo sapiens
gtgggtgtgggtgga

SEQ ID NO: 4022274 - DNA, 16 bp, Homo sapiens
gtggtaagctctggct

SEQ ID NO: 4022275 - DNA, 12 bp, Homo sapiens
gtggtactctga

SEQ ID NO: 4022276 - DNA, 19 bp, Homo sapiens
gtcctctgatacccagagc

SEQ ID NO: 4022277 - DNA, 18 bp, Homo sapiens
gtcctcttccctctctgc

SEQ ID NO: 4022278 - DNA, 13 bp, Homo sapiens
gtcctcttctggg

SEQ ID NO: 4022279 - DNA, 13 bp, Homo sapiens
gtcctgactcaac

SEQ ID NO: 4022280 - DNA, 15 bp, Homo sapiens
gtcctgactgggctg

SEQ ID NO: 4022281 - DNA, 20 bp, Homo sapiens
gtcctgagatggaaaagtgt

SEQ ID NO: 4022282 - DNA, 20 bp, Homo sapiens
gtcctgcagcaaacactcca

SEQ ID NO: 4022283 - DNA, 23 bp, Homo sapiens
gtcctgcagcaaacactccaccc

SEQ ID NO: 4022284 - DNA, 18 bp, Homo sapiens
gtcctgcccatgccccag

SEQ ID NO: 4022285 - DNA, 16 bp, Homo sapiens
gtcctgcccatgtgtc

SEQ ID NO: 4022286 - DNA, 21 bp, Homo sapiens
gtcctgcccatgtgtcccctc

SEQ ID NO: 4022287 - DNA, 17 bp, Homo sapiens
gtcctgcctgcaatatt

SEQ ID NO: 4022288 - DNA, 12 bp, Homo sapiens
gtcctgcctggc

SEQ ID NO: 4022289 - DNA, 13 bp, Homo sapiens
gtcctgcctggca

SEQ ID NO: 4022290 - DNA, 12 bp, Homo sapiens
gtcctgcctgtc

SEQ ID NO: 4022291 - DNA, 14 bp, Homo sapiens
gtcctgcctgtctg

SEQ ID NO: 4022292 - DNA, 15 bp, Homo sapiens
gtcctgctcagcagt

SEQ ID NO: 4022293 - DNA, 15 bp, Homo sapiens
gtcctgctggcttcc

SEQ ID NO: 4022294 - DNA, 22 bp, Homo sapiens
gtcctggaatttggacaagtgc

SEQ ID NO: 4022295 - DNA, 19 bp, Homo sapiens
gtcctggagcagaccaccc

SEQ ID NO: 4022296 - DNA, 22 bp, Homo sapiens
gtcctggctacatcccagcctg

SEQ ID NO: 4022297 - DNA, 19 bp, Homo sapiens
gtcctggctcctgaggggc

SEQ ID NO: 4022298 - DNA, 23 bp, Homo sapiens
gtcctgggcatgggtccagggcc

SEQ ID NO: 4022299 - DNA, 14 bp, Homo sapiens
gtcctgggcctgca

SEQ ID NO: 4022300 - DNA, 15 bp, Homo sapiens
gtcctgggctggggc

SEQ ID NO: 4022301 - DNA, 18 bp, Homo sapiens
gtcctgggctggggccac

SEQ ID NO: 4022302 - DNA, 15 bp, Homo sapiens
gtcctgtacattgtg

SEQ ID NO: 4022303 - DNA, 16 bp, Homo sapiens
gtcctgtcctttcttg

SEQ ID NO: 4022304 - DNA, 22 bp, Homo sapiens
gtccttcaaaatccttccaaag

SEQ ID NO: 4022305 - DNA, 16 bp, Homo sapiens
gtccttgcacccctca

SEQ ID NO: 4022306 - DNA, 14 bp, Homo sapiens
gtccttggtgtgac

SEQ ID NO: 4022307 - DNA, 11 bp, Homo sapiens
gtcctttccct

SEQ ID NO: 4022308 - DNA, 16 bp, Homo sapiens
gtcctttttttccatc

SEQ ID NO: 4022309 - DNA, 14 bp, Homo sapiens
gtcgaggggctctc

SEQ ID NO: 4022310 - DNA, 19 bp, Homo sapiens
gtcgaggggctctcagctc

SEQ ID NO: 4022311 - DNA, 17 bp, Homo sapiens
gtcgcagaccagagctg

SEQ ID NO: 4022312 - DNA, 19 bp, Homo sapiens
gtcgccacctggcattcct

SEQ ID NO: 4022313 - DNA, 13 bp, Homo sapiens
gtcgcccaggaga

SEQ ID NO: 4022314 - DNA, 18 bp, Homo sapiens
gtcgcccgctgagctgag

SEQ ID NO: 4022315 - DNA, 16 bp, Homo sapiens
gtcgctttctcagtgt

SEQ ID NO: 4022316 - DNA, 14 bp, Homo sapiens
gtcggaacagcaga

SEQ ID NO: 4022317 - DNA, 11 bp, Homo sapiens
gtcggctccag

SEQ ID NO: 4022318 - DNA, 18 bp, Homo sapiens
gtcgggggctgaggggca

SEQ ID NO: 4022319 - DNA, 12 bp, Homo sapiens
gtcgtaaagatt

SEQ ID NO: 4022320 - DNA, 13 bp, Homo sapiens
gtctaaatatttc

SEQ ID NO: 4022321 - DNA, 22 bp, Homo sapiens
gtctaaccacagctccttttcc

SEQ ID NO: 4022322 - DNA, 22 bp, Homo sapiens
gtctaactttagaagtgcattt

SEQ ID NO: 4022323 - DNA, 23 bp, Homo sapiens
gtctaagatagtaacaatgaaga

SEQ ID NO: 4022324 - DNA, 18 bp, Homo sapiens
gtctaagatgattcaaag

SEQ ID NO: 4022325 - DNA, 15 bp, Homo sapiens
gtctacagctccccc

SEQ ID NO: 4022326 - DNA, 17 bp, Homo sapiens
gtctacagctcccccag

SEQ ID NO: 4022327 - DNA, 21 bp, Homo sapiens
gtctacagctcccccagctcc

SEQ ID NO: 4022328 - DNA, 13 bp, Homo sapiens
gtctagaatgtgg

SEQ ID NO: 4022329 - DNA, 21 bp, Homo sapiens
gtctagttgccaaatctggct

SEQ ID NO: 4022330 - DNA, 15 bp, Homo sapiens
gtctattattatgaa

SEQ ID NO: 4022331 - DNA, 16 bp, Homo sapiens
gtctattttaaaataa

SEQ ID NO: 4022332 - DNA, 19 bp, Homo sapiens
gtctatttttttaactgaa

SEQ ID NO: 4022333 - DNA, 20 bp, Homo sapiens
gtctcaaacttgtggcctca

SEQ ID NO: 4022334 - DNA, 21 bp, Homo sapiens
gtctcaaacttgtggcctcaa

SEQ ID NO: 4022335 - DNA, 19 bp, Homo sapiens
gtctcacagtgttgcccag

SEQ ID NO: 4022336 - DNA, 23 bp, Homo sapiens
gtctcacagtgttgcccaggctg

SEQ ID NO: 4022337 - DNA, 21 bp, Homo sapiens
gtctcacccattatctggaat

SEQ ID NO: 4022338 - DNA, 23 bp, Homo sapiens
gtctcacgggcatgggcactccc

SEQ ID NO: 4022339 - DNA, 16 bp, Homo sapiens
gtctcactgttctgca

SEQ ID NO: 4022340 - DNA, 13 bp, Homo sapiens
gtctcagcctccc

SEQ ID NO: 4022341 - DNA, 18 bp, Homo sapiens
gtctcagggtgcagaggt

SEQ ID NO: 4022342 - DNA, 15 bp, Homo sapiens
gtctcagtttcactt

SEQ ID NO: 4022343 - DNA, 22 bp, Homo sapiens
gtctcatagttggactttctag

SEQ ID NO: 4022344 - DNA, 18 bp, Homo sapiens
gtctcatgtcctgctggc

SEQ ID NO: 4022345 - DNA, 22 bp, Homo sapiens
gtctcatgtcctgctggcttcc

SEQ ID NO: 4022346 - DNA, 21 bp, Homo sapiens
gtctccactaaatgagctcct

SEQ ID NO: 4022347 - DNA, 22 bp, Homo sapiens
gtctccactaaatgagctcctg

SEQ ID NO: 4022348 - DNA, 16 bp, Homo sapiens
gtctccagctgcctgg

SEQ ID NO: 4022349 - DNA, 17 bp, Homo sapiens
gtctccagctgcctggg

SEQ ID NO: 4022350 - DNA, 20 bp, Homo sapiens
gtctccagctgcctgggccc

SEQ ID NO: 4022351 - DNA, 17 bp, Homo sapiens
gtctcccacgtgggaga

SEQ ID NO: 4022352 - DNA, 19 bp, Homo sapiens
gtctcccaggccccctgca

SEQ ID NO: 4022353 - DNA, 22 bp, Homo sapiens
gtctcccccacccttgttccag

SEQ ID NO: 4022354 - DNA, 20 bp, Homo sapiens
gtctcccgattcccaactga

SEQ ID NO: 4022355 - DNA, 17 bp, Homo sapiens
gtctccctcgacagcgc

SEQ ID NO: 4022356 - DNA, 13 bp, Homo sapiens
gtctccctctgat

SEQ ID NO: 4022357 - DNA, 14 bp, Homo sapiens
gtcttttttttcct

SEQ ID NO: 4022358 - DNA, 12 bp, Homo sapiens
gtgaaaatcttg

SEQ ID NO: 4022359 - DNA, 16 bp, Homo sapiens
gtgaaacacaccaggc

SEQ ID NO: 4022360 - DNA, 14 bp, Homo sapiens
gtgaaacacagctg

SEQ ID NO: 4022361 - DNA, 16 bp, Homo sapiens
gtgaaacacagctgtt

SEQ ID NO: 4022362 - DNA, 13 bp, Homo sapiens
gtgaaaccttttt

SEQ ID NO: 4022363 - DNA, 21 bp, Homo sapiens
gtgaaagaaagctgagaagaa

SEQ ID NO: 4022364 - DNA, 15 bp, Homo sapiens
gtgaaagaattattt

SEQ ID NO: 4022365 - DNA, 22 bp, Homo sapiens
gtgaaagaattatttttgtgtt

SEQ ID NO: 4022366 - DNA, 21 bp, Homo sapiens
gtgaaagggagctatcaggaa

SEQ ID NO: 4022367 - DNA, 17 bp, Homo sapiens
gtgaaagtacatttgga

SEQ ID NO: 4022368 - DNA, 17 bp, Homo sapiens
gtgaaatcaaaggtgct

SEQ ID NO: 4022369 - DNA, 15 bp, Homo sapiens
gtgaaatgtgaagga

SEQ ID NO: 4022370 - DNA, 17 bp, Homo sapiens
gtgaaatgtgaaggaaa

SEQ ID NO: 4022371 - DNA, 17 bp, Homo sapiens
gtgaacagagagaccct

SEQ ID NO: 4022372 - DNA, 14 bp, Homo sapiens
gtgaaccctggggc

SEQ ID NO: 4022373 - DNA, 19 bp, Homo sapiens
gtgaaccctggggcctgac

SEQ ID NO: 4022374 - DNA, 21 bp, Homo sapiens
gtgaacgtccacatgaaacct

SEQ ID NO: 4022375 - DNA, 23 bp, Homo sapiens
gtgaactcaccctgggagccagt

SEQ ID NO: 4022376 - DNA, 19 bp, Homo sapiens
gtgaactcctgccaggcac

SEQ ID NO: 4022377 - DNA, 23 bp, Homo sapiens
gtgaagaatgcacaagaatggat

SEQ ID NO: 4022378 - DNA, 14 bp, Homo sapiens
gtgaagactccaga

SEQ ID NO: 4022379 - DNA, 19 bp, Homo sapiens
gtgaagagggagaagcatg

SEQ ID NO: 4022380 - DNA, 20 bp, Homo sapiens
gtgaagccaattcagacagg

SEQ ID NO: 4022381 - DNA, 17 bp, Homo sapiens
gtgaaggaggctccagg

SEQ ID NO: 4022382 - DNA, 19 bp, Homo sapiens
gtgaaggcccaagagcaga

SEQ ID NO: 4022383 - DNA, 16 bp, Homo sapiens
gtgaagtgaatgaaac

SEQ ID NO: 4022384 - DNA, 22 bp, Homo sapiens
gtgaagttacatgcataaaagg

SEQ ID NO: 4022385 - DNA, 19 bp, Homo sapiens
gtgaagtttaattgtctca

SEQ ID NO: 4022386 - DNA, 14 bp, Homo sapiens
gtgaagtttacatt

SEQ ID NO: 4022387 - DNA, 13 bp, Homo sapiens
gtgaatacaatta

SEQ ID NO: 4022388 - DNA, 14 bp, Homo sapiens
gtgaatacaattaa

SEQ ID NO: 4022389 - DNA, 15 bp, Homo sapiens
gtgaatacaattaaa

SEQ ID NO: 4022390 - DNA, 17 bp, Homo sapiens
gtgaatacaattaaagg

SEQ ID NO: 4022391 - DNA, 22 bp, Homo sapiens
gtgaatatttccatatggattt

SEQ ID NO: 4022392 - DNA, 13 bp, Homo sapiens
gtgaatcacctgg

SEQ ID NO: 4022393 - DNA, 13 bp, Homo sapiens
gtgaatcttgtct

SEQ ID NO: 4022394 - DNA, 13 bp, Homo sapiens
gtgaatgaacact

SEQ ID NO: 4022395 - DNA, 23 bp, Homo sapiens
gtgaatgatcaagtcctttgtga

SEQ ID NO: 4022396 - DNA, 15 bp, Homo sapiens
gtgaatggattggat

SEQ ID NO: 4022397 - DNA, 21 bp, Homo sapiens
gtgaattaattaaacattgtg

SEQ ID NO: 4022398 - DNA, 14 bp, Homo sapiens
gtgaattattgaca

SEQ ID NO: 4022399 - DNA, 16 bp, Homo sapiens
gtgaattattgacact

SEQ ID NO: 4022400 - DNA, 17 bp, Homo sapiens
gtgaattattgacactg

SEQ ID NO: 4022401 - DNA, 19 bp, Homo sapiens
gtgaattattgacactgaa

SEQ ID NO: 4022402 - DNA, 18 bp, Homo sapiens
gtgaattcttgaaggaaa

SEQ ID NO: 4022403 - DNA, 20 bp, Homo sapiens
gtgaatttatacctacctgt

SEQ ID NO: 4022404 - DNA, 11 bp, Homo sapiens
gtgaattttta

SEQ ID NO: 4022405 - DNA, 13 bp, Homo sapiens
gtgaatttttaag

SEQ ID NO: 4022406 - DNA, 12 bp, Homo sapiens
gtgaatttttat

SEQ ID NO: 4022407 - DNA, 22 bp, Homo sapiens
gtgacacagcagcttcaccaga

SEQ ID NO: 4022408 - DNA, 18 bp, Homo sapiens
gtgacacttcagagagct

SEQ ID NO: 4022409 - DNA, 21 bp, Homo sapiens
gtgacacttcagagagctggt

SEQ ID NO: 4022410 - DNA, 17 bp, Homo sapiens
gtgacagacaggctctt

SEQ ID NO: 4022411 - DNA, 17 bp, Homo sapiens
gtgacagagttcactat

SEQ ID NO: 4022412 - DNA, 13 bp, Homo sapiens
gtgacagctgcaa

SEQ ID NO: 4022413 - DNA, 18 bp, Homo sapiens
gtgacaggaaagccctcc

SEQ ID NO: 4022414 - DNA, 19 bp, Homo sapiens
gtgacagggccagtggggc

SEQ ID NO: 4022415 - DNA, 11 bp, Homo sapiens
gtgacagtcat

SEQ ID NO: 4022416 - DNA, 13 bp, Homo sapiens
gtgacagtcatca

SEQ ID NO: 4022417 - DNA, 18 bp, Homo sapiens
gtgacagtcatcatcagg

SEQ ID NO: 4022418 - DNA, 20 bp, Homo sapiens
gtgacagtcatcatcagggc

SEQ ID NO: 4022419 - DNA, 15 bp, Homo sapiens
gtgacagtgcctggg

SEQ ID NO: 4022420 - DNA, 23 bp, Homo sapiens
gtgacagtgcctgggaatgtatt

SEQ ID NO: 4022421 - DNA, 12 bp, Homo sapiens
gtgacagtgttg

SEQ ID NO: 4022422 - DNA, 22 bp, Homo sapiens
gtgacatggtgcctgagaggca

SEQ ID NO: 4022423 - DNA, 14 bp, Homo sapiens
gtgacatgtgaaac

SEQ ID NO: 4022424 - DNA, 15 bp, Homo sapiens
gtgacatgtgaaacc

SEQ ID NO: 4022425 - DNA, 16 bp, Homo sapiens
gtgacatttctcttcc

SEQ ID NO: 4022426 - DNA, 22 bp, Homo sapiens
gtgacatttgggagacatgtga

SEQ ID NO: 4022427 - DNA, 19 bp, Homo sapiens
gtgacattttacattaaat

SEQ ID NO: 4022428 - DNA, 20 bp, Homo sapiens
gtgacattttacattaaatt

SEQ ID NO: 4022429 - DNA, 19 bp, Homo sapiens
gtgaccaccttctgtcccc

SEQ ID NO: 4022430 - DNA, 22 bp, Homo sapiens
gtgaccatcttcataatttgct

SEQ ID NO: 4022431 - DNA, 15 bp, Homo sapiens
gtgacccccagctcc

SEQ ID NO: 4022432 - DNA, 21 bp, Homo sapiens
gtgaccctctgaatggtccag

SEQ ID NO: 4022433 - DNA, 12 bp, Homo sapiens
gtcactggctgg

SEQ ID NO: 4022434 - DNA, 16 bp, Homo sapiens
gtcactggctggctcc

SEQ ID NO: 4022435 - DNA, 17 bp, Homo sapiens
gtcactgtgcactgccc

SEQ ID NO: 4022436 - DNA, 16 bp, Homo sapiens
gtcactgtttctctgc

SEQ ID NO: 4022437 - DNA, 13 bp, Homo sapiens
gtcacttcttctg

SEQ ID NO: 4022438 - DNA, 18 bp, Homo sapiens
gtcacttgtgctttgctc

SEQ ID NO: 4022439 - DNA, 14 bp, Homo sapiens
gtcactttttatgc

SEQ ID NO: 4022440 - DNA, 13 bp, Homo sapiens
gtcagagccctgg

SEQ ID NO: 4022441 - DNA, 23 bp, Homo sapiens
gtcagaggagtgattgaaccagc

SEQ ID NO: 4022442 - DNA, 13 bp, Homo sapiens
gtcagagtccagt

SEQ ID NO: 4022443 - DNA, 16 bp, Homo sapiens
gtcagagtgttgttcc

SEQ ID NO: 4022444 - DNA, 17 bp, Homo sapiens
gtcagatgagcaaggac

SEQ ID NO: 4022445 - DNA, 18 bp, Homo sapiens
gtcagatgagcaaggaca

SEQ ID NO: 4022446 - DNA, 22 bp, Homo sapiens
gtcagatgagcaaggacattgc

SEQ ID NO: 4022447 - DNA, 23 bp, Homo sapiens
gtcagatgagcaaggacattgcc

SEQ ID NO: 4022448 - DNA, 15 bp, Homo sapiens
gtattcttctgtatt

SEQ ID NO: 4022449 - DNA, 14 bp, Homo sapiens
gtattgcacattgt

SEQ ID NO: 4022450 - DNA, 14 bp, Homo sapiens
gtattgccccctct

SEQ ID NO: 4022451 - DNA, 17 bp, Homo sapiens
gtattgctgctgtgcgt

SEQ ID NO: 4022452 - DNA, 18 bp, Homo sapiens
gtattgctgctgtgcgtg

SEQ ID NO: 4022453 - DNA, 22 bp, Homo sapiens
gtattggagcacatgttactgc

SEQ ID NO: 4022454 - DNA, 17 bp, Homo sapiens
gtattgtctgaacttgc

SEQ ID NO: 4022455 - DNA, 18 bp, Homo sapiens
gtattgttcccagtgaca

SEQ ID NO: 4022456 - DNA, 13 bp, Homo sapiens
gtatttataaata

SEQ ID NO: 4022457 - DNA, 12 bp, Homo sapiens
gtatttatatat

SEQ ID NO: 4022458 - DNA, 13 bp, Homo sapiens
gtatttatatatt

SEQ ID NO: 4022459 - DNA, 13 bp, Homo sapiens
gtccagagctgct

SEQ ID NO: 4022460 - DNA, 13 bp, Homo sapiens
gtccagagcttgt

SEQ ID NO: 4022461 - DNA, 18 bp, Homo sapiens
gtccagattattggctgc

SEQ ID NO: 4022462 - DNA, 20 bp, Homo sapiens
gtccagattattggctgctt

SEQ ID NO: 4022463 - DNA, 13 bp, Homo sapiens
gtccagcagtctg

SEQ ID NO: 4022464 - DNA, 11 bp, Homo sapiens
gtccagcctgg

SEQ ID NO: 4022465 - DNA, 14 bp, Homo sapiens
gtccagctcttggc

SEQ ID NO: 4022466 - DNA, 14 bp, Homo sapiens
gtccagctggggcc

SEQ ID NO: 4022467 - DNA, 17 bp, Homo sapiens
gtccagctggggccaga

SEQ ID NO: 4022468 - DNA, 19 bp, Homo sapiens
gtccagctggggccagagg

SEQ ID NO: 4022469 - DNA, 15 bp, Homo sapiens
gtccagggaagctgg

SEQ ID NO: 4022470 - DNA, 16 bp, Homo sapiens
gtccagggcctgacac

SEQ ID NO: 4022471 - DNA, 21 bp, Homo sapiens
gtccagggcctgacaccccct

SEQ ID NO: 4022472 - DNA, 18 bp, Homo sapiens
gtccagggctagtgactt

SEQ ID NO: 4022473 - DNA, 19 bp, Homo sapiens
gtccaggggagatggggag

SEQ ID NO: 4022474 - DNA, 16 bp, Homo sapiens
gtccaggggtctgtct

SEQ ID NO: 4022475 - DNA, 18 bp, Homo sapiens
gtccaggggtctgtctgc

SEQ ID NO: 4022476 - DNA, 21 bp, Homo sapiens
gtctctgccacccactcagga

SEQ ID NO: 4022477 - DNA, 20 bp, Homo sapiens
gtctctgctggcccagccaa

SEQ ID NO: 4022478 - DNA, 21 bp, Homo sapiens
gtctctggcagttctggaatg

SEQ ID NO: 4022479 - DNA, 16 bp, Homo sapiens
gtctcttctccactgg

SEQ ID NO: 4022480 - DNA, 13 bp, Homo sapiens
gtctcttgaggga

SEQ ID NO: 4022481 - DNA, 19 bp, Homo sapiens
gtctcttgtattaaactct

SEQ ID NO: 4022482 - DNA, 23 bp, Homo sapiens
gtctctttaagggcatgccttgt

SEQ ID NO: 4022483 - DNA, 18 bp, Homo sapiens
gtctctttaatcttcagt

SEQ ID NO: 4022484 - DNA, 12 bp, Homo sapiens
gtctcttttgta

SEQ ID NO: 4022485 - DNA, 15 bp, Homo sapiens
gtctgaacagctgta

SEQ ID NO: 4022486 - DNA, 13 bp, Homo sapiens
gtctgaatgttct

SEQ ID NO: 4022487 - DNA, 17 bp, Homo sapiens
gtctgaatgttctgaca

SEQ ID NO: 4022488 - DNA, 18 bp, Homo sapiens
gtctgaatgttctgacat

SEQ ID NO: 4022489 - DNA, 14 bp, Homo sapiens
gtctgaatttattt

SEQ ID NO: 4022490 - DNA, 22 bp, Homo sapiens
gtctgagactcacaggaaggag

SEQ ID NO: 4022491 - DNA, 16 bp, Homo sapiens
gtctgatattaatcaa

SEQ ID NO: 4022492 - DNA, 17 bp, Homo sapiens
gtctgcacccaggggtg

SEQ ID NO: 4022493 - DNA, 17 bp, Homo sapiens
gtctgccagaatactgg

SEQ ID NO: 4022494 - DNA, 21 bp, Homo sapiens
gtctgccatgttgcccctttc

SEQ ID NO: 4022495 - DNA, 12 bp, Homo sapiens
gtctgccccagc

SEQ ID NO: 4022496 - DNA, 10 bp, Homo sapiens
gtctgccctt

SEQ ID NO: 4022497 - DNA, 17 bp, Homo sapiens
gtctgcccttcacccca

SEQ ID NO: 4022498 - DNA, 21 bp, Homo sapiens
gtctgcctggagtgctgtgct

SEQ ID NO: 4022499 - DNA, 14 bp, Homo sapiens
gtctgcgccttggg

SEQ ID NO: 4022500 - DNA, 15 bp, Homo sapiens
gtctgctctttctct

SEQ ID NO: 4022501 - DNA, 20 bp, Homo sapiens
gtctgctctttctctgccag

SEQ ID NO: 4022502 - DNA, 18 bp, Homo sapiens
gtctgctgagttggcctg

SEQ ID NO: 4022503 - DNA, 22 bp, Homo sapiens
gtctgctgagttggcctggcca

SEQ ID NO: 4022504 - DNA, 14 bp, Homo sapiens
gtctgcttgtcaaa

SEQ ID NO: 4022505 - DNA, 13 bp, Homo sapiens
gtctggactttgc

SEQ ID NO: 4022506 - DNA, 23 bp, Homo sapiens
gtctggactttgcttcccctcca

SEQ ID NO: 4022507 - DNA, 18 bp, Homo sapiens
gtctggaggacctgcccg

SEQ ID NO: 4022508 - DNA, 21 bp, Homo sapiens
gtctggagttgatctggaacc

SEQ ID NO: 4022509 - DNA, 12 bp, Homo sapiens
gtctggcagcct

SEQ ID NO: 4022510 - DNA, 12 bp, Homo sapiens
gtctggcctgag

SEQ ID NO: 4022511 - DNA, 12 bp, Homo sapiens
gtctgggcctct

SEQ ID NO: 4022512 - DNA, 13 bp, Homo sapiens
gtctggtgggagg

SEQ ID NO: 4022513 - DNA, 13 bp, Homo sapiens
gtctggtttctag

SEQ ID NO: 4022514 - DNA, 23 bp, Homo sapiens
gtctgtatttatgtgtgaggagc

SEQ ID NO: 4022515 - DNA, 16 bp, Homo sapiens
gtctgtctttcctgaa

SEQ ID NO: 4022516 - DNA, 21 bp, Homo sapiens
gtctgtgaacagagagaccct

SEQ ID NO: 4022517 - DNA, 17 bp, Homo sapiens
gtctgtgagaggcagct

SEQ ID NO: 4022518 - DNA, 15 bp, Homo sapiens
gtctgtgtcatttct

SEQ ID NO: 4022519 - DNA, 13 bp, Homo sapiens
gtctgtgtgaatg

SEQ ID NO: 4022520 - DNA, 15 bp, Homo sapiens
gtctgtgtgaatgtg

SEQ ID NO: 4022521 - DNA, 16 bp, Homo sapiens
gtctgttaacttaata

SEQ ID NO: 4022522 - DNA, 15 bp, Homo sapiens
gtctgttaccatgtc

SEQ ID NO: 4022523 - DNA, 20 bp, Homo sapiens
gtctgttaccatgtcactgt

SEQ ID NO: 4022524 - DNA, 11 bp, Homo sapiens
gtctgttgagt

SEQ ID NO: 4022525 - DNA, 15 bp, Homo sapiens
gtctgtttaagaaaa

SEQ ID NO: 4022526 - DNA, 13 bp, Homo sapiens
gtctgtttggact

SEQ ID NO: 4022527 - DNA, 18 bp, Homo sapiens
gtctgtttgtttcaagaa

SEQ ID NO: 4022528 - DNA, 13 bp, Homo sapiens
gtcttaaatgaga

SEQ ID NO: 4022529 - DNA, 20 bp, Homo sapiens
gtcttaaatgctcattttct

SEQ ID NO: 4022530 - DNA, 13 bp, Homo sapiens
gtcttagagcctt

SEQ ID NO: 4022531 - DNA, 14 bp, Homo sapiens
gtcttatggtccag

SEQ ID NO: 4022532 - DNA, 16 bp, Homo sapiens
gtcttatggtccagaa

SEQ ID NO: 4022533 - DNA, 14 bp, Homo sapiens
gtcttatttccaag

SEQ ID NO: 4022534 - DNA, 17 bp, Homo sapiens
gtcttcaaactgtgaag

SEQ ID NO: 4022535 - DNA, 18 bp, Homo sapiens
gtcttcacttgcactggg

SEQ ID NO: 4022536 - DNA, 17 bp, Homo sapiens
gtcttcatgttcccact

SEQ ID NO: 4022537 - DNA, 11 bp, Homo sapiens
gtcttccacaa

SEQ ID NO: 4022538 - DNA, 15 bp, Homo sapiens
gtcttccctacctca

SEQ ID NO: 4022539 - DNA, 11 bp, Homo sapiens
gtcttccctgg

SEQ ID NO: 4022540 - DNA, 12 bp, Homo sapiens
gtcttccctggg

SEQ ID NO: 4022541 - DNA, 14 bp, Homo sapiens
gtcttccctgggct

SEQ ID NO: 4022542 - DNA, 14 bp, Homo sapiens
gtcttcctactctt

SEQ ID NO: 4022543 - DNA, 19 bp, Homo sapiens
gtcttcctactcttctctc

SEQ ID NO: 4022544 - DNA, 12 bp, Homo sapiens
gtcttcctgagt

SEQ ID NO: 4022545 - DNA, 23 bp, Homo sapiens
gtcttctaaacttccccatcttc

SEQ ID NO: 4022546 - DNA, 13 bp, Homo sapiens
gtcttctaatttc

SEQ ID NO: 4022547 - DNA, 15 bp, Homo sapiens
gtcttctaatttcaa

SEQ ID NO: 4022548 - DNA, 16 bp, Homo sapiens
gtcttctcatagcatt

SEQ ID NO: 4022549 - DNA, 17 bp, Homo sapiens
gtcttctcatagcatta

SEQ ID NO: 4022550 - DNA, 18 bp, Homo sapiens
gtcttctggacaggctct

SEQ ID NO: 4022551 - DNA, 23 bp, Homo sapiens
gtcttctggacaggctctgcttc

SEQ ID NO: 4022552 - DNA, 16 bp, Homo sapiens
gtcttcttacatgcat

SEQ ID NO: 4022553 - DNA, 12 bp, Homo sapiens
gtcttgaatttc

SEQ ID NO: 4022554 - DNA, 12 bp, Homo sapiens
gtcttgactcat

SEQ ID NO: 4022555 - DNA, 19 bp, Homo sapiens
gtcttgactcatggcagct

SEQ ID NO: 4022556 - DNA, 21 bp, Homo sapiens
gtcttgactctaaatgcagtt

SEQ ID NO: 4022557 - DNA, 16 bp, Homo sapiens
gtcttgctctgtcccc

SEQ ID NO: 4022558 - DNA, 14 bp, Homo sapiens
gtcttggccagcca

SEQ ID NO: 4022559 - DNA, 17 bp, Homo sapiens
gtcttggtgccttttgt

SEQ ID NO: 4022560 - DNA, 23 bp, Homo sapiens
gtcttgtgtttccacagcctgca

SEQ ID NO: 4022561 - DNA, 16 bp, Homo sapiens
gtcttgttagaaaaca

SEQ ID NO: 4022562 - DNA, 17 bp, Homo sapiens
gtcttgttagaaaacaa

SEQ ID NO: 4022563 - DNA, 22 bp, Homo sapiens
gtcttgttttttttttccactt

SEQ ID NO: 4022564 - DNA, 15 bp, Homo sapiens
gtctttaaaagagag

SEQ ID NO: 4022565 - DNA, 16 bp, Homo sapiens
gtctttaaatacttca

SEQ ID NO: 4022566 - DNA, 16 bp, Homo sapiens
gtctttaaatagatac

SEQ ID NO: 4022567 - DNA, 17 bp, Homo sapiens
gtctttaggcagcagct

SEQ ID NO: 4022568 - DNA, 14 bp, Homo sapiens
gtctttctccaaag

SEQ ID NO: 4022569 - DNA, 19 bp, Homo sapiens
gtctttctggggtttttct

SEQ ID NO: 4022570 - DNA, 13 bp, Homo sapiens
gtctttgccttct

SEQ ID NO: 4022571 - DNA, 11 bp, Homo sapiens
gtctttgtaag

SEQ ID NO: 4022572 - DNA, 12 bp, Homo sapiens
gtctttgtaaga

SEQ ID NO: 4022573 - DNA, 17 bp, Homo sapiens
gtcttttaatgcttcat

SEQ ID NO: 4022574 - DNA, 13 bp, Homo sapiens
gtcttttatattt

SEQ ID NO: 4022575 - DNA, 18 bp, Homo sapiens
gtcttttatatttgtatc

SEQ ID NO: 4022576 - DNA, 15 bp, Homo sapiens
gtcttttcagaagca

SEQ ID NO: 4022577 - DNA, 23 bp, Homo sapiens
gtcttttcagaagcaagccagac

SEQ ID NO: 4022578 - DNA, 23 bp, Homo sapiens
gtcttttctgtcaccaaatttgt

SEQ ID NO: 4022579 - DNA, 23 bp, Homo sapiens
gtcttttcttggcaaaagccttg

SEQ ID NO: 4022580 - DNA, 16 bp, Homo sapiens
gtctttttatgcattt

SEQ ID NO: 4022581 - DNA, 21 bp, Homo sapiens
ggcacactacagagcagctcc

SEQ ID NO: 4022582 - DNA, 23 bp, Homo sapiens
ggcacactacagagcagctcccc

SEQ ID NO: 4022583 - DNA, 12 bp, Homo sapiens
ggcacagccctc

SEQ ID NO: 4022584 - DNA, 12 bp, Homo sapiens
ggcacagcctgg

SEQ ID NO: 4022585 - DNA, 19 bp, Homo sapiens
ggcacagggcaccagaggc

SEQ ID NO: 4022586 - DNA, 21 bp, Homo sapiens
ggcacagggcccgcagtgctg

SEQ ID NO: 4022587 - DNA, 17 bp, Homo sapiens
ggcacagggtctgctct

SEQ ID NO: 4022588 - DNA, 13 bp, Homo sapiens
ggcacagtccaga

SEQ ID NO: 4022589 - DNA, 15 bp, Homo sapiens
ggcacatgctggccg

SEQ ID NO: 4022590 - DNA, 13 bp, Homo sapiens
ggcaccagacacc

SEQ ID NO: 4022591 - DNA, 18 bp, Homo sapiens
ggcaccagacacccagga

SEQ ID NO: 4022592 - DNA, 13 bp, Homo sapiens
ggcaccagcatcc

SEQ ID NO: 4022593 - DNA, 19 bp, Homo sapiens
ggcaccagcatccaccttg

SEQ ID NO: 4022594 - DNA, 14 bp, Homo sapiens
ggcaccagccagcg

SEQ ID NO: 4022595 - DNA, 20 bp, Homo sapiens
ggcacccaccgtggaggagg

SEQ ID NO: 4022596 - DNA, 14 bp, Homo sapiens
ggcaccccctggag

SEQ ID NO: 4022597 - DNA, 15 bp, Homo sapiens
ggcaccccctggaga

SEQ ID NO: 4022598 - DNA, 16 bp, Homo sapiens
ggcaccccctggagag

SEQ ID NO: 4022599 - DNA, 12 bp, Homo sapiens
ggcaccctcagg

SEQ ID NO: 4022600 - DNA, 19 bp, Homo sapiens
ggcaccctcagggagcctc

SEQ ID NO: 4022601 - DNA, 22 bp, Homo sapiens
ggcaccctcagggagcctcccc

SEQ ID NO: 4022602 - DNA, 20 bp, Homo sapiens
ggcaccgccacgtcccagca

SEQ ID NO: 4022603 - DNA, 18 bp, Homo sapiens
ggcacctaatccaggcag

SEQ ID NO: 4022604 - DNA, 14 bp, Homo sapiens
ggcacctcagaaag

SEQ ID NO: 4022605 - DNA, 16 bp, Homo sapiens
ggcacctgcacactcc

SEQ ID NO: 4022606 - DNA, 13 bp, Homo sapiens
ggcacgggtccct

SEQ ID NO: 4022607 - DNA, 18 bp, Homo sapiens
ggcactcagtgagcctcc

SEQ ID NO: 4022608 - DNA, 20 bp, Homo sapiens
ggcactcagtgagcctcctg

SEQ ID NO: 4022609 - DNA, 22 bp, Homo sapiens
ggcactcagtgagcctcctgtg

SEQ ID NO: 4022610 - DNA, 17 bp, Homo sapiens
ggcactgagatatttat

SEQ ID NO: 4022611 - DNA, 13 bp, Homo sapiens
ggcactgccttct

SEQ ID NO: 4022612 - DNA, 23 bp, Homo sapiens
ggcactgccttctcctctctggg

SEQ ID NO: 4022613 - DNA, 19 bp, Homo sapiens
ggcactgggaggcagggct

SEQ ID NO: 4022614 - DNA, 20 bp, Homo sapiens
ggcactgggaggcagggctc

SEQ ID NO: 4022615 - DNA, 22 bp, Homo sapiens
ggcactgggctgttgttccatt

SEQ ID NO: 4022616 - DNA, 16 bp, Homo sapiens
ggcagaaagtggccat

SEQ ID NO: 4022617 - DNA, 14 bp, Homo sapiens
ggcagaactcccac

SEQ ID NO: 4022618 - DNA, 11 bp, Homo sapiens
ggcagaaggga

SEQ ID NO: 4022619 - DNA, 17 bp, Homo sapiens
ggcagacagcaggcagc

SEQ ID NO: 4022620 - DNA, 15 bp, Homo sapiens
ggcagagaagttctc

SEQ ID NO: 4022621 - DNA, 12 bp, Homo sapiens
ggcagagagaga

SEQ ID NO: 4022622 - DNA, 16 bp, Homo sapiens
ggcagagagagagaaa

SEQ ID NO: 4022623 - DNA, 21 bp, Homo sapiens
ggcagagcttgcagtgagccg

SEQ ID NO: 4022624 - DNA, 20 bp, Homo sapiens
ggcagagggagaatccaagg

SEQ ID NO: 4022625 - DNA, 20 bp, Homo sapiens
ggcagagggctggaggccca

SEQ ID NO: 4022626 - DNA, 15 bp, Homo sapiens
ggcagatctgtgccc

SEQ ID NO: 4022627 - DNA, 15 bp, Homo sapiens
ggcagatgcagctct

SEQ ID NO: 4022628 - DNA, 18 bp, Homo sapiens
ggcagatgcagctcttcc

SEQ ID NO: 4022629 - DNA, 20 bp, Homo sapiens
ggcagatgcagctcttcctg

SEQ ID NO: 4022630 - DNA, 15 bp, Homo sapiens
ggcagatgtcttccc

SEQ ID NO: 4022631 - DNA, 16 bp, Homo sapiens
ggcagattttacaaaa

SEQ ID NO: 4022632 - DNA, 21 bp, Homo sapiens
ggcagattttacaaaagatgt

SEQ ID NO: 4022633 - DNA, 15 bp, Homo sapiens
ggcagcaatttaaat

SEQ ID NO: 4022634 - DNA, 16 bp, Homo sapiens
ggcagcaatttaaatg

SEQ ID NO: 4022635 - DNA, 13 bp, Homo sapiens
ggcagcacccagg

SEQ ID NO: 4022636 - DNA, 20 bp, Homo sapiens
ggcagcaccctcccccgcag

SEQ ID NO: 4022637 - DNA, 18 bp, Homo sapiens
ggcagccaaacccatgag

SEQ ID NO: 4022638 - DNA, 13 bp, Homo sapiens
ggcagccagcaga

SEQ ID NO: 4022639 - DNA, 12 bp, Homo sapiens
ggcagccaggct

SEQ ID NO: 4022640 - DNA, 15 bp, Homo sapiens
ggcagccaggctgcc

SEQ ID NO: 4022641 - DNA, 19 bp, Homo sapiens
ggcagccaggctgccaagg

SEQ ID NO: 4022642 - DNA, 15 bp, Homo sapiens
gggtgaggagctggg

SEQ ID NO: 4022643 - DNA, 20 bp, Homo sapiens
gggtgaggtgtgcctggcct

SEQ ID NO: 4022644 - DNA, 19 bp, Homo sapiens
gggtgagtccattctccca

SEQ ID NO: 4022645 - DNA, 18 bp, Homo sapiens
gggtgagtcctccagaac

SEQ ID NO: 4022646 - DNA, 18 bp, Homo sapiens
gggtgatggccagcccct

SEQ ID NO: 4022647 - DNA, 13 bp, Homo sapiens
gggtgattcctaa

SEQ ID NO: 4022648 - DNA, 13 bp, Homo sapiens
gggtgcaggtggg

SEQ ID NO: 4022649 - DNA, 21 bp, Homo sapiens
gggtgcatttgagagaagcca

SEQ ID NO: 4022650 - DNA, 23 bp, Homo sapiens
gggtgcctgctgcggcagacggg

SEQ ID NO: 4022651 - DNA, 17 bp, Homo sapiens
gggtgctgccatgacag

SEQ ID NO: 4022652 - DNA, 15 bp, Homo sapiens
gggtggaatgagccg

SEQ ID NO: 4022653 - DNA, 21 bp, Homo sapiens
gggtggacaaactggagtctg

SEQ ID NO: 4022654 - DNA, 12 bp, Homo sapiens
gggtggcaggca

SEQ ID NO: 4022655 - DNA, 23 bp, Homo sapiens
gggtggcaggcacacagcagccc

SEQ ID NO: 4022656 - DNA, 13 bp, Homo sapiens
gggtggccatccc

SEQ ID NO: 4022657 - DNA, 13 bp, Homo sapiens
gggtgggcccaga

SEQ ID NO: 4022658 - DNA, 15 bp, Homo sapiens
gggtgggcccagaac

SEQ ID NO: 4022659 - DNA, 17 bp, Homo sapiens
gggtgggcccagaactg

SEQ ID NO: 4022660 - DNA, 19 bp, Homo sapiens
gggtgggcttcctgccctt

SEQ ID NO: 4022661 - DNA, 16 bp, Homo sapiens
gggtggggtagggctg

SEQ ID NO: 4022662 - DNA, 17 bp, Homo sapiens
gggtggggtagggctga

SEQ ID NO: 4022663 - DNA, 16 bp, Homo sapiens
gggtgggtgctcagaa

SEQ ID NO: 4022664 - DNA, 13 bp, Homo sapiens
gggtggtcctgac

SEQ ID NO: 4022665 - DNA, 15 bp, Homo sapiens
gggtggtggcctggt

SEQ ID NO: 4022666 - DNA, 15 bp, Homo sapiens
gggtgtaacttcctg

SEQ ID NO: 4022667 - DNA, 22 bp, Homo sapiens
gggtgtaacttcctgctgcacc

SEQ ID NO: 4022668 - DNA, 23 bp, Homo sapiens
gggtgtaacttcctgctgcaccc

SEQ ID NO: 4022669 - DNA, 19 bp, Homo sapiens
gggtgtcctgcctgtctgc

SEQ ID NO: 4022670 - DNA, 12 bp, Homo sapiens
gggtgtggcagt

SEQ ID NO: 4022671 - DNA, 15 bp, Homo sapiens
gggtgtggcctcagc

SEQ ID NO: 4022672 - DNA, 18 bp, Homo sapiens
gggtgtggcctcagccct

SEQ ID NO: 4022673 - DNA, 19 bp, Homo sapiens
gggtgtggcctcagccctc

SEQ ID NO: 4022674 - DNA, 22 bp, Homo sapiens
gggtgtgggtggaagggctggg

SEQ ID NO: 4022675 - DNA, 22 bp, Homo sapiens
gggtgttttgtggggctccccg

SEQ ID NO: 4022676 - DNA, 17 bp, Homo sapiens
gggttcagcctggcctg

SEQ ID NO: 4022677 - DNA, 23 bp, Homo sapiens
gggttccagaggtattcctctct

SEQ ID NO: 4022678 - DNA, 20 bp, Homo sapiens
gggttctgcctgccagctgc

SEQ ID NO: 4022679 - DNA, 21 bp, Homo sapiens
gggttctgcctgccagctgca

SEQ ID NO: 4022680 - DNA, 16 bp, Homo sapiens
gggttctttggaagga

SEQ ID NO: 4022681 - DNA, 19 bp, Homo sapiens
gggttctttggaaggagtg

SEQ ID NO: 4022682 - DNA, 13 bp, Homo sapiens
gggttgagagcca

SEQ ID NO: 4022683 - DNA, 14 bp, Homo sapiens
gggttgagagccag

SEQ ID NO: 4022684 - DNA, 15 bp, Homo sapiens
gggttgagagccagt

SEQ ID NO: 4022685 - DNA, 14 bp, Homo sapiens
gggttggcacctgc

SEQ ID NO: 4022686 - DNA, 12 bp, Homo sapiens
gggttgggccca

SEQ ID NO: 4022687 - DNA, 14 bp, Homo sapiens
gggttgtgaggcct

SEQ ID NO: 4022688 - DNA, 20 bp, Homo sapiens
gggtttcaccgtgttagcca

SEQ ID NO: 4022689 - DNA, 23 bp, Homo sapiens
gggtttttaatctttgtgacagg

SEQ ID NO: 4022690 - DNA, 16 bp, Homo sapiens
gggtttttattatttt

SEQ ID NO: 4022691 - DNA, 19 bp, Homo sapiens
ggtaaaactcactgtgatc

SEQ ID NO: 4022692 - DNA, 13 bp, Homo sapiens
ggtaaaatacttc

SEQ ID NO: 4022693 - DNA, 15 bp, Homo sapiens
ggtaaatcagtaaga

SEQ ID NO: 4022694 - DNA, 16 bp, Homo sapiens
ggtaacagaacagctt

SEQ ID NO: 4022695 - DNA, 21 bp, Homo sapiens
ggtaaccttatatttacaata

SEQ ID NO: 4022696 - DNA, 18 bp, Homo sapiens
ggtaactgctttctgttc

SEQ ID NO: 4022697 - DNA, 12 bp, Homo sapiens
ggtaactgtcct

SEQ ID NO: 4022698 - DNA, 14 bp, Homo sapiens
ggtaactgtcctgt

SEQ ID NO: 4022699 - DNA, 12 bp, Homo sapiens
ggtaagaaaaag

SEQ ID NO: 4022700 - DNA, 23 bp, Homo sapiens
ggtaagaagttttaaaaagccag

SEQ ID NO: 4022701 - DNA, 15 bp, Homo sapiens
ggtaagcggaataaa

SEQ ID NO: 4022702 - DNA, 16 bp, Homo sapiens
ggtaagcggaataaac

SEQ ID NO: 4022703 - DNA, 18 bp, Homo sapiens
ggtaatgttttgtatata

SEQ ID NO: 4022704 - DNA, 23 bp, Homo sapiens
ggtaatgttttgtatatacagtt

SEQ ID NO: 4022705 - DNA, 23 bp, Homo sapiens
ggtaattattttggtacttttat

SEQ ID NO: 4022706 - DNA, 13 bp, Homo sapiens
ggtaccctctgga

SEQ ID NO: 4022707 - DNA, 21 bp, Homo sapiens
ggtacttagagtttctgtttg

SEQ ID NO: 4022708 - DNA, 20 bp, Homo sapiens
ggtacttttgagtgtgtgtg

SEQ ID NO: 4022709 - DNA, 13 bp, Homo sapiens
ggtagaaaaacat

SEQ ID NO: 4022710 - DNA, 11 bp, Homo sapiens
ggtagaaatgc

SEQ ID NO: 4022711 - DNA, 14 bp, Homo sapiens
ggtagactttgctt

SEQ ID NO: 4022712 - DNA, 17 bp, Homo sapiens
ggtagagaggggactgg

SEQ ID NO: 4022713 - DNA, 18 bp, Homo sapiens
ggtagatcacgagatcaa

SEQ ID NO: 4022714 - DNA, 20 bp, Homo sapiens
ggtagatgcatgacttgtgt

SEQ ID NO: 4022715 - DNA, 16 bp, Homo sapiens
ggtagccagcacacag

SEQ ID NO: 4022716 - DNA, 18 bp, Homo sapiens
ggtagcccagcactgtga

SEQ ID NO: 4022717 - DNA, 20 bp, Homo sapiens
ggtagcccagcactgtgaag

SEQ ID NO: 4022718 - DNA, 19 bp, Homo sapiens
ggtagccccctcttccctg

SEQ ID NO: 4022719 - DNA, 13 bp, Homo sapiens
ggtagggagcctc

SEQ ID NO: 4022720 - DNA, 19 bp, Homo sapiens
ggggcaagacagaaaagtg

SEQ ID NO: 4022721 - DNA, 22 bp, Homo sapiens
ggggcaagacagaaaagtgcct

SEQ ID NO: 4022722 - DNA, 17 bp, Homo sapiens
ggggcagagccctgctc

SEQ ID NO: 4022723 - DNA, 21 bp, Homo sapiens
ggggcagccaaacccatgagg

SEQ ID NO: 4022724 - DNA, 14 bp, Homo sapiens
ggggcagcctgcct

SEQ ID NO: 4022725 - DNA, 13 bp, Homo sapiens
ggggcaggctggg

SEQ ID NO: 4022726 - DNA, 14 bp, Homo sapiens
ggggcaggctgggc

SEQ ID NO: 4022727 - DNA, 16 bp, Homo sapiens
ggggcaggctgggcca

SEQ ID NO: 4022728 - DNA, 13 bp, Homo sapiens
ggggcagtggcaa

SEQ ID NO: 4022729 - DNA, 12 bp, Homo sapiens
ggggccagagga

SEQ ID NO: 4022730 - DNA, 15 bp, Homo sapiens
ggggccagaggctgg

SEQ ID NO: 4022731 - DNA, 14 bp, Homo sapiens
ggggccagatccag

SEQ ID NO: 4022732 - DNA, 19 bp, Homo sapiens
ggggccagatccagcctgg

SEQ ID NO: 4022733 - DNA, 21 bp, Homo sapiens
ggggccaggacaccagtccag

SEQ ID NO: 4022734 - DNA, 20 bp, Homo sapiens
ggggccagtggggaactgag

SEQ ID NO: 4022735 - DNA, 19 bp, Homo sapiens
ggggcccaaggcggcccct

SEQ ID NO: 4022736 - DNA, 22 bp, Homo sapiens
ggggcccaaggcggcccctccc

SEQ ID NO: 4022737 - DNA, 22 bp, Homo sapiens
ggggcccacagacagatcccat

SEQ ID NO: 4022738 - DNA, 17 bp, Homo sapiens
ggggccccgccagggct

SEQ ID NO: 4022739 - DNA, 21 bp, Homo sapiens
ggggccccgggttcagcctgg

SEQ ID NO: 4022740 - DNA, 16 bp, Homo sapiens
ggggccgggcaggtcc

SEQ ID NO: 4022741 - DNA, 17 bp, Homo sapiens
ggggccgggcaggtcct

SEQ ID NO: 4022742 - DNA, 23 bp, Homo sapiens
ggggccgggcaggtcctgcccat

SEQ ID NO: 4022743 - DNA, 23 bp, Homo sapiens
ggggcctacagctttgatccctg

SEQ ID NO: 4022744 - DNA, 15 bp, Homo sapiens
ggggcctggacctgc

SEQ ID NO: 4022745 - DNA, 12 bp, Homo sapiens
ggggcctggcag

SEQ ID NO: 4022746 - DNA, 23 bp, Homo sapiens
ggggcctgggacttccatgcctt

SEQ ID NO: 4022747 - DNA, 20 bp, Homo sapiens
ggggccttagggcactgggc

SEQ ID NO: 4022748 - DNA, 14 bp, Homo sapiens
ggggcgatgctccc

SEQ ID NO: 4022749 - DNA, 22 bp, Homo sapiens
ggggctcagatggactgggagg

SEQ ID NO: 4022750 - DNA, 12 bp, Homo sapiens
ggggctgtgcat

SEQ ID NO: 4022751 - DNA, 22 bp, Homo sapiens
ggggcttagggtcggaacccaa

SEQ ID NO: 4022752 - DNA, 16 bp, Homo sapiens
gggggaatgagcccag

SEQ ID NO: 4022753 - DNA, 11 bp, Homo sapiens
gggggactggg

SEQ ID NO: 4022754 - DNA, 13 bp, Homo sapiens
gggggcagggctg

SEQ ID NO: 4022755 - DNA, 15 bp, Homo sapiens
gggggccagtgggga

SEQ ID NO: 4022756 - DNA, 22 bp, Homo sapiens
gggggccccgccagggctgggg

SEQ ID NO: 4022757 - DNA, 18 bp, Homo sapiens
gggggccgggcaggtcct

SEQ ID NO: 4022758 - DNA, 21 bp, Homo sapiens
gggggtcaccggccgatggag

SEQ ID NO: 4022759 - DNA, 16 bp, Homo sapiens
gggggtccacccagca

SEQ ID NO: 4022760 - DNA, 12 bp, Homo sapiens
gggggtggcagg

SEQ ID NO: 4022761 - DNA, 18 bp, Homo sapiens
gggggtttttactccagt

SEQ ID NO: 4022762 - DNA, 24 bp, Homo sapiens
gggggtttttactccagtggtgaa

SEQ ID NO: 4022763 - DNA, 15 bp, Homo sapiens
ggggtagggagcctc

SEQ ID NO: 4022764 - DNA, 18 bp, Homo sapiens
ggggtcccctccaggagt

SEQ ID NO: 4022765 - DNA, 23 bp, Homo sapiens
ggggtctcgttttgttgccaaag

SEQ ID NO: 4022766 - DNA, 22 bp, Homo sapiens
ggggtgactttgtctctcctgg

SEQ ID NO: 4022767 - DNA, 14 bp, Homo sapiens
ggggtgaggagctg

SEQ ID NO: 4022768 - DNA, 18 bp, Homo sapiens
ggggtgatttcagagagg

SEQ ID NO: 4022769 - DNA, 16 bp, Homo sapiens
ggggtgcccacaggcc

SEQ ID NO: 4022770 - DNA, 13 bp, Homo sapiens
ggggtgggctggt

SEQ ID NO: 4022771 - DNA, 18 bp, Homo sapiens
ggggtgggggtggaggct

SEQ ID NO: 4022772 - DNA, 17 bp, Homo sapiens
ggggtgggggtggggag

SEQ ID NO: 4022773 - DNA, 16 bp, Homo sapiens
ggggtgtaacttcctg

SEQ ID NO: 4022774 - DNA, 20 bp, Homo sapiens
ggggtgtttgggaggctgcg

SEQ ID NO: 4022775 - DNA, 22 bp, Homo sapiens
ggggttccctcctagctctccc

SEQ ID NO: 4022776 - DNA, 13 bp, Homo sapiens
gggtacagctggg

SEQ ID NO: 4022777 - DNA, 14 bp, Homo sapiens
gggtagatgtgcaa

SEQ ID NO: 4022778 - DNA, 18 bp, Homo sapiens
gggtaggggtagggagcc

SEQ ID NO: 4022779 - DNA, 19 bp, Homo sapiens
gggtaggggtagggagcct

SEQ ID NO: 4022780 - DNA, 22 bp, Homo sapiens
gggtagggtaaatcagtaagag

SEQ ID NO: 4022781 - DNA, 23 bp, Homo sapiens
gggtataaaactttcctcgcctg

SEQ ID NO: 4022782 - DNA, 19 bp, Homo sapiens
gggtatccaagttggactg

SEQ ID NO: 4022783 - DNA, 21 bp, Homo sapiens
gggtatccaagttggactggg

SEQ ID NO: 4022784 - DNA, 13 bp, Homo sapiens
gggtcaaacctgt

SEQ ID NO: 4022785 - DNA, 19 bp, Homo sapiens
gggtcaagaaacagccagc

SEQ ID NO: 4022786 - DNA, 16 bp, Homo sapiens
gggtcacatccatccc

SEQ ID NO: 4022787 - DNA, 12 bp, Homo sapiens
gggtcagccagg

SEQ ID NO: 4022788 - DNA, 19 bp, Homo sapiens
gggtcagccagggccaggg

SEQ ID NO: 4022789 - DNA, 11 bp, Homo sapiens
gggtcaggaac

SEQ ID NO: 4022790 - DNA, 21 bp, Homo sapiens
gggtcaggcggggtgctgtgg

SEQ ID NO: 4022791 - DNA, 12 bp, Homo sapiens
gggtcagggggg

SEQ ID NO: 4022792 - DNA, 19 bp, Homo sapiens
gggtcaggttgacaggagg

SEQ ID NO: 4022793 - DNA, 21 bp, Homo sapiens
gggtcatgtttgcaggggtga

SEQ ID NO: 4022794 - DNA, 21 bp, Homo sapiens
gggtcattgacctctcagggc

SEQ ID NO: 4022795 - DNA, 12 bp, Homo sapiens
gggtccagggcc

SEQ ID NO: 4022796 - DNA, 14 bp, Homo sapiens
ggtagggaggcagc

SEQ ID NO: 4022797 - DNA, 14 bp, Homo sapiens
ggtagggtaaatca

SEQ ID NO: 4022798 - DNA, 15 bp, Homo sapiens
ggtagggtaaatcag

SEQ ID NO: 4022799 - DNA, 16 bp, Homo sapiens
ggtagttagtagcatg

SEQ ID NO: 4022800 - DNA, 19 bp, Homo sapiens
ggtagttagtagcatgttg

SEQ ID NO: 4022801 - DNA, 21 bp, Homo sapiens
ggtataaaactttcctcgcct

SEQ ID NO: 4022802 - DNA, 22 bp, Homo sapiens
ggtataaaactttcctcgcctg

SEQ ID NO: 4022803 - DNA, 12 bp, Homo sapiens
ggtatcctgccc

SEQ ID NO: 4022804 - DNA, 15 bp, Homo sapiens
ggtatctcagaaagt

SEQ ID NO: 4022805 - DNA, 13 bp, Homo sapiens
ggtatctccagga

SEQ ID NO: 4022806 - DNA, 23 bp, Homo sapiens
ggtatctccaggattgaagagca

SEQ ID NO: 4022807 - DNA, 17 bp, Homo sapiens
ggtatgctggccagcac

SEQ ID NO: 4022808 - DNA, 18 bp, Homo sapiens
ggtatgctggccagcacc

SEQ ID NO: 4022809 - DNA, 14 bp, Homo sapiens
ggtattagaaagtg

SEQ ID NO: 4022810 - DNA, 18 bp, Homo sapiens
ggtattattctgttttgc

SEQ ID NO: 4022811 - DNA, 19 bp, Homo sapiens
ggtattccttttgtgtaca

SEQ ID NO: 4022812 - DNA, 14 bp, Homo sapiens
ggtatttctccagt

SEQ ID NO: 4022813 - DNA, 15 bp, Homo sapiens
ggtattttgtttctt

SEQ ID NO: 4022814 - DNA, 18 bp, Homo sapiens
ggtattttgtttctttta

SEQ ID NO: 4022815 - DNA, 21 bp, Homo sapiens
ggtcaagaaacagccagcaag

SEQ ID NO: 4022816 - DNA, 21 bp, Homo sapiens
ggtcaataaacttagaggaaa

SEQ ID NO: 4022817 - DNA, 23 bp, Homo sapiens
ggtcaataaacttagaggaaaat

SEQ ID NO: 4022818 - DNA, 14 bp, Homo sapiens
ggtcacacactgat

SEQ ID NO: 4022819 - DNA, 22 bp, Homo sapiens
ggtctgctctttctctgccagt

SEQ ID NO: 4022820 - DNA, 14 bp, Homo sapiens
ggtctggaggacct

SEQ ID NO: 4022821 - DNA, 18 bp, Homo sapiens
ggtctgtacgttacctct

SEQ ID NO: 4022822 - DNA, 16 bp, Homo sapiens
ggtctgtgtcatttct

SEQ ID NO: 4022823 - DNA, 19 bp, Homo sapiens
ggtctgtgtctcttttctc

SEQ ID NO: 4022824 - DNA, 14 bp, Homo sapiens
ggtcttcagccatc

SEQ ID NO: 4022825 - DNA, 17 bp, Homo sapiens
ggtcttccctacctcag

SEQ ID NO: 4022826 - DNA, 22 bp, Homo sapiens
ggtcttccctacctcaggcagg

SEQ ID NO: 4022827 - DNA, 19 bp, Homo sapiens
ggtcttcctactcttctct

SEQ ID NO: 4022828 - DNA, 22 bp, Homo sapiens
ggtcttcttacatgcatttgag

SEQ ID NO: 4022829 - DNA, 20 bp, Homo sapiens
ggtcttgactcatggcagct

SEQ ID NO: 4022830 - DNA, 13 bp, Homo sapiens
ggtcttgatctcc

SEQ ID NO: 4022831 - DNA, 20 bp, Homo sapiens
ggtcttgctctgtcccccag

SEQ ID NO: 4022832 - DNA, 12 bp, Homo sapiens
ggtctttgtaag

SEQ ID NO: 4022833 - DNA, 13 bp, Homo sapiens
ggtctttgtaaga

SEQ ID NO: 4022834 - DNA, 15 bp, Homo sapiens
ggtctttgtaagagt

SEQ ID NO: 4022835 - DNA, 17 bp, Homo sapiens
ggtcttttgacatgtgg

SEQ ID NO: 4022836 - DNA, 21 bp, Homo sapiens
ggtcttttgacatgtggaaag

SEQ ID NO: 4022837 - DNA, 15 bp, Homo sapiens
ggtcttttttcattt

SEQ ID NO: 4022838 - DNA, 17 bp, Homo sapiens
ggtcttttttcatttct

SEQ ID NO: 4022839 - DNA, 19 bp, Homo sapiens
gtaaatacaagactgttgt

SEQ ID NO: 4022840 - DNA, 17 bp, Homo sapiens
gtaaatagtatttgaga

SEQ ID NO: 4022841 - DNA, 17 bp, Homo sapiens
gtaaatatatgtctgat

SEQ ID NO: 4022842 - DNA, 18 bp, Homo sapiens
gtaaatatgtacatttgt

SEQ ID NO: 4022843 - DNA, 14 bp, Homo sapiens
gtaaatattctata

SEQ ID NO: 4022844 - DNA, 15 bp, Homo sapiens
gtaaatattctatat

SEQ ID NO: 4022845 - DNA, 19 bp, Homo sapiens
gtaaatattgaggctttgt

SEQ ID NO: 4022846 - DNA, 14 bp, Homo sapiens
gtaaatcagtaaga

SEQ ID NO: 4022847 - DNA, 17 bp, Homo sapiens
gtaaatcagtaagaggt

SEQ ID NO: 4022848 - DNA, 12 bp, Homo sapiens
gtaaatgatgtg

SEQ ID NO: 4022849 - DNA, 15 bp, Homo sapiens
gtaaattatttgcta

SEQ ID NO: 4022850 - DNA, 17 bp, Homo sapiens
gtaaattatttgctaag

SEQ ID NO: 4022851 - DNA, 19 bp, Homo sapiens
gtaaattgaatcagtataa

SEQ ID NO: 4022852 - DNA, 20 bp, Homo sapiens
gtaacaaataaagtgcagtt

SEQ ID NO: 4022853 - DNA, 21 bp, Homo sapiens
gtaacaattgtgtagcctttt

SEQ ID NO: 4022854 - DNA, 21 bp, Homo sapiens
gtaacagaacagcttcaggtt

SEQ ID NO: 4022855 - DNA, 18 bp, Homo sapiens
gtaacagttcatgtttgc

SEQ ID NO: 4022856 - DNA, 20 bp, Homo sapiens
gtaacagttcatgtttgctt

SEQ ID NO: 4022857 - DNA, 22 bp, Homo sapiens
gtaacatgtttacttttcaggg

SEQ ID NO: 4022858 - DNA, 14 bp, Homo sapiens
gtaacatttgctgt

SEQ ID NO: 4022859 - DNA, 19 bp, Homo sapiens
gtaacatttgctgttttaa

SEQ ID NO: 4022860 - DNA, 22 bp, Homo sapiens
gtaacatttgctgttttaaaca

SEQ ID NO: 4022861 - DNA, 17 bp, Homo sapiens
gtaacctcagctctggg

SEQ ID NO: 4022862 - DNA, 18 bp, Homo sapiens
gtaacgtgtgctgtgttt

SEQ ID NO: 4022863 - DNA, 20 bp, Homo sapiens
gtaactgctttctgttccaa

SEQ ID NO: 4022864 - DNA, 16 bp, Homo sapiens
gtaactgtcctgtcct

SEQ ID NO: 4022865 - DNA, 19 bp, Homo sapiens
gtaacttatattgaagaca

SEQ ID NO: 4022866 - DNA, 22 bp, Homo sapiens
gtaacttatattgaagacaatt

SEQ ID NO: 4022867 - DNA, 13 bp, Homo sapiens
gtaacttcctgct

SEQ ID NO: 4022868 - DNA, 18 bp, Homo sapiens
gtaacttcttatggaatt

SEQ ID NO: 4022869 - DNA, 22 bp, Homo sapiens
gtaactttactctgtgtttaaa

SEQ ID NO: 4022870 - DNA, 20 bp, Homo sapiens
gtaagaaagtgaagcaaatc

SEQ ID NO: 4022871 - DNA, 15 bp, Homo sapiens
gtaagaagagactgg

SEQ ID NO: 4022872 - DNA, 16 bp, Homo sapiens
gtaagagctggtgtct

SEQ ID NO: 4022873 - DNA, 23 bp, Homo sapiens
gtaagagtactgggagaatcact

SEQ ID NO: 4022874 - DNA, 18 bp, Homo sapiens
gtaagagtgtagaagcat

SEQ ID NO: 4022875 - DNA, 18 bp, Homo sapiens
gtaagatacaagtttcag

SEQ ID NO: 4022876 - DNA, 15 bp, Homo sapiens
gtaagatgcactgaa

SEQ ID NO: 4022877 - DNA, 13 bp, Homo sapiens
gtaaggtgcagtt

SEQ ID NO: 4022878 - DNA, 14 bp, Homo sapiens
gtaagtcagtgttg

SEQ ID NO: 4022879 - DNA, 19 bp, Homo sapiens
gtaagtcagtgttgagatg

SEQ ID NO: 4022880 - DNA, 20 bp, Homo sapiens
gtaagtgtgagtaagagctg

SEQ ID NO: 4022881 - DNA, 21 bp, Homo sapiens
gtaagtgtgagtaagagctgg

SEQ ID NO: 4022882 - DNA, 13 bp, Homo sapiens
gtaagttgtacaa

SEQ ID NO: 4022883 - DNA, 21 bp, Homo sapiens
gtaagtttcccctctggcttg

SEQ ID NO: 4022884 - DNA, 17 bp, Homo sapiens
gtaataaagtatataat

SEQ ID NO: 4022885 - DNA, 19 bp, Homo sapiens
gtaataacaaacgtgtttt

SEQ ID NO: 4022886 - DNA, 15 bp, Homo sapiens
gtaataactgtgaag

SEQ ID NO: 4022887 - DNA, 22 bp, Homo sapiens
gtaataactgtgaagtttacat

SEQ ID NO: 4022888 - DNA, 19 bp, Homo sapiens
gtaatcaataaagaaaact

SEQ ID NO: 4022889 - DNA, 17 bp, Homo sapiens
gtaatcatatgtgtctt

SEQ ID NO: 4022890 - DNA, 15 bp, Homo sapiens
gtaatcccagcactt

SEQ ID NO: 4022891 - DNA, 22 bp, Homo sapiens
gtaatcctcaagaaataaaagg

SEQ ID NO: 4022892 - DNA, 20 bp, Homo sapiens
gtaatctctctgcagctgcc

SEQ ID NO: 4022893 - DNA, 19 bp, Homo sapiens
gtaatctttacctgtatac

SEQ ID NO: 4022894 - DNA, 14 bp, Homo sapiens
gtaatgagggactg

SEQ ID NO: 4022895 - DNA, 23 bp, Homo sapiens
gtaatggtactgactttgcttgc

SEQ ID NO: 4022896 - DNA, 16 bp, Homo sapiens
gtaatggtgtagaaca

SEQ ID NO: 4022897 - DNA, 20 bp, Homo sapiens
gtaatgtagcgtgtttacat

SEQ ID NO: 4022898 - DNA, 21 bp, Homo sapiens
gtaatgtagcgtgtttacatg

SEQ ID NO: 4022899 - DNA, 14 bp, Homo sapiens
gtaatgttactgat

SEQ ID NO: 4022900 - DNA, 23 bp, Homo sapiens
gtaatgttactgatcatgcattg

SEQ ID NO: 4022901 - DNA, 14 bp, Homo sapiens
gtaattatgatttg

SEQ ID NO: 4022902 - DNA, 17 bp, Homo sapiens
gtaattattttggtact

SEQ ID NO: 4022903 - DNA, 13 bp, Homo sapiens
gtaattcaagaaa

SEQ ID NO: 4022904 - DNA, 15 bp, Homo sapiens
gtaattgacatgtgc

SEQ ID NO: 4022905 - DNA, 15 bp, Homo sapiens
gtaattgcttacatt

SEQ ID NO: 4022906 - DNA, 12 bp, Homo sapiens
gtaattgctttt

SEQ ID NO: 4022907 - DNA, 13 bp, Homo sapiens
gtaattgtgaaaa

SEQ ID NO: 4022908 - DNA, 12 bp, Homo sapiens
gtaattgttcca

SEQ ID NO: 4022909 - DNA, 21 bp, Homo sapiens
gtaattgttccagagacaaat

SEQ ID NO: 4022910 - DNA, 12 bp, Homo sapiens
gtaatttatgca

SEQ ID NO: 4022911 - DNA, 13 bp, Homo sapiens
gtaatttatgcaa

SEQ ID NO: 4022912 - DNA, 14 bp, Homo sapiens
gtaatttgaagatt

SEQ ID NO: 4022913 - DNA, 18 bp, Homo sapiens
gtaattttatatgaagat

SEQ ID NO: 4022914 - DNA, 22 bp, Homo sapiens
gtaatttttaccctaatgtctt

SEQ ID NO: 4022915 - DNA, 21 bp, Homo sapiens
gtaatttttttaatttacaaa

SEQ ID NO: 4022916 - DNA, 17 bp, Homo sapiens
gtacaaatgtattttga

SEQ ID NO: 4022917 - DNA, 21 bp, Homo sapiens
gtacaagttgttattgttgaa

SEQ ID NO: 4022918 - DNA, 18 bp, Homo sapiens
gtacaatgaagaagtttc

SEQ ID NO: 4022919 - DNA, 15 bp, Homo sapiens
gtacactgaatattt

SEQ ID NO: 4022920 - DNA, 13 bp, Homo sapiens
gtacactgctgta

SEQ ID NO: 4022921 - DNA, 20 bp, Homo sapiens
gtacagcggctcccctctgc

SEQ ID NO: 4022922 - DNA, 17 bp, Homo sapiens
gtacagtaggataagcc

SEQ ID NO: 4022923 - DNA, 21 bp, Homo sapiens
gtacagttatttatgcctctg

SEQ ID NO: 4022924 - DNA, 20 bp, Homo sapiens
gtacataaattgcataaagc

SEQ ID NO: 4022925 - DNA, 21 bp, Homo sapiens
gtacataaattgcataaagca

SEQ ID NO: 4022926 - DNA, 19 bp, Homo sapiens
gtacataccctggccgccc

SEQ ID NO: 4022927 - DNA, 20 bp, Homo sapiens
gtacatagttatttttctct

SEQ ID NO: 4022928 - DNA, 16 bp, Homo sapiens
ggatctgtccaaggaa

SEQ ID NO: 4022929 - DNA, 15 bp, Homo sapiens
ggatcttgaatgtgg

SEQ ID NO: 4022930 - DNA, 22 bp, Homo sapiens
ggatcttgaatgtggtctcagg

SEQ ID NO: 4022931 - DNA, 16 bp, Homo sapiens
ggatcttgcattccca

SEQ ID NO: 4022932 - DNA, 22 bp, Homo sapiens
ggatcttgcattcccagtggtc

SEQ ID NO: 4022933 - DNA, 13 bp, Homo sapiens
ggatcttgccaca

SEQ ID NO: 4022934 - DNA, 23 bp, Homo sapiens
ggatcttgccacatttctgatca

SEQ ID NO: 4022935 - DNA, 17 bp, Homo sapiens
ggatgacaccctggcct

SEQ ID NO: 4022936 - DNA, 23 bp, Homo sapiens
ggatgacagggcagagcaggaag

SEQ ID NO: 4022937 - DNA, 15 bp, Homo sapiens
ggatgagagcccaga

SEQ ID NO: 4022938 - DNA, 16 bp, Homo sapiens
ggatgagagcccagag

SEQ ID NO: 4022939 - DNA, 23 bp, Homo sapiens
ggatgagagcccagaggtaacag

SEQ ID NO: 4022940 - DNA, 18 bp, Homo sapiens
ggatgaggggtgctgggt

SEQ ID NO: 4022941 - DNA, 20 bp, Homo sapiens
ggatgattcagaaattggaa

SEQ ID NO: 4022942 - DNA, 21 bp, Homo sapiens
ggatgcaacacgcatggtcaa

SEQ ID NO: 4022943 - DNA, 16 bp, Homo sapiens
ggatgcgcagtgcctt

SEQ ID NO: 4022944 - DNA, 12 bp, Homo sapiens
ggatgctgctcc

SEQ ID NO: 4022945 - DNA, 13 bp, Homo sapiens
ggatgctgggctg

SEQ ID NO: 4022946 - DNA, 16 bp, Homo sapiens
ggatgctgggctgggc

SEQ ID NO: 4022947 - DNA, 18 bp, Homo sapiens
ggatgctgggctgggccc

SEQ ID NO: 4022948 - DNA, 19 bp, Homo sapiens
ggatggaaggttggatgga

SEQ ID NO: 4022949 - DNA, 15 bp, Homo sapiens
ggatggacagtgggc

SEQ ID NO: 4022950 - DNA, 18 bp, Homo sapiens
ggatggaccaacctgctc

SEQ ID NO: 4022951 - DNA, 20 bp, Homo sapiens
ggatggaccaacctgctctg

SEQ ID NO: 4022952 - DNA, 23 bp, Homo sapiens
ggatggaccaacctgctctgtcc

SEQ ID NO: 4022953 - DNA, 22 bp, Homo sapiens
ggatggactcttctcggctcag

SEQ ID NO: 4022954 - DNA, 16 bp, Homo sapiens
ggatggagaggcggcc

SEQ ID NO: 4022955 - DNA, 12 bp, Homo sapiens
ggatggccgtgg

SEQ ID NO: 4022956 - DNA, 18 bp, Homo sapiens
ggatgggaatttgtcagc

SEQ ID NO: 4022957 - DNA, 13 bp, Homo sapiens
ggatgggacaggg

SEQ ID NO: 4022958 - DNA, 15 bp, Homo sapiens
ggatgggaccaggga

SEQ ID NO: 4022959 - DNA, 15 bp, Homo sapiens
ggatgggagtgagac

SEQ ID NO: 4022960 - DNA, 17 bp, Homo sapiens
ggatgggggaactcaga

SEQ ID NO: 4022961 - DNA, 19 bp, Homo sapiens
ggatgggggatgggccagg

SEQ ID NO: 4022962 - DNA, 16 bp, Homo sapiens
ggatgggtcagagcta

SEQ ID NO: 4022963 - DNA, 17 bp, Homo sapiens
ggatgggttccagaggt

SEQ ID NO: 4022964 - DNA, 20 bp, Homo sapiens
ggatggtctcgatctcctga

SEQ ID NO: 4022965 - DNA, 17 bp, Homo sapiens
ggatgtggaaagcactt

SEQ ID NO: 4022966 - DNA, 15 bp, Homo sapiens
ggatgtgggagggag

SEQ ID NO: 4022967 - DNA, 23 bp, Homo sapiens
ggatgtgggagggagcagacagg

SEQ ID NO: 4022968 - DNA, 20 bp, Homo sapiens
ggatgttcagcactgtccct

SEQ ID NO: 4022969 - DNA, 17 bp, Homo sapiens
ggattaacctctgcact

SEQ ID NO: 4022970 - DNA, 18 bp, Homo sapiens
ggattaacctctgcacta

SEQ ID NO: 4022971 - DNA, 15 bp, Homo sapiens
ggattattcatttaa

SEQ ID NO: 4022972 - DNA, 17 bp, Homo sapiens
ggattattcatttaaaa

SEQ ID NO: 4022973 - DNA, 19 bp, Homo sapiens
ggattattcatttaaaatg

SEQ ID NO: 4022974 - DNA, 19 bp, Homo sapiens
ggattatttaataacatta

SEQ ID NO: 4022975 - DNA, 15 bp, Homo sapiens
ggattcaggctgctt

SEQ ID NO: 4022976 - DNA, 23 bp, Homo sapiens
ggattctactttaagcactacat

SEQ ID NO: 4022977 - DNA, 22 bp, Homo sapiens
ggattctgggaggcaagaaaag

SEQ ID NO: 4022978 - DNA, 17 bp, Homo sapiens
ggattgaggggccctgg

SEQ ID NO: 4022979 - DNA, 18 bp, Homo sapiens
ggattgcacgtggcctct

SEQ ID NO: 4022980 - DNA, 15 bp, Homo sapiens
ggattgcccctggct

SEQ ID NO: 4022981 - DNA, 17 bp, Homo sapiens
ggattgcccctggcttt

SEQ ID NO: 4022982 - DNA, 16 bp, Homo sapiens
ggattgctatgaatga

SEQ ID NO: 4022983 - DNA, 16 bp, Homo sapiens
ggattggattatttaa

SEQ ID NO: 4022984 - DNA, 18 bp, Homo sapiens
ggattggattatttaata

SEQ ID NO: 4022985 - DNA, 22 bp, Homo sapiens
ggattggattatttaataacat

SEQ ID NO: 4022986 - DNA, 16 bp, Homo sapiens
ggatttataaatgcta

SEQ ID NO: 4022987 - DNA, 20 bp, Homo sapiens
ggatttcatgatttcatttc

SEQ ID NO: 4022988 - DNA, 15 bp, Homo sapiens
ggatttccctgcaga

SEQ ID NO: 4022989 - DNA, 16 bp, Homo sapiens
ggatttgattcatttt

SEQ ID NO: 4022990 - DNA, 12 bp, Homo sapiens
ggcagtgcccca

SEQ ID NO: 4022991 - DNA, 15 bp, Homo sapiens
ggcagtgccccaggg

SEQ ID NO: 4022992 - DNA, 16 bp, Homo sapiens
ggcagtgccccaggga

SEQ ID NO: 4022993 - DNA, 19 bp, Homo sapiens
ggcagttctcactcctagg

SEQ ID NO: 4022994 - DNA, 13 bp, Homo sapiens
ggcagttgcatta

SEQ ID NO: 4022995 - DNA, 22 bp, Homo sapiens
ggcatacgagagcagaggtctc

SEQ ID NO: 4022996 - DNA, 21 bp, Homo sapiens
ggcatagctccccgcttctgc

SEQ ID NO: 4022997 - DNA, 17 bp, Homo sapiens
ggcataggcctgggtgc

SEQ ID NO: 4022998 - DNA, 22 bp, Homo sapiens
ggcatatccaccacctccctca

SEQ ID NO: 4022999 - DNA, 16 bp, Homo sapiens
ggcatcagcagcaggg

SEQ ID NO: 4023000 - DNA, 20 bp, Homo sapiens
ggcatcagtccccctgtgca

SEQ ID NO: 4023001 - DNA, 12 bp, Homo sapiens
ggcatcattcca

SEQ ID NO: 4023002 - DNA, 17 bp, Homo sapiens
ggcatcccagcctgggg

SEQ ID NO: 4023003 - DNA, 19 bp, Homo sapiens
ggcatcccagcctgggggc

SEQ ID NO: 4023004 - DNA, 20 bp, Homo sapiens
ggcatctacacagcctggac

SEQ ID NO: 4023005 - DNA, 21 bp, Homo sapiens
ggcatctacacagcctggact

SEQ ID NO: 4023006 - DNA, 17 bp, Homo sapiens
ggcatctcctgtgcatg

SEQ ID NO: 4023007 - DNA, 17 bp, Homo sapiens
ggcatctcttccccaga

SEQ ID NO: 4023008 - DNA, 18 bp, Homo sapiens
ggcatctcttccccagag

SEQ ID NO: 4023009 - DNA, 16 bp, Homo sapiens
ggcatctgcccctccc

SEQ ID NO: 4023010 - DNA, 16 bp, Homo sapiens
ggcatcttggaaaagg

SEQ ID NO: 4023011 - DNA, 17 bp, Homo sapiens
ggcatctttgccttggg

SEQ ID NO: 4023012 - DNA, 13 bp, Homo sapiens
ggcatgagaaaga

SEQ ID NO: 4023013 - DNA, 20 bp, Homo sapiens
ggcatgatcatagctcactg

SEQ ID NO: 4023014 - DNA, 22 bp, Homo sapiens
ggcatgcacatctggaattaag

SEQ ID NO: 4023015 - DNA, 13 bp, Homo sapiens
ggcatgccaccct

SEQ ID NO: 4023016 - DNA, 24 bp, Homo sapiens
ggcatgccaccctcacacacacag

SEQ ID NO: 4023017 - DNA, 17 bp, Homo sapiens
ggcatggccaggtggcc

SEQ ID NO: 4023018 - DNA, 13 bp, Homo sapiens
ggcatggccctgg

SEQ ID NO: 4023019 - DNA, 16 bp, Homo sapiens
ggcatggccctggggt

SEQ ID NO: 4023020 - DNA, 17 bp, Homo sapiens
ggcatggccctggggtc

SEQ ID NO: 4023021 - DNA, 17 bp, Homo sapiens
ggcatggctcagagctt

SEQ ID NO: 4023022 - DNA, 21 bp, Homo sapiens
ggcatgggaaagccacctctc

SEQ ID NO: 4023023 - DNA, 18 bp, Homo sapiens
ggcatgtgtatgtgtctg

SEQ ID NO: 4023024 - DNA, 16 bp, Homo sapiens
ggcatgtttccagcag

SEQ ID NO: 4023025 - DNA, 19 bp, Homo sapiens
ggcatgttttgtgcatttg

SEQ ID NO: 4023026 - DNA, 16 bp, Homo sapiens
ggcattaacacaaagg

SEQ ID NO: 4023027 - DNA, 16 bp, Homo sapiens
ggcattaatgtttcta

SEQ ID NO: 4023028 - DNA, 19 bp, Homo sapiens
ggcattagaattatttaaa

SEQ ID NO: 4023029 - DNA, 17 bp, Homo sapiens
ggcattcgggccacagg

SEQ ID NO: 4023030 - DNA, 18 bp, Homo sapiens
ggcattcgggccacaggg

SEQ ID NO: 4023031 - DNA, 17 bp, Homo sapiens
ggcattgttagtttagt

SEQ ID NO: 4023032 - DNA, 11 bp, Homo sapiens
ggcatttccta

SEQ ID NO: 4023033 - DNA, 12 bp, Homo sapiens
ggcatttgttca

SEQ ID NO: 4023034 - DNA, 17 bp, Homo sapiens
ggccaaaagcagtaaat

SEQ ID NO: 4023035 - DNA, 19 bp, Homo sapiens
ggccaaacccttgctttcc

SEQ ID NO: 4023036 - DNA, 15 bp, Homo sapiens
ggccaaactgtccct

SEQ ID NO: 4023037 - DNA, 16 bp, Homo sapiens
ggccaaaggctggtgg

SEQ ID NO: 4023038 - DNA, 19 bp, Homo sapiens
ggccaacatcgtgaaaccc

SEQ ID NO: 4023039 - DNA, 21 bp, Homo sapiens
ggccaacttgagggcccagag

SEQ ID NO: 4023040 - DNA, 12 bp, Homo sapiens
ggccaagagaag

SEQ ID NO: 4023041 - DNA, 19 bp, Homo sapiens
ggccaaggccttctcctcc

SEQ ID NO: 4023042 - DNA, 15 bp, Homo sapiens
ggccaaggtcctgct

SEQ ID NO: 4023043 - DNA, 21 bp, Homo sapiens
ggccaataaaaagttcagagt

SEQ ID NO: 4023044 - DNA, 22 bp, Homo sapiens
ggccacactattaccatgagaa

SEQ ID NO: 4023045 - DNA, 20 bp, Homo sapiens
ggccacagtagtcttgatga

SEQ ID NO: 4023046 - DNA, 16 bp, Homo sapiens
ggccacatcaaagagg

SEQ ID NO: 4023047 - DNA, 21 bp, Homo sapiens
ggccaccagccatcctccctc

SEQ ID NO: 4023048 - DNA, 23 bp, Homo sapiens
ggacagagttcacaggaggccag

SEQ ID NO: 4023049 - DNA, 18 bp, Homo sapiens
ggacagcagaagcctcca

SEQ ID NO: 4023050 - DNA, 17 bp, Homo sapiens
ggacagcattgccagta

SEQ ID NO: 4023051 - DNA, 14 bp, Homo sapiens
ggacagccccaccc

SEQ ID NO: 4023052 - DNA, 15 bp, Homo sapiens
ggacagccccaccct

SEQ ID NO: 4023053 - DNA, 17 bp, Homo sapiens
ggacagccccaccctgg

SEQ ID NO: 4023054 - DNA, 14 bp, Homo sapiens
ggacaggaagctgg

SEQ ID NO: 4023055 - DNA, 23 bp, Homo sapiens
ggacaggaagctggcagaacgga

SEQ ID NO: 4023056 - DNA, 16 bp, Homo sapiens
ggacaggaggaggaga

SEQ ID NO: 4023057 - DNA, 15 bp, Homo sapiens
ggacaggagtcagtg

SEQ ID NO: 4023058 - DNA, 20 bp, Homo sapiens
ggacaggatgacctggataa

SEQ ID NO: 4023059 - DNA, 13 bp, Homo sapiens
ggacaggctctgc

SEQ ID NO: 4023060 - DNA, 14 bp, Homo sapiens
ggacaggctctgct

SEQ ID NO: 4023061 - DNA, 15 bp, Homo sapiens
ggacaggctggctcc

SEQ ID NO: 4023062 - DNA, 16 bp, Homo sapiens
ggacagggaggccaca

SEQ ID NO: 4023063 - DNA, 20 bp, Homo sapiens
ggacagggaggccacacgca

SEQ ID NO: 4023064 - DNA, 20 bp, Homo sapiens
ggacagtttaccagttgcct

SEQ ID NO: 4023065 - DNA, 19 bp, Homo sapiens
ggacatactctctgcctgg

SEQ ID NO: 4023066 - DNA, 22 bp, Homo sapiens
ggacatactctctgcctggtgg

SEQ ID NO: 4023067 - DNA, 12 bp, Homo sapiens
ggacatcagcaa

SEQ ID NO: 4023068 - DNA, 14 bp, Homo sapiens
ggacatcctcttct

SEQ ID NO: 4023069 - DNA, 17 bp, Homo sapiens
ggacatgctcacctcta

SEQ ID NO: 4023070 - DNA, 16 bp, Homo sapiens
ggacattgccccaaga

SEQ ID NO: 4023071 - DNA, 20 bp, Homo sapiens
ggaccaaccctggggaagga

SEQ ID NO: 4023072 - DNA, 19 bp, Homo sapiens
ggaccaacctgctctgtcc

SEQ ID NO: 4023073 - DNA, 23 bp, Homo sapiens
ggaagacatttcttttcttttta

SEQ ID NO: 4023074 - DNA, 15 bp, Homo sapiens
ggaagacgcctgagc

SEQ ID NO: 4023075 - DNA, 21 bp, Homo sapiens
ggaagagaagagggcccagcc

SEQ ID NO: 4023076 - DNA, 20 bp, Homo sapiens
ggaagagcccagtctgttga

SEQ ID NO: 4023077 - DNA, 18 bp, Homo sapiens
ggaagagggggctggcca

SEQ ID NO: 4023078 - DNA, 17 bp, Homo sapiens
ggaagataggctctgca

SEQ ID NO: 4023079 - DNA, 18 bp, Homo sapiens
ggaagattttaaattcac

SEQ ID NO: 4023080 - DNA, 22 bp, Homo sapiens
ggaagcaccccatgccaaagct

SEQ ID NO: 4023081 - DNA, 22 bp, Homo sapiens
ggaagcagatacatatgagtgt

SEQ ID NO: 4023082 - DNA, 20 bp, Homo sapiens
ggaagcagtgccttccataa

SEQ ID NO: 4023083 - DNA, 21 bp, Homo sapiens
ggaagcagtgccttccataat

SEQ ID NO: 4023084 - DNA, 14 bp, Homo sapiens
ggaagccaaagagt

SEQ ID NO: 4023085 - DNA, 15 bp, Homo sapiens
ggaagccaaatttat

SEQ ID NO: 4023086 - DNA, 13 bp, Homo sapiens
ggaagccagagcc

SEQ ID NO: 4023087 - DNA, 23 bp, Homo sapiens
ggaagcccagcccctactgctgt

SEQ ID NO: 4023088 - DNA, 13 bp, Homo sapiens
ggaagcccccacc

SEQ ID NO: 4023089 - DNA, 20 bp, Homo sapiens
ggaagccgtgctcgccccag

SEQ ID NO: 4023090 - DNA, 20 bp, Homo sapiens
ggaagcgcgagggcctcaaa

SEQ ID NO: 4023091 - DNA, 21 bp, Homo sapiens
ggaagcggccctaagggagtg

SEQ ID NO: 4023092 - DNA, 16 bp, Homo sapiens
ggaagctaatttgcat

SEQ ID NO: 4023093 - DNA, 18 bp, Homo sapiens
ggaagctctgaagtcaca

SEQ ID NO: 4023094 - DNA, 15 bp, Homo sapiens
ggaagctggcctgag

SEQ ID NO: 4023095 - DNA, 14 bp, Homo sapiens
ggaggccaataaaa

SEQ ID NO: 4023096 - DNA, 16 bp, Homo sapiens
ggaggccaataaaaag

SEQ ID NO: 4023097 - DNA, 22 bp, Homo sapiens
ggaggccaataaaaagttcaga

SEQ ID NO: 4023098 - DNA, 22 bp, Homo sapiens
ggaggcccaggctgggaactca

SEQ ID NO: 4023099 - DNA, 14 bp, Homo sapiens
ggaggccccactga

SEQ ID NO: 4023100 - DNA, 18 bp, Homo sapiens
ggaggccccactgatgct

SEQ ID NO: 4023101 - DNA, 16 bp, Homo sapiens
ggaggccctcctgtgc

SEQ ID NO: 4023102 - DNA, 15 bp, Homo sapiens
ggaggcctcaggtgc

SEQ ID NO: 4023103 - DNA, 18 bp, Homo sapiens
ggaggccttccagctgct

SEQ ID NO: 4023104 - DNA, 20 bp, Homo sapiens
ggaggcggagagtacagtga

SEQ ID NO: 4023105 - DNA, 15 bp, Homo sapiens
ggaggctcaggtccc

SEQ ID NO: 4023106 - DNA, 14 bp, Homo sapiens
ggaggctgaggcag

SEQ ID NO: 4023107 - DNA, 19 bp, Homo sapiens
ggaggctgaggcaggagga

SEQ ID NO: 4023108 - DNA, 22 bp, Homo sapiens
ggaggctgcccccggccccctg

SEQ ID NO: 4023109 - DNA, 10 bp, Homo sapiens
ggaggctgcg

SEQ ID NO: 4023110 - DNA, 17 bp, Homo sapiens
ggaggctgcgtgccagt

SEQ ID NO: 4023111 - DNA, 12 bp, Homo sapiens
ggaggctgggca

SEQ ID NO: 4023112 - DNA, 17 bp, Homo sapiens
ggaggctgggcccctgg

SEQ ID NO: 4023113 - DNA, 19 bp, Homo sapiens
ggaggctgggcccctggga

SEQ ID NO: 4023114 - DNA, 15 bp, Homo sapiens
ggaggcttcctgcgt

SEQ ID NO: 4023115 - DNA, 16 bp, Homo sapiens
ggagggaagtgtgagc

SEQ ID NO: 4023116 - DNA, 15 bp, Homo sapiens
ggagggatgctgctc

SEQ ID NO: 4023117 - DNA, 16 bp, Homo sapiens
ggagggatggagaggc

SEQ ID NO: 4023118 - DNA, 22 bp, Homo sapiens
ggagggatggagaggcggcctc

SEQ ID NO: 4023119 - DNA, 21 bp, Homo sapiens
ggagggcaagggccatgctga

SEQ ID NO: 4023120 - DNA, 19 bp, Homo sapiens
ggagggcccctgcgtgggg

SEQ ID NO: 4023121 - DNA, 16 bp, Homo sapiens
ggagggccctacctga

SEQ ID NO: 4023122 - DNA, 17 bp, Homo sapiens
ggagggcggcacaggtc

SEQ ID NO: 4023123 - DNA, 17 bp, Homo sapiens
ggagggcttggcccagc

SEQ ID NO: 4023124 - DNA, 20 bp, Homo sapiens
ggaggggagcgtctgggaac

SEQ ID NO: 4023125 - DNA, 13 bp, Homo sapiens
ggaggggcctggc

SEQ ID NO: 4023126 - DNA, 21 bp, Homo sapiens
ggaggggcctggcagccgtgc

SEQ ID NO: 4023127 - DNA, 17 bp, Homo sapiens
ggaggggtgtggcagtg

SEQ ID NO: 4023128 - DNA, 13 bp, Homo sapiens
ggagggtaaataa

SEQ ID NO: 4023129 - DNA, 20 bp, Homo sapiens
ggagggttctaagtgggaga

SEQ ID NO: 4023130 - DNA, 19 bp, Homo sapiens
ggagggttggggaggggcg

SEQ ID NO: 4023131 - DNA, 15 bp, Homo sapiens
ggaggtcacagctgg

SEQ ID NO: 4023132 - DNA, 16 bp, Homo sapiens
ggaggtcacagctgga

SEQ ID NO: 4023133 - DNA, 19 bp, Homo sapiens
ggaggtcacagctggatct

SEQ ID NO: 4023134 - DNA, 21 bp, Homo sapiens
ggaggtcacagctggatctgc

SEQ ID NO: 4023135 - DNA, 19 bp, Homo sapiens
ggaggtcacattcaggaag

SEQ ID NO: 4023136 - DNA, 13 bp, Homo sapiens
ggaggtccaagca

SEQ ID NO: 4023137 - DNA, 15 bp, Homo sapiens
ggaggtgagagtggg

SEQ ID NO: 4023138 - DNA, 18 bp, Homo sapiens
ggaggtgagagtgggagg

SEQ ID NO: 4023139 - DNA, 21 bp, Homo sapiens
ggaggtgagatcacagcctcc

SEQ ID NO: 4023140 - DNA, 18 bp, Homo sapiens
ggaggtgaggggggctgg

SEQ ID NO: 4023141 - DNA, 20 bp, Homo sapiens
ggaggtggaagaagggagaa

SEQ ID NO: 4023142 - DNA, 20 bp, Homo sapiens
ggaggtggagattgcagtga

SEQ ID NO: 4023143 - DNA, 12 bp, Homo sapiens
ggaggtgggcat

SEQ ID NO: 4023144 - DNA, 17 bp, Homo sapiens
ggaggtgtgaggcagga

SEQ ID NO: 4023145 - DNA, 14 bp, Homo sapiens
ggaggttctcagag

SEQ ID NO: 4023146 - DNA, 19 bp, Homo sapiens
ggaggttctcagagccaag

SEQ ID NO: 4023147 - DNA, 14 bp, Homo sapiens
ggaggttgaagcca

SEQ ID NO: 4023148 - DNA, 16 bp, Homo sapiens
ggaggttgaagccaag

SEQ ID NO: 4023149 - DNA, 14 bp, Homo sapiens
ggaggttgcagtga

SEQ ID NO: 4023150 - DNA, 17 bp, Homo sapiens
ggaggttggagggaaag

SEQ ID NO: 4023151 - DNA, 22 bp, Homo sapiens
ggagtaacaatacaaatggatt

SEQ ID NO: 4023152 - DNA, 13 bp, Homo sapiens
ggagtacctgctg

SEQ ID NO: 4023153 - DNA, 16 bp, Homo sapiens
ggagtcagagccctgg

SEQ ID NO: 4023154 - DNA, 19 bp, Homo sapiens
ggagtcagagccctggctg

SEQ ID NO: 4023155 - DNA, 19 bp, Homo sapiens
ggagtccagggtttctctg

SEQ ID NO: 4023156 - DNA, 20 bp, Homo sapiens
ggagtccagggtttctctgc

SEQ ID NO: 4023157 - DNA, 17 bp, Homo sapiens
ggagtcccaaggaaagc

SEQ ID NO: 4023158 - DNA, 15 bp, Homo sapiens
ggagtctccctctga

SEQ ID NO: 4023159 - DNA, 13 bp, Homo sapiens
ggagtctctgcca

SEQ ID NO: 4023160 - DNA, 15 bp, Homo sapiens
ggagtctctgccacc

SEQ ID NO: 4023161 - DNA, 19 bp, Homo sapiens
ggagtctctgccacccact

SEQ ID NO: 4023162 - DNA, 23 bp, Homo sapiens
ggagtgagtcacctgctccagaa

SEQ ID NO: 4023163 - DNA, 15 bp, Homo sapiens
ggagtgcagggagga

SEQ ID NO: 4023164 - DNA, 23 bp, Homo sapiens
gctgcagatttgatatttgcatt

SEQ ID NO: 4023165 - DNA, 15 bp, Homo sapiens
gctgcagcctggctg

SEQ ID NO: 4023166 - DNA, 20 bp, Homo sapiens
gctgcagcctggctggtcct

SEQ ID NO: 4023167 - DNA, 21 bp, Homo sapiens
gctgcaggaatcaaaaattga

SEQ ID NO: 4023168 - DNA, 12 bp, Homo sapiens
gctgcaggagtg

SEQ ID NO: 4023169 - DNA, 15 bp, Homo sapiens
gctgcaggtgccagg

SEQ ID NO: 4023170 - DNA, 22 bp, Homo sapiens
gctgcaggtgccagggcccacc

SEQ ID NO: 4023171 - DNA, 15 bp, Homo sapiens
gctgcattagaaaaa

SEQ ID NO: 4023172 - DNA, 18 bp, Homo sapiens
gctgccaaggccagagtg

SEQ ID NO: 4023173 - DNA, 23 bp, Homo sapiens
gctgccaaggccagagtggcctg

SEQ ID NO: 4023174 - DNA, 15 bp, Homo sapiens
gctgccacacttcag

SEQ ID NO: 4023175 - DNA, 21 bp, Homo sapiens
gctgccacacttcaggctctt

SEQ ID NO: 4023176 - DNA, 22 bp, Homo sapiens
gctgccacacttcaggctcttc

SEQ ID NO: 4023177 - DNA, 15 bp, Homo sapiens
gctgccaccagcccc

SEQ ID NO: 4023178 - DNA, 15 bp, Homo sapiens
gctgccagcccagaa

SEQ ID NO: 4023179 - DNA, 19 bp, Homo sapiens
gctgccagcccagaacacc

SEQ ID NO: 4023180 - DNA, 23 bp, Homo sapiens
gctgccagccttgagccctggct

SEQ ID NO: 4023181 - DNA, 10 bp, Homo sapiens
gctgccagta

SEQ ID NO: 4023182 - DNA, 22 bp, Homo sapiens
gctgccagtggggcctgaggct

SEQ ID NO: 4023183 - DNA, 17 bp, Homo sapiens
gctgccataattctaag

SEQ ID NO: 4023184 - DNA, 21 bp, Homo sapiens
gctgccatgtgaagagggaga

SEQ ID NO: 4023185 - DNA, 13 bp, Homo sapiens
gctgcccaggaga

SEQ ID NO: 4023186 - DNA, 16 bp, Homo sapiens
gctgcccaggagacag

SEQ ID NO: 4023187 - DNA, 22 bp, Homo sapiens
gctgccccagctgactgtggcc

SEQ ID NO: 4023188 - DNA, 15 bp, Homo sapiens
gctgcccccaccccg

SEQ ID NO: 4023189 - DNA, 14 bp, Homo sapiens
gctgcccccggccc

SEQ ID NO: 4023190 - DNA, 15 bp, Homo sapiens
gctgccccggcccct

SEQ ID NO: 4023191 - DNA, 16 bp, Homo sapiens
gctgccccggcccctc

SEQ ID NO: 4023192 - DNA, 23 bp, Homo sapiens
gctgccccggcccctccccctga

SEQ ID NO: 4023193 - DNA, 22 bp, Homo sapiens
gctgcccctaatctctgtagga

SEQ ID NO: 4023194 - DNA, 14 bp, Homo sapiens
gctgcccctcacct

SEQ ID NO: 4023195 - DNA, 14 bp, Homo sapiens
gctgcccctctcac

SEQ ID NO: 4023196 - DNA, 13 bp, Homo sapiens
gctgccctagctg

SEQ ID NO: 4023197 - DNA, 14 bp, Homo sapiens
gctgccctagctga

SEQ ID NO: 4023198 - DNA, 16 bp, Homo sapiens
gctgccctagctgacc

SEQ ID NO: 4023199 - DNA, 20 bp, Homo sapiens
gctgccctagctgaccccga

SEQ ID NO: 4023200 - DNA, 17 bp, Homo sapiens
gctgccctatgggcctg

SEQ ID NO: 4023201 - DNA, 21 bp, Homo sapiens
gctgccctccttgtccaccca

SEQ ID NO: 4023202 - DNA, 18 bp, Homo sapiens
gctgccctgagaagctgc

SEQ ID NO: 4023203 - DNA, 15 bp, Homo sapiens
gctgccctggtgctg

SEQ ID NO: 4023204 - DNA, 20 bp, Homo sapiens
gctgccctggtgctgccaca

SEQ ID NO: 4023205 - DNA, 23 bp, Homo sapiens
gctgccctggtgctgccacactt

SEQ ID NO: 4023206 - DNA, 22 bp, Homo sapiens
gctgcctagcaagctggcctct

SEQ ID NO: 4023207 - DNA, 15 bp, Homo sapiens
gctgcctcctgccct

SEQ ID NO: 4023208 - DNA, 13 bp, Homo sapiens
gctgcctctttcc

SEQ ID NO: 4023209 - DNA, 21 bp, Homo sapiens
gctgcctgaaacagccatgtc

SEQ ID NO: 4023210 - DNA, 19 bp, Homo sapiens
gctgcctgacactgagccc

SEQ ID NO: 4023211 - DNA, 16 bp, Homo sapiens
gctgcctgctgagatg

SEQ ID NO: 4023212 - DNA, 16 bp, Homo sapiens
gctgcctgcttggccc

SEQ ID NO: 4023213 - DNA, 12 bp, Homo sapiens
gctgcctggaga

SEQ ID NO: 4023214 - DNA, 18 bp, Homo sapiens
gctgcctggagagggtct

SEQ ID NO: 4023215 - DNA, 19 bp, Homo sapiens
gctgcctggagagggtctc

SEQ ID NO: 4023216 - DNA, 15 bp, Homo sapiens
gctgccttagaacct

SEQ ID NO: 4023217 - DNA, 20 bp, Homo sapiens
gctgccttagaacctttctt

SEQ ID NO: 4023218 - DNA, 14 bp, Homo sapiens
gctgccttgcttct

SEQ ID NO: 4023219 - DNA, 23 bp, Homo sapiens
gctgccttggctcagacatgttt

SEQ ID NO: 4023220 - DNA, 15 bp, Homo sapiens
gctgcgcttgctttt

SEQ ID NO: 4023221 - DNA, 15 bp, Homo sapiens
gctgctaccgccctg

SEQ ID NO: 4023222 - DNA, 23 bp, Homo sapiens
gctgctacttaattcctttctca

SEQ ID NO: 4023223 - DNA, 22 bp, Homo sapiens
gctgctatccccatctccctgc

SEQ ID NO: 4023224 - DNA, 23 bp, Homo sapiens
gctgctatccccatctccctgcc

SEQ ID NO: 4023225 - DNA, 19 bp, Homo sapiens
gctgctccaggcctgcagc

SEQ ID NO: 4023226 - DNA, 12 bp, Homo sapiens
gctgctgcaccc

SEQ ID NO: 4023227 - DNA, 20 bp, Homo sapiens
gctgctggatcacagctgct

SEQ ID NO: 4023228 - DNA, 15 bp, Homo sapiens
gctgctggcttgcag

SEQ ID NO: 4023229 - DNA, 19 bp, Homo sapiens
gctgctggtaacagtggct

SEQ ID NO: 4023230 - DNA, 22 bp, Homo sapiens
gctgctgtgcgtggaaaaagac

SEQ ID NO: 4023231 - DNA, 13 bp, Homo sapiens
gctgctgttctca

SEQ ID NO: 4023232 - DNA, 15 bp, Homo sapiens
gctgctgttctcagg

SEQ ID NO: 4023233 - DNA, 19 bp, Homo sapiens
gctgctgttctcaggacag

SEQ ID NO: 4023234 - DNA, 20 bp, Homo sapiens
gctgcttagaatccaaactt

SEQ ID NO: 4023235 - DNA, 22 bp, Homo sapiens
gctgcttgcccaagtcacacag

SEQ ID NO: 4023236 - DNA, 14 bp, Homo sapiens
gctgcttgtcctgg

SEQ ID NO: 4023237 - DNA, 23 bp, Homo sapiens
gctggaagagggtgaaaggcagg

SEQ ID NO: 4023238 - DNA, 12 bp, Homo sapiens
gctggaagccca

SEQ ID NO: 4023239 - DNA, 14 bp, Homo sapiens
gctggaagcccagc

SEQ ID NO: 4023240 - DNA, 22 bp, Homo sapiens
gctggaagcccagcccctactg

SEQ ID NO: 4023241 - DNA, 16 bp, Homo sapiens
gctggactattgtgcc

SEQ ID NO: 4023242 - DNA, 12 bp, Homo sapiens
gctggactggag

SEQ ID NO: 4023243 - DNA, 20 bp, Homo sapiens
gctggactggaggcccctgg

SEQ ID NO: 4023244 - DNA, 16 bp, Homo sapiens
gctggactggaggtgg

SEQ ID NO: 4023245 - DNA, 21 bp, Homo sapiens
gctggacttctacctgccctc

SEQ ID NO: 4023246 - DNA, 23 bp, Homo sapiens
gctggacttctacctgccctcaa

SEQ ID NO: 4023247 - DNA, 16 bp, Homo sapiens
gctggagcccccagca

SEQ ID NO: 4023248 - DNA, 18 bp, Homo sapiens
gctggagcccccagcaga

SEQ ID NO: 4023249 - DNA, 13 bp, Homo sapiens
gctggaggcccag

SEQ ID NO: 4023250 - DNA, 14 bp, Homo sapiens
gctggaggcccagg

SEQ ID NO: 4023251 - DNA, 14 bp, Homo sapiens
gctggagtgcagtg

SEQ ID NO: 4023252 - DNA, 15 bp, Homo sapiens
gctggataaaatgag

SEQ ID NO: 4023253 - DNA, 18 bp, Homo sapiens
gctggatggacagtgggc

SEQ ID NO: 4023254 - DNA, 14 bp, Homo sapiens
gctggcaacacaga

SEQ ID NO: 4023255 - DNA, 15 bp, Homo sapiens
gctgtgagggagggg

SEQ ID NO: 4023256 - DNA, 23 bp, Homo sapiens
gctgtgagggaggggaaaagcat

SEQ ID NO: 4023257 - DNA, 22 bp, Homo sapiens
gctgtgagtgtaagtgtgagta

SEQ ID NO: 4023258 - DNA, 18 bp, Homo sapiens
gctgtgagttctccctgt

SEQ ID NO: 4023259 - DNA, 12 bp, Homo sapiens
gctgtggaccgt

SEQ ID NO: 4023260 - DNA, 20 bp, Homo sapiens
gctgtggaccgtggacaggc

SEQ ID NO: 4023261 - DNA, 22 bp, Homo sapiens
gctgtggaccgtggacaggccc

SEQ ID NO: 4023262 - DNA, 17 bp, Homo sapiens
gctgtggaggattgcta

SEQ ID NO: 4023263 - DNA, 23 bp, Homo sapiens
gctgtggaggattgctatctgga

SEQ ID NO: 4023264 - DNA, 14 bp, Homo sapiens
gctgtggccctgga

SEQ ID NO: 4023265 - DNA, 18 bp, Homo sapiens
gctgtgggcctcaaggac

SEQ ID NO: 4023266 - DNA, 19 bp, Homo sapiens
gctgtgggcctcaaggact

SEQ ID NO: 4023267 - DNA, 16 bp, Homo sapiens
gctgtgggtagatgtg

SEQ ID NO: 4023268 - DNA, 14 bp, Homo sapiens
gctgtgtcccagat

SEQ ID NO: 4023269 - DNA, 17 bp, Homo sapiens
gctgtgtgaaacatggt

SEQ ID NO: 4023270 - DNA, 16 bp, Homo sapiens
gctgtgtttaatttga

SEQ ID NO: 4023271 - DNA, 19 bp, Homo sapiens
gctgtgtttgcagcctgct

SEQ ID NO: 4023272 - DNA, 16 bp, Homo sapiens
gctgtgtttgctcccc

SEQ ID NO: 4023273 - DNA, 18 bp, Homo sapiens
gctgttaatagatcttag

SEQ ID NO: 4023274 - DNA, 21 bp, Homo sapiens
gctgttaccgcctgtctcttt

SEQ ID NO: 4023275 - DNA, 18 bp, Homo sapiens
gctgttactgttaaccat

SEQ ID NO: 4023276 - DNA, 18 bp, Homo sapiens
gctgttatttcttccctg

SEQ ID NO: 4023277 - DNA, 16 bp, Homo sapiens
gctgttccccctgccg

SEQ ID NO: 4023278 - DNA, 13 bp, Homo sapiens
gctgttcctgaga

SEQ ID NO: 4023279 - DNA, 13 bp, Homo sapiens
gctgttctcagga

SEQ ID NO: 4023280 - DNA, 16 bp, Homo sapiens
gctgttgagctgtttt

SEQ ID NO: 4023281 - DNA, 12 bp, Homo sapiens
gctgttgtacat

SEQ ID NO: 4023282 - DNA, 15 bp, Homo sapiens
gctgttgtacattta

SEQ ID NO: 4023283 - DNA, 14 bp, Homo sapiens
gctgttgtctcttc

SEQ ID NO: 4023284 - DNA, 15 bp, Homo sapiens
gctgtttagcagaac

SEQ ID NO: 4023285 - DNA, 14 bp, Homo sapiens
gctgtttatggcct

SEQ ID NO: 4023286 - DNA, 17 bp, Homo sapiens
gctgtttatggcctcag

SEQ ID NO: 4023287 - DNA, 23 bp, Homo sapiens
gctgtttatggcctcagctgcct

SEQ ID NO: 4023288 - DNA, 12 bp, Homo sapiens
gctgtttctcat

SEQ ID NO: 4023289 - DNA, 18 bp, Homo sapiens
gctgtttctcatgaagct

SEQ ID NO: 4023290 - DNA, 14 bp, Homo sapiens
gctgtttttgttgt

SEQ ID NO: 4023291 - DNA, 17 bp, Homo sapiens
gcttaaaataagcaggt

SEQ ID NO: 4023292 - DNA, 14 bp, Homo sapiens
gcttaaacaaagtg

SEQ ID NO: 4023293 - DNA, 16 bp, Homo sapiens
gcttaaactaaataat

SEQ ID NO: 4023294 - DNA, 14 bp, Homo sapiens
gcttaatgtttatt

SEQ ID NO: 4023295 - DNA, 23 bp, Homo sapiens
gcttaatgtttattcctgataat

SEQ ID NO: 4023296 - DNA, 14 bp, Homo sapiens
gcttaattcaaata

SEQ ID NO: 4023297 - DNA, 12 bp, Homo sapiens
gcttaatttcta

SEQ ID NO: 4023298 - DNA, 13 bp, Homo sapiens
gcttaatttctaa

SEQ ID NO: 4023299 - DNA, 15 bp, Homo sapiens
gcttacaaagcctta

SEQ ID NO: 4023300 - DNA, 17 bp, Homo sapiens
gcttacaaagccttaca

SEQ ID NO: 4023301 - DNA, 14 bp, Homo sapiens
gcttacatttttac

SEQ ID NO: 4023302 - DNA, 23 bp, Homo sapiens
gcttaccatctctaccatcatcc

SEQ ID NO: 4023303 - DNA, 23 bp, Homo sapiens
gcttactaagctttgccagctgc

SEQ ID NO: 4023304 - DNA, 11 bp, Homo sapiens
gcttactctgt

SEQ ID NO: 4023305 - DNA, 23 bp, Homo sapiens
gcttagagagaggaggcagcccc

SEQ ID NO: 4023306 - DNA, 18 bp, Homo sapiens
gcttagaggcatgggctt

SEQ ID NO: 4023307 - DNA, 12 bp, Homo sapiens
gcttaggagaga

SEQ ID NO: 4023308 - DNA, 13 bp, Homo sapiens
gcttataaacaca

SEQ ID NO: 4023309 - DNA, 12 bp, Homo sapiens
gcttatacactt

SEQ ID NO: 4023310 - DNA, 14 bp, Homo sapiens
gcttatatgtactt

SEQ ID NO: 4023311 - DNA, 17 bp, Homo sapiens
gcttatgaatatattta

SEQ ID NO: 4023312 - DNA, 22 bp, Homo sapiens
gcttattgttccaagacattgt

SEQ ID NO: 4023313 - DNA, 15 bp, Homo sapiens
gcttatttttctgtg

SEQ ID NO: 4023314 - DNA, 19 bp, Homo sapiens
gcttatttttctgtgaata

SEQ ID NO: 4023315 - DNA, 22 bp, Homo sapiens
gcttattttttaaaatatttga

SEQ ID NO: 4023316 - DNA, 16 bp, Homo sapiens
gcttcaaaatagagaa

SEQ ID NO: 4023317 - DNA, 15 bp, Homo sapiens
gcttcaagtgccttt

SEQ ID NO: 4023318 - DNA, 24 bp, Homo sapiens
gcttcaagtgccttttgctgcgca

SEQ ID NO: 4023319 - DNA, 14 bp, Homo sapiens
gcttcacaggacag

SEQ ID NO: 4023320 - DNA, 18 bp, Homo sapiens
gcttcacagtctggtgct

SEQ ID NO: 4023321 - DNA, 13 bp, Homo sapiens
gcttcagactcaa

SEQ ID NO: 4023322 - DNA, 19 bp, Homo sapiens
gcttcagcatatttatagc

SEQ ID NO: 4023323 - DNA, 13 bp, Homo sapiens
gcttcaggcacca

SEQ ID NO: 4023324 - DNA, 19 bp, Homo sapiens
gcttcaggttatcgaaata

SEQ ID NO: 4023325 - DNA, 22 bp, Homo sapiens
gcttcaggttatcgaaataaca

SEQ ID NO: 4023326 - DNA, 23 bp, Homo sapiens
gcttcagtacttgtgaaacacag

SEQ ID NO: 4023327 - DNA, 22 bp, Homo sapiens
gcttcataaatgaagcagcttt

SEQ ID NO: 4023328 - DNA, 11 bp, Homo sapiens
gcttcattgta

SEQ ID NO: 4023329 - DNA, 23 bp, Homo sapiens
gcttcattttatttttgacgtca

SEQ ID NO: 4023330 - DNA, 17 bp, Homo sapiens
gcttccaatcttgcttt

SEQ ID NO: 4023331 - DNA, 20 bp, Homo sapiens
gcttccagcttcaggcacca

SEQ ID NO: 4023332 - DNA, 21 bp, Homo sapiens
gcttccaggaaactccacatc

SEQ ID NO: 4023333 - DNA, 17 bp, Homo sapiens
gcttccatgagaacagc

SEQ ID NO: 4023334 - DNA, 19 bp, Homo sapiens
gcttccatgattctattta

SEQ ID NO: 4023335 - DNA, 15 bp, Homo sapiens
gcttcccagagggag

SEQ ID NO: 4023336 - DNA, 14 bp, Homo sapiens
gcttccccactccc

SEQ ID NO: 4023337 - DNA, 12 bp, Homo sapiens
gcttcccctcca

SEQ ID NO: 4023338 - DNA, 15 bp, Homo sapiens
gcttcccctccagga

SEQ ID NO: 4023339 - DNA, 16 bp, Homo sapiens
gcttcccctccaggag

SEQ ID NO: 4023340 - DNA, 12 bp, Homo sapiens
gcttcccctccc

SEQ ID NO: 4023341 - DNA, 15 bp, Homo sapiens
gctttggcagtgcca

SEQ ID NO: 4023342 - DNA, 16 bp, Homo sapiens
gctttggcagtgccat

SEQ ID NO: 4023343 - DNA, 14 bp, Homo sapiens
gctttggctgaggg

SEQ ID NO: 4023344 - DNA, 16 bp, Homo sapiens
gctttggctgaggggc

SEQ ID NO: 4023345 - DNA, 20 bp, Homo sapiens
gctttggctgaggggcttgg

SEQ ID NO: 4023346 - DNA, 22 bp, Homo sapiens
gctttgggaatgtttttagctg

SEQ ID NO: 4023347 - DNA, 22 bp, Homo sapiens
gctttgtgcttgtcattccaga

SEQ ID NO: 4023348 - DNA, 15 bp, Homo sapiens
gctttgtgttgtaat

SEQ ID NO: 4023349 - DNA, 20 bp, Homo sapiens
gctttgtgtttggtttacat

SEQ ID NO: 4023350 - DNA, 20 bp, Homo sapiens
gctttgtttggatgtaattt

SEQ ID NO: 4023351 - DNA, 14 bp, Homo sapiens
gctttgttttaata

SEQ ID NO: 4023352 - DNA, 15 bp, Homo sapiens
gcttttagtttttct

SEQ ID NO: 4023353 - DNA, 16 bp, Homo sapiens
gcttttatagaggcta

SEQ ID NO: 4023354 - DNA, 19 bp, Homo sapiens
gcttttatagaggctagct

SEQ ID NO: 4023355 - DNA, 16 bp, Homo sapiens
gcttttatatggccca

SEQ ID NO: 4023356 - DNA, 15 bp, Homo sapiens
gcttttattttgaaa

SEQ ID NO: 4023357 - DNA, 16 bp, Homo sapiens
gcttttattttgaaaa

SEQ ID NO: 4023358 - DNA, 13 bp, Homo sapiens
gcttttcactgct

SEQ ID NO: 4023359 - DNA, 23 bp, Homo sapiens
gcttttcactgctggctgcctta

SEQ ID NO: 4023360 - DNA, 16 bp, Homo sapiens
gcctggcctgcccgtg

SEQ ID NO: 4023361 - DNA, 22 bp, Homo sapiens
gcctggcctgcccgtgccctgg

SEQ ID NO: 4023362 - DNA, 19 bp, Homo sapiens
gcctggcgacagagcgaga

SEQ ID NO: 4023363 - DNA, 11 bp, Homo sapiens
gcctggctgga

SEQ ID NO: 4023364 - DNA, 17 bp, Homo sapiens
gcctggctggaggagca

SEQ ID NO: 4023365 - DNA, 23 bp, Homo sapiens
gcctggctggaggagcagcagct

SEQ ID NO: 4023366 - DNA, 17 bp, Homo sapiens
gcctgggagcccagagg

SEQ ID NO: 4023367 - DNA, 19 bp, Homo sapiens
gcctgggcagcatagcaag

SEQ ID NO: 4023368 - DNA, 20 bp, Homo sapiens
gcctgggcagccaggctgcc

SEQ ID NO: 4023369 - DNA, 16 bp, Homo sapiens
gcctgggcctctgccc

SEQ ID NO: 4023370 - DNA, 21 bp, Homo sapiens
gcctggggcaaacctagccgg

SEQ ID NO: 4023371 - DNA, 14 bp, Homo sapiens
gcctggggcctgag

SEQ ID NO: 4023372 - DNA, 17 bp, Homo sapiens
gctctgcaattcccctc

SEQ ID NO: 4023373 - DNA, 11 bp, Homo sapiens
gctctgcacag

SEQ ID NO: 4023374 - DNA, 13 bp, Homo sapiens
gctctgcactaag

SEQ ID NO: 4023375 - DNA, 19 bp, Homo sapiens
gctctgcactaagagaaaa

SEQ ID NO: 4023376 - DNA, 24 bp, Homo sapiens
gctctgcctcagacgttgcctgag

SEQ ID NO: 4023377 - DNA, 11 bp, Homo sapiens
gctctgctggt

SEQ ID NO: 4023378 - DNA, 24 bp, Homo sapiens
gctctggaataaagttgcagatga

SEQ ID NO: 4023379 - DNA, 20 bp, Homo sapiens
gcatcccttcccacatgcct

SEQ ID NO: 4023380 - DNA, 18 bp, Homo sapiens
gcatccgcaggtgctggt

SEQ ID NO: 4023381 - DNA, 18 bp, Homo sapiens
gcatcctccacaatagca

SEQ ID NO: 4023382 - DNA, 21 bp, Homo sapiens
gcatcgcaggagtctctgcca

SEQ ID NO: 4023383 - DNA, 15 bp, Homo sapiens
gcatctacacagcct

SEQ ID NO: 4023384 - DNA, 19 bp, Homo sapiens
gcatctacacagcctggac

SEQ ID NO: 4023385 - DNA, 23 bp, Homo sapiens
gcatctcctcccgcccttccatg

SEQ ID NO: 4023386 - DNA, 16 bp, Homo sapiens
gcatctcctgtgcatg

SEQ ID NO: 4023387 - DNA, 18 bp, Homo sapiens
gcatctcttccccagaga

SEQ ID NO: 4023388 - DNA, 19 bp, Homo sapiens
gcatctcttccccagagag

SEQ ID NO: 4023389 - DNA, 20 bp, Homo sapiens
gcatctcttccccagagagg

SEQ ID NO: 4023390 - DNA, 22 bp, Homo sapiens
gcatctcttccccagagaggca

SEQ ID NO: 4023391 - DNA, 15 bp, Homo sapiens
gcatctgagggggag

SEQ ID NO: 4023392 - DNA, 14 bp, Homo sapiens
gcatctgcccctcc

SEQ ID NO: 4023393 - DNA, 17 bp, Homo sapiens
gcatctgcccctccccc

SEQ ID NO: 4023394 - DNA, 18 bp, Homo sapiens
gcatctgcccctccccca

SEQ ID NO: 4023395 - DNA, 12 bp, Homo sapiens
gcatctggctgt

SEQ ID NO: 4023396 - DNA, 20 bp, Homo sapiens
gcatctggctgtctagaatg

SEQ ID NO: 4023397 - DNA, 20 bp, Homo sapiens
gcatctgggattcccaccaa

SEQ ID NO: 4023398 - DNA, 15 bp, Homo sapiens
gcatctgtgatggga

SEQ ID NO: 4023399 - DNA, 18 bp, Homo sapiens
gcatctgtgatgggagcg

SEQ ID NO: 4023400 - DNA, 15 bp, Homo sapiens
gcatcttgctggcta

SEQ ID NO: 4023401 - DNA, 13 bp, Homo sapiens
gcatctttgcctt

SEQ ID NO: 4023402 - DNA, 22 bp, Homo sapiens
gcatctttgccttgggctgctc

SEQ ID NO: 4023403 - DNA, 12 bp, Homo sapiens
gcatgaaatttt

SEQ ID NO: 4023404 - DNA, 14 bp, Homo sapiens
gcatgacagcctgc

SEQ ID NO: 4023405 - DNA, 15 bp, Homo sapiens
gcatgacagcctgca

SEQ ID NO: 4023406 - DNA, 18 bp, Homo sapiens
gcatgacagcctgcagca

SEQ ID NO: 4023407 - DNA, 21 bp, Homo sapiens
gcatgacatcctttcttttaa

SEQ ID NO: 4023408 - DNA, 16 bp, Homo sapiens
gcatgacctgtgacca

SEQ ID NO: 4023409 - DNA, 17 bp, Homo sapiens
gcatgacctgtgaccag

SEQ ID NO: 4023410 - DNA, 12 bp, Homo sapiens
gcatgagaaaga

SEQ ID NO: 4023411 - DNA, 15 bp, Homo sapiens
gcatgagactttctg

SEQ ID NO: 4023412 - DNA, 13 bp, Homo sapiens
gcatgcacatctg

SEQ ID NO: 4023413 - DNA, 13 bp, Homo sapiens
gcatgccaccctc

SEQ ID NO: 4023414 - DNA, 18 bp, Homo sapiens
gcatgccaccctcacaca

SEQ ID NO: 4023415 - DNA, 17 bp, Homo sapiens
gcatgccctctctgagt

SEQ ID NO: 4023416 - DNA, 23 bp, Homo sapiens
gcatgccgggcccctccatccac

SEQ ID NO: 4023417 - DNA, 13 bp, Homo sapiens
gcatgcttcccag

SEQ ID NO: 4023418 - DNA, 15 bp, Homo sapiens
gcatggagaataaac

SEQ ID NO: 4023419 - DNA, 18 bp, Homo sapiens
gcatggagtgtgtattgt

SEQ ID NO: 4023420 - DNA, 21 bp, Homo sapiens
gcatggcaagtcacatgcgta

SEQ ID NO: 4023421 - DNA, 13 bp, Homo sapiens
gcatggccaggtg

SEQ ID NO: 4023422 - DNA, 17 bp, Homo sapiens
gcatggccaggtggcca

SEQ ID NO: 4023423 - DNA, 13 bp, Homo sapiens
gcatgggcctggc

SEQ ID NO: 4023424 - DNA, 22 bp, Homo sapiens
gcatgggcctggccacctctct

SEQ ID NO: 4023425 - DNA, 22 bp, Homo sapiens
gcatggtcaaccctcaggggaa

SEQ ID NO: 4023426 - DNA, 18 bp, Homo sapiens
gcatggtcacacactgat

SEQ ID NO: 4023427 - DNA, 22 bp, Homo sapiens
gcatggtgagtgttggggttga

SEQ ID NO: 4023428 - DNA, 13 bp, Homo sapiens
gcatggtgcagtt

SEQ ID NO: 4023429 - DNA, 15 bp, Homo sapiens
gcatggtgccccagg

SEQ ID NO: 4023430 - DNA, 21 bp, Homo sapiens
gcatggtgccccaggaccagc

SEQ ID NO: 4023431 - DNA, 23 bp, Homo sapiens
gcatggtgccccaggaccagctc

SEQ ID NO: 4023432 - DNA, 17 bp, Homo sapiens
gcatggtggctcatgcc

SEQ ID NO: 4023433 - DNA, 17 bp, Homo sapiens
gcatgtaaaagcggaaa

SEQ ID NO: 4023434 - DNA, 14 bp, Homo sapiens
gcatgtaggaccct

SEQ ID NO: 4023435 - DNA, 22 bp, Homo sapiens
gcatgtcccatgtgagctgctg

SEQ ID NO: 4023436 - DNA, 17 bp, Homo sapiens
gcatgtctgcctggagt

SEQ ID NO: 4023437 - DNA, 18 bp, Homo sapiens
gcatgtctgcctggagtg

SEQ ID NO: 4023438 - DNA, 19 bp, Homo sapiens
gcccccaggggcaggactg

SEQ ID NO: 4023439 - DNA, 15 bp, Homo sapiens
gcccccagtccccac

SEQ ID NO: 4023440 - DNA, 20 bp, Homo sapiens
gcccccagtccccacccctg

SEQ ID NO: 4023441 - DNA, 21 bp, Homo sapiens
gcccccagtccccacccctgc

SEQ ID NO: 4023442 - DNA, 12 bp, Homo sapiens
gcccccagtggg

SEQ ID NO: 4023443 - DNA, 23 bp, Homo sapiens
gcccccagtgggaccacatgcca

SEQ ID NO: 4023444 - DNA, 16 bp, Homo sapiens
gcccccatgggctcct

SEQ ID NO: 4023445 - DNA, 22 bp, Homo sapiens
gcccccatgggctcctgcccct

SEQ ID NO: 4023446 - DNA, 21 bp, Homo sapiens
gccccccacccctggaagagc

SEQ ID NO: 4023447 - DNA, 12 bp, Homo sapiens
gccccccagcac

SEQ ID NO: 4023448 - DNA, 16 bp, Homo sapiens
gccccccagcctctgg

SEQ ID NO: 4023449 - DNA, 15 bp, Homo sapiens
gccccccgccctcat

SEQ ID NO: 4023450 - DNA, 18 bp, Homo sapiens
gccccccgcgctcgccca

SEQ ID NO: 4023451 - DNA, 14 bp, Homo sapiens
gcccccgccccaga

SEQ ID NO: 4023452 - DNA, 14 bp, Homo sapiens
gccccctcacctct

SEQ ID NO: 4023453 - DNA, 23 bp, Homo sapiens
gccccctcacctctccaggtgct

SEQ ID NO: 4023454 - DNA, 15 bp, Homo sapiens
gccccctccacacca

SEQ ID NO: 4023455 - DNA, 20 bp, Homo sapiens
gccccctcctctagctgtgg

SEQ ID NO: 4023456 - DNA, 13 bp, Homo sapiens
gccccctgctggc

SEQ ID NO: 4023457 - DNA, 14 bp, Homo sapiens
gccccctggcctct

SEQ ID NO: 4023458 - DNA, 14 bp, Homo sapiens
gccccgccagggct

SEQ ID NO: 4023459 - DNA, 16 bp, Homo sapiens
gccccgccagggctgg

SEQ ID NO: 4023460 - DNA, 17 bp, Homo sapiens
gccccgccagggctggg

SEQ ID NO: 4023461 - DNA, 20 bp, Homo sapiens
gccccgccagggctggggac

SEQ ID NO: 4023462 - DNA, 22 bp, Homo sapiens
gccccgcgcaccccacgccctg

SEQ ID NO: 4023463 - DNA, 18 bp, Homo sapiens
gccccggaggaagcttgg

SEQ ID NO: 4023464 - DNA, 17 bp, Homo sapiens
gccccggccctgggctc

SEQ ID NO: 4023465 - DNA, 14 bp, Homo sapiens
gccccggcctcctc

SEQ ID NO: 4023466 - DNA, 16 bp, Homo sapiens
gccccgggttcagcct

SEQ ID NO: 4023467 - DNA, 18 bp, Homo sapiens
gccccgggttcagcctgg

SEQ ID NO: 4023468 - DNA, 20 bp, Homo sapiens
gccccgggttcagcctggcc

SEQ ID NO: 4023469 - DNA, 23 bp, Homo sapiens
gccccgggttcagcctggcctgc

SEQ ID NO: 4023470 - DNA, 18 bp, Homo sapiens
gccccggtcacctagcaa

SEQ ID NO: 4023471 - DNA, 18 bp, Homo sapiens
gccccgtctacagctccc

SEQ ID NO: 4023472 - DNA, 13 bp, Homo sapiens
gccccgtgaggca

SEQ ID NO: 4023473 - DNA, 15 bp, Homo sapiens
gccccgttctgtttg

SEQ ID NO: 4023474 - DNA, 13 bp, Homo sapiens
gcccctactgctg

SEQ ID NO: 4023475 - DNA, 14 bp, Homo sapiens
gcccctactgctgt

SEQ ID NO: 4023476 - DNA, 18 bp, Homo sapiens
gcccctcaccctgcctta

SEQ ID NO: 4023477 - DNA, 16 bp, Homo sapiens
gcccctcaccttgggc

SEQ ID NO: 4023478 - DNA, 23 bp, Homo sapiens
gcccctcaccttgggctggggga

SEQ ID NO: 4023479 - DNA, 12 bp, Homo sapiens
gcccctcagagc

SEQ ID NO: 4023480 - DNA, 13 bp, Homo sapiens
gcccctcagagcc

SEQ ID NO: 4023481 - DNA, 23 bp, Homo sapiens
gcccctcagagccctgccctgca

SEQ ID NO: 4023482 - DNA, 19 bp, Homo sapiens
gcccctccaaacctccagc

SEQ ID NO: 4023483 - DNA, 16 bp, Homo sapiens
gcccctccacgcctcc

SEQ ID NO: 4023484 - DNA, 12 bp, Homo sapiens
gcccctccccca

SEQ ID NO: 4023485 - DNA, 21 bp, Homo sapiens
gcccctcccccaacccccacc

SEQ ID NO: 4023486 - DNA, 23 bp, Homo sapiens
gcccctcccccaacccccacccc

SEQ ID NO: 4023487 - DNA, 16 bp, Homo sapiens
gcccctcccccatctc

SEQ ID NO: 4023488 - DNA, 13 bp, Homo sapiens
gcccctcccgccc

SEQ ID NO: 4023489 - DNA, 15 bp, Homo sapiens
gcccctccctcctct

SEQ ID NO: 4023490 - DNA, 17 bp, Homo sapiens
gcccctccctcctctga

SEQ ID NO: 4023491 - DNA, 15 bp, Homo sapiens
gcccctcccttcaac

SEQ ID NO: 4023492 - DNA, 20 bp, Homo sapiens
gcccctcctccagcccctgt

SEQ ID NO: 4023493 - DNA, 14 bp, Homo sapiens
gcccctctcaccaa

SEQ ID NO: 4023494 - DNA, 20 bp, Homo sapiens
gcccctctccccgcagtgtt

SEQ ID NO: 4023495 - DNA, 13 bp, Homo sapiens
gcccctgcagttg

SEQ ID NO: 4023496 - DNA, 14 bp, Homo sapiens
gcccctgcatcccc

SEQ ID NO: 4023497 - DNA, 12 bp, Homo sapiens
gcccctgctgtc

SEQ ID NO: 4023498 - DNA, 20 bp, Homo sapiens
gcccctgctgtcttccccac

SEQ ID NO: 4023499 - DNA, 12 bp, Homo sapiens
gcccctggccca

SEQ ID NO: 4023500 - DNA, 17 bp, Homo sapiens
gcccctggcccatctca

SEQ ID NO: 4023501 - DNA, 12 bp, Homo sapiens
gcccctggctgg

SEQ ID NO: 4023502 - DNA, 16 bp, Homo sapiens
gcccctggctgggacg

SEQ ID NO: 4023503 - DNA, 23 bp, Homo sapiens
gcccctggctgggacgtggctca

SEQ ID NO: 4023504 - DNA, 11 bp, Homo sapiens
gcccctggctt

SEQ ID NO: 4023505 - DNA, 13 bp, Homo sapiens
gcccctggctttg

SEQ ID NO: 4023506 - DNA, 20 bp, Homo sapiens
gcccctggctttgcctcttc

SEQ ID NO: 4023507 - DNA, 22 bp, Homo sapiens
gcccctgggatgggaccaggga

SEQ ID NO: 4023508 - DNA, 11 bp, Homo sapiens
gcccctgggct

SEQ ID NO: 4023509 - DNA, 18 bp, Homo sapiens
gccaggaccctgacctcc

SEQ ID NO: 4023510 - DNA, 23 bp, Homo sapiens
gccaggaccctgacctccgcccc

SEQ ID NO: 4023511 - DNA, 17 bp, Homo sapiens
gccaggacgaattgaga

SEQ ID NO: 4023512 - DNA, 15 bp, Homo sapiens
gccaggactccccag

SEQ ID NO: 4023513 - DNA, 13 bp, Homo sapiens
gccaggagcagat

SEQ ID NO: 4023514 - DNA, 22 bp, Homo sapiens
gccaggagctcttcaggcctcc

SEQ ID NO: 4023515 - DNA, 23 bp, Homo sapiens
gccaggagctgtcaccaaggaaa

SEQ ID NO: 4023516 - DNA, 20 bp, Homo sapiens
gccaggatggaacacggcca

SEQ ID NO: 4023517 - DNA, 17 bp, Homo sapiens
gccaggcacacacagcc

SEQ ID NO: 4023518 - DNA, 20 bp, Homo sapiens
gccaggcaccccctggagag

SEQ ID NO: 4023519 - DNA, 13 bp, Homo sapiens
gccaggcactgcc

SEQ ID NO: 4023520 - DNA, 14 bp, Homo sapiens
gccaggcagatctg

SEQ ID NO: 4023521 - DNA, 15 bp, Homo sapiens
gccaggcagatctgt

SEQ ID NO: 4023522 - DNA, 17 bp, Homo sapiens
gccaggcaggggtgggg

SEQ ID NO: 4023523 - DNA, 22 bp, Homo sapiens
gccaggccaacagcacctcccc

SEQ ID NO: 4023524 - DNA, 12 bp, Homo sapiens
gccaggccagcc

SEQ ID NO: 4023525 - DNA, 16 bp, Homo sapiens
gccaggcccaggcctc

SEQ ID NO: 4023526 - DNA, 13 bp, Homo sapiens
gccaggccgggcc

SEQ ID NO: 4023527 - DNA, 18 bp, Homo sapiens
gccaggctgaccacagca

SEQ ID NO: 4023528 - DNA, 20 bp, Homo sapiens
gccaggctgaccacagcaca

SEQ ID NO: 4023529 - DNA, 18 bp, Homo sapiens
gccaggctgagtgagcca

SEQ ID NO: 4023530 - DNA, 21 bp, Homo sapiens
gccaggctgagtgagccacag

SEQ ID NO: 4023531 - DNA, 15 bp, Homo sapiens
gccaggctgcctcct

SEQ ID NO: 4023532 - DNA, 16 bp, Homo sapiens
gccaggctgcctcctg

SEQ ID NO: 4023533 - DNA, 14 bp, Homo sapiens
gccaggctgctaac

SEQ ID NO: 4023534 - DNA, 15 bp, Homo sapiens
gccagggagaagctc

SEQ ID NO: 4023535 - DNA, 14 bp, Homo sapiens
gccagggcatgtgt

SEQ ID NO: 4023536 - DNA, 15 bp, Homo sapiens
gccagggccacgctc

SEQ ID NO: 4023537 - DNA, 20 bp, Homo sapiens
gccagggccacgctccagct

SEQ ID NO: 4023538 - DNA, 13 bp, Homo sapiens
gccagggccaggg

SEQ ID NO: 4023539 - DNA, 13 bp, Homo sapiens
gccagggcccacc

SEQ ID NO: 4023540 - DNA, 16 bp, Homo sapiens
gccagggcccacccca

SEQ ID NO: 4023541 - DNA, 20 bp, Homo sapiens
gccagggcccaccccagcct

SEQ ID NO: 4023542 - DNA, 23 bp, Homo sapiens
gccagggcccaccccagcctcgc

SEQ ID NO: 4023543 - DNA, 11 bp, Homo sapiens
gccagggctgc

SEQ ID NO: 4023544 - DNA, 12 bp, Homo sapiens
gccagggctggg

SEQ ID NO: 4023545 - DNA, 19 bp, Homo sapiens
gccaggggggtgaggagct

SEQ ID NO: 4023546 - DNA, 21 bp, Homo sapiens
gccaggggggtgaggagctgg

SEQ ID NO: 4023547 - DNA, 17 bp, Homo sapiens
gccagggtctctccctc

SEQ ID NO: 4023548 - DNA, 20 bp, Homo sapiens
gccagggtctgtgtgaatgt

SEQ ID NO: 4023549 - DNA, 23 bp, Homo sapiens
gccagggtgagagctgctctgga

SEQ ID NO: 4023550 - DNA, 18 bp, Homo sapiens
gccagggtgggtgtccat

SEQ ID NO: 4023551 - DNA, 20 bp, Homo sapiens
gccagggtgggtgtccatgt

SEQ ID NO: 4023552 - DNA, 20 bp, Homo sapiens
gccaggtggttgtcttattg

SEQ ID NO: 4023553 - DNA, 23 bp, Homo sapiens
gccagtaaaatactattgcctca

SEQ ID NO: 4023554 - DNA, 21 bp, Homo sapiens
gccagtaacgcgtcttcctga

SEQ ID NO: 4023555 - DNA, 16 bp, Homo sapiens
gccagtccccatttct

SEQ ID NO: 4023556 - DNA, 17 bp, Homo sapiens
gcccagccaggccaaca

SEQ ID NO: 4023557 - DNA, 13 bp, Homo sapiens
gcccagcccagag

SEQ ID NO: 4023558 - DNA, 14 bp, Homo sapiens
gcccagcccagagc

SEQ ID NO: 4023559 - DNA, 16 bp, Homo sapiens
gcccagcccagagcca

SEQ ID NO: 4023560 - DNA, 17 bp, Homo sapiens
gcccagcccagagccac

SEQ ID NO: 4023561 - DNA, 18 bp, Homo sapiens
gcccagcccagagccacc

SEQ ID NO: 4023562 - DNA, 11 bp, Homo sapiens
gcccagcccca

SEQ ID NO: 4023563 - DNA, 18 bp, Homo sapiens
gcccagcccctactgctg

SEQ ID NO: 4023564 - DNA, 16 bp, Homo sapiens
gcccagccctccccat

SEQ ID NO: 4023565 - DNA, 22 bp, Homo sapiens
gcccagcctgggagcccagagg

SEQ ID NO: 4023566 - DNA, 15 bp, Homo sapiens
gcccagcgccaagta

SEQ ID NO: 4023567 - DNA, 13 bp, Homo sapiens
gcccagcgggcag

SEQ ID NO: 4023568 - DNA, 23 bp, Homo sapiens
gcccaggaactcgcacctgtgct

SEQ ID NO: 4023569 - DNA, 18 bp, Homo sapiens
gcccaggagacagaccac

SEQ ID NO: 4023570 - DNA, 23 bp, Homo sapiens
gcccaggccggggtggagcatgg

SEQ ID NO: 4023571 - DNA, 17 bp, Homo sapiens
gcccaggcctcaccacc

SEQ ID NO: 4023572 - DNA, 15 bp, Homo sapiens
gcccaggcctgggtt

SEQ ID NO: 4023573 - DNA, 20 bp, Homo sapiens
gcccaggctggagtgcagtg

SEQ ID NO: 4023574 - DNA, 22 bp, Homo sapiens
gcccagggagggaagtgtgagc

SEQ ID NO: 4023575 - DNA, 18 bp, Homo sapiens
gcccagggcatcttgctg

SEQ ID NO: 4023576 - DNA, 16 bp, Homo sapiens
gcccagggcccagagc

SEQ ID NO: 4023577 - DNA, 21 bp, Homo sapiens
gcccagggcccagagcccagc

SEQ ID NO: 4023578 - DNA, 23 bp, Homo sapiens
gcccagggcccagagcccagctc

SEQ ID NO: 4023579 - DNA, 23 bp, Homo sapiens
gcccaggggctgtggccgtctcc

SEQ ID NO: 4023580 - DNA, 17 bp, Homo sapiens
gcccagtgaagcctctg

SEQ ID NO: 4023581 - DNA, 17 bp, Homo sapiens
gcccagtgttgtttgta

SEQ ID NO: 4023582 - DNA, 19 bp, Homo sapiens
gcccagttcaccctgattt

SEQ ID NO: 4023583 - DNA, 21 bp, Homo sapiens
gcccatactcagcctgctgcc

SEQ ID NO: 4023584 - DNA, 13 bp, Homo sapiens
gcccatccttccc

SEQ ID NO: 4023585 - DNA, 14 bp, Homo sapiens
gcccatctcaggac

SEQ ID NO: 4023586 - DNA, 13 bp, Homo sapiens
gcccatgcccacc

SEQ ID NO: 4023587 - DNA, 21 bp, Homo sapiens
gcccatggacaggctggctcc

SEQ ID NO: 4023588 - DNA, 18 bp, Homo sapiens
gcccatgggatatgtggt

SEQ ID NO: 4023589 - DNA, 16 bp, Homo sapiens
gcccatgtgtcccctc

SEQ ID NO: 4023590 - DNA, 17 bp, Homo sapiens
gcccatgtgttccctct

SEQ ID NO: 4023591 - DNA, 17 bp, Homo sapiens
gccccaaacaaatatgc

SEQ ID NO: 4023592 - DNA, 18 bp, Homo sapiens
gccccaaacaaatatgca

SEQ ID NO: 4023593 - DNA, 19 bp, Homo sapiens
gccccaagataggggcaca

SEQ ID NO: 4023594 - DNA, 18 bp, Homo sapiens
gccccaatccctttatta

SEQ ID NO: 4023595 - DNA, 19 bp, Homo sapiens
gccccaatccctttattac

SEQ ID NO: 4023596 - DNA, 9 bp, Homo sapiens
gccccacac

SEQ ID NO: 4023597 - DNA, 16 bp, Homo sapiens
gccccacacagctaca

SEQ ID NO: 4023598 - DNA, 14 bp, Homo sapiens
gccccacacggact

SEQ ID NO: 4023599 - DNA, 16 bp, Homo sapiens
gccccacactccccgc

SEQ ID NO: 4023600 - DNA, 10 bp, Homo sapiens
gccccacagc

SEQ ID NO: 4023601 - DNA, 11 bp, Homo sapiens
gccccacagct

SEQ ID NO: 4023602 - DNA, 15 bp, Homo sapiens
gccccacagctacct

SEQ ID NO: 4023603 - DNA, 19 bp, Homo sapiens
gccccacagctacctgaga

SEQ ID NO: 4023604 - DNA, 21 bp, Homo sapiens
gccccacagctacctgagacg

SEQ ID NO: 4023605 - DNA, 21 bp, Homo sapiens
gccccaccagccacagcctcc

SEQ ID NO: 4023606 - DNA, 18 bp, Homo sapiens
gccccacccaagcccaaa

SEQ ID NO: 4023607 - DNA, 20 bp, Homo sapiens
gccccacccaagcccaaact

SEQ ID NO: 4023608 - DNA, 14 bp, Homo sapiens
gccccaccccacct

SEQ ID NO: 4023609 - DNA, 17 bp, Homo sapiens
gccccaccccacctcca

SEQ ID NO: 4023610 - DNA, 23 bp, Homo sapiens
gccccaccccacctccactccca

SEQ ID NO: 4023611 - DNA, 17 bp, Homo sapiens
gccccacctgcagctcc

SEQ ID NO: 4023612 - DNA, 18 bp, Homo sapiens
gccccacctgcagctccc

SEQ ID NO: 4023613 - DNA, 18 bp, Homo sapiens
gccccactgatgctgttc

SEQ ID NO: 4023614 - DNA, 13 bp, Homo sapiens
gccccagaagaaa

SEQ ID NO: 4023615 - DNA, 21 bp, Homo sapiens
gcactgtgaagacccagcagg

SEQ ID NO: 4023616 - DNA, 18 bp, Homo sapiens
gcactgtgaaggaccctt

SEQ ID NO: 4023617 - DNA, 22 bp, Homo sapiens
gcacttaagcacaagcagagtg

SEQ ID NO: 4023618 - DNA, 16 bp, Homo sapiens
gcacttactggtcctt

SEQ ID NO: 4023619 - DNA, 21 bp, Homo sapiens
gcacttactggtccttaccag

SEQ ID NO: 4023620 - DNA, 16 bp, Homo sapiens
gcactttaatggcctg

SEQ ID NO: 4023621 - DNA, 16 bp, Homo sapiens
gcactttctaatgttt

SEQ ID NO: 4023622 - DNA, 22 bp, Homo sapiens
gcactttctacaatgtgaactt

SEQ ID NO: 4023623 - DNA, 17 bp, Homo sapiens
gcacttttgttattcca

SEQ ID NO: 4023624 - DNA, 18 bp, Homo sapiens
gcagaaaataaaggaagc

SEQ ID NO: 4023625 - DNA, 21 bp, Homo sapiens
gcagaaaggaaaacctgaaga

SEQ ID NO: 4023626 - DNA, 18 bp, Homo sapiens
gcagaaaggttctgcccg

SEQ ID NO: 4023627 - DNA, 24 bp, Homo sapiens
gcagaacggagccccaggcctctg

SEQ ID NO: 4023628 - DNA, 15 bp, Homo sapiens
gcagaagacaccaga

SEQ ID NO: 4023629 - DNA, 20 bp, Homo sapiens
gcagaagacaccagagcaga

SEQ ID NO: 4023630 - DNA, 12 bp, Homo sapiens
gcagaagagggt

SEQ ID NO: 4023631 - DNA, 16 bp, Homo sapiens
gcagaagcagggtacc

SEQ ID NO: 4023632 - DNA, 18 bp, Homo sapiens
gcagaagcagggtaccct

SEQ ID NO: 4023633 - DNA, 13 bp, Homo sapiens
gcagaagggagaa

SEQ ID NO: 4023634 - DNA, 18 bp, Homo sapiens
gcagaagggagctggctc

SEQ ID NO: 4023635 - DNA, 20 bp, Homo sapiens
gcagaagggagctggctcca

SEQ ID NO: 4023636 - DNA, 18 bp, Homo sapiens
gcagaataatctttgggt

SEQ ID NO: 4023637 - DNA, 17 bp, Homo sapiens
gcagaataatggaaaca

SEQ ID NO: 4023638 - DNA, 11 bp, Homo sapiens
gcagaatttta

SEQ ID NO: 4023639 - DNA, 12 bp, Homo sapiens
gcagaattttaa

SEQ ID NO: 4023640 - DNA, 13 bp, Homo sapiens
gcagacaaacaga

SEQ ID NO: 4023641 - DNA, 12 bp, Homo sapiens
gcagacacacat

SEQ ID NO: 4023642 - DNA, 20 bp, Homo sapiens
gcagacacacatgggcagcc

SEQ ID NO: 4023643 - DNA, 21 bp, Homo sapiens
gcagacacacatgggcagccc

SEQ ID NO: 4023644 - DNA, 17 bp, Homo sapiens
gcagacagaaactggat

SEQ ID NO: 4023645 - DNA, 13 bp, Homo sapiens
gcagacagacaat

SEQ ID NO: 4023646 - DNA, 19 bp, Homo sapiens
gcagacagcaggcagcgcc

SEQ ID NO: 4023647 - DNA, 21 bp, Homo sapiens
gcagaccaccccgcctgccct

SEQ ID NO: 4023648 - DNA, 18 bp, Homo sapiens
gcagacgggcacagacac

SEQ ID NO: 4023649 - DNA, 16 bp, Homo sapiens
gcagactacacaggat

SEQ ID NO: 4023650 - DNA, 12 bp, Homo sapiens
gcagactgtgaa

SEQ ID NO: 4023651 - DNA, 20 bp, Homo sapiens
gcagagaaacttaagcaaag

SEQ ID NO: 4023652 - DNA, 21 bp, Homo sapiens
gcagagaaacttaagcaaagg

SEQ ID NO: 4023653 - DNA, 23 bp, Homo sapiens
gcagagaaagaagagacaggagg

SEQ ID NO: 4023654 - DNA, 21 bp, Homo sapiens
gcagagaattctcttatccaa

SEQ ID NO: 4023655 - DNA, 13 bp, Homo sapiens
gcagagacactaa

SEQ ID NO: 4023656 - DNA, 22 bp, Homo sapiens
gcagagagagaggacagagggg

SEQ ID NO: 4023657 - DNA, 15 bp, Homo sapiens
gcagagagatcttcc

SEQ ID NO: 4023658 - DNA, 15 bp, Homo sapiens
gcagagagccatttt

SEQ ID NO: 4023659 - DNA, 19 bp, Homo sapiens
gcagagagccattttgtga

SEQ ID NO: 4023660 - DNA, 21 bp, Homo sapiens
gcagagagccattttgtgaat

SEQ ID NO: 4023661 - DNA, 19 bp, Homo sapiens
gcagagaggtggagaactg

SEQ ID NO: 4023662 - DNA, 22 bp, Homo sapiens
gcagagcacctttgcacaggat

SEQ ID NO: 4023663 - DNA, 13 bp, Homo sapiens
gcagagcaggaag

SEQ ID NO: 4023664 - DNA, 15 bp, Homo sapiens
gcagagcaggaagga

SEQ ID NO: 4023665 - DNA, 17 bp, Homo sapiens
gcagagcccccaggaag

SEQ ID NO: 4023666 - DNA, 13 bp, Homo sapiens
gcagagccctgct

SEQ ID NO: 4023667 - DNA, 16 bp, Homo sapiens
gcagagccttctcaga

SEQ ID NO: 4023668 - DNA, 23 bp, Homo sapiens
gcagagccttctcagaagcacag

SEQ ID NO: 4023669 - DNA, 20 bp, Homo sapiens
gcagaggaggtgagagtggg

SEQ ID NO: 4023670 - DNA, 14 bp, Homo sapiens
gcagaggcaggctg

SEQ ID NO: 4023671 - DNA, 16 bp, Homo sapiens
gcagagggagaatcca

SEQ ID NO: 4023672 - DNA, 21 bp, Homo sapiens
gcagagggagaatccaagggt

SEQ ID NO: 4023673 - DNA, 19 bp, Homo sapiens
gcagaggggtaggcagagc

SEQ ID NO: 4023674 - DNA, 20 bp, Homo sapiens
gcagaggtaaaagtgtgagc

SEQ ID NO: 4023675 - DNA, 14 bp, Homo sapiens
gcagaggtggccag

SEQ ID NO: 4023676 - DNA, 19 bp, Homo sapiens
gcagagtaaattgctctgt

SEQ ID NO: 4023677 - DNA, 15 bp, Homo sapiens
gcagagtgcacagct

SEQ ID NO: 4023678 - DNA, 17 bp, Homo sapiens
gcagagtgcacagctgt

SEQ ID NO: 4023679 - DNA, 18 bp, Homo sapiens
gcagagtgcacagctgtc

SEQ ID NO: 4023680 - DNA, 13 bp, Homo sapiens
gcagagtttgcct

SEQ ID NO: 4023681 - DNA, 14 bp, Homo sapiens
gcaggaccaggact

SEQ ID NO: 4023682 - DNA, 20 bp, Homo sapiens
gcaggacctactaggagagg

SEQ ID NO: 4023683 - DNA, 14 bp, Homo sapiens
gcaggacctggcat

SEQ ID NO: 4023684 - DNA, 20 bp, Homo sapiens
gcaggacctggcatcatggt

SEQ ID NO: 4023685 - DNA, 17 bp, Homo sapiens
gcaggactccaggccca

SEQ ID NO: 4023686 - DNA, 22 bp, Homo sapiens
gcaggactccaggcccaaggct

SEQ ID NO: 4023687 - DNA, 19 bp, Homo sapiens
gcaggactttgaggcaagt

SEQ ID NO: 4023688 - DNA, 10 bp, Homo sapiens
gcaggagaga

SEQ ID NO: 4023689 - DNA, 22 bp, Homo sapiens
gcaggagagactgagcagccgc

SEQ ID NO: 4023690 - DNA, 12 bp, Homo sapiens
gcaggaggccaa

SEQ ID NO: 4023691 - DNA, 15 bp, Homo sapiens
gcaggaggccaataa

SEQ ID NO: 4023692 - DNA, 17 bp, Homo sapiens
gcaggaggccaataaaa

SEQ ID NO: 4023693 - DNA, 22 bp, Homo sapiens
gcaggaggccaataaaaagttc

SEQ ID NO: 4023694 - DNA, 18 bp, Homo sapiens
gcaggagggtgaggaggt

SEQ ID NO: 4023695 - DNA, 23 bp, Homo sapiens
gcaggagtctctgccacccactc

SEQ ID NO: 4023696 - DNA, 15 bp, Homo sapiens
gcaggagtggtgcag

SEQ ID NO: 4023697 - DNA, 20 bp, Homo sapiens
gcaggcaaaaaagggacagc

SEQ ID NO: 4023698 - DNA, 23 bp, Homo sapiens
gcaggcaccgccacgtcccagca

SEQ ID NO: 4023699 - DNA, 13 bp, Homo sapiens
gcaggcagagctg

SEQ ID NO: 4023700 - DNA, 9 bp, Homo sapiens
gcaggcagc

SEQ ID NO: 4023701 - DNA, 12 bp, Homo sapiens
gcaggcaggctg

SEQ ID NO: 4023702 - DNA, 15 bp, Homo sapiens
gcaggcattgaggaa

SEQ ID NO: 4023703 - DNA, 19 bp, Homo sapiens
gcaggccctttgaagcctc

SEQ ID NO: 4023704 - DNA, 14 bp, Homo sapiens
gcaggccggaacca

SEQ ID NO: 4023705 - DNA, 19 bp, Homo sapiens
gcaggccggaaccacaggg

SEQ ID NO: 4023706 - DNA, 20 bp, Homo sapiens
gcaggccggaaccacagggc

SEQ ID NO: 4023707 - DNA, 15 bp, Homo sapiens
gcaggcctaagacat

SEQ ID NO: 4023708 - DNA, 22 bp, Homo sapiens
gcaggcgatggggcaagacaga

SEQ ID NO: 4023709 - DNA, 23 bp, Homo sapiens
gcaggcggtccccatccccacca

SEQ ID NO: 4023710 - DNA, 21 bp, Homo sapiens
gcaggctcactgccaggccag

SEQ ID NO: 4023711 - DNA, 22 bp, Homo sapiens
gcaggctcactgccaggccagc

SEQ ID NO: 4023712 - DNA, 10 bp, Homo sapiens
gcaggctggg

SEQ ID NO: 4023713 - DNA, 15 bp, Homo sapiens
gcagggaaggcctga

SEQ ID NO: 4023714 - DNA, 14 bp, Homo sapiens
gcagggagggcagt

SEQ ID NO: 4023715 - DNA, 14 bp, Homo sapiens
gcagggaggggagg

SEQ ID NO: 4023716 - DNA, 15 bp, Homo sapiens
gcagggcagccccac

SEQ ID NO: 4023717 - DNA, 14 bp, Homo sapiens
gcagggcatctcct

SEQ ID NO: 4023718 - DNA, 21 bp, Homo sapiens
gcagggcccttggggctgggg

SEQ ID NO: 4023719 - DNA, 11 bp, Homo sapiens
gcagggctggt

SEQ ID NO: 4023720 - DNA, 22 bp, Homo sapiens
gcaacaggacagagttcacagg

SEQ ID NO: 4023721 - DNA, 13 bp, Homo sapiens
gcaacatccaaaa

SEQ ID NO: 4023722 - DNA, 17 bp, Homo sapiens
gcaacatccaaaatagt

SEQ ID NO: 4023723 - DNA, 13 bp, Homo sapiens
gcaacatcttttt

SEQ ID NO: 4023724 - DNA, 15 bp, Homo sapiens
gcaaccaaactccca

SEQ ID NO: 4023725 - DNA, 16 bp, Homo sapiens
gcaacccaaggactga

SEQ ID NO: 4023726 - DNA, 19 bp, Homo sapiens
gcaaccccaggctgaagca

SEQ ID NO: 4023727 - DNA, 22 bp, Homo sapiens
gcaacctcaccttcctgtgggt

SEQ ID NO: 4023728 - DNA, 16 bp, Homo sapiens
gcaacctcttggcctg

SEQ ID NO: 4023729 - DNA, 23 bp, Homo sapiens
gcaacgaagaaaaaaaataacac

SEQ ID NO: 4023730 - DNA, 22 bp, Homo sapiens
gcaacgtttacaccgactagcc

SEQ ID NO: 4023731 - DNA, 22 bp, Homo sapiens
gcaactcaaggactttgcagcc

SEQ ID NO: 4023732 - DNA, 15 bp, Homo sapiens
gcaactcttgattat

SEQ ID NO: 4023733 - DNA, 15 bp, Homo sapiens
gcaacttcagtttta

SEQ ID NO: 4023734 - DNA, 23 bp, Homo sapiens
gcaacttcagttttatttttgcc

SEQ ID NO: 4023735 - DNA, 17 bp, Homo sapiens
gcaacttccgctgaggg

SEQ ID NO: 4023736 - DNA, 19 bp, Homo sapiens
gcaacttgaaattatatct

SEQ ID NO: 4023737 - DNA, 19 bp, Homo sapiens
gcaacttgtctttttctgg

SEQ ID NO: 4023738 - DNA, 21 bp, Homo sapiens
gcaacttgtctttttctggac

SEQ ID NO: 4023739 - DNA, 23 bp, Homo sapiens
gcaacttgtctttttctggactg

SEQ ID NO: 4023740 - DNA, 13 bp, Homo sapiens
gcaacttttaaag

SEQ ID NO: 4023741 - DNA, 14 bp, Homo sapiens
gcaacttttaaagc

SEQ ID NO: 4023742 - DNA, 16 bp, Homo sapiens
gcaacttttaaagctc

SEQ ID NO: 4023743 - DNA, 11 bp, Homo sapiens
gcaagaaaagg

SEQ ID NO: 4023744 - DNA, 15 bp, Homo sapiens
gcaagaatttgatcg

SEQ ID NO: 4023745 - DNA, 13 bp, Homo sapiens
gcaagacagaaaa

SEQ ID NO: 4023746 - DNA, 21 bp, Homo sapiens
gcaagacagaaaagtgcctga

SEQ ID NO: 4023747 - DNA, 19 bp, Homo sapiens
gcaagacagagacgcagga

SEQ ID NO: 4023748 - DNA, 15 bp, Homo sapiens
gcaagaccagtcact

SEQ ID NO: 4023749 - DNA, 21 bp, Homo sapiens
gcacacgcacaaacacacaca

SEQ ID NO: 4023750 - DNA, 12 bp, Homo sapiens
gcacactacaga

SEQ ID NO: 4023751 - DNA, 19 bp, Homo sapiens
gcacactccatctcctgct

SEQ ID NO: 4023752 - DNA, 17 bp, Homo sapiens
gcacactggggccccgg

SEQ ID NO: 4023753 - DNA, 20 bp, Homo sapiens
gcacagaaggaatctgtgca

SEQ ID NO: 4023754 - DNA, 21 bp, Homo sapiens
gcacagaaggaatctgtgcag

SEQ ID NO: 4023755 - DNA, 15 bp, Homo sapiens
gcacagaatttgtat

SEQ ID NO: 4023756 - DNA, 17 bp, Homo sapiens
gcacagacacgctcgcg

SEQ ID NO: 4023757 - DNA, 14 bp, Homo sapiens
gcacagagcctggc

SEQ ID NO: 4023758 - DNA, 15 bp, Homo sapiens
gcacagagcctggcc

SEQ ID NO: 4023759 - DNA, 19 bp, Homo sapiens
gcacagagcctggccccag

SEQ ID NO: 4023760 - DNA, 19 bp, Homo sapiens
gcacagagcgtccttcccc

SEQ ID NO: 4023761 - DNA, 16 bp, Homo sapiens
gcacagatatttccat

SEQ ID NO: 4023762 - DNA, 17 bp, Homo sapiens
gcacagatatttccatt

SEQ ID NO: 4023763 - DNA, 20 bp, Homo sapiens
gcacagctcccttctgttga

SEQ ID NO: 4023764 - DNA, 16 bp, Homo sapiens
gcacagcttagatttc

SEQ ID NO: 4023765 - DNA, 19 bp, Homo sapiens
gcacagcttagatttcata

SEQ ID NO: 4023766 - DNA, 20 bp, Homo sapiens
gcacaggagtgtcctcttcc

SEQ ID NO: 4023767 - DNA, 12 bp, Homo sapiens
gcacaggcagct

SEQ ID NO: 4023768 - DNA, 23 bp, Homo sapiens
gcacagggaaaattgccccatcc

SEQ ID NO: 4023769 - DNA, 18 bp, Homo sapiens
gcacagggaagggcttgg

SEQ ID NO: 4023770 - DNA, 16 bp, Homo sapiens
gcacagggagaggccg

SEQ ID NO: 4023771 - DNA, 18 bp, Homo sapiens
gcacagggcaccagaggc

SEQ ID NO: 4023772 - DNA, 20 bp, Homo sapiens
gcacagggcccgcagtgctg

SEQ ID NO: 4023773 - DNA, 23 bp, Homo sapiens
gcacagggcccgcagtgctggga

SEQ ID NO: 4023774 - DNA, 12 bp, Homo sapiens
gcacagggtctg

SEQ ID NO: 4023775 - DNA, 17 bp, Homo sapiens
gcacagggtctgctctt

SEQ ID NO: 4023776 - DNA, 13 bp, Homo sapiens
gcacaggtcaggc

SEQ ID NO: 4023777 - DNA, 20 bp, Homo sapiens
gcacaggtcgggcgcaggat

SEQ ID NO: 4023778 - DNA, 13 bp, Homo sapiens
gcacagtgcatct

SEQ ID NO: 4023779 - DNA, 22 bp, Homo sapiens
gcacagtgtaatccaggggtgt

SEQ ID NO: 4023780 - DNA, 19 bp, Homo sapiens
gcacatacattaaaactag

SEQ ID NO: 4023781 - DNA, 21 bp, Homo sapiens
gatgaagcaaggaagatatac

SEQ ID NO: 4023782 - DNA, 18 bp, Homo sapiens
gatgaagggcgagtgaat

SEQ ID NO: 4023783 - DNA, 19 bp, Homo sapiens
gatgaatctcccactccag

SEQ ID NO: 4023784 - DNA, 14 bp, Homo sapiens
gatgaatgtatgtg

SEQ ID NO: 4023785 - DNA, 23 bp, Homo sapiens
gatgacacccaccctgtgccatc

SEQ ID NO: 4023786 - DNA, 16 bp, Homo sapiens
gatgacaccctggcct

SEQ ID NO: 4023787 - DNA, 14 bp, Homo sapiens
gatgacagagcgag

SEQ ID NO: 4023788 - DNA, 14 bp, Homo sapiens
gatgacagggcaga

SEQ ID NO: 4023789 - DNA, 22 bp, Homo sapiens
gatgacagggcagagcaggaag

SEQ ID NO: 4023790 - DNA, 15 bp, Homo sapiens
gatgacattccctgc

SEQ ID NO: 4023791 - DNA, 13 bp, Homo sapiens
gatgaccagaaca

SEQ ID NO: 4023792 - DNA, 14 bp, Homo sapiens
gatgaccagggatg

SEQ ID NO: 4023793 - DNA, 15 bp, Homo sapiens
gatgacccctgccca

SEQ ID NO: 4023794 - DNA, 19 bp, Homo sapiens
gatgactggggtgggaggt

SEQ ID NO: 4023795 - DNA, 22 bp, Homo sapiens
gatgagaatttctaaaaagatt

SEQ ID NO: 4023796 - DNA, 17 bp, Homo sapiens
gatgagagcccagaggt

SEQ ID NO: 4023797 - DNA, 21 bp, Homo sapiens
gatgagagcccagaggtaaca

SEQ ID NO: 4023798 - DNA, 23 bp, Homo sapiens
gatgagccgctgtgagcccctgg

SEQ ID NO: 4023799 - DNA, 16 bp, Homo sapiens
gatgaggggtgctggg

SEQ ID NO: 4023800 - DNA, 17 bp, Homo sapiens
gatgataacacttaaaa

SEQ ID NO: 4023801 - DNA, 13 bp, Homo sapiens
gatgtttgtggcc

SEQ ID NO: 4023802 - DNA, 15 bp, Homo sapiens
gatgtttgtggcctc

SEQ ID NO: 4023803 - DNA, 14 bp, Homo sapiens
gatgttttattatt

SEQ ID NO: 4023804 - DNA, 23 bp, Homo sapiens
gatgttttcaggtgtcatggact

SEQ ID NO: 4023805 - DNA, 15 bp, Homo sapiens
gattaaacacctgac

SEQ ID NO: 4023806 - DNA, 16 bp, Homo sapiens
gattaacaaatatgct

SEQ ID NO: 4023807 - DNA, 17 bp, Homo sapiens
gattaacctctgcacta

SEQ ID NO: 4023808 - DNA, 17 bp, Homo sapiens
gattaacttatttagag

SEQ ID NO: 4023809 - DNA, 11 bp, Homo sapiens
gattaagaaac

SEQ ID NO: 4023810 - DNA, 12 bp, Homo sapiens
gattaagatttt

SEQ ID NO: 4023811 - DNA, 13 bp, Homo sapiens
gattaatcaaagg

SEQ ID NO: 4023812 - DNA, 20 bp, Homo sapiens
gattaatcaaaggcatatct

SEQ ID NO: 4023813 - DNA, 14 bp, Homo sapiens
gattacatgcatgt

SEQ ID NO: 4023814 - DNA, 23 bp, Homo sapiens
gattaccagggactatctttgct

SEQ ID NO: 4023815 - DNA, 17 bp, Homo sapiens
gattactgtcaataaac

SEQ ID NO: 4023816 - DNA, 12 bp, Homo sapiens
gattacttaaat

SEQ ID NO: 4023817 - DNA, 19 bp, Homo sapiens
gattagaaaaattcctaag

SEQ ID NO: 4023818 - DNA, 15 bp, Homo sapiens
gattagatgtgccaa

SEQ ID NO: 4023819 - DNA, 19 bp, Homo sapiens
gattagcaaggtcatttct

SEQ ID NO: 4023820 - DNA, 20 bp, Homo sapiens
gattagcaaggtcatttctt

SEQ ID NO: 4023821 - DNA, 19 bp, Homo sapiens
gattagcaagttacagtga

SEQ ID NO: 4023822 - DNA, 12 bp, Homo sapiens
gattagctttgt

SEQ ID NO: 4023823 - DNA, 16 bp, Homo sapiens
gattagctttgtgttt

SEQ ID NO: 4023824 - DNA, 17 bp, Homo sapiens
gattagctttgtgtttg

SEQ ID NO: 4023825 - DNA, 22 bp, Homo sapiens
gattagttgaaaggcctcaaga

SEQ ID NO: 4023826 - DNA, 12 bp, Homo sapiens
gattagttggac

SEQ ID NO: 4023827 - DNA, 19 bp, Homo sapiens
gattataaaattaatcaca

SEQ ID NO: 4023828 - DNA, 20 bp, Homo sapiens
gattataaaattaatcacaa

SEQ ID NO: 4023829 - DNA, 14 bp, Homo sapiens
gattatggagcttt

SEQ ID NO: 4023830 - DNA, 19 bp, Homo sapiens
gattatgggtcctgcaatt

SEQ ID NO: 4023831 - DNA, 21 bp, Homo sapiens
gattatgtcttttatatttgt

SEQ ID NO: 4023832 - DNA, 23 bp, Homo sapiens
gattattaactaatatgggcatt

SEQ ID NO: 4023833 - DNA, 12 bp, Homo sapiens
gattattggaaa

SEQ ID NO: 4023834 - DNA, 15 bp, Homo sapiens
gattattggctgctt

SEQ ID NO: 4023835 - DNA, 15 bp, Homo sapiens
gattatttaataaca

SEQ ID NO: 4023836 - DNA, 16 bp, Homo sapiens
gattatttaataacat

SEQ ID NO: 4023837 - DNA, 17 bp, Homo sapiens
gattatttaataacatt

SEQ ID NO: 4023838 - DNA, 15 bp, Homo sapiens
gattcaaagtgttgt

SEQ ID NO: 4023839 - DNA, 22 bp, Homo sapiens
gattcaaagtgttgtgttcctg

SEQ ID NO: 4023840 - DNA, 12 bp, Homo sapiens
gattcagaaatt

SEQ ID NO: 4023841 - DNA, 19 bp, Homo sapiens
gattcaggccagcccagcc

SEQ ID NO: 4023842 - DNA, 18 bp, Homo sapiens
gattcaggggctgggggt

SEQ ID NO: 4023843 - DNA, 19 bp, Homo sapiens
gattcatagtaacttctta

SEQ ID NO: 4023844 - DNA, 22 bp, Homo sapiens
gattcatctaccctgctgacct

SEQ ID NO: 4023845 - DNA, 20 bp, Homo sapiens
gattcattctcataattcct

SEQ ID NO: 4023846 - DNA, 18 bp, Homo sapiens
gattccaaagagtagaat

SEQ ID NO: 4023847 - DNA, 19 bp, Homo sapiens
gattccaaagagtagaatt

SEQ ID NO: 4023848 - DNA, 22 bp, Homo sapiens
gattccagagagtggctcctcc

SEQ ID NO: 4023849 - DNA, 14 bp, Homo sapiens
gattcccctgtgtc

SEQ ID NO: 4023850 - DNA, 13 bp, Homo sapiens
gattcctggtttg

SEQ ID NO: 4023851 - DNA, 16 bp, Homo sapiens
gattcctggtttgact

SEQ ID NO: 4023852 - DNA, 18 bp, Homo sapiens
gattccttagactctttt

SEQ ID NO: 4023853 - DNA, 13 bp, Homo sapiens
gattccttctctg

SEQ ID NO: 4023854 - DNA, 23 bp, Homo sapiens
gattcgtggtcttttcctcgctt

SEQ ID NO: 4023855 - DNA, 20 bp, Homo sapiens
gattctatttatatgtacat

SEQ ID NO: 4023856 - DNA, 15 bp, Homo sapiens
gattctcaccagctg

SEQ ID NO: 4023857 - DNA, 14 bp, Homo sapiens
gattctcctgtgct

SEQ ID NO: 4023858 - DNA, 13 bp, Homo sapiens
gattctctattgg

SEQ ID NO: 4023859 - DNA, 11 bp, Homo sapiens
gattctctcca

SEQ ID NO: 4023860 - DNA, 19 bp, Homo sapiens
gattctcttagctactgta

SEQ ID NO: 4023861 - DNA, 12 bp, Homo sapiens
gattctgaatct

SEQ ID NO: 4023862 - DNA, 11 bp, Homo sapiens
gattctgagca

SEQ ID NO: 4023863 - DNA, 20 bp, Homo sapiens
gattctgagcagtgcctctt

SEQ ID NO: 4023864 - DNA, 18 bp, Homo sapiens
gattctgcagtaaatctt

SEQ ID NO: 4023865 - DNA, 19 bp, Homo sapiens
gattctgcagtaaatcttt

SEQ ID NO: 4023866 - DNA, 13 bp, Homo sapiens
gattctgcctctc

SEQ ID NO: 4023867 - DNA, 21 bp, Homo sapiens
gattctgggaggcaagaaaag

SEQ ID NO: 4023868 - DNA, 21 bp, Homo sapiens
gattctgtttattcttccaga

SEQ ID NO: 4023869 - DNA, 19 bp, Homo sapiens
gattctttaatagaagttt

SEQ ID NO: 4023870 - DNA, 19 bp, Homo sapiens
gattctttccattatgatt

SEQ ID NO: 4023871 - DNA, 12 bp, Homo sapiens
gattgacctgct

SEQ ID NO: 4023872 - DNA, 23 bp, Homo sapiens
gattgacctgctccgctgctcct

SEQ ID NO: 4023873 - DNA, 20 bp, Homo sapiens
gattgaggggccctggccag

SEQ ID NO: 4023874 - DNA, 15 bp, Homo sapiens
gattgatttgaagaa

SEQ ID NO: 4023875 - DNA, 11 bp, Homo sapiens
gattgcacaga

SEQ ID NO: 4023876 - DNA, 16 bp, Homo sapiens
gattgcacgtggcctc

SEQ ID NO: 4023877 - DNA, 19 bp, Homo sapiens
gattgcagaaaattctgtg

SEQ ID NO: 4023878 - DNA, 11 bp, Homo sapiens
gattgcagctt

SEQ ID NO: 4023879 - DNA, 19 bp, Homo sapiens
gattgccggtcttgacagc

SEQ ID NO: 4023880 - DNA, 19 bp, Homo sapiens
gattgcggtttacagctat

SEQ ID NO: 4023881 - DNA, 11 bp, Homo sapiens
gattgctgcca

SEQ ID NO: 4023882 - DNA, 16 bp, Homo sapiens
gattgcttgagcccag

SEQ ID NO: 4023883 - DNA, 18 bp, Homo sapiens
gattggagctgaagacct

SEQ ID NO: 4023884 - DNA, 11 bp, Homo sapiens
gattggattat

SEQ ID NO: 4023885 - DNA, 20 bp, Homo sapiens
gattggattattcatttaaa

SEQ ID NO: 4023886 - DNA, 20 bp, Homo sapiens
gattggattatttaataaca

SEQ ID NO: 4023887 - DNA, 18 bp, Homo sapiens
gattggctcacccaagca

SEQ ID NO: 4023888 - DNA, 20 bp, Homo sapiens
gattggtgattcaaagtgtt

SEQ ID NO: 4023889 - DNA, 21 bp, Homo sapiens
gattggttttggggaaatgtg

SEQ ID NO: 4023890 - DNA, 23 bp, Homo sapiens
gattgtacatttatttattactg

SEQ ID NO: 4023891 - DNA, 14 bp, Homo sapiens
gattgtataagcat

SEQ ID NO: 4023892 - DNA, 16 bp, Homo sapiens
gattgtcttgcaactt

SEQ ID NO: 4023893 - DNA, 21 bp, Homo sapiens
gattgttaggagtggttctca

SEQ ID NO: 4023894 - DNA, 23 bp, Homo sapiens
gatttaaaaagtgagaaagaaag

SEQ ID NO: 4023895 - DNA, 15 bp, Homo sapiens
gatttaaacacacag

SEQ ID NO: 4023896 - DNA, 18 bp, Homo sapiens
gatttaacagtcatttaa

SEQ ID NO: 4023897 - DNA, 22 bp, Homo sapiens
gatttaagggatggaaaaggaa

SEQ ID NO: 4023898 - DNA, 13 bp, Homo sapiens
gatttaataaaat

SEQ ID NO: 4023899 - DNA, 17 bp, Homo sapiens
gatttaataaaataatt

SEQ ID NO: 4023900 - DNA, 22 bp, Homo sapiens
gatttaataaaataattctaaa

SEQ ID NO: 4023901 - DNA, 14 bp, Homo sapiens
gatttaatatggat

SEQ ID NO: 4023902 - DNA, 19 bp, Homo sapiens
gatttacagcctcacttga

SEQ ID NO: 4023903 - DNA, 20 bp, Homo sapiens
gatttacctgttttcgcacc

SEQ ID NO: 4023904 - DNA, 14 bp, Homo sapiens
gatttagtttcagt

SEQ ID NO: 4023905 - DNA, 23 bp, Homo sapiens
gacataacgtttttcctttaaaa

SEQ ID NO: 4023906 - DNA, 20 bp, Homo sapiens
gacatacatattatctcatt

SEQ ID NO: 4023907 - DNA, 20 bp, Homo sapiens
gacataccccactgggcaca

SEQ ID NO: 4023908 - DNA, 17 bp, Homo sapiens
gacatacttgaagggcc

SEQ ID NO: 4023909 - DNA, 20 bp, Homo sapiens
gacatattatgcctgaatga

SEQ ID NO: 4023910 - DNA, 18 bp, Homo sapiens
gacatcacagcagcctcc

SEQ ID NO: 4023911 - DNA, 18 bp, Homo sapiens
gacatcatgaattttaca

SEQ ID NO: 4023912 - DNA, 23 bp, Homo sapiens
gacatccatgttccgagaagaac

SEQ ID NO: 4023913 - DNA, 13 bp, Homo sapiens
gacatcctcttct

SEQ ID NO: 4023914 - DNA, 19 bp, Homo sapiens
gacatcctgtataagcact

SEQ ID NO: 4023915 - DNA, 21 bp, Homo sapiens
gacatcctgtataagcactga

SEQ ID NO: 4023916 - DNA, 20 bp, Homo sapiens
gacatctcaggggccagagg

SEQ ID NO: 4023917 - DNA, 18 bp, Homo sapiens
gacatctggaatctggag

SEQ ID NO: 4023918 - DNA, 14 bp, Homo sapiens
gacatgatttcctt

SEQ ID NO: 4023919 - DNA, 17 bp, Homo sapiens
gacatgatttccttgaa

SEQ ID NO: 4023920 - DNA, 19 bp, Homo sapiens
gacatgatttccttgaatg

SEQ ID NO: 4023921 - DNA, 15 bp, Homo sapiens
gacatgctcacctct

SEQ ID NO: 4023922 - DNA, 16 bp, Homo sapiens
gacatgctcacctcta

SEQ ID NO: 4023923 - DNA, 17 bp, Homo sapiens
gacatgctcacctctag

SEQ ID NO: 4023924 - DNA, 19 bp, Homo sapiens
gacatggagactcctgccc

SEQ ID NO: 4023925 - DNA, 22 bp, Homo sapiens
gacatggagactcctgccctgt

SEQ ID NO: 4023926 - DNA, 19 bp, Homo sapiens
gacatggtgcctgagaggc

SEQ ID NO: 4023927 - DNA, 20 bp, Homo sapiens
gacatggtgcctgagaggca

SEQ ID NO: 4023928 - DNA, 21 bp, Homo sapiens
gacatgtagcttcttctgaaa

SEQ ID NO: 4023929 - DNA, 20 bp, Homo sapiens
gacatgtgacatttatatat

SEQ ID NO: 4023930 - DNA, 21 bp, Homo sapiens
gacatgtgcaattgtgaggga

SEQ ID NO: 4023931 - DNA, 17 bp, Homo sapiens
gacatgtggggccaggt

SEQ ID NO: 4023932 - DNA, 19 bp, Homo sapiens
gaattctttaaaattacaa

SEQ ID NO: 4023933 - DNA, 21 bp, Homo sapiens
gaattgaccgacagctttcca

SEQ ID NO: 4023934 - DNA, 22 bp, Homo sapiens
gaattgaggggattaatatgaa

SEQ ID NO: 4023935 - DNA, 14 bp, Homo sapiens
gaattgatttgcat

SEQ ID NO: 4023936 - DNA, 15 bp, Homo sapiens
gaattgatttgcatt

SEQ ID NO: 4023937 - DNA, 18 bp, Homo sapiens
gaattgatttgcattgaa

SEQ ID NO: 4023938 - DNA, 22 bp, Homo sapiens
gaattgatttgcattgaacaca

SEQ ID NO: 4023939 - DNA, 13 bp, Homo sapiens
gaattgcattgac

SEQ ID NO: 4023940 - DNA, 21 bp, Homo sapiens
gaattgcctgcagagagaagc

SEQ ID NO: 4023941 - DNA, 12 bp, Homo sapiens
gaattgtacaga

SEQ ID NO: 4023942 - DNA, 9 bp, Homo sapiens
gaattgttt

SEQ ID NO: 4023943 - DNA, 20 bp, Homo sapiens
gaattgttttctttaaagat

SEQ ID NO: 4023944 - DNA, 13 bp, Homo sapiens
gaatttaaataaa

SEQ ID NO: 4023945 - DNA, 15 bp, Homo sapiens
gaatttaaatataat

SEQ ID NO: 4023946 - DNA, 23 bp, Homo sapiens
gaatttatacctacctgtgtggt

SEQ ID NO: 4023947 - DNA, 20 bp, Homo sapiens
gaatttatcacacttctgtg

SEQ ID NO: 4023948 - DNA, 22 bp, Homo sapiens
gaatttatcacacttctgtgag

SEQ ID NO: 4023949 - DNA, 20 bp, Homo sapiens
gaatttatgtgaaatgcttt

SEQ ID NO: 4023950 - DNA, 23 bp, Homo sapiens
gaatttatgtgaaatgctttctg

SEQ ID NO: 4023951 - DNA, 16 bp, Homo sapiens
gaatttcactgtcttt

SEQ ID NO: 4023952 - DNA, 16 bp, Homo sapiens
gaatttcccaggaccc

SEQ ID NO: 4023953 - DNA, 17 bp, Homo sapiens
gaatttcccaggaccct

SEQ ID NO: 4023954 - DNA, 17 bp, Homo sapiens
gaatttctaaaaaacag

SEQ ID NO: 4023955 - DNA, 18 bp, Homo sapiens
gaatttctaaaaagatta

SEQ ID NO: 4023956 - DNA, 19 bp, Homo sapiens
gaatttctatctaaatgat

SEQ ID NO: 4023957 - DNA, 14 bp, Homo sapiens
gaatttcttttcct

SEQ ID NO: 4023958 - DNA, 22 bp, Homo sapiens
gaatttcttttccttcattcat

SEQ ID NO: 4023959 - DNA, 19 bp, Homo sapiens
gaatttgaatgaaaaattt

SEQ ID NO: 4023960 - DNA, 16 bp, Homo sapiens
gaatttgtaacctcag

SEQ ID NO: 4023961 - DNA, 17 bp, Homo sapiens
gaatttgtaacctcagc

SEQ ID NO: 4023962 - DNA, 21 bp, Homo sapiens
gaatttgtcagcgttctacca

SEQ ID NO: 4023963 - DNA, 16 bp, Homo sapiens
gaattttaatgtgaag

SEQ ID NO: 4023964 - DNA, 19 bp, Homo sapiens
gaattttccacgcagttct

SEQ ID NO: 4023965 - DNA, 23 bp, Homo sapiens
gaattttctccctttatgtatct

SEQ ID NO: 4023966 - DNA, 23 bp, Homo sapiens
gaattttgtttttattttcaaga

SEQ ID NO: 4023967 - DNA, 21 bp, Homo sapiens
gaatttttatttctttttaat

SEQ ID NO: 4023968 - DNA, 21 bp, Homo sapiens
gaatttttcagcacttaacta

SEQ ID NO: 4023969 - DNA, 14 bp, Homo sapiens
gaatttttttgtaa

SEQ ID NO: 4023970 - DNA, 17 bp, Homo sapiens
gaatttttttgtcttta

SEQ ID NO: 4023971 - DNA, 17 bp, Homo sapiens
gacaaaaaaatttaaaa

SEQ ID NO: 4023972 - DNA, 19 bp, Homo sapiens
gacaaaaaaatttaaaatt

SEQ ID NO: 4023973 - DNA, 15 bp, Homo sapiens
gacaaaagtaaatgg

SEQ ID NO: 4023974 - DNA, 22 bp, Homo sapiens
gacaaaattttagtccaaataa

SEQ ID NO: 4023975 - DNA, 19 bp, Homo sapiens
gacaaattcggatgtatga

SEQ ID NO: 4023976 - DNA, 17 bp, Homo sapiens
gacaacagaagtcatga

SEQ ID NO: 4023977 - DNA, 15 bp, Homo sapiens
gacaaccactggtct

SEQ ID NO: 4023978 - DNA, 18 bp, Homo sapiens
gacaactttgccagcttt

SEQ ID NO: 4023979 - DNA, 16 bp, Homo sapiens
gacaagaaatccctgt

SEQ ID NO: 4023980 - DNA, 19 bp, Homo sapiens
gacaagatattgtacataa

SEQ ID NO: 4023981 - DNA, 23 bp, Homo sapiens
gacaagatggtccatttgttcct

SEQ ID NO: 4023982 - DNA, 12 bp, Homo sapiens
gacaagcacagt

SEQ ID NO: 4023983 - DNA, 16 bp, Homo sapiens
gacaagcactgctagg

SEQ ID NO: 4023984 - DNA, 12 bp, Homo sapiens
gacaagcagagg

SEQ ID NO: 4023985 - DNA, 19 bp, Homo sapiens
gacaagccaacttgtaaat

SEQ ID NO: 4023986 - DNA, 20 bp, Homo sapiens
gacaagctgttgaccaggca

SEQ ID NO: 4023987 - DNA, 20 bp, Homo sapiens
gacaataaacatctgagcag

SEQ ID NO: 4023988 - DNA, 17 bp, Homo sapiens
gacaatcaactctaata

SEQ ID NO: 4023989 - DNA, 13 bp, Homo sapiens
gacaatcttctgt

SEQ ID NO: 4023990 - DNA, 15 bp, Homo sapiens
gacacaaactgccaa

SEQ ID NO: 4023991 - DNA, 13 bp, Homo sapiens
gacacaactattt

SEQ ID NO: 4023992 - DNA, 14 bp, Homo sapiens
gacacaagcacttt

SEQ ID NO: 4023993 - DNA, 22 bp, Homo sapiens
gacacaatatgtatgcttttta

SEQ ID NO: 4023994 - DNA, 14 bp, Homo sapiens
gacacacacacgca

SEQ ID NO: 4023995 - DNA, 21 bp, Homo sapiens
gacacacacacgcacgcacac

SEQ ID NO: 4023996 - DNA, 13 bp, Homo sapiens
gacacacagcact

SEQ ID NO: 4023997 - DNA, 15 bp, Homo sapiens
gacacacagcactct

SEQ ID NO: 4023998 - DNA, 12 bp, Homo sapiens
gaaaagaggagt

SEQ ID NO: 4023999 - DNA, 13 bp, Homo sapiens
gaaaagataaacc

SEQ ID NO: 4024000 - DNA, 13 bp, Homo sapiens
gaaaagataaaga

SEQ ID NO: 4024001 - DNA, 22 bp, Homo sapiens
gaaaagatacgactttattttc

SEQ ID NO: 4024002 - DNA, 17 bp, Homo sapiens
gaaaagattttaatcaa

SEQ ID NO: 4024003 - DNA, 21 bp, Homo sapiens
gaaaagcacttttgttattcc

SEQ ID NO: 4024004 - DNA, 22 bp, Homo sapiens
gaaaagcacttttgttattcca

SEQ ID NO: 4024005 - DNA, 10 bp, Homo sapiens
gaaaagcata

SEQ ID NO: 4024006 - DNA, 14 bp, Homo sapiens
gaaaagcataacac

SEQ ID NO: 4024007 - DNA, 19 bp, Homo sapiens
gaaaagcatacatgcaaaa

SEQ ID NO: 4024008 - DNA, 12 bp, Homo sapiens
gaaaagccaagc

SEQ ID NO: 4024009 - DNA, 20 bp, Homo sapiens
gaaaagctattagccaggat

SEQ ID NO: 4024010 - DNA, 22 bp, Homo sapiens
gaaaagctattagccaggatca

SEQ ID NO: 4024011 - DNA, 14 bp, Homo sapiens
gaaaagcttcttaa

SEQ ID NO: 4024012 - DNA, 19 bp, Homo sapiens
gaaaaggaaaaaaagcaaa

SEQ ID NO: 4024013 - DNA, 20 bp, Homo sapiens
gaaaaggaagactagaggct

SEQ ID NO: 4024014 - DNA, 14 bp, Homo sapiens
gaaaagggagaaaa

SEQ ID NO: 4024015 - DNA, 16 bp, Homo sapiens
gaaaagggagaaaaag

SEQ ID NO: 4024016 - DNA, 23 bp, Homo sapiens
gaaaaggtagaggagtcacgtta

SEQ ID NO: 4024017 - DNA, 21 bp, Homo sapiens
gaaaagtaaggtgcagttccc

SEQ ID NO: 4024018 - DNA, 19 bp, Homo sapiens
gaaaagtatcactctaaaa

SEQ ID NO: 4024019 - DNA, 18 bp, Homo sapiens
gaaaagtcacttactatt

SEQ ID NO: 4024020 - DNA, 19 bp, Homo sapiens
gaaaagtgcctgagctggg

SEQ ID NO: 4024021 - DNA, 20 bp, Homo sapiens
gaaaagttgcagatgtattg

SEQ ID NO: 4024022 - DNA, 19 bp, Homo sapiens
gaaaatacaacttaaataa

SEQ ID NO: 4024023 - DNA, 14 bp, Homo sapiens
gaaaatacaataaa

SEQ ID NO: 4024024 - DNA, 16 bp, Homo sapiens
gaaaatataaccagcc

SEQ ID NO: 4024025 - DNA, 16 bp, Homo sapiens
gaaaatatatgatggc

SEQ ID NO: 4024026 - DNA, 21 bp, Homo sapiens
gaaaatattatgtgtttccat

SEQ ID NO: 4024027 - DNA, 19 bp, Homo sapiens
gaaaatatttcctgacttg

SEQ ID NO: 4024028 - DNA, 21 bp, Homo sapiens
gaaaatatttcctgacttgag

SEQ ID NO: 4024029 - DNA, 22 bp, Homo sapiens
gaaaatatttcctgacttgagt

SEQ ID NO: 4024030 - DNA, 24 bp, Homo sapiens
gaaaatcaaaccgagcagggctgt

SEQ ID NO: 4024031 - DNA, 17 bp, Homo sapiens
gaaaatgacttatttct

SEQ ID NO: 4024032 - DNA, 19 bp, Homo sapiens
gaaaatgagtatttggtcc

SEQ ID NO: 4024033 - DNA, 20 bp, Homo sapiens
gaaaatgagtatttggtcca

SEQ ID NO: 4024034 - DNA, 22 bp, Homo sapiens
gaaaatgcagtcctgaggagag

SEQ ID NO: 4024035 - DNA, 22 bp, Homo sapiens
gaaaatgcctcaattcacatag

SEQ ID NO: 4024036 - DNA, 15 bp, Homo sapiens
gaaaatgcggttata

SEQ ID NO: 4024037 - DNA, 14 bp, Homo sapiens
gaaaatggtatttt

SEQ ID NO: 4024038 - DNA, 22 bp, Homo sapiens
gaaaatggtccaattagtttcc

SEQ ID NO: 4024039 - DNA, 23 bp, Homo sapiens
gaaaatggtccaattagtttcct

SEQ ID NO: 4024040 - DNA, 15 bp, Homo sapiens
gaaaatgtatgtgta

SEQ ID NO: 4024041 - DNA, 21 bp, Homo sapiens
gaaaatgtcagaaaccagtta

SEQ ID NO: 4024042 - DNA, 23 bp, Homo sapiens
gaaaatgtctattcaaaatatca

SEQ ID NO: 4024043 - DNA, 15 bp, Homo sapiens
gaaaatgttcttcca

SEQ ID NO: 4024044 - DNA, 21 bp, Homo sapiens
gaaaatgttgagaatcccaaa

SEQ ID NO: 4024045 - DNA, 20 bp, Homo sapiens
gaaaatgtttttctgccagg

SEQ ID NO: 4024046 - DNA, 18 bp, Homo sapiens
gaaaattagactgtgatt

SEQ ID NO: 4024047 - DNA, 18 bp, Homo sapiens
gaaaattccagaaaggat

SEQ ID NO: 4024048 - DNA, 20 bp, Homo sapiens
gaaaattctgtgccttgttt

SEQ ID NO: 4024049 - DNA, 19 bp, Homo sapiens
gaaaattgaaataaagcta

SEQ ID NO: 4024050 - DNA, 18 bp, Homo sapiens
gaaaatttagccctttaa

SEQ ID NO: 4024051 - DNA, 20 bp, Homo sapiens
gaaaattttaaaaatacata

SEQ ID NO: 4024052 - DNA, 21 bp, Homo sapiens
gaaaattttaaaaatacatat

SEQ ID NO: 4024053 - DNA, 13 bp, Homo sapiens
gaaaatttttgta

SEQ ID NO: 4024054 - DNA, 16 bp, Homo sapiens
gaaacacaccaggctg

SEQ ID NO: 4024055 - DNA, 13 bp, Homo sapiens
gaaacacagaaac

SEQ ID NO: 4024056 - DNA, 21 bp, Homo sapiens
gaaataaatagctatatccat

SEQ ID NO: 4024057 - DNA, 21 bp, Homo sapiens
gaaataaatcagagagcaagg

SEQ ID NO: 4024058 - DNA, 19 bp, Homo sapiens
gaaataaattctgattctt

SEQ ID NO: 4024059 - DNA, 17 bp, Homo sapiens
gaaataacaaaatggac

SEQ ID NO: 4024060 - DNA, 18 bp, Homo sapiens
gaaataatagaatgagca

SEQ ID NO: 4024061 - DNA, 19 bp, Homo sapiens
gaaataatgtacatctggc

SEQ ID NO: 4024062 - DNA, 13 bp, Homo sapiens
gaaatactaaaag

SEQ ID NO: 4024063 - DNA, 16 bp, Homo sapiens
gaaatactaaaagcaa

SEQ ID NO: 4024064 - DNA, 18 bp, Homo sapiens
gaaatactgcaagaaaat

SEQ ID NO: 4024065 - DNA, 15 bp, Homo sapiens
gaaatacttgtgatt

SEQ ID NO: 4024066 - DNA, 17 bp, Homo sapiens
gaaatagaaagaagcca

SEQ ID NO: 4024067 - DNA, 19 bp, Homo sapiens
gaaatagacagtatattta

SEQ ID NO: 4024068 - DNA, 15 bp, Homo sapiens
gaaatagtctgtgtg

SEQ ID NO: 4024069 - DNA, 17 bp, Homo sapiens
gaaatagtctgtgtgaa

SEQ ID NO: 4024070 - DNA, 14 bp, Homo sapiens
gaaatatatatgtg

SEQ ID NO: 4024071 - DNA, 12 bp, Homo sapiens
gaaatatcattt

SEQ ID NO: 4024072 - DNA, 19 bp, Homo sapiens
gaaatatctgaaaatgtat

SEQ ID NO: 4024073 - DNA, 20 bp, Homo sapiens
gaaatatctgaaaatgtatg

SEQ ID NO: 4024074 - DNA, 14 bp, Homo sapiens
gaaatatgaaattc

SEQ ID NO: 4024075 - DNA, 19 bp, Homo sapiens
gaaatatgaaattccagca

SEQ ID NO: 4024076 - DNA, 14 bp, Homo sapiens
gaaatatgatttta

SEQ ID NO: 4024077 - DNA, 18 bp, Homo sapiens
gaaatatgcacaatagca

SEQ ID NO: 4024078 - DNA, 17 bp, Homo sapiens
gaaatatgtaatgcttc

SEQ ID NO: 4024079 - DNA, 15 bp, Homo sapiens
gaaatatgtgagatt

SEQ ID NO: 4024080 - DNA, 13 bp, Homo sapiens
gaaatatttacct

SEQ ID NO: 4024081 - DNA, 15 bp, Homo sapiens
gaaatcaagcataaa

SEQ ID NO: 4024082 - DNA, 20 bp, Homo sapiens
gaaatcagtaatatttatat

SEQ ID NO: 4024083 - DNA, 14 bp, Homo sapiens
gaaatccattcaca

SEQ ID NO: 4024084 - DNA, 21 bp, Homo sapiens
gaaatccattgtttaaagatg

SEQ ID NO: 4024085 - DNA, 19 bp, Homo sapiens
gaaatccctgtttaatatt

SEQ ID NO: 4024086 - DNA, 21 bp, Homo sapiens
gaaatccctgtttaatattta

SEQ ID NO: 4024087 - DNA, 19 bp, Homo sapiens
gaaatccttgactggacct

SEQ ID NO: 4024088 - DNA, 12 bp, Homo sapiens
gaaatctcaccc

SEQ ID NO: 4024089 - DNA, 16 bp, Homo sapiens
gaaatgaaaacatgta

SEQ ID NO: 4024090 - DNA, 17 bp, Homo sapiens
gaaatgctgctggccaa

SEQ ID NO: 4024091 - DNA, 22 bp, Homo sapiens
gaaatgctgttagtaaatttct

SEQ ID NO: 4024092 - DNA, 13 bp, Homo sapiens
gaaatgtaatact

SEQ ID NO: 4024093 - DNA, 17 bp, Homo sapiens
gaaatgtccctttcttc

SEQ ID NO: 4024094 - DNA, 20 bp, Homo sapiens
gaaatgtccctttcttctcc

SEQ ID NO: 4024095 - DNA, 21 bp, Homo sapiens
gaaatgttattttttaattat

SEQ ID NO: 4024096 - DNA, 12 bp, Homo sapiens
gaaattaacaca

SEQ ID NO: 4024097 - DNA, 17 bp, Homo sapiens
gaaattaagaaggcaaa

SEQ ID NO: 4024098 - DNA, 14 bp, Homo sapiens
gaaattactgtgta

SEQ ID NO: 4024099 - DNA, 16 bp, Homo sapiens
gaaattagctgtgtga

SEQ ID NO: 4024100 - DNA, 19 bp, Homo sapiens
gaaattaggggttaaagca

SEQ ID NO: 4024101 - DNA, 15 bp, Homo sapiens
gaaattatatctgtg

SEQ ID NO: 4024102 - DNA, 21 bp, Homo sapiens
gaaattatgtatgtttacata

SEQ ID NO: 4024103 - DNA, 22 bp, Homo sapiens
gaaattatgtgacattttacat

SEQ ID NO: 4024104 - DNA, 23 bp, Homo sapiens
gaaattatgtgacattttacatt

SEQ ID NO: 4024105 - DNA, 19 bp, Homo sapiens
gaaattccagcaataagaa

SEQ ID NO: 4024106 - DNA, 20 bp, Homo sapiens
gaaattccagcaataagaaa

SEQ ID NO: 4024107 - DNA, 23 bp, Homo sapiens
gaaattccagcaataagaaatga

SEQ ID NO: 4024108 - DNA, 15 bp, Homo sapiens
gaaattcgtgtgttt

SEQ ID NO: 4024109 - DNA, 15 bp, Homo sapiens
gaagcctgctccttc

SEQ ID NO: 4024110 - DNA, 16 bp, Homo sapiens
gaagcctggactctgc

SEQ ID NO: 4024111 - DNA, 17 bp, Homo sapiens
gaagcctggactctgcc

SEQ ID NO: 4024112 - DNA, 20 bp, Homo sapiens
gaagcctgttttgttggaag

SEQ ID NO: 4024113 - DNA, 22 bp, Homo sapiens
gaagcctgttttgttggaaggt

SEQ ID NO: 4024114 - DNA, 20 bp, Homo sapiens
gaagctaataaaattcgctt

SEQ ID NO: 4024115 - DNA, 23 bp, Homo sapiens
gaagctaataaaattcgctttct

SEQ ID NO: 4024116 - DNA, 14 bp, Homo sapiens
gaagctccactgtc

SEQ ID NO: 4024117 - DNA, 16 bp, Homo sapiens
gaagctccactgtcac

SEQ ID NO: 4024118 - DNA, 18 bp, Homo sapiens
gaagctccactgtcaccc

SEQ ID NO: 4024119 - DNA, 23 bp, Homo sapiens
gaagctccactgtcaccctccac

SEQ ID NO: 4024120 - DNA, 13 bp, Homo sapiens
gaagctctgaagt

SEQ ID NO: 4024121 - DNA, 15 bp, Homo sapiens
gaagctctgaagtca

SEQ ID NO: 4024122 - DNA, 19 bp, Homo sapiens
gaagctcttcaatagctaa

SEQ ID NO: 4024123 - DNA, 18 bp, Homo sapiens
gaagctgccagcccagaa

SEQ ID NO: 4024124 - DNA, 18 bp, Homo sapiens
gaagctgctccaggcctg

SEQ ID NO: 4024125 - DNA, 20 bp, Homo sapiens
gaagctgctccaggcctgca

SEQ ID NO: 4024126 - DNA, 13 bp, Homo sapiens
gaagctgctgacc

SEQ ID NO: 4024127 - DNA, 20 bp, Homo sapiens
gaagctggacttctgtgggc

SEQ ID NO: 4024128 - DNA, 21 bp, Homo sapiens
gaagctggacttctgtgggcc

SEQ ID NO: 4024129 - DNA, 17 bp, Homo sapiens
gaagctggccgagggtc

SEQ ID NO: 4024130 - DNA, 15 bp, Homo sapiens
gaagctggcctgaga

SEQ ID NO: 4024131 - DNA, 15 bp, Homo sapiens
gaagctggctttgaa

SEQ ID NO: 4024132 - DNA, 23 bp, Homo sapiens
gaagctggctttgaaacctcagg

SEQ ID NO: 4024133 - DNA, 18 bp, Homo sapiens
gaagctgttgtacattta

SEQ ID NO: 4024134 - DNA, 21 bp, Homo sapiens
gaagctgttgtacatttatga

SEQ ID NO: 4024135 - DNA, 22 bp, Homo sapiens
gaagctgttgtacatttatgat

SEQ ID NO: 4024136 - DNA, 22 bp, Homo sapiens
gaagcttctaaatggtgctgca

SEQ ID NO: 4024137 - DNA, 15 bp, Homo sapiens
gaagcttgactccca

SEQ ID NO: 4024138 - DNA, 20 bp, Homo sapiens
gaaggaatcattccagtgct

SEQ ID NO: 4024139 - DNA, 22 bp, Homo sapiens
gaaggaccacattttatattta

SEQ ID NO: 4024140 - DNA, 16 bp, Homo sapiens
gaaggagagcctgctg

SEQ ID NO: 4024141 - DNA, 14 bp, Homo sapiens
gaaggagcagaaag

SEQ ID NO: 4024142 - DNA, 19 bp, Homo sapiens
gaaggaggctccaggcagc

SEQ ID NO: 4024143 - DNA, 23 bp, Homo sapiens
gaaggaggggagagacaggcagc

SEQ ID NO: 4024144 - DNA, 17 bp, Homo sapiens
gaaggaggtgagggatg

SEQ ID NO: 4024145 - DNA, 14 bp, Homo sapiens
gaaggattgtaaaa

SEQ ID NO: 4024146 - DNA, 23 bp, Homo sapiens
gaaggcaagagggggtggagggg

SEQ ID NO: 4024147 - DNA, 16 bp, Homo sapiens
gaaggcagacagcagg

SEQ ID NO: 4024148 - DNA, 19 bp, Homo sapiens
gaaggcagacagcaggcag

SEQ ID NO: 4024149 - DNA, 21 bp, Homo sapiens
gaaggcagacagcaggcagcg

SEQ ID NO: 4024150 - DNA, 14 bp, Homo sapiens
gaaggcatgagaaa

SEQ ID NO: 4024151 - DNA, 17 bp, Homo sapiens
gaaggcatttgcagggt

SEQ ID NO: 4024152 - DNA, 19 bp, Homo sapiens
gaaggcatttgcagggtcc

SEQ ID NO: 4024153 - DNA, 21 bp, Homo sapiens
gaatatttttatatttccttt

SEQ ID NO: 4024154 - DNA, 22 bp, Homo sapiens
gaatcaaagcagttaactttaa

SEQ ID NO: 4024155 - DNA, 18 bp, Homo sapiens
gaatcaagagctgccctc

SEQ ID NO: 4024156 - DNA, 13 bp, Homo sapiens
gaatcaatgaaaa

SEQ ID NO: 4024157 - DNA, 14 bp, Homo sapiens
gaatcaatgaaaaa

SEQ ID NO: 4024158 - DNA, 20 bp, Homo sapiens
gaatcactaggtaacttatt

SEQ ID NO: 4024159 - DNA, 19 bp, Homo sapiens
gaatcagaatcatggagaa

SEQ ID NO: 4024160 - DNA, 19 bp, Homo sapiens
gaatcagtataaacaaagt

SEQ ID NO: 4024161 - DNA, 17 bp, Homo sapiens
gaatcatgagcctgctg

SEQ ID NO: 4024162 - DNA, 18 bp, Homo sapiens
gaatcatgagcctgctgg

SEQ ID NO: 4024163 - DNA, 13 bp, Homo sapiens
gaatcatttagca

SEQ ID NO: 4024164 - DNA, 17 bp, Homo sapiens
gaatccaaaagaaaaac

SEQ ID NO: 4024165 - DNA, 18 bp, Homo sapiens
gaatccagctccctagac

SEQ ID NO: 4024166 - DNA, 18 bp, Homo sapiens
gaatcccccttgccaccc

SEQ ID NO: 4024167 - DNA, 16 bp, Homo sapiens
gaatcccctccctgtc

SEQ ID NO: 4024168 - DNA, 17 bp, Homo sapiens
gaatcccctccctgtca

SEQ ID NO: 4024169 - DNA, 10 bp, Homo sapiens
gaatcctcct

SEQ ID NO: 4024170 - DNA, 19 bp, Homo sapiens
gaatcctttggtgccaact

SEQ ID NO: 4024171 - DNA, 16 bp, Homo sapiens
gaatcgatttcctccc

SEQ ID NO: 4024172 - DNA, 18 bp, Homo sapiens
gaatctaaggataatgaa

SEQ ID NO: 4024173 - DNA, 23 bp, Homo sapiens
gaatctaaggataatgaaataat

SEQ ID NO: 4024174 - DNA, 22 bp, Homo sapiens
gaatctacccccagatccaagc

SEQ ID NO: 4024175 - DNA, 18 bp, Homo sapiens
gaatctcccactccagcg

SEQ ID NO: 4024176 - DNA, 16 bp, Homo sapiens
gaatctcgttcccaaa

SEQ ID NO: 4024177 - DNA, 13 bp, Homo sapiens
gaatctgctcact

SEQ ID NO: 4024178 - DNA, 20 bp, Homo sapiens
gaatctgctgcatagctcta

SEQ ID NO: 4024179 - DNA, 16 bp, Homo sapiens
gaatctggagaccagg

SEQ ID NO: 4024180 - DNA, 18 bp, Homo sapiens
gaatctggagaccaggga

SEQ ID NO: 4024181 - DNA, 22 bp, Homo sapiens
gaatctggagaccagggagcct

SEQ ID NO: 4024182 - DNA, 15 bp, Homo sapiens
gaatctgtgcagatg

SEQ ID NO: 4024183 - DNA, 16 bp, Homo sapiens
gaatctgtgcagatga

SEQ ID NO: 4024184 - DNA, 13 bp, Homo sapiens
gaatctgtgcctg

SEQ ID NO: 4024185 - DNA, 19 bp, Homo sapiens
gaatctgtgggtctgggag

SEQ ID NO: 4024186 - DNA, 14 bp, Homo sapiens
gaatctgtgtgaaa

SEQ ID NO: 4024187 - DNA, 19 bp, Homo sapiens
gaatcttgactttctgatt

SEQ ID NO: 4024188 - DNA, 22 bp, Homo sapiens
gaatgaaaaatttaagcattgt

SEQ ID NO: 4024189 - DNA, 16 bp, Homo sapiens
gaatgaaattaacaca

SEQ ID NO: 4024190 - DNA, 21 bp, Homo sapiens
gaatgaagacatttctgctct

SEQ ID NO: 4024191 - DNA, 14 bp, Homo sapiens
gaatgagcccagag

SEQ ID NO: 4024192 - DNA, 19 bp, Homo sapiens
gaatgagcccagagaacag

SEQ ID NO: 4024193 - DNA, 15 bp, Homo sapiens
gaatgaggtcccagg

SEQ ID NO: 4024194 - DNA, 17 bp, Homo sapiens
gaatgaggtcccaggca

SEQ ID NO: 4024195 - DNA, 19 bp, Homo sapiens
gaatgaggtcccaggcaga

SEQ ID NO: 4024196 - DNA, 16 bp, Homo sapiens
gaatgattaatcaaag

SEQ ID NO: 4024197 - DNA, 15 bp, Homo sapiens
gaatgcattccctga

SEQ ID NO: 4024198 - DNA, 15 bp, Homo sapiens
gaatgccatttctca

SEQ ID NO: 4024199 - DNA, 14 bp, Homo sapiens
gaatgccctcaggg

SEQ ID NO: 4024200 - DNA, 14 bp, Homo sapiens
gaatgccgtggatt

SEQ ID NO: 4024201 - DNA, 16 bp, Homo sapiens
gaatgcctcctgtggg

SEQ ID NO: 4024202 - DNA, 14 bp, Homo sapiens
gaatgcctgtgcca

SEQ ID NO: 4024203 - DNA, 22 bp, Homo sapiens
gaatgccttggaaatagaaaga

SEQ ID NO: 4024204 - DNA, 10 bp, Homo sapiens
gaatgctgcc

SEQ ID NO: 4024205 - DNA, 12 bp, Homo sapiens
gaatgctgccag

SEQ ID NO: 4024206 - DNA, 15 bp, Homo sapiens
gaatgctgtacatct

SEQ ID NO: 4024207 - DNA, 21 bp, Homo sapiens
gaatggaatcgatttcctccc

SEQ ID NO: 4024208 - DNA, 13 bp, Homo sapiens
gaatggagacaga

SEQ ID NO: 4024209 - DNA, 22 bp, Homo sapiens
gaatggataaaataatgctgca

SEQ ID NO: 4024210 - DNA, 14 bp, Homo sapiens
gaatggatcacaag

SEQ ID NO: 4024211 - DNA, 17 bp, Homo sapiens
gaatggatcacaagatg

SEQ ID NO: 4024212 - DNA, 22 bp, Homo sapiens
gaatggcaatagggtagaatga

SEQ ID NO: 4024213 - DNA, 14 bp, Homo sapiens
gaatggtccagggt

SEQ ID NO: 4024214 - DNA, 18 bp, Homo sapiens
gaatgtaagaaaacaaaa

SEQ ID NO: 4024215 - DNA, 16 bp, Homo sapiens
gaatgtaatcaatgtt

SEQ ID NO: 4024216 - DNA, 22 bp, Homo sapiens
ctttcccaccctcctgccccac

SEQ ID NO: 4024217 - DNA, 20 bp, Homo sapiens
ctttccccagcatcactccc

SEQ ID NO: 4024218 - DNA, 19 bp, Homo sapiens
ctttcccccaccagctaag

SEQ ID NO: 4024219 - DNA, 17 bp, Homo sapiens
ctttcccccttctctta

SEQ ID NO: 4024220 - DNA, 18 bp, Homo sapiens
ctttcccttagtgactct

SEQ ID NO: 4024221 - DNA, 15 bp, Homo sapiens
ctttcccttcctcca

SEQ ID NO: 4024222 - DNA, 21 bp, Homo sapiens
ctttccgctgtcgccccaggc

SEQ ID NO: 4024223 - DNA, 15 bp, Homo sapiens
ctttcctaggcccag

SEQ ID NO: 4024224 - DNA, 18 bp, Homo sapiens
ctttcctaggcccaggcc

SEQ ID NO: 4024225 - DNA, 20 bp, Homo sapiens
ctttcctaggcccaggcctg

SEQ ID NO: 4024226 - DNA, 16 bp, Homo sapiens
ctttcctccccctgca

SEQ ID NO: 4024227 - DNA, 13 bp, Homo sapiens
ctttcctgcccca

SEQ ID NO: 4024228 - DNA, 18 bp, Homo sapiens
ctttcctgccccaggcct

SEQ ID NO: 4024229 - DNA, 20 bp, Homo sapiens
ctttcctggacactcagacc

SEQ ID NO: 4024230 - DNA, 18 bp, Homo sapiens
ctttcctgggcctttgca

SEQ ID NO: 4024231 - DNA, 15 bp, Homo sapiens
ctttccttggcttta

SEQ ID NO: 4024232 - DNA, 14 bp, Homo sapiens
ctttcgaggcctga

SEQ ID NO: 4024233 - DNA, 15 bp, Homo sapiens
ctttcgtcacccttg

SEQ ID NO: 4024234 - DNA, 15 bp, Homo sapiens
ctttctaatgtttct

SEQ ID NO: 4024235 - DNA, 20 bp, Homo sapiens
ctttctacatgactgggcct

SEQ ID NO: 4024236 - DNA, 23 bp, Homo sapiens
ctttctagaagtttcccttcctc

SEQ ID NO: 4024237 - DNA, 23 bp, Homo sapiens
ctttctagctgttgagctgtttt

SEQ ID NO: 4024238 - DNA, 18 bp, Homo sapiens
ctttctagtggtctttgt

SEQ ID NO: 4024239 - DNA, 22 bp, Homo sapiens
ctttctagtggtctttgtaaga

SEQ ID NO: 4024240 - DNA, 12 bp, Homo sapiens
ctttctcagtgt

SEQ ID NO: 4024241 - DNA, 14 bp, Homo sapiens
ctttctccaaagtt

SEQ ID NO: 4024242 - DNA, 20 bp, Homo sapiens
ctttctccaaagttatccag

SEQ ID NO: 4024243 - DNA, 13 bp, Homo sapiens
ctttctccagcca

SEQ ID NO: 4024244 - DNA, 14 bp, Homo sapiens
ctttctccagccag

SEQ ID NO: 4024245 - DNA, 14 bp, Homo sapiens
ctttctccaggacc

SEQ ID NO: 4024246 - DNA, 15 bp, Homo sapiens
ctttctccaggacca

SEQ ID NO: 4024247 - DNA, 14 bp, Homo sapiens
ctttgcttgagaat

SEQ ID NO: 4024248 - DNA, 17 bp, Homo sapiens
ctttggaaggagtgaga

SEQ ID NO: 4024249 - DNA, 20 bp, Homo sapiens
ctttggagaacgccagtctc

SEQ ID NO: 4024250 - DNA, 18 bp, Homo sapiens
ctttggagatgctgaggg

SEQ ID NO: 4024251 - DNA, 16 bp, Homo sapiens
ctttggagtcccctca

SEQ ID NO: 4024252 - DNA, 13 bp, Homo sapiens
ctttggatttgac

SEQ ID NO: 4024253 - DNA, 15 bp, Homo sapiens
ctttggcagtgtttt

SEQ ID NO: 4024254 - DNA, 14 bp, Homo sapiens
ctttggcagttgca

SEQ ID NO: 4024255 - DNA, 22 bp, Homo sapiens
ctttggcctggggtgcatctcc

SEQ ID NO: 4024256 - DNA, 15 bp, Homo sapiens
ctttggctcccctgt

SEQ ID NO: 4024257 - DNA, 18 bp, Homo sapiens
ctttggctgaggggcttg

SEQ ID NO: 4024258 - DNA, 20 bp, Homo sapiens
ctttgggaggccgaggcggg

SEQ ID NO: 4024259 - DNA, 11 bp, Homo sapiens
ctttgggatcc

SEQ ID NO: 4024260 - DNA, 19 bp, Homo sapiens
ctttgggatcccaccctgg

SEQ ID NO: 4024261 - DNA, 21 bp, Homo sapiens
ctttgggatcccaccctgggg

SEQ ID NO: 4024262 - DNA, 15 bp, Homo sapiens
ctttgggatttaatt

SEQ ID NO: 4024263 - DNA, 19 bp, Homo sapiens
ctttgggatttaatttcca

SEQ ID NO: 4024264 - DNA, 14 bp, Homo sapiens
ctttgggctgccct

SEQ ID NO: 4024265 - DNA, 20 bp, Homo sapiens
ctttgggctgccctggtgct

SEQ ID NO: 4024266 - DNA, 13 bp, Homo sapiens
ctttggggagcag

SEQ ID NO: 4024267 - DNA, 19 bp, Homo sapiens
ctttggttaagggctccct

SEQ ID NO: 4024268 - DNA, 18 bp, Homo sapiens
ctttggttccttctctgg

SEQ ID NO: 4024269 - DNA, 19 bp, Homo sapiens
ctttggttccttctctggg

SEQ ID NO: 4024270 - DNA, 20 bp, Homo sapiens
ctttggttccttctctgggt

SEQ ID NO: 4024271 - DNA, 17 bp, Homo sapiens
ctttggttctctccagg

SEQ ID NO: 4024272 - DNA, 20 bp, Homo sapiens
ctttggttctctccaggaag

SEQ ID NO: 4024273 - DNA, 21 bp, Homo sapiens
ctttggttctctccaggaagg

SEQ ID NO: 4024274 - DNA, 19 bp, Homo sapiens
ctttggttctggccagaat

SEQ ID NO: 4024275 - DNA, 11 bp, Homo sapiens
ctttggttttt

SEQ ID NO: 4024276 - DNA, 23 bp, Homo sapiens
ctttggtttttttcttctgtatt

SEQ ID NO: 4024277 - DNA, 18 bp, Homo sapiens
ctttgtaagagtgtagaa

SEQ ID NO: 4024278 - DNA, 13 bp, Homo sapiens
ctttgtaatggga

SEQ ID NO: 4024279 - DNA, 16 bp, Homo sapiens
ctttgtaatttttggg

SEQ ID NO: 4024280 - DNA, 21 bp, Homo sapiens
ctttgtaatttttggggaaaa

SEQ ID NO: 4024281 - DNA, 12 bp, Homo sapiens
ctttgtacttgt

SEQ ID NO: 4024282 - DNA, 14 bp, Homo sapiens
ctttgtacttgtgt

SEQ ID NO: 4024283 - DNA, 15 bp, Homo sapiens
ctttgtagctacttt

SEQ ID NO: 4024284 - DNA, 15 bp, Homo sapiens
ctttgtatagagaat

SEQ ID NO: 4024285 - DNA, 23 bp, Homo sapiens
ctttgtatcttccatatttggaa

SEQ ID NO: 4024286 - DNA, 21 bp, Homo sapiens
ctttgtcctcctgctgccagt

SEQ ID NO: 4024287 - DNA, 21 bp, Homo sapiens
ctttgtctctcctggctgggc

SEQ ID NO: 4024288 - DNA, 16 bp, Homo sapiens
ctttgtgataatttaa

SEQ ID NO: 4024289 - DNA, 17 bp, Homo sapiens
ctttgtgataatttaag

SEQ ID NO: 4024290 - DNA, 18 bp, Homo sapiens
ctttgtgataatttaaga

SEQ ID NO: 4024291 - DNA, 13 bp, Homo sapiens
ctttgtgcctttg

SEQ ID NO: 4024292 - DNA, 22 bp, Homo sapiens
ctttgtgcttgtcattccagag

SEQ ID NO: 4024293 - DNA, 18 bp, Homo sapiens
ctttgtggtttcttgttt

SEQ ID NO: 4024294 - DNA, 21 bp, Homo sapiens
ctttgtgtatctcatttaatt

SEQ ID NO: 4024295 - DNA, 15 bp, Homo sapiens
ctttgtgttgtaatt

SEQ ID NO: 4024296 - DNA, 21 bp, Homo sapiens
ctttgtgtttgcttggtgctg

SEQ ID NO: 4024297 - DNA, 18 bp, Homo sapiens
ctttgtgtttggtttaca

SEQ ID NO: 4024298 - DNA, 19 bp, Homo sapiens
ctttgtgtttggtttacat

SEQ ID NO: 4024299 - DNA, 20 bp, Homo sapiens
ctttgttatttttgtttctt

SEQ ID NO: 4024300 - DNA, 17 bp, Homo sapiens
ctttgttttctgactaa

SEQ ID NO: 4024301 - DNA, 22 bp, Homo sapiens
cttttaaaggggcagaaaaact

SEQ ID NO: 4024302 - DNA, 17 bp, Homo sapiens
cttttaaagtgtttcag

SEQ ID NO: 4024303 - DNA, 19 bp, Homo sapiens
cttttaaatggcagtattt

SEQ ID NO: 4024304 - DNA, 23 bp, Homo sapiens
cttttaaatggcagtatttcatt

SEQ ID NO: 4024305 - DNA, 12 bp, Homo sapiens
cttttaagcagt

SEQ ID NO: 4024306 - DNA, 16 bp, Homo sapiens
cttttaatcagtgaag

SEQ ID NO: 4024307 - DNA, 22 bp, Homo sapiens
cttttaattaaataaaagctgg

SEQ ID NO: 4024308 - DNA, 15 bp, Homo sapiens
cttttaattctcatt

SEQ ID NO: 4024309 - DNA, 19 bp, Homo sapiens
cttttaattgtttcagaat

SEQ ID NO: 4024310 - DNA, 14 bp, Homo sapiens
cttttactctgcct

SEQ ID NO: 4024311 - DNA, 13 bp, Homo sapiens
cttttacttgaaa

SEQ ID NO: 4024312 - DNA, 14 bp, Homo sapiens
cttttactttttta

SEQ ID NO: 4024313 - DNA, 15 bp, Homo sapiens
cttttagaaatactg

SEQ ID NO: 4024314 - DNA, 19 bp, Homo sapiens
cttttagaaatactgcaag

SEQ ID NO: 4024315 - DNA, 23 bp, Homo sapiens
cttttagaaatactgcaagaaaa

SEQ ID NO: 4024316 - DNA, 20 bp, Homo sapiens
cttttaggaaaatcactttg

SEQ ID NO: 4024317 - DNA, 21 bp, Homo sapiens
cttttaggaaaatcactttgt

SEQ ID NO: 4024318 - DNA, 22 bp, Homo sapiens
cttttagttttagttgcagaaa

SEQ ID NO: 4024319 - DNA, 14 bp, Homo sapiens
cttttataataaaa

SEQ ID NO: 4024320 - DNA, 12 bp, Homo sapiens
cttttatactct

SEQ ID NO: 4024321 - DNA, 20 bp, Homo sapiens
cttttatactctttctgtat

SEQ ID NO: 4024322 - DNA, 13 bp, Homo sapiens
cttttatatttgt

SEQ ID NO: 4024323 - DNA, 15 bp, Homo sapiens
cttttatatttgtat

SEQ ID NO: 4024324 - DNA, 22 bp, Homo sapiens
cttttatcccaaagttgttgta

SEQ ID NO: 4024325 - DNA, 15 bp, Homo sapiens
cttttatctgcagaa

SEQ ID NO: 4024326 - DNA, 17 bp, Homo sapiens
cttttatgatgtatatt

SEQ ID NO: 4024327 - DNA, 21 bp, Homo sapiens
cttttatgcagatagaatcaa

SEQ ID NO: 4024328 - DNA, 14 bp, Homo sapiens
cttttatgtagcac

SEQ ID NO: 4024329 - DNA, 18 bp, Homo sapiens
cttttatgtagtaattga

SEQ ID NO: 4024330 - DNA, 16 bp, Homo sapiens
cttttatgtttgaata

SEQ ID NO: 4024331 - DNA, 17 bp, Homo sapiens
cttttatgtttgaatat

SEQ ID NO: 4024332 - DNA, 18 bp, Homo sapiens
cttttattcattagctgt

SEQ ID NO: 4024333 - DNA, 13 bp, Homo sapiens
cttttattttgaa

SEQ ID NO: 4024334 - DNA, 15 bp, Homo sapiens
cttttcaatgacatt

SEQ ID NO: 4024335 - DNA, 16 bp, Homo sapiens
cttttcactgctggct

SEQ ID NO: 4024336 - DNA, 20 bp, Homo sapiens
cttttcactgctggctgcct

SEQ ID NO: 4024337 - DNA, 23 bp, Homo sapiens
cttttcactttctacttttttca

SEQ ID NO: 4024338 - DNA, 21 bp, Homo sapiens
cttttcagaagcaagccagac

SEQ ID NO: 4024339 - DNA, 16 bp, Homo sapiens
cttttcaggaagctct

SEQ ID NO: 4024340 - DNA, 18 bp, Homo sapiens
cttttcaggaagctctct

SEQ ID NO: 4024341 - DNA, 21 bp, Homo sapiens
cttttcaggtttgtcatcaga

SEQ ID NO: 4024342 - DNA, 14 bp, Homo sapiens
cttttcattgctgt

SEQ ID NO: 4024343 - DNA, 14 bp, Homo sapiens
cttttccagagcat

SEQ ID NO: 4024344 - DNA, 24 bp, Homo sapiens
cttttgctgcgcaccaatgcccag

SEQ ID NO: 4024345 - DNA, 17 bp, Homo sapiens
cttttgcttgatccaga

SEQ ID NO: 4024346 - DNA, 15 bp, Homo sapiens
cttttggcactgaga

SEQ ID NO: 4024347 - DNA, 11 bp, Homo sapiens
cttttgggaag

SEQ ID NO: 4024348 - DNA, 19 bp, Homo sapiens
cttttggggagggagggga

SEQ ID NO: 4024349 - DNA, 14 bp, Homo sapiens
cttttgtaattgtg

SEQ ID NO: 4024350 - DNA, 12 bp, Homo sapiens
cttttgtactga

SEQ ID NO: 4024351 - DNA, 16 bp, Homo sapiens
cttttgtctaattaaa

SEQ ID NO: 4024352 - DNA, 18 bp, Homo sapiens
cttttgtgcctggcttct

SEQ ID NO: 4024353 - DNA, 15 bp, Homo sapiens
cttttgtggagggga

SEQ ID NO: 4024354 - DNA, 21 bp, Homo sapiens
cttttgtggaggggagggatg

SEQ ID NO: 4024355 - DNA, 23 bp, Homo sapiens
cttttgtgtacagtgtgtaaagt

SEQ ID NO: 4024356 - DNA, 17 bp, Homo sapiens
cttttgtgtgaattgac

SEQ ID NO: 4024357 - DNA, 17 bp, Homo sapiens
cttttgttattccatca

SEQ ID NO: 4024358 - DNA, 18 bp, Homo sapiens
cttttgttattccatcaa

SEQ ID NO: 4024359 - DNA, 16 bp, Homo sapiens
cttttgttcatttcat

SEQ ID NO: 4024360 - DNA, 22 bp, Homo sapiens
cttttgttcatttcatcctttc

SEQ ID NO: 4024361 - DNA, 13 bp, Homo sapiens
cttttgttcgcat

SEQ ID NO: 4024362 - DNA, 21 bp, Homo sapiens
cttttgtttcccttgctttgt

SEQ ID NO: 4024363 - DNA, 15 bp, Homo sapiens
ctttttaaatgtgaa

SEQ ID NO: 4024364 - DNA, 16 bp, Homo sapiens
ctttttaatatgctta

SEQ ID NO: 4024365 - DNA, 22 bp, Homo sapiens
ctttttaattattttaaaatat

SEQ ID NO: 4024366 - DNA, 16 bp, Homo sapiens
ctttttaattgttgtt

SEQ ID NO: 4024367 - DNA, 15 bp, Homo sapiens
ctttttccatcattt

SEQ ID NO: 4024368 - DNA, 17 bp, Homo sapiens
ctttttcccctttctgt

SEQ ID NO: 4024369 - DNA, 16 bp, Homo sapiens
ctttttcctctgagcc

SEQ ID NO: 4024370 - DNA, 18 bp, Homo sapiens
ctttttcctctgagccca

SEQ ID NO: 4024371 - DNA, 18 bp, Homo sapiens
ctttttctaatgtggtta

SEQ ID NO: 4024372 - DNA, 18 bp, Homo sapiens
ctttttctgattagcttt

SEQ ID NO: 4024373 - DNA, 22 bp, Homo sapiens
ctttttctgattagctttgtgt

SEQ ID NO: 4024374 - DNA, 22 bp, Homo sapiens
ctttttcttgatcttaaagatc

SEQ ID NO: 4024375 - DNA, 12 bp, Homo sapiens
ctttttctttat

SEQ ID NO: 4024376 - DNA, 18 bp, Homo sapiens
ctttttctttataaactt

SEQ ID NO: 4024377 - DNA, 12 bp, Homo sapiens
ctttttgtaaat

SEQ ID NO: 4024378 - DNA, 16 bp, Homo sapiens
ctttttgtaaatactg

SEQ ID NO: 4024379 - DNA, 13 bp, Homo sapiens
ctttttgtataaa

SEQ ID NO: 4024380 - DNA, 16 bp, Homo sapiens
cttttttcaaaagaaa

SEQ ID NO: 4024381 - DNA, 14 bp, Homo sapiens
cttttttcatttct

SEQ ID NO: 4024382 - DNA, 13 bp, Homo sapiens
cttttttcctaat

SEQ ID NO: 4024383 - DNA, 18 bp, Homo sapiens
cttttttccttaatccag

SEQ ID NO: 4024384 - DNA, 16 bp, Homo sapiens
cttttttctttaagat

SEQ ID NO: 4024385 - DNA, 13 bp, Homo sapiens
ctttttttccttt

SEQ ID NO: 4024386 - DNA, 23 bp, Homo sapiens
ctttttttggtataatgtttaaa

SEQ ID NO: 4024387 - DNA, 16 bp, Homo sapiens
ctttttttgtatgtgt

SEQ ID NO: 4024388 - DNA, 14 bp, Homo sapiens
cttttttttcttta

SEQ ID NO: 4024389 - DNA, 14 bp, Homo sapiens
ctttttttttaagt

SEQ ID NO: 4024390 - DNA, 21 bp, Homo sapiens
ctttttttttaagttcttatg

SEQ ID NO: 4024391 - DNA, 20 bp, Homo sapiens
ctttttttttgaaacagcag

SEQ ID NO: 4024392 - DNA, 21 bp, Homo sapiens
ctttttttttttttttgaaag

SEQ ID NO: 4024393 - DNA, 22 bp, Homo sapiens
ctttttttttttttttttggtc

SEQ ID NO: 4024394 - DNA, 17 bp, Homo sapiens
gaaaaaaaaaaaagaaa

SEQ ID NO: 4024395 - DNA, 11 bp, Homo sapiens
gaaaaaaaaga

SEQ ID NO: 4024396 - DNA, 16 bp, Homo sapiens
gaaaaaaaagaaaaaa

SEQ ID NO: 4024397 - DNA, 19 bp, Homo sapiens
gaaaaaaaagtttcagaga

SEQ ID NO: 4024398 - DNA, 22 bp, Homo sapiens
gaaaaaaaagtttcagagaagt

SEQ ID NO: 4024399 - DNA, 20 bp, Homo sapiens
gaaaaaaaataacacagaga

SEQ ID NO: 4024400 - DNA, 20 bp, Homo sapiens
gaaaaaaaatgttctttggg

SEQ ID NO: 4024401 - DNA, 18 bp, Homo sapiens
gaaaaaaacataaaaagc

SEQ ID NO: 4024402 - DNA, 18 bp, Homo sapiens
gaaaaaaaccacacaaag

SEQ ID NO: 4024403 - DNA, 22 bp, Homo sapiens
gaaaaaaccgtgtttgtctctt

SEQ ID NO: 4024404 - DNA, 20 bp, Homo sapiens
gaaaaaagcacatacattaa

SEQ ID NO: 4024405 - DNA, 12 bp, Homo sapiens
ctgtcctacctt

SEQ ID NO: 4024406 - DNA, 13 bp, Homo sapiens
ctgtcctcagcct

SEQ ID NO: 4024407 - DNA, 18 bp, Homo sapiens
ctgtcctcagccttgcca

SEQ ID NO: 4024408 - DNA, 20 bp, Homo sapiens
ctgtcctcagccttgccaga

SEQ ID NO: 4024409 - DNA, 14 bp, Homo sapiens
ctgtcctcatgacc

SEQ ID NO: 4024410 - DNA, 15 bp, Homo sapiens
ctgtcctccaacacc

SEQ ID NO: 4024411 - DNA, 23 bp, Homo sapiens
ctgtcctccaacaccaagcacag

SEQ ID NO: 4024412 - DNA, 16 bp, Homo sapiens
ctgtcctcccatcccc

SEQ ID NO: 4024413 - DNA, 14 bp, Homo sapiens
ctgtcctccctctg

SEQ ID NO: 4024414 - DNA, 16 bp, Homo sapiens
ctgtcctctcccctcc

SEQ ID NO: 4024415 - DNA, 12 bp, Homo sapiens
ctgtcctgatct

SEQ ID NO: 4024416 - DNA, 17 bp, Homo sapiens
ctgtcctgatctgtgat

SEQ ID NO: 4024417 - DNA, 13 bp, Homo sapiens
ctgtcctgcagca

SEQ ID NO: 4024418 - DNA, 22 bp, Homo sapiens
ctgtcctgggcatgggtccagg

SEQ ID NO: 4024419 - DNA, 13 bp, Homo sapiens
ctgtcctgggcct

SEQ ID NO: 4024420 - DNA, 21 bp, Homo sapiens
ctgtccttaacccacctctcc

SEQ ID NO: 4024421 - DNA, 21 bp, Homo sapiens
ctgtccttttcccctacagaa

SEQ ID NO: 4024422 - DNA, 18 bp, Homo sapiens
ctgtcgagacacttgcct

SEQ ID NO: 4024423 - DNA, 15 bp, Homo sapiens
ctgtcgccccaggcc

SEQ ID NO: 4024424 - DNA, 17 bp, Homo sapiens
ctgtcgccccaggccct

SEQ ID NO: 4024425 - DNA, 20 bp, Homo sapiens
ctgtcgccccaggccctccc

SEQ ID NO: 4024426 - DNA, 22 bp, Homo sapiens
ctgtcgccccaggccctccctg

SEQ ID NO: 4024427 - DNA, 15 bp, Homo sapiens
ctgtcgtgatggggc

SEQ ID NO: 4024428 - DNA, 21 bp, Homo sapiens
ctgtcgtgatggggcaagggc

SEQ ID NO: 4024429 - DNA, 12 bp, Homo sapiens
ctgtcgtgccag

SEQ ID NO: 4024430 - DNA, 16 bp, Homo sapiens
ctgtcgtgccagtcct

SEQ ID NO: 4024431 - DNA, 17 bp, Homo sapiens
ctgtcgtgccagtcctg

SEQ ID NO: 4024432 - DNA, 23 bp, Homo sapiens
ctgtcgttgttgtggaagcatgt

SEQ ID NO: 4024433 - DNA, 15 bp, Homo sapiens
ctgtctaacccccag

SEQ ID NO: 4024434 - DNA, 16 bp, Homo sapiens
ctgtctagcacttcct

SEQ ID NO: 4024435 - DNA, 17 bp, Homo sapiens
ctgtctaggtctcctca

SEQ ID NO: 4024436 - DNA, 19 bp, Homo sapiens
ctgtctcaagagggcactg

SEQ ID NO: 4024437 - DNA, 20 bp, Homo sapiens
ctgtctcaagagggcactgg

SEQ ID NO: 4024438 - DNA, 12 bp, Homo sapiens
ctgtctcagcct

SEQ ID NO: 4024439 - DNA, 16 bp, Homo sapiens
ctgtctcagcctccca

SEQ ID NO: 4024440 - DNA, 15 bp, Homo sapiens
ctgtctcatccccag

SEQ ID NO: 4024441 - DNA, 20 bp, Homo sapiens
ctgtctcatccccaggggtc

SEQ ID NO: 4024442 - DNA, 19 bp, Homo sapiens
ctgtttataatctgaagat

SEQ ID NO: 4024443 - DNA, 20 bp, Homo sapiens
ctgtttataatctgaagata

SEQ ID NO: 4024444 - DNA, 16 bp, Homo sapiens
ctgtttatggcctcag

SEQ ID NO: 4024445 - DNA, 17 bp, Homo sapiens
ctgtttatggcctcagc

SEQ ID NO: 4024446 - DNA, 19 bp, Homo sapiens
ctgtttatggcctcagctg

SEQ ID NO: 4024447 - DNA, 21 bp, Homo sapiens
ctgtttatggcctcagctgcc

SEQ ID NO: 4024448 - DNA, 15 bp, Homo sapiens
ctgtttattcccatc

SEQ ID NO: 4024449 - DNA, 17 bp, Homo sapiens
ctgtttattcttccaga

SEQ ID NO: 4024450 - DNA, 18 bp, Homo sapiens
ctgtttattcttccagaa

SEQ ID NO: 4024451 - DNA, 19 bp, Homo sapiens
ctgtttattcttccagaat

SEQ ID NO: 4024452 - DNA, 22 bp, Homo sapiens
ctgtttattcttccagaatgct

SEQ ID NO: 4024453 - DNA, 22 bp, Homo sapiens
ctgtttcactgaaatgtttgga

SEQ ID NO: 4024454 - DNA, 11 bp, Homo sapiens
ctgtttctcat

SEQ ID NO: 4024455 - DNA, 13 bp, Homo sapiens
ctgtttctcatga

SEQ ID NO: 4024456 - DNA, 14 bp, Homo sapiens
ctgtttctcatgaa

SEQ ID NO: 4024457 - DNA, 15 bp, Homo sapiens
ctgtttctcatgaag

SEQ ID NO: 4024458 - DNA, 17 bp, Homo sapiens
ctgtttctcatgaagct

SEQ ID NO: 4024459 - DNA, 13 bp, Homo sapiens
ctgtttctctgct

SEQ ID NO: 4024460 - DNA, 15 bp, Homo sapiens
ctgtttgacacctct

SEQ ID NO: 4024461 - DNA, 19 bp, Homo sapiens
ctgtttgacacctcttttt

SEQ ID NO: 4024462 - DNA, 23 bp, Homo sapiens
ctgtttgatgctatttatgcaag

SEQ ID NO: 4024463 - DNA, 13 bp, Homo sapiens
ctgtttgtaaatt

SEQ ID NO: 4024464 - DNA, 15 bp, Homo sapiens
ctgtttgtaaattat

SEQ ID NO: 4024465 - DNA, 19 bp, Homo sapiens
ctgtttgtaaattatttgc

SEQ ID NO: 4024466 - DNA, 22 bp, Homo sapiens
ctgtttgtaaattatttgctaa

SEQ ID NO: 4024467 - DNA, 22 bp, Homo sapiens
ctgtttgtcctgagatggaaaa

SEQ ID NO: 4024468 - DNA, 12 bp, Homo sapiens
ctgttttaaatt

SEQ ID NO: 4024469 - DNA, 14 bp, Homo sapiens
ctgttttatactgt

SEQ ID NO: 4024470 - DNA, 13 bp, Homo sapiens
ctgttttccccca

SEQ ID NO: 4024471 - DNA, 17 bp, Homo sapiens
ctgttttcccccagcaa

SEQ ID NO: 4024472 - DNA, 17 bp, Homo sapiens
ctgttttctgtttgtaa

SEQ ID NO: 4024473 - DNA, 21 bp, Homo sapiens
ctgttttgtttggcaaggaaa

SEQ ID NO: 4024474 - DNA, 21 bp, Homo sapiens
ctgtttttctctaatgcttga

SEQ ID NO: 4024475 - DNA, 15 bp, Homo sapiens
cttaaaaaattgaaa

SEQ ID NO: 4024476 - DNA, 13 bp, Homo sapiens
cttaaaaaggaac

SEQ ID NO: 4024477 - DNA, 22 bp, Homo sapiens
cttaaaaatcacactgtaaata

SEQ ID NO: 4024478 - DNA, 14 bp, Homo sapiens
cttaaaaccaaaga

SEQ ID NO: 4024479 - DNA, 15 bp, Homo sapiens
cttaaaaccaaagag

SEQ ID NO: 4024480 - DNA, 21 bp, Homo sapiens
cttaaaaccaaagagggcttc

SEQ ID NO: 4024481 - DNA, 21 bp, Homo sapiens
cttaaaataaacagttgtgaa

SEQ ID NO: 4024482 - DNA, 23 bp, Homo sapiens
cttaaaataaacagttgtgaacc

SEQ ID NO: 4024483 - DNA, 22 bp, Homo sapiens
cttaaaataatgaatacatttc

SEQ ID NO: 4024484 - DNA, 17 bp, Homo sapiens
cttaaaatatatttcag

SEQ ID NO: 4024485 - DNA, 17 bp, Homo sapiens
cttaaacacaggctgtc

SEQ ID NO: 4024486 - DNA, 21 bp, Homo sapiens
cttaaacacaggctgtcctta

SEQ ID NO: 4024487 - DNA, 20 bp, Homo sapiens
cttaaaccaacctttaaaat

SEQ ID NO: 4024488 - DNA, 15 bp, Homo sapiens
cttaaacctggaatc

SEQ ID NO: 4024489 - DNA, 15 bp, Homo sapiens
cttaaactaaataat

SEQ ID NO: 4024490 - DNA, 16 bp, Homo sapiens
cttaaactaaataatg

SEQ ID NO: 4024491 - DNA, 17 bp, Homo sapiens
cttaaactgtacagaat

SEQ ID NO: 4024492 - DNA, 15 bp, Homo sapiens
cttaaagttgtcact

SEQ ID NO: 4024493 - DNA, 15 bp, Homo sapiens
cttaaatcagaataa

SEQ ID NO: 4024494 - DNA, 17 bp, Homo sapiens
cttaaattatgttttaa

SEQ ID NO: 4024495 - DNA, 19 bp, Homo sapiens
cttaaatttcttatgtgac

SEQ ID NO: 4024496 - DNA, 15 bp, Homo sapiens
cttaaatttgtttaa

SEQ ID NO: 4024497 - DNA, 17 bp, Homo sapiens
cttaacaaaccaacatc

SEQ ID NO: 4024498 - DNA, 20 bp, Homo sapiens
cttaacaaaccaacatcttt

SEQ ID NO: 4024499 - DNA, 23 bp, Homo sapiens
cttaacaatttctgtccttcaga

SEQ ID NO: 4024500 - DNA, 14 bp, Homo sapiens
cttaacccacctct

SEQ ID NO: 4024501 - DNA, 17 bp, Homo sapiens
cttaacccacctctcct

SEQ ID NO: 4024502 - DNA, 22 bp, Homo sapiens
cttaacccacctctcctgccct

SEQ ID NO: 4024503 - DNA, 14 bp, Homo sapiens
cttaacggctccag

SEQ ID NO: 4024504 - DNA, 15 bp, Homo sapiens
cttaacggctccagg

SEQ ID NO: 4024505 - DNA, 16 bp, Homo sapiens
cttaacggctccagga

SEQ ID NO: 4024506 - DNA, 15 bp, Homo sapiens
cttaactaatttgaa

SEQ ID NO: 4024507 - DNA, 19 bp, Homo sapiens
cttaactgcatttttagac

SEQ ID NO: 4024508 - DNA, 22 bp, Homo sapiens
cttaactgtggtgttgaggctt

SEQ ID NO: 4024509 - DNA, 11 bp, Homo sapiens
cttaagaacac

SEQ ID NO: 4024510 - DNA, 14 bp, Homo sapiens
cttaagcaaaagaa

SEQ ID NO: 4024511 - DNA, 12 bp, Homo sapiens
cttaagcaaagg

SEQ ID NO: 4024512 - DNA, 19 bp, Homo sapiens
cttaagcaaaggggacagc

SEQ ID NO: 4024513 - DNA, 19 bp, Homo sapiens
cttaagcagcatggaaaaa

SEQ ID NO: 4024514 - DNA, 11 bp, Homo sapiens
cttaagctgat

SEQ ID NO: 4024515 - DNA, 20 bp, Homo sapiens
cttaaggggggcagggagtg

SEQ ID NO: 4024516 - DNA, 19 bp, Homo sapiens
cttaataaactgtggtgct

SEQ ID NO: 4024517 - DNA, 17 bp, Homo sapiens
cttaataaattcagata

SEQ ID NO: 4024518 - DNA, 16 bp, Homo sapiens
cttaatactaccttga

SEQ ID NO: 4024519 - DNA, 14 bp, Homo sapiens
cttaatatatttga

SEQ ID NO: 4024520 - DNA, 22 bp, Homo sapiens
cttaatctaatctaaaagctct

SEQ ID NO: 4024521 - DNA, 12 bp, Homo sapiens
cttaatgaaata

SEQ ID NO: 4024522 - DNA, 15 bp, Homo sapiens
ctgtaggtggtatgt

SEQ ID NO: 4024523 - DNA, 18 bp, Homo sapiens
ctgtaggttatttaaaat

SEQ ID NO: 4024524 - DNA, 14 bp, Homo sapiens
ctgtagtcccagcc

SEQ ID NO: 4024525 - DNA, 17 bp, Homo sapiens
ctgtagtcccagccact

SEQ ID NO: 4024526 - DNA, 21 bp, Homo sapiens
ctgtagtgtagtcaggtgctc

SEQ ID NO: 4024527 - DNA, 15 bp, Homo sapiens
ctgtataaagcatgt

SEQ ID NO: 4024528 - DNA, 13 bp, Homo sapiens
ctgtataaatagg

SEQ ID NO: 4024529 - DNA, 14 bp, Homo sapiens
ctgtataaatagga

SEQ ID NO: 4024530 - DNA, 13 bp, Homo sapiens
ctgtataaatgtc

SEQ ID NO: 4024531 - DNA, 17 bp, Homo sapiens
ctgtataaatgtctatt

SEQ ID NO: 4024532 - DNA, 22 bp, Homo sapiens
ctgtataagtggaggcacttta

SEQ ID NO: 4024533 - DNA, 13 bp, Homo sapiens
ctgtatagaaatc

SEQ ID NO: 4024534 - DNA, 14 bp, Homo sapiens
ctgtatagacatgc

SEQ ID NO: 4024535 - DNA, 15 bp, Homo sapiens
ctgtatataaaggtg

SEQ ID NO: 4024536 - DNA, 23 bp, Homo sapiens
ctgtatatttgtgatagcacttt

SEQ ID NO: 4024537 - DNA, 17 bp, Homo sapiens
ctgtatcggagacagtg

SEQ ID NO: 4024538 - DNA, 20 bp, Homo sapiens
ctgtatgaaaaattggggag

SEQ ID NO: 4024539 - DNA, 13 bp, Homo sapiens
ctgtatgatttgt

SEQ ID NO: 4024540 - DNA, 15 bp, Homo sapiens
ctgtatgatttgttt

SEQ ID NO: 4024541 - DNA, 18 bp, Homo sapiens
ctgtatgatttgttttga

SEQ ID NO: 4024542 - DNA, 16 bp, Homo sapiens
ctgtatgctgatcatc

SEQ ID NO: 4024543 - DNA, 19 bp, Homo sapiens
ctgtatggaaacactgatt

SEQ ID NO: 4024544 - DNA, 18 bp, Homo sapiens
ctgtattcccatatcaaa

SEQ ID NO: 4024545 - DNA, 20 bp, Homo sapiens
ctgtattccgatacaaagtg

SEQ ID NO: 4024546 - DNA, 16 bp, Homo sapiens
ctgtattcgtgcattt

SEQ ID NO: 4024547 - DNA, 13 bp, Homo sapiens
ctgtattgtctga

SEQ ID NO: 4024548 - DNA, 14 bp, Homo sapiens
ctgtattgtctgaa

SEQ ID NO: 4024549 - DNA, 21 bp, Homo sapiens
ctgtattgtgctgattgtgga

SEQ ID NO: 4024550 - DNA, 14 bp, Homo sapiens
ctgtatttcatgtg

SEQ ID NO: 4024551 - DNA, 17 bp, Homo sapiens
ctgtatttcatgtggct

SEQ ID NO: 4024552 - DNA, 19 bp, Homo sapiens
ctgtatttcatgtggctgt

SEQ ID NO: 4024553 - DNA, 12 bp, Homo sapiens
ctgtatttcctt

SEQ ID NO: 4024554 - DNA, 22 bp, Homo sapiens
ctgtattttatttagacaagag

SEQ ID NO: 4024555 - DNA, 23 bp, Homo sapiens
ctgtattttatttagacaagaga

SEQ ID NO: 4024556 - DNA, 14 bp, Homo sapiens
ctgtatttttgtta

SEQ ID NO: 4024557 - DNA, 18 bp, Homo sapiens
ctgtatttttgttagttt

SEQ ID NO: 4024558 - DNA, 23 bp, Homo sapiens
ctgtatttttgttagtttacaat

SEQ ID NO: 4024559 - DNA, 22 bp, Homo sapiens
ctgtatttttttttctaagaga

SEQ ID NO: 4024560 - DNA, 17 bp, Homo sapiens
ctgtcaaggctgcttag

SEQ ID NO: 4024561 - DNA, 19 bp, Homo sapiens
ctgtcaaggctgcttagaa

SEQ ID NO: 4024562 - DNA, 21 bp, Homo sapiens
ctgtcaagtgggatctgtcac

SEQ ID NO: 4024563 - DNA, 14 bp, Homo sapiens
ctgtcaagttaaca

SEQ ID NO: 4024564 - DNA, 17 bp, Homo sapiens
ctgtcaatttccctgac

SEQ ID NO: 4024565 - DNA, 17 bp, Homo sapiens
ctggctgaggttcctct

SEQ ID NO: 4024566 - DNA, 19 bp, Homo sapiens
ctggctgaggttcctctgc

SEQ ID NO: 4024567 - DNA, 12 bp, Homo sapiens
ctggctgatgat

SEQ ID NO: 4024568 - DNA, 12 bp, Homo sapiens
ctggctgcagct

SEQ ID NO: 4024569 - DNA, 13 bp, Homo sapiens
ctggctgcagctg

SEQ ID NO: 4024570 - DNA, 14 bp, Homo sapiens
ctggctgcagctgg

SEQ ID NO: 4024571 - DNA, 16 bp, Homo sapiens
ctggctgcagctgggc

SEQ ID NO: 4024572 - DNA, 18 bp, Homo sapiens
ctggctgcccagacccct

SEQ ID NO: 4024573 - DNA, 20 bp, Homo sapiens
ctggctgccccaacctgctg

SEQ ID NO: 4024574 - DNA, 14 bp, Homo sapiens
ctggctgcccctca

SEQ ID NO: 4024575 - DNA, 14 bp, Homo sapiens
ctggctgccttaga

SEQ ID NO: 4024576 - DNA, 14 bp, Homo sapiens
ctggctgctgcccc

SEQ ID NO: 4024577 - DNA, 21 bp, Homo sapiens
ctggctggaggagcagcagct

SEQ ID NO: 4024578 - DNA, 17 bp, Homo sapiens
ctggctggcctcaccca

SEQ ID NO: 4024579 - DNA, 16 bp, Homo sapiens
ctggctggcctgagca

SEQ ID NO: 4024580 - DNA, 17 bp, Homo sapiens
ctggctggcctgagcaa

SEQ ID NO: 4024581 - DNA, 16 bp, Homo sapiens
ctggctggctcctagg

SEQ ID NO: 4024582 - DNA, 13 bp, Homo sapiens
ctggctgggttca

SEQ ID NO: 4024583 - DNA, 17 bp, Homo sapiens
ctggctggtcctcccat

SEQ ID NO: 4024584 - DNA, 18 bp, Homo sapiens
ctggctgtttagcagaac

SEQ ID NO: 4024585 - DNA, 18 bp, Homo sapiens
ctggcttccagcttcagg

SEQ ID NO: 4024586 - DNA, 20 bp, Homo sapiens
ctggcttccagcttcaggca

SEQ ID NO: 4024587 - DNA, 24 bp, Homo sapiens
ctggcttccagcttcaggcaccag

SEQ ID NO: 4024588 - DNA, 12 bp, Homo sapiens
ctggcttccagg

SEQ ID NO: 4024589 - DNA, 16 bp, Homo sapiens
ctggcttgacagcatg

SEQ ID NO: 4024590 - DNA, 14 bp, Homo sapiens
ctggctttcccagg

SEQ ID NO: 4024591 - DNA, 15 bp, Homo sapiens
ctggctttcccagga

SEQ ID NO: 4024592 - DNA, 16 bp, Homo sapiens
ctggctttcccaggag

SEQ ID NO: 4024593 - DNA, 20 bp, Homo sapiens
ctggctttgaaacctcaggg

SEQ ID NO: 4024594 - DNA, 15 bp, Homo sapiens
ctggctttgcacttg

SEQ ID NO: 4024595 - DNA, 15 bp, Homo sapiens
ctggctttgcctctt

SEQ ID NO: 4024596 - DNA, 16 bp, Homo sapiens
ctggctttgcctcttc

SEQ ID NO: 4024597 - DNA, 22 bp, Homo sapiens
ctggctttgcctcttctttgtg

SEQ ID NO: 4024598 - DNA, 16 bp, Homo sapiens
ctggcttttcactgct

SEQ ID NO: 4024599 - DNA, 17 bp, Homo sapiens
ctggcttttcactgctg

SEQ ID NO: 4024600 - DNA, 17 bp, Homo sapiens
ctggctttttcctctga

SEQ ID NO: 4024601 - DNA, 18 bp, Homo sapiens
ctggctttttcctctgag

SEQ ID NO: 4024602 - DNA, 19 bp, Homo sapiens
ctggctttttcctctgagc

SEQ ID NO: 4024603 - DNA, 21 bp, Homo sapiens
ctggctttttcctctgagccc

SEQ ID NO: 4024604 - DNA, 23 bp, Homo sapiens
ctggctttttcctctgagcccag

SEQ ID NO: 4024605 - DNA, 19 bp, Homo sapiens
ctgggaacttgcgagtcca

SEQ ID NO: 4024606 - DNA, 18 bp, Homo sapiens
ctgggaagataggctctg

SEQ ID NO: 4024607 - DNA, 18 bp, Homo sapiens
ctgggaatgtattattct

SEQ ID NO: 4024608 - DNA, 19 bp, Homo sapiens
ctgggacacttaacagatg

SEQ ID NO: 4024609 - DNA, 23 bp, Homo sapiens
ctgggacacttaacagatgcaat

SEQ ID NO: 4024610 - DNA, 22 bp, Homo sapiens
ctgggaccacaggttcatgcca

SEQ ID NO: 4024611 - DNA, 15 bp, Homo sapiens
ctgggaccagagcca

SEQ ID NO: 4024612 - DNA, 16 bp, Homo sapiens
ctgggaccagagccag

SEQ ID NO: 4024613 - DNA, 19 bp, Homo sapiens
ctgggacctgccaggcagg

SEQ ID NO: 4024614 - DNA, 14 bp, Homo sapiens
ctgggacgctctgc

SEQ ID NO: 4024615 - DNA, 15 bp, Homo sapiens
ctgggacgctctgct

SEQ ID NO: 4024616 - DNA, 15 bp, Homo sapiens
ctgggacgtggctca

SEQ ID NO: 4024617 - DNA, 23 bp, Homo sapiens
ctgggacgtggctcagccagcac

SEQ ID NO: 4024618 - DNA, 19 bp, Homo sapiens
ctgggacttccatgcctta

SEQ ID NO: 4024619 - DNA, 18 bp, Homo sapiens
ctgggagccacttctccc

SEQ ID NO: 4024620 - DNA, 15 bp, Homo sapiens
ctgggagcccagagg

SEQ ID NO: 4024621 - DNA, 15 bp, Homo sapiens
ctgggaggaggggga

SEQ ID NO: 4024622 - DNA, 20 bp, Homo sapiens
ctgggaggagggggagggtg

SEQ ID NO: 4024623 - DNA, 22 bp, Homo sapiens
ctgggaggcggagagtacagtg

SEQ ID NO: 4024624 - DNA, 16 bp, Homo sapiens
ctgggagtcacacagt

SEQ ID NO: 4024625 - DNA, 13 bp, Homo sapiens
ctgggagtcagag

SEQ ID NO: 4024626 - DNA, 14 bp, Homo sapiens
ctgggagtcagagc

SEQ ID NO: 4024627 - DNA, 19 bp, Homo sapiens
ctgggagttctagaaccac

SEQ ID NO: 4024628 - DNA, 17 bp, Homo sapiens
ctgggataggggcagag

SEQ ID NO: 4024629 - DNA, 19 bp, Homo sapiens
ctgggatatctttacaagc

SEQ ID NO: 4024630 - DNA, 15 bp, Homo sapiens
ctgggatatggctgc

SEQ ID NO: 4024631 - DNA, 18 bp, Homo sapiens
ctgggatatggctgccca

SEQ ID NO: 4024632 - DNA, 17 bp, Homo sapiens
ctgggatgagccgctgt

SEQ ID NO: 4024633 - DNA, 20 bp, Homo sapiens
ctgggattcccaccaaggtc

SEQ ID NO: 4024634 - DNA, 22 bp, Homo sapiens
ctgggcaaagccacaaggctgg

SEQ ID NO: 4024635 - DNA, 23 bp, Homo sapiens
ctgggcacagctcttcacaccat

SEQ ID NO: 4024636 - DNA, 22 bp, Homo sapiens
ctgggcacagtggactcagcag

SEQ ID NO: 4024637 - DNA, 16 bp, Homo sapiens
ctgggcacgcctgctg

SEQ ID NO: 4024638 - DNA, 18 bp, Homo sapiens
ctgggcagcatagcaaga

SEQ ID NO: 4024639 - DNA, 15 bp, Homo sapiens
ctgggcagccaggct

SEQ ID NO: 4024640 - DNA, 14 bp, Homo sapiens
ctgggcagccccag

SEQ ID NO: 4024641 - DNA, 16 bp, Homo sapiens
ctgggcatgggtccag

SEQ ID NO: 4024642 - DNA, 22 bp, Homo sapiens
ctgggcatgggtccagggcctg

SEQ ID NO: 4024643 - DNA, 13 bp, Homo sapiens
ctgggcattgctt

SEQ ID NO: 4024644 - DNA, 14 bp, Homo sapiens
ctgggcattgcttt

SEQ ID NO: 4024645 - DNA, 14 bp, Homo sapiens
ctgggccacggagg

SEQ ID NO: 4024646 - DNA, 22 bp, Homo sapiens
ctgggccacggaggagggatgc

SEQ ID NO: 4024647 - DNA, 19 bp, Homo sapiens
aggaggccaaactgtccct

SEQ ID NO: 4024648 - DNA, 15 bp, Homo sapiens
aggaggccagtgggc

SEQ ID NO: 4024649 - DNA, 15 bp, Homo sapiens
aggaggcctccatct

SEQ ID NO: 4024650 - DNA, 16 bp, Homo sapiens
aggaggcctgtcccaa

SEQ ID NO: 4024651 - DNA, 19 bp, Homo sapiens
aggaggcggcccggccagc

SEQ ID NO: 4024652 - DNA, 21 bp, Homo sapiens
aggaggcgtctcgggagagga

SEQ ID NO: 4024653 - DNA, 12 bp, Homo sapiens
aggaggctccag

SEQ ID NO: 4024654 - DNA, 17 bp, Homo sapiens
aggaggctccaggcagc

SEQ ID NO: 4024655 - DNA, 17 bp, Homo sapiens
aggaggctgaggcagga

SEQ ID NO: 4024656 - DNA, 19 bp, Homo sapiens
aggaggctgaggcaggagg

SEQ ID NO: 4024657 - DNA, 12 bp, Homo sapiens
aggaggctggag

SEQ ID NO: 4024658 - DNA, 18 bp, Homo sapiens
aggaggctggaggaaggg

SEQ ID NO: 4024659 - DNA, 13 bp, Homo sapiens
aggagggagaggg

SEQ ID NO: 4024660 - DNA, 14 bp, Homo sapiens
aggagggagaggga

SEQ ID NO: 4024661 - DNA, 15 bp, Homo sapiens
aggagggagagggag

SEQ ID NO: 4024662 - DNA, 15 bp, Homo sapiens
aggagggagggggct

SEQ ID NO: 4024663 - DNA, 13 bp, Homo sapiens
aggagggatgctg

SEQ ID NO: 4024664 - DNA, 14 bp, Homo sapiens
aggagggatgctgc

SEQ ID NO: 4024665 - DNA, 15 bp, Homo sapiens
aggagggcagaggga

SEQ ID NO: 4024666 - DNA, 22 bp, Homo sapiens
aggagggcatccataccagctc

SEQ ID NO: 4024667 - DNA, 14 bp, Homo sapiens
aggagggggagggt

SEQ ID NO: 4024668 - DNA, 19 bp, Homo sapiens
gtagccccctggcctctgt

SEQ ID NO: 4024669 - DNA, 23 bp, Homo sapiens
gtagccccctggcctctgtgcct

SEQ ID NO: 4024670 - DNA, 15 bp, Homo sapiens
gtagccgggctctgc

SEQ ID NO: 4024671 - DNA, 18 bp, Homo sapiens
gtagccgggctctgcacc

SEQ ID NO: 4024672 - DNA, 11 bp, Homo sapiens
gtagccttttt

SEQ ID NO: 4024673 - DNA, 22 bp, Homo sapiens
gtagcgttttttaaatgtatac

SEQ ID NO: 4024674 - DNA, 23 bp, Homo sapiens
gtagctcctcaactcacctaatg

SEQ ID NO: 4024675 - DNA, 16 bp, Homo sapiens
gtagcttcttctgaaa

SEQ ID NO: 4024676 - DNA, 22 bp, Homo sapiens
gtaggagctgccttggctcaga

SEQ ID NO: 4024677 - DNA, 20 bp, Homo sapiens
tggggtatttaccacagcag

SEQ ID NO: 4024678 - DNA, 12 bp, Homo sapiens
tggggtattttt

SEQ ID NO: 4024679 - DNA, 21 bp, Homo sapiens
tggggtcaagaaacagccagc

SEQ ID NO: 4024680 - DNA, 20 bp, Homo sapiens
tggggtcaggccgggcagag

SEQ ID NO: 4024681 - DNA, 22 bp, Homo sapiens
tggggtcaggccgggcagagca

SEQ ID NO: 4024682 - DNA, 14 bp, Homo sapiens
tggggtcctgggct

SEQ ID NO: 4024683 - DNA, 19 bp, Homo sapiens
tggggtcctgggctggggc

SEQ ID NO: 4024684 - DNA, 21 bp, Homo sapiens
tggggtctggagttgatctgg

SEQ ID NO: 4024685 - DNA, 16 bp, Homo sapiens
ttccgtagactgttta

SEQ ID NO: 4024686 - DNA, 20 bp, Homo sapiens
ttccgtaggtagatgtgtaa

SEQ ID NO: 4024687 - DNA, 19 bp, Homo sapiens
ttccgtcacatcccacccc

SEQ ID NO: 4024688 - DNA, 13 bp, Homo sapiens
ttcctaaatgcag

SEQ ID NO: 4024689 - DNA, 18 bp, Homo sapiens
ttcctaacacagcatgtg

SEQ ID NO: 4024690 - DNA, 22 bp, Homo sapiens
ttcctaacttttcaatgacatt

SEQ ID NO: 4024691 - DNA, 21 bp, Homo sapiens
ttcctaagccacttgaaatgt

SEQ ID NO: 4024692 - DNA, 23 bp, Homo sapiens
ttcctaatcagaaatttttatca

SEQ ID NO: 4024693 - DNA, 19 bp, Homo sapiens
ttcctacaacttaatggaa

SEQ ID NO: 4024694 - DNA, 20 bp, Homo sapiens
ttcctacaagagcagcctgt

SEQ ID NO: 4024695 - DNA, 15 bp, Homo sapiens
ttcctacagcactac

SEQ ID NO: 4024696 - DNA, 20 bp, Homo sapiens
ttcctacagcactactgggt

SEQ ID NO: 4024697 - DNA, 12 bp, Homo sapiens
ttcctacagccc

SEQ ID NO: 4024698 - DNA, 12 bp, Homo sapiens
ttcctacatctt

SEQ ID NO: 4024699 - DNA, 19 bp, Homo sapiens
ttcctaccaagtcaaactt

SEQ ID NO: 4024700 - DNA, 20 bp, Homo sapiens
ttcctactcacacttcagct

SEQ ID NO: 4024701 - DNA, 15 bp, Homo sapiens
ttcctactcttctct

SEQ ID NO: 4024702 - DNA, 17 bp, Homo sapiens
ttcctactcttctctct

SEQ ID NO: 4024703 - DNA, 17 bp, Homo sapiens
ttcctaggcccaggcct

SEQ ID NO: 4024704 - DNA, 14 bp, Homo sapiens
ttcctaggggtttg

SEQ ID NO: 4024705 - DNA, 13 bp, Homo sapiens
ttcctatgcccag

SEQ ID NO: 4024706 - DNA, 22 bp, Homo sapiens
ttcctatgcccaggtaccaccc

SEQ ID NO: 4024707 - DNA, 13 bp, Homo sapiens
ttcctattgtcat

SEQ ID NO: 4024708 - DNA, 20 bp, Homo sapiens
ttcctattgtcattaaaggt

SEQ ID NO: 4024709 - DNA, 20 bp, Homo sapiens
ttcctatttgccatgggctt

SEQ ID NO: 4024710 - DNA, 22 bp, Homo sapiens
ttcctatttgccatgggcttca

SEQ ID NO: 4024711 - DNA, 14 bp, Homo sapiens
ttcctcaaattttt

SEQ ID NO: 4024712 - DNA, 18 bp, Homo sapiens
ttcctcaagtatcttcta

SEQ ID NO: 4024713 - DNA, 22 bp, Homo sapiens
ttcctcaagtatcttctatttt

SEQ ID NO: 4024714 - DNA, 19 bp, Homo sapiens
ttcctcagatgatgtttgc

SEQ ID NO: 4024715 - DNA, 22 bp, Homo sapiens
ttcctcagctggttactcaggg

SEQ ID NO: 4024716 - DNA, 12 bp, Homo sapiens
ttcctcagctta

SEQ ID NO: 4024717 - DNA, 19 bp, Homo sapiens
ttcctcccagtgagactgc

SEQ ID NO: 4024718 - DNA, 23 bp, Homo sapiens
ttcctcccagtgagactgcccca

SEQ ID NO: 4024719 - DNA, 14 bp, Homo sapiens
ttcctccccctgca

SEQ ID NO: 4024720 - DNA, 17 bp, Homo sapiens
ttcctccccctgcaact

SEQ ID NO: 4024721 - DNA, 22 bp, Homo sapiens
ttcctcctacttacaacccagg

SEQ ID NO: 4024722 - DNA, 15 bp, Homo sapiens
ttcctcgcttctttc

SEQ ID NO: 4024723 - DNA, 15 bp, Homo sapiens
ttcctctaggcaagc

SEQ ID NO: 4024724 - DNA, 14 bp, Homo sapiens
ttctttataaactt

SEQ ID NO: 4024725 - DNA, 14 bp, Homo sapiens
ttctttccattatg

SEQ ID NO: 4024726 - DNA, 17 bp, Homo sapiens
ttctttccattatgatt

SEQ ID NO: 4024727 - DNA, 19 bp, Homo sapiens
ttctttcctccccctgcaa

SEQ ID NO: 4024728 - DNA, 22 bp, Homo sapiens
ttctttctagtggtctttgtaa

SEQ ID NO: 4024729 - DNA, 23 bp, Homo sapiens
ttctttctctcagccttacattt

SEQ ID NO: 4024730 - DNA, 16 bp, Homo sapiens
ttctttgataatgtta

SEQ ID NO: 4024731 - DNA, 13 bp, Homo sapiens
ttctttgcctctg

SEQ ID NO: 4024732 - DNA, 15 bp, Homo sapiens
ttctttgtgcctttg

SEQ ID NO: 4024733 - DNA, 21 bp, Homo sapiens
ttcttttaaaggggcagaaaa

SEQ ID NO: 4024734 - DNA, 21 bp, Homo sapiens
ttcttttctggaatgtaatca

SEQ ID NO: 4024735 - DNA, 16 bp, Homo sapiens
ttcttttgtaattgtg

SEQ ID NO: 4024736 - DNA, 13 bp, Homo sapiens
ttctttttacata

SEQ ID NO: 4024737 - DNA, 17 bp, Homo sapiens
ttctttttgatcatctt

SEQ ID NO: 4024738 - DNA, 20 bp, Homo sapiens
ttgaaaaaaacttcattctc

SEQ ID NO: 4024739 - DNA, 14 bp, Homo sapiens
ttgaaaaactcttt

SEQ ID NO: 4024740 - DNA, 16 bp, Homo sapiens
ttgaaaacttcagaag

SEQ ID NO: 4024741 - DNA, 18 bp, Homo sapiens
ttgaaaacttcagaagca

SEQ ID NO: 4024742 - DNA, 15 bp, Homo sapiens
ttgaaaagaaagtgt

SEQ ID NO: 4024743 - DNA, 17 bp, Homo sapiens
ttgaaaagaaagtgttt

SEQ ID NO: 4024744 - DNA, 12 bp, Homo sapiens
ttgaaaagctat

SEQ ID NO: 4024745 - DNA, 13 bp, Homo sapiens
ttgaaaagctatt

SEQ ID NO: 4024746 - DNA, 14 bp, Homo sapiens
ttgaaaagctatta

SEQ ID NO: 4024747 - DNA, 22 bp, Homo sapiens
ttgaaaagcttcttaattaatt

SEQ ID NO: 4024748 - DNA, 15 bp, Homo sapiens
ttgaaaatgtgtttg

SEQ ID NO: 4024749 - DNA, 14 bp, Homo sapiens
ttgaaaattttact

SEQ ID NO: 4024750 - DNA, 15 bp, Homo sapiens
ttgaaaccaggacat

SEQ ID NO: 4024751 - DNA, 19 bp, Homo sapiens
ttgaaactagttattttat

SEQ ID NO: 4024752 - DNA, 13 bp, Homo sapiens
ttgaaagaccttc

SEQ ID NO: 4024753 - DNA, 17 bp, Homo sapiens
ttgaaagagaaccagtt

SEQ ID NO: 4024754 - DNA, 14 bp, Homo sapiens
ttgaaagagttaag

SEQ ID NO: 4024755 - DNA, 16 bp, Homo sapiens
ttgaaagcatccatgt

SEQ ID NO: 4024756 - DNA, 21 bp, Homo sapiens
ttgagatttttaagaacttca

SEQ ID NO: 4024757 - DNA, 19 bp, Homo sapiens
ttgagcagtggctggtcca

SEQ ID NO: 4024758 - DNA, 22 bp, Homo sapiens
ttgagccaggcctgggtctgtg

SEQ ID NO: 4024759 - DNA, 14 bp, Homo sapiens
ttgagccctggctg

SEQ ID NO: 4024760 - DNA, 11 bp, Homo sapiens
ttgagctgcct

SEQ ID NO: 4024761 - DNA, 15 bp, Homo sapiens
ttgagctgccttccc

SEQ ID NO: 4024762 - DNA, 12 bp, Homo sapiens
ttgagctgtttt

SEQ ID NO: 4024763 - DNA, 17 bp, Homo sapiens
ttgaggagctgcactga

SEQ ID NO: 4024764 - DNA, 18 bp, Homo sapiens
ttgaggcaagtgtgggcc

SEQ ID NO: 4024765 - DNA, 16 bp, Homo sapiens
ttgaggcatgcacatc

SEQ ID NO: 4024766 - DNA, 13 bp, Homo sapiens
ttgaggccaggag

SEQ ID NO: 4024767 - DNA, 13 bp, Homo sapiens
ttgaggctttgtg

SEQ ID NO: 4024768 - DNA, 17 bp, Homo sapiens
ttgaggctttgtgttgt

SEQ ID NO: 4024769 - DNA, 15 bp, Homo sapiens
ttgagggcccagagc

SEQ ID NO: 4024770 - DNA, 16 bp, Homo sapiens
ttgagggcccagagca

SEQ ID NO: 4024771 - DNA, 19 bp, Homo sapiens
ttgagggcccagagcagga

SEQ ID NO: 4024772 - DNA, 14 bp, Homo sapiens
ttgaggtcaggagt

SEQ ID NO: 4024773 - DNA, 22 bp, Homo sapiens
ttgaggtcttttgacatgtgga

SEQ ID NO: 4024774 - DNA, 17 bp, Homo sapiens
ttgagtacctactgtgt

SEQ ID NO: 4024775 - DNA, 19 bp, Homo sapiens
ttgagtacctactgtgtgc

SEQ ID NO: 4024776 - DNA, 19 bp, Homo sapiens
ttgagtataagaaatgcat

SEQ ID NO: 4024777 - DNA, 17 bp, Homo sapiens
ttgagtctcctctctga

SEQ ID NO: 4024778 - DNA, 18 bp, Homo sapiens
ttgagtctcctctctgag

SEQ ID NO: 4024779 - DNA, 12 bp, Homo sapiens
ttgagtgtgtgt

SEQ ID NO: 4024780 - DNA, 14 bp, Homo sapiens
ttgagtttttcctc

SEQ ID NO: 4024781 - DNA, 15 bp, Homo sapiens
ttgagtttttcctcc

SEQ ID NO: 4024782 - DNA, 15 bp, Homo sapiens
ttgataatgttaaat

SEQ ID NO: 4024783 - DNA, 18 bp, Homo sapiens
ttgataatgttaaatttg

SEQ ID NO: 4024784 - DNA, 19 bp, Homo sapiens
ttgatacagttttcagaaa

SEQ ID NO: 4024785 - DNA, 13 bp, Homo sapiens
ttgatacataata

SEQ ID NO: 4024786 - DNA, 17 bp, Homo sapiens
ttgatacataataaaaa

SEQ ID NO: 4024787 - DNA, 15 bp, Homo sapiens
ttgatactctttcta

SEQ ID NO: 4024788 - DNA, 20 bp, Homo sapiens
ttgatactctttctaatgct

SEQ ID NO: 4024789 - DNA, 19 bp, Homo sapiens
ttgatagctttatttttta

SEQ ID NO: 4024790 - DNA, 16 bp, Homo sapiens
ttgatatttgcattga

SEQ ID NO: 4024791 - DNA, 19 bp, Homo sapiens
ttgatcattttccccccac

SEQ ID NO: 4024792 - DNA, 20 bp, Homo sapiens
ttgatccagaagagcccata

SEQ ID NO: 4024793 - DNA, 17 bp, Homo sapiens
ttgatctctcttgtcct

SEQ ID NO: 4024794 - DNA, 14 bp, Homo sapiens
ttgatctggaaccc

SEQ ID NO: 4024795 - DNA, 15 bp, Homo sapiens
ttgatctggaaccca

SEQ ID NO: 4024796 - DNA, 19 bp, Homo sapiens
ttgatctggaacccagact

SEQ ID NO: 4024797 - DNA, 19 bp, Homo sapiens
ttgatgaaaagatttaagc

SEQ ID NO: 4024798 - DNA, 20 bp, Homo sapiens
ttgatgaaaagatttaagca

SEQ ID NO: 4024799 - DNA, 20 bp, Homo sapiens
ttgatgaaacgtcatgtgtt

SEQ ID NO: 4024800 - DNA, 16 bp, Homo sapiens
ttgatgaaagctgatt

SEQ ID NO: 4024801 - DNA, 18 bp, Homo sapiens
ttgatgaagcaaggaaga

SEQ ID NO: 4024802 - DNA, 17 bp, Homo sapiens
ttgatgaagtatacttt

SEQ ID NO: 4024803 - DNA, 21 bp, Homo sapiens
ttgatggaaaataaacatcag

SEQ ID NO: 4024804 - DNA, 14 bp, Homo sapiens
ttgatggagatatt

SEQ ID NO: 4024805 - DNA, 13 bp, Homo sapiens
ttgatgggttcta

SEQ ID NO: 4024806 - DNA, 19 bp, Homo sapiens
ttgatggtgacagctgcaa

SEQ ID NO: 4024807 - DNA, 22 bp, Homo sapiens
ttgatggtggactaagcaattt

SEQ ID NO: 4024808 - DNA, 20 bp, Homo sapiens
ttgatgtacataactcctgt

SEQ ID NO: 4024809 - DNA, 14 bp, Homo sapiens
ttgatgtatatgtt

SEQ ID NO: 4024810 - DNA, 14 bp, Homo sapiens
ttgatgtgactttt

SEQ ID NO: 4024811 - DNA, 20 bp, Homo sapiens
ttgatgtgtttatttataga

SEQ ID NO: 4024812 - DNA, 13 bp, Homo sapiens
ttgatgtttgtgg

SEQ ID NO: 4024813 - DNA, 16 bp, Homo sapiens
ttgatgtttgtggcct

SEQ ID NO: 4024814 - DNA, 20 bp, Homo sapiens
ttgatgtttgtggcctcaga

SEQ ID NO: 4024815 - DNA, 17 bp, Homo sapiens
ttgattaagattttaca

SEQ ID NO: 4024816 - DNA, 20 bp, Homo sapiens
ttgattaagattttacaaaa

SEQ ID NO: 4024817 - DNA, 21 bp, Homo sapiens
ttgattatccatattgagtca

SEQ ID NO: 4024818 - DNA, 17 bp, Homo sapiens
ttgattcattttcctgt

SEQ ID NO: 4024819 - DNA, 13 bp, Homo sapiens
ttgattcctggtt

SEQ ID NO: 4024820 - DNA, 18 bp, Homo sapiens
ttgattcctggtttgact

SEQ ID NO: 4024821 - DNA, 14 bp, Homo sapiens
ttgattctctccat

SEQ ID NO: 4024822 - DNA, 20 bp, Homo sapiens
ttgattgttcgggtgtgcaa

SEQ ID NO: 4024823 - DNA, 14 bp, Homo sapiens
ttgatttgcattga

SEQ ID NO: 4024824 - DNA, 15 bp, Homo sapiens
ttgatttgcattgaa

SEQ ID NO: 4024825 - DNA, 23 bp, Homo sapiens
ttgattttaatacattgatcagg

SEQ ID NO: 4024826 - DNA, 16 bp, Homo sapiens
ttgattttctgttgta

SEQ ID NO: 4024827 - DNA, 11 bp, Homo sapiens
ttgcaaaattt

SEQ ID NO: 4024828 - DNA, 15 bp, Homo sapiens
ttgcaaaatttccag

SEQ ID NO: 4024829 - DNA, 21 bp, Homo sapiens
ttgcaaaatttccagtacctt

SEQ ID NO: 4024830 - DNA, 21 bp, Homo sapiens
ttaacaacaataacactgtct

SEQ ID NO: 4024831 - DNA, 22 bp, Homo sapiens
ttaacaaggaatgcctgtgcca

SEQ ID NO: 4024832 - DNA, 18 bp, Homo sapiens
ttaacaataactactgtg

SEQ ID NO: 4024833 - DNA, 15 bp, Homo sapiens
ttaacaatttctgtc

SEQ ID NO: 4024834 - DNA, 16 bp, Homo sapiens
ttaacacaatgtgaat

SEQ ID NO: 4024835 - DNA, 17 bp, Homo sapiens
ttaacacaatgtgaatt

SEQ ID NO: 4024836 - DNA, 20 bp, Homo sapiens
ttaacacaatgtgaatttct

SEQ ID NO: 4024837 - DNA, 18 bp, Homo sapiens
ttaacagcagtcctttgt

SEQ ID NO: 4024838 - DNA, 17 bp, Homo sapiens
ttaacagtcatttaaaa

SEQ ID NO: 4024839 - DNA, 13 bp, Homo sapiens
ttaacattattta

SEQ ID NO: 4024840 - DNA, 14 bp, Homo sapiens
ttaacattgaccaa

SEQ ID NO: 4024841 - DNA, 23 bp, Homo sapiens
ttaacattgaccaagaactgcat

SEQ ID NO: 4024842 - DNA, 13 bp, Homo sapiens
ttaaccagaataa

SEQ ID NO: 4024843 - DNA, 14 bp, Homo sapiens
ttaaccatttaata

SEQ ID NO: 4024844 - DNA, 17 bp, Homo sapiens
ttaaccatttaataaag

SEQ ID NO: 4024845 - DNA, 15 bp, Homo sapiens
ttaaccctaatcttt

SEQ ID NO: 4024846 - DNA, 16 bp, Homo sapiens
ttaacctgcagaaaca

SEQ ID NO: 4024847 - DNA, 13 bp, Homo sapiens
ttaacctggtgct

SEQ ID NO: 4024848 - DNA, 17 bp, Homo sapiens
ttaacctggtgctggat

SEQ ID NO: 4024849 - DNA, 18 bp, Homo sapiens
ttaacctttttgtaaata

SEQ ID NO: 4024850 - DNA, 23 bp, Homo sapiens
ttaactaatatgggcattgtagt

SEQ ID NO: 4024851 - DNA, 20 bp, Homo sapiens
ttaactaatttgaatgtggt

SEQ ID NO: 4024852 - DNA, 14 bp, Homo sapiens
ttaactagaattta

SEQ ID NO: 4024853 - DNA, 21 bp, Homo sapiens
ttaactagaatttattcaatt

SEQ ID NO: 4024854 - DNA, 21 bp, Homo sapiens
ttaactatgacagatatattt

SEQ ID NO: 4024855 - DNA, 22 bp, Homo sapiens
ttaacttcagagggaaagtaaa

SEQ ID NO: 4024856 - DNA, 14 bp, Homo sapiens
ttaacttgaatttg

SEQ ID NO: 4024857 - DNA, 20 bp, Homo sapiens
ttaacttttttttctctctt

SEQ ID NO: 4024858 - DNA, 20 bp, Homo sapiens
ttaagaaaaaataacacaca

SEQ ID NO: 4024859 - DNA, 13 bp, Homo sapiens
ttaagaaaagcac

SEQ ID NO: 4024860 - DNA, 16 bp, Homo sapiens
ttaagaaaagcacttt

SEQ ID NO: 4024861 - DNA, 13 bp, Homo sapiens
ttaagaaaccttg

SEQ ID NO: 4024862 - DNA, 22 bp, Homo sapiens
ttaagaaagactatctaaatgt

SEQ ID NO: 4024863 - DNA, 16 bp, Homo sapiens
ttaagaacttcatttt

SEQ ID NO: 4024864 - DNA, 18 bp, Homo sapiens
ttaagaagctgttgtaca

SEQ ID NO: 4024865 - DNA, 23 bp, Homo sapiens
ttaagaagctgttgtacatttat

SEQ ID NO: 4024866 - DNA, 20 bp, Homo sapiens
ttaagaatatctgtaatggt

SEQ ID NO: 4024867 - DNA, 16 bp, Homo sapiens
ttaagaatatgtttcc

SEQ ID NO: 4024868 - DNA, 14 bp, Homo sapiens
ttaagaattgacca

SEQ ID NO: 4024869 - DNA, 20 bp, Homo sapiens
ttaagacactgaaaaatcta

SEQ ID NO: 4024870 - DNA, 16 bp, Homo sapiens
ttaagacatgatttcc

SEQ ID NO: 4024871 - DNA, 14 bp, Homo sapiens
ttaagacctggcag

SEQ ID NO: 4024872 - DNA, 21 bp, Homo sapiens
ttaagactgagcacctgcttc

SEQ ID NO: 4024873 - DNA, 16 bp, Homo sapiens
ttaagagaaactttat

SEQ ID NO: 4024874 - DNA, 21 bp, Homo sapiens
ttaagataatagtttacatgt

SEQ ID NO: 4024875 - DNA, 14 bp, Homo sapiens
ttaagataattata

SEQ ID NO: 4024876 - DNA, 16 bp, Homo sapiens
ttaagataattataat

SEQ ID NO: 4024877 - DNA, 11 bp, Homo sapiens
ttaagatatcc

SEQ ID NO: 4024878 - DNA, 23 bp, Homo sapiens
ttaagcaaaggggacagctgtgt

SEQ ID NO: 4024879 - DNA, 13 bp, Homo sapiens
ttaagcaaatgca

SEQ ID NO: 4024880 - DNA, 15 bp, Homo sapiens
ttaagcaaatgcatt

SEQ ID NO: 4024881 - DNA, 21 bp, Homo sapiens
ttaagcagatggaatgctgtg

SEQ ID NO: 4024882 - DNA, 22 bp, Homo sapiens
ttaagcagcatggaaaaatggt

SEQ ID NO: 4024883 - DNA, 22 bp, Homo sapiens
ttaagcagctaaattttctgaa

SEQ ID NO: 4024884 - DNA, 18 bp, Homo sapiens
ttaagcattaccactcag

SEQ ID NO: 4024885 - DNA, 12 bp, Homo sapiens
ttaagcattgtt

SEQ ID NO: 4024886 - DNA, 19 bp, Homo sapiens
ttaagcattgtttgcttat

SEQ ID NO: 4024887 - DNA, 22 bp, Homo sapiens
ttaagcctcatatttaaagaca

SEQ ID NO: 4024888 - DNA, 21 bp, Homo sapiens
ttaagccttataaaccaatct

SEQ ID NO: 4024889 - DNA, 11 bp, Homo sapiens
ttctcagtgtg

SEQ ID NO: 4024890 - DNA, 17 bp, Homo sapiens
ttctcataattcctaca

SEQ ID NO: 4024891 - DNA, 16 bp, Homo sapiens
ttctcataattttgca

SEQ ID NO: 4024892 - DNA, 18 bp, Homo sapiens
ttctcatagcattaacta

SEQ ID NO: 4024893 - DNA, 24 bp, Homo sapiens
ttctcataggaaaagtacatttaa

SEQ ID NO: 4024894 - DNA, 22 bp, Homo sapiens
ttctccacagcaaccccaggct

SEQ ID NO: 4024895 - DNA, 13 bp, Homo sapiens
ttctccagaatgt

SEQ ID NO: 4024896 - DNA, 14 bp, Homo sapiens
ttctccagccagca

SEQ ID NO: 4024897 - DNA, 20 bp, Homo sapiens
ttctccagctgggctctgca

SEQ ID NO: 4024898 - DNA, 21 bp, Homo sapiens
ttctccaggcttcacagtctg

SEQ ID NO: 4024899 - DNA, 23 bp, Homo sapiens
ttctcccacatgaggccatctca

SEQ ID NO: 4024900 - DNA, 12 bp, Homo sapiens
ttctcccagcac

SEQ ID NO: 4024901 - DNA, 21 bp, Homo sapiens
ttctcccgttcacgttgccta

SEQ ID NO: 4024902 - DNA, 19 bp, Homo sapiens
ttctccgccagcctcctct

SEQ ID NO: 4024903 - DNA, 14 bp, Homo sapiens
ttctcctgcctcag

SEQ ID NO: 4024904 - DNA, 20 bp, Homo sapiens
ttctccttagtcttctcata

SEQ ID NO: 4024905 - DNA, 21 bp, Homo sapiens
ttctccttgaatatctttcga

SEQ ID NO: 4024906 - DNA, 17 bp, Homo sapiens
ttctcctttcacaacct

SEQ ID NO: 4024907 - DNA, 18 bp, Homo sapiens
ttctccttttcctatcct

SEQ ID NO: 4024908 - DNA, 17 bp, Homo sapiens
ttctcggctcaggctct

SEQ ID NO: 4024909 - DNA, 15 bp, Homo sapiens
ttctctaatcgaaag

SEQ ID NO: 4024910 - DNA, 18 bp, Homo sapiens
ttctctagctctctaggc

SEQ ID NO: 4024911 - DNA, 20 bp, Homo sapiens
ttctctagctctctaggcct

SEQ ID NO: 4024912 - DNA, 14 bp, Homo sapiens
ttctctcctcccca

SEQ ID NO: 4024913 - DNA, 17 bp, Homo sapiens
ttctctcctccccaaat

SEQ ID NO: 4024914 - DNA, 14 bp, Homo sapiens
ttctctccttgccc

SEQ ID NO: 4024915 - DNA, 20 bp, Homo sapiens
ttctctctactggtcctctt

SEQ ID NO: 4024916 - DNA, 16 bp, Homo sapiens
ttctctcttccctcag

SEQ ID NO: 4024917 - DNA, 19 bp, Homo sapiens
ttctctgaacacaggcagc

SEQ ID NO: 4024918 - DNA, 24 bp, Homo sapiens
ttctctgaacacaggcagctttct

SEQ ID NO: 4024919 - DNA, 10 bp, Homo sapiens
ttctctgcca

SEQ ID NO: 4024920 - DNA, 12 bp, Homo sapiens
ttctctgccagt

SEQ ID NO: 4024921 - DNA, 13 bp, Homo sapiens
ttctctgccagtg

SEQ ID NO: 4024922 - DNA, 18 bp, Homo sapiens
ttctctgcccagcttttc

SEQ ID NO: 4024923 - DNA, 20 bp, Homo sapiens
ttctctgcccagcttttcat

SEQ ID NO: 4024924 - DNA, 12 bp, Homo sapiens
ttgcaaatagtc

SEQ ID NO: 4024925 - DNA, 12 bp, Homo sapiens
ttgcaaatataa

SEQ ID NO: 4024926 - DNA, 17 bp, Homo sapiens
ttgcaaatataaacatc

SEQ ID NO: 4024927 - DNA, 16 bp, Homo sapiens
ttgcaaatcttgaaat

SEQ ID NO: 4024928 - DNA, 17 bp, Homo sapiens
ttgcaaatcttgaaatt

SEQ ID NO: 4024929 - DNA, 20 bp, Homo sapiens
ttgcaacctcaccttcctgt

SEQ ID NO: 4024930 - DNA, 15 bp, Homo sapiens
ttgcaacttcagttt

SEQ ID NO: 4024931 - DNA, 22 bp, Homo sapiens
ttgcaacttcatgtcaacttct

SEQ ID NO: 4024932 - DNA, 20 bp, Homo sapiens
ttgcaagatgtgaattattg

SEQ ID NO: 4024933 - DNA, 21 bp, Homo sapiens
ttgcaagatgtgaattattga

SEQ ID NO: 4024934 - DNA, 23 bp, Homo sapiens
ttgcaatgcttttatatggccca

SEQ ID NO: 4024935 - DNA, 14 bp, Homo sapiens
ttgcacagaatttg

SEQ ID NO: 4024936 - DNA, 17 bp, Homo sapiens
ttgcacatgaatgcagt

SEQ ID NO: 4024937 - DNA, 22 bp, Homo sapiens
ttgcaccatactccttgcttcc

SEQ ID NO: 4024938 - DNA, 13 bp, Homo sapiens
ttgcacccctcac

SEQ ID NO: 4024939 - DNA, 15 bp, Homo sapiens
ttgcacgtggcctct

SEQ ID NO: 4024940 - DNA, 16 bp, Homo sapiens
ttgcactgagggccac

SEQ ID NO: 4024941 - DNA, 21 bp, Homo sapiens
ttgcactgagggccacactat

SEQ ID NO: 4024942 - DNA, 17 bp, Homo sapiens
ttgcagaaaattctgtg

SEQ ID NO: 4024943 - DNA, 21 bp, Homo sapiens
ttgcagaagagggtgtgtttg

SEQ ID NO: 4024944 - DNA, 14 bp, Homo sapiens
ttgcagatgaaatg

SEQ ID NO: 4024945 - DNA, 23 bp, Homo sapiens
ttgcagatgaaatgttctgttca

SEQ ID NO: 4024946 - DNA, 20 bp, Homo sapiens
ttgcagatgtattgactgta

SEQ ID NO: 4024947 - DNA, 16 bp, Homo sapiens
ttgcagatttatttag

SEQ ID NO: 4024948 - DNA, 23 bp, Homo sapiens
ttgcagcagtgagtctcttcaga

SEQ ID NO: 4024949 - DNA, 22 bp, Homo sapiens
ttgcagcctgctctagtgggac

SEQ ID NO: 4024950 - DNA, 23 bp, Homo sapiens
ttgcagcctgctctagtgggaca

SEQ ID NO: 4024951 - DNA, 16 bp, Homo sapiens
ttgcctttcgaggcct

SEQ ID NO: 4024952 - DNA, 18 bp, Homo sapiens
ttgcgacggagagaaaaa

SEQ ID NO: 4024953 - DNA, 22 bp, Homo sapiens
ttgcgctctcaagaccagagac

SEQ ID NO: 4024954 - DNA, 12 bp, Homo sapiens
ttgcggccccag

SEQ ID NO: 4024955 - DNA, 15 bp, Homo sapiens
ttgcggccccaggag

SEQ ID NO: 4024956 - DNA, 16 bp, Homo sapiens
ttgcggccccaggagg

SEQ ID NO: 4024957 - DNA, 16 bp, Homo sapiens
ttgcgtatgtctgtta

SEQ ID NO: 4024958 - DNA, 20 bp, Homo sapiens
ttgcgtatgtctgttaccat

SEQ ID NO: 4024959 - DNA, 15 bp, Homo sapiens
ttgctaagaagccta

SEQ ID NO: 4024960 - DNA, 21 bp, Homo sapiens
ttgctaagtaaatctcttctg

SEQ ID NO: 4024961 - DNA, 18 bp, Homo sapiens
ttgctaatcaaagccagg

SEQ ID NO: 4024962 - DNA, 22 bp, Homo sapiens
ttgctaatcaaagccagggtct

SEQ ID NO: 4024963 - DNA, 21 bp, Homo sapiens
ttgctaccctgagttcatcca

SEQ ID NO: 4024964 - DNA, 19 bp, Homo sapiens
ttgctagaatgggaagggt

SEQ ID NO: 4024965 - DNA, 18 bp, Homo sapiens
ttgctagactctagacaa

SEQ ID NO: 4024966 - DNA, 13 bp, Homo sapiens
ttgctagtatttg

SEQ ID NO: 4024967 - DNA, 22 bp, Homo sapiens
ttgctatctggaggccttccag

SEQ ID NO: 4024968 - DNA, 15 bp, Homo sapiens
ttgctatgttactat

SEQ ID NO: 4024969 - DNA, 23 bp, Homo sapiens
ttgctatgttactattttctaca

SEQ ID NO: 4024970 - DNA, 18 bp, Homo sapiens
ttgctcaaaaaatgagct

SEQ ID NO: 4024971 - DNA, 19 bp, Homo sapiens
ttgctcaaatctattcaga

SEQ ID NO: 4024972 - DNA, 13 bp, Homo sapiens
ttgctcagctcct

SEQ ID NO: 4024973 - DNA, 17 bp, Homo sapiens
ttgctcccaacccattc

SEQ ID NO: 4024974 - DNA, 19 bp, Homo sapiens
ttgctcccttcagccccca

SEQ ID NO: 4024975 - DNA, 15 bp, Homo sapiens
ttgctcctagcagac

SEQ ID NO: 4024976 - DNA, 14 bp, Homo sapiens
ttgctctaggaaga

SEQ ID NO: 4024977 - DNA, 12 bp, Homo sapiens
tttacatgtttt

SEQ ID NO: 4024978 - DNA, 16 bp, Homo sapiens
tttacattcatcaata

SEQ ID NO: 4024979 - DNA, 15 bp, Homo sapiens
tttacattgtaaata

SEQ ID NO: 4024980 - DNA, 12 bp, Homo sapiens
tttacatttaaa

SEQ ID NO: 4024981 - DNA, 19 bp, Homo sapiens
tttacatttttatttatga

SEQ ID NO: 4024982 - DNA, 18 bp, Homo sapiens
tttaccaagagtaacttt

SEQ ID NO: 4024983 - DNA, 19 bp, Homo sapiens
tttaccagttaattactca

SEQ ID NO: 4024984 - DNA, 13 bp, Homo sapiens
tttaccatcatct

SEQ ID NO: 4024985 - DNA, 19 bp, Homo sapiens
tttaccatttgtaataaag

SEQ ID NO: 4024986 - DNA, 23 bp, Homo sapiens
tttaccatttgtaataaagtata

SEQ ID NO: 4024987 - DNA, 17 bp, Homo sapiens
tttacccagtgggacag

SEQ ID NO: 4024988 - DNA, 16 bp, Homo sapiens
tttaccctctttgctg

SEQ ID NO: 4024989 - DNA, 18 bp, Homo sapiens
tttacctaccacagtgtc

SEQ ID NO: 4024990 - DNA, 19 bp, Homo sapiens
tttacctaccacagtgtct

SEQ ID NO: 4024991 - DNA, 21 bp, Homo sapiens
tttacctatggaagtggttct

SEQ ID NO: 4024992 - DNA, 13 bp, Homo sapiens
tttacctgagacc

SEQ ID NO: 4024993 - DNA, 15 bp, Homo sapiens
tttacctgtcacatt

SEQ ID NO: 4024994 - DNA, 13 bp, Homo sapiens
tttactccagtgg

SEQ ID NO: 4024995 - DNA, 21 bp, Homo sapiens
tttactccagtggtgaagaaa

SEQ ID NO: 4024996 - DNA, 13 bp, Homo sapiens
tttactctgtgtt

SEQ ID NO: 4024997 - DNA, 17 bp, Homo sapiens
tttactgagcttctctg

SEQ ID NO: 4024998 - DNA, 18 bp, Homo sapiens
tttactgagcttctctgt

SEQ ID NO: 4024999 - DNA, 21 bp, Homo sapiens
tttactgagcttctctgtgaa

SEQ ID NO: 4025000 - DNA, 23 bp, Homo sapiens
tttacttcaatgggctcttccaa

SEQ ID NO: 4025001 - DNA, 16 bp, Homo sapiens
tttacttctaatctta

SEQ ID NO: 4025002 - DNA, 17 bp, Homo sapiens
tttacttctaatcttaa

SEQ ID NO: 4025003 - DNA, 14 bp, Homo sapiens
tttacttcttatac

SEQ ID NO: 4025004 - DNA, 22 bp, Homo sapiens
tttacttcttatacatttgata

SEQ ID NO: 4025005 - DNA, 16 bp, Homo sapiens
tttactttaaacttgt

SEQ ID NO: 4025006 - DNA, 15 bp, Homo sapiens
tttactttgtacttg

SEQ ID NO: 4025007 - DNA, 13 bp, Homo sapiens
tttacttttgttt

SEQ ID NO: 4025008 - DNA, 18 bp, Homo sapiens
tttagaaactgatttctt

SEQ ID NO: 4025009 - DNA, 22 bp, Homo sapiens
tttagaaatactgcaagaaaat

SEQ ID NO: 4025010 - DNA, 21 bp, Homo sapiens
tttagaatgttgaaaagtaat

SEQ ID NO: 4025011 - DNA, 18 bp, Homo sapiens
tttagacaacctgaaatt

SEQ ID NO: 4025012 - DNA, 16 bp, Homo sapiens
tttagacagtctcact

SEQ ID NO: 4025013 - DNA, 21 bp, Homo sapiens
tttagagatgaattaaattta

SEQ ID NO: 4025014 - DNA, 16 bp, Homo sapiens
tttagatcaaatactt

SEQ ID NO: 4025015 - DNA, 17 bp, Homo sapiens
tttagatcaaatacttt

SEQ ID NO: 4025016 - DNA, 17 bp, Homo sapiens
tttagatgaggaaatga

SEQ ID NO: 4025017 - DNA, 22 bp, Homo sapiens
tttagcagcagcctttaatgca

SEQ ID NO: 4025018 - DNA, 16 bp, Homo sapiens
tttagcataaaatttt

SEQ ID NO: 4025019 - DNA, 18 bp, Homo sapiens
tttagccaaacccttgtc

SEQ ID NO: 4025020 - DNA, 18 bp, Homo sapiens
tttagctagtatcttcaa

SEQ ID NO: 4025021 - DNA, 19 bp, Homo sapiens
tttagctagtatcttcaaa

SEQ ID NO: 4025022 - DNA, 13 bp, Homo sapiens
tttagcttttcct

SEQ ID NO: 4025023 - DNA, 22 bp, Homo sapiens
tttaggaaaatcactttgtcta

SEQ ID NO: 4025024 - DNA, 15 bp, Homo sapiens
tttaggaacttcaga

SEQ ID NO: 4025025 - DNA, 16 bp, Homo sapiens
tttaggaacttcagag

SEQ ID NO: 4025026 - DNA, 17 bp, Homo sapiens
tttaggataaaataatg

SEQ ID NO: 4025027 - DNA, 16 bp, Homo sapiens
tttaggcaaagataat

SEQ ID NO: 4025028 - DNA, 16 bp, Homo sapiens
tttagggccaggcagg

SEQ ID NO: 4025029 - DNA, 20 bp, Homo sapiens
tttagggctgtaaaatgcat

SEQ ID NO: 4025030 - DNA, 16 bp, Homo sapiens
tttagggtaaaaattg

SEQ ID NO: 4025031 - DNA, 22 bp, Homo sapiens
tttaggtgaattaattaaacat

SEQ ID NO: 4025032 - DNA, 21 bp, Homo sapiens
tttagtattcattctgcattg

SEQ ID NO: 4025033 - DNA, 17 bp, Homo sapiens
tttagtctaagatgatt

SEQ ID NO: 4025034 - DNA, 20 bp, Homo sapiens
tttagtggaagcttctaaat

SEQ ID NO: 4025035 - DNA, 16 bp, Homo sapiens
tttagtgttagttata

SEQ ID NO: 4025036 - DNA, 19 bp, Homo sapiens
tttagttgcagaaacattt

SEQ ID NO: 4025037 - DNA, 13 bp, Homo sapiens
tttagttttctct

SEQ ID NO: 4025038 - DNA, 15 bp, Homo sapiens
tttagttttctctta

SEQ ID NO: 4025039 - DNA, 13 bp, Homo sapiens
tttataaaacttc

SEQ ID NO: 4025040 - DNA, 20 bp, Homo sapiens
tttataaataaactgttgct

SEQ ID NO: 4025041 - DNA, 18 bp, Homo sapiens
tttataaccatgagaatt

SEQ ID NO: 4025042 - DNA, 17 bp, Homo sapiens
tttataaccccagcctg

SEQ ID NO: 4025043 - DNA, 22 bp, Homo sapiens
tttataactcatcataaaataa

SEQ ID NO: 4025044 - DNA, 20 bp, Homo sapiens
tttataagcagatttaacaa

SEQ ID NO: 4025045 - DNA, 19 bp, Homo sapiens
tttataagtcattgtatgt

SEQ ID NO: 4025046 - DNA, 18 bp, Homo sapiens
tttataatagcaactttt

SEQ ID NO: 4025047 - DNA, 19 bp, Homo sapiens
tttatacaaattagaaaat

SEQ ID NO: 4025048 - DNA, 13 bp, Homo sapiens
tttatacattagt

SEQ ID NO: 4025049 - DNA, 17 bp, Homo sapiens
tttatacattagtaaat

SEQ ID NO: 4025050 - DNA, 21 bp, Homo sapiens
tttatacattagtaaatgtct

SEQ ID NO: 4025051 - DNA, 18 bp, Homo sapiens
tttatactctttctgtat

SEQ ID NO: 4025052 - DNA, 20 bp, Homo sapiens
tttatactctttctgtatat

SEQ ID NO: 4025053 - DNA, 20 bp, Homo sapiens
tttatactgattatgtcttt

SEQ ID NO: 4025054 - DNA, 19 bp, Homo sapiens
tttatactgtgaagttaca

SEQ ID NO: 4025055 - DNA, 18 bp, Homo sapiens
tttatagcaacaacaatt

SEQ ID NO: 4025056 - DNA, 16 bp, Homo sapiens
tttatagctcagttta

SEQ ID NO: 4025057 - DNA, 16 bp, Homo sapiens
tttatatatgaaaact

SEQ ID NO: 4025058 - DNA, 13 bp, Homo sapiens
tttatatatgtat

SEQ ID NO: 4025059 - DNA, 12 bp, Homo sapiens
tttatatctttt

SEQ ID NO: 4025060 - DNA, 17 bp, Homo sapiens
tttatatgaagataagt

SEQ ID NO: 4025061 - DNA, 13 bp, Homo sapiens
tttatatgtacat

SEQ ID NO: 4025062 - DNA, 18 bp, Homo sapiens
tttatattcagtgaaaag

SEQ ID NO: 4025063 - DNA, 15 bp, Homo sapiens
tttatatttccttta

SEQ ID NO: 4025064 - DNA, 14 bp, Homo sapiens
tttatcaaaatgta

SEQ ID NO: 4025065 - DNA, 14 bp, Homo sapiens
tttatcaaagcata

SEQ ID NO: 4025066 - DNA, 15 bp, Homo sapiens
tttatcaactttggt

SEQ ID NO: 4025067 - DNA, 17 bp, Homo sapiens
tttatcacacttctgtg

SEQ ID NO: 4025068 - DNA, 18 bp, Homo sapiens
tttatcacacttctgtga

SEQ ID NO: 4025069 - DNA, 13 bp, Homo sapiens
tttatcagataca

SEQ ID NO: 4025070 - DNA, 21 bp, Homo sapiens
tttatcagatacatcactgct

SEQ ID NO: 4025071 - DNA, 13 bp, Homo sapiens
tttatcagtgaca

SEQ ID NO: 4025072 - DNA, 18 bp, Homo sapiens
tttatcagtgacagagtt

SEQ ID NO: 4025073 - DNA, 21 bp, Homo sapiens
tttatcatgaattccctttta

SEQ ID NO: 4025074 - DNA, 17 bp, Homo sapiens
tttatccaaaatgtgta

SEQ ID NO: 4025075 - DNA, 14 bp, Homo sapiens
tttatccacaggaa

SEQ ID NO: 4025076 - DNA, 22 bp, Homo sapiens
tttatcctagtcattcttccct

SEQ ID NO: 4025077 - DNA, 14 bp, Homo sapiens
tttatctctattta

SEQ ID NO: 4025078 - DNA, 17 bp, Homo sapiens
tttatctctatttaata

SEQ ID NO: 4025079 - DNA, 16 bp, Homo sapiens
tttatctgcagaacat

SEQ ID NO: 4025080 - DNA, 14 bp, Homo sapiens
tttatcttgtctct

SEQ ID NO: 4025081 - DNA, 18 bp, Homo sapiens
tttatgaaaggtttacat

SEQ ID NO: 4025082 - DNA, 19 bp, Homo sapiens
tttatgaaaggtttacatt

SEQ ID NO: 4025083 - DNA, 20 bp, Homo sapiens
tttatgaatgaaaaaacagt

SEQ ID NO: 4025084 - DNA, 20 bp, Homo sapiens
tttatgagatgctggttttc

SEQ ID NO: 4025085 - DNA, 18 bp, Homo sapiens
tttatgagtaactattat

SEQ ID NO: 4025086 - DNA, 21 bp, Homo sapiens
tttatgatcagtgttgttgct

SEQ ID NO: 4025087 - DNA, 14 bp, Homo sapiens
tttatgatttaata

SEQ ID NO: 4025088 - DNA, 20 bp, Homo sapiens
tttatggaattaaccattta

SEQ ID NO: 4025089 - DNA, 12 bp, Homo sapiens
tttatggcctca

SEQ ID NO: 4025090 - DNA, 13 bp, Homo sapiens
tttatggcctcag

SEQ ID NO: 4025091 - DNA, 22 bp, Homo sapiens
tttatggcctcagctgcctcac

SEQ ID NO: 4025092 - DNA, 16 bp, Homo sapiens
tttatggtttctccag

SEQ ID NO: 4025093 - DNA, 14 bp, Homo sapiens
tttatgtagcacat

SEQ ID NO: 4025094 - DNA, 18 bp, Homo sapiens
tttatgtgtgaggagctg

SEQ ID NO: 4025095 - DNA, 17 bp, Homo sapiens
tttatgttaaaagattt

SEQ ID NO: 4025096 - DNA, 12 bp, Homo sapiens
tttatgttttgt

SEQ ID NO: 4025097 - DNA, 12 bp, Homo sapiens
tttattaaaaca

SEQ ID NO: 4025098 - DNA, 17 bp, Homo sapiens
tttattaaacagatttt

SEQ ID NO: 4025099 - DNA, 13 bp, Homo sapiens
tttattaaatttg

SEQ ID NO: 4025100 - DNA, 15 bp, Homo sapiens
tttattaagatggat

SEQ ID NO: 4025101 - DNA, 16 bp, Homo sapiens
tttattaatttatatg

SEQ ID NO: 4025102 - DNA, 12 bp, Homo sapiens
tttattaatttg

SEQ ID NO: 4025103 - DNA, 17 bp, Homo sapiens
tttattaccccctcctt

SEQ ID NO: 4025104 - DNA, 13 bp, Homo sapiens
tttattacctctg

SEQ ID NO: 4025105 - DNA, 20 bp, Homo sapiens
tttattacctctgatacctc

SEQ ID NO: 4025106 - DNA, 13 bp, Homo sapiens
tttattactgatt

SEQ ID NO: 4025107 - DNA, 13 bp, Homo sapiens
tttattatttcta

SEQ ID NO: 4025108 - DNA, 17 bp, Homo sapiens
tttattattttcacctg

SEQ ID NO: 4025109 - DNA, 15 bp, Homo sapiens
tttattcagcagact

SEQ ID NO: 4025110 - DNA, 18 bp, Homo sapiens
tttattcattagctgtga

SEQ ID NO: 4025111 - DNA, 19 bp, Homo sapiens
tttattccagaatgctgta

SEQ ID NO: 4025112 - DNA, 22 bp, Homo sapiens
tttattccagaatgctgtacat

SEQ ID NO: 4025113 - DNA, 14 bp, Homo sapiens
tttattccttgtga

SEQ ID NO: 4025114 - DNA, 12 bp, Homo sapiens
tttattgagtac

SEQ ID NO: 4025115 - DNA, 19 bp, Homo sapiens
tttattgctagtatttgaa

SEQ ID NO: 4025116 - DNA, 20 bp, Homo sapiens
tttattgctagtatttgaat

SEQ ID NO: 4025117 - DNA, 22 bp, Homo sapiens
tttattgttttctatttatgcc

SEQ ID NO: 4025118 - DNA, 14 bp, Homo sapiens
tttatttaaagcat

SEQ ID NO: 4025119 - DNA, 15 bp, Homo sapiens
tttatttaaagcatt

SEQ ID NO: 4025120 - DNA, 17 bp, Homo sapiens
tttatttaatgttatgt

SEQ ID NO: 4025121 - DNA, 11 bp, Homo sapiens
tttatttaatt

SEQ ID NO: 4025122 - DNA, 19 bp, Homo sapiens
tttatttaattaaatgtat

SEQ ID NO: 4025123 - DNA, 20 bp, Homo sapiens
tttatttacagatgaatgta

SEQ ID NO: 4025124 - DNA, 15 bp, Homo sapiens
tttatttatcagtga

SEQ ID NO: 4025125 - DNA, 15 bp, Homo sapiens
tttatttattactgt

SEQ ID NO: 4025126 - DNA, 13 bp, Homo sapiens
tttatttatttat

SEQ ID NO: 4025127 - DNA, 13 bp, Homo sapiens
tttatttatttct

SEQ ID NO: 4025128 - DNA, 11 bp, Homo sapiens
tttatttcact

SEQ ID NO: 4025129 - DNA, 15 bp, Homo sapiens
tttatttctcctttt

SEQ ID NO: 4025130 - DNA, 14 bp, Homo sapiens
tttatttgtttttc

SEQ ID NO: 4025131 - DNA, 21 bp, Homo sapiens
tttattttaaaacagaagaat

SEQ ID NO: 4025132 - DNA, 17 bp, Homo sapiens
tttattttaatgtaaag

SEQ ID NO: 4025133 - DNA, 22 bp, Homo sapiens
tttattttctggtagatagaaa

SEQ ID NO: 4025134 - DNA, 16 bp, Homo sapiens
tttcaaaaatataact

SEQ ID NO: 4025135 - DNA, 21 bp, Homo sapiens
tttcaaaaatataacttaaaa

SEQ ID NO: 4025136 - DNA, 13 bp, Homo sapiens
tttcaaaatgctt

SEQ ID NO: 4025137 - DNA, 15 bp, Homo sapiens
tttcaaaatgctttt

SEQ ID NO: 4025138 - DNA, 16 bp, Homo sapiens
tttcaaacttactatt

SEQ ID NO: 4025139 - DNA, 19 bp, Homo sapiens
tttcaaacttactattttg

SEQ ID NO: 4025140 - DNA, 21 bp, Homo sapiens
tttcaaagtgatagaaaagtg

SEQ ID NO: 4025141 - DNA, 16 bp, Homo sapiens
tttcaacgcagccctg

SEQ ID NO: 4025142 - DNA, 20 bp, Homo sapiens
tttcaacgcagccctgcttt

SEQ ID NO: 4025143 - DNA, 15 bp, Homo sapiens
tttcaactactcttt

SEQ ID NO: 4025144 - DNA, 22 bp, Homo sapiens
tttcaacttggcttcctttctt

SEQ ID NO: 4025145 - DNA, 17 bp, Homo sapiens
tttcaagaacctggaaa

SEQ ID NO: 4025146 - DNA, 19 bp, Homo sapiens
tttcaagctggaagaagtg

SEQ ID NO: 4025147 - DNA, 18 bp, Homo sapiens
tttcaagtcaaattaata

SEQ ID NO: 4025148 - DNA, 23 bp, Homo sapiens
tttcaagtcaaattaataatctt

SEQ ID NO: 4025149 - DNA, 15 bp, Homo sapiens
tttcaataaatcttt

SEQ ID NO: 4025150 - DNA, 13 bp, Homo sapiens
tttcaatatattg

SEQ ID NO: 4025151 - DNA, 22 bp, Homo sapiens
tttcaattccacctgcaatcaa

SEQ ID NO: 4025152 - DNA, 16 bp, Homo sapiens
tttcacaaccttctgt

SEQ ID NO: 4025153 - DNA, 13 bp, Homo sapiens
tttcacagctcct

SEQ ID NO: 4025154 - DNA, 15 bp, Homo sapiens
tttcacattgtttgc

SEQ ID NO: 4025155 - DNA, 16 bp, Homo sapiens
tttcacgtcttggtgc

SEQ ID NO: 4025156 - DNA, 15 bp, Homo sapiens
tttcactagaaaagc

SEQ ID NO: 4025157 - DNA, 18 bp, Homo sapiens
tttcactatcttcttcaa

SEQ ID NO: 4025158 - DNA, 21 bp, Homo sapiens
tttcactatcttcttcaaata

SEQ ID NO: 4025159 - DNA, 17 bp, Homo sapiens
tttcactgctggctgcc

SEQ ID NO: 4025160 - DNA, 13 bp, Homo sapiens
tttcactgtctgt

SEQ ID NO: 4025161 - DNA, 22 bp, Homo sapiens
tttcacttcaagggagaatata

SEQ ID NO: 4025162 - DNA, 14 bp, Homo sapiens
tttcacttctttcc

SEQ ID NO: 4025163 - DNA, 16 bp, Homo sapiens
tttcacttctttccct

SEQ ID NO: 4025164 - DNA, 15 bp, Homo sapiens
tttcacttgaaagat

SEQ ID NO: 4025165 - DNA, 18 bp, Homo sapiens
tttcacttgaaagatttt

SEQ ID NO: 4025166 - DNA, 22 bp, Homo sapiens
tttcactttgctctcaattaaa

SEQ ID NO: 4025167 - DNA, 14 bp, Homo sapiens
tttaaatcatgtat

SEQ ID NO: 4025168 - DNA, 19 bp, Homo sapiens
tttaaatctaaatctattt

SEQ ID NO: 4025169 - DNA, 16 bp, Homo sapiens
tttaaatgtaaaacat

SEQ ID NO: 4025170 - DNA, 13 bp, Homo sapiens
tttaaatgtatac

SEQ ID NO: 4025171 - DNA, 14 bp, Homo sapiens
tttaaatgtatact

SEQ ID NO: 4025172 - DNA, 15 bp, Homo sapiens
tttaaatgtatacta

SEQ ID NO: 4025173 - DNA, 24 bp, Homo sapiens
tttaaatgtgaatttttatttctt

SEQ ID NO: 4025174 - DNA, 16 bp, Homo sapiens
tttaaattatgtataa

SEQ ID NO: 4025175 - DNA, 22 bp, Homo sapiens
tttaaattatgtataaacataa

SEQ ID NO: 4025176 - DNA, 21 bp, Homo sapiens
tttaaattcacaatagaaact

SEQ ID NO: 4025177 - DNA, 12 bp, Homo sapiens
tttaaattctga

SEQ ID NO: 4025178 - DNA, 15 bp, Homo sapiens
tttaacaaaagcaag

SEQ ID NO: 4025179 - DNA, 18 bp, Homo sapiens
tttaacaataactactgt

SEQ ID NO: 4025180 - DNA, 21 bp, Homo sapiens
tttaacaataactactgtgtt

SEQ ID NO: 4025181 - DNA, 23 bp, Homo sapiens
tttaacaataactactgtgttcc

SEQ ID NO: 4025182 - DNA, 16 bp, Homo sapiens
tttaacagtcatttaa

SEQ ID NO: 4025183 - DNA, 23 bp, Homo sapiens
tttaacatgaacacccttagaaa

SEQ ID NO: 4025184 - DNA, 18 bp, Homo sapiens
tttaaccctaatctttca

SEQ ID NO: 4025185 - DNA, 15 bp, Homo sapiens
tttaactagaattta

SEQ ID NO: 4025186 - DNA, 13 bp, Homo sapiens
tttaactgaaaat

SEQ ID NO: 4025187 - DNA, 14 bp, Homo sapiens
tttaagaaaagcac

SEQ ID NO: 4025188 - DNA, 21 bp, Homo sapiens
tttaagaaaagcacttttgtt

SEQ ID NO: 4025189 - DNA, 19 bp, Homo sapiens
tttaagaaaagtattttga

SEQ ID NO: 4025190 - DNA, 11 bp, Homo sapiens
tttaagaaaat

SEQ ID NO: 4025191 - DNA, 12 bp, Homo sapiens
tttaagaaaata

SEQ ID NO: 4025192 - DNA, 13 bp, Homo sapiens
tttaagaaaatac

SEQ ID NO: 4025193 - DNA, 12 bp, Homo sapiens
tttaagaacttc

SEQ ID NO: 4025194 - DNA, 13 bp, Homo sapiens
tttaagaacttca

SEQ ID NO: 4025195 - DNA, 16 bp, Homo sapiens
tttaagaacttcattt

SEQ ID NO: 4025196 - DNA, 17 bp, Homo sapiens
tttaagaacttcatttt

SEQ ID NO: 4025197 - DNA, 15 bp, Homo sapiens
tttaagaattgagta

SEQ ID NO: 4025198 - DNA, 17 bp, Homo sapiens
tttaagacacttccgtc

SEQ ID NO: 4025199 - DNA, 22 bp, Homo sapiens
tttaagacagtcccatcaaaac

SEQ ID NO: 4025200 - DNA, 14 bp, Homo sapiens
tttaagataattat

SEQ ID NO: 4025201 - DNA, 19 bp, Homo sapiens
tttaagatatccatctttt

SEQ ID NO: 4025202 - DNA, 22 bp, Homo sapiens
tttaagatatccatctttttct

SEQ ID NO: 4025203 - DNA, 23 bp, Homo sapiens
tttaagatatccatctttttctt

SEQ ID NO: 4025204 - DNA, 15 bp, Homo sapiens
tttaagatttgtgtt

SEQ ID NO: 4025205 - DNA, 12 bp, Homo sapiens
tttaagattttt

SEQ ID NO: 4025206 - DNA, 19 bp, Homo sapiens
tttaagcaaatgcattcta

SEQ ID NO: 4025207 - DNA, 20 bp, Homo sapiens
tttaagcactcttaaagcaa

SEQ ID NO: 4025208 - DNA, 13 bp, Homo sapiens
tttaagcattgtt

SEQ ID NO: 4025209 - DNA, 23 bp, Homo sapiens
tttaagcattgtttgcttattgt

SEQ ID NO: 4025210 - DNA, 22 bp, Homo sapiens
tttaagccttataaaccaatct

SEQ ID NO: 4025211 - DNA, 20 bp, Homo sapiens
tttaagctccttgagtaaaa

SEQ ID NO: 4025212 - DNA, 20 bp, Homo sapiens
tttaagctgcaaatctgatg

SEQ ID NO: 4025213 - DNA, 18 bp, Homo sapiens
tttaagggcatgccttgt

SEQ ID NO: 4025214 - DNA, 19 bp, Homo sapiens
tttaaggtagcttcagcta

SEQ ID NO: 4025215 - DNA, 14 bp, Homo sapiens
tttaagtatttata

SEQ ID NO: 4025216 - DNA, 19 bp, Homo sapiens
tttaataaactactctttg

SEQ ID NO: 4025217 - DNA, 17 bp, Homo sapiens
tttaataaagaaatatt

SEQ ID NO: 4025218 - DNA, 16 bp, Homo sapiens
tttaataaagcttgtg

SEQ ID NO: 4025219 - DNA, 15 bp, Homo sapiens
tttaataacattacc

SEQ ID NO: 4025220 - DNA, 18 bp, Homo sapiens
tttaataacattacctta

SEQ ID NO: 4025221 - DNA, 20 bp, Homo sapiens
tttaataacattaccttact

SEQ ID NO: 4025222 - DNA, 14 bp, Homo sapiens
tttaatacaggact

SEQ ID NO: 4025223 - DNA, 22 bp, Homo sapiens
tttaatagaaataaattcctaa

SEQ ID NO: 4025224 - DNA, 17 bp, Homo sapiens
tttaatagaagttttat

SEQ ID NO: 4025225 - DNA, 13 bp, Homo sapiens
tttaatagtgctt

SEQ ID NO: 4025226 - DNA, 22 bp, Homo sapiens
tttaatattcttttgtttccat

SEQ ID NO: 4025227 - DNA, 21 bp, Homo sapiens
tttaatccagaattgaccttt

SEQ ID NO: 4025228 - DNA, 17 bp, Homo sapiens
tttaatctgaaattcta

SEQ ID NO: 4025229 - DNA, 13 bp, Homo sapiens
tttaatcttcagt

SEQ ID NO: 4025230 - DNA, 21 bp, Homo sapiens
tttaatgaaagactgtacaaa

SEQ ID NO: 4025231 - DNA, 12 bp, Homo sapiens
tttaatgtgaag

SEQ ID NO: 4025232 - DNA, 13 bp, Homo sapiens
tttaatgtgaaga

SEQ ID NO: 4025233 - DNA, 15 bp, Homo sapiens
tttaattaaatctca

SEQ ID NO: 4025234 - DNA, 22 bp, Homo sapiens
tttaattactggaattcttctg

SEQ ID NO: 4025235 - DNA, 21 bp, Homo sapiens
tttaattaggggttgctaaga

SEQ ID NO: 4025236 - DNA, 14 bp, Homo sapiens
tttaattattattc

SEQ ID NO: 4025237 - DNA, 17 bp, Homo sapiens
tttaattattttaaaat

SEQ ID NO: 4025238 - DNA, 20 bp, Homo sapiens
tttaattattttaaaatatt

SEQ ID NO: 4025239 - DNA, 23 bp, Homo sapiens
tttaattcatcccaactgtcttt

SEQ ID NO: 4025240 - DNA, 14 bp, Homo sapiens
tttaattctcattt

SEQ ID NO: 4025241 - DNA, 22 bp, Homo sapiens
tttaattgaaactagttatttt

SEQ ID NO: 4025242 - DNA, 18 bp, Homo sapiens
tttaattgttgtttcttt

SEQ ID NO: 4025243 - DNA, 22 bp, Homo sapiens
tttaattgttgtttctttctag

SEQ ID NO: 4025244 - DNA, 17 bp, Homo sapiens
tttaatttaacaaacta

SEQ ID NO: 4025245 - DNA, 16 bp, Homo sapiens
tttaatttatgagttt

SEQ ID NO: 4025246 - DNA, 16 bp, Homo sapiens
tttaatttatttatta

SEQ ID NO: 4025247 - DNA, 19 bp, Homo sapiens
tttaatttatttattaaga

SEQ ID NO: 4025248 - DNA, 20 bp, Homo sapiens
tttaatttatttattaagat

SEQ ID NO: 4025249 - DNA, 22 bp, Homo sapiens
tttaatttgatgaaagctgatt

SEQ ID NO: 4025250 - DNA, 17 bp, Homo sapiens
tttacaaacaaaagcat

SEQ ID NO: 4025251 - DNA, 16 bp, Homo sapiens
tttcacttttgttctg

SEQ ID NO: 4025252 - DNA, 17 bp, Homo sapiens
tttcacttttgttctgc

SEQ ID NO: 4025253 - DNA, 18 bp, Homo sapiens
tttcagaacctcttcccc

SEQ ID NO: 4025254 - DNA, 20 bp, Homo sapiens
tttcagaacctcttccccag

SEQ ID NO: 4025255 - DNA, 14 bp, Homo sapiens
tttcagacagggtc

SEQ ID NO: 4025256 - DNA, 12 bp, Homo sapiens
tttcagaccccc

SEQ ID NO: 4025257 - DNA, 23 bp, Homo sapiens
tttcagagacagctgatacttca

SEQ ID NO: 4025258 - DNA, 14 bp, Homo sapiens
tttcagatgcttct

SEQ ID NO: 4025259 - DNA, 13 bp, Homo sapiens
tttcagcttaaaa

SEQ ID NO: 4025260 - DNA, 22 bp, Homo sapiens
tttcaggaggctggaggaaggg

SEQ ID NO: 4025261 - DNA, 21 bp, Homo sapiens
tttcaggatactctgtcagat

SEQ ID NO: 4025262 - DNA, 14 bp, Homo sapiens
tttcaggtttgtca

SEQ ID NO: 4025263 - DNA, 14 bp, Homo sapiens
tttcagtggcttcc

SEQ ID NO: 4025264 - DNA, 14 bp, Homo sapiens
tttcagtgtacatg

SEQ ID NO: 4025265 - DNA, 21 bp, Homo sapiens
tttcagttgatcactggcaat

SEQ ID NO: 4025266 - DNA, 15 bp, Homo sapiens
tttcataaaaggaga

SEQ ID NO: 4025267 - DNA, 15 bp, Homo sapiens
tttcataaagggttg

SEQ ID NO: 4025268 - DNA, 22 bp, Homo sapiens
tttcatagtttattattattaa

SEQ ID NO: 4025269 - DNA, 12 bp, Homo sapiens
tttcatcactgg

SEQ ID NO: 4025270 - DNA, 21 bp, Homo sapiens
tttcatccagtttgttctccg

SEQ ID NO: 4025271 - DNA, 16 bp, Homo sapiens
tttcatccttcccact

SEQ ID NO: 4025272 - DNA, 17 bp, Homo sapiens
tttcatctggttttatt

SEQ ID NO: 4025273 - DNA, 20 bp, Homo sapiens
tttcatgaacgttattatat

SEQ ID NO: 4025274 - DNA, 14 bp, Homo sapiens
tttcatgtaaaaca

SEQ ID NO: 4025275 - DNA, 18 bp, Homo sapiens
tttcatgtacaagatgaa

SEQ ID NO: 4025276 - DNA, 17 bp, Homo sapiens
tttcatgttcactgtga

SEQ ID NO: 4025277 - DNA, 15 bp, Homo sapiens
tttcattatcatcaa

SEQ ID NO: 4025278 - DNA, 12 bp, Homo sapiens
tttcattccatt

SEQ ID NO: 4025279 - DNA, 13 bp, Homo sapiens
tttcattctcatt

SEQ ID NO: 4025280 - DNA, 15 bp, Homo sapiens
tttcattgctgtgac

SEQ ID NO: 4025281 - DNA, 23 bp, Homo sapiens
tttccaacaccacagacacacac

SEQ ID NO: 4025282 - DNA, 19 bp, Homo sapiens
tttccacaaaatctgtcca

SEQ ID NO: 4025283 - DNA, 19 bp, Homo sapiens
tttccaccaggccgtgcct

SEQ ID NO: 4025284 - DNA, 16 bp, Homo sapiens
tttccactgtaattaa

SEQ ID NO: 4025285 - DNA, 17 bp, Homo sapiens
tttccactgtaattaaa

SEQ ID NO: 4025286 - DNA, 15 bp, Homo sapiens
tttccacttcttcct

SEQ ID NO: 4025287 - DNA, 18 bp, Homo sapiens
tttccagacttccttgag

SEQ ID NO: 4025288 - DNA, 18 bp, Homo sapiens
tttccatatggattttct

SEQ ID NO: 4025289 - DNA, 22 bp, Homo sapiens
tttccatatggattttctattg

SEQ ID NO: 4025290 - DNA, 14 bp, Homo sapiens
tttccatcaactcc

SEQ ID NO: 4025291 - DNA, 23 bp, Homo sapiens
tttccatcaactcccaacttctt

SEQ ID NO: 4025292 - DNA, 18 bp, Homo sapiens
tttccatcattttacagt

SEQ ID NO: 4025293 - DNA, 19 bp, Homo sapiens
tttccatcattttacagtg

SEQ ID NO: 4025294 - DNA, 12 bp, Homo sapiens
tttccatcttta

SEQ ID NO: 4025295 - DNA, 13 bp, Homo sapiens
tttccattattta

SEQ ID NO: 4025296 - DNA, 13 bp, Homo sapiens
tttccattccaga

SEQ ID NO: 4025297 - DNA, 15 bp, Homo sapiens
tttcccacatctttc

SEQ ID NO: 4025298 - DNA, 11 bp, Homo sapiens
tttcccaccct

SEQ ID NO: 4025299 - DNA, 18 bp, Homo sapiens
tttcccaggaccctgaag

SEQ ID NO: 4025300 - DNA, 17 bp, Homo sapiens
tttcccatcatcctttg

SEQ ID NO: 4025301 - DNA, 12 bp, Homo sapiens
tttcccatctgc

SEQ ID NO: 4025302 - DNA, 19 bp, Homo sapiens
tttccccaggggaaaatga

SEQ ID NO: 4025303 - DNA, 19 bp, Homo sapiens
tttccccccactctcccca

SEQ ID NO: 4025304 - DNA, 23 bp, Homo sapiens
tttccccccactctccccacact

SEQ ID NO: 4025305 - DNA, 15 bp, Homo sapiens
tttcccccgagctct

SEQ ID NO: 4025306 - DNA, 23 bp, Homo sapiens
tttcccccgagctcttggccttt

SEQ ID NO: 4025307 - DNA, 14 bp, Homo sapiens
tttcccccttccca

SEQ ID NO: 4025308 - DNA, 18 bp, Homo sapiens
tttccccctttcttcctc

SEQ ID NO: 4025309 - DNA, 21 bp, Homo sapiens
tttcccccttttctgcatttt

SEQ ID NO: 4025310 - DNA, 16 bp, Homo sapiens
tttcccctctggcttg

SEQ ID NO: 4025311 - DNA, 23 bp, Homo sapiens
tttcccctctggcttgacagcat

SEQ ID NO: 4025312 - DNA, 15 bp, Homo sapiens
tttcccctgttaaac

SEQ ID NO: 4025313 - DNA, 13 bp, Homo sapiens
tttcccctttcct

SEQ ID NO: 4025314 - DNA, 16 bp, Homo sapiens
tttcccctttcctgtc

SEQ ID NO: 4025315 - DNA, 19 bp, Homo sapiens
tttccctaaaatacattta

SEQ ID NO: 4025316 - DNA, 13 bp, Homo sapiens
tttccctcaggtt

SEQ ID NO: 4025317 - DNA, 13 bp, Homo sapiens
tttccctccccag

SEQ ID NO: 4025318 - DNA, 13 bp, Homo sapiens
tttccctgacctc

SEQ ID NO: 4025319 - DNA, 14 bp, Homo sapiens
tttccctgactcct

SEQ ID NO: 4025320 - DNA, 16 bp, Homo sapiens
tttccctgcagacctc

SEQ ID NO: 4025321 - DNA, 18 bp, Homo sapiens
tttccctgcagacctcaa

SEQ ID NO: 4025322 - DNA, 20 bp, Homo sapiens
tttcccttcagtaccctctc

SEQ ID NO: 4025323 - DNA, 14 bp, Homo sapiens
tttcccttccagtt

SEQ ID NO: 4025324 - DNA, 17 bp, Homo sapiens
tttcccttgcttcccct

SEQ ID NO: 4025325 - DNA, 22 bp, Homo sapiens
tttccgctgtcgccccaggccc

SEQ ID NO: 4025326 - DNA, 19 bp, Homo sapiens
tttccgtgaactctggtgc

SEQ ID NO: 4025327 - DNA, 17 bp, Homo sapiens
tttcctaaatgcagtga

SEQ ID NO: 4025328 - DNA, 19 bp, Homo sapiens
tttcctcaagtatcttcta

SEQ ID NO: 4025329 - DNA, 19 bp, Homo sapiens
tttcctcagcttatctctt

SEQ ID NO: 4025330 - DNA, 19 bp, Homo sapiens
tttcctcattcctgaaaga

SEQ ID NO: 4025331 - DNA, 13 bp, Homo sapiens
tttcctcccagtg

SEQ ID NO: 4025332 - DNA, 15 bp, Homo sapiens
tttcctccccctgca

SEQ ID NO: 4025333 - DNA, 11 bp, Homo sapiens
tttcctccctt

SEQ ID NO: 4025334 - DNA, 22 bp, Homo sapiens
tttcctcccttgggttctgata

SEQ ID NO: 4025335 - DNA, 10 bp, Homo sapiens
tttcctcctg

SEQ ID NO: 4025336 - DNA, 22 bp, Homo sapiens
tttcctctatacatctctcccc

SEQ ID NO: 4025337 - DNA, 13 bp, Homo sapiens
tttcctcttgtga

SEQ ID NO: 4025338 - DNA, 23 bp, Homo sapiens
tttcctgatggggaagggacttt

SEQ ID NO: 4025339 - DNA, 13 bp, Homo sapiens
tttcctgcccagc

SEQ ID NO: 4025340 - DNA, 16 bp, Homo sapiens
tttcctgccctgtcca

SEQ ID NO: 4025341 - DNA, 16 bp, Homo sapiens
tttcctggacactcag

SEQ ID NO: 4025342 - DNA, 21 bp, Homo sapiens
tttcctggacatcctcttctg

SEQ ID NO: 4025343 - DNA, 18 bp, Homo sapiens
tttcctgggcctttgcaa

SEQ ID NO: 4025344 - DNA, 15 bp, Homo sapiens
tttccttccagccca

SEQ ID NO: 4025345 - DNA, 14 bp, Homo sapiens
tttccttccctttt

SEQ ID NO: 4025346 - DNA, 16 bp, Homo sapiens
tttccttctaacatgt

SEQ ID NO: 4025347 - DNA, 20 bp, Homo sapiens
tttccttgaggggagccagg

SEQ ID NO: 4025348 - DNA, 15 bp, Homo sapiens
tttcctttatgtgaa

SEQ ID NO: 4025349 - DNA, 13 bp, Homo sapiens
tttcctttgctct

SEQ ID NO: 4025350 - DNA, 12 bp, Homo sapiens
tttcctttggag

SEQ ID NO: 4025351 - DNA, 18 bp, Homo sapiens
tttccttttctctgccct

SEQ ID NO: 4025352 - DNA, 13 bp, Homo sapiens
tttccttttgggg

SEQ ID NO: 4025353 - DNA, 19 bp, Homo sapiens
tttcctttttaatatgctt

SEQ ID NO: 4025354 - DNA, 17 bp, Homo sapiens
tttcctttttctgatta

SEQ ID NO: 4025355 - DNA, 24 bp, Homo sapiens
tttgttaaaatacagttctgtcat

SEQ ID NO: 4025356 - DNA, 13 bp, Homo sapiens
tttgttaaataat

SEQ ID NO: 4025357 - DNA, 13 bp, Homo sapiens
tttgttaccttta

SEQ ID NO: 4025358 - DNA, 15 bp, Homo sapiens
tttgttacttcctta

SEQ ID NO: 4025359 - DNA, 16 bp, Homo sapiens
tttgttagtttacaat

SEQ ID NO: 4025360 - DNA, 14 bp, Homo sapiens
tttgttattccatc

SEQ ID NO: 4025361 - DNA, 12 bp, Homo sapiens
tttgttattcct

SEQ ID NO: 4025362 - DNA, 16 bp, Homo sapiens
tttgttattgttttgt

SEQ ID NO: 4025363 - DNA, 12 bp, Homo sapiens
tttgttattttg

SEQ ID NO: 4025364 - DNA, 19 bp, Homo sapiens
tttgttcactgaaggtgat

SEQ ID NO: 4025365 - DNA, 23 bp, Homo sapiens
tttgttcatttcatcctttcact

SEQ ID NO: 4025366 - DNA, 12 bp, Homo sapiens
tttgttccctgt

SEQ ID NO: 4025367 - DNA, 20 bp, Homo sapiens
tttgttcgcatggtcacaca

SEQ ID NO: 4025368 - DNA, 16 bp, Homo sapiens
tttgttgcaagatgtg

SEQ ID NO: 4025369 - DNA, 18 bp, Homo sapiens
tttgttgcaagatgtgaa

SEQ ID NO: 4025370 - DNA, 18 bp, Homo sapiens
tttgttgctttcttacct

SEQ ID NO: 4025371 - DNA, 12 bp, Homo sapiens
tttgttgtttat

SEQ ID NO: 4025372 - DNA, 10 bp, Homo sapiens
tttgtttctt

SEQ ID NO: 4025373 - DNA, 21 bp, Homo sapiens
tttgtttggatgtaatttagg

SEQ ID NO: 4025374 - DNA, 15 bp, Homo sapiens
tttgtttgtttaatt

SEQ ID NO: 4025375 - DNA, 13 bp, Homo sapiens
tttgtttttaatt

SEQ ID NO: 4025376 - DNA, 13 bp, Homo sapiens
tttgtttttgctt

SEQ ID NO: 4025377 - DNA, 20 bp, Homo sapiens
tttgtttttgctttctgaaa

SEQ ID NO: 4025378 - DNA, 13 bp, Homo sapiens
ttttaaaaaccta

SEQ ID NO: 4025379 - DNA, 15 bp, Homo sapiens
ttttaaaaactcctt

SEQ ID NO: 4025380 - DNA, 17 bp, Homo sapiens
ttttaaaaatagacact

SEQ ID NO: 4025381 - DNA, 20 bp, Homo sapiens
ttttaaaaattgttaatttt

SEQ ID NO: 4025382 - DNA, 15 bp, Homo sapiens
ttttaaaacactaaa

SEQ ID NO: 4025383 - DNA, 16 bp, Homo sapiens
ttttaaaatagaaatt

SEQ ID NO: 4025384 - DNA, 23 bp, Homo sapiens
ttttaaaatagaaattttgtaag

SEQ ID NO: 4025385 - DNA, 16 bp, Homo sapiens
ttttaaaatatttagt

SEQ ID NO: 4025386 - DNA, 21 bp, Homo sapiens
ttttaaaatatttgaatgaaa

SEQ ID NO: 4025387 - DNA, 12 bp, Homo sapiens
ttttaaaatgag

SEQ ID NO: 4025388 - DNA, 18 bp, Homo sapiens
ttttaaagtgtttcagct

SEQ ID NO: 4025389 - DNA, 13 bp, Homo sapiens
ttttaaatgtgaa

SEQ ID NO: 4025390 - DNA, 13 bp, Homo sapiens
ttttaaattctga

SEQ ID NO: 4025391 - DNA, 24 bp, Homo sapiens
ttttaaattctgagacatgtgtca

SEQ ID NO: 4025392 - DNA, 19 bp, Homo sapiens
ttttaacaataactactgt

SEQ ID NO: 4025393 - DNA, 21 bp, Homo sapiens
ttttaacaataactactgtgt

SEQ ID NO: 4025394 - DNA, 17 bp, Homo sapiens
ttttaactgaaaatgta

SEQ ID NO: 4025395 - DNA, 20 bp, Homo sapiens
ttttaactgaaaatgtaaat

SEQ ID NO: 4025396 - DNA, 15 bp, Homo sapiens
ttttaagatagtgta

SEQ ID NO: 4025397 - DNA, 23 bp, Homo sapiens
ttttaagatagtgtaacttgctt

SEQ ID NO: 4025398 - DNA, 15 bp, Homo sapiens
ttttaagatttgtgt

SEQ ID NO: 4025399 - DNA, 17 bp, Homo sapiens
ttttaagatttttctca

SEQ ID NO: 4025400 - DNA, 21 bp, Homo sapiens
ttttaagatttttctcaaagt

SEQ ID NO: 4025401 - DNA, 16 bp, Homo sapiens
ttttaagcaaatgcat

SEQ ID NO: 4025402 - DNA, 21 bp, Homo sapiens
ttttaagcactcttaaagcaa

SEQ ID NO: 4025403 - DNA, 21 bp, Homo sapiens
ttttaagctgcaaatctgatg

SEQ ID NO: 4025404 - DNA, 15 bp, Homo sapiens
ttttaagtaacttaa

SEQ ID NO: 4025405 - DNA, 17 bp, Homo sapiens
ttttaagtgctttgtaa

SEQ ID NO: 4025406 - DNA, 12 bp, Homo sapiens
ttttaagttctt

SEQ ID NO: 4025407 - DNA, 21 bp, Homo sapiens
ttttaataaactactctttga

SEQ ID NO: 4025408 - DNA, 12 bp, Homo sapiens
ttttaatacagg

SEQ ID NO: 4025409 - DNA, 22 bp, Homo sapiens
ttttaatacattgatcaggcca

SEQ ID NO: 4025410 - DNA, 18 bp, Homo sapiens
ttttaatagaataaaata

SEQ ID NO: 4025411 - DNA, 16 bp, Homo sapiens
ttttaatctttgtgac

SEQ ID NO: 4025412 - DNA, 12 bp, Homo sapiens
ttttaatgtgaa

SEQ ID NO: 4025413 - DNA, 13 bp, Homo sapiens
ttttaatgtgaag

SEQ ID NO: 4025414 - DNA, 14 bp, Homo sapiens
ttttaatgtgaaga

SEQ ID NO: 4025415 - DNA, 19 bp, Homo sapiens
ttttaatgtgaagacattt

SEQ ID NO: 4025416 - DNA, 11 bp, Homo sapiens
ttttaattatt

SEQ ID NO: 4025417 - DNA, 12 bp, Homo sapiens
ttttaatttaac

SEQ ID NO: 4025418 - DNA, 14 bp, Homo sapiens
ttttaatttaacaa

SEQ ID NO: 4025419 - DNA, 21 bp, Homo sapiens
ttttaatttaacaaactaaaa

SEQ ID NO: 4025420 - DNA, 17 bp, Homo sapiens
ttttaatttaacatgaa

SEQ ID NO: 4025421 - DNA, 17 bp, Homo sapiens
ttttaatttacaaaaat

SEQ ID NO: 4025422 - DNA, 22 bp, Homo sapiens
ttttaatttatttattaagatg

SEQ ID NO: 4025423 - DNA, 19 bp, Homo sapiens
ttttaatttgatgaaagct

SEQ ID NO: 4025424 - DNA, 17 bp, Homo sapiens
ttttacaagaagtttat

SEQ ID NO: 4025425 - DNA, 12 bp, Homo sapiens
ttttacaataaa

SEQ ID NO: 4025426 - DNA, 18 bp, Homo sapiens
ttttacaataaataatct

SEQ ID NO: 4025427 - DNA, 19 bp, Homo sapiens
ttttacacattagatttta

SEQ ID NO: 4025428 - DNA, 17 bp, Homo sapiens
ttttacagtgacctttt

SEQ ID NO: 4025429 - DNA, 18 bp, Homo sapiens
ttttacataactgccttg

SEQ ID NO: 4025430 - DNA, 22 bp, Homo sapiens
ttttaccctaatgtcttcataa

SEQ ID NO: 4025431 - DNA, 19 bp, Homo sapiens
ttttacctgtcacattgca

SEQ ID NO: 4025432 - DNA, 20 bp, Homo sapiens
ttttacctgtcacattgcat

SEQ ID NO: 4025433 - DNA, 23 bp, Homo sapiens
ttttacctgtcacattgcattct

SEQ ID NO: 4025434 - DNA, 12 bp, Homo sapiens
ttttactctgcc

SEQ ID NO: 4025435 - DNA, 12 bp, Homo sapiens
ttttactgtttt

SEQ ID NO: 4025436 - DNA, 18 bp, Homo sapiens
ttttacttccattataca

SEQ ID NO: 4025437 - DNA, 12 bp, Homo sapiens
ttttacttttat

SEQ ID NO: 4025438 - DNA, 21 bp, Homo sapiens
ttttagacagtctcactttgt

SEQ ID NO: 4025439 - DNA, 16 bp, Homo sapiens
ttttagatcaaatact

SEQ ID NO: 4025440 - DNA, 17 bp, Homo sapiens
ttttagatcaaatactt

SEQ ID NO: 4025441 - DNA, 20 bp, Homo sapiens
ttttaggaaaatcactttgt

SEQ ID NO: 4025442 - DNA, 13 bp, Homo sapiens
ttttagttttgct

SEQ ID NO: 4025443 - DNA, 19 bp, Homo sapiens
ttttataaggacttcctga

SEQ ID NO: 4025444 - DNA, 12 bp, Homo sapiens
ttttatactgta

SEQ ID NO: 4025445 - DNA, 16 bp, Homo sapiens
ttttatatgttgctat

SEQ ID NO: 4025446 - DNA, 17 bp, Homo sapiens
ttttatattaatgtact

SEQ ID NO: 4025447 - DNA, 11 bp, Homo sapiens
ttttatattct

SEQ ID NO: 4025448 - DNA, 14 bp, Homo sapiens
ttttatatttcctt

SEQ ID NO: 4025449 - DNA, 20 bp, Homo sapiens
ttttatatttcctttatgtg

SEQ ID NO: 4025450 - DNA, 22 bp, Homo sapiens
ttttatatttcctttatgtgaa

SEQ ID NO: 4025451 - DNA, 23 bp, Homo sapiens
ttttatatttcctttatgtgaat

SEQ ID NO: 4025452 - DNA, 12 bp, Homo sapiens
ttttatatttgt

SEQ ID NO: 4025453 - DNA, 18 bp, Homo sapiens
ttttgcaaatataaacat

SEQ ID NO: 4025454 - DNA, 20 bp, Homo sapiens
ttttgcaaatataaacatct

SEQ ID NO: 4025455 - DNA, 15 bp, Homo sapiens
ttttgcattccagaa

SEQ ID NO: 4025456 - DNA, 18 bp, Homo sapiens
ttttgcattccagaatct

SEQ ID NO: 4025457 - DNA, 13 bp, Homo sapiens
ttttgcatttatg

SEQ ID NO: 4025458 - DNA, 16 bp, Homo sapiens
ttttgccacagctttt

SEQ ID NO: 4025459 - DNA, 20 bp, Homo sapiens
ttttgccatacatcagttat

SEQ ID NO: 4025460 - DNA, 15 bp, Homo sapiens
ttttgccattaaact

SEQ ID NO: 4025461 - DNA, 16 bp, Homo sapiens
ttttgctataatcatt

SEQ ID NO: 4025462 - DNA, 15 bp, Homo sapiens
ttttgctgagagcat

SEQ ID NO: 4025463 - DNA, 12 bp, Homo sapiens
ttttgctgtata

SEQ ID NO: 4025464 - DNA, 23 bp, Homo sapiens
ttttgcttgttatattaagcaga

SEQ ID NO: 4025465 - DNA, 11 bp, Homo sapiens
ttttggaaact

SEQ ID NO: 4025466 - DNA, 23 bp, Homo sapiens
ttttggaaactgctaaattctat

SEQ ID NO: 4025467 - DNA, 21 bp, Homo sapiens
ttttggaactaaagcaaattt

SEQ ID NO: 4025468 - DNA, 20 bp, Homo sapiens
ttttggagaaggttatcaaa

SEQ ID NO: 4025469 - DNA, 16 bp, Homo sapiens
ttttggccaaagtgtt

SEQ ID NO: 4025470 - DNA, 17 bp, Homo sapiens
ttttggcgctattacaa

SEQ ID NO: 4025471 - DNA, 19 bp, Homo sapiens
ttttggcgctattacaaat

SEQ ID NO: 4025472 - DNA, 17 bp, Homo sapiens
ttttgggacaattgttt

SEQ ID NO: 4025473 - DNA, 16 bp, Homo sapiens
ttttggggaaaaaagc

SEQ ID NO: 4025474 - DNA, 19 bp, Homo sapiens
ttttggggaaaaaagcaca

SEQ ID NO: 4025475 - DNA, 22 bp, Homo sapiens
ttttggggagggaggggaaatg

SEQ ID NO: 4025476 - DNA, 17 bp, Homo sapiens
ttttggtagagaaggag

SEQ ID NO: 4025477 - DNA, 16 bp, Homo sapiens
ttttggtagattaaat

SEQ ID NO: 4025478 - DNA, 19 bp, Homo sapiens
ttttggtataatgtttaaa

SEQ ID NO: 4025479 - DNA, 22 bp, Homo sapiens
ttttggttgtcaatattaaata

SEQ ID NO: 4025480 - DNA, 15 bp, Homo sapiens
ttttgtaaaagaaat

SEQ ID NO: 4025481 - DNA, 19 bp, Homo sapiens
ttttgtaaacgacaagaat

SEQ ID NO: 4025482 - DNA, 19 bp, Homo sapiens
ttttgtaaatactgcttga

SEQ ID NO: 4025483 - DNA, 16 bp, Homo sapiens
ttttgtaataagcaat

SEQ ID NO: 4025484 - DNA, 19 bp, Homo sapiens
ttttgtaatgtgaaaagta

SEQ ID NO: 4025485 - DNA, 22 bp, Homo sapiens
ttttgtaatgtgaaaagtatca

SEQ ID NO: 4025486 - DNA, 18 bp, Homo sapiens
ttttgtaattgtgtaaaa

SEQ ID NO: 4025487 - DNA, 17 bp, Homo sapiens
ttttgtacactgctgta

SEQ ID NO: 4025488 - DNA, 16 bp, Homo sapiens
ttttgtataaaataga

SEQ ID NO: 4025489 - DNA, 13 bp, Homo sapiens
ttttgtatcttaa

SEQ ID NO: 4025490 - DNA, 14 bp, Homo sapiens
ttttgtatcttggg

SEQ ID NO: 4025491 - DNA, 17 bp, Homo sapiens
ttttgtcccatttcctt

SEQ ID NO: 4025492 - DNA, 15 bp, Homo sapiens
ttttgtctaattaaa

SEQ ID NO: 4025493 - DNA, 13 bp, Homo sapiens
ttttgtcttatat

SEQ ID NO: 4025494 - DNA, 18 bp, Homo sapiens
ttttgtgatgatgctgtg

SEQ ID NO: 4025495 - DNA, 19 bp, Homo sapiens
ttttgtgatgatgctgtga

SEQ ID NO: 4025496 - DNA, 22 bp, Homo sapiens
ttttgtgcaaaagcttcaaatt

SEQ ID NO: 4025497 - DNA, 17 bp, Homo sapiens
ttttgtgtaatgaaaat

SEQ ID NO: 4025498 - DNA, 11 bp, Homo sapiens
ttttgtgtcct

SEQ ID NO: 4025499 - DNA, 20 bp, Homo sapiens
ttttgtgtcctccaggagct

SEQ ID NO: 4025500 - DNA, 13 bp, Homo sapiens
ttttgttagttta

SEQ ID NO: 4025501 - DNA, 17 bp, Homo sapiens
ttttgttagtttacaat

SEQ ID NO: 4025502 - DNA, 11 bp, Homo sapiens
ttttgttattc

SEQ ID NO: 4025503 - DNA, 14 bp, Homo sapiens
ttttgttattccat

SEQ ID NO: 4025504 - DNA, 20 bp, Homo sapiens
ttttgttattccatcaataa

SEQ ID NO: 4025505 - DNA, 14 bp, Homo sapiens
ttttgttgattaaa

SEQ ID NO: 4025506 - DNA, 15 bp, Homo sapiens
ttttgttgattaaaa

SEQ ID NO: 4025507 - DNA, 17 bp, Homo sapiens
ttttgtttataaaaaac

SEQ ID NO: 4025508 - DNA, 15 bp, Homo sapiens
ttttgtttcttccaa

SEQ ID NO: 4025509 - DNA, 15 bp, Homo sapiens
ttttgttttgttgga

SEQ ID NO: 4025510 - DNA, 14 bp, Homo sapiens
tttttaaaatagaa

SEQ ID NO: 4025511 - DNA, 23 bp, Homo sapiens
tttttaaaatagaaattttgtaa

SEQ ID NO: 4025512 - DNA, 23 bp, Homo sapiens
tttttaaatgtatactatagtac

SEQ ID NO: 4025513 - DNA, 14 bp, Homo sapiens
tttttaaattgttt

SEQ ID NO: 4025514 - DNA, 17 bp, Homo sapiens
tttttaactgaaaatgt

SEQ ID NO: 4025515 - DNA, 16 bp, Homo sapiens
tttttaactgattctt

SEQ ID NO: 4025516 - DNA, 23 bp, Homo sapiens
tttttaactgattcttatgatta

SEQ ID NO: 4025517 - DNA, 15 bp, Homo sapiens
tttttaagatagtgt

SEQ ID NO: 4025518 - DNA, 13 bp, Homo sapiens
tttttaagatttt

SEQ ID NO: 4025519 - DNA, 15 bp, Homo sapiens
tttttaataaactac

SEQ ID NO: 4025520 - DNA, 14 bp, Homo sapiens
tttttaatatgctt

SEQ ID NO: 4025521 - DNA, 14 bp, Homo sapiens
tttttaatttaaca

SEQ ID NO: 4025522 - DNA, 23 bp, Homo sapiens
tttttaatttacaaaaatataaa

SEQ ID NO: 4025523 - DNA, 22 bp, Homo sapiens
tttttaatttgatgaaagctga

SEQ ID NO: 4025524 - DNA, 13 bp, Homo sapiens
tttttacaagaag

SEQ ID NO: 4025525 - DNA, 18 bp, Homo sapiens
tttttacaagttttaaat

SEQ ID NO: 4025526 - DNA, 15 bp, Homo sapiens
tttttacctgtcaca

SEQ ID NO: 4025527 - DNA, 21 bp, Homo sapiens
tttttacctgtcacattgcat

SEQ ID NO: 4025528 - DNA, 15 bp, Homo sapiens
tttttataccattca

SEQ ID NO: 4025529 - DNA, 21 bp, Homo sapiens
tttttatatcatgcaaaatat

SEQ ID NO: 4025530 - DNA, 22 bp, Homo sapiens
tttttatatttcctttatgtga

SEQ ID NO: 4025531 - DNA, 12 bp, Homo sapiens
tttttatgtgat

SEQ ID NO: 4025532 - DNA, 16 bp, Homo sapiens
tttttatgtgatcaat

SEQ ID NO: 4025533 - DNA, 15 bp, Homo sapiens
tttttattcagcaga

SEQ ID NO: 4025534 - DNA, 22 bp, Homo sapiens
tttttattgctagtatttgaat

SEQ ID NO: 4025535 - DNA, 12 bp, Homo sapiens
tttttatttctt

SEQ ID NO: 4025536 - DNA, 19 bp, Homo sapiens
tttttcaaagatgtgttgc

SEQ ID NO: 4025537 - DNA, 13 bp, Homo sapiens
tttttcaaggaag

SEQ ID NO: 4025538 - DNA, 21 bp, Homo sapiens
tttttcagcacttaactactt

SEQ ID NO: 4025539 - DNA, 19 bp, Homo sapiens
tttttcatattttctaaag

SEQ ID NO: 4025540 - DNA, 23 bp, Homo sapiens
tttttcattcatcccattaatca

SEQ ID NO: 4025541 - DNA, 13 bp, Homo sapiens
tttttcatttctt

SEQ ID NO: 4025542 - DNA, 11 bp, Homo sapiens
tttttccatca

SEQ ID NO: 4025543 - DNA, 12 bp, Homo sapiens
tttttccatcat

SEQ ID NO: 4025544 - DNA, 13 bp, Homo sapiens
tttttccatcatt

SEQ ID NO: 4025545 - DNA, 14 bp, Homo sapiens
tttttccatcattt

SEQ ID NO: 4025546 - DNA, 15 bp, Homo sapiens
tttttccctccccag

SEQ ID NO: 4025547 - DNA, 13 bp, Homo sapiens
tttttcctcccag

SEQ ID NO: 4025548 - DNA, 11 bp, Homo sapiens
tttttcctcct

SEQ ID NO: 4025549 - DNA, 19 bp, Homo sapiens
tttttcctctgagcccagc

SEQ ID NO: 4025550 - DNA, 20 bp, Homo sapiens
tttttccttaatccagctga

SEQ ID NO: 4025551 - DNA, 20 bp, Homo sapiens
tttttccttcctctgtaaga

SEQ ID NO: 4025552 - DNA, 17 bp, Homo sapiens
tttttcggtttcaaagt

SEQ ID NO: 4025553 - DNA, 15 bp, Homo sapiens
tgtgttcctggctga

SEQ ID NO: 4025554 - DNA, 19 bp, Homo sapiens
tgtgttcctggctgatgat

SEQ ID NO: 4025555 - DNA, 18 bp, Homo sapiens
tgtgttgccactttccaa

SEQ ID NO: 4025556 - DNA, 13 bp, Homo sapiens
tgtgttgttgctt

SEQ ID NO: 4025557 - DNA, 14 bp, Homo sapiens
tgtgttgttgcttt

SEQ ID NO: 4025558 - DNA, 15 bp, Homo sapiens
tgtgtttcaagttca

SEQ ID NO: 4025559 - DNA, 16 bp, Homo sapiens
tgtgtttgaaatcatc

SEQ ID NO: 4025560 - DNA, 16 bp, Homo sapiens
tgtgtttgcagcctgc

SEQ ID NO: 4025561 - DNA, 14 bp, Homo sapiens
tgtgttttctgaat

SEQ ID NO: 4025562 - DNA, 19 bp, Homo sapiens
tgtgtttttattgttaact

SEQ ID NO: 4025563 - DNA, 14 bp, Homo sapiens
tgtgtttttctttt

SEQ ID NO: 4025564 - DNA, 17 bp, Homo sapiens
tgtgttttttaagatag

SEQ ID NO: 4025565 - DNA, 13 bp, Homo sapiens
tgttaaaaataaa

SEQ ID NO: 4025566 - DNA, 12 bp, Homo sapiens
tgttaaaatcta

SEQ ID NO: 4025567 - DNA, 22 bp, Homo sapiens
tgttaaaattatacctgttgct

SEQ ID NO: 4025568 - DNA, 13 bp, Homo sapiens
tgttaaatactgt

SEQ ID NO: 4025569 - DNA, 14 bp, Homo sapiens
tgttaaatactgtg

SEQ ID NO: 4025570 - DNA, 16 bp, Homo sapiens
tgttaaatttgtaagt

SEQ ID NO: 4025571 - DNA, 15 bp, Homo sapiens
tgttaaccatttaag

SEQ ID NO: 4025572 - DNA, 15 bp, Homo sapiens
tgttaacctcagtgt

SEQ ID NO: 4025573 - DNA, 14 bp, Homo sapiens
tgttaactatgaca

SEQ ID NO: 4025574 - DNA, 15 bp, Homo sapiens
tgttaagaattgacc

SEQ ID NO: 4025575 - DNA, 21 bp, Homo sapiens
tgttaagagataattcttaaa

SEQ ID NO: 4025576 - DNA, 23 bp, Homo sapiens
tgttaagcagatggaatgctgtg

SEQ ID NO: 4025577 - DNA, 15 bp, Homo sapiens
tgttaaggaaactct

SEQ ID NO: 4025578 - DNA, 16 bp, Homo sapiens
tgttaaggaaactctt

SEQ ID NO: 4025579 - DNA, 17 bp, Homo sapiens
tgttaaggaaactctta

SEQ ID NO: 4025580 - DNA, 23 bp, Homo sapiens
tgttaaggaaactcttatctcag

SEQ ID NO: 4025581 - DNA, 17 bp, Homo sapiens
tgttaaggttgaacttt

SEQ ID NO: 4025582 - DNA, 13 bp, Homo sapiens
tgttaagtgtaaa

SEQ ID NO: 4025583 - DNA, 17 bp, Homo sapiens
tgttaatgaaaatgtca

SEQ ID NO: 4025584 - DNA, 19 bp, Homo sapiens
tgttaatgaaaatgtcaga

SEQ ID NO: 4025585 - DNA, 19 bp, Homo sapiens
tgttaatggatttcagaag

SEQ ID NO: 4025586 - DNA, 20 bp, Homo sapiens
tgttaatggtgcaaatccta

SEQ ID NO: 4025587 - DNA, 18 bp, Homo sapiens
tgttaattataggagcct

SEQ ID NO: 4025588 - DNA, 21 bp, Homo sapiens
tgttaccactggtaacatgtg

SEQ ID NO: 4025589 - DNA, 15 bp, Homo sapiens
tgttaccgcctgtct

SEQ ID NO: 4025590 - DNA, 18 bp, Homo sapiens
tgttacctaaagtatttt

SEQ ID NO: 4025591 - DNA, 15 bp, Homo sapiens
tgttactattttcta

SEQ ID NO: 4025592 - DNA, 20 bp, Homo sapiens
tgttactattttctacaatt

SEQ ID NO: 4025593 - DNA, 22 bp, Homo sapiens
tgttactattttctacaattaa

SEQ ID NO: 4025594 - DNA, 20 bp, Homo sapiens
tgttactcagtgttagagaa

SEQ ID NO: 4025595 - DNA, 17 bp, Homo sapiens
tgttactctggttcttt

SEQ ID NO: 4025596 - DNA, 15 bp, Homo sapiens
tgttactgaccagca

SEQ ID NO: 4025597 - DNA, 13 bp, Homo sapiens
tgttactgatcat

SEQ ID NO: 4025598 - DNA, 20 bp, Homo sapiens
tgttactgatcatgcattgt

SEQ ID NO: 4025599 - DNA, 12 bp, Homo sapiens
tgttactgtaat

SEQ ID NO: 4025600 - DNA, 15 bp, Homo sapiens
tgttactgtaattcc

SEQ ID NO: 4025601 - DNA, 18 bp, Homo sapiens
tgttacttacctaaacag

SEQ ID NO: 4025602 - DNA, 15 bp, Homo sapiens
tgttacttccttatg

SEQ ID NO: 4025603 - DNA, 17 bp, Homo sapiens
tgttagaaaacaaaatt

SEQ ID NO: 4025604 - DNA, 17 bp, Homo sapiens
tgttagaaaatgactta

SEQ ID NO: 4025605 - DNA, 20 bp, Homo sapiens
tgttagaaaatgacttattt

SEQ ID NO: 4025606 - DNA, 19 bp, Homo sapiens
tgttagcccttcagattgt

SEQ ID NO: 4025607 - DNA, 14 bp, Homo sapiens
tgttagcttcctta

SEQ ID NO: 4025608 - DNA, 20 bp, Homo sapiens
tgttagcttccttaagtata

SEQ ID NO: 4025609 - DNA, 17 bp, Homo sapiens
tgttaggaacagcagtg

SEQ ID NO: 4025610 - DNA, 23 bp, Homo sapiens
tgttaggaacagcagtgttctca

SEQ ID NO: 4025611 - DNA, 15 bp, Homo sapiens
tgttagtattttaat

SEQ ID NO: 4025612 - DNA, 15 bp, Homo sapiens
tgttagtcatttgct

SEQ ID NO: 4025613 - DNA, 20 bp, Homo sapiens
tgttagttctagctctattt

SEQ ID NO: 4025614 - DNA, 15 bp, Homo sapiens
tgttagtttacaata

SEQ ID NO: 4025615 - DNA, 17 bp, Homo sapiens
tgttatcaaactgctgt

SEQ ID NO: 4025616 - DNA, 14 bp, Homo sapiens
tgttatcagctttc

SEQ ID NO: 4025617 - DNA, 13 bp, Homo sapiens
tgttatgaacatg

SEQ ID NO: 4025618 - DNA, 15 bp, Homo sapiens
tgttatgaacatgca

SEQ ID NO: 4025619 - DNA, 15 bp, Homo sapiens
tgtttgtctcttctg

SEQ ID NO: 4025620 - DNA, 19 bp, Homo sapiens
tgtttgtctgtcttcatag

SEQ ID NO: 4025621 - DNA, 14 bp, Homo sapiens
tgtttgtggcctca

SEQ ID NO: 4025622 - DNA, 14 bp, Homo sapiens
tgtttgtttaattt

SEQ ID NO: 4025623 - DNA, 19 bp, Homo sapiens
tgtttgtttcaagaacctg

SEQ ID NO: 4025624 - DNA, 13 bp, Homo sapiens
tgtttgtttcttt

SEQ ID NO: 4025625 - DNA, 13 bp, Homo sapiens
tgtttgtttgtct

SEQ ID NO: 4025626 - DNA, 14 bp, Homo sapiens
tgttttaaattctg

SEQ ID NO: 4025627 - DNA, 19 bp, Homo sapiens
tgttttaagactgaatgtt

SEQ ID NO: 4025628 - DNA, 18 bp, Homo sapiens
tgttttaatctgaaattc

SEQ ID NO: 4025629 - DNA, 15 bp, Homo sapiens
tgttttactgtgaaa

SEQ ID NO: 4025630 - DNA, 18 bp, Homo sapiens
tgttttactgtgaaactg

SEQ ID NO: 4025631 - DNA, 15 bp, Homo sapiens
tgttttatatacctg

SEQ ID NO: 4025632 - DNA, 15 bp, Homo sapiens
tgttttattttcaaa

SEQ ID NO: 4025633 - DNA, 13 bp, Homo sapiens
tgttttcaggtgt

SEQ ID NO: 4025634 - DNA, 17 bp, Homo sapiens
tgttttctgaataacat

SEQ ID NO: 4025635 - DNA, 19 bp, Homo sapiens
tgttttctgggggaaaaag

SEQ ID NO: 4025636 - DNA, 16 bp, Homo sapiens
tgttttctttctttaa

SEQ ID NO: 4025637 - DNA, 17 bp, Homo sapiens
tgttttgaaactcagta

SEQ ID NO: 4025638 - DNA, 17 bp, Homo sapiens
tgttttgaaatcaatgc

SEQ ID NO: 4025639 - DNA, 14 bp, Homo sapiens
tgttttgaattttg

SEQ ID NO: 4025640 - DNA, 15 bp, Homo sapiens
tgttttgaattttgt

SEQ ID NO: 4025641 - DNA, 13 bp, Homo sapiens
tgttttgcacttt

SEQ ID NO: 4025642 - DNA, 17 bp, Homo sapiens
tgttttgcttcccctcc

SEQ ID NO: 4025643 - DNA, 19 bp, Homo sapiens
tgttttgcttttgctcgat

SEQ ID NO: 4025644 - DNA, 19 bp, Homo sapiens
tgttttggtagattaaata

SEQ ID NO: 4025645 - DNA, 21 bp, Homo sapiens
tgttttggtagattaaatata

SEQ ID NO: 4025646 - DNA, 13 bp, Homo sapiens
tgttttgtgcatt

SEQ ID NO: 4025647 - DNA, 15 bp, Homo sapiens
tgtttttaagctgtt

SEQ ID NO: 4025648 - DNA, 20 bp, Homo sapiens
tgtttttaagctgtttccat

SEQ ID NO: 4025649 - DNA, 19 bp, Homo sapiens
tgtttttaagtaacttaag

SEQ ID NO: 4025650 - DNA, 16 bp, Homo sapiens
tgtttttatcttttta

SEQ ID NO: 4025651 - DNA, 14 bp, Homo sapiens
tgtttttcatgaaa

SEQ ID NO: 4025652 - DNA, 18 bp, Homo sapiens
tgtttttccctccccaga

SEQ ID NO: 4025653 - DNA, 17 bp, Homo sapiens
tgtttttctctaatgct

SEQ ID NO: 4025654 - DNA, 20 bp, Homo sapiens
tgtttttgcttgttatatta

SEQ ID NO: 4025655 - DNA, 17 bp, Homo sapiens
tgtttttgctttctgaa

SEQ ID NO: 4025656 - DNA, 18 bp, Homo sapiens
tgtttttgctttctgaaa

SEQ ID NO: 4025657 - DNA, 22 bp, Homo sapiens
tgtttttgtatttattaatttg

SEQ ID NO: 4025658 - DNA, 14 bp, Homo sapiens
tgtttttgttgtgt

SEQ ID NO: 4025659 - DNA, 15 bp, Homo sapiens
tgtttttgttgtgtg

SEQ ID NO: 4025660 - DNA, 12 bp, Homo sapiens
tgttttttaaga

SEQ ID NO: 4025661 - DNA, 21 bp, Homo sapiens
tgttttttagatcaaatactt

SEQ ID NO: 4025662 - DNA, 14 bp, Homo sapiens
tgttttttgaaaac

SEQ ID NO: 4025663 - DNA, 23 bp, Homo sapiens
tgttttttgccacagcttttgca

SEQ ID NO: 4025664 - DNA, 16 bp, Homo sapiens
ttaaaaaaaaaggcat

SEQ ID NO: 4025665 - DNA, 23 bp, Homo sapiens
ttaaaaaaatcacaaaaatttga

SEQ ID NO: 4025666 - DNA, 14 bp, Homo sapiens
ttaaaaaaatgaca

SEQ ID NO: 4025667 - DNA, 21 bp, Homo sapiens
ttaaaaaaattggttggagaa

SEQ ID NO: 4025668 - DNA, 15 bp, Homo sapiens
ttaaaaaacagaaaa

SEQ ID NO: 4025669 - DNA, 13 bp, Homo sapiens
ttaaaaaacttgt

SEQ ID NO: 4025670 - DNA, 16 bp, Homo sapiens
ttaaaaacaaaaggca

SEQ ID NO: 4025671 - DNA, 16 bp, Homo sapiens
ttaaaaacatagaaaa

SEQ ID NO: 4025672 - DNA, 23 bp, Homo sapiens
ttaaaaagggcagggcatctcct

SEQ ID NO: 4025673 - DNA, 16 bp, Homo sapiens
ttaaaaataaatccca

SEQ ID NO: 4025674 - DNA, 14 bp, Homo sapiens
ttaaaaatacatat

SEQ ID NO: 4025675 - DNA, 14 bp, Homo sapiens
ttaaaaatgtaaat

SEQ ID NO: 4025676 - DNA, 13 bp, Homo sapiens
ttaaaacagtatt

SEQ ID NO: 4025677 - DNA, 16 bp, Homo sapiens
ttaaaactaagcacaa

SEQ ID NO: 4025678 - DNA, 17 bp, Homo sapiens
ttaaaactaggtaatgt

SEQ ID NO: 4025679 - DNA, 19 bp, Homo sapiens
ttaaaacttcttaaatatc

SEQ ID NO: 4025680 - DNA, 13 bp, Homo sapiens
ttaaaagaatgac

SEQ ID NO: 4025681 - DNA, 23 bp, Homo sapiens
ttaaaaggaaagtcaagaagaat

SEQ ID NO: 4025682 - DNA, 16 bp, Homo sapiens
ttaaaataaaaattct

SEQ ID NO: 4025683 - DNA, 17 bp, Homo sapiens
ttaaaataaaatgaaaa

SEQ ID NO: 4025684 - DNA, 20 bp, Homo sapiens
ttaaaataaaatgaaaattg

SEQ ID NO: 4025685 - DNA, 21 bp, Homo sapiens
ttaaaataaaatgaaaattgt

SEQ ID NO: 4025686 - DNA, 19 bp, Homo sapiens
ttaaaataaacagttgtga

SEQ ID NO: 4025687 - DNA, 18 bp, Homo sapiens
ttaaaataggggatattt

SEQ ID NO: 4025688 - DNA, 22 bp, Homo sapiens
ttaaaataggggatatttaagg

SEQ ID NO: 4025689 - DNA, 12 bp, Homo sapiens
ttaaaatatatt

SEQ ID NO: 4025690 - DNA, 14 bp, Homo sapiens
ttaaaatatggcta

SEQ ID NO: 4025691 - DNA, 17 bp, Homo sapiens
ttaaaatctattctgtg

SEQ ID NO: 4025692 - DNA, 23 bp, Homo sapiens
ttaaaatctattctgtgttgcat

SEQ ID NO: 4025693 - DNA, 19 bp, Homo sapiens
ttaaaattaagtagaacaa

SEQ ID NO: 4025694 - DNA, 16 bp, Homo sapiens
ttaaaattacaactaa

SEQ ID NO: 4025695 - DNA, 19 bp, Homo sapiens
ttaaaattatatagctgct

SEQ ID NO: 4025696 - DNA, 23 bp, Homo sapiens
ttaaaattatcaatatctaatat

SEQ ID NO: 4025697 - DNA, 21 bp, Homo sapiens
ttaaaattgtcacctctgtta

SEQ ID NO: 4025698 - DNA, 16 bp, Homo sapiens
ttaaaatttatcttaa

SEQ ID NO: 4025699 - DNA, 13 bp, Homo sapiens
ttaaacaaagtga

SEQ ID NO: 4025700 - DNA, 21 bp, Homo sapiens
ttaaacacaggctgtccttaa

SEQ ID NO: 4025701 - DNA, 16 bp, Homo sapiens
ttaaacacctgacaca

SEQ ID NO: 4025702 - DNA, 11 bp, Homo sapiens
ttaaacagatg

SEQ ID NO: 4025703 - DNA, 22 bp, Homo sapiens
ttaaacagatgatgagaatttc

SEQ ID NO: 4025704 - DNA, 21 bp, Homo sapiens
ttaaacagtagttgtattctt

SEQ ID NO: 4025705 - DNA, 23 bp, Homo sapiens
ttaaacagtagttgtattcttct

SEQ ID NO: 4025706 - DNA, 13 bp, Homo sapiens
ttaaacataataa

SEQ ID NO: 4025707 - DNA, 17 bp, Homo sapiens
ttaaacatttgttcctg

SEQ ID NO: 4025708 - DNA, 19 bp, Homo sapiens
ttaaacatttgttcctgga

SEQ ID NO: 4025709 - DNA, 23 bp, Homo sapiens
ttaaaccaacctttaaaattgtc

SEQ ID NO: 4025710 - DNA, 21 bp, Homo sapiens
ttaaacctgtttttttttcat

SEQ ID NO: 4025711 - DNA, 15 bp, Homo sapiens
ttaaactaaataatg

SEQ ID NO: 4025712 - DNA, 21 bp, Homo sapiens
ttaaactaaataatgaataaa

SEQ ID NO: 4025713 - DNA, 17 bp, Homo sapiens
ttaaactgtacagaatt

SEQ ID NO: 4025714 - DNA, 18 bp, Homo sapiens
ttaaactgtacagaattt

SEQ ID NO: 4025715 - DNA, 21 bp, Homo sapiens
ttaaactgtacagaatttcca

SEQ ID NO: 4025716 - DNA, 12 bp, Homo sapiens
ttaaagacagag

SEQ ID NO: 4025717 - DNA, 14 bp, Homo sapiens
ttaaagatattgtt

SEQ ID NO: 4025718 - DNA, 22 bp, Homo sapiens
ttaaagcaagcaacacagagga

SEQ ID NO: 4025719 - DNA, 18 bp, Homo sapiens
ttaaagcagacagtcaca

SEQ ID NO: 4025720 - DNA, 20 bp, Homo sapiens
ttaaagcattgctgttatgt

SEQ ID NO: 4025721 - DNA, 22 bp, Homo sapiens
ttaaagctcatgcatttcaagc

SEQ ID NO: 4025722 - DNA, 13 bp, Homo sapiens
tgtcatctgtgca

SEQ ID NO: 4025723 - DNA, 16 bp, Homo sapiens
tgtcatgctgggattt

SEQ ID NO: 4025724 - DNA, 16 bp, Homo sapiens
tgtcatgtctgcttgt

SEQ ID NO: 4025725 - DNA, 18 bp, Homo sapiens
tgtcatgtctgcttgtca

SEQ ID NO: 4025726 - DNA, 17 bp, Homo sapiens
tgtcattaaaggtatca

SEQ ID NO: 4025727 - DNA, 13 bp, Homo sapiens
tgtcattgcttct

SEQ ID NO: 4025728 - DNA, 13 bp, Homo sapiens
tgtcatttgttaa

SEQ ID NO: 4025729 - DNA, 16 bp, Homo sapiens
tgtcatttgttaaaat

SEQ ID NO: 4025730 - DNA, 17 bp, Homo sapiens
tgtcatttgttgtgatg

SEQ ID NO: 4025731 - DNA, 19 bp, Homo sapiens
tgtccaaaagcgccctcac

SEQ ID NO: 4025732 - DNA, 19 bp, Homo sapiens
tgtccaaagaggctgcccc

SEQ ID NO: 4025733 - DNA, 19 bp, Homo sapiens
tgtccaaaggaggctggca

SEQ ID NO: 4025734 - DNA, 23 bp, Homo sapiens
tgtccaactgagaagtaccttat

SEQ ID NO: 4025735 - DNA, 19 bp, Homo sapiens
tgtccaactggccctattt

SEQ ID NO: 4025736 - DNA, 17 bp, Homo sapiens
tgtccaagttcttcacc

SEQ ID NO: 4025737 - DNA, 18 bp, Homo sapiens
tgtccaagttcttcacct

SEQ ID NO: 4025738 - DNA, 20 bp, Homo sapiens
tgtccaagttcttcacctct

SEQ ID NO: 4025739 - DNA, 15 bp, Homo sapiens
tgtccacctgtgggt

SEQ ID NO: 4025740 - DNA, 21 bp, Homo sapiens
tgtccagaagaatattcagga

SEQ ID NO: 4025741 - DNA, 21 bp, Homo sapiens
tgtccagattattggctgctt

SEQ ID NO: 4025742 - DNA, 22 bp, Homo sapiens
tgtccagcctgggcagccaggc

SEQ ID NO: 4025743 - DNA, 21 bp, Homo sapiens
tgtccagctgagcgccaggat

SEQ ID NO: 4025744 - DNA, 14 bp, Homo sapiens
tgtccagctggggc

SEQ ID NO: 4025745 - DNA, 20 bp, Homo sapiens
tgtcccacccacacagctgc

SEQ ID NO: 4025746 - DNA, 19 bp, Homo sapiens
tgtcccacccccttccccc

SEQ ID NO: 4025747 - DNA, 16 bp, Homo sapiens
tgtcccacccctagcc

SEQ ID NO: 4025748 - DNA, 21 bp, Homo sapiens
tgtcccacccctagccaccag

SEQ ID NO: 4025749 - DNA, 22 bp, Homo sapiens
tgtcccaccgggagcctccccc

SEQ ID NO: 4025750 - DNA, 12 bp, Homo sapiens
tgtcccaggcag

SEQ ID NO: 4025751 - DNA, 20 bp, Homo sapiens
tgtcccaggcagcacagtgt

SEQ ID NO: 4025752 - DNA, 13 bp, Homo sapiens
tgtcccaggccgg

SEQ ID NO: 4025753 - DNA, 23 bp, Homo sapiens
tgtcccagtgctcaccagccctg

SEQ ID NO: 4025754 - DNA, 18 bp, Homo sapiens
tgtcccatttccttggag

SEQ ID NO: 4025755 - DNA, 21 bp, Homo sapiens
tgtccccagccctgtcctggt

SEQ ID NO: 4025756 - DNA, 13 bp, Homo sapiens
tgtcccccaggct

SEQ ID NO: 4025757 - DNA, 15 bp, Homo sapiens
tgtcccccaggctgg

SEQ ID NO: 4025758 - DNA, 19 bp, Homo sapiens
tgtccccctcccctcccag

SEQ ID NO: 4025759 - DNA, 22 bp, Homo sapiens
tgtccctatctattaaagtgac

SEQ ID NO: 4025760 - DNA, 17 bp, Homo sapiens
tgtccctatgcatatca

SEQ ID NO: 4025761 - DNA, 16 bp, Homo sapiens
tgtccctctagtgcct

SEQ ID NO: 4025762 - DNA, 17 bp, Homo sapiens
tgtccctggcttcctta

SEQ ID NO: 4025763 - DNA, 14 bp, Homo sapiens
tgtcccttgcctct

SEQ ID NO: 4025764 - DNA, 14 bp, Homo sapiens
tgtccctttcccta

SEQ ID NO: 4025765 - DNA, 13 bp, Homo sapiens
tgtcccttttccc

SEQ ID NO: 4025766 - DNA, 22 bp, Homo sapiens
tgtccgctgggtggtaccctct

SEQ ID NO: 4025767 - DNA, 20 bp, Homo sapiens
tgtcctaaaccgtcccctcc

SEQ ID NO: 4025768 - DNA, 20 bp, Homo sapiens
tgtcctaaggacacactaat

SEQ ID NO: 4025769 - DNA, 18 bp, Homo sapiens
tgtcctaattcttctgtc

SEQ ID NO: 4025770 - DNA, 16 bp, Homo sapiens
tgtcctcagccttgcc

SEQ ID NO: 4025771 - DNA, 21 bp, Homo sapiens
tgtcctcagccttgccagaga

SEQ ID NO: 4025772 - DNA, 20 bp, Homo sapiens
tgtcctcagtccatttatat

SEQ ID NO: 4025773 - DNA, 23 bp, Homo sapiens
tgtcctccaacaccaagcacagc

SEQ ID NO: 4025774 - DNA, 15 bp, Homo sapiens
tgtcctccaagtgcc

SEQ ID NO: 4025775 - DNA, 19 bp, Homo sapiens
tgtcctccagaagcctctg

SEQ ID NO: 4025776 - DNA, 20 bp, Homo sapiens
tgtcctccagaagcctctgg

SEQ ID NO: 4025777 - DNA, 15 bp, Homo sapiens
tgtcctccaggagct

SEQ ID NO: 4025778 - DNA, 19 bp, Homo sapiens
tgtcctcccatcccctgga

SEQ ID NO: 4025779 - DNA, 13 bp, Homo sapiens
tgtcctctcccct

SEQ ID NO: 4025780 - DNA, 22 bp, Homo sapiens
tgtcctctcccctccagccttt

SEQ ID NO: 4025781 - DNA, 13 bp, Homo sapiens
tgtcctcttctgc

SEQ ID NO: 4025782 - DNA, 14 bp, Homo sapiens
tgtcctgagcacca

SEQ ID NO: 4025783 - DNA, 15 bp, Homo sapiens
tgtcctgcctgtctg

SEQ ID NO: 4025784 - DNA, 18 bp, Homo sapiens
tgtcctgctggcttccag

SEQ ID NO: 4025785 - DNA, 14 bp, Homo sapiens
tgtcctgggcctgc

SEQ ID NO: 4025786 - DNA, 17 bp, Homo sapiens
tgtcctgggcctgcaga

SEQ ID NO: 4025787 - DNA, 15 bp, Homo sapiens
tgtcctggttcccgt

SEQ ID NO: 4025788 - DNA, 11 bp, Homo sapiens
tgtcctgtcct

SEQ ID NO: 4025789 - DNA, 13 bp, Homo sapiens
tgtcctgtcctgc

SEQ ID NO: 4025790 - DNA, 14 bp, Homo sapiens
tgtcctgtcctgct

SEQ ID NO: 4025791 - DNA, 18 bp, Homo sapiens
tgtccttaacccacctct

SEQ ID NO: 4025792 - DNA, 19 bp, Homo sapiens
tgtccttaacccacctctc

SEQ ID NO: 4025793 - DNA, 15 bp, Homo sapiens
tgtccttagtgtata

SEQ ID NO: 4025794 - DNA, 19 bp, Homo sapiens
tgtcctttaaaaaagaaaa

SEQ ID NO: 4025795 - DNA, 13 bp, Homo sapiens
tgtcctttccctt

SEQ ID NO: 4025796 - DNA, 13 bp, Homo sapiens
tgtcgagacactt

SEQ ID NO: 4025797 - DNA, 15 bp, Homo sapiens
tgtcgagacacttgc

SEQ ID NO: 4025798 - DNA, 14 bp, Homo sapiens
tgtcggagaggctg

SEQ ID NO: 4025799 - DNA, 23 bp, Homo sapiens
tgtcggctccagtccccagaact

SEQ ID NO: 4025800 - DNA, 15 bp, Homo sapiens
tgtcgtgccagtcct

SEQ ID NO: 4025801 - DNA, 21 bp, Homo sapiens
tgtcgttaaaaagttgtttgt

SEQ ID NO: 4025802 - DNA, 14 bp, Homo sapiens
tgtctaaaatgtca

SEQ ID NO: 4025803 - DNA, 16 bp, Homo sapiens
tgtctaaacaatgctg

SEQ ID NO: 4025804 - DNA, 18 bp, Homo sapiens
tgtctaaatttgaatgtt

SEQ ID NO: 4025805 - DNA, 12 bp, Homo sapiens
tgtgaatacaat

SEQ ID NO: 4025806 - DNA, 20 bp, Homo sapiens
tgtgaatacaattaaaggtc

SEQ ID NO: 4025807 - DNA, 16 bp, Homo sapiens
tgtgaatagcctggcc

SEQ ID NO: 4025808 - DNA, 12 bp, Homo sapiens
tgtgaatgtggg

SEQ ID NO: 4025809 - DNA, 15 bp, Homo sapiens
tgtgaattattgaca

SEQ ID NO: 4025810 - DNA, 19 bp, Homo sapiens
tgtgaattattgacactga

SEQ ID NO: 4025811 - DNA, 21 bp, Homo sapiens
tgtgaattattgacactgaac

SEQ ID NO: 4025812 - DNA, 15 bp, Homo sapiens
tgtgaattgactacc

SEQ ID NO: 4025813 - DNA, 22 bp, Homo sapiens
tgtgaattgcctgcagagagaa

SEQ ID NO: 4025814 - DNA, 21 bp, Homo sapiens
tgtgacaactgtctaacttta

SEQ ID NO: 4025815 - DNA, 22 bp, Homo sapiens
tgtgacaataatattgttgtat

SEQ ID NO: 4025816 - DNA, 12 bp, Homo sapiens
tgtgacagggcc

SEQ ID NO: 4025817 - DNA, 14 bp, Homo sapiens
tgtgacagggccag

SEQ ID NO: 4025818 - DNA, 23 bp, Homo sapiens
tgtgacagggccagtggggcctg

SEQ ID NO: 4025819 - DNA, 20 bp, Homo sapiens
tgtgacatctctattcccca

SEQ ID NO: 4025820 - DNA, 21 bp, Homo sapiens
tgtgacatctctattccccac

SEQ ID NO: 4025821 - DNA, 18 bp, Homo sapiens
tgtgacatttatatattg

SEQ ID NO: 4025822 - DNA, 14 bp, Homo sapiens
tgtgaccagcactg

SEQ ID NO: 4025823 - DNA, 13 bp, Homo sapiens
tgtgacctgaggg

SEQ ID NO: 4025824 - DNA, 14 bp, Homo sapiens
tgtgacctgagggc

SEQ ID NO: 4025825 - DNA, 22 bp, Homo sapiens
tgtgactctaagctcagtgctc

SEQ ID NO: 4025826 - DNA, 21 bp, Homo sapiens
tgtgactcttactccttaggt

SEQ ID NO: 4025827 - DNA, 20 bp, Homo sapiens
tgcatattttgagaaactgc

SEQ ID NO: 4025828 - DNA, 13 bp, Homo sapiens
tgcatcactgggt

SEQ ID NO: 4025829 - DNA, 14 bp, Homo sapiens
tgcatcactgggtg

SEQ ID NO: 4025830 - DNA, 18 bp, Homo sapiens
tgcatccaaaggtgctca

SEQ ID NO: 4025831 - DNA, 14 bp, Homo sapiens
tgcatcccagcacc

SEQ ID NO: 4025832 - DNA, 18 bp, Homo sapiens
tgcatcccccctgctcag

SEQ ID NO: 4025833 - DNA, 13 bp, Homo sapiens
tgcatccctgaga

SEQ ID NO: 4025834 - DNA, 18 bp, Homo sapiens
tgcatctagattatggag

SEQ ID NO: 4025835 - DNA, 19 bp, Homo sapiens
tgcatctcaaaattattct

SEQ ID NO: 4025836 - DNA, 23 bp, Homo sapiens
tgcatctgggattcccaccaagg

SEQ ID NO: 4025837 - DNA, 16 bp, Homo sapiens
tgcatctttgttactt

SEQ ID NO: 4025838 - DNA, 16 bp, Homo sapiens
tgcatgaagagaagca

SEQ ID NO: 4025839 - DNA, 21 bp, Homo sapiens
tgcatgaagagaagcaatttt

SEQ ID NO: 4025840 - DNA, 22 bp, Homo sapiens
tgcatgaagagaagcaattttg

SEQ ID NO: 4025841 - DNA, 16 bp, Homo sapiens
tgcatgcatgccctct

SEQ ID NO: 4025842 - DNA, 13 bp, Homo sapiens
tgcatgccctctc

SEQ ID NO: 4025843 - DNA, 16 bp, Homo sapiens
tgcatgccctctctga

SEQ ID NO: 4025844 - DNA, 23 bp, Homo sapiens
tgcatggacaccccttatccagg

SEQ ID NO: 4025845 - DNA, 18 bp, Homo sapiens
tgcatggaggccctcctg

SEQ ID NO: 4025846 - DNA, 22 bp, Homo sapiens
tgcatggctccagaaatgtcta

SEQ ID NO: 4025847 - DNA, 17 bp, Homo sapiens
tgcatggtgccccagga

SEQ ID NO: 4025848 - DNA, 14 bp, Homo sapiens
tgctccctccagaa

SEQ ID NO: 4025849 - DNA, 14 bp, Homo sapiens
tgctccctcccctg

SEQ ID NO: 4025850 - DNA, 18 bp, Homo sapiens
tgctccctcccctgccct

SEQ ID NO: 4025851 - DNA, 20 bp, Homo sapiens
tgctccctcccctgccctgg

SEQ ID NO: 4025852 - DNA, 15 bp, Homo sapiens
tgctccgccatggtg

SEQ ID NO: 4025853 - DNA, 15 bp, Homo sapiens
tgctccgctgctcct

SEQ ID NO: 4025854 - DNA, 20 bp, Homo sapiens
tgctccgctgctccttggct

SEQ ID NO: 4025855 - DNA, 14 bp, Homo sapiens
tgctcctcacctgt

SEQ ID NO: 4025856 - DNA, 15 bp, Homo sapiens
tgctcctcacctgtc

SEQ ID NO: 4025857 - DNA, 15 bp, Homo sapiens
tgctcctcctgccct

SEQ ID NO: 4025858 - DNA, 18 bp, Homo sapiens
tgcttctctgcccagctt

SEQ ID NO: 4025859 - DNA, 20 bp, Homo sapiens
tgcttctgtagtactcctta

SEQ ID NO: 4025860 - DNA, 17 bp, Homo sapiens
tgcttctgtatttcctt

SEQ ID NO: 4025861 - DNA, 17 bp, Homo sapiens
tgcttcttactgataat

SEQ ID NO: 4025862 - DNA, 21 bp, Homo sapiens
tgcttgaaattactgtgtaaa

SEQ ID NO: 4025863 - DNA, 16 bp, Homo sapiens
tgcttgaaggccctgc

SEQ ID NO: 4025864 - DNA, 14 bp, Homo sapiens
tggaagattttaaa

SEQ ID NO: 4025865 - DNA, 16 bp, Homo sapiens
tggaagattttaaatt

SEQ ID NO: 4025866 - DNA, 17 bp, Homo sapiens
tggaagattttcagtct

SEQ ID NO: 4025867 - DNA, 14 bp, Homo sapiens
tggaagcaaagtat

SEQ ID NO: 4025868 - DNA, 16 bp, Homo sapiens
tggagatactggtgga

SEQ ID NO: 4025869 - DNA, 13 bp, Homo sapiens
tggagatgcagag

SEQ ID NO: 4025870 - DNA, 16 bp, Homo sapiens
tggagcaaaaggcagc

SEQ ID NO: 4025871 - DNA, 20 bp, Homo sapiens
tggagcaaaaggcagctcac

SEQ ID NO: 4025872 - DNA, 21 bp, Homo sapiens
tggagcaaaaggcagctcacc

SEQ ID NO: 4025873 - DNA, 23 bp, Homo sapiens
tggagcacatgttactgcttcat

SEQ ID NO: 4025874 - DNA, 13 bp, Homo sapiens
tggagcaggagcc

SEQ ID NO: 4025875 - DNA, 19 bp, Homo sapiens
tggagcaggagccccgcca

SEQ ID NO: 4025876 - DNA, 14 bp, Homo sapiens
tggagcccaggagt

SEQ ID NO: 4025877 - DNA, 22 bp, Homo sapiens
tggagcccagggcatcttgctg

SEQ ID NO: 4025878 - DNA, 13 bp, Homo sapiens
tggagccccaggg

SEQ ID NO: 4025879 - DNA, 12 bp, Homo sapiens
tggagcccccag

SEQ ID NO: 4025880 - DNA, 15 bp, Homo sapiens
tggagcccccagcag

SEQ ID NO: 4025881 - DNA, 15 bp, Homo sapiens
tggagccctgttcct

SEQ ID NO: 4025882 - DNA, 18 bp, Homo sapiens
tggagcctgacagccaga

SEQ ID NO: 4025883 - DNA, 18 bp, Homo sapiens
tggagcggggtatgaaga

SEQ ID NO: 4025884 - DNA, 16 bp, Homo sapiens
tggagctactgatgaa

SEQ ID NO: 4025885 - DNA, 13 bp, Homo sapiens
tggagctgaagac

SEQ ID NO: 4025886 - DNA, 15 bp, Homo sapiens
tggagctgaagacct

SEQ ID NO: 4025887 - DNA, 21 bp, Homo sapiens
tggagctgtcatcactcaaca

SEQ ID NO: 4025888 - DNA, 21 bp, Homo sapiens
tggagcttgtggagttgatga

SEQ ID NO: 4025889 - DNA, 21 bp, Homo sapiens
tggagcttttttctttaagat

SEQ ID NO: 4025890 - DNA, 16 bp, Homo sapiens
tggaggaaaaaggtca

SEQ ID NO: 4025891 - DNA, 21 bp, Homo sapiens
tggaggaaaaccaagccgtgg

SEQ ID NO: 4025892 - DNA, 19 bp, Homo sapiens
tggaggaacaactctccag

SEQ ID NO: 4025893 - DNA, 17 bp, Homo sapiens
tggaggatcagtttttt

SEQ ID NO: 4025894 - DNA, 24 bp, Homo sapiens
tggaggccaccgggacagacctgg

SEQ ID NO: 4025895 - DNA, 18 bp, Homo sapiens
tggaggcccaggctggga

SEQ ID NO: 4025896 - DNA, 13 bp, Homo sapiens
tggaggcccctgg

SEQ ID NO: 4025897 - DNA, 20 bp, Homo sapiens
tggaggcccctggagccaga

SEQ ID NO: 4025898 - DNA, 19 bp, Homo sapiens
tggaggccttccagctgct

SEQ ID NO: 4025899 - DNA, 13 bp, Homo sapiens
tggaggcttcctg

SEQ ID NO: 4025900 - DNA, 15 bp, Homo sapiens
tggaggcttcctgcg

SEQ ID NO: 4025901 - DNA, 16 bp, Homo sapiens
tggaggcttcctgcgt

SEQ ID NO: 4025902 - DNA, 17 bp, Homo sapiens
tggaggcttcctgcgtc

SEQ ID NO: 4025903 - DNA, 12 bp, Homo sapiens
tggagggaaagc

SEQ ID NO: 4025904 - DNA, 23 bp, Homo sapiens
tggagggacttttaatcagtgaa

SEQ ID NO: 4025905 - DNA, 17 bp, Homo sapiens
tggagggagggaagggt

SEQ ID NO: 4025906 - DNA, 13 bp, Homo sapiens
tggagggcttggc

SEQ ID NO: 4025907 - DNA, 15 bp, Homo sapiens
tggagggcttggccc

SEQ ID NO: 4025908 - DNA, 16 bp, Homo sapiens
tggaggggagtgttgg

SEQ ID NO: 4025909 - DNA, 19 bp, Homo sapiens
tggaggggtggtcctgact

SEQ ID NO: 4025910 - DNA, 19 bp, Homo sapiens
tggaggggtgtggcagtgg

SEQ ID NO: 4025911 - DNA, 15 bp, Homo sapiens
tggaggtatttgaaa

SEQ ID NO: 4025912 - DNA, 20 bp, Homo sapiens
tggaggtgagatcacagcct

SEQ ID NO: 4025913 - DNA, 23 bp, Homo sapiens
tggaggtgagatcacagcctcca

SEQ ID NO: 4025914 - DNA, 15 bp, Homo sapiens
tggaggttctcagag

SEQ ID NO: 4025915 - DNA, 17 bp, Homo sapiens
tggaggttctcagagcc

SEQ ID NO: 4025916 - DNA, 19 bp, Homo sapiens
tggaggttctcagagccaa

SEQ ID NO: 4025917 - DNA, 15 bp, Homo sapiens
tggagtactatattt

SEQ ID NO: 4025918 - DNA, 23 bp, Homo sapiens
tggagtcagatgagcaaggacat

SEQ ID NO: 4025919 - DNA, 14 bp, Homo sapiens
tggagtcagcctcg

SEQ ID NO: 4025920 - DNA, 20 bp, Homo sapiens
tggagtcccctcacctcctc

SEQ ID NO: 4025921 - DNA, 21 bp, Homo sapiens
tggagtcccctcacctcctct

SEQ ID NO: 4025922 - DNA, 16 bp, Homo sapiens
tggagtctggagtggg

SEQ ID NO: 4025923 - DNA, 23 bp, Homo sapiens
tggagtgagtcacctgctccaga

SEQ ID NO: 4025924 - DNA, 16 bp, Homo sapiens
tggagtgcaaaaggct

SEQ ID NO: 4025925 - DNA, 19 bp, Homo sapiens
tggagtgcagggaggagag

SEQ ID NO: 4025926 - DNA, 20 bp, Homo sapiens
tggagtggaaggtctattgg

SEQ ID NO: 4025927 - DNA, 20 bp, Homo sapiens
tggagtgtttctaataaact

SEQ ID NO: 4025928 - DNA, 20 bp, Homo sapiens
tggagttacattaatgttaa

SEQ ID NO: 4025929 - DNA, 17 bp, Homo sapiens
tggagttgatctggaac

SEQ ID NO: 4025930 - DNA, 19 bp, Homo sapiens
tggagttgatctggaaccc

SEQ ID NO: 4025931 - DNA, 17 bp, Homo sapiens
tggagttttaactgtaa

SEQ ID NO: 4025932 - DNA, 23 bp, Homo sapiens
tggagtttttgtttggagagcac

SEQ ID NO: 4025933 - DNA, 14 bp, Homo sapiens
tggataaactgagc

SEQ ID NO: 4025934 - DNA, 15 bp, Homo sapiens
tggataaactgagcc

SEQ ID NO: 4025935 - DNA, 20 bp, Homo sapiens
tggataaatcatttcagtat

SEQ ID NO: 4025936 - DNA, 13 bp, Homo sapiens
tggataagtttct

SEQ ID NO: 4025937 - DNA, 19 bp, Homo sapiens
tggataagtttctattctg

SEQ ID NO: 4025938 - DNA, 15 bp, Homo sapiens
tggatactacatctt

SEQ ID NO: 4025939 - DNA, 15 bp, Homo sapiens
tggatataaaatgtg

SEQ ID NO: 4025940 - DNA, 22 bp, Homo sapiens
tggatattttcaaattgtatct

SEQ ID NO: 4025941 - DNA, 23 bp, Homo sapiens
tggatattttcaaattgtatcta

SEQ ID NO: 4025942 - DNA, 16 bp, Homo sapiens
tggatcacagctgctt

SEQ ID NO: 4025943 - DNA, 20 bp, Homo sapiens
tggatcacagctgctttctg

SEQ ID NO: 4025944 - DNA, 20 bp, Homo sapiens
tggatcacgacgctgcagag

SEQ ID NO: 4025945 - DNA, 20 bp, Homo sapiens
tggatcccctctgtctacaa

SEQ ID NO: 4025946 - DNA, 18 bp, Homo sapiens
tggatcccctgcggtcag

SEQ ID NO: 4025947 - DNA, 20 bp, Homo sapiens
tggatcccctgcggtcaggc

SEQ ID NO: 4025948 - DNA, 19 bp, Homo sapiens
tggatccctgcccttctca

SEQ ID NO: 4025949 - DNA, 14 bp, Homo sapiens
tggatctccaagga

SEQ ID NO: 4025950 - DNA, 15 bp, Homo sapiens
tggatctccccactc

SEQ ID NO: 4025951 - DNA, 16 bp, Homo sapiens
tggatctgtccaagga

SEQ ID NO: 4025952 - DNA, 14 bp, Homo sapiens
tggatcttgaatgt

SEQ ID NO: 4025953 - DNA, 15 bp, Homo sapiens
tggatcttgaatgtg

SEQ ID NO: 4025954 - DNA, 12 bp, Homo sapiens
tggatcttgcca

SEQ ID NO: 4025955 - DNA, 14 bp, Homo sapiens
tggatcttgccaca

SEQ ID NO: 4025956 - DNA, 16 bp, Homo sapiens
tggatcttttcattct

SEQ ID NO: 4025957 - DNA, 23 bp, Homo sapiens
tggatgaagattctcctgtgcta

SEQ ID NO: 4025958 - DNA, 16 bp, Homo sapiens
tggatgacagggcaga

SEQ ID NO: 4025959 - DNA, 13 bp, Homo sapiens
tggatgccagctg

SEQ ID NO: 4025960 - DNA, 17 bp, Homo sapiens
tggatgccagctgtgtc

SEQ ID NO: 4025961 - DNA, 15 bp, Homo sapiens
tggatgggaatttgt

SEQ ID NO: 4025962 - DNA, 18 bp, Homo sapiens
tggatgggggaactcaga

SEQ ID NO: 4025963 - DNA, 12 bp, Homo sapiens
tggatgttctga

SEQ ID NO: 4025964 - DNA, 12 bp, Homo sapiens
tggattaaaaca

SEQ ID NO: 4025965 - DNA, 18 bp, Homo sapiens
tggattattcatttaaaa

SEQ ID NO: 4025966 - DNA, 14 bp, Homo sapiens
tggattatttaata

SEQ ID NO: 4025967 - DNA, 14 bp, Homo sapiens
tggattctcagata

SEQ ID NO: 4025968 - DNA, 21 bp, Homo sapiens
tggattctcttagctactgta

SEQ ID NO: 4025969 - DNA, 14 bp, Homo sapiens
tggctctgcaatgg

SEQ ID NO: 4025970 - DNA, 13 bp, Homo sapiens
tggctctgcacta

SEQ ID NO: 4025971 - DNA, 15 bp, Homo sapiens
tggctcttctgccca

SEQ ID NO: 4025972 - DNA, 23 bp, Homo sapiens
tggctcttgatacccccctctgt

SEQ ID NO: 4025973 - DNA, 16 bp, Homo sapiens
tggctgacccctctgg

SEQ ID NO: 4025974 - DNA, 13 bp, Homo sapiens
tggctgactgggg

SEQ ID NO: 4025975 - DNA, 14 bp, Homo sapiens
tggctgactggggc

SEQ ID NO: 4025976 - DNA, 15 bp, Homo sapiens
tggctgagggcagct

SEQ ID NO: 4025977 - DNA, 22 bp, Homo sapiens
tggctgaggttcctctgcctgc

SEQ ID NO: 4025978 - DNA, 19 bp, Homo sapiens
tggctgccacacccagggg

SEQ ID NO: 4025979 - DNA, 20 bp, Homo sapiens
tggctgcccagacccctctg

SEQ ID NO: 4025980 - DNA, 21 bp, Homo sapiens
tggctgcccagacccctctgg

SEQ ID NO: 4025981 - DNA, 23 bp, Homo sapiens
tggctgcccagacccctctggcc

SEQ ID NO: 4025982 - DNA, 22 bp, Homo sapiens
tggctgcccatcatgtggcccc

SEQ ID NO: 4025983 - DNA, 13 bp, Homo sapiens
tggctgccccggc

SEQ ID NO: 4025984 - DNA, 18 bp, Homo sapiens
tggctgccccggcctcct

SEQ ID NO: 4025985 - DNA, 16 bp, Homo sapiens
tggctgcccctcacct

SEQ ID NO: 4025986 - DNA, 15 bp, Homo sapiens
tggctgcttctctct

SEQ ID NO: 4025987 - DNA, 13 bp, Homo sapiens
tggctgctttgcc

SEQ ID NO: 4025988 - DNA, 18 bp, Homo sapiens
tggctggaagagggtgaa

SEQ ID NO: 4025989 - DNA, 19 bp, Homo sapiens
tggctggcctcacccaccc

SEQ ID NO: 4025990 - DNA, 14 bp, Homo sapiens
tggctggctcctag

SEQ ID NO: 4025991 - DNA, 15 bp, Homo sapiens
tggctggctcctagg

SEQ ID NO: 4025992 - DNA, 23 bp, Homo sapiens
tggctgggacgtggctcagccag

SEQ ID NO: 4025993 - DNA, 15 bp, Homo sapiens
tggctggtccagggc

SEQ ID NO: 4025994 - DNA, 16 bp, Homo sapiens
tggctggtccagggct

SEQ ID NO: 4025995 - DNA, 15 bp, Homo sapiens
tggctgtgaggcccc

SEQ ID NO: 4025996 - DNA, 15 bp, Homo sapiens
tggcttaatgtttat

SEQ ID NO: 4025997 - DNA, 21 bp, Homo sapiens
tggcttacctgacctcttgct

SEQ ID NO: 4025998 - DNA, 13 bp, Homo sapiens
tggcttataaaca

SEQ ID NO: 4025999 - DNA, 18 bp, Homo sapiens
tggcttcaagttgtaaaa

SEQ ID NO: 4026000 - DNA, 20 bp, Homo sapiens
tggcttcaagttgtaaaaat

SEQ ID NO: 4026001 - DNA, 15 bp, Homo sapiens
tggcttccagcttca

SEQ ID NO: 4026002 - DNA, 23 bp, Homo sapiens
tggcttccagcttcaggcaccag

SEQ ID NO: 4026003 - DNA, 14 bp, Homo sapiens
tggcttccaggtat

SEQ ID NO: 4026004 - DNA, 21 bp, Homo sapiens
tggcttccaggtatctccagg

SEQ ID NO: 4026005 - DNA, 17 bp, Homo sapiens
tggcttcccatgtcttt

SEQ ID NO: 4026006 - DNA, 14 bp, Homo sapiens
tggcttccccactc

SEQ ID NO: 4026007 - DNA, 15 bp, Homo sapiens
tggcttccccactcc

SEQ ID NO: 4026008 - DNA, 18 bp, Homo sapiens
tggcttccccactccccc

SEQ ID NO: 4026009 - DNA, 15 bp, Homo sapiens
tggcttcccgctcag

SEQ ID NO: 4026010 - DNA, 19 bp, Homo sapiens
tggcttcccgctcagccct

SEQ ID NO: 4026011 - DNA, 20 bp, Homo sapiens
tggcttcccgctcagccctc

SEQ ID NO: 4026012 - DNA, 17 bp, Homo sapiens
tggcttgacatgtgcaa

SEQ ID NO: 4026013 - DNA, 18 bp, Homo sapiens
tggcttgacatgtgcaat

SEQ ID NO: 4026014 - DNA, 14 bp, Homo sapiens
tggcttgggcattg

SEQ ID NO: 4026015 - DNA, 14 bp, Homo sapiens
tggctttccaggca

SEQ ID NO: 4026016 - DNA, 15 bp, Homo sapiens
tggctttccaggcac

SEQ ID NO: 4026017 - DNA, 19 bp, Homo sapiens
tggctttcccaggagatgg

SEQ ID NO: 4026018 - DNA, 22 bp, Homo sapiens
tggctttctccgactgctaggg

SEQ ID NO: 4026019 - DNA, 18 bp, Homo sapiens
tggctttgcccacccctc

SEQ ID NO: 4026020 - DNA, 13 bp, Homo sapiens
tggctttgcctct

SEQ ID NO: 4026021 - DNA, 14 bp, Homo sapiens
tggctttgttttct

SEQ ID NO: 4026022 - DNA, 12 bp, Homo sapiens
tggcttttactt

SEQ ID NO: 4026023 - DNA, 21 bp, Homo sapiens
tggcttttcactgctggctgc

SEQ ID NO: 4026024 - DNA, 22 bp, Homo sapiens
tggcttttcactgctggctgcc

SEQ ID NO: 4026025 - DNA, 23 bp, Homo sapiens
tgggaaaaatgcccttaaatcat

SEQ ID NO: 4026026 - DNA, 21 bp, Homo sapiens
tgggaaagaaggcaaagtccc

SEQ ID NO: 4026027 - DNA, 16 bp, Homo sapiens
tgggaaagccacctct

SEQ ID NO: 4026028 - DNA, 20 bp, Homo sapiens
tgggaaagccacctctccct

SEQ ID NO: 4026029 - DNA, 22 bp, Homo sapiens
tgggaaatggtatgagctgagg

SEQ ID NO: 4026030 - DNA, 22 bp, Homo sapiens
tgggaaattaaatccaataaaa

SEQ ID NO: 4026031 - DNA, 20 bp, Homo sapiens
tgggaaccccttcatcctct

SEQ ID NO: 4026032 - DNA, 16 bp, Homo sapiens
tgggaagaattggaag

SEQ ID NO: 4026033 - DNA, 18 bp, Homo sapiens
tgggaagacgcctgagct

SEQ ID NO: 4026034 - DNA, 20 bp, Homo sapiens
tgggaagagggggctggcca

SEQ ID NO: 4026035 - DNA, 18 bp, Homo sapiens
tgggaagatgaggttctg

SEQ ID NO: 4026036 - DNA, 17 bp, Homo sapiens
tgggaaggcttgggatt

SEQ ID NO: 4026037 - DNA, 23 bp, Homo sapiens
tgggaagttgcattcctttgtct

SEQ ID NO: 4026038 - DNA, 15 bp, Homo sapiens
tgggaatagggagac

SEQ ID NO: 4026039 - DNA, 14 bp, Homo sapiens
tgggaatgaggtgg

SEQ ID NO: 4026040 - DNA, 22 bp, Homo sapiens
tgggaatgtattattctgcagc

SEQ ID NO: 4026041 - DNA, 15 bp, Homo sapiens
tgggaatttgtcagc

SEQ ID NO: 4026042 - DNA, 17 bp, Homo sapiens
tgggacaattgttttaa

SEQ ID NO: 4026043 - DNA, 14 bp, Homo sapiens
tgggacacagaccc

SEQ ID NO: 4026044 - DNA, 14 bp, Homo sapiens
tgggacaccaggga

SEQ ID NO: 4026045 - DNA, 23 bp, Homo sapiens
tgggacagccagagctgggtggg

SEQ ID NO: 4026046 - DNA, 14 bp, Homo sapiens
tgggacagcccaga

SEQ ID NO: 4026047 - DNA, 20 bp, Homo sapiens
tgggacagcccagagcctgg

SEQ ID NO: 4026048 - DNA, 22 bp, Homo sapiens
tgggaccacatgccactgcctg

SEQ ID NO: 4026049 - DNA, 23 bp, Homo sapiens
tgggaccacatgccactgcctgc

SEQ ID NO: 4026050 - DNA, 12 bp, Homo sapiens
tgggaccagagc

SEQ ID NO: 4026051 - DNA, 13 bp, Homo sapiens
tgggaccagagcc

SEQ ID NO: 4026052 - DNA, 15 bp, Homo sapiens
tgggaccagagccag

SEQ ID NO: 4026053 - DNA, 22 bp, Homo sapiens
tgggacccaaaacacaggaagt

SEQ ID NO: 4026054 - DNA, 20 bp, Homo sapiens
tgggacgtggctcagccagc

SEQ ID NO: 4026055 - DNA, 21 bp, Homo sapiens
tgggacgtggctcagccagca

SEQ ID NO: 4026056 - DNA, 17 bp, Homo sapiens
tgggactacaggcatgc

SEQ ID NO: 4026057 - DNA, 20 bp, Homo sapiens
tgggactaggacctgagcct

SEQ ID NO: 4026058 - DNA, 14 bp, Homo sapiens
tgggacttaactcc

SEQ ID NO: 4026059 - DNA, 21 bp, Homo sapiens
tgggagacaagaaatccctgt

SEQ ID NO: 4026060 - DNA, 13 bp, Homo sapiens
tgggagacagacc

SEQ ID NO: 4026061 - DNA, 23 bp, Homo sapiens
tgggagcactggagtgcagggag

SEQ ID NO: 4026062 - DNA, 20 bp, Homo sapiens
tgggagccacttctccccag

SEQ ID NO: 4026063 - DNA, 16 bp, Homo sapiens
tgggagccagctgctt

SEQ ID NO: 4026064 - DNA, 13 bp, Homo sapiens
tgggagccccagg

SEQ ID NO: 4026065 - DNA, 23 bp, Homo sapiens
tgggagccccagggtcttcccta

SEQ ID NO: 4026066 - DNA, 13 bp, Homo sapiens
tgggagcctagct

SEQ ID NO: 4026067 - DNA, 21 bp, Homo sapiens
tgggagcctagctcctgccac

SEQ ID NO: 4026068 - DNA, 22 bp, Homo sapiens
tgggagcctgcaaactcactgc

SEQ ID NO: 4026069 - DNA, 13 bp, Homo sapiens
tgggagctcctct

SEQ ID NO: 4026070 - DNA, 12 bp, Homo sapiens
tgggctctgtgc

SEQ ID NO: 4026071 - DNA, 17 bp, Homo sapiens
tgggctgaccaggcttc

SEQ ID NO: 4026072 - DNA, 18 bp, Homo sapiens
tgggctgagtgacacaag

SEQ ID NO: 4026073 - DNA, 16 bp, Homo sapiens
tgggctgccaccagcc

SEQ ID NO: 4026074 - DNA, 17 bp, Homo sapiens
tgggctgccaccagccc

SEQ ID NO: 4026075 - DNA, 19 bp, Homo sapiens
tgggctgccaccagccccc

SEQ ID NO: 4026076 - DNA, 14 bp, Homo sapiens
tgggctgccctggt

SEQ ID NO: 4026077 - DNA, 16 bp, Homo sapiens
tcactctaaaaaacat

SEQ ID NO: 4026078 - DNA, 21 bp, Homo sapiens
tcactctaattaattgtaatc

SEQ ID NO: 4026079 - DNA, 13 bp, Homo sapiens
tcactctcagtgc

SEQ ID NO: 4026080 - DNA, 15 bp, Homo sapiens
tcactctctccgtct

SEQ ID NO: 4026081 - DNA, 12 bp, Homo sapiens
tcactctgggct

SEQ ID NO: 4026082 - DNA, 13 bp, Homo sapiens
tcactctgtcagc

SEQ ID NO: 4026083 - DNA, 15 bp, Homo sapiens
tcactctgtcagcca

SEQ ID NO: 4026084 - DNA, 17 bp, Homo sapiens
tcactctgtcagccagc

SEQ ID NO: 4026085 - DNA, 20 bp, Homo sapiens
tcactctgtcagccagccgc

SEQ ID NO: 4026086 - DNA, 19 bp, Homo sapiens
tcactcttcctgcaaggac

SEQ ID NO: 4026087 - DNA, 15 bp, Homo sapiens
tcactgaaatgtttg

SEQ ID NO: 4026088 - DNA, 17 bp, Homo sapiens
tcactgaaatgtttgga

SEQ ID NO: 4026089 - DNA, 14 bp, Homo sapiens
tcactgaagcctgc

SEQ ID NO: 4026090 - DNA, 21 bp, Homo sapiens
tcactgaaggacctgagctgg

SEQ ID NO: 4026091 - DNA, 18 bp, Homo sapiens
tcactgcaacctctgcct

SEQ ID NO: 4026092 - DNA, 24 bp, Homo sapiens
tcactgcacagtgcatctcagccc

SEQ ID NO: 4026093 - DNA, 11 bp, Homo sapiens
tcactgccagg

SEQ ID NO: 4026094 - DNA, 14 bp, Homo sapiens
tcactgccaggcca

SEQ ID NO: 4026095 - DNA, 20 bp, Homo sapiens
tcactgccaggccagcctcc

SEQ ID NO: 4026096 - DNA, 12 bp, Homo sapiens
tcactgctggct

SEQ ID NO: 4026097 - DNA, 16 bp, Homo sapiens
tcactgctggctgcct

SEQ ID NO: 4026098 - DNA, 22 bp, Homo sapiens
tcactgctggctgccttagaac

SEQ ID NO: 4026099 - DNA, 11 bp, Homo sapiens
tcactgcttca

SEQ ID NO: 4026100 - DNA, 15 bp, Homo sapiens
tcactggaaagggga

SEQ ID NO: 4026101 - DNA, 18 bp, Homo sapiens
tcactggaaaggggagag

SEQ ID NO: 4026102 - DNA, 22 bp, Homo sapiens
tcactggagttacattaatgtt

SEQ ID NO: 4026103 - DNA, 13 bp, Homo sapiens
tcactggatgaaa

SEQ ID NO: 4026104 - DNA, 15 bp, Homo sapiens
tcactggctggctcc

SEQ ID NO: 4026105 - DNA, 15 bp, Homo sapiens
tcactgtataaatag

SEQ ID NO: 4026106 - DNA, 16 bp, Homo sapiens
tcactgtataaatagg

SEQ ID NO: 4026107 - DNA, 20 bp, Homo sapiens
tcactgtctttaattctgta

SEQ ID NO: 4026108 - DNA, 21 bp, Homo sapiens
tcactgtgatcaatattttta

SEQ ID NO: 4026109 - DNA, 14 bp, Homo sapiens
tcactgtgcactgc

SEQ ID NO: 4026110 - DNA, 15 bp, Homo sapiens
tcactgtgcactgcc

SEQ ID NO: 4026111 - DNA, 16 bp, Homo sapiens
tcactgtgcactgccc

SEQ ID NO: 4026112 - DNA, 18 bp, Homo sapiens
tcactgtgcactgccctg

SEQ ID NO: 4026113 - DNA, 17 bp, Homo sapiens
tcactgtggtcctatgc

SEQ ID NO: 4026114 - DNA, 16 bp, Homo sapiens
tcactgtgtacataat

SEQ ID NO: 4026115 - DNA, 22 bp, Homo sapiens
tcactgttagctttttaaaaca

SEQ ID NO: 4026116 - DNA, 23 bp, Homo sapiens
tcactgttagctttttaaaacat

SEQ ID NO: 4026117 - DNA, 21 bp, Homo sapiens
tcactgttccctctgctcctg

SEQ ID NO: 4026118 - DNA, 14 bp, Homo sapiens
tcactgtttctctg

SEQ ID NO: 4026119 - DNA, 13 bp, Homo sapiens
tcacttagccatg

SEQ ID NO: 4026120 - DNA, 18 bp, Homo sapiens
tcacttcaagctgttatt

SEQ ID NO: 4026121 - DNA, 15 bp, Homo sapiens
tcacttcaccctgga

SEQ ID NO: 4026122 - DNA, 20 bp, Homo sapiens
tcacttcaggagaaactgct

SEQ ID NO: 4026123 - DNA, 18 bp, Homo sapiens
tcacttcccgagcgctgg

SEQ ID NO: 4026124 - DNA, 23 bp, Homo sapiens
tcacttcgggctgtgtaaacaca

SEQ ID NO: 4026125 - DNA, 19 bp, Homo sapiens
tcacttctttcccttcctc

SEQ ID NO: 4026126 - DNA, 23 bp, Homo sapiens
tcacttgaaagattttattgtat

SEQ ID NO: 4026127 - DNA, 14 bp, Homo sapiens
tcacttgatgatac

SEQ ID NO: 4026128 - DNA, 19 bp, Homo sapiens
tcacttgatgtgccatttt

SEQ ID NO: 4026129 - DNA, 14 bp, Homo sapiens
tcactttgctctgg

SEQ ID NO: 4026130 - DNA, 16 bp, Homo sapiens
tcactttgctctgggt

SEQ ID NO: 4026131 - DNA, 13 bp, Homo sapiens
tcacttttgttct

SEQ ID NO: 4026132 - DNA, 10 bp, Homo sapiens
tcagaaaaaa

SEQ ID NO: 4026133 - DNA, 19 bp, Homo sapiens
tcagaaaatattatgtgtt

SEQ ID NO: 4026134 - DNA, 15 bp, Homo sapiens
tcagaaaatgttctg

SEQ ID NO: 4026135 - DNA, 18 bp, Homo sapiens
tcagaaaatgttctgttt

SEQ ID NO: 4026136 - DNA, 23 bp, Homo sapiens
tcagaaaatgttctgtttgctgt

SEQ ID NO: 4026137 - DNA, 17 bp, Homo sapiens
tcagaaacttgtgaagt

SEQ ID NO: 4026138 - DNA, 18 bp, Homo sapiens
tcagaaattggaacagaa

SEQ ID NO: 4026139 - DNA, 21 bp, Homo sapiens
tcagaaattggaacagaatgt

SEQ ID NO: 4026140 - DNA, 15 bp, Homo sapiens
tcagaacctcttccc

SEQ ID NO: 4026141 - DNA, 14 bp, Homo sapiens
tcagaacctgagct

SEQ ID NO: 4026142 - DNA, 15 bp, Homo sapiens
tcagaactgtgccac

SEQ ID NO: 4026143 - DNA, 12 bp, Homo sapiens
tcagaagaaaga

SEQ ID NO: 4026144 - DNA, 18 bp, Homo sapiens
tcagaagcacagaatatt

SEQ ID NO: 4026145 - DNA, 12 bp, Homo sapiens
tcagaataaatt

SEQ ID NO: 4026146 - DNA, 21 bp, Homo sapiens
tcagaatagccacatttggaa

SEQ ID NO: 4026147 - DNA, 17 bp, Homo sapiens
tcagaatcatggagaaa

SEQ ID NO: 4026148 - DNA, 14 bp, Homo sapiens
tcagaatgtaaaag

SEQ ID NO: 4026149 - DNA, 16 bp, Homo sapiens
tcagaattaaactttt

SEQ ID NO: 4026150 - DNA, 10 bp, Homo sapiens
tcagaattct

SEQ ID NO: 4026151 - DNA, 21 bp, Homo sapiens
tcagaatttagtgtatccata

SEQ ID NO: 4026152 - DNA, 18 bp, Homo sapiens
tcagacaccctctcctta

SEQ ID NO: 4026153 - DNA, 23 bp, Homo sapiens
tcagacagaacttgaatgtgtca

SEQ ID NO: 4026154 - DNA, 14 bp, Homo sapiens
tcagaccacggctc

SEQ ID NO: 4026155 - DNA, 15 bp, Homo sapiens
tcagaccccagttct

SEQ ID NO: 4026156 - DNA, 12 bp, Homo sapiens
tcagaccccccc

SEQ ID NO: 4026157 - DNA, 15 bp, Homo sapiens
tcagacccccccatt

SEQ ID NO: 4026158 - DNA, 15 bp, Homo sapiens
tcagacccctgcctg

SEQ ID NO: 4026159 - DNA, 18 bp, Homo sapiens
tcagacccctttgagaga

SEQ ID NO: 4026160 - DNA, 23 bp, Homo sapiens
tcagacccctttgagagacgcca

SEQ ID NO: 4026161 - DNA, 23 bp, Homo sapiens
tcagacctgtcttccaaggagac

SEQ ID NO: 4026162 - DNA, 13 bp, Homo sapiens
tcagacggcggcc

SEQ ID NO: 4026163 - DNA, 19 bp, Homo sapiens
tcagactcaagtacccatt

SEQ ID NO: 4026164 - DNA, 15 bp, Homo sapiens
tcagactccgccctc

SEQ ID NO: 4026165 - DNA, 14 bp, Homo sapiens
tcagactgcatgta

SEQ ID NO: 4026166 - DNA, 21 bp, Homo sapiens
tcagagaaggaaaagactgaa

SEQ ID NO: 4026167 - DNA, 15 bp, Homo sapiens
tcagagagcaaggca

SEQ ID NO: 4026168 - DNA, 12 bp, Homo sapiens
tcagagagcagc

SEQ ID NO: 4026169 - DNA, 14 bp, Homo sapiens
tcagagagctggta

SEQ ID NO: 4026170 - DNA, 18 bp, Homo sapiens
tcagagatgaacatctaa

SEQ ID NO: 4026171 - DNA, 14 bp, Homo sapiens
tcagagcatgtgtc

SEQ ID NO: 4026172 - DNA, 21 bp, Homo sapiens
tcagagccacccctaaagaga

SEQ ID NO: 4026173 - DNA, 17 bp, Homo sapiens
tcagagcgccaggaagc

SEQ ID NO: 4026174 - DNA, 21 bp, Homo sapiens
tcagagcgccaggaagccaga

SEQ ID NO: 4026175 - DNA, 22 bp, Homo sapiens
tcagagcgccaggaagccagag

SEQ ID NO: 4026176 - DNA, 21 bp, Homo sapiens
tcagagctaagggtgggtgct

SEQ ID NO: 4026177 - DNA, 22 bp, Homo sapiens
tcagagtacgtcctgcctggca

SEQ ID NO: 4026178 - DNA, 14 bp, Homo sapiens
tcagagtgaagaat

SEQ ID NO: 4026179 - DNA, 16 bp, Homo sapiens
tcagatacatcactgc

SEQ ID NO: 4026180 - DNA, 18 bp, Homo sapiens
tcagatatatttttcaca

SEQ ID NO: 4026181 - DNA, 23 bp, Homo sapiens
tcagatattttttcagaaatatg

SEQ ID NO: 4026182 - DNA, 13 bp, Homo sapiens
tcagatctgtctg

SEQ ID NO: 4026183 - DNA, 18 bp, Homo sapiens
tcagatctttctccttga

SEQ ID NO: 4026184 - DNA, 19 bp, Homo sapiens
tcagatctttctccttgaa

SEQ ID NO: 4026185 - DNA, 17 bp, Homo sapiens
tcagatgatctctccac

SEQ ID NO: 4026186 - DNA, 15 bp, Homo sapiens
tcagatgcaggttgg

SEQ ID NO: 4026187 - DNA, 16 bp, Homo sapiens
tcagatgcagtttgga

SEQ ID NO: 4026188 - DNA, 18 bp, Homo sapiens
tcagatgcttctgggaga

SEQ ID NO: 4026189 - DNA, 17 bp, Homo sapiens
tcagatgggtctgatat

SEQ ID NO: 4026190 - DNA, 23 bp, Homo sapiens
tcagatgggtctgatattaatca

SEQ ID NO: 4026191 - DNA, 14 bp, Homo sapiens
tcagatttctggtt

SEQ ID NO: 4026192 - DNA, 12 bp, Homo sapiens
tcagatttgaac

SEQ ID NO: 4026193 - DNA, 19 bp, Homo sapiens
tcagattttaaaaagtctt

SEQ ID NO: 4026194 - DNA, 21 bp, Homo sapiens
tcagcaaacaggatcagttaa

SEQ ID NO: 4026195 - DNA, 14 bp, Homo sapiens
tcagcaccacccta

SEQ ID NO: 4026196 - DNA, 17 bp, Homo sapiens
tcagcacccccacccac

SEQ ID NO: 4026197 - DNA, 20 bp, Homo sapiens
tcagcacttaactactttgt

SEQ ID NO: 4026198 - DNA, 20 bp, Homo sapiens
tcagcacttaactatgagcc

SEQ ID NO: 4026199 - DNA, 14 bp, Homo sapiens
tcagcagacacaca

SEQ ID NO: 4026200 - DNA, 23 bp, Homo sapiens
tcagcagacacacatgggcagcc

SEQ ID NO: 4026201 - DNA, 22 bp, Homo sapiens
tcagcagccgccttaagctgat

SEQ ID NO: 4026202 - DNA, 15 bp, Homo sapiens
tcagcaggcagcctt

SEQ ID NO: 4026203 - DNA, 18 bp, Homo sapiens
tcagcagtcaatacaaat

SEQ ID NO: 4026204 - DNA, 15 bp, Homo sapiens
tcagcatcactaaac

SEQ ID NO: 4026205 - DNA, 15 bp, Homo sapiens
tcagcatctggctgt

SEQ ID NO: 4026206 - DNA, 17 bp, Homo sapiens
tcagcatctgtgatggg

SEQ ID NO: 4026207 - DNA, 13 bp, Homo sapiens
tcagcatgaaaat

SEQ ID NO: 4026208 - DNA, 17 bp, Homo sapiens
tcagcatgcttcccaga

SEQ ID NO: 4026209 - DNA, 19 bp, Homo sapiens
tcagcatgcttcccagagg

SEQ ID NO: 4026210 - DNA, 19 bp, Homo sapiens
tcagcatttccttccagcc

SEQ ID NO: 4026211 - DNA, 22 bp, Homo sapiens
tcagcatttccttccagcccat

SEQ ID NO: 4026212 - DNA, 23 bp, Homo sapiens
tcagccaagacaaggaggtagag

SEQ ID NO: 4026213 - DNA, 18 bp, Homo sapiens
tcagccagccgccctggg

SEQ ID NO: 4026214 - DNA, 18 bp, Homo sapiens
tcagccaggagctgtcac

SEQ ID NO: 4026215 - DNA, 19 bp, Homo sapiens
tcagccaggagctgtcacc

SEQ ID NO: 4026216 - DNA, 12 bp, Homo sapiens
tcagccagggcc

SEQ ID NO: 4026217 - DNA, 13 bp, Homo sapiens
tcagccagggcca

SEQ ID NO: 4026218 - DNA, 19 bp, Homo sapiens
tcagccctcagttccttca

SEQ ID NO: 4026219 - DNA, 14 bp, Homo sapiens
tcagccctccctgc

SEQ ID NO: 4026220 - DNA, 18 bp, Homo sapiens
tcagccctccctgcccct

SEQ ID NO: 4026221 - DNA, 12 bp, Homo sapiens
tcagcctcagag

SEQ ID NO: 4026222 - DNA, 13 bp, Homo sapiens
tcagcctcagagg

SEQ ID NO: 4026223 - DNA, 20 bp, Homo sapiens
tcagcctcccgagtagctgg

SEQ ID NO: 4026224 - DNA, 17 bp, Homo sapiens
tcagcctcctgagcctg

SEQ ID NO: 4026225 - DNA, 18 bp, Homo sapiens
tcagcctcctgagcctgt

SEQ ID NO: 4026226 - DNA, 19 bp, Homo sapiens
tcagcctcctgagcctgtg

SEQ ID NO: 4026227 - DNA, 13 bp, Homo sapiens
tcagcctcgcagg

SEQ ID NO: 4026228 - DNA, 23 bp, Homo sapiens
tcagcctcgcaggcctccctgcc

SEQ ID NO: 4026229 - DNA, 22 bp, Homo sapiens
tcagcctgctgcccaggctgtg

SEQ ID NO: 4026230 - DNA, 14 bp, Homo sapiens
tcagcctggccaga

SEQ ID NO: 4026231 - DNA, 15 bp, Homo sapiens
tcagcctggccagac

SEQ ID NO: 4026232 - DNA, 17 bp, Homo sapiens
tcagcctggccagacac

SEQ ID NO: 4026233 - DNA, 18 bp, Homo sapiens
tcagcctggccagacaca

SEQ ID NO: 4026234 - DNA, 20 bp, Homo sapiens
tcagcctggccagacacagg

SEQ ID NO: 4026235 - DNA, 12 bp, Homo sapiens
tcagcctggcct

SEQ ID NO: 4026236 - DNA, 23 bp, Homo sapiens
tcagcctggcctgcccgtgccct

SEQ ID NO: 4026237 - DNA, 18 bp, Homo sapiens
tcagccttacatttgtga

SEQ ID NO: 4026238 - DNA, 15 bp, Homo sapiens
tcagccttgccagag

SEQ ID NO: 4026239 - DNA, 16 bp, Homo sapiens
tcagcgtaaaatggtg

SEQ ID NO: 4026240 - DNA, 23 bp, Homo sapiens
tcagctatacctgcacgttcata

SEQ ID NO: 4026241 - DNA, 12 bp, Homo sapiens
tcagctccagct

SEQ ID NO: 4026242 - DNA, 18 bp, Homo sapiens
tcagctcccccaggctgt

SEQ ID NO: 4026243 - DNA, 21 bp, Homo sapiens
tcagctcctacctctgtgcca

SEQ ID NO: 4026244 - DNA, 14 bp, Homo sapiens
tcagctccttttcc

SEQ ID NO: 4026245 - DNA, 15 bp, Homo sapiens
tcagctctctgccct

SEQ ID NO: 4026246 - DNA, 20 bp, Homo sapiens
tcagctctctgccctgtgta

SEQ ID NO: 4026247 - DNA, 18 bp, Homo sapiens
tcagctctctgggacctc

SEQ ID NO: 4026248 - DNA, 17 bp, Homo sapiens
tcagctctgggagagga

SEQ ID NO: 4026249 - DNA, 18 bp, Homo sapiens
tcagctctgggagaggat

SEQ ID NO: 4026250 - DNA, 21 bp, Homo sapiens
tcagctgacccggcctctctg

SEQ ID NO: 4026251 - DNA, 17 bp, Homo sapiens
tcagctgagccctgggg

SEQ ID NO: 4026252 - DNA, 14 bp, Homo sapiens
tcagctgagccttc

SEQ ID NO: 4026253 - DNA, 16 bp, Homo sapiens
tcagctgcctgaaaca

SEQ ID NO: 4026254 - DNA, 15 bp, Homo sapiens
tcagctgctactact

SEQ ID NO: 4026255 - DNA, 19 bp, Homo sapiens
tctgttttctgtttgtaaa

SEQ ID NO: 4026256 - DNA, 18 bp, Homo sapiens
tcttaaaagggaaattag

SEQ ID NO: 4026257 - DNA, 20 bp, Homo sapiens
tcttaaaattcaagaaaata

SEQ ID NO: 4026258 - DNA, 17 bp, Homo sapiens
tcttaaacataataaat

SEQ ID NO: 4026259 - DNA, 19 bp, Homo sapiens
tcttaaaccaacctttaaa

SEQ ID NO: 4026260 - DNA, 21 bp, Homo sapiens
tcttaaaccaacctttaaaat

SEQ ID NO: 4026261 - DNA, 20 bp, Homo sapiens
tcttaaagtttaaagttgca

SEQ ID NO: 4026262 - DNA, 14 bp, Homo sapiens
tcttaaatatcttt

SEQ ID NO: 4026263 - DNA, 20 bp, Homo sapiens
tcttaacaaaccaacatctt

SEQ ID NO: 4026264 - DNA, 15 bp, Homo sapiens
tcttaagacttttgg

SEQ ID NO: 4026265 - DNA, 13 bp, Homo sapiens
tcttaagcagcat

SEQ ID NO: 4026266 - DNA, 14 bp, Homo sapiens
tcttaagcagcatg

SEQ ID NO: 4026267 - DNA, 15 bp, Homo sapiens
tcttaagcagcatgg

SEQ ID NO: 4026268 - DNA, 12 bp, Homo sapiens
tcttaagcttcc

SEQ ID NO: 4026269 - DNA, 20 bp, Homo sapiens
tcttaagttctatgaagagt

SEQ ID NO: 4026270 - DNA, 19 bp, Homo sapiens
tcttaatatgttcttttaa

SEQ ID NO: 4026271 - DNA, 23 bp, Homo sapiens
tcttaattaatttgattaacaaa

SEQ ID NO: 4026272 - DNA, 12 bp, Homo sapiens
tcttaattatta

SEQ ID NO: 4026273 - DNA, 20 bp, Homo sapiens
tcttaattattatttgtgtt

SEQ ID NO: 4026274 - DNA, 17 bp, Homo sapiens
tcttaccgacaagcaca

SEQ ID NO: 4026275 - DNA, 21 bp, Homo sapiens
tcttacctactattggcccta

SEQ ID NO: 4026276 - DNA, 21 bp, Homo sapiens
tcttactaatgtaaaatgatt

SEQ ID NO: 4026277 - DNA, 15 bp, Homo sapiens
tcttactctttccta

SEQ ID NO: 4026278 - DNA, 22 bp, Homo sapiens
tcttactgcttaattcaaataa

SEQ ID NO: 4026279 - DNA, 16 bp, Homo sapiens
tcttacttgagccttt

SEQ ID NO: 4026280 - DNA, 17 bp, Homo sapiens
tcttacttgagccttta

SEQ ID NO: 4026281 - DNA, 13 bp, Homo sapiens
tcttactttgctt

SEQ ID NO: 4026282 - DNA, 13 bp, Homo sapiens
tcttagaaatact

SEQ ID NO: 4026283 - DNA, 22 bp, Homo sapiens
tcttagagccttttatctgcag

SEQ ID NO: 4026284 - DNA, 12 bp, Homo sapiens
tcttagatgtat

SEQ ID NO: 4026285 - DNA, 14 bp, Homo sapiens
tcttagatgtatat

SEQ ID NO: 4026286 - DNA, 22 bp, Homo sapiens
tcttagctttttaattgttgtt

SEQ ID NO: 4026287 - DNA, 12 bp, Homo sapiens
tcttagtcccaa

SEQ ID NO: 4026288 - DNA, 17 bp, Homo sapiens
tcttagttacatttcta

SEQ ID NO: 4026289 - DNA, 23 bp, Homo sapiens
tcttagttacatttctatcagta

SEQ ID NO: 4026290 - DNA, 23 bp, Homo sapiens
tcttagttgacaacctagaatgt

SEQ ID NO: 4026291 - DNA, 12 bp, Homo sapiens
tcttatagaata

SEQ ID NO: 4026292 - DNA, 22 bp, Homo sapiens
tcttatagaataaaagctgtgg

SEQ ID NO: 4026293 - DNA, 15 bp, Homo sapiens
tcttatcttctgcaa

SEQ ID NO: 4026294 - DNA, 13 bp, Homo sapiens
tcttatgaataag

SEQ ID NO: 4026295 - DNA, 16 bp, Homo sapiens
tcttatgaggagggga

SEQ ID NO: 4026296 - DNA, 20 bp, Homo sapiens
tcttatgcttccagaaacac

SEQ ID NO: 4026297 - DNA, 21 bp, Homo sapiens
tcttatggaattgatttgcat

SEQ ID NO: 4026298 - DNA, 16 bp, Homo sapiens
tcttatggtccagaaa

SEQ ID NO: 4026299 - DNA, 14 bp, Homo sapiens
tcttatgtgtgcct

SEQ ID NO: 4026300 - DNA, 19 bp, Homo sapiens
tcttattaattcttcacct

SEQ ID NO: 4026301 - DNA, 20 bp, Homo sapiens
tcttattaatttcagtcttg

SEQ ID NO: 4026302 - DNA, 17 bp, Homo sapiens
tcttattgcgctgctac

SEQ ID NO: 4026303 - DNA, 15 bp, Homo sapiens
tcttatttaaaattc

SEQ ID NO: 4026304 - DNA, 17 bp, Homo sapiens
tcttatttaatgaaaga

SEQ ID NO: 4026305 - DNA, 14 bp, Homo sapiens
tcttatttaccctt

SEQ ID NO: 4026306 - DNA, 15 bp, Homo sapiens
tcttatttacccttt

SEQ ID NO: 4026307 - DNA, 17 bp, Homo sapiens
tcttatttacccttttc

SEQ ID NO: 4026308 - DNA, 19 bp, Homo sapiens
tcttcaaactttcactttg

SEQ ID NO: 4026309 - DNA, 15 bp, Homo sapiens
tcttcaaatacaaag

SEQ ID NO: 4026310 - DNA, 17 bp, Homo sapiens
tcttcaaatccttccaa

SEQ ID NO: 4026311 - DNA, 17 bp, Homo sapiens
tcttgcattcattttct

SEQ ID NO: 4026312 - DNA, 10 bp, Homo sapiens
tcttgccaca

SEQ ID NO: 4026313 - DNA, 21 bp, Homo sapiens
tcttgccacatttctgatcag

SEQ ID NO: 4026314 - DNA, 15 bp, Homo sapiens
tcttgcccatcctga

SEQ ID NO: 4026315 - DNA, 18 bp, Homo sapiens
tcttgcccatcctgactg

SEQ ID NO: 4026316 - DNA, 17 bp, Homo sapiens
tcttgcctgctgggctc

SEQ ID NO: 4026317 - DNA, 14 bp, Homo sapiens
tcttgctcccttca

SEQ ID NO: 4026318 - DNA, 22 bp, Homo sapiens
tcttgctcccttcagcccccag

SEQ ID NO: 4026319 - DNA, 18 bp, Homo sapiens
tcttgctctatctctcaa

SEQ ID NO: 4026320 - DNA, 12 bp, Homo sapiens
tcttgctctcct

SEQ ID NO: 4026321 - DNA, 13 bp, Homo sapiens
tcttgctctgcca

SEQ ID NO: 4026322 - DNA, 11 bp, Homo sapiens
tcttgctggct

SEQ ID NO: 4026323 - DNA, 14 bp, Homo sapiens
tcttgctgtctctg

SEQ ID NO: 4026324 - DNA, 14 bp, Homo sapiens
tcttgcttgtcatt

SEQ ID NO: 4026325 - DNA, 21 bp, Homo sapiens
tcttgctttgtgtatctcatt

SEQ ID NO: 4026326 - DNA, 20 bp, Homo sapiens
tcttggcaaaagccttgtgt

SEQ ID NO: 4026327 - DNA, 16 bp, Homo sapiens
tcttggcccctgtgtg

SEQ ID NO: 4026328 - DNA, 13 bp, Homo sapiens
tcttggctgaccc

SEQ ID NO: 4026329 - DNA, 20 bp, Homo sapiens
tcttgggatagtgttctgct

SEQ ID NO: 4026330 - DNA, 23 bp, Homo sapiens
tcttgggatagtgttctgctcct

SEQ ID NO: 4026331 - DNA, 14 bp, Homo sapiens
tcttgggccccaga

SEQ ID NO: 4026332 - DNA, 16 bp, Homo sapiens
tcttgggccccagacc

SEQ ID NO: 4026333 - DNA, 20 bp, Homo sapiens
tcttggggcaagactgcaaa

SEQ ID NO: 4026334 - DNA, 14 bp, Homo sapiens
tcttggggtcccac

SEQ ID NO: 4026335 - DNA, 13 bp, Homo sapiens
tcttgggtgggtg

SEQ ID NO: 4026336 - DNA, 14 bp, Homo sapiens
tcttggtaagaagc

SEQ ID NO: 4026337 - DNA, 14 bp, Homo sapiens
tcttggtagagatt

SEQ ID NO: 4026338 - DNA, 16 bp, Homo sapiens
tcttggtgactgtccc

SEQ ID NO: 4026339 - DNA, 15 bp, Homo sapiens
tcttggtgctctgtg

SEQ ID NO: 4026340 - DNA, 20 bp, Homo sapiens
tcttggtgtgattgcacaga

SEQ ID NO: 4026341 - DNA, 18 bp, Homo sapiens
tcttggttcataaatgaa

SEQ ID NO: 4026342 - DNA, 21 bp, Homo sapiens
tcttggttcataaatgaattt

SEQ ID NO: 4026343 - DNA, 19 bp, Homo sapiens
tcttggttcgatacctgga

SEQ ID NO: 4026344 - DNA, 15 bp, Homo sapiens
tcttgtaaagactgg

SEQ ID NO: 4026345 - DNA, 17 bp, Homo sapiens
tcttgtaaagactggtt

SEQ ID NO: 4026346 - DNA, 23 bp, Homo sapiens
tcttgtaaagactggttttctgc

SEQ ID NO: 4026347 - DNA, 17 bp, Homo sapiens
tcttgtagccatggctg

SEQ ID NO: 4026348 - DNA, 15 bp, Homo sapiens
tcttgtatggtttgc

SEQ ID NO: 4026349 - DNA, 19 bp, Homo sapiens
tcttgtattaaactcttca

SEQ ID NO: 4026350 - DNA, 17 bp, Homo sapiens
tcttgtcctcagtccat

SEQ ID NO: 4026351 - DNA, 21 bp, Homo sapiens
tcttgtcctcttctgctcttt

SEQ ID NO: 4026352 - DNA, 14 bp, Homo sapiens
tcttgtctccacta

SEQ ID NO: 4026353 - DNA, 15 bp, Homo sapiens
tcttgtctctgggct

SEQ ID NO: 4026354 - DNA, 15 bp, Homo sapiens
tgaaaatagtgttcc

SEQ ID NO: 4026355 - DNA, 16 bp, Homo sapiens
tgaaaatataaccagc

SEQ ID NO: 4026356 - DNA, 17 bp, Homo sapiens
tgaaaatatatgatggc

SEQ ID NO: 4026357 - DNA, 15 bp, Homo sapiens
tgaaaatggtatttt

SEQ ID NO: 4026358 - DNA, 16 bp, Homo sapiens
tgaaaatggtattttc

SEQ ID NO: 4026359 - DNA, 21 bp, Homo sapiens
tgaaaatggtattttccccct

SEQ ID NO: 4026360 - DNA, 15 bp, Homo sapiens
tgaaaatgtcagaaa

SEQ ID NO: 4026361 - DNA, 20 bp, Homo sapiens
tgaaaattttaaaaatacat

SEQ ID NO: 4026362 - DNA, 15 bp, Homo sapiens
tgaaaattttacttc

SEQ ID NO: 4026363 - DNA, 18 bp, Homo sapiens
tgaaaatttttacattca

SEQ ID NO: 4026364 - DNA, 16 bp, Homo sapiens
tgaaacaacttggaaa

SEQ ID NO: 4026365 - DNA, 16 bp, Homo sapiens
tgaaacacaccaggct

SEQ ID NO: 4026366 - DNA, 22 bp, Homo sapiens
tgaaacacaccaggctgtgggc

SEQ ID NO: 4026367 - DNA, 17 bp, Homo sapiens
tgaaacacagctgttct

SEQ ID NO: 4026368 - DNA, 21 bp, Homo sapiens
tgaaacacagctgttcttctg

SEQ ID NO: 4026369 - DNA, 15 bp, Homo sapiens
tgaaacattttttct

SEQ ID NO: 4026370 - DNA, 18 bp, Homo sapiens
tgaaacattttttcttct

SEQ ID NO: 4026371 - DNA, 19 bp, Homo sapiens
tgaaacattttttcttctg

SEQ ID NO: 4026372 - DNA, 21 bp, Homo sapiens
tgaaaccaccgtgaaccagag

SEQ ID NO: 4026373 - DNA, 20 bp, Homo sapiens
tgaaacctacacactgtcat

SEQ ID NO: 4026374 - DNA, 18 bp, Homo sapiens
tgaaacctagtactgccc

SEQ ID NO: 4026375 - DNA, 16 bp, Homo sapiens
tgaaacctcagggctg

SEQ ID NO: 4026376 - DNA, 16 bp, Homo sapiens
tgaaaccttttttaag

SEQ ID NO: 4026377 - DNA, 21 bp, Homo sapiens
tgaaaccttttttaagatttt

SEQ ID NO: 4026378 - DNA, 17 bp, Homo sapiens
tgaaactaagagctctc

SEQ ID NO: 4026379 - DNA, 17 bp, Homo sapiens
tgaaactcacaaatgat

SEQ ID NO: 4026380 - DNA, 14 bp, Homo sapiens
tgaaagaaacagtt

SEQ ID NO: 4026381 - DNA, 20 bp, Homo sapiens
tgaaagaaacagttaacttt

SEQ ID NO: 4026382 - DNA, 22 bp, Homo sapiens
tgaaagaaacagttaactttca

SEQ ID NO: 4026383 - DNA, 14 bp, Homo sapiens
tgaaagaatatatt

SEQ ID NO: 4026384 - DNA, 16 bp, Homo sapiens
tgaaagaattattttt

SEQ ID NO: 4026385 - DNA, 20 bp, Homo sapiens
tgaaagaattatttttgtgt

SEQ ID NO: 4026386 - DNA, 17 bp, Homo sapiens
tgaaagaccttctccaa

SEQ ID NO: 4026387 - DNA, 13 bp, Homo sapiens
tgaaagagaacca

SEQ ID NO: 4026388 - DNA, 16 bp, Homo sapiens
tgaaagagaaccagtt

SEQ ID NO: 4026389 - DNA, 18 bp, Homo sapiens
tgaaagagattacttaaa

SEQ ID NO: 4026390 - DNA, 16 bp, Homo sapiens
tgaaagagttaagaat

SEQ ID NO: 4026391 - DNA, 12 bp, Homo sapiens
tgaaagattaaa

SEQ ID NO: 4026392 - DNA, 15 bp, Homo sapiens
tgaaagattaaacag

SEQ ID NO: 4026393 - DNA, 20 bp, Homo sapiens
tgaaagattttattgtataa

SEQ ID NO: 4026394 - DNA, 19 bp, Homo sapiens
tgaaagcagggaatttcta

SEQ ID NO: 4026395 - DNA, 22 bp, Homo sapiens
tgaaagcagggaatttctatct

SEQ ID NO: 4026396 - DNA, 18 bp, Homo sapiens
tgaaagctgattactgtc

SEQ ID NO: 4026397 - DNA, 21 bp, Homo sapiens
tgaaagctgattactgtcaat

SEQ ID NO: 4026398 - DNA, 11 bp, Homo sapiens
tgaaagctgtg

SEQ ID NO: 4026399 - DNA, 22 bp, Homo sapiens
tgaaaggaattttgctaagtaa

SEQ ID NO: 4026400 - DNA, 22 bp, Homo sapiens
tgaaagggagctatcaggaaca

SEQ ID NO: 4026401 - DNA, 15 bp, Homo sapiens
tgaaaggtactatat

SEQ ID NO: 4026402 - DNA, 15 bp, Homo sapiens
tgaaaggtttacatt

SEQ ID NO: 4026403 - DNA, 18 bp, Homo sapiens
tgaaaggttttttttcag

SEQ ID NO: 4026404 - DNA, 11 bp, Homo sapiens
tgaaagtgact

SEQ ID NO: 4026405 - DNA, 16 bp, Homo sapiens
tgaaagttttgtaaaa

SEQ ID NO: 4026406 - DNA, 17 bp, Homo sapiens
tgaaagttttgtaaaag

SEQ ID NO: 4026407 - DNA, 20 bp, Homo sapiens
tgaaagttttgtaaaagaaa

SEQ ID NO: 4026408 - DNA, 14 bp, Homo sapiens
tgaaataaatgttc

SEQ ID NO: 4026409 - DNA, 17 bp, Homo sapiens
tgaaataacaaaatgga

SEQ ID NO: 4026410 - DNA, 12 bp, Homo sapiens
tgaaataataga

SEQ ID NO: 4026411 - DNA, 21 bp, Homo sapiens
tgaaataccaacctgaagaca

SEQ ID NO: 4026412 - DNA, 17 bp, Homo sapiens
tgaaatactaaaagcaa

SEQ ID NO: 4026413 - DNA, 22 bp, Homo sapiens
tgaaatactaaaagcaaatcta

SEQ ID NO: 4026414 - DNA, 13 bp, Homo sapiens
tgaaatagtctgt

SEQ ID NO: 4026415 - DNA, 23 bp, Homo sapiens
tgaaggaagccaaatttatcaaa

SEQ ID NO: 4026416 - DNA, 12 bp, Homo sapiens
tgaaggaccctt

SEQ ID NO: 4026417 - DNA, 19 bp, Homo sapiens
tgaaggacctgagctggcc

SEQ ID NO: 4026418 - DNA, 14 bp, Homo sapiens
tgaaggcaaaattg

SEQ ID NO: 4026419 - DNA, 16 bp, Homo sapiens
tgaaggcaaaattgca

SEQ ID NO: 4026420 - DNA, 19 bp, Homo sapiens
tgaaggcccaagagcagag

SEQ ID NO: 4026421 - DNA, 14 bp, Homo sapiens
tgaaggcctggctg

SEQ ID NO: 4026422 - DNA, 17 bp, Homo sapiens
tgaaggcctggctggaa

SEQ ID NO: 4026423 - DNA, 23 bp, Homo sapiens
tgaaggctctcacccccatccct

SEQ ID NO: 4026424 - DNA, 18 bp, Homo sapiens
tgaagggaaaggatattt

SEQ ID NO: 4026425 - DNA, 21 bp, Homo sapiens
tgaagggaaaggatattttct

SEQ ID NO: 4026426 - DNA, 22 bp, Homo sapiens
tgaagggaaaggatattttctt

SEQ ID NO: 4026427 - DNA, 17 bp, Homo sapiens
tgaagggagagccagct

SEQ ID NO: 4026428 - DNA, 15 bp, Homo sapiens
tgaagggccagagcc

SEQ ID NO: 4026429 - DNA, 19 bp, Homo sapiens
tgaagggccagagccaggg

SEQ ID NO: 4026430 - DNA, 16 bp, Homo sapiens
tgaagggggacactcc

SEQ ID NO: 4026431 - DNA, 21 bp, Homo sapiens
tgaagggggtaccttaagaga

SEQ ID NO: 4026432 - DNA, 20 bp, Homo sapiens
tgaaggtattttgtagatgt

SEQ ID NO: 4026433 - DNA, 22 bp, Homo sapiens
tgaaggtattttgtagatgtga

SEQ ID NO: 4026434 - DNA, 22 bp, Homo sapiens
tgaaggtcactcttcctgcaag

SEQ ID NO: 4026435 - DNA, 19 bp, Homo sapiens
tgaaggtctcctaaaactg

SEQ ID NO: 4026436 - DNA, 19 bp, Homo sapiens
tgaaggtgctgacggccag

SEQ ID NO: 4026437 - DNA, 20 bp, Homo sapiens
tgaaggtgctgacggccagg

SEQ ID NO: 4026438 - DNA, 20 bp, Homo sapiens
tgaaggttaggatttaacag

SEQ ID NO: 4026439 - DNA, 22 bp, Homo sapiens
tgaagtaaactttttgttctgg

SEQ ID NO: 4026440 - DNA, 20 bp, Homo sapiens
tgaagtaatgaatttttatg

SEQ ID NO: 4026441 - DNA, 20 bp, Homo sapiens
tgaagtacatattaggaaaa

SEQ ID NO: 4026442 - DNA, 18 bp, Homo sapiens
tgaagtcacatcacagga

SEQ ID NO: 4026443 - DNA, 21 bp, Homo sapiens
tgaagtcactgcacagtgcat

SEQ ID NO: 4026444 - DNA, 22 bp, Homo sapiens
tgaagtcatgctcccctgtgcc

SEQ ID NO: 4026445 - DNA, 14 bp, Homo sapiens
tgaagtcttttctg

SEQ ID NO: 4026446 - DNA, 17 bp, Homo sapiens
tgaagtcttttctgtca

SEQ ID NO: 4026447 - DNA, 13 bp, Homo sapiens
tgaagtgcgtgaa

SEQ ID NO: 4026448 - DNA, 16 bp, Homo sapiens
tgaagttacatgcata

SEQ ID NO: 4026449 - DNA, 23 bp, Homo sapiens
tgaagttacatgcataaaagggt

SEQ ID NO: 4026450 - DNA, 16 bp, Homo sapiens
tgaagttactttatgt

SEQ ID NO: 4026451 - DNA, 14 bp, Homo sapiens
tgaagtttaaaaca

SEQ ID NO: 4026452 - DNA, 16 bp, Homo sapiens
tgaagtttacattgta

SEQ ID NO: 4026453 - DNA, 14 bp, Homo sapiens
tgaagtttacattt

SEQ ID NO: 4026454 - DNA, 19 bp, Homo sapiens
tgaagtttacatttttatt

SEQ ID NO: 4026455 - DNA, 14 bp, Homo sapiens
tgaagtttcacatg

SEQ ID NO: 4026456 - DNA, 16 bp, Homo sapiens
tgaagttttacattgt

SEQ ID NO: 4026457 - DNA, 12 bp, Homo sapiens
tgaataaactga

SEQ ID NO: 4026458 - DNA, 14 bp, Homo sapiens
tgaataaactgaat

SEQ ID NO: 4026459 - DNA, 12 bp, Homo sapiens
tgaataaatgtc

SEQ ID NO: 4026460 - DNA, 14 bp, Homo sapiens
tgaataaatgtctt

SEQ ID NO: 4026461 - DNA, 15 bp, Homo sapiens
tgaataaccacttaa

SEQ ID NO: 4026462 - DNA, 22 bp, Homo sapiens
tgaataatcatgtgaaatgttt

SEQ ID NO: 4026463 - DNA, 14 bp, Homo sapiens
tgaataatttccca

SEQ ID NO: 4026464 - DNA, 15 bp, Homo sapiens
tgaataatttcccaa

SEQ ID NO: 4026465 - DNA, 22 bp, Homo sapiens
tgaataatttcccaattaggaa

SEQ ID NO: 4026466 - DNA, 17 bp, Homo sapiens
tgaatataaagcttaat

SEQ ID NO: 4026467 - DNA, 18 bp, Homo sapiens
tgaatatattataatctt

SEQ ID NO: 4026468 - DNA, 14 bp, Homo sapiens
tgaatatctttcga

SEQ ID NO: 4026469 - DNA, 21 bp, Homo sapiens
tgaatatttccatatggattt

SEQ ID NO: 4026470 - DNA, 21 bp, Homo sapiens
tgaatattttcaactatgtag

SEQ ID NO: 4026471 - DNA, 15 bp, Homo sapiens
tgaatattttggaaa

SEQ ID NO: 4026472 - DNA, 16 bp, Homo sapiens
tgaatattttggaaac

SEQ ID NO: 4026473 - DNA, 17 bp, Homo sapiens
tgaatattttggaaact

SEQ ID NO: 4026474 - DNA, 18 bp, Homo sapiens
tgaatattttggaaactg

SEQ ID NO: 4026475 - DNA, 19 bp, Homo sapiens
tgaatattttggaaactgc

SEQ ID NO: 4026476 - DNA, 23 bp, Homo sapiens
tgaatattttggaaactgctaaa

SEQ ID NO: 4026477 - DNA, 16 bp, Homo sapiens
tgaatcaatcctgggc

SEQ ID NO: 4026478 - DNA, 14 bp, Homo sapiens
tgagactttctgct

SEQ ID NO: 4026479 - DNA, 22 bp, Homo sapiens
tgagagaaatatggaacttaca

SEQ ID NO: 4026480 - DNA, 14 bp, Homo sapiens
tgagagaattggct

SEQ ID NO: 4026481 - DNA, 19 bp, Homo sapiens
tgagagaattgtatcattt

SEQ ID NO: 4026482 - DNA, 14 bp, Homo sapiens
tgagagattctgtg

SEQ ID NO: 4026483 - DNA, 21 bp, Homo sapiens
tgagagattctgtgatctttt

SEQ ID NO: 4026484 - DNA, 16 bp, Homo sapiens
tgagagcccagaggta

SEQ ID NO: 4026485 - DNA, 16 bp, Homo sapiens
tgagagcccccacctt

SEQ ID NO: 4026486 - DNA, 15 bp, Homo sapiens
tgagaggatgaatgt

SEQ ID NO: 4026487 - DNA, 22 bp, Homo sapiens
tgagaggatgaatgtatgtgca

SEQ ID NO: 4026488 - DNA, 12 bp, Homo sapiens
tgagaggcagct

SEQ ID NO: 4026489 - DNA, 13 bp, Homo sapiens
tgagaggcagcta

SEQ ID NO: 4026490 - DNA, 14 bp, Homo sapiens
tgagaggcaggcat

SEQ ID NO: 4026491 - DNA, 11 bp, Homo sapiens
tgagagggcaa

SEQ ID NO: 4026492 - DNA, 12 bp, Homo sapiens
tgagaggggaag

SEQ ID NO: 4026493 - DNA, 14 bp, Homo sapiens
tgagaggggagagc

SEQ ID NO: 4026494 - DNA, 19 bp, Homo sapiens
tgagaggtagccgggctct

SEQ ID NO: 4026495 - DNA, 17 bp, Homo sapiens
tgagagtcagctctctg

SEQ ID NO: 4026496 - DNA, 17 bp, Homo sapiens
tgagataatatctgtga

SEQ ID NO: 4026497 - DNA, 23 bp, Homo sapiens
tgagatagtagcatacatttata

SEQ ID NO: 4026498 - DNA, 20 bp, Homo sapiens
tgagatatttattgtttatt

SEQ ID NO: 4026499 - DNA, 14 bp, Homo sapiens
tgagatcacagcct

SEQ ID NO: 4026500 - DNA, 22 bp, Homo sapiens
tgagatcacagcctccagggcc

SEQ ID NO: 4026501 - DNA, 20 bp, Homo sapiens
tgagatcgtgctactgcact

SEQ ID NO: 4026502 - DNA, 20 bp, Homo sapiens
tgagatgatacatccaaagc

SEQ ID NO: 4026503 - DNA, 20 bp, Homo sapiens
tgagattcctctgtattgtg

SEQ ID NO: 4026504 - DNA, 17 bp, Homo sapiens
tgagattgaatttcact

SEQ ID NO: 4026505 - DNA, 17 bp, Homo sapiens
tgagatttcctcctggc

SEQ ID NO: 4026506 - DNA, 17 bp, Homo sapiens
tgagatttttaagaact

SEQ ID NO: 4026507 - DNA, 19 bp, Homo sapiens
tgagatttttaagaacttc

SEQ ID NO: 4026508 - DNA, 19 bp, Homo sapiens
tgagatttttttgtgtatg

SEQ ID NO: 4026509 - DNA, 20 bp, Homo sapiens
tgagatttttttgtgtatgt

SEQ ID NO: 4026510 - DNA, 21 bp, Homo sapiens
tgagatttttttgtgtatgtt

SEQ ID NO: 4026511 - DNA, 20 bp, Homo sapiens
tgagcaaaatatgccccttc

SEQ ID NO: 4026512 - DNA, 16 bp, Homo sapiens
tgaggcttagagagag

SEQ ID NO: 4026513 - DNA, 21 bp, Homo sapiens
tgagggaaagtgcatatgaaa

SEQ ID NO: 4026514 - DNA, 14 bp, Homo sapiens
tgagggagcttagc

SEQ ID NO: 4026515 - DNA, 13 bp, Homo sapiens
tgagggcccagag

SEQ ID NO: 4026516 - DNA, 14 bp, Homo sapiens
tgagggcccagagc

SEQ ID NO: 4026517 - DNA, 16 bp, Homo sapiens
tgagggcccagagcag

SEQ ID NO: 4026518 - DNA, 20 bp, Homo sapiens
tgagggcccagagcaggaag

SEQ ID NO: 4026519 - DNA, 22 bp, Homo sapiens
tgagggcctgctggaggcctca

SEQ ID NO: 4026520 - DNA, 15 bp, Homo sapiens
tgaggggagccagga

SEQ ID NO: 4026521 - DNA, 20 bp, Homo sapiens
tgaggtcaagtaagaagaca

SEQ ID NO: 4026522 - DNA, 14 bp, Homo sapiens
tgaggtcagggagt

SEQ ID NO: 4026523 - DNA, 21 bp, Homo sapiens
tgaggtccttatgtcctgtca

SEQ ID NO: 4026524 - DNA, 15 bp, Homo sapiens
tgaggtctgaaatgg

SEQ ID NO: 4026525 - DNA, 17 bp, Homo sapiens
tgaggtctgtttaaagt

SEQ ID NO: 4026526 - DNA, 17 bp, Homo sapiens
tgaggtcttttgacatg

SEQ ID NO: 4026527 - DNA, 23 bp, Homo sapiens
tgaggtcttttgacatgtggaaa

SEQ ID NO: 4026528 - DNA, 18 bp, Homo sapiens
tgaggtgaaagggagcta

SEQ ID NO: 4026529 - DNA, 16 bp, Homo sapiens
tgaggtgcctgtccca

SEQ ID NO: 4026530 - DNA, 14 bp, Homo sapiens
tgaggtgctgatga

SEQ ID NO: 4026531 - DNA, 13 bp, Homo sapiens
tgaggtgggaggt

SEQ ID NO: 4026532 - DNA, 22 bp, Homo sapiens
tgaggtgggaggtggaagaagg

SEQ ID NO: 4026533 - DNA, 14 bp, Homo sapiens
tgaggtggtctgaa

SEQ ID NO: 4026534 - DNA, 20 bp, Homo sapiens
tgaggtggtctgaatgttct

SEQ ID NO: 4026535 - DNA, 21 bp, Homo sapiens
tgaggtggtctgaatgttctg

SEQ ID NO: 4026536 - DNA, 15 bp, Homo sapiens
tgaggtgtccaactg

SEQ ID NO: 4026537 - DNA, 18 bp, Homo sapiens
tgaggtgtcttaagcctt

SEQ ID NO: 4026538 - DNA, 15 bp, Homo sapiens
tgaggtgtgtcacaa

SEQ ID NO: 4026539 - DNA, 18 bp, Homo sapiens
tgaggtgttgtgcatttg

SEQ ID NO: 4026540 - DNA, 21 bp, Homo sapiens
tgaggttcctctgcctgcccc

SEQ ID NO: 4026541 - DNA, 13 bp, Homo sapiens
tgaggttctgaga

SEQ ID NO: 4026542 - DNA, 16 bp, Homo sapiens
tgaggttctgagacca

SEQ ID NO: 4026543 - DNA, 23 bp, Homo sapiens
tgagtaaaaaggtggtatgtaat

SEQ ID NO: 4026544 - DNA, 12 bp, Homo sapiens
tgagtaaatatt

SEQ ID NO: 4026545 - DNA, 15 bp, Homo sapiens
tgagtaacatttgct

SEQ ID NO: 4026546 - DNA, 15 bp, Homo sapiens
tgagtaactattatt

SEQ ID NO: 4026547 - DNA, 22 bp, Homo sapiens
tgagtaatcaatacagacaagg

SEQ ID NO: 4026548 - DNA, 17 bp, Homo sapiens
tgagtaattttggattt

SEQ ID NO: 4026549 - DNA, 14 bp, Homo sapiens
tgagtaccaggggc

SEQ ID NO: 4026550 - DNA, 13 bp, Homo sapiens
tgagtcaatgtgc

SEQ ID NO: 4026551 - DNA, 15 bp, Homo sapiens
tgagtcaatgtgcag

SEQ ID NO: 4026552 - DNA, 15 bp, Homo sapiens
tgagtcacctgctcc

SEQ ID NO: 4026553 - DNA, 16 bp, Homo sapiens
tgagtcacctgctcca

SEQ ID NO: 4026554 - DNA, 17 bp, Homo sapiens
tgagtcacgctggggct

SEQ ID NO: 4026555 - DNA, 15 bp, Homo sapiens
tgagtcatctgttag

SEQ ID NO: 4026556 - DNA, 21 bp, Homo sapiens
tgagtcatctgttagggcctt

SEQ ID NO: 4026557 - DNA, 12 bp, Homo sapiens
tgagtccagagc

SEQ ID NO: 4026558 - DNA, 14 bp, Homo sapiens
tgagtccagagctt

SEQ ID NO: 4026559 - DNA, 19 bp, Homo sapiens
tgagtccagagcttgtgct

SEQ ID NO: 4026560 - DNA, 19 bp, Homo sapiens
tgagtctcctctctgagac

SEQ ID NO: 4026561 - DNA, 21 bp, Homo sapiens
tgagtctcctctctgagactg

SEQ ID NO: 4026562 - DNA, 23 bp, Homo sapiens
tgagtgagccacagaccacctgc

SEQ ID NO: 4026563 - DNA, 20 bp, Homo sapiens
tgagtgatcctccaacttca

SEQ ID NO: 4026564 - DNA, 14 bp, Homo sapiens
tgagtggccagcca

SEQ ID NO: 4026565 - DNA, 16 bp, Homo sapiens
tgagtggcgcaaggcc

SEQ ID NO: 4026566 - DNA, 12 bp, Homo sapiens
tgagtgtgacag

SEQ ID NO: 4026567 - DNA, 15 bp, Homo sapiens
tgagtgtgacagggc

SEQ ID NO: 4026568 - DNA, 13 bp, Homo sapiens
tgagtgtggactt

SEQ ID NO: 4026569 - DNA, 16 bp, Homo sapiens
tgagtgtgtgtgtgca

SEQ ID NO: 4026570 - DNA, 16 bp, Homo sapiens
tgagttacagcctgtt

SEQ ID NO: 4026571 - DNA, 23 bp, Homo sapiens
tgagttattccttgatcattttg

SEQ ID NO: 4026572 - DNA, 14 bp, Homo sapiens
tgagttctgggttt

SEQ ID NO: 4026573 - DNA, 18 bp, Homo sapiens
tgagtttaccatttgtaa

SEQ ID NO: 4026574 - DNA, 19 bp, Homo sapiens
tgagtttgagctgccttcc

SEQ ID NO: 4026575 - DNA, 15 bp, Homo sapiens
tgagtttttcctccc

SEQ ID NO: 4026576 - DNA, 19 bp, Homo sapiens
tgagtttttcctcccagtg

SEQ ID NO: 4026577 - DNA, 20 bp, Homo sapiens
tgagtttttcctcccagtga

SEQ ID NO: 4026578 - DNA, 19 bp, Homo sapiens
tgagtttttgatagcttta

SEQ ID NO: 4026579 - DNA, 11 bp, Homo sapiens
tgataaaataa

SEQ ID NO: 4026580 - DNA, 17 bp, Homo sapiens
tgataaaataaataatt

SEQ ID NO: 4026581 - DNA, 13 bp, Homo sapiens
tgataataaattg

SEQ ID NO: 4026582 - DNA, 15 bp, Homo sapiens
tgataataaattgaa

SEQ ID NO: 4026583 - DNA, 23 bp, Homo sapiens
tgataataaattgaaattgtgaa

SEQ ID NO: 4026584 - DNA, 20 bp, Homo sapiens
tctggtagatttttaacgaa

SEQ ID NO: 4026585 - DNA, 13 bp, Homo sapiens
tctggtcccttgc

SEQ ID NO: 4026586 - DNA, 15 bp, Homo sapiens
tctggtgctcctgca

SEQ ID NO: 4026587 - DNA, 17 bp, Homo sapiens
tctggtgcttgggagag

SEQ ID NO: 4026588 - DNA, 13 bp, Homo sapiens
tctggtgttgact

SEQ ID NO: 4026589 - DNA, 22 bp, Homo sapiens
tctggttgatttgtaacacagt

SEQ ID NO: 4026590 - DNA, 18 bp, Homo sapiens
tctggttgtttctgttcc

SEQ ID NO: 4026591 - DNA, 20 bp, Homo sapiens
tctggttgtttctgttccaa

SEQ ID NO: 4026592 - DNA, 14 bp, Homo sapiens
tctgtaaataacct

SEQ ID NO: 4026593 - DNA, 18 bp, Homo sapiens
tctgtaagcataagctta

SEQ ID NO: 4026594 - DNA, 17 bp, Homo sapiens
tctgtaattgtgtgtga

SEQ ID NO: 4026595 - DNA, 13 bp, Homo sapiens
tctgtagctcctc

SEQ ID NO: 4026596 - DNA, 23 bp, Homo sapiens
tctgtagctcctcaactcaccta

SEQ ID NO: 4026597 - DNA, 16 bp, Homo sapiens
tctgtagggctggacc

SEQ ID NO: 4026598 - DNA, 13 bp, Homo sapiens
tctgtataaatgt

SEQ ID NO: 4026599 - DNA, 15 bp, Homo sapiens
tctgtataaatgtct

SEQ ID NO: 4026600 - DNA, 16 bp, Homo sapiens
tctgtataaatgtcta

SEQ ID NO: 4026601 - DNA, 14 bp, Homo sapiens
tctgtatagaaatc

SEQ ID NO: 4026602 - DNA, 21 bp, Homo sapiens
tctgtatcggagacagtgatc

SEQ ID NO: 4026603 - DNA, 23 bp, Homo sapiens
tctgtatttatgtgtgaggagct

SEQ ID NO: 4026604 - DNA, 13 bp, Homo sapiens
tctgtatttcatg

SEQ ID NO: 4026605 - DNA, 18 bp, Homo sapiens
tctgtatttcatgtggct

SEQ ID NO: 4026606 - DNA, 13 bp, Homo sapiens
tctgtatttctag

SEQ ID NO: 4026607 - DNA, 14 bp, Homo sapiens
tctgtatttctagg

SEQ ID NO: 4026608 - DNA, 19 bp, Homo sapiens
tctgtcaccagctatctgt

SEQ ID NO: 4026609 - DNA, 15 bp, Homo sapiens
tctgtcagcatctgg

SEQ ID NO: 4026610 - DNA, 17 bp, Homo sapiens
tctgtcagcatctggct

SEQ ID NO: 4026611 - DNA, 13 bp, Homo sapiens
tctgtcagccagc

SEQ ID NO: 4026612 - DNA, 13 bp, Homo sapiens
tctgtcatctctc

SEQ ID NO: 4026613 - DNA, 16 bp, Homo sapiens
tctgtcatctctctgg

SEQ ID NO: 4026614 - DNA, 18 bp, Homo sapiens
tctgtcatctctctgggg

SEQ ID NO: 4026615 - DNA, 22 bp, Homo sapiens
tctgtcatctctctggggccct

SEQ ID NO: 4026616 - DNA, 23 bp, Homo sapiens
tctgtcatctctctggggccctg

SEQ ID NO: 4026617 - DNA, 22 bp, Homo sapiens
tctgtccaaaggaggctggcag

SEQ ID NO: 4026618 - DNA, 23 bp, Homo sapiens
tctgtccaaaggaggctggcagg

SEQ ID NO: 4026619 - DNA, 12 bp, Homo sapiens
tctgtccaagga

SEQ ID NO: 4026620 - DNA, 20 bp, Homo sapiens
tctgtccagctggggccaga

SEQ ID NO: 4026621 - DNA, 15 bp, Homo sapiens
tctgtccatggcctt

SEQ ID NO: 4026622 - DNA, 12 bp, Homo sapiens
tctgtccccagc

SEQ ID NO: 4026623 - DNA, 20 bp, Homo sapiens
tctgtccccagccctgtcct

SEQ ID NO: 4026624 - DNA, 16 bp, Homo sapiens
tctgtcccccaggctg

SEQ ID NO: 4026625 - DNA, 15 bp, Homo sapiens
tctgtcccttgctgt

SEQ ID NO: 4026626 - DNA, 12 bp, Homo sapiens
tctgtctcatcc

SEQ ID NO: 4026627 - DNA, 18 bp, Homo sapiens
tctgtctcatcctcctgg

SEQ ID NO: 4026628 - DNA, 22 bp, Homo sapiens
tctgtctgcccttcaccccagt

SEQ ID NO: 4026629 - DNA, 12 bp, Homo sapiens
tctgtctgctgg

SEQ ID NO: 4026630 - DNA, 13 bp, Homo sapiens
tctgtctgctggt

SEQ ID NO: 4026631 - DNA, 22 bp, Homo sapiens
tctgtcttcaggctctgcccag

SEQ ID NO: 4026632 - DNA, 19 bp, Homo sapiens
tctgtcttgttaatgcttt

SEQ ID NO: 4026633 - DNA, 11 bp, Homo sapiens
tctgtctttcc

SEQ ID NO: 4026634 - DNA, 21 bp, Homo sapiens
tctgtctttcctgaaccatgt

SEQ ID NO: 4026635 - DNA, 19 bp, Homo sapiens
tgatcaagtcctttgtgaa

SEQ ID NO: 4026636 - DNA, 16 bp, Homo sapiens
tgatcaatatttttat

SEQ ID NO: 4026637 - DNA, 21 bp, Homo sapiens
tgatcaatatttttatatcat

SEQ ID NO: 4026638 - DNA, 16 bp, Homo sapiens
tgatcaattttgactt

SEQ ID NO: 4026639 - DNA, 15 bp, Homo sapiens
tgatcactagcctgt

SEQ ID NO: 4026640 - DNA, 18 bp, Homo sapiens
tgatcactggcaatgaaa

SEQ ID NO: 4026641 - DNA, 11 bp, Homo sapiens
tgatcagaggt

SEQ ID NO: 4026642 - DNA, 19 bp, Homo sapiens
tgatcagaggtgtacacta

SEQ ID NO: 4026643 - DNA, 23 bp, Homo sapiens
tgatcagaggtgtacactaacat

SEQ ID NO: 4026644 - DNA, 11 bp, Homo sapiens
tgatcagtgtt

SEQ ID NO: 4026645 - DNA, 18 bp, Homo sapiens
tgatcataagtgaattta

SEQ ID NO: 4026646 - DNA, 13 bp, Homo sapiens
tgatcatgcattg

SEQ ID NO: 4026647 - DNA, 14 bp, Homo sapiens
tgatcatgcattgt

SEQ ID NO: 4026648 - DNA, 16 bp, Homo sapiens
tgatcattttcccccc

SEQ ID NO: 4026649 - DNA, 12 bp, Homo sapiens
tgatccacactt

SEQ ID NO: 4026650 - DNA, 17 bp, Homo sapiens
tgatccagaagagccca

SEQ ID NO: 4026651 - DNA, 15 bp, Homo sapiens
tgatcccattttcct

SEQ ID NO: 4026652 - DNA, 20 bp, Homo sapiens
tgatcccttccacctgctct

SEQ ID NO: 4026653 - DNA, 18 bp, Homo sapiens
tgatcctagtgtctttaa

SEQ ID NO: 4026654 - DNA, 17 bp, Homo sapiens
tgatcctccaacttcat

SEQ ID NO: 4026655 - DNA, 14 bp, Homo sapiens
tgatcctctatttt

SEQ ID NO: 4026656 - DNA, 21 bp, Homo sapiens
tgatcctgcggagaacaccct

SEQ ID NO: 4026657 - DNA, 16 bp, Homo sapiens
tgatcctggaggccca

SEQ ID NO: 4026658 - DNA, 15 bp, Homo sapiens
tgatctcagggcaga

SEQ ID NO: 4026659 - DNA, 16 bp, Homo sapiens
tgatctccatatgtta

SEQ ID NO: 4026660 - DNA, 18 bp, Homo sapiens
tgatctctcttgtcctct

SEQ ID NO: 4026661 - DNA, 13 bp, Homo sapiens
tgatctggaaccc

SEQ ID NO: 4026662 - DNA, 18 bp, Homo sapiens
tgatctggaacccagact

SEQ ID NO: 4026663 - DNA, 14 bp, Homo sapiens
tgatctggacagaa

SEQ ID NO: 4026664 - DNA, 18 bp, Homo sapiens
tgatcttaaagatcgtgt

SEQ ID NO: 4026665 - DNA, 20 bp, Homo sapiens
tgatcttctgggagcaggaa

SEQ ID NO: 4026666 - DNA, 16 bp, Homo sapiens
tgatcttgtgctcagc

SEQ ID NO: 4026667 - DNA, 18 bp, Homo sapiens
tgatcttgtgctcagcat

SEQ ID NO: 4026668 - DNA, 19 bp, Homo sapiens
tgatcttgtgctcagcatg

SEQ ID NO: 4026669 - DNA, 14 bp, Homo sapiens
tgatcttttaaagt

SEQ ID NO: 4026670 - DNA, 17 bp, Homo sapiens
tgatcttttaaagtgtt

SEQ ID NO: 4026671 - DNA, 18 bp, Homo sapiens
tgatcttttaaagtgtta

SEQ ID NO: 4026672 - DNA, 21 bp, Homo sapiens
tgatcttttaaagtgttactt

SEQ ID NO: 4026673 - DNA, 12 bp, Homo sapiens
tgatgaaatctg

SEQ ID NO: 4026674 - DNA, 22 bp, Homo sapiens
tgatgaaatctgctagaaagtt

SEQ ID NO: 4026675 - DNA, 15 bp, Homo sapiens
tgatgaagcaaggaa

SEQ ID NO: 4026676 - DNA, 16 bp, Homo sapiens
tgatgaagcaaggaag

SEQ ID NO: 4026677 - DNA, 12 bp, Homo sapiens
tgatgaagtata

SEQ ID NO: 4026678 - DNA, 16 bp, Homo sapiens
tgatgaatcaatgaaa

SEQ ID NO: 4026679 - DNA, 17 bp, Homo sapiens
tgatgaatcaatgaaaa

SEQ ID NO: 4026680 - DNA, 22 bp, Homo sapiens
tgatgaatcaatgaaaaatgta

SEQ ID NO: 4026681 - DNA, 15 bp, Homo sapiens
tgatgacattccctg

SEQ ID NO: 4026682 - DNA, 18 bp, Homo sapiens
tgatgacattccctgcta

SEQ ID NO: 4026683 - DNA, 15 bp, Homo sapiens
tgatgagaatttcta

SEQ ID NO: 4026684 - DNA, 21 bp, Homo sapiens
tgatgagtgattgacacacag

SEQ ID NO: 4026685 - DNA, 17 bp, Homo sapiens
tgatgatacaatgaaca

SEQ ID NO: 4026686 - DNA, 21 bp, Homo sapiens
tgatgatcagctgtttgtcat

SEQ ID NO: 4026687 - DNA, 13 bp, Homo sapiens
tgatgatccagaa

SEQ ID NO: 4026688 - DNA, 17 bp, Homo sapiens
tgatgatccagaacagt

SEQ ID NO: 4026689 - DNA, 18 bp, Homo sapiens
tgatgattaaacacctga

SEQ ID NO: 4026690 - DNA, 22 bp, Homo sapiens
tgatgattaaacacctgacaca

SEQ ID NO: 4026691 - DNA, 15 bp, Homo sapiens
tgatgattttccttt

SEQ ID NO: 4026692 - DNA, 21 bp, Homo sapiens
tgatgcattaattaatggctt

SEQ ID NO: 4026693 - DNA, 15 bp, Homo sapiens
tgatgctatttatgc

SEQ ID NO: 4026694 - DNA, 16 bp, Homo sapiens
tgatgctatttatgca

SEQ ID NO: 4026695 - DNA, 17 bp, Homo sapiens
tgatgctccctcccctg

SEQ ID NO: 4026696 - DNA, 21 bp, Homo sapiens
tgatgctccctcccctgccct

SEQ ID NO: 4026697 - DNA, 22 bp, Homo sapiens
tgatgctccctcccctgccctg

SEQ ID NO: 4026698 - DNA, 15 bp, Homo sapiens
tgatgctctttccca

SEQ ID NO: 4026699 - DNA, 22 bp, Homo sapiens
tgatgctctttcccacccagcc

SEQ ID NO: 4026700 - DNA, 17 bp, Homo sapiens
tgatgctggagaggtta

SEQ ID NO: 4026701 - DNA, 18 bp, Homo sapiens
tgatgcttataataaaga

SEQ ID NO: 4026702 - DNA, 22 bp, Homo sapiens
tgatgcttataataaagaaaac

SEQ ID NO: 4026703 - DNA, 13 bp, Homo sapiens
tgatggaaaataa

SEQ ID NO: 4026704 - DNA, 22 bp, Homo sapiens
tgatggaagtaaagcctcaacc

SEQ ID NO: 4026705 - DNA, 14 bp, Homo sapiens
tgatggaggaaaaa

SEQ ID NO: 4026706 - DNA, 16 bp, Homo sapiens
tgatggccttaatttc

SEQ ID NO: 4026707 - DNA, 20 bp, Homo sapiens
tgatggccttaatttccttt

SEQ ID NO: 4026708 - DNA, 21 bp, Homo sapiens
tgcaaggcctggtgtttcttg

SEQ ID NO: 4026709 - DNA, 19 bp, Homo sapiens
tgcaaggtatttctccagt

SEQ ID NO: 4026710 - DNA, 13 bp, Homo sapiens
tgcaaggtggcct

SEQ ID NO: 4026711 - DNA, 14 bp, Homo sapiens
tgcaataacttcta

SEQ ID NO: 4026712 - DNA, 22 bp, Homo sapiens
tgcaataacttctatattttaa

SEQ ID NO: 4026713 - DNA, 19 bp, Homo sapiens
tgcaataacttctgacctt

SEQ ID NO: 4026714 - DNA, 11 bp, Homo sapiens
tgcaataattt

SEQ ID NO: 4026715 - DNA, 14 bp, Homo sapiens
tgcaataattttac

SEQ ID NO: 4026716 - DNA, 22 bp, Homo sapiens
tgcaatgaaaggtactatattt

SEQ ID NO: 4026717 - DNA, 17 bp, Homo sapiens
tgcaatgacatcttcaa

SEQ ID NO: 4026718 - DNA, 15 bp, Homo sapiens
tgcaatgggcactgg

SEQ ID NO: 4026719 - DNA, 19 bp, Homo sapiens
tgcaatgtctgagtgaacc

SEQ ID NO: 4026720 - DNA, 17 bp, Homo sapiens
tgcaattaggattttga

SEQ ID NO: 4026721 - DNA, 20 bp, Homo sapiens
tgcaattaggtttttcctta

SEQ ID NO: 4026722 - DNA, 14 bp, Homo sapiens
tgcaattcccctct

SEQ ID NO: 4026723 - DNA, 18 bp, Homo sapiens
tgcaattcccctctgctg

SEQ ID NO: 4026724 - DNA, 14 bp, Homo sapiens
tgcaatttcatatg

SEQ ID NO: 4026725 - DNA, 18 bp, Homo sapiens
tgcacaaaacccagacct

SEQ ID NO: 4026726 - DNA, 21 bp, Homo sapiens
tgcacactagcctctccagga

SEQ ID NO: 4026727 - DNA, 10 bp, Homo sapiens
tgcacagctg

SEQ ID NO: 4026728 - DNA, 11 bp, Homo sapiens
tgcacagctgt

SEQ ID NO: 4026729 - DNA, 14 bp, Homo sapiens
tgcacagctgtcca

SEQ ID NO: 4026730 - DNA, 12 bp, Homo sapiens
tgcacaggcaga

SEQ ID NO: 4026731 - DNA, 18 bp, Homo sapiens
tgcacagggaagggcttg

SEQ ID NO: 4026732 - DNA, 15 bp, Homo sapiens
tgcacagtgcatctc

SEQ ID NO: 4026733 - DNA, 16 bp, Homo sapiens
tgcacagtgcatctca

SEQ ID NO: 4026734 - DNA, 18 bp, Homo sapiens
tgcacagtgcatctcagc

SEQ ID NO: 4026735 - DNA, 20 bp, Homo sapiens
tgcacagtgcatctcagccc

SEQ ID NO: 4026736 - DNA, 22 bp, Homo sapiens
tgcacatagctatcaagtgtgc

SEQ ID NO: 4026737 - DNA, 14 bp, Homo sapiens
tgcacatgaaagtt

SEQ ID NO: 4026738 - DNA, 16 bp, Homo sapiens
tgcacatgaatgcagt

SEQ ID NO: 4026739 - DNA, 16 bp, Homo sapiens
tgcacatgattgtata

SEQ ID NO: 4026740 - DNA, 17 bp, Homo sapiens
tgcacatgattgtataa

SEQ ID NO: 4026741 - DNA, 19 bp, Homo sapiens
tgcacatgattgtataagc

SEQ ID NO: 4026742 - DNA, 18 bp, Homo sapiens
tgcacatttctttgcatt

SEQ ID NO: 4026743 - DNA, 15 bp, Homo sapiens
tgcaccaagaaagct

SEQ ID NO: 4026744 - DNA, 12 bp, Homo sapiens
tgcacccagctc

SEQ ID NO: 4026745 - DNA, 18 bp, Homo sapiens
tgcacccagctccagggg

SEQ ID NO: 4026746 - DNA, 15 bp, Homo sapiens
tgcacccaggggtgg

SEQ ID NO: 4026747 - DNA, 19 bp, Homo sapiens
tgcaccccaaagctttcct

SEQ ID NO: 4026748 - DNA, 20 bp, Homo sapiens
tgcaccccaaagctttcctg

SEQ ID NO: 4026749 - DNA, 21 bp, Homo sapiens
tgcacccctgagccagcaggg

SEQ ID NO: 4026750 - DNA, 16 bp, Homo sapiens
tgcacccctgggccag

SEQ ID NO: 4026751 - DNA, 20 bp, Homo sapiens
tgcacccggcctggatgcca

SEQ ID NO: 4026752 - DNA, 17 bp, Homo sapiens
tgcaccctgcgcctcca

SEQ ID NO: 4026753 - DNA, 19 bp, Homo sapiens
tgcaccctgcgcctccaga

SEQ ID NO: 4026754 - DNA, 20 bp, Homo sapiens
tgcaccctgcgcctccagag

SEQ ID NO: 4026755 - DNA, 19 bp, Homo sapiens
tgcacctgattagttgaaa

SEQ ID NO: 4026756 - DNA, 13 bp, Homo sapiens
tgcacctgggaca

SEQ ID NO: 4026757 - DNA, 15 bp, Homo sapiens
tgcacgtcatgggag

SEQ ID NO: 4026758 - DNA, 14 bp, Homo sapiens
tgcacgtggcctct

SEQ ID NO: 4026759 - DNA, 22 bp, Homo sapiens
tgcacgtggcctcttgagcagt

SEQ ID NO: 4026760 - DNA, 17 bp, Homo sapiens
tgcacgttcataaccaa

SEQ ID NO: 4026761 - DNA, 16 bp, Homo sapiens
tgcactactgacatgt

SEQ ID NO: 4026762 - DNA, 14 bp, Homo sapiens
tgcactccagcctg

SEQ ID NO: 4026763 - DNA, 20 bp, Homo sapiens
tgcactccagcctgggcaac

SEQ ID NO: 4026764 - DNA, 18 bp, Homo sapiens
tgcactccagcctggggg

SEQ ID NO: 4026765 - DNA, 17 bp, Homo sapiens
tgcactctaaactgcaa

SEQ ID NO: 4026766 - DNA, 18 bp, Homo sapiens
tgcactctaaactgcaaa

SEQ ID NO: 4026767 - DNA, 16 bp, Homo sapiens
tgcactctcttggctg

SEQ ID NO: 4026768 - DNA, 19 bp, Homo sapiens
tgcactgaaaacttagcca

SEQ ID NO: 4026769 - DNA, 15 bp, Homo sapiens
tgcactgatcaccca

SEQ ID NO: 4026770 - DNA, 22 bp, Homo sapiens
tgcactgatgctgcccctcatc

SEQ ID NO: 4026771 - DNA, 20 bp, Homo sapiens
tgcactggggagcccgtctc

SEQ ID NO: 4026772 - DNA, 16 bp, Homo sapiens
tgcactgggggaacag

SEQ ID NO: 4026773 - DNA, 17 bp, Homo sapiens
tgcactgggggaacaga

SEQ ID NO: 4026774 - DNA, 19 bp, Homo sapiens
tgcactgtcactttgctct

SEQ ID NO: 4026775 - DNA, 21 bp, Homo sapiens
tgcactgtcactttgctctgg

SEQ ID NO: 4026776 - DNA, 20 bp, Homo sapiens
tgcacttaagttagcctcca

SEQ ID NO: 4026777 - DNA, 22 bp, Homo sapiens
tgcacttatttatgaacctgcc

SEQ ID NO: 4026778 - DNA, 13 bp, Homo sapiens
tgcagaaaaagaa

SEQ ID NO: 4026779 - DNA, 16 bp, Homo sapiens
tgcagaaaaagaaaaa

SEQ ID NO: 4026780 - DNA, 17 bp, Homo sapiens
tgcagaaaattctgtgc

SEQ ID NO: 4026781 - DNA, 22 bp, Homo sapiens
tgcagaacttgaagcctgctcc

SEQ ID NO: 4026782 - DNA, 15 bp, Homo sapiens
tgcagaagggagctg

SEQ ID NO: 4026783 - DNA, 13 bp, Homo sapiens
tgcagaataatgg

SEQ ID NO: 4026784 - DNA, 19 bp, Homo sapiens
aaaagtattttttcaagtt

SEQ ID NO: 4026785 - DNA, 15 bp, Homo sapiens
aaaagtcacttacta

SEQ ID NO: 4026786 - DNA, 14 bp, Homo sapiens
aaaagtctattttt

SEQ ID NO: 4026787 - DNA, 19 bp, Homo sapiens
aaaagtcttcactctctga

SEQ ID NO: 4026788 - DNA, 15 bp, Homo sapiens
aaaagtgacacagca

SEQ ID NO: 4026789 - DNA, 18 bp, Homo sapiens
aaaagtgggcttgattct

SEQ ID NO: 4026790 - DNA, 19 bp, Homo sapiens
aaaagtgtggcttgggcat

SEQ ID NO: 4026791 - DNA, 14 bp, Homo sapiens
aaaagttagctgag

SEQ ID NO: 4026792 - DNA, 11 bp, Homo sapiens
aaaagttcttt

SEQ ID NO: 4026793 - DNA, 20 bp, Homo sapiens
aaaagtttcacgtcttggtg

SEQ ID NO: 4026794 - DNA, 12 bp, Homo sapiens
aaaagtttccat

SEQ ID NO: 4026795 - DNA, 13 bp, Homo sapiens
aaaagtttcctag

SEQ ID NO: 4026796 - DNA, 22 bp, Homo sapiens
aaaataaaaagtgacacagcag

SEQ ID NO: 4026797 - DNA, 14 bp, Homo sapiens
aaaataaaactaag

SEQ ID NO: 4026798 - DNA, 14 bp, Homo sapiens
aaaataaagaagta

SEQ ID NO: 4026799 - DNA, 16 bp, Homo sapiens
aaaataaataatttta

SEQ ID NO: 4026800 - DNA, 20 bp, Homo sapiens
aaaataaccctttggttttt

SEQ ID NO: 4026801 - DNA, 16 bp, Homo sapiens
aaaataacttcaagca

SEQ ID NO: 4026802 - DNA, 16 bp, Homo sapiens
aaaataagaatagaaa

SEQ ID NO: 4026803 - DNA, 14 bp, Homo sapiens
aaaataagcaggtg

SEQ ID NO: 4026804 - DNA, 13 bp, Homo sapiens
aaaataataataa

SEQ ID NO: 4026805 - DNA, 22 bp, Homo sapiens
aaaataataatttttatattta

SEQ ID NO: 4026806 - DNA, 14 bp, Homo sapiens
aaaataatcaagat

SEQ ID NO: 4026807 - DNA, 17 bp, Homo sapiens
aaaatacaatcctgttt

SEQ ID NO: 4026808 - DNA, 12 bp, Homo sapiens
aaaatacattgt

SEQ ID NO: 4026809 - DNA, 17 bp, Homo sapiens
aaaatactattgcctca

SEQ ID NO: 4026810 - DNA, 21 bp, Homo sapiens
aaaatacttgtcaatatttaa

SEQ ID NO: 4026811 - DNA, 16 bp, Homo sapiens
aaaatacttttactct

SEQ ID NO: 4026812 - DNA, 20 bp, Homo sapiens
aaaatagaaattttgtaaga

SEQ ID NO: 4026813 - DNA, 19 bp, Homo sapiens
aaaatagacaaatagaaaa

SEQ ID NO: 4026814 - DNA, 16 bp, Homo sapiens
aaaatagagcttttaa

SEQ ID NO: 4026815 - DNA, 15 bp, Homo sapiens
aaaatagcaatgcct

SEQ ID NO: 4026816 - DNA, 22 bp, Homo sapiens
aaaatagtttaggagaaaccag

SEQ ID NO: 4026817 - DNA, 13 bp, Homo sapiens
aaaatatatacta

SEQ ID NO: 4026818 - DNA, 15 bp, Homo sapiens
aaaatattatgtgtt

SEQ ID NO: 4026819 - DNA, 20 bp, Homo sapiens
aaaatattcctccaaatctc

SEQ ID NO: 4026820 - DNA, 11 bp, Homo sapiens
aaaatattgtt

SEQ ID NO: 4026821 - DNA, 15 bp, Homo sapiens
aaaatattgtttctg

SEQ ID NO: 4026822 - DNA, 23 bp, Homo sapiens
aaaatattgtttctgcattcatt

SEQ ID NO: 4026823 - DNA, 20 bp, Homo sapiens
aaaatatttcagatatcaaa

SEQ ID NO: 4026824 - DNA, 11 bp, Homo sapiens
aaaatatttcc

SEQ ID NO: 4026825 - DNA, 21 bp, Homo sapiens
aaaatatttcctgacttgagt

SEQ ID NO: 4026826 - DNA, 17 bp, Homo sapiens
aaaatattttataattt

SEQ ID NO: 4026827 - DNA, 18 bp, Homo sapiens
aaaatattttataatttt

SEQ ID NO: 4026828 - DNA, 20 bp, Homo sapiens
aaaatattttgttgccttca

SEQ ID NO: 4026829 - DNA, 16 bp, Homo sapiens
aaaatattttttgcaa

SEQ ID NO: 4026830 - DNA, 23 bp, Homo sapiens
aaaatcacactgtaaatatgaat

SEQ ID NO: 4026831 - DNA, 14 bp, Homo sapiens
aaaatcacttagca

SEQ ID NO: 4026832 - DNA, 21 bp, Homo sapiens
aaaatcactttgtctaactca

SEQ ID NO: 4026833 - DNA, 12 bp, Homo sapiens
aaaatcattgat

SEQ ID NO: 4026834 - DNA, 22 bp, Homo sapiens
aaaatccagaaacttgttcttc

SEQ ID NO: 4026835 - DNA, 18 bp, Homo sapiens
aaaatcccaccttcccac

SEQ ID NO: 4026836 - DNA, 22 bp, Homo sapiens
aaaatctaaaacaaaatctgaa

SEQ ID NO: 4026837 - DNA, 22 bp, Homo sapiens
aaaatctgaactctcaaaagtc

SEQ ID NO: 4026838 - DNA, 20 bp, Homo sapiens
aaaatcttggagaccctgca

SEQ ID NO: 4026839 - DNA, 18 bp, Homo sapiens
aaaatcttggcacagaaa

SEQ ID NO: 4026840 - DNA, 15 bp, Homo sapiens
aaaatgaaaagccaa

SEQ ID NO: 4026841 - DNA, 16 bp, Homo sapiens
aaaatgaaaattgtat

SEQ ID NO: 4026842 - DNA, 15 bp, Homo sapiens
aaaatgaaagtgact

SEQ ID NO: 4026843 - DNA, 15 bp, Homo sapiens
aaaatgaaatccttt

SEQ ID NO: 4026844 - DNA, 13 bp, Homo sapiens
aaaatgacagatg

SEQ ID NO: 4026845 - DNA, 18 bp, Homo sapiens
aaaatgactacttagcat

SEQ ID NO: 4026846 - DNA, 13 bp, Homo sapiens
aaaatgagaattt

SEQ ID NO: 4026847 - DNA, 23 bp, Homo sapiens
aaaatgagctcgcatttgtcaat

SEQ ID NO: 4026848 - DNA, 17 bp, Homo sapiens
aaacatggttgtaatat

SEQ ID NO: 4026849 - DNA, 20 bp, Homo sapiens
aaacattaagattgaggcct

SEQ ID NO: 4026850 - DNA, 20 bp, Homo sapiens
aaacattaatagcagccttt

SEQ ID NO: 4026851 - DNA, 22 bp, Homo sapiens
aaacattaatagcagcctttct

SEQ ID NO: 4026852 - DNA, 24 bp, Homo sapiens
aaacattgacgattccttctctga

SEQ ID NO: 4026853 - DNA, 14 bp, Homo sapiens
aaacattttaaaaa

SEQ ID NO: 4026854 - DNA, 21 bp, Homo sapiens
aaacattttatttttaaaata

SEQ ID NO: 4026855 - DNA, 21 bp, Homo sapiens
aaacattttgtggtcattaag

SEQ ID NO: 4026856 - DNA, 13 bp, Homo sapiens
aaacatttttaat

SEQ ID NO: 4026857 - DNA, 18 bp, Homo sapiens
aaacattttttcttctga

SEQ ID NO: 4026858 - DNA, 21 bp, Homo sapiens
aaaccaacctttaaaattgtc

SEQ ID NO: 4026859 - DNA, 22 bp, Homo sapiens
aaaccaacctttaaaattgtca

SEQ ID NO: 4026860 - DNA, 20 bp, Homo sapiens
aaaccaagtcggaacagcag

SEQ ID NO: 4026861 - DNA, 21 bp, Homo sapiens
aaaccaatcttaaacataata

SEQ ID NO: 4026862 - DNA, 12 bp, Homo sapiens
aaaccacacaaa

SEQ ID NO: 4026863 - DNA, 14 bp, Homo sapiens
aaaccacacaaaga

SEQ ID NO: 4026864 - DNA, 19 bp, Homo sapiens
aaaccaccgtgaaccagag

SEQ ID NO: 4026865 - DNA, 21 bp, Homo sapiens
aaaccagcttgttctgggctc

SEQ ID NO: 4026866 - DNA, 15 bp, Homo sapiens
aaaccaggacattaa

SEQ ID NO: 4026867 - DNA, 21 bp, Homo sapiens
aaaccatgactgtgaccacct

SEQ ID NO: 4026868 - DNA, 23 bp, Homo sapiens
aaaccattttcccatcatccttt

SEQ ID NO: 4026869 - DNA, 23 bp, Homo sapiens
aaacccagggaggaagactgtaa

SEQ ID NO: 4026870 - DNA, 13 bp, Homo sapiens
aaacccagggcaa

SEQ ID NO: 4026871 - DNA, 13 bp, Homo sapiens
aaacccctgtccc

SEQ ID NO: 4026872 - DNA, 14 bp, Homo sapiens
aaaccctagccttg

SEQ ID NO: 4026873 - DNA, 15 bp, Homo sapiens
aaaccctagccttgc

SEQ ID NO: 4026874 - DNA, 18 bp, Homo sapiens
aaaccctagccttgcttg

SEQ ID NO: 4026875 - DNA, 21 bp, Homo sapiens
aaaccctgtctctactaaaaa

SEQ ID NO: 4026876 - DNA, 20 bp, Homo sapiens
aaaccgataatgcatgaagc

SEQ ID NO: 4026877 - DNA, 20 bp, Homo sapiens
aaaccgcctagtttactgtt

SEQ ID NO: 4026878 - DNA, 13 bp, Homo sapiens
aaaccgtgtttgt

SEQ ID NO: 4026879 - DNA, 18 bp, Homo sapiens
aaacctacacactgtcat

SEQ ID NO: 4026880 - DNA, 16 bp, Homo sapiens
aaacctagaattttct

SEQ ID NO: 4026881 - DNA, 18 bp, Homo sapiens
aaacctatcctcactgcc

SEQ ID NO: 4026882 - DNA, 23 bp, Homo sapiens
aaacttccatgaggccaaacgtt

SEQ ID NO: 4026883 - DNA, 17 bp, Homo sapiens
aaacttcttaaatatct

SEQ ID NO: 4026884 - DNA, 19 bp, Homo sapiens
aaacttcttaaatatcttt

SEQ ID NO: 4026885 - DNA, 15 bp, Homo sapiens
aaacttgaagcagtc

SEQ ID NO: 4026886 - DNA, 17 bp, Homo sapiens
aaacttggatacttgga

SEQ ID NO: 4026887 - DNA, 11 bp, Homo sapiens
aaacttgtaaa

SEQ ID NO: 4026888 - DNA, 12 bp, Homo sapiens
aaacttgtaaat

SEQ ID NO: 4026889 - DNA, 16 bp, Homo sapiens
aaacttgtaatttttt

SEQ ID NO: 4026890 - DNA, 20 bp, Homo sapiens
aaacttgtaatttttttaat

SEQ ID NO: 4026891 - DNA, 22 bp, Homo sapiens
aaacttgtcttttcaaaatatt

SEQ ID NO: 4026892 - DNA, 16 bp, Homo sapiens
aaacttgttcttccaa

SEQ ID NO: 4026893 - DNA, 22 bp, Homo sapiens
aaactttaaaaaatatttatta

SEQ ID NO: 4026894 - DNA, 13 bp, Homo sapiens
aaactttatacat

SEQ ID NO: 4026895 - DNA, 18 bp, Homo sapiens
aaactttcctcgcctgac

SEQ ID NO: 4026896 - DNA, 16 bp, Homo sapiens
aaacttttaattcatt

SEQ ID NO: 4026897 - DNA, 13 bp, Homo sapiens
aaacttttctgct

SEQ ID NO: 4026898 - DNA, 16 bp, Homo sapiens
aaacttttctgctgat

SEQ ID NO: 4026899 - DNA, 18 bp, Homo sapiens
aaagaaaaaaaagaaagc

SEQ ID NO: 4026900 - DNA, 16 bp, Homo sapiens
aaagaaaacctttcta

SEQ ID NO: 4026901 - DNA, 12 bp, Homo sapiens
aaagaaacacaa

SEQ ID NO: 4026902 - DNA, 14 bp, Homo sapiens
aaagaaagaaggaa

SEQ ID NO: 4026903 - DNA, 13 bp, Homo sapiens
aaagaaatattta

SEQ ID NO: 4026904 - DNA, 14 bp, Homo sapiens
aaagaaatatttac

SEQ ID NO: 4026905 - DNA, 16 bp, Homo sapiens
aaagaaatgactaatt

SEQ ID NO: 4026906 - DNA, 20 bp, Homo sapiens
aaagaacatggacttgtata

SEQ ID NO: 4026907 - DNA, 22 bp, Homo sapiens
aaagaacatggacttgtatatt

SEQ ID NO: 4026908 - DNA, 16 bp, Homo sapiens
aaagaagaaagactct

SEQ ID NO: 4026909 - DNA, 17 bp, Homo sapiens
aaagaagaacttgcatg

SEQ ID NO: 4026910 - DNA, 20 bp, Homo sapiens
aaagaagcccaatattataa

SEQ ID NO: 4026911 - DNA, 16 bp, Homo sapiens
aaagaagcccccagct

SEQ ID NO: 4026912 - DNA, 18 bp, Homo sapiens
aaagaagttactttgtaa

SEQ ID NO: 4026913 - DNA, 20 bp, Homo sapiens
aaagaagttactttgtaatt

SEQ ID NO: 4026914 - DNA, 18 bp, Homo sapiens
aacactaactatgcatgg

SEQ ID NO: 4026915 - DNA, 15 bp, Homo sapiens
aacactaattcataa

SEQ ID NO: 4026916 - DNA, 16 bp, Homo sapiens
aacactaattcataat

SEQ ID NO: 4026917 - DNA, 16 bp, Homo sapiens
aacactatgtttattt

SEQ ID NO: 4026918 - DNA, 16 bp, Homo sapiens
aacactcttttgcttt

SEQ ID NO: 4026919 - DNA, 15 bp, Homo sapiens
aacactgaaaaatta

SEQ ID NO: 4026920 - DNA, 22 bp, Homo sapiens
aacactggtgtgacctgagggc

SEQ ID NO: 4026921 - DNA, 22 bp, Homo sapiens
aacacttaagggttttagaaaa

SEQ ID NO: 4026922 - DNA, 18 bp, Homo sapiens
aacagaaaaacagacaaa

SEQ ID NO: 4026923 - DNA, 13 bp, Homo sapiens
aacagaacagctt

SEQ ID NO: 4026924 - DNA, 16 bp, Homo sapiens
aacagaactaaatgtt

SEQ ID NO: 4026925 - DNA, 15 bp, Homo sapiens
aacagaacttttcct

SEQ ID NO: 4026926 - DNA, 14 bp, Homo sapiens
aacagaatgtttta

SEQ ID NO: 4026927 - DNA, 18 bp, Homo sapiens
aacagacaacagaagtca

SEQ ID NO: 4026928 - DNA, 19 bp, Homo sapiens
aacagaccccctctagaaa

SEQ ID NO: 4026929 - DNA, 19 bp, Homo sapiens
aacagagtggcctccctgc

SEQ ID NO: 4026930 - DNA, 19 bp, Homo sapiens
aacagataagcaagagaga

SEQ ID NO: 4026931 - DNA, 20 bp, Homo sapiens
aacagatataaatggctggt

SEQ ID NO: 4026932 - DNA, 13 bp, Homo sapiens
aacagatctggaa

SEQ ID NO: 4026933 - DNA, 21 bp, Homo sapiens
aacagatctggaacctcagcc

SEQ ID NO: 4026934 - DNA, 22 bp, Homo sapiens
aacagatctggaacctcagcct

SEQ ID NO: 4026935 - DNA, 19 bp, Homo sapiens
aacagatgacccctgccca

SEQ ID NO: 4026936 - DNA, 12 bp, Homo sapiens
aacgaagaaaaa

SEQ ID NO: 4026937 - DNA, 20 bp, Homo sapiens
aacgatgtgtctgtatttca

SEQ ID NO: 4026938 - DNA, 12 bp, Homo sapiens
aacgatttagaa

SEQ ID NO: 4026939 - DNA, 18 bp, Homo sapiens
aacgcaaagggctgaaag

SEQ ID NO: 4026940 - DNA, 11 bp, Homo sapiens
aacgcagccct

SEQ ID NO: 4026941 - DNA, 22 bp, Homo sapiens
aacgcagccctagagcctgcct

SEQ ID NO: 4026942 - DNA, 16 bp, Homo sapiens
aacgcagccctgcttt

SEQ ID NO: 4026943 - DNA, 17 bp, Homo sapiens
aacgccagtctcccagg

SEQ ID NO: 4026944 - DNA, 23 bp, Homo sapiens
aacgccagtctcccaggccccct

SEQ ID NO: 4026945 - DNA, 15 bp, Homo sapiens
aacgcccctccaaac

SEQ ID NO: 4026946 - DNA, 17 bp, Homo sapiens
aacgctaaagagccctt

SEQ ID NO: 4026947 - DNA, 14 bp, Homo sapiens
aacgctcctttgtg

SEQ ID NO: 4026948 - DNA, 16 bp, Homo sapiens
aacgctcctttgtgtg

SEQ ID NO: 4026949 - DNA, 17 bp, Homo sapiens
aacggaacgttggactt

SEQ ID NO: 4026950 - DNA, 17 bp, Homo sapiens
aacggccccagcttctc

SEQ ID NO: 4026951 - DNA, 13 bp, Homo sapiens
aacgggaggctgg

SEQ ID NO: 4026952 - DNA, 14 bp, Homo sapiens
aacgggaggctggg

SEQ ID NO: 4026953 - DNA, 18 bp, Homo sapiens
aacggtgcccatcctgcc

SEQ ID NO: 4026954 - DNA, 20 bp, Homo sapiens
aacggtgctgtgagggaggg

SEQ ID NO: 4026955 - DNA, 19 bp, Homo sapiens
aacgtgtgctgtgtttgct

SEQ ID NO: 4026956 - DNA, 13 bp, Homo sapiens
aacgttttattgt

SEQ ID NO: 4026957 - DNA, 14 bp, Homo sapiens
aactaaaagacatt

SEQ ID NO: 4026958 - DNA, 23 bp, Homo sapiens
aactaaactcttaccatatgttt

SEQ ID NO: 4026959 - DNA, 23 bp, Homo sapiens
aactaaataatgaataaactgaa

SEQ ID NO: 4026960 - DNA, 14 bp, Homo sapiens
aactaataaaagca

SEQ ID NO: 4026961 - DNA, 15 bp, Homo sapiens
aactaataaaagcat

SEQ ID NO: 4026962 - DNA, 22 bp, Homo sapiens
aactaatatgggcattgtagtt

SEQ ID NO: 4026963 - DNA, 20 bp, Homo sapiens
aactaatctattgggttcat

SEQ ID NO: 4026964 - DNA, 19 bp, Homo sapiens
aactaatttgaatgtggtt

SEQ ID NO: 4026965 - DNA, 15 bp, Homo sapiens
aactacatttatgag

SEQ ID NO: 4026966 - DNA, 16 bp, Homo sapiens
aactactctttgattt

SEQ ID NO: 4026967 - DNA, 14 bp, Homo sapiens
aactactgtgttcc

SEQ ID NO: 4026968 - DNA, 22 bp, Homo sapiens
aactacttctcttgttaggtaa

SEQ ID NO: 4026969 - DNA, 14 bp, Homo sapiens
aactagctgggact

SEQ ID NO: 4026970 - DNA, 18 bp, Homo sapiens
aactaggtaatgttttgt

SEQ ID NO: 4026971 - DNA, 23 bp, Homo sapiens
aactaggtaatgttttgtatata

SEQ ID NO: 4026972 - DNA, 18 bp, Homo sapiens
aactaggtttttgcttct

SEQ ID NO: 4026973 - DNA, 12 bp, Homo sapiens
aactataaatac

SEQ ID NO: 4026974 - DNA, 17 bp, Homo sapiens
aactataaatacaaatc

SEQ ID NO: 4026975 - DNA, 14 bp, Homo sapiens
aactatctgcatta

SEQ ID NO: 4026976 - DNA, 22 bp, Homo sapiens
aactatctgcattatctatgca

SEQ ID NO: 4026977 - DNA, 19 bp, Homo sapiens
aactatgacagatatattt

SEQ ID NO: 4026978 - DNA, 17 bp, Homo sapiens
aactatgcatggtgccc

SEQ ID NO: 4026979 - DNA, 22 bp, Homo sapiens
aactatgcatggtgccccagga

SEQ ID NO: 4026980 - DNA, 23 bp, Homo sapiens
aactatgcatggtgccccaggac

SEQ ID NO: 4026981 - DNA, 17 bp, Homo sapiens
aactatggttcccaata

SEQ ID NO: 4026982 - DNA, 20 bp, Homo sapiens
aactatggttcccaataaaa

SEQ ID NO: 4026983 - DNA, 17 bp, Homo sapiens
aactatttagtgttagt

SEQ ID NO: 4026984 - DNA, 20 bp, Homo sapiens
aactatttatctgtgttttt

SEQ ID NO: 4026985 - DNA, 22 bp, Homo sapiens
aactcaaatggggccagatcca

SEQ ID NO: 4026986 - DNA, 23 bp, Homo sapiens
aactcaccctgggagccagtcct

SEQ ID NO: 4026987 - DNA, 22 bp, Homo sapiens
aactcactcagtttatgctgtg

SEQ ID NO: 4026988 - DNA, 17 bp, Homo sapiens
aactcactctgggctgt

SEQ ID NO: 4026989 - DNA, 14 bp, Homo sapiens
aactcactttcctc

SEQ ID NO: 4026990 - DNA, 12 bp, Homo sapiens
aactcagatcca

SEQ ID NO: 4026991 - DNA, 15 bp, Homo sapiens
aactcagatccaggg

SEQ ID NO: 4026992 - DNA, 22 bp, Homo sapiens
aactcagatccagggacagagg

SEQ ID NO: 4026993 - DNA, 22 bp, Homo sapiens
aactcagtcattagactcctcc

SEQ ID NO: 4026994 - DNA, 23 bp, Homo sapiens
aactcagtcattagactcctcct

SEQ ID NO: 4026995 - DNA, 20 bp, Homo sapiens
aactcagtcctgtactctgg

SEQ ID NO: 4026996 - DNA, 15 bp, Homo sapiens
aactcagttttaact

SEQ ID NO: 4026997 - DNA, 16 bp, Homo sapiens
aactcatcataaaata

SEQ ID NO: 4026998 - DNA, 17 bp, Homo sapiens
aactcatcataaaataa

SEQ ID NO: 4026999 - DNA, 17 bp, Homo sapiens
aactcattttgcttgtg

SEQ ID NO: 4027000 - DNA, 17 bp, Homo sapiens
aactcatttttgccata

SEQ ID NO: 4027001 - DNA, 14 bp, Homo sapiens
aactccacatctgc

SEQ ID NO: 4027002 - DNA, 18 bp, Homo sapiens
aactccacatctgcctta

SEQ ID NO: 4027003 - DNA, 22 bp, Homo sapiens
aactccaccgaccaactgccct

SEQ ID NO: 4027004 - DNA, 23 bp, Homo sapiens
aactccaccgaccaactgcccta

SEQ ID NO: 4027005 - DNA, 21 bp, Homo sapiens
aactccaggaaagagcagtca

SEQ ID NO: 4027006 - DNA, 18 bp, Homo sapiens
aactcccaacttcttcct

SEQ ID NO: 4027007 - DNA, 13 bp, Homo sapiens
aactcctggcctt

SEQ ID NO: 4027008 - DNA, 14 bp, Homo sapiens
aactcctgtccctt

SEQ ID NO: 4027009 - DNA, 22 bp, Homo sapiens
aactcctgtcccttttccctta

SEQ ID NO: 4027010 - DNA, 13 bp, Homo sapiens
aactcctgtttct

SEQ ID NO: 4027011 - DNA, 24 bp, Homo sapiens
aactccttgttagcccttcagatt

SEQ ID NO: 4027012 - DNA, 21 bp, Homo sapiens
aactcctttagcaggtggtcc

SEQ ID NO: 4027013 - DNA, 16 bp, Homo sapiens
aactcgaatctgtgtg

SEQ ID NO: 4027014 - DNA, 17 bp, Homo sapiens
aactcgcacctgtgctg

SEQ ID NO: 4027015 - DNA, 19 bp, Homo sapiens
aactcgcacctgtgctgga

SEQ ID NO: 4027016 - DNA, 14 bp, Homo sapiens
aactctacccctgc

SEQ ID NO: 4027017 - DNA, 18 bp, Homo sapiens
aactctacccctgctccc

SEQ ID NO: 4027018 - DNA, 20 bp, Homo sapiens
aagtaagagtactgggagaa

SEQ ID NO: 4027019 - DNA, 23 bp, Homo sapiens
aagtaagagtactgggagaatca

SEQ ID NO: 4027020 - DNA, 15 bp, Homo sapiens
aagtaaggtgcagtt

SEQ ID NO: 4027021 - DNA, 18 bp, Homo sapiens
aagtaatcccgccaccta

SEQ ID NO: 4027022 - DNA, 22 bp, Homo sapiens
aagtaattatcgggaacagtgt

SEQ ID NO: 4027023 - DNA, 16 bp, Homo sapiens
aagtacacaataagca

SEQ ID NO: 4027024 - DNA, 18 bp, Homo sapiens
aagtacacaataagcaaa

SEQ ID NO: 4027025 - DNA, 19 bp, Homo sapiens
aagtacagcggctcccctc

SEQ ID NO: 4027026 - DNA, 13 bp, Homo sapiens
aagtacatattta

SEQ ID NO: 4027027 - DNA, 21 bp, Homo sapiens
aagtacatatttattttcttt

SEQ ID NO: 4027028 - DNA, 22 bp, Homo sapiens
aagtaccttgaactcttagtga

SEQ ID NO: 4027029 - DNA, 15 bp, Homo sapiens
aagtacgttattgtt

SEQ ID NO: 4027030 - DNA, 13 bp, Homo sapiens
aagtactatgtat

SEQ ID NO: 4027031 - DNA, 23 bp, Homo sapiens
aagtagaaaagttgcagatgtat

SEQ ID NO: 4027032 - DNA, 16 bp, Homo sapiens
aagtagaacaaaaaac

SEQ ID NO: 4027033 - DNA, 15 bp, Homo sapiens
aagtatacataagtt

SEQ ID NO: 4027034 - DNA, 11 bp, Homo sapiens
aagtatatata

SEQ ID NO: 4027035 - DNA, 16 bp, Homo sapiens
aagtatatatagaatc

SEQ ID NO: 4027036 - DNA, 23 bp, Homo sapiens
aagtatatcatgtaaagaaatgt

SEQ ID NO: 4027037 - DNA, 22 bp, Homo sapiens
aagtatatgtgaaaaaaatgag

SEQ ID NO: 4027038 - DNA, 16 bp, Homo sapiens
aagtatcactctaaaa

SEQ ID NO: 4027039 - DNA, 21 bp, Homo sapiens
aagtattcttatttaatgaaa

SEQ ID NO: 4027040 - DNA, 12 bp, Homo sapiens
aagtatttataa

SEQ ID NO: 4027041 - DNA, 17 bp, Homo sapiens
aagtatttatatattta

SEQ ID NO: 4027042 - DNA, 22 bp, Homo sapiens
aagtatttatatatttataact

SEQ ID NO: 4027043 - DNA, 11 bp, Homo sapiens
aagtatttctg

SEQ ID NO: 4027044 - DNA, 14 bp, Homo sapiens
aagtattttgaagt

SEQ ID NO: 4027045 - DNA, 19 bp, Homo sapiens
aagtattttgaagtttaca

SEQ ID NO: 4027046 - DNA, 20 bp, Homo sapiens
aagtattttgaagtttacat

SEQ ID NO: 4027047 - DNA, 21 bp, Homo sapiens
aagtattttgaagtttacatt

SEQ ID NO: 4027048 - DNA, 22 bp, Homo sapiens
aagtattttgaagtttacattt

SEQ ID NO: 4027049 - DNA, 18 bp, Homo sapiens
aagtattttgtgtttgga

SEQ ID NO: 4027050 - DNA, 19 bp, Homo sapiens
aagtatttttataaatata

SEQ ID NO: 4027051 - DNA, 14 bp, Homo sapiens
aagtattttttcaa

SEQ ID NO: 4027052 - DNA, 14 bp, Homo sapiens
aagtcaagaagaat

SEQ ID NO: 4027053 - DNA, 19 bp, Homo sapiens
aagtcacatcacaggacac

SEQ ID NO: 4027054 - DNA, 15 bp, Homo sapiens
aagtcacatgcgtaa

SEQ ID NO: 4027055 - DNA, 22 bp, Homo sapiens
aagtcacccctttctgtcccac

SEQ ID NO: 4027056 - DNA, 15 bp, Homo sapiens
aagtcaggtccaatt

SEQ ID NO: 4027057 - DNA, 16 bp, Homo sapiens
aagtcaggtccaattt

SEQ ID NO: 4027058 - DNA, 16 bp, Homo sapiens
aagtcagtatggtcta

SEQ ID NO: 4027059 - DNA, 20 bp, Homo sapiens
aagtcagtcacgtttccttt

SEQ ID NO: 4027060 - DNA, 23 bp, Homo sapiens
aagtcatgaagcccaagtgaaat

SEQ ID NO: 4027061 - DNA, 15 bp, Homo sapiens
aagtcatgctcccct

SEQ ID NO: 4027062 - DNA, 21 bp, Homo sapiens
aagtcatgctcccctgtgcca

SEQ ID NO: 4027063 - DNA, 15 bp, Homo sapiens
aagtccaataagaca

SEQ ID NO: 4027064 - DNA, 11 bp, Homo sapiens
aagtccctccc

SEQ ID NO: 4027065 - DNA, 13 bp, Homo sapiens
aagtccctccctg

SEQ ID NO: 4027066 - DNA, 18 bp, Homo sapiens
aagtcctgactgggctgg

SEQ ID NO: 4027067 - DNA, 14 bp, Homo sapiens
aagtctattcaaaa

SEQ ID NO: 4027068 - DNA, 21 bp, Homo sapiens
aagtctcacccattatctgga

SEQ ID NO: 4027069 - DNA, 12 bp, Homo sapiens
aagtctcctgtc

SEQ ID NO: 4027070 - DNA, 16 bp, Homo sapiens
aagtctctctgtgaat

SEQ ID NO: 4027071 - DNA, 23 bp, Homo sapiens
aagtctctctgtgaatacaatta

SEQ ID NO: 4027072 - DNA, 16 bp, Homo sapiens
aagtctctgctggccc

SEQ ID NO: 4027073 - DNA, 12 bp, Homo sapiens
aagtctgaatca

SEQ ID NO: 4027074 - DNA, 15 bp, Homo sapiens
aagtctgtctttcct

SEQ ID NO: 4027075 - DNA, 19 bp, Homo sapiens
aagtcttgggtctgaattt

SEQ ID NO: 4027076 - DNA, 22 bp, Homo sapiens
aagtcttttctgtcaccaaatt

SEQ ID NO: 4027077 - DNA, 18 bp, Homo sapiens
aagtgaaataacaaaatg

SEQ ID NO: 4027078 - DNA, 19 bp, Homo sapiens
aagtgaatgaaagattaaa

SEQ ID NO: 4027079 - DNA, 24 bp, Homo sapiens
aagtgacacagcagcttcaccaga

SEQ ID NO: 4027080 - DNA, 12 bp, Homo sapiens
aagtgactgttt

SEQ ID NO: 4027081 - DNA, 19 bp, Homo sapiens
aagtgactttaaaagaaaa

SEQ ID NO: 4027082 - DNA, 15 bp, Homo sapiens
aagtgagaaagaaag

SEQ ID NO: 4027083 - DNA, 20 bp, Homo sapiens
aagtgagcagtcgcctgcct

SEQ ID NO: 4027084 - DNA, 20 bp, Homo sapiens
aagtgagtggtgtgactctt

SEQ ID NO: 4027085 - DNA, 21 bp, Homo sapiens
aagtgatcaaactacatattg

SEQ ID NO: 4027086 - DNA, 22 bp, Homo sapiens
aagtgatcaataaaatgtgatt

SEQ ID NO: 4027087 - DNA, 16 bp, Homo sapiens
aagtgcactttctaat

SEQ ID NO: 4027088 - DNA, 21 bp, Homo sapiens
aagtgccactgcccgagctgg

SEQ ID NO: 4027089 - DNA, 18 bp, Homo sapiens
aagtgccccctcacctct

SEQ ID NO: 4027090 - DNA, 13 bp, Homo sapiens
aagtgccttctcc

SEQ ID NO: 4027091 - DNA, 21 bp, Homo sapiens
aagtgccttctccttccccag

SEQ ID NO: 4027092 - DNA, 23 bp, Homo sapiens
aagtgccttctccttccccagga

SEQ ID NO: 4027093 - DNA, 19 bp, Homo sapiens
aagtgccttttgctgcgca

SEQ ID NO: 4027094 - DNA, 20 bp, Homo sapiens
aagtgccttttgctgcgcac

SEQ ID NO: 4027095 - DNA, 20 bp, Homo sapiens
aagtgcgtgccgtgtgagtg

SEQ ID NO: 4027096 - DNA, 18 bp, Homo sapiens
aagtgcgtggtataatct

SEQ ID NO: 4027097 - DNA, 15 bp, Homo sapiens
aagtgcgtgtgtaga

SEQ ID NO: 4027098 - DNA, 22 bp, Homo sapiens
aagtgcgtgtgtagagttaaga

SEQ ID NO: 4027099 - DNA, 23 bp, Homo sapiens
aagtgcgtgtgtagagttaagaa

SEQ ID NO: 4027100 - DNA, 19 bp, Homo sapiens
aagtgctcttggctgaccc

SEQ ID NO: 4027101 - DNA, 20 bp, Homo sapiens
aagtgctcttggctgacccc

SEQ ID NO: 4027102 - DNA, 21 bp, Homo sapiens
aagtgctgagattgcagatgt

SEQ ID NO: 4027103 - DNA, 23 bp, Homo sapiens
aagtgctggcaaccactaagaat

SEQ ID NO: 4027104 - DNA, 13 bp, Homo sapiens
aagtgctgggatt

SEQ ID NO: 4027105 - DNA, 17 bp, Homo sapiens
aagtgcttgctttttgc

SEQ ID NO: 4027106 - DNA, 18 bp, Homo sapiens
aagtgcttgctttttgcc

SEQ ID NO: 4027107 - DNA, 14 bp, Homo sapiens
aagtggactggagg

SEQ ID NO: 4027108 - DNA, 13 bp, Homo sapiens
aagtggatgggaa

SEQ ID NO: 4027109 - DNA, 19 bp, Homo sapiens
aagtggatgggaatttgtc

SEQ ID NO: 4027110 - DNA, 21 bp, Homo sapiens
aagtggatgggaatttgtcag

SEQ ID NO: 4027111 - DNA, 13 bp, Homo sapiens
aagtggcaaagct

SEQ ID NO: 4027112 - DNA, 22 bp, Homo sapiens
aagtggcaaagctgttcttcct

SEQ ID NO: 4027113 - DNA, 16 bp, Homo sapiens
aagcatagatgttttg

SEQ ID NO: 4027114 - DNA, 17 bp, Homo sapiens
aagcatagatgttttgg

SEQ ID NO: 4027115 - DNA, 20 bp, Homo sapiens
aagcatccatgtgtggactc

SEQ ID NO: 4027116 - DNA, 21 bp, Homo sapiens
aagcatccatgtgtggactca

SEQ ID NO: 4027117 - DNA, 13 bp, Homo sapiens
aagcatgaaaaag

SEQ ID NO: 4027118 - DNA, 20 bp, Homo sapiens
aagctgagaagaatgaaaat

SEQ ID NO: 4027119 - DNA, 17 bp, Homo sapiens
aagctgaggcgggagaa

SEQ ID NO: 4027120 - DNA, 22 bp, Homo sapiens
aagctgatcataagtgaattta

SEQ ID NO: 4027121 - DNA, 13 bp, Homo sapiens
aagctgatcctgc

SEQ ID NO: 4027122 - DNA, 19 bp, Homo sapiens
aagctgattactgtcaata

SEQ ID NO: 4027123 - DNA, 15 bp, Homo sapiens
aagctgccagcccag

SEQ ID NO: 4027124 - DNA, 18 bp, Homo sapiens
aagctgccagcccagaac

SEQ ID NO: 4027125 - DNA, 20 bp, Homo sapiens
aagctgccagcccagaacac

SEQ ID NO: 4027126 - DNA, 21 bp, Homo sapiens
aagctgccatttcccttctgg

SEQ ID NO: 4027127 - DNA, 15 bp, Homo sapiens
aagctgcctctgggc

SEQ ID NO: 4027128 - DNA, 17 bp, Homo sapiens
aagctgctccaggcctg

SEQ ID NO: 4027129 - DNA, 19 bp, Homo sapiens
aagctgctctgagccacag

SEQ ID NO: 4027130 - DNA, 21 bp, Homo sapiens
aagctgcttgcccaagtcaca

SEQ ID NO: 4027131 - DNA, 11 bp, Homo sapiens
aagctggaagc

SEQ ID NO: 4027132 - DNA, 19 bp, Homo sapiens
aagctggacttctgtgggc

SEQ ID NO: 4027133 - DNA, 19 bp, Homo sapiens
aagctggcagaacggagga

SEQ ID NO: 4027134 - DNA, 11 bp, Homo sapiens
aagctggccct

SEQ ID NO: 4027135 - DNA, 12 bp, Homo sapiens
aagctggccctg

SEQ ID NO: 4027136 - DNA, 14 bp, Homo sapiens
aagctggccctgcc

SEQ ID NO: 4027137 - DNA, 17 bp, Homo sapiens
aagctggccctgcctcc

SEQ ID NO: 4027138 - DNA, 21 bp, Homo sapiens
aagctggccctgcctcctggg

SEQ ID NO: 4027139 - DNA, 21 bp, Homo sapiens
aagctggccgagggtcctggc

SEQ ID NO: 4027140 - DNA, 14 bp, Homo sapiens
aagctggcctgaga

SEQ ID NO: 4027141 - DNA, 21 bp, Homo sapiens
aagctggctttgaaacctcag

SEQ ID NO: 4027142 - DNA, 14 bp, Homo sapiens
aagctgtggaatga

SEQ ID NO: 4027143 - DNA, 13 bp, Homo sapiens
aagctgtggccag

SEQ ID NO: 4027144 - DNA, 16 bp, Homo sapiens
aagctgttatttcttc

SEQ ID NO: 4027145 - DNA, 17 bp, Homo sapiens
aagctgttatttcttcc

SEQ ID NO: 4027146 - DNA, 21 bp, Homo sapiens
aagctgttatttcttccctgc

SEQ ID NO: 4027147 - DNA, 15 bp, Homo sapiens
aagctgttcttcctg

SEQ ID NO: 4027148 - DNA, 16 bp, Homo sapiens
aagctgttcttcctgg

SEQ ID NO: 4027149 - DNA, 14 bp, Homo sapiens
aagctgttgtacat

SEQ ID NO: 4027150 - DNA, 21 bp, Homo sapiens
aagctgttgtacatttatgat

SEQ ID NO: 4027151 - DNA, 16 bp, Homo sapiens
aagcttaataaaaaca

SEQ ID NO: 4027152 - DNA, 17 bp, Homo sapiens
aagcttccctccctgct

SEQ ID NO: 4027153 - DNA, 15 bp, Homo sapiens
aagcttctaaatggt

SEQ ID NO: 4027154 - DNA, 14 bp, Homo sapiens
aagcttcttgctga

SEQ ID NO: 4027155 - DNA, 18 bp, Homo sapiens
aagcttgactcccaagtt

SEQ ID NO: 4027156 - DNA, 21 bp, Homo sapiens
aagctttattaccagtggcgt

SEQ ID NO: 4027157 - DNA, 23 bp, Homo sapiens
aagctttcttctacaaccagagc

SEQ ID NO: 4027158 - DNA, 14 bp, Homo sapiens
aagcttttagaaat

SEQ ID NO: 4027159 - DNA, 23 bp, Homo sapiens
aagcttttgcttgatccagaaga

SEQ ID NO: 4027160 - DNA, 15 bp, Homo sapiens
aaggaaaaaatgttg

SEQ ID NO: 4027161 - DNA, 17 bp, Homo sapiens
aaggaaaaataatcaag

SEQ ID NO: 4027162 - DNA, 17 bp, Homo sapiens
aaggaaaatagtaatgt

SEQ ID NO: 4027163 - DNA, 22 bp, Homo sapiens
aaggaaaccaagtggtcaggag

SEQ ID NO: 4027164 - DNA, 16 bp, Homo sapiens
aaggaaactcttatct

SEQ ID NO: 4027165 - DNA, 19 bp, Homo sapiens
aaggaaactcttatctcag

SEQ ID NO: 4027166 - DNA, 15 bp, Homo sapiens
aaggaaagaaaacat

SEQ ID NO: 4027167 - DNA, 13 bp, Homo sapiens
aaggaaagcaata

SEQ ID NO: 4027168 - DNA, 19 bp, Homo sapiens
aaggaaaggtctcagcttg

SEQ ID NO: 4027169 - DNA, 21 bp, Homo sapiens
aaggaaccttccttcctgctt

SEQ ID NO: 4027170 - DNA, 14 bp, Homo sapiens
aaggaagagggctg

SEQ ID NO: 4027171 - DNA, 18 bp, Homo sapiens
aaggaagatatacatgaa

SEQ ID NO: 4027172 - DNA, 16 bp, Homo sapiens
aaggaagccaaattta

SEQ ID NO: 4027173 - DNA, 19 bp, Homo sapiens
aaggaagccaaatttatca

SEQ ID NO: 4027174 - DNA, 23 bp, Homo sapiens
aaggaagccttgctcattcttga

SEQ ID NO: 4027175 - DNA, 19 bp, Homo sapiens
aaggaagtggggtgttctt

SEQ ID NO: 4027176 - DNA, 16 bp, Homo sapiens
aaggaatcattccagt

SEQ ID NO: 4027177 - DNA, 20 bp, Homo sapiens
aaggaatcattccagtgcta

SEQ ID NO: 4027178 - DNA, 17 bp, Homo sapiens
aaggaatctccagtttt

SEQ ID NO: 4027179 - DNA, 19 bp, Homo sapiens
aaggaatgcctgtgccaat

SEQ ID NO: 4027180 - DNA, 19 bp, Homo sapiens
aaggaattttgctaagtaa

SEQ ID NO: 4027181 - DNA, 14 bp, Homo sapiens
aaggacacactaat

SEQ ID NO: 4027182 - DNA, 20 bp, Homo sapiens
aaggacaggaggaggagatg

SEQ ID NO: 4027183 - DNA, 14 bp, Homo sapiens
aaggacatcagcaa

SEQ ID NO: 4027184 - DNA, 15 bp, Homo sapiens
aaggacatcagcaaa

SEQ ID NO: 4027185 - DNA, 16 bp, Homo sapiens
aaggacattgccccaa

SEQ ID NO: 4027186 - DNA, 20 bp, Homo sapiens
aaggacattgccccaagata

SEQ ID NO: 4027187 - DNA, 23 bp, Homo sapiens
aaggaccacattttatatttatt

SEQ ID NO: 4027188 - DNA, 18 bp, Homo sapiens
aaggacccggaggggcct

SEQ ID NO: 4027189 - DNA, 21 bp, Homo sapiens
aaggacccggaggggcctggc

SEQ ID NO: 4027190 - DNA, 21 bp, Homo sapiens
aaggacggccttcaactgaaa

SEQ ID NO: 4027191 - DNA, 23 bp, Homo sapiens
aaggactctggtttctcattctt

SEQ ID NO: 4027192 - DNA, 23 bp, Homo sapiens
aaggactgcgggacttgggtctc

SEQ ID NO: 4027193 - DNA, 17 bp, Homo sapiens
aaggactggattggcca

SEQ ID NO: 4027194 - DNA, 14 bp, Homo sapiens
aaggactgtaatct

SEQ ID NO: 4027195 - DNA, 17 bp, Homo sapiens
aaggacttcctgtccag

SEQ ID NO: 4027196 - DNA, 21 bp, Homo sapiens
aaggacttcctgtccagctcc

SEQ ID NO: 4027197 - DNA, 23 bp, Homo sapiens
aaggacttcctgtccagctccaa

SEQ ID NO: 4027198 - DNA, 16 bp, Homo sapiens
aaggacttctgcagct

SEQ ID NO: 4027199 - DNA, 20 bp, Homo sapiens
aaggagaggcaacatccaaa

SEQ ID NO: 4027200 - DNA, 13 bp, Homo sapiens
aaggagcacaagc

SEQ ID NO: 4027201 - DNA, 20 bp, Homo sapiens
aaggagccttttgctctctg

SEQ ID NO: 4027202 - DNA, 14 bp, Homo sapiens
aaggaggctggcag

SEQ ID NO: 4027203 - DNA, 19 bp, Homo sapiens
aaggaggtgagggatgtga

SEQ ID NO: 4027204 - DNA, 20 bp, Homo sapiens
aaggataatgaaataatcag

SEQ ID NO: 4027205 - DNA, 19 bp, Homo sapiens
aaggatagatgctggccca

SEQ ID NO: 4027206 - DNA, 18 bp, Homo sapiens
aaggatatttaagaaaat

SEQ ID NO: 4027207 - DNA, 22 bp, Homo sapiens
aaggatcagaacagcagaggtt

SEQ ID NO: 4027208 - DNA, 20 bp, Homo sapiens
aaggatcctctccactccat

SEQ ID NO: 4027209 - DNA, 18 bp, Homo sapiens
aaggatcggactctgccc

SEQ ID NO: 4027210 - DNA, 22 bp, Homo sapiens
aaggatctctcaggagcacagg

SEQ ID NO: 4027211 - DNA, 14 bp, Homo sapiens
aaggatgtcacagg

SEQ ID NO: 4027212 - DNA, 19 bp, Homo sapiens
aaggatgttttgtcccatt

SEQ ID NO: 4027213 - DNA, 21 bp, Homo sapiens
aaggattgtaaaaaaaaatgc

SEQ ID NO: 4027214 - DNA, 14 bp, Homo sapiens
aaggcaaaaatgta

SEQ ID NO: 4027215 - DNA, 12 bp, Homo sapiens
aaggcaaaattg

SEQ ID NO: 4027216 - DNA, 19 bp, Homo sapiens
aaggcaaaattgcaaatct

SEQ ID NO: 4027217 - DNA, 20 bp, Homo sapiens
aaggcaaagcacgaaatgtt

SEQ ID NO: 4027218 - DNA, 15 bp, Homo sapiens
aaggcaagttaagag

SEQ ID NO: 4027219 - DNA, 11 bp, Homo sapiens
aaggcagccac

SEQ ID NO: 4027220 - DNA, 18 bp, Homo sapiens
aagacaccgttcattcag

SEQ ID NO: 4027221 - DNA, 11 bp, Homo sapiens
aagacagaaaa

SEQ ID NO: 4027222 - DNA, 16 bp, Homo sapiens
aagacagaaaagtgcc

SEQ ID NO: 4027223 - DNA, 19 bp, Homo sapiens
aagacagaaaagtgcctga

SEQ ID NO: 4027224 - DNA, 13 bp, Homo sapiens
aagacagaatggt

SEQ ID NO: 4027225 - DNA, 16 bp, Homo sapiens
aagacagagacgcagg

SEQ ID NO: 4027226 - DNA, 19 bp, Homo sapiens
aagacataacgtttttcct

SEQ ID NO: 4027227 - DNA, 15 bp, Homo sapiens
aagacatatctctaa

SEQ ID NO: 4027228 - DNA, 16 bp, Homo sapiens
aagacatatctctaat

SEQ ID NO: 4027229 - DNA, 13 bp, Homo sapiens
aagacatgaacca

SEQ ID NO: 4027230 - DNA, 18 bp, Homo sapiens
aagacatgaatgcacact

SEQ ID NO: 4027231 - DNA, 23 bp, Homo sapiens
aagatcaaaaggttaataaagta

SEQ ID NO: 4027232 - DNA, 21 bp, Homo sapiens
aagatcaaaataaaaagtgac

SEQ ID NO: 4027233 - DNA, 19 bp, Homo sapiens
aagatccatttgcctttct

SEQ ID NO: 4027234 - DNA, 15 bp, Homo sapiens
aagatcccctcagga

SEQ ID NO: 4027235 - DNA, 20 bp, Homo sapiens
aagatcgcgccactgcactc

SEQ ID NO: 4027236 - DNA, 20 bp, Homo sapiens
aagatctgtcctcagccttg

SEQ ID NO: 4027237 - DNA, 21 bp, Homo sapiens
aagatctgttttgaaggcaaa

SEQ ID NO: 4027238 - DNA, 12 bp, Homo sapiens
aagatgaaataa

SEQ ID NO: 4027239 - DNA, 23 bp, Homo sapiens
aagatgaaggagaggcaacatcc

SEQ ID NO: 4027240 - DNA, 14 bp, Homo sapiens
aagatgaagtttta

SEQ ID NO: 4027241 - DNA, 13 bp, Homo sapiens
aagatgatcattt

SEQ ID NO: 4027242 - DNA, 18 bp, Homo sapiens
aagatgatctactcagaa

SEQ ID NO: 4027243 - DNA, 20 bp, Homo sapiens
aagatgcaaggaccaggact

SEQ ID NO: 4027244 - DNA, 20 bp, Homo sapiens
aagatggaatttatcaaacc

SEQ ID NO: 4027245 - DNA, 20 bp, Homo sapiens
aagatggtgtgggtgtcctg

SEQ ID NO: 4027246 - DNA, 17 bp, Homo sapiens
aagatggtttcaattca

SEQ ID NO: 4027247 - DNA, 20 bp, Homo sapiens
aagatgtgaattattgacac

SEQ ID NO: 4027248 - DNA, 21 bp, Homo sapiens
aagatgtgaattattgacact

SEQ ID NO: 4027249 - DNA, 21 bp, Homo sapiens
aagatgttgaagaatacagtt

SEQ ID NO: 4027250 - DNA, 23 bp, Homo sapiens
aagattcctcgttattgttgttg

SEQ ID NO: 4027251 - DNA, 17 bp, Homo sapiens
aagattgatgtttcctt

SEQ ID NO: 4027252 - DNA, 18 bp, Homo sapiens
aagattgccccatctaga

SEQ ID NO: 4027253 - DNA, 12 bp, Homo sapiens
aagatttaagca

SEQ ID NO: 4027254 - DNA, 23 bp, Homo sapiens
aagatttgatgctggagaggtta

SEQ ID NO: 4027255 - DNA, 15 bp, Homo sapiens
aagattttattgtat

SEQ ID NO: 4027256 - DNA, 16 bp, Homo sapiens
aagattttcctcttgt

SEQ ID NO: 4027257 - DNA, 20 bp, Homo sapiens
aagattttgttttgttggac

SEQ ID NO: 4027258 - DNA, 12 bp, Homo sapiens
aagcaaaaggca

SEQ ID NO: 4027259 - DNA, 13 bp, Homo sapiens
aagcaaagaaaat

SEQ ID NO: 4027260 - DNA, 17 bp, Homo sapiens
aagcaaagcaccagctt

SEQ ID NO: 4027261 - DNA, 18 bp, Homo sapiens
aagcaaaggggacagctg

SEQ ID NO: 4027262 - DNA, 13 bp, Homo sapiens
aagcaaataaata

SEQ ID NO: 4027263 - DNA, 16 bp, Homo sapiens
aagcaaataaatatca

SEQ ID NO: 4027264 - DNA, 17 bp, Homo sapiens
aagcaaatgcattctat

SEQ ID NO: 4027265 - DNA, 16 bp, Homo sapiens
aagcaaatgttgggaa

SEQ ID NO: 4027266 - DNA, 20 bp, Homo sapiens
aagcaacgataaaattacaa

SEQ ID NO: 4027267 - DNA, 18 bp, Homo sapiens
aagcaagagagatgtttt

SEQ ID NO: 4027268 - DNA, 20 bp, Homo sapiens
aagcaaggaagatatacatg

SEQ ID NO: 4027269 - DNA, 17 bp, Homo sapiens
aagcaagggagaaaaga

SEQ ID NO: 4027270 - DNA, 21 bp, Homo sapiens
aagcaagggagaaaagagaaa

SEQ ID NO: 4027271 - DNA, 19 bp, Homo sapiens
aagcaagtaaaaaggctaa

SEQ ID NO: 4027272 - DNA, 20 bp, Homo sapiens
aagcaagtaaaaaggctaaa

SEQ ID NO: 4027273 - DNA, 19 bp, Homo sapiens
aagcaagtagctttccaca

SEQ ID NO: 4027274 - DNA, 16 bp, Homo sapiens
aagcaatccacctgcc

SEQ ID NO: 4027275 - DNA, 18 bp, Homo sapiens
aagcaatccacctgcctt

SEQ ID NO: 4027276 - DNA, 15 bp, Homo sapiens
aagcaatcctcctgc

SEQ ID NO: 4027277 - DNA, 20 bp, Homo sapiens
aagcaatcctcctgcctcag

SEQ ID NO: 4027278 - DNA, 15 bp, Homo sapiens
aagcacaaactttag

SEQ ID NO: 4027279 - DNA, 17 bp, Homo sapiens
aagcacaccacaattct

SEQ ID NO: 4027280 - DNA, 16 bp, Homo sapiens
aagcacagaatatttt

SEQ ID NO: 4027281 - DNA, 19 bp, Homo sapiens
aagcacagagcctggcccc

SEQ ID NO: 4027282 - DNA, 14 bp, Homo sapiens
aagcacatacatta

SEQ ID NO: 4027283 - DNA, 21 bp, Homo sapiens
aagcacatacattaaaactag

SEQ ID NO: 4027284 - DNA, 16 bp, Homo sapiens
aagcacatctgcattt

SEQ ID NO: 4027285 - DNA, 16 bp, Homo sapiens
aagcacatgtttattt

SEQ ID NO: 4027286 - DNA, 19 bp, Homo sapiens
aagcaccagcttctccagg

SEQ ID NO: 4027287 - DNA, 20 bp, Homo sapiens
aagcaccagcttctccaggc

SEQ ID NO: 4027288 - DNA, 23 bp, Homo sapiens
aagcactacaccttgccttgctg

SEQ ID NO: 4027289 - DNA, 19 bp, Homo sapiens
aagcactctggatgatgga

SEQ ID NO: 4027290 - DNA, 19 bp, Homo sapiens
aagcactgctaggcgagtg

SEQ ID NO: 4027291 - DNA, 23 bp, Homo sapiens
aagcactgctaggcgagtgccag

SEQ ID NO: 4027292 - DNA, 14 bp, Homo sapiens
aagcactttaagct

SEQ ID NO: 4027293 - DNA, 18 bp, Homo sapiens
aagcactttgggattctt

SEQ ID NO: 4027294 - DNA, 13 bp, Homo sapiens
aagcacttttgtt

SEQ ID NO: 4027295 - DNA, 20 bp, Homo sapiens
aagcacttttgttattccat

SEQ ID NO: 4027296 - DNA, 22 bp, Homo sapiens
aagcacttttgttattccatca

SEQ ID NO: 4027297 - DNA, 18 bp, Homo sapiens
aagcactttttggctgac

SEQ ID NO: 4027298 - DNA, 22 bp, Homo sapiens
aagcagaaatcctgcaatgaaa

SEQ ID NO: 4027299 - DNA, 16 bp, Homo sapiens
aagcagaattttaatg

SEQ ID NO: 4027300 - DNA, 12 bp, Homo sapiens
aagcagacagct

SEQ ID NO: 4027301 - DNA, 20 bp, Homo sapiens
aagcagagtgcacagctgtc

SEQ ID NO: 4027302 - DNA, 17 bp, Homo sapiens
aagcagatggaatgctg

SEQ ID NO: 4027303 - DNA, 19 bp, Homo sapiens
aagcagatggaatgctgtg

SEQ ID NO: 4027304 - DNA, 12 bp, Homo sapiens
aagcagccagct

SEQ ID NO: 4027305 - DNA, 21 bp, Homo sapiens
aagcagccagctccccacacc

SEQ ID NO: 4027306 - DNA, 16 bp, Homo sapiens
aagcagctaaattttc

SEQ ID NO: 4027307 - DNA, 20 bp, Homo sapiens
aagcagctaacaatgtctgg

SEQ ID NO: 4027308 - DNA, 16 bp, Homo sapiens
aagcagctttaaacaa

SEQ ID NO: 4027309 - DNA, 17 bp, Homo sapiens
aagcagctttaaacaaa

SEQ ID NO: 4027310 - DNA, 14 bp, Homo sapiens
aagcaggaattatg

SEQ ID NO: 4027311 - DNA, 23 bp, Homo sapiens
aagcaggactttgaggcaagtgt

SEQ ID NO: 4027312 - DNA, 18 bp, Homo sapiens
aagcaggagacgacaggc

SEQ ID NO: 4027313 - DNA, 16 bp, Homo sapiens
aagcagggaatttcta

SEQ ID NO: 4027314 - DNA, 22 bp, Homo sapiens
aagcaggggtggggggtgcagg

SEQ ID NO: 4027315 - DNA, 18 bp, Homo sapiens
aagcagggtaccctttgg

SEQ ID NO: 4027316 - DNA, 19 bp, Homo sapiens
aagcaggttcccaagctca

SEQ ID NO: 4027317 - DNA, 17 bp, Homo sapiens
aagcagtaaatttgcta

SEQ ID NO: 4027318 - DNA, 20 bp, Homo sapiens
aagcagtagaaataatatgc

SEQ ID NO: 4027319 - DNA, 22 bp, Homo sapiens
aagcagtagaaataatatgcat

SEQ ID NO: 4027320 - DNA, 17 bp, Homo sapiens
aagcagtgccttccata

SEQ ID NO: 4027321 - DNA, 18 bp, Homo sapiens
aagcagtggagcccagga

SEQ ID NO: 4027322 - DNA, 15 bp, Homo sapiens
aagcataaaaacatt

SEQ ID NO: 4027323 - DNA, 14 bp, Homo sapiens
aagcataaatcact

SEQ ID NO: 4027324 - DNA, 22 bp, Homo sapiens
aagcatacatgcaaaaagaaat

SEQ ID NO: 4027325 - DNA, 23 bp, Homo sapiens
aactttattaaatacaaaacttc

SEQ ID NO: 4027326 - DNA, 14 bp, Homo sapiens
aactttcagaggca

SEQ ID NO: 4027327 - DNA, 22 bp, Homo sapiens
aactttggagagtgagctacag

SEQ ID NO: 4027328 - DNA, 19 bp, Homo sapiens
aacttttctaacagaaagc

SEQ ID NO: 4027329 - DNA, 18 bp, Homo sapiens
aacttttttttctctctt

SEQ ID NO: 4027330 - DNA, 16 bp, Homo sapiens
aagaaaaaaaaaatat

SEQ ID NO: 4027331 - DNA, 17 bp, Homo sapiens
aagaaaaaaaagaaagc

SEQ ID NO: 4027332 - DNA, 15 bp, Homo sapiens
aagaaaaaaatcttc

SEQ ID NO: 4027333 - DNA, 23 bp, Homo sapiens
aagaaaaaaccgtgtttgtctct

SEQ ID NO: 4027334 - DNA, 14 bp, Homo sapiens
aagaaaaaatcaga

SEQ ID NO: 4027335 - DNA, 17 bp, Homo sapiens
aagaaaacatctttaag

SEQ ID NO: 4027336 - DNA, 23 bp, Homo sapiens
aagaaaagagatattttaaaatg

SEQ ID NO: 4027337 - DNA, 22 bp, Homo sapiens
aagaaaagattttaatcaagtt

SEQ ID NO: 4027338 - DNA, 15 bp, Homo sapiens
aagaaaaggacaaat

SEQ ID NO: 4027339 - DNA, 16 bp, Homo sapiens
aagaaaagtattttga

SEQ ID NO: 4027340 - DNA, 18 bp, Homo sapiens
aagaaaatacaataaact

SEQ ID NO: 4027341 - DNA, 23 bp, Homo sapiens
aagaaaatcagatggagcatgaa

SEQ ID NO: 4027342 - DNA, 16 bp, Homo sapiens
aagaaaatgaagggat

SEQ ID NO: 4027343 - DNA, 19 bp, Homo sapiens
aagaaaatttttgtagtag

SEQ ID NO: 4027344 - DNA, 22 bp, Homo sapiens
aagaaaatttttgtagtagcgt

SEQ ID NO: 4027345 - DNA, 15 bp, Homo sapiens
aagaaaccttgctct

SEQ ID NO: 4027346 - DNA, 17 bp, Homo sapiens
aagaaacttgtccttcc

SEQ ID NO: 4027347 - DNA, 13 bp, Homo sapiens
aagaaagactcta

SEQ ID NO: 4027348 - DNA, 23 bp, Homo sapiens
aagaaagagcaacaatccatctc

SEQ ID NO: 4027349 - DNA, 16 bp, Homo sapiens
aagaaagcatagacat

SEQ ID NO: 4027350 - DNA, 16 bp, Homo sapiens
aagaaagtcagccata

SEQ ID NO: 4027351 - DNA, 20 bp, Homo sapiens
aagaaagtgttttattttca

SEQ ID NO: 4027352 - DNA, 13 bp, Homo sapiens
aagaaataaatca

SEQ ID NO: 4027353 - DNA, 19 bp, Homo sapiens
aagaaataatccctgtaat

SEQ ID NO: 4027354 - DNA, 11 bp, Homo sapiens
aagaaatatgt

SEQ ID NO: 4027355 - DNA, 18 bp, Homo sapiens
aagaaatatgtgagattt

SEQ ID NO: 4027356 - DNA, 19 bp, Homo sapiens
aagaaatatgtgagatttt

SEQ ID NO: 4027357 - DNA, 20 bp, Homo sapiens
aagaaatatgtgagattttt

SEQ ID NO: 4027358 - DNA, 23 bp, Homo sapiens
aagaaatcatgtccatacacttt

SEQ ID NO: 4027359 - DNA, 18 bp, Homo sapiens
aagaaatgaacaaaagat

SEQ ID NO: 4027360 - DNA, 13 bp, Homo sapiens
aagaaatgtctta

SEQ ID NO: 4027361 - DNA, 12 bp, Homo sapiens
aagaacaaacac

SEQ ID NO: 4027362 - DNA, 21 bp, Homo sapiens
aagaacacaaagcggggggag

SEQ ID NO: 4027363 - DNA, 19 bp, Homo sapiens
aagaacaccctatattttg

SEQ ID NO: 4027364 - DNA, 11 bp, Homo sapiens
aagaacatgtg

SEQ ID NO: 4027365 - DNA, 23 bp, Homo sapiens
aagaactgcatggacctaacatt

SEQ ID NO: 4027366 - DNA, 20 bp, Homo sapiens
aagaactgtgtttcaagttc

SEQ ID NO: 4027367 - DNA, 15 bp, Homo sapiens
aagaacttactgatt

SEQ ID NO: 4027368 - DNA, 20 bp, Homo sapiens
aagaacttactgattatttt

SEQ ID NO: 4027369 - DNA, 12 bp, Homo sapiens
aagaacttcatt

SEQ ID NO: 4027370 - DNA, 17 bp, Homo sapiens
aagaacttgatttgcat

SEQ ID NO: 4027371 - DNA, 18 bp, Homo sapiens
aagaacttgatttgcatg

SEQ ID NO: 4027372 - DNA, 15 bp, Homo sapiens
aagaacttgcatgga

SEQ ID NO: 4027373 - DNA, 16 bp, Homo sapiens
aagaagagaagctgct

SEQ ID NO: 4027374 - DNA, 18 bp, Homo sapiens
aagaagagaagctgctga

SEQ ID NO: 4027375 - DNA, 11 bp, Homo sapiens
aagaagagaca

SEQ ID NO: 4027376 - DNA, 16 bp, Homo sapiens
aagaagctgttgtaca

SEQ ID NO: 4027377 - DNA, 17 bp, Homo sapiens
aagaagctgttgtacat

SEQ ID NO: 4027378 - DNA, 16 bp, Homo sapiens
aagaaggcaaaaatgt

SEQ ID NO: 4027379 - DNA, 14 bp, Homo sapiens
aagaaggcaatatt

SEQ ID NO: 4027380 - DNA, 16 bp, Homo sapiens
aagaagggctggtatt

SEQ ID NO: 4027381 - DNA, 20 bp, Homo sapiens
aagaaggtggaccttttaaa

SEQ ID NO: 4027382 - DNA, 14 bp, Homo sapiens
aagaagttactttg

SEQ ID NO: 4027383 - DNA, 15 bp, Homo sapiens
aagaagttactttgt

SEQ ID NO: 4027384 - DNA, 16 bp, Homo sapiens
aagaagttactttgta

SEQ ID NO: 4027385 - DNA, 12 bp, Homo sapiens
aagaataaagtc

SEQ ID NO: 4027386 - DNA, 19 bp, Homo sapiens
aagaataggcattaacaca

SEQ ID NO: 4027387 - DNA, 19 bp, Homo sapiens
aagaatatctgtaatggta

SEQ ID NO: 4027388 - DNA, 20 bp, Homo sapiens
aagaatatctgtaatggtac

SEQ ID NO: 4027389 - DNA, 17 bp, Homo sapiens
aagaatatttaagaaaa

SEQ ID NO: 4027390 - DNA, 20 bp, Homo sapiens
aagaatatttaagaaaagca

SEQ ID NO: 4027391 - DNA, 21 bp, Homo sapiens
aagaatatttaagaaaagcac

SEQ ID NO: 4027392 - DNA, 23 bp, Homo sapiens
aagaatatttaagaaaagcactt

SEQ ID NO: 4027393 - DNA, 23 bp, Homo sapiens
aagaatctaaaccttacatgtgt

SEQ ID NO: 4027394 - DNA, 18 bp, Homo sapiens
aagaatcttaatgcttgt

SEQ ID NO: 4027395 - DNA, 16 bp, Homo sapiens
aagaatgactatataa

SEQ ID NO: 4027396 - DNA, 17 bp, Homo sapiens
aagaatgcacaagaatg

SEQ ID NO: 4027397 - DNA, 22 bp, Homo sapiens
aagaatgcacaagaatggatca

SEQ ID NO: 4027398 - DNA, 15 bp, Homo sapiens
aagaatgccatttct

SEQ ID NO: 4027399 - DNA, 22 bp, Homo sapiens
aagaatgctggttttcctaaat

SEQ ID NO: 4027400 - DNA, 18 bp, Homo sapiens
aagaattaagatacaaat

SEQ ID NO: 4027401 - DNA, 23 bp, Homo sapiens
aagaattatttgccttctgaaat

SEQ ID NO: 4027402 - DNA, 15 bp, Homo sapiens
aagaattatttttgt

SEQ ID NO: 4027403 - DNA, 15 bp, Homo sapiens
aagaattgaccttga

SEQ ID NO: 4027404 - DNA, 15 bp, Homo sapiens
aagaattgagtaatg

SEQ ID NO: 4027405 - DNA, 17 bp, Homo sapiens
aagaattgagtaatggt

SEQ ID NO: 4027406 - DNA, 15 bp, Homo sapiens
aagaattgccaatct

SEQ ID NO: 4027407 - DNA, 18 bp, Homo sapiens
aagaattgccaatcttgt

SEQ ID NO: 4027408 - DNA, 22 bp, Homo sapiens
aagaattgtttttgaatttaaa

SEQ ID NO: 4027409 - DNA, 22 bp, Homo sapiens
aagaatttcttggtaagaagcc

SEQ ID NO: 4027410 - DNA, 14 bp, Homo sapiens
aagaatttttttgt

SEQ ID NO: 4027411 - DNA, 16 bp, Homo sapiens
aagacaatttgataca

SEQ ID NO: 4027412 - DNA, 19 bp, Homo sapiens
aagacaatttgatacataa

SEQ ID NO: 4027413 - DNA, 19 bp, Homo sapiens
aaatagtttatttttcaca

SEQ ID NO: 4027414 - DNA, 14 bp, Homo sapiens
aaatataagccttt

SEQ ID NO: 4027415 - DNA, 17 bp, Homo sapiens
aaatataattctgtaaa

SEQ ID NO: 4027416 - DNA, 18 bp, Homo sapiens
aaatataattctgtaaat

SEQ ID NO: 4027417 - DNA, 14 bp, Homo sapiens
aaatataattgaca

SEQ ID NO: 4027418 - DNA, 16 bp, Homo sapiens
aaatatagattagaaa

SEQ ID NO: 4027419 - DNA, 18 bp, Homo sapiens
aaatatagattagaaaaa

SEQ ID NO: 4027420 - DNA, 23 bp, Homo sapiens
aaatatatacccccccatgcagt

SEQ ID NO: 4027421 - DNA, 16 bp, Homo sapiens
aaatatatactaaaca

SEQ ID NO: 4027422 - DNA, 14 bp, Homo sapiens
aaatatatttaatg

SEQ ID NO: 4027423 - DNA, 17 bp, Homo sapiens
aaatatctgaaaatgta

SEQ ID NO: 4027424 - DNA, 23 bp, Homo sapiens
aaatatctgaaaatgtatgtgta

SEQ ID NO: 4027425 - DNA, 15 bp, Homo sapiens
aaatatcttttatgt

SEQ ID NO: 4027426 - DNA, 20 bp, Homo sapiens
aaatatcttttatgtttgaa

SEQ ID NO: 4027427 - DNA, 23 bp, Homo sapiens
aaatatcttttatgtttgaatat

SEQ ID NO: 4027428 - DNA, 19 bp, Homo sapiens
aaatatgattttatttgac

SEQ ID NO: 4027429 - DNA, 22 bp, Homo sapiens
aaatatgcagtgatatggcaga

SEQ ID NO: 4027430 - DNA, 15 bp, Homo sapiens
aaatatggacactta

SEQ ID NO: 4027431 - DNA, 18 bp, Homo sapiens
aaatatgtatatgacatt

SEQ ID NO: 4027432 - DNA, 19 bp, Homo sapiens
aaatattaagaaagactat

SEQ ID NO: 4027433 - DNA, 20 bp, Homo sapiens
aaatattattttatgaaagg

SEQ ID NO: 4027434 - DNA, 13 bp, Homo sapiens
aaatattctatat

SEQ ID NO: 4027435 - DNA, 14 bp, Homo sapiens
aaatattctatatg

SEQ ID NO: 4027436 - DNA, 18 bp, Homo sapiens
aaatattgaggctttgtg

SEQ ID NO: 4027437 - DNA, 21 bp, Homo sapiens
aaatattgaggctttgtgttg

SEQ ID NO: 4027438 - DNA, 20 bp, Homo sapiens
acggcggccaggcacagggc

SEQ ID NO: 4027439 - DNA, 19 bp, Homo sapiens
acggcgttgtacctgtagg

SEQ ID NO: 4027440 - DNA, 22 bp, Homo sapiens
acggctcctcagagcgccagga

SEQ ID NO: 4027441 - DNA, 20 bp, Homo sapiens
acggctgtggaccgtggaca

SEQ ID NO: 4027442 - DNA, 15 bp, Homo sapiens
acgggaggctgggca

SEQ ID NO: 4027443 - DNA, 18 bp, Homo sapiens
acgggcatgggcactccc

SEQ ID NO: 4027444 - DNA, 14 bp, Homo sapiens
acggggactgggga

SEQ ID NO: 4027445 - DNA, 18 bp, Homo sapiens
acggggcctccaacccat

SEQ ID NO: 4027446 - DNA, 15 bp, Homo sapiens
acgggttggggccgg

SEQ ID NO: 4027447 - DNA, 21 bp, Homo sapiens
acggtcccacactggtgactg

SEQ ID NO: 4027448 - DNA, 20 bp, Homo sapiens
acggtgctgtgagggagggg

SEQ ID NO: 4027449 - DNA, 17 bp, Homo sapiens
acgtcaagtctccttcc

SEQ ID NO: 4027450 - DNA, 15 bp, Homo sapiens
acgtcaggccctgac

SEQ ID NO: 4027451 - DNA, 18 bp, Homo sapiens
acgtcatcggaggctggg

SEQ ID NO: 4027452 - DNA, 16 bp, Homo sapiens
acgtccaaggtggcag

SEQ ID NO: 4027453 - DNA, 22 bp, Homo sapiens
acgtcccagcatccctggagca

SEQ ID NO: 4027454 - DNA, 12 bp, Homo sapiens
acgtctcagaga

SEQ ID NO: 4027455 - DNA, 20 bp, Homo sapiens
acgtctgaagcttgactccc

SEQ ID NO: 4027456 - DNA, 17 bp, Homo sapiens
acgtctggccaggcact

SEQ ID NO: 4027457 - DNA, 20 bp, Homo sapiens
acgtcttcttgctgcagcct

SEQ ID NO: 4027458 - DNA, 21 bp, Homo sapiens
acgtcttcttgctgcagcctg

SEQ ID NO: 4027459 - DNA, 16 bp, Homo sapiens
acgtgacagtgcctgg

SEQ ID NO: 4027460 - DNA, 19 bp, Homo sapiens
acgtgacagtgcctgggaa

SEQ ID NO: 4027461 - DNA, 14 bp, Homo sapiens
acgtgagccaggta

SEQ ID NO: 4027462 - DNA, 22 bp, Homo sapiens
acgtgagccaggtaatgaggga

SEQ ID NO: 4027463 - DNA, 23 bp, Homo sapiens
acgtgagccaggtaatgagggac

SEQ ID NO: 4027464 - DNA, 15 bp, Homo sapiens
acgtggagagctggt

SEQ ID NO: 4027465 - DNA, 11 bp, Homo sapiens
acgtgggagac

SEQ ID NO: 4027466 - DNA, 16 bp, Homo sapiens
acgtgggagacaagaa

SEQ ID NO: 4027467 - DNA, 16 bp, Homo sapiens
acgtgggcaaacaggc

SEQ ID NO: 4027468 - DNA, 18 bp, Homo sapiens
acgtggttggggccctgc

SEQ ID NO: 4027469 - DNA, 22 bp, Homo sapiens
acgtgtcagaagcctccaagcc

SEQ ID NO: 4027470 - DNA, 21 bp, Homo sapiens
acgtgtgtaaatatgtacatt

SEQ ID NO: 4027471 - DNA, 21 bp, Homo sapiens
acgttcacccatcttatcaag

SEQ ID NO: 4027472 - DNA, 20 bp, Homo sapiens
acgttcctattgtcattaaa

SEQ ID NO: 4027473 - DNA, 21 bp, Homo sapiens
acgttcctattgtcattaaag

SEQ ID NO: 4027474 - DNA, 19 bp, Homo sapiens
acgttggacttttcgttaa

SEQ ID NO: 4027475 - DNA, 14 bp, Homo sapiens
acgttttattgtgt

SEQ ID NO: 4027476 - DNA, 14 bp, Homo sapiens
acgtttttccttta

SEQ ID NO: 4027477 - DNA, 17 bp, Homo sapiens
actaaaaaggaaacttc

SEQ ID NO: 4027478 - DNA, 13 bp, Homo sapiens
actaaaaatatta

SEQ ID NO: 4027479 - DNA, 12 bp, Homo sapiens
actaaaagatcg

SEQ ID NO: 4027480 - DNA, 14 bp, Homo sapiens
actaaagagagaat

SEQ ID NO: 4027481 - DNA, 21 bp, Homo sapiens
actaaagagagaatgtagata

SEQ ID NO: 4027482 - DNA, 21 bp, Homo sapiens
actaaagctatgttacatgga

SEQ ID NO: 4027483 - DNA, 23 bp, Homo sapiens
actaaaggaaaaaactttgactt

SEQ ID NO: 4027484 - DNA, 15 bp, Homo sapiens
actaaataatgaata

SEQ ID NO: 4027485 - DNA, 21 bp, Homo sapiens
actaaataatgaataaactga

SEQ ID NO: 4027486 - DNA, 18 bp, Homo sapiens
actaaatgagctcctgcg

SEQ ID NO: 4027487 - DNA, 17 bp, Homo sapiens
actaacagataagcaag

SEQ ID NO: 4027488 - DNA, 17 bp, Homo sapiens
actaacaggatatttaa

SEQ ID NO: 4027489 - DNA, 12 bp, Homo sapiens
actaacatttcc

SEQ ID NO: 4027490 - DNA, 14 bp, Homo sapiens
actaaccaaatctc

SEQ ID NO: 4027491 - DNA, 18 bp, Homo sapiens
actaaccaagctgagttt

SEQ ID NO: 4027492 - DNA, 21 bp, Homo sapiens
actaaccaagctgagtttcct

SEQ ID NO: 4027493 - DNA, 19 bp, Homo sapiens
actaaccagtacctctgta

SEQ ID NO: 4027494 - DNA, 23 bp, Homo sapiens
actaactatgcatggtgccccag

SEQ ID NO: 4027495 - DNA, 13 bp, Homo sapiens
actaactggcagg

SEQ ID NO: 4027496 - DNA, 17 bp, Homo sapiens
actaagaaatattccaa

SEQ ID NO: 4027497 - DNA, 23 bp, Homo sapiens
actaagaaatattccaaatgtct

SEQ ID NO: 4027498 - DNA, 16 bp, Homo sapiens
actaagaattcaaact

SEQ ID NO: 4027499 - DNA, 18 bp, Homo sapiens
actaagaattcaaactgg

SEQ ID NO: 4027500 - DNA, 18 bp, Homo sapiens
actaagagaaaattgcac

SEQ ID NO: 4027501 - DNA, 15 bp, Homo sapiens
actaagcaatttccc

SEQ ID NO: 4027502 - DNA, 11 bp, Homo sapiens
actaagccagg

SEQ ID NO: 4027503 - DNA, 16 bp, Homo sapiens
actaagccaggcctgg

SEQ ID NO: 4027504 - DNA, 21 bp, Homo sapiens
actaagccaggcctggctgga

SEQ ID NO: 4027505 - DNA, 15 bp, Homo sapiens
actaatatgggcatt

SEQ ID NO: 4027506 - DNA, 22 bp, Homo sapiens
actaatatgggcattgtagtta

SEQ ID NO: 4027507 - DNA, 19 bp, Homo sapiens
actaatattttatgtgaga

SEQ ID NO: 4027508 - DNA, 22 bp, Homo sapiens
actaatctattgggttcattat

SEQ ID NO: 4027509 - DNA, 15 bp, Homo sapiens
actaatgtaaaatga

SEQ ID NO: 4027510 - DNA, 23 bp, Homo sapiens
actaattagggtacatttataat

SEQ ID NO: 4027511 - DNA, 15 bp, Homo sapiens
actaattccacacct

SEQ ID NO: 4027512 - DNA, 20 bp, Homo sapiens
actaattctcacatccctct

SEQ ID NO: 4027513 - DNA, 16 bp, Homo sapiens
actaatttcaaaatgc

SEQ ID NO: 4027514 - DNA, 13 bp, Homo sapiens
actaatttttgta

SEQ ID NO: 4027515 - DNA, 14 bp, Homo sapiens
actacaaaatacaa

SEQ ID NO: 4027516 - DNA, 13 bp, Homo sapiens
actacaaaatttg

SEQ ID NO: 4027517 - DNA, 14 bp, Homo sapiens
actacaaaatttga

SEQ ID NO: 4027518 - DNA, 19 bp, Homo sapiens
actacaaatcaagtatttg

SEQ ID NO: 4027519 - DNA, 16 bp, Homo sapiens
actacacatttttaaa

SEQ ID NO: 4027520 - DNA, 20 bp, Homo sapiens
actacacatttttaaattgt

SEQ ID NO: 4027521 - DNA, 21 bp, Homo sapiens
actacacatttttaaattgtt

SEQ ID NO: 4027522 - DNA, 13 bp, Homo sapiens
actacacctggct

SEQ ID NO: 4027523 - DNA, 21 bp, Homo sapiens
actacaccttgccttgctgtt

SEQ ID NO: 4027524 - DNA, 20 bp, Homo sapiens
actacagagcagctccccag

SEQ ID NO: 4027525 - DNA, 19 bp, Homo sapiens
actacagctcttaaatgta

SEQ ID NO: 4027526 - DNA, 23 bp, Homo sapiens
actacataaactgactttatcct

SEQ ID NO: 4027527 - DNA, 11 bp, Homo sapiens
actacatctgg

SEQ ID NO: 4027528 - DNA, 18 bp, Homo sapiens
actacatctttaaacagt

SEQ ID NO: 4027529 - DNA, 17 bp, Homo sapiens
acctgcacgttcataac

SEQ ID NO: 4027530 - DNA, 15 bp, Homo sapiens
acctgcatcacagcc

SEQ ID NO: 4027531 - DNA, 16 bp, Homo sapiens
acctgcatctggggcc

SEQ ID NO: 4027532 - DNA, 21 bp, Homo sapiens
acctgcatttgtatgtgtccc

SEQ ID NO: 4027533 - DNA, 13 bp, Homo sapiens
acctgccaggcag

SEQ ID NO: 4027534 - DNA, 15 bp, Homo sapiens
acctgccaggcaggg

SEQ ID NO: 4027535 - DNA, 20 bp, Homo sapiens
acctgccaggcaggggtggg

SEQ ID NO: 4027536 - DNA, 17 bp, Homo sapiens
acctgccctcaagggtg

SEQ ID NO: 4027537 - DNA, 12 bp, Homo sapiens
acctgccctgcc

SEQ ID NO: 4027538 - DNA, 17 bp, Homo sapiens
acctgccctgcccccac

SEQ ID NO: 4027539 - DNA, 12 bp, Homo sapiens
acctgccctgga

SEQ ID NO: 4027540 - DNA, 15 bp, Homo sapiens
acctgccctggaaca

SEQ ID NO: 4027541 - DNA, 13 bp, Homo sapiens
acctgcctcagga

SEQ ID NO: 4027542 - DNA, 13 bp, Homo sapiens
acctgcctcctcg

SEQ ID NO: 4027543 - DNA, 20 bp, Homo sapiens
acctgcctcctcgttccttt

SEQ ID NO: 4027544 - DNA, 21 bp, Homo sapiens
acctgcctcggcctcccaaag

SEQ ID NO: 4027545 - DNA, 15 bp, Homo sapiens
acctgctccgctgct

SEQ ID NO: 4027546 - DNA, 17 bp, Homo sapiens
acctgctccgctgctcc

SEQ ID NO: 4027547 - DNA, 18 bp, Homo sapiens
acctgctccgctgctcct

SEQ ID NO: 4027548 - DNA, 13 bp, Homo sapiens
acctgctctgctg

SEQ ID NO: 4027549 - DNA, 14 bp, Homo sapiens
acctgctctgctga

SEQ ID NO: 4027550 - DNA, 21 bp, Homo sapiens
acctgcttagctgccttgagc

SEQ ID NO: 4027551 - DNA, 21 bp, Homo sapiens
acctgcttctgaactcaagct

SEQ ID NO: 4027552 - DNA, 23 bp, Homo sapiens
acctgcttctgaactcaagctgc

SEQ ID NO: 4027553 - DNA, 19 bp, Homo sapiens
acctggaaggcccagcacc

SEQ ID NO: 4027554 - DNA, 17 bp, Homo sapiens
acctggatccagcactg

SEQ ID NO: 4027555 - DNA, 18 bp, Homo sapiens
acctggatccagcactgg

SEQ ID NO: 4027556 - DNA, 16 bp, Homo sapiens
acctggcactgggagg

SEQ ID NO: 4027557 - DNA, 17 bp, Homo sapiens
acctggcagctctggac

SEQ ID NO: 4027558 - DNA, 13 bp, Homo sapiens
acctggctgagca

SEQ ID NO: 4027559 - DNA, 19 bp, Homo sapiens
acctggctgaggttcctct

SEQ ID NO: 4027560 - DNA, 23 bp, Homo sapiens
acctggctgaggttcctctgcct

SEQ ID NO: 4027561 - DNA, 19 bp, Homo sapiens
acctggctgcccctcacct

SEQ ID NO: 4027562 - DNA, 22 bp, Homo sapiens
acctggctgcccctcaccttgg

SEQ ID NO: 4027563 - DNA, 19 bp, Homo sapiens
acctggcttttactttatt

SEQ ID NO: 4027564 - DNA, 21 bp, Homo sapiens
acctggcttttactttattaa

SEQ ID NO: 4027565 - DNA, 20 bp, Homo sapiens
acctgggaacgactggactg

SEQ ID NO: 4027566 - DNA, 15 bp, Homo sapiens
acctgggacagggag

SEQ ID NO: 4027567 - DNA, 14 bp, Homo sapiens
acctgggaccccga

SEQ ID NO: 4027568 - DNA, 18 bp, Homo sapiens
acctgggattcaggaatg

SEQ ID NO: 4027569 - DNA, 22 bp, Homo sapiens
acctggggagtggttaggcagc

SEQ ID NO: 4027570 - DNA, 20 bp, Homo sapiens
acctgggtttccagggcaca

SEQ ID NO: 4027571 - DNA, 20 bp, Homo sapiens
acctggtggcaccagatgca

SEQ ID NO: 4027572 - DNA, 19 bp, Homo sapiens
acctgtaatcccagctact

SEQ ID NO: 4027573 - DNA, 20 bp, Homo sapiens
acctgtaatcccagctactt

SEQ ID NO: 4027574 - DNA, 19 bp, Homo sapiens
acctgtagatgcagaaaaa

SEQ ID NO: 4027575 - DNA, 21 bp, Homo sapiens
acctgtagatgcagaaaaaga

SEQ ID NO: 4027576 - DNA, 14 bp, Homo sapiens
acctgtagtcccag

SEQ ID NO: 4027577 - DNA, 16 bp, Homo sapiens
acctgtagtcccagct

SEQ ID NO: 4027578 - DNA, 15 bp, Homo sapiens
acctgtcacattgca

SEQ ID NO: 4027579 - DNA, 16 bp, Homo sapiens
acctgtcacattgcat

SEQ ID NO: 4027580 - DNA, 20 bp, Homo sapiens
acctgtcacattgcattcta

SEQ ID NO: 4027581 - DNA, 22 bp, Homo sapiens
acctgtcacattgcattctatt

SEQ ID NO: 4027582 - DNA, 19 bp, Homo sapiens
acctgtcaccgtgagcagc

SEQ ID NO: 4027583 - DNA, 20 bp, Homo sapiens
acctgtccccaccctccact

SEQ ID NO: 4027584 - DNA, 21 bp, Homo sapiens
acctgtccccaccctccactc

SEQ ID NO: 4027585 - DNA, 22 bp, Homo sapiens
acctgtcctaaggaaccttcct

SEQ ID NO: 4027586 - DNA, 23 bp, Homo sapiens
acctgtctataagagaattatat

SEQ ID NO: 4027587 - DNA, 14 bp, Homo sapiens
acctgtgaccagca

SEQ ID NO: 4027588 - DNA, 19 bp, Homo sapiens
acctgtgaccagcactgtc

SEQ ID NO: 4027589 - DNA, 21 bp, Homo sapiens
acctgtgctagttttacagat

SEQ ID NO: 4027590 - DNA, 14 bp, Homo sapiens
acctgtgctggagc

SEQ ID NO: 4027591 - DNA, 13 bp, Homo sapiens
acctgtgggtgta

SEQ ID NO: 4027592 - DNA, 14 bp, Homo sapiens
acctgttatgtatg

SEQ ID NO: 4027593 - DNA, 15 bp, Homo sapiens
acctgttatgtatga

SEQ ID NO: 4027594 - DNA, 14 bp, Homo sapiens
acctgttctgaaat

SEQ ID NO: 4027595 - DNA, 18 bp, Homo sapiens
acctgttgctgtgtttaa

SEQ ID NO: 4027596 - DNA, 20 bp, Homo sapiens
acctgtttttaagctgtttc

SEQ ID NO: 4027597 - DNA, 18 bp, Homo sapiens
acctgtttttttttcatt

SEQ ID NO: 4027598 - DNA, 15 bp, Homo sapiens
accttactgtggagg

SEQ ID NO: 4027599 - DNA, 13 bp, Homo sapiens
accttaggccttc

SEQ ID NO: 4027600 - DNA, 20 bp, Homo sapiens
accttaggccttcctctctc

SEQ ID NO: 4027601 - DNA, 21 bp, Homo sapiens
accttaggccttcctctctcc

SEQ ID NO: 4027602 - DNA, 16 bp, Homo sapiens
accttatatttacaat

SEQ ID NO: 4027603 - DNA, 23 bp, Homo sapiens
accttatatttacaataaatgaa

SEQ ID NO: 4027604 - DNA, 16 bp, Homo sapiens
accttatcaggatggt

SEQ ID NO: 4027605 - DNA, 14 bp, Homo sapiens
accttattgtacct

SEQ ID NO: 4027606 - DNA, 20 bp, Homo sapiens
accttattgtacctctctta

SEQ ID NO: 4027607 - DNA, 18 bp, Homo sapiens
accttcatttcaggaggg

SEQ ID NO: 4027608 - DNA, 21 bp, Homo sapiens
accttcatttcaggagggatt

SEQ ID NO: 4027609 - DNA, 13 bp, Homo sapiens
accttccagctcc

SEQ ID NO: 4027610 - DNA, 12 bp, Homo sapiens
accttccagggc

SEQ ID NO: 4027611 - DNA, 13 bp, Homo sapiens
accttccagggcc

SEQ ID NO: 4027612 - DNA, 14 bp, Homo sapiens
accttccagggccc

SEQ ID NO: 4027613 - DNA, 23 bp, Homo sapiens
acctatgttattttgtgtacaag

SEQ ID NO: 4027614 - DNA, 16 bp, Homo sapiens
acctcaaaatgtctaa

SEQ ID NO: 4027615 - DNA, 16 bp, Homo sapiens
acctcaaactatctgg

SEQ ID NO: 4027616 - DNA, 23 bp, Homo sapiens
acctcaaacttccagtcaggtag

SEQ ID NO: 4027617 - DNA, 21 bp, Homo sapiens
acctcaaccatcctggctgcg

SEQ ID NO: 4027618 - DNA, 21 bp, Homo sapiens
acctcaacccccatttctatt

SEQ ID NO: 4027619 - DNA, 22 bp, Homo sapiens
acctcaacccccatttctattt

SEQ ID NO: 4027620 - DNA, 20 bp, Homo sapiens
acctcaagccccatttcctc

SEQ ID NO: 4027621 - DNA, 19 bp, Homo sapiens
acctcaccattgtgaagca

SEQ ID NO: 4027622 - DNA, 13 bp, Homo sapiens
acctcacccggcc

SEQ ID NO: 4027623 - DNA, 15 bp, Homo sapiens
acctcacccggcctc

SEQ ID NO: 4027624 - DNA, 12 bp, Homo sapiens
acctcaccctgc

SEQ ID NO: 4027625 - DNA, 17 bp, Homo sapiens
acctcaccttcctgtgg

SEQ ID NO: 4027626 - DNA, 16 bp, Homo sapiens
acctcactatggtatg

SEQ ID NO: 4027627 - DNA, 23 bp, Homo sapiens
acctcactatggtatgctggcca

SEQ ID NO: 4027628 - DNA, 13 bp, Homo sapiens
acctcactcctgt

SEQ ID NO: 4027629 - DNA, 16 bp, Homo sapiens
acctcagcctggccag

SEQ ID NO: 4027630 - DNA, 12 bp, Homo sapiens
acctcagctctg

SEQ ID NO: 4027631 - DNA, 14 bp, Homo sapiens
acctcagctctggg

SEQ ID NO: 4027632 - DNA, 17 bp, Homo sapiens
acctcagctctgggaga

SEQ ID NO: 4027633 - DNA, 12 bp, Homo sapiens
acctcaggcagc

SEQ ID NO: 4027634 - DNA, 15 bp, Homo sapiens
acctcaggcaggaag

SEQ ID NO: 4027635 - DNA, 12 bp, Homo sapiens
acctcagggcac

SEQ ID NO: 4027636 - DNA, 22 bp, Homo sapiens
acctcagggcacgcaggaccag

SEQ ID NO: 4027637 - DNA, 12 bp, Homo sapiens
acctcagggctc

SEQ ID NO: 4027638 - DNA, 15 bp, Homo sapiens
acctcagggctccca

SEQ ID NO: 4027639 - DNA, 16 bp, Homo sapiens
acctcagggctcccag

SEQ ID NO: 4027640 - DNA, 17 bp, Homo sapiens
acctcagggctgtccca

SEQ ID NO: 4027641 - DNA, 18 bp, Homo sapiens
acctcagttcccttggcc

SEQ ID NO: 4027642 - DNA, 20 bp, Homo sapiens
acctcagttcccttggcctc

SEQ ID NO: 4027643 - DNA, 23 bp, Homo sapiens
acctcagttcccttggcctcaga

SEQ ID NO: 4027644 - DNA, 14 bp, Homo sapiens
acctcatcccatga

SEQ ID NO: 4027645 - DNA, 13 bp, Homo sapiens
acctcatgcccac

SEQ ID NO: 4027646 - DNA, 23 bp, Homo sapiens
acctccaacagaactaaatgttc

SEQ ID NO: 4027647 - DNA, 17 bp, Homo sapiens
acctccaccacatctgc

SEQ ID NO: 4027648 - DNA, 18 bp, Homo sapiens
acctccaccacatctgcc

SEQ ID NO: 4027649 - DNA, 12 bp, Homo sapiens
acctccacccag

SEQ ID NO: 4027650 - DNA, 11 bp, Homo sapiens
acctccactcc

SEQ ID NO: 4027651 - DNA, 14 bp, Homo sapiens
acctccactcccac

SEQ ID NO: 4027652 - DNA, 19 bp, Homo sapiens
acctccactcccacctcac

SEQ ID NO: 4027653 - DNA, 14 bp, Homo sapiens
acctccagcctccc

SEQ ID NO: 4027654 - DNA, 21 bp, Homo sapiens
acctccagcctccctgtctcc

SEQ ID NO: 4027655 - DNA, 16 bp, Homo sapiens
acctccattaaagtct

SEQ ID NO: 4027656 - DNA, 16 bp, Homo sapiens
acctcccacactccca

SEQ ID NO: 4027657 - DNA, 12 bp, Homo sapiens
acctccccacat

SEQ ID NO: 4027658 - DNA, 20 bp, Homo sapiens
acctccccacatcgcacact

SEQ ID NO: 4027659 - DNA, 21 bp, Homo sapiens
acctccccacatcgcacactg

SEQ ID NO: 4027660 - DNA, 13 bp, Homo sapiens
acctccctgaccc

SEQ ID NO: 4027661 - DNA, 17 bp, Homo sapiens
acctccgagacagtcca

SEQ ID NO: 4027662 - DNA, 22 bp, Homo sapiens
acctccgcccctgcccccgctc

SEQ ID NO: 4027663 - DNA, 13 bp, Homo sapiens
acctcctctcctg

SEQ ID NO: 4027664 - DNA, 19 bp, Homo sapiens
acctccttgtcactttatt

SEQ ID NO: 4027665 - DNA, 19 bp, Homo sapiens
acctcctttcatcacactg

SEQ ID NO: 4027666 - DNA, 21 bp, Homo sapiens
acctcggcttgtgggctggtg

SEQ ID NO: 4027667 - DNA, 18 bp, Homo sapiens
acctcggtcactccaact

SEQ ID NO: 4027668 - DNA, 19 bp, Homo sapiens
acctctagccttaaggggg

SEQ ID NO: 4027669 - DNA, 22 bp, Homo sapiens
acctctcaagctagtgtttcta

SEQ ID NO: 4027670 - DNA, 14 bp, Homo sapiens
acctctcagggcct

SEQ ID NO: 4027671 - DNA, 21 bp, Homo sapiens
acctctcagggcctggcaggc

SEQ ID NO: 4027672 - DNA, 12 bp, Homo sapiens
acctctccaggt

SEQ ID NO: 4027673 - DNA, 14 bp, Homo sapiens
acctctccaggtgc

SEQ ID NO: 4027674 - DNA, 16 bp, Homo sapiens
acctctccaggtgctc

SEQ ID NO: 4027675 - DNA, 12 bp, Homo sapiens
acctctccctca

SEQ ID NO: 4027676 - DNA, 15 bp, Homo sapiens
acctctccctcaaca

SEQ ID NO: 4027677 - DNA, 14 bp, Homo sapiens
acctctctcagagc

SEQ ID NO: 4027678 - DNA, 19 bp, Homo sapiens
acctctctgtagtttatgg

SEQ ID NO: 4027679 - DNA, 12 bp, Homo sapiens
acctctctgtcc

SEQ ID NO: 4027680 - DNA, 15 bp, Homo sapiens
acctctctgtccctt

SEQ ID NO: 4027681 - DNA, 13 bp, Homo sapiens
acctctgatacct

SEQ ID NO: 4027682 - DNA, 14 bp, Homo sapiens
acctctgggagctg

SEQ ID NO: 4027683 - DNA, 16 bp, Homo sapiens
acctctgtgccagggc

SEQ ID NO: 4027684 - DNA, 19 bp, Homo sapiens
acctctgtgccagggcagc

SEQ ID NO: 4027685 - DNA, 15 bp, Homo sapiens
acctctgttaaggtt

SEQ ID NO: 4027686 - DNA, 20 bp, Homo sapiens
acctcttaacaatttctgtc

SEQ ID NO: 4027687 - DNA, 15 bp, Homo sapiens
acctcttcacccccc

SEQ ID NO: 4027688 - DNA, 15 bp, Homo sapiens
acctcttcccatgac

SEQ ID NO: 4027689 - DNA, 22 bp, Homo sapiens
acctcttccccagaaaggagac

SEQ ID NO: 4027690 - DNA, 23 bp, Homo sapiens
acctcttccccagaaaggagact

SEQ ID NO: 4027691 - DNA, 18 bp, Homo sapiens
acctcttgctgtctctgc

SEQ ID NO: 4027692 - DNA, 13 bp, Homo sapiens
acctctttgctca

SEQ ID NO: 4027693 - DNA, 17 bp, Homo sapiens
acctctttttcctcctg

SEQ ID NO: 4027694 - DNA, 22 bp, Homo sapiens
accctggggcctgactgctcag

SEQ ID NO: 4027695 - DNA, 17 bp, Homo sapiens
accctggggcctggacc

SEQ ID NO: 4027696 - DNA, 16 bp, Homo sapiens
accctggtgcctggct

SEQ ID NO: 4027697 - DNA, 15 bp, Homo sapiens
accctgtacctcatc

SEQ ID NO: 4027698 - DNA, 15 bp, Homo sapiens
accctgtggccctgg

SEQ ID NO: 4027699 - DNA, 12 bp, Homo sapiens
acccttagaaaa

SEQ ID NO: 4027700 - DNA, 15 bp, Homo sapiens
acccttcatcttcct

SEQ ID NO: 4027701 - DNA, 22 bp, Homo sapiens
acccttcccctccttctccctt

SEQ ID NO: 4027702 - DNA, 15 bp, Homo sapiens
acccttccctgcact

SEQ ID NO: 4027703 - DNA, 22 bp, Homo sapiens
acccttccctgcactaaagcca

SEQ ID NO: 4027704 - DNA, 16 bp, Homo sapiens
acccttcttgcctgct

SEQ ID NO: 4027705 - DNA, 20 bp, Homo sapiens
acccttcttgcctgctgggc

SEQ ID NO: 4027706 - DNA, 23 bp, Homo sapiens
acccttgaatgtagcagccccgg

SEQ ID NO: 4027707 - DNA, 18 bp, Homo sapiens
acccttgctttcctgggc

SEQ ID NO: 4027708 - DNA, 19 bp, Homo sapiens
acccttgggcctgggcctc

SEQ ID NO: 4027709 - DNA, 19 bp, Homo sapiens
accctttaagatatccatc

SEQ ID NO: 4027710 - DNA, 20 bp, Homo sapiens
accctttcctcctttatcac

SEQ ID NO: 4027711 - DNA, 22 bp, Homo sapiens
accctttgcctttcttctgccc

SEQ ID NO: 4027712 - DNA, 16 bp, Homo sapiens
acccttttcccccttc

SEQ ID NO: 4027713 - DNA, 17 bp, Homo sapiens
acccttttcccccttcc

SEQ ID NO: 4027714 - DNA, 17 bp, Homo sapiens
accctttttctccagct

SEQ ID NO: 4027715 - DNA, 20 bp, Homo sapiens
accgaagtggactggcccct

SEQ ID NO: 4027716 - DNA, 21 bp, Homo sapiens
accgaagtggactggcccctg

SEQ ID NO: 4027717 - DNA, 23 bp, Homo sapiens
accgaagtggactggcccctggg

SEQ ID NO: 4027718 - DNA, 17 bp, Homo sapiens
accgacgcgtctcctgt

SEQ ID NO: 4027719 - DNA, 15 bp, Homo sapiens
accgactagacacac

SEQ ID NO: 4027720 - DNA, 15 bp, Homo sapiens
accgagcaaagatca

SEQ ID NO: 4027721 - DNA, 17 bp, Homo sapiens
accgagcaaagatcaaa

SEQ ID NO: 4027722 - DNA, 13 bp, Homo sapiens
accgagctggagc

SEQ ID NO: 4027723 - DNA, 14 bp, Homo sapiens
accgagctggagcg

SEQ ID NO: 4027724 - DNA, 20 bp, Homo sapiens
accgaggcgatgccacgctt

SEQ ID NO: 4027725 - DNA, 17 bp, Homo sapiens
accgagtctcttctcca

SEQ ID NO: 4027726 - DNA, 20 bp, Homo sapiens
accgagtctcttctccactg

SEQ ID NO: 4027727 - DNA, 21 bp, Homo sapiens
accgagtctcttctccactgg

SEQ ID NO: 4027728 - DNA, 17 bp, Homo sapiens
accgatggagcccccag

SEQ ID NO: 4027729 - DNA, 19 bp, Homo sapiens
accgatggagcccccagat

SEQ ID NO: 4027730 - DNA, 14 bp, Homo sapiens
accgcaactcacac

SEQ ID NO: 4027731 - DNA, 16 bp, Homo sapiens
accgcaactcacacat

SEQ ID NO: 4027732 - DNA, 13 bp, Homo sapiens
accgcagtcacca

SEQ ID NO: 4027733 - DNA, 16 bp, Homo sapiens
accgccacgtcccagc

SEQ ID NO: 4027734 - DNA, 17 bp, Homo sapiens
accgccacgtcccagca

SEQ ID NO: 4027735 - DNA, 15 bp, Homo sapiens
accgccctgggctgg

SEQ ID NO: 4027736 - DNA, 17 bp, Homo sapiens
accgccctgggctggac

SEQ ID NO: 4027737 - DNA, 16 bp, Homo sapiens
accgcctgtctcttta

SEQ ID NO: 4027738 - DNA, 14 bp, Homo sapiens
accgctgccagcac

SEQ ID NO: 4027739 - DNA, 16 bp, Homo sapiens
accgctgccagcacag

SEQ ID NO: 4027740 - DNA, 13 bp, Homo sapiens
accgctggccctt

SEQ ID NO: 4027741 - DNA, 17 bp, Homo sapiens
accgcttctgccttttc

SEQ ID NO: 4027742 - DNA, 18 bp, Homo sapiens
accggccgatggagacac

SEQ ID NO: 4027743 - DNA, 18 bp, Homo sapiens
accgggaataaccttcca

SEQ ID NO: 4027744 - DNA, 16 bp, Homo sapiens
accgggacagacctgg

SEQ ID NO: 4027745 - DNA, 15 bp, Homo sapiens
accgggagcctcccc

SEQ ID NO: 4027746 - DNA, 20 bp, Homo sapiens
accgggagcctccccctcag

SEQ ID NO: 4027747 - DNA, 18 bp, Homo sapiens
accgggcatgtctgcctg

SEQ ID NO: 4027748 - DNA, 22 bp, Homo sapiens
accgggcatgtctgcctggagt

SEQ ID NO: 4027749 - DNA, 14 bp, Homo sapiens
accggtcagtgcct

SEQ ID NO: 4027750 - DNA, 15 bp, Homo sapiens
accggtcagtgcctt

SEQ ID NO: 4027751 - DNA, 15 bp, Homo sapiens
accggtgctgcagga

SEQ ID NO: 4027752 - DNA, 17 bp, Homo sapiens
accggtgctgcaggagt

SEQ ID NO: 4027753 - DNA, 22 bp, Homo sapiens
accgtcatggcttaatgtttat

SEQ ID NO: 4027754 - DNA, 23 bp, Homo sapiens
accgtcatggcttaatgtttatt

SEQ ID NO: 4027755 - DNA, 17 bp, Homo sapiens
accgtcccctccttccc

SEQ ID NO: 4027756 - DNA, 18 bp, Homo sapiens
accgtcccctccttccct

SEQ ID NO: 4027757 - DNA, 15 bp, Homo sapiens
accgtgcctggccag

SEQ ID NO: 4027758 - DNA, 13 bp, Homo sapiens
accgtggacaggc

SEQ ID NO: 4027759 - DNA, 17 bp, Homo sapiens
accgtggacaggcccag

SEQ ID NO: 4027760 - DNA, 18 bp, Homo sapiens
accgtggacaggcccagc

SEQ ID NO: 4027761 - DNA, 15 bp, Homo sapiens
accgtggaggaggaa

SEQ ID NO: 4027762 - DNA, 18 bp, Homo sapiens
accgtggaggaggaaggc

SEQ ID NO: 4027763 - DNA, 20 bp, Homo sapiens
accgtggtatgtctgccatg

SEQ ID NO: 4027764 - DNA, 14 bp, Homo sapiens
accgtgtaaaccaa

SEQ ID NO: 4027765 - DNA, 19 bp, Homo sapiens
accgtgtcaagctgctctg

SEQ ID NO: 4027766 - DNA, 17 bp, Homo sapiens
accgtgtccagcacaga

SEQ ID NO: 4027767 - DNA, 20 bp, Homo sapiens
accgtgttagccaggatggt

SEQ ID NO: 4027768 - DNA, 18 bp, Homo sapiens
accgtgtttgtctcttct

SEQ ID NO: 4027769 - DNA, 20 bp, Homo sapiens
acctaaaggtgtatttaaac

SEQ ID NO: 4027770 - DNA, 12 bp, Homo sapiens
accaagagaagg

SEQ ID NO: 4027771 - DNA, 14 bp, Homo sapiens
accaagatctataa

SEQ ID NO: 4027772 - DNA, 14 bp, Homo sapiens
accaagccgtggct

SEQ ID NO: 4027773 - DNA, 17 bp, Homo sapiens
accaagccgtggcttcc

SEQ ID NO: 4027774 - DNA, 24 bp, Homo sapiens
accaagtaaaacaaaaccactggg

SEQ ID NO: 4027775 - DNA, 15 bp, Homo sapiens
accaagtcctggcta

SEQ ID NO: 4027776 - DNA, 23 bp, Homo sapiens
accaagtcctggctacatcccag

SEQ ID NO: 4027777 - DNA, 16 bp, Homo sapiens
accaagtggaccttga

SEQ ID NO: 4027778 - DNA, 16 bp, Homo sapiens
accaagtttattcagt

SEQ ID NO: 4027779 - DNA, 20 bp, Homo sapiens
accaagtttattcagtaaac

SEQ ID NO: 4027780 - DNA, 22 bp, Homo sapiens
accaagtttattcagtaaacaa

SEQ ID NO: 4027781 - DNA, 13 bp, Homo sapiens
accaatcatttta

SEQ ID NO: 4027782 - DNA, 20 bp, Homo sapiens
accaatcattttaattatta

SEQ ID NO: 4027783 - DNA, 22 bp, Homo sapiens
accaatcccagggctggctctg

SEQ ID NO: 4027784 - DNA, 18 bp, Homo sapiens
accaatcccgtgaaagaa

SEQ ID NO: 4027785 - DNA, 18 bp, Homo sapiens
accaattcaccaacacag

SEQ ID NO: 4027786 - DNA, 12 bp, Homo sapiens
accacaaggaaa

SEQ ID NO: 4027787 - DNA, 17 bp, Homo sapiens
accacacagaggctgcc

SEQ ID NO: 4027788 - DNA, 13 bp, Homo sapiens
accacaccctgta

SEQ ID NO: 4027789 - DNA, 19 bp, Homo sapiens
accacacctggctaatttt

SEQ ID NO: 4027790 - DNA, 24 bp, Homo sapiens
accacagacacaatatgtatgctt

SEQ ID NO: 4027791 - DNA, 15 bp, Homo sapiens
accacagacacacac

SEQ ID NO: 4027792 - DNA, 16 bp, Homo sapiens
accacagacacacaca

SEQ ID NO: 4027793 - DNA, 16 bp, Homo sapiens
accacagcacagccaa

SEQ ID NO: 4027794 - DNA, 12 bp, Homo sapiens
accacagcatcg

SEQ ID NO: 4027795 - DNA, 18 bp, Homo sapiens
accacagggccagaggga

SEQ ID NO: 4027796 - DNA, 13 bp, Homo sapiens
accacagtgtctg

SEQ ID NO: 4027797 - DNA, 22 bp, Homo sapiens
accacatcctccgtccagccgc

SEQ ID NO: 4027798 - DNA, 13 bp, Homo sapiens
accacatctgcca

SEQ ID NO: 4027799 - DNA, 15 bp, Homo sapiens
accacatgccactgc

SEQ ID NO: 4027800 - DNA, 16 bp, Homo sapiens
accacatgccactgcc

SEQ ID NO: 4027801 - DNA, 15 bp, Homo sapiens
accacattgcttttc

SEQ ID NO: 4027802 - DNA, 18 bp, Homo sapiens
accaccccgcctgccctc

SEQ ID NO: 4027803 - DNA, 22 bp, Homo sapiens
accaccccgcctgccctcatgg

SEQ ID NO: 4027804 - DNA, 21 bp, Homo sapiens
accaccctagtcccttcccct

SEQ ID NO: 4027805 - DNA, 14 bp, Homo sapiens
accacctctgtggc

SEQ ID NO: 4027806 - DNA, 10 bp, Homo sapiens
accacctgcc

SEQ ID NO: 4027807 - DNA, 20 bp, Homo sapiens
accatgtattcatccagagt

SEQ ID NO: 4027808 - DNA, 15 bp, Homo sapiens
accatgtcactgtgg

SEQ ID NO: 4027809 - DNA, 21 bp, Homo sapiens
accatgtgccatctgtacata

SEQ ID NO: 4027810 - DNA, 22 bp, Homo sapiens
accatgtggataactttacaga

SEQ ID NO: 4027811 - DNA, 21 bp, Homo sapiens
accatgtgtcacttgtgcttt

SEQ ID NO: 4027812 - DNA, 20 bp, Homo sapiens
accattaagtcatgtgtgaa

SEQ ID NO: 4027813 - DNA, 16 bp, Homo sapiens
accattaataaagaca

SEQ ID NO: 4027814 - DNA, 21 bp, Homo sapiens
accattcagtgattactgtca

SEQ ID NO: 4027815 - DNA, 18 bp, Homo sapiens
accatttaataaagaaat

SEQ ID NO: 4027816 - DNA, 22 bp, Homo sapiens
accatttcctcagcttatctct

SEQ ID NO: 4027817 - DNA, 22 bp, Homo sapiens
accatttgcatggctccagaaa

SEQ ID NO: 4027818 - DNA, 13 bp, Homo sapiens
accatttgtaata

SEQ ID NO: 4027819 - DNA, 15 bp, Homo sapiens
accatttgtaataaa

SEQ ID NO: 4027820 - DNA, 16 bp, Homo sapiens
accatttgtaataaag

SEQ ID NO: 4027821 - DNA, 18 bp, Homo sapiens
accatttgtaataaagta

SEQ ID NO: 4027822 - DNA, 17 bp, Homo sapiens
accattttcccatcatc

SEQ ID NO: 4027823 - DNA, 22 bp, Homo sapiens
acccaaagcggtccctgtccct

SEQ ID NO: 4027824 - DNA, 12 bp, Homo sapiens
acccaaccactc

SEQ ID NO: 4027825 - DNA, 23 bp, Homo sapiens
acccaacggccctgcagccagct

SEQ ID NO: 4027826 - DNA, 20 bp, Homo sapiens
acccaactactgagctgaga

SEQ ID NO: 4027827 - DNA, 17 bp, Homo sapiens
acccaagagcaagggct

SEQ ID NO: 4027828 - DNA, 16 bp, Homo sapiens
acccaagtccctgtca

SEQ ID NO: 4027829 - DNA, 13 bp, Homo sapiens
acccaatctgcac

SEQ ID NO: 4027830 - DNA, 17 bp, Homo sapiens
acccacaagtgccactg

SEQ ID NO: 4027831 - DNA, 18 bp, Homo sapiens
acccacacagctgcccta

SEQ ID NO: 4027832 - DNA, 15 bp, Homo sapiens
acccacacctctgcc

SEQ ID NO: 4027833 - DNA, 16 bp, Homo sapiens
acccacacctctgcca

SEQ ID NO: 4027834 - DNA, 17 bp, Homo sapiens
acccacacctctgccag

SEQ ID NO: 4027835 - DNA, 20 bp, Homo sapiens
acccacagatgtctctgggg

SEQ ID NO: 4027836 - DNA, 22 bp, Homo sapiens
acccacagatgtctctggggca

SEQ ID NO: 4027837 - DNA, 15 bp, Homo sapiens
acccacccctgcaca

SEQ ID NO: 4027838 - DNA, 18 bp, Homo sapiens
acccacccgacctggctg

SEQ ID NO: 4027839 - DNA, 23 bp, Homo sapiens
acccacccgacctggctgcccct

SEQ ID NO: 4027840 - DNA, 14 bp, Homo sapiens
acccacctccaccc

SEQ ID NO: 4027841 - DNA, 16 bp, Homo sapiens
acccacctccacccag

SEQ ID NO: 4027842 - DNA, 17 bp, Homo sapiens
acccacctccacccagc

SEQ ID NO: 4027843 - DNA, 21 bp, Homo sapiens
acccacctccacccagcccct

SEQ ID NO: 4027844 - DNA, 16 bp, Homo sapiens
acccacctctcctgcc

SEQ ID NO: 4027845 - DNA, 12 bp, Homo sapiens
acccactcagga

SEQ ID NO: 4027846 - DNA, 18 bp, Homo sapiens
acccagaatggagcctgc

SEQ ID NO: 4027847 - DNA, 18 bp, Homo sapiens
acccagagaatatataca

SEQ ID NO: 4027848 - DNA, 24 bp, Homo sapiens
acccagagcaccccctgctccacc

SEQ ID NO: 4027849 - DNA, 22 bp, Homo sapiens
acccagcaggaagccaggctga

SEQ ID NO: 4027850 - DNA, 16 bp, Homo sapiens
acccagccccttgaga

SEQ ID NO: 4027851 - DNA, 17 bp, Homo sapiens
acccagccccttgagaa

SEQ ID NO: 4027852 - DNA, 23 bp, Homo sapiens
acccagcgggcaggttctgcctg

SEQ ID NO: 4027853 - DNA, 13 bp, Homo sapiens
acccagctccagg

SEQ ID NO: 4027854 - DNA, 17 bp, Homo sapiens
acccagctccaggggcc

SEQ ID NO: 4027855 - DNA, 21 bp, Homo sapiens
acccagctccaggggcccttg

SEQ ID NO: 4027856 - DNA, 16 bp, Homo sapiens
acccaggatgacccct

SEQ ID NO: 4027857 - DNA, 19 bp, Homo sapiens
acccaggatgacccctggg

SEQ ID NO: 4027858 - DNA, 21 bp, Homo sapiens
acccaggcccatgccaaggcc

SEQ ID NO: 4027859 - DNA, 19 bp, Homo sapiens
acccaggctggagtgcagt

SEQ ID NO: 4027860 - DNA, 16 bp, Homo sapiens
acccataatcctttct

SEQ ID NO: 4027861 - DNA, 13 bp, Homo sapiens
acccatgagcctg

SEQ ID NO: 4027862 - DNA, 20 bp, Homo sapiens
acccatgaggcaatgtcagg

SEQ ID NO: 4027863 - DNA, 16 bp, Homo sapiens
acccatgggctctgac

SEQ ID NO: 4027864 - DNA, 23 bp, Homo sapiens
acccatgtcaccggtcagtgcct

SEQ ID NO: 4027865 - DNA, 14 bp, Homo sapiens
acccatgtgccaag

SEQ ID NO: 4027866 - DNA, 18 bp, Homo sapiens
acccattcactacaggtg

SEQ ID NO: 4027867 - DNA, 21 bp, Homo sapiens
acccattcagagactgtccct

SEQ ID NO: 4027868 - DNA, 21 bp, Homo sapiens
acccattctgttttcccccag

SEQ ID NO: 4027869 - DNA, 18 bp, Homo sapiens
accccaaacaccttccag

SEQ ID NO: 4027870 - DNA, 15 bp, Homo sapiens
accccaacaaaccat

SEQ ID NO: 4027871 - DNA, 17 bp, Homo sapiens
accccaccctccctgga

SEQ ID NO: 4027872 - DNA, 13 bp, Homo sapiens
accccacccttcc

SEQ ID NO: 4027873 - DNA, 11 bp, Homo sapiens
accccacctcc

SEQ ID NO: 4027874 - DNA, 15 bp, Homo sapiens
accccacctccactc

SEQ ID NO: 4027875 - DNA, 16 bp, Homo sapiens
accccacctccactcc

SEQ ID NO: 4027876 - DNA, 21 bp, Homo sapiens
acatgtgacatttatatattg

SEQ ID NO: 4027877 - DNA, 20 bp, Homo sapiens
acatgtgaggaggaaaagga

SEQ ID NO: 4027878 - DNA, 17 bp, Homo sapiens
acatgtgccgaatgtgc

SEQ ID NO: 4027879 - DNA, 16 bp, Homo sapiens
acatgtgtatttatac

SEQ ID NO: 4027880 - DNA, 22 bp, Homo sapiens
acatgtgtttattcatccagca

SEQ ID NO: 4027881 - DNA, 23 bp, Homo sapiens
acatgtgtttattcatccagcag

SEQ ID NO: 4027882 - DNA, 17 bp, Homo sapiens
acatgttactgaccagc

SEQ ID NO: 4027883 - DNA, 18 bp, Homo sapiens
acatgttactgcttcatt

SEQ ID NO: 4027884 - DNA, 23 bp, Homo sapiens
acatgtttatttattctgcattt

SEQ ID NO: 4027885 - DNA, 17 bp, Homo sapiens
acattaaatgcaataat

SEQ ID NO: 4027886 - DNA, 20 bp, Homo sapiens
acattaaatgcaataatttt

SEQ ID NO: 4027887 - DNA, 22 bp, Homo sapiens
acattaaattttttttacattt

SEQ ID NO: 4027888 - DNA, 18 bp, Homo sapiens
acattaacagttttccat

SEQ ID NO: 4027889 - DNA, 14 bp, Homo sapiens
acattaaggaattt

SEQ ID NO: 4027890 - DNA, 19 bp, Homo sapiens
acattaaggaatttgatga

SEQ ID NO: 4027891 - DNA, 15 bp, Homo sapiens
acattaccttactgt

SEQ ID NO: 4027892 - DNA, 19 bp, Homo sapiens
acattagattttattttac

SEQ ID NO: 4027893 - DNA, 22 bp, Homo sapiens
acattagcagtttgctttgtat

SEQ ID NO: 4027894 - DNA, 21 bp, Homo sapiens
acattagtaaatgtctttgta

SEQ ID NO: 4027895 - DNA, 22 bp, Homo sapiens
acattagtaaatgtctttgtaa

SEQ ID NO: 4027896 - DNA, 15 bp, Homo sapiens
acattataaacgctt

SEQ ID NO: 4027897 - DNA, 18 bp, Homo sapiens
acattatcgggagcagtg

SEQ ID NO: 4027898 - DNA, 21 bp, Homo sapiens
acattatcgggagcagtgtct

SEQ ID NO: 4027899 - DNA, 22 bp, Homo sapiens
acattatcgggagcagtgtctt

SEQ ID NO: 4027900 - DNA, 21 bp, Homo sapiens
acattatctcacttagtcctt

SEQ ID NO: 4027901 - DNA, 18 bp, Homo sapiens
acattattatcaacaata

SEQ ID NO: 4027902 - DNA, 16 bp, Homo sapiens
acattatttctagtcc

SEQ ID NO: 4027903 - DNA, 14 bp, Homo sapiens
acattatttgcatg

SEQ ID NO: 4027904 - DNA, 12 bp, Homo sapiens
acattcaatgtt

SEQ ID NO: 4027905 - DNA, 13 bp, Homo sapiens
acattcacctgcc

SEQ ID NO: 4027906 - DNA, 23 bp, Homo sapiens
acattcccccaccagctgcagcc

SEQ ID NO: 4027907 - DNA, 19 bp, Homo sapiens
acattccctctcctgccca

SEQ ID NO: 4027908 - DNA, 23 bp, Homo sapiens
acattcgatctcattcagtatta

SEQ ID NO: 4027909 - DNA, 15 bp, Homo sapiens
acattcgtgagctgg

SEQ ID NO: 4027910 - DNA, 16 bp, Homo sapiens
acattcgtgagctggg

SEQ ID NO: 4027911 - DNA, 13 bp, Homo sapiens
acattctagttca

SEQ ID NO: 4027912 - DNA, 14 bp, Homo sapiens
acattctagttcag

SEQ ID NO: 4027913 - DNA, 18 bp, Homo sapiens
acattctagttcagagcc

SEQ ID NO: 4027914 - DNA, 14 bp, Homo sapiens
acattctgtaaaat

SEQ ID NO: 4027915 - DNA, 18 bp, Homo sapiens
acattcttattaattctt

SEQ ID NO: 4027916 - DNA, 20 bp, Homo sapiens
acagcagccccccagcacta

SEQ ID NO: 4027917 - DNA, 13 bp, Homo sapiens
acagcagcttcac

SEQ ID NO: 4027918 - DNA, 17 bp, Homo sapiens
acagcagcttcaccaga

SEQ ID NO: 4027919 - DNA, 22 bp, Homo sapiens
acagcagcttcaccagagcatt

SEQ ID NO: 4027920 - DNA, 12 bp, Homo sapiens
acagcaggcagc

SEQ ID NO: 4027921 - DNA, 22 bp, Homo sapiens
acagcagggtagtctggtttct

SEQ ID NO: 4027922 - DNA, 21 bp, Homo sapiens
acagcagtcccagtattctca

SEQ ID NO: 4027923 - DNA, 20 bp, Homo sapiens
acagcagtcttatgcttcca

SEQ ID NO: 4027924 - DNA, 23 bp, Homo sapiens
acagcagtgatctcagggcagac

SEQ ID NO: 4027925 - DNA, 17 bp, Homo sapiens
acagcagtgtcatcaga

SEQ ID NO: 4027926 - DNA, 17 bp, Homo sapiens
acagcagtgttctcaca

SEQ ID NO: 4027927 - DNA, 21 bp, Homo sapiens
acagcatcattttgcattcaa

SEQ ID NO: 4027928 - DNA, 19 bp, Homo sapiens
acagcatcccttcccacat

SEQ ID NO: 4027929 - DNA, 18 bp, Homo sapiens
acagcatcgggagcaccc

SEQ ID NO: 4027930 - DNA, 14 bp, Homo sapiens
acagcatgcccctt

SEQ ID NO: 4027931 - DNA, 21 bp, Homo sapiens
acagcatgtacggattttcag

SEQ ID NO: 4027932 - DNA, 23 bp, Homo sapiens
acagcattcttgtcacaataaat

SEQ ID NO: 4027933 - DNA, 21 bp, Homo sapiens
acagccaacacgcacctgcct

SEQ ID NO: 4027934 - DNA, 20 bp, Homo sapiens
acagccaactagcccctggg

SEQ ID NO: 4027935 - DNA, 21 bp, Homo sapiens
acagccaactagcccctgggg

SEQ ID NO: 4027936 - DNA, 12 bp, Homo sapiens
acagccaagtgt

SEQ ID NO: 4027937 - DNA, 15 bp, Homo sapiens
acagccaagtgtgac

SEQ ID NO: 4027938 - DNA, 17 bp, Homo sapiens
acagccagagctgggtg

SEQ ID NO: 4027939 - DNA, 14 bp, Homo sapiens
acagccagcaagag

SEQ ID NO: 4027940 - DNA, 16 bp, Homo sapiens
acagccatgcccgcat

SEQ ID NO: 4027941 - DNA, 23 bp, Homo sapiens
acagccattgcggccccaggagg

SEQ ID NO: 4027942 - DNA, 10 bp, Homo sapiens
acagcccaga

SEQ ID NO: 4027943 - DNA, 15 bp, Homo sapiens
acagcccagagcctg

SEQ ID NO: 4027944 - DNA, 18 bp, Homo sapiens
acagcccagagcctggct

SEQ ID NO: 4027945 - DNA, 14 bp, Homo sapiens
acagcccatctgcc

SEQ ID NO: 4027946 - DNA, 13 bp, Homo sapiens
acagccccaccct

SEQ ID NO: 4027947 - DNA, 16 bp, Homo sapiens
acagcccctccctcct

SEQ ID NO: 4027948 - DNA, 15 bp, Homo sapiens
acagcctcccacccc

SEQ ID NO: 4027949 - DNA, 19 bp, Homo sapiens
acagcctcctctgtctgcc

SEQ ID NO: 4027950 - DNA, 15 bp, Homo sapiens
acagcctgcaagtca

SEQ ID NO: 4027951 - DNA, 12 bp, Homo sapiens
acagcctggact

SEQ ID NO: 4027952 - DNA, 12 bp, Homo sapiens
acagcctggcac

SEQ ID NO: 4027953 - DNA, 20 bp, Homo sapiens
acagcctggtcgccttccac

SEQ ID NO: 4027954 - DNA, 16 bp, Homo sapiens
acagccttagctgcca

SEQ ID NO: 4027955 - DNA, 18 bp, Homo sapiens
acagccttagctgccagt

SEQ ID NO: 4027956 - DNA, 19 bp, Homo sapiens
acagcgaagtagcttgctc

SEQ ID NO: 4027957 - DNA, 23 bp, Homo sapiens
acagcgcccctgctgtcttcccc

SEQ ID NO: 4027958 - DNA, 23 bp, Homo sapiens
acagcggaggagaccagctcaga

SEQ ID NO: 4027959 - DNA, 15 bp, Homo sapiens
acagctacctgagac

SEQ ID NO: 4027960 - DNA, 14 bp, Homo sapiens
acagctactctccc

SEQ ID NO: 4027961 - DNA, 20 bp, Homo sapiens
acagctagtgaagaccagag

SEQ ID NO: 4027962 - DNA, 17 bp, Homo sapiens
acagctatgggagcccc

SEQ ID NO: 4027963 - DNA, 12 bp, Homo sapiens
acagctcctccc

SEQ ID NO: 4027964 - DNA, 16 bp, Homo sapiens
acagctgaattatcta

SEQ ID NO: 4027965 - DNA, 16 bp, Homo sapiens
acagaaaaagcatgat

SEQ ID NO: 4027966 - DNA, 17 bp, Homo sapiens
acagaaaaagcatgatg

SEQ ID NO: 4027967 - DNA, 18 bp, Homo sapiens
acagaaaagtgcctgagc

SEQ ID NO: 4027968 - DNA, 19 bp, Homo sapiens
acagaaactggattaaaac

SEQ ID NO: 4027969 - DNA, 23 bp, Homo sapiens
acagaaactggattaaaacaatt

SEQ ID NO: 4027970 - DNA, 20 bp, Homo sapiens
acagaaatcagaggagagac

SEQ ID NO: 4027971 - DNA, 21 bp, Homo sapiens
acagaaatcagaggagagacg

SEQ ID NO: 4027972 - DNA, 19 bp, Homo sapiens
acagaaatcaggtgtttta

SEQ ID NO: 4027973 - DNA, 16 bp, Homo sapiens
acagaaatgctgctgg

SEQ ID NO: 4027974 - DNA, 15 bp, Homo sapiens
acagaaatggactgg

SEQ ID NO: 4027975 - DNA, 22 bp, Homo sapiens
acagaaatggggaattctctaa

SEQ ID NO: 4027976 - DNA, 16 bp, Homo sapiens
acagaacagcttcagg

SEQ ID NO: 4027977 - DNA, 18 bp, Homo sapiens
acagaacagcttcaggtt

SEQ ID NO: 4027978 - DNA, 15 bp, Homo sapiens
acagaacagggtcat

SEQ ID NO: 4027979 - DNA, 21 bp, Homo sapiens
acagaaccttcaacccagtgg

SEQ ID NO: 4027980 - DNA, 13 bp, Homo sapiens
acagaactaaatg

SEQ ID NO: 4027981 - DNA, 14 bp, Homo sapiens
acagaactaaatgt

SEQ ID NO: 4027982 - DNA, 18 bp, Homo sapiens
acagaactaaatgttcta

SEQ ID NO: 4027983 - DNA, 19 bp, Homo sapiens
acagaacttcagaaagact

SEQ ID NO: 4027984 - DNA, 21 bp, Homo sapiens
acagaacttcagaaagacttg

SEQ ID NO: 4027985 - DNA, 17 bp, Homo sapiens
acagaacttgaatgtgt

SEQ ID NO: 4027986 - DNA, 21 bp, Homo sapiens
acagaagctgaagtgcatcca

SEQ ID NO: 4027987 - DNA, 18 bp, Homo sapiens
acagaaggaatctgtgca

SEQ ID NO: 4027988 - DNA, 20 bp, Homo sapiens
acagaaggaatctgtgcaga

SEQ ID NO: 4027989 - DNA, 16 bp, Homo sapiens
acagaaggctcctgcc

SEQ ID NO: 4027990 - DNA, 17 bp, Homo sapiens
acagaagtcatgaagcc

SEQ ID NO: 4027991 - DNA, 19 bp, Homo sapiens
acagaatatttctattgaa

SEQ ID NO: 4027992 - DNA, 23 bp, Homo sapiens
acagaatatttttatatttcctt

SEQ ID NO: 4027993 - DNA, 20 bp, Homo sapiens
acagaatgttttactgtgaa

SEQ ID NO: 4027994 - DNA, 21 bp, Homo sapiens
acagaatgttttactgtgaaa

SEQ ID NO: 4027995 - DNA, 18 bp, Homo sapiens
acagaatttccactgtaa

SEQ ID NO: 4027996 - DNA, 11 bp, Homo sapiens
acagacacaca

SEQ ID NO: 4027997 - DNA, 23 bp, Homo sapiens
acagacacacacacgcacgcaca

SEQ ID NO: 4027998 - DNA, 20 bp, Homo sapiens
acagacacgctcgcgggcag

SEQ ID NO: 4027999 - DNA, 18 bp, Homo sapiens
acagacactaagttatag

SEQ ID NO: 4028000 - DNA, 15 bp, Homo sapiens
acagacatctctgca

SEQ ID NO: 4028001 - DNA, 20 bp, Homo sapiens
acagaccacatctttatctg

SEQ ID NO: 4028002 - DNA, 22 bp, Homo sapiens
acagaccacatctttatctgtt

SEQ ID NO: 4028003 - DNA, 15 bp, Homo sapiens
acagaccacctgctt

SEQ ID NO: 4028004 - DNA, 15 bp, Homo sapiens
acagactccatctct

SEQ ID NO: 4028005 - DNA, 17 bp, Homo sapiens
acagacttctccagacc

SEQ ID NO: 4028006 - DNA, 14 bp, Homo sapiens
acagacttgagaac

SEQ ID NO: 4028007 - DNA, 16 bp, Homo sapiens
acagacttgagaactt

SEQ ID NO: 4028008 - DNA, 18 bp, Homo sapiens
acagacttgagaacttga

SEQ ID NO: 4028009 - DNA, 23 bp, Homo sapiens
acagagagacagacttgagaact

SEQ ID NO: 4028010 - DNA, 13 bp, Homo sapiens
acagagatgtctc

SEQ ID NO: 4028011 - DNA, 22 bp, Homo sapiens
acagagattactttgctgcctt

SEQ ID NO: 4028012 - DNA, 13 bp, Homo sapiens
acagagcagctcc

SEQ ID NO: 4028013 - DNA, 18 bp, Homo sapiens
acagagccgagcaatatt

SEQ ID NO: 4028014 - DNA, 13 bp, Homo sapiens
acagagcctggcc

SEQ ID NO: 4028015 - DNA, 17 bp, Homo sapiens
acagagcgacagagcag

SEQ ID NO: 4028016 - DNA, 15 bp, Homo sapiens
acagagcgcccctcc

SEQ ID NO: 4028017 - DNA, 13 bp, Homo sapiens
acaccacagacac

SEQ ID NO: 4028018 - DNA, 15 bp, Homo sapiens
acaccacagacacac

SEQ ID NO: 4028019 - DNA, 16 bp, Homo sapiens
acaccacagacacaca

SEQ ID NO: 4028020 - DNA, 17 bp, Homo sapiens
acaccagagcagatgca

SEQ ID NO: 4028021 - DNA, 18 bp, Homo sapiens
acaccagagcagatgcag

SEQ ID NO: 4028022 - DNA, 22 bp, Homo sapiens
acaccagagcagatgcagagag

SEQ ID NO: 4028023 - DNA, 16 bp, Homo sapiens
acacccaccctgtgcc

SEQ ID NO: 4028024 - DNA, 16 bp, Homo sapiens
acacccactcccttcc

SEQ ID NO: 4028025 - DNA, 21 bp, Homo sapiens
acaccccctccccgcccctgt

SEQ ID NO: 4028026 - DNA, 23 bp, Homo sapiens
acacccctgctctacccatgagc

SEQ ID NO: 4028027 - DNA, 17 bp, Homo sapiens
acacccgactcctcaaa

SEQ ID NO: 4028028 - DNA, 17 bp, Homo sapiens
acaccctcaacctcttc

SEQ ID NO: 4028029 - DNA, 14 bp, Homo sapiens
acaccctcccccgc

SEQ ID NO: 4028030 - DNA, 11 bp, Homo sapiens
acaccctggcc

SEQ ID NO: 4028031 - DNA, 12 bp, Homo sapiens
acaccctggcct

SEQ ID NO: 4028032 - DNA, 17 bp, Homo sapiens
acaccctggcctgaact

SEQ ID NO: 4028033 - DNA, 16 bp, Homo sapiens
acaccgactagccagg

SEQ ID NO: 4028034 - DNA, 14 bp, Homo sapiens
acaccgggcctgga

SEQ ID NO: 4028035 - DNA, 16 bp, Homo sapiens
acaccgggcctggaga

SEQ ID NO: 4028036 - DNA, 21 bp, Homo sapiens
acacctaaaggtgtatttaaa

SEQ ID NO: 4028037 - DNA, 22 bp, Homo sapiens
acacctagctttattcttcaga

SEQ ID NO: 4028038 - DNA, 21 bp, Homo sapiens
acacctcagttcccttggcct

SEQ ID NO: 4028039 - DNA, 22 bp, Homo sapiens
acacctcagttcccttggcctc

SEQ ID NO: 4028040 - DNA, 23 bp, Homo sapiens
acacctcagttcccttggcctca

SEQ ID NO: 4028041 - DNA, 22 bp, Homo sapiens
acacctccgagacagtccagtg

SEQ ID NO: 4028042 - DNA, 12 bp, Homo sapiens
acacctctgcca

SEQ ID NO: 4028043 - DNA, 12 bp, Homo sapiens
acacctgacaca

SEQ ID NO: 4028044 - DNA, 22 bp, Homo sapiens
acacctgttcacagaaaaagca

SEQ ID NO: 4028045 - DNA, 23 bp, Homo sapiens
acacctgttcacagaaaaagcat

SEQ ID NO: 4028046 - DNA, 20 bp, Homo sapiens
acaccttccagctcctgtaa

SEQ ID NO: 4028047 - DNA, 16 bp, Homo sapiens
acaccttccagggccc

SEQ ID NO: 4028048 - DNA, 21 bp, Homo sapiens
acaccttttattgacacagaa

SEQ ID NO: 4028049 - DNA, 23 bp, Homo sapiens
acaccttttattgacacagaaaa

SEQ ID NO: 4028050 - DNA, 23 bp, Homo sapiens
acaccttttccccaaccacagag

SEQ ID NO: 4028051 - DNA, 14 bp, Homo sapiens
acacgcacgcacac

SEQ ID NO: 4028052 - DNA, 15 bp, Homo sapiens
acacgcacgcacaca

SEQ ID NO: 4028053 - DNA, 16 bp, Homo sapiens
acacgcacgcacacac

SEQ ID NO: 4028054 - DNA, 20 bp, Homo sapiens
acacgcacgcacacacacaa

SEQ ID NO: 4028055 - DNA, 19 bp, Homo sapiens
acacgtacctctcatcagt

SEQ ID NO: 4028056 - DNA, 16 bp, Homo sapiens
acacgtacttaaatga

SEQ ID NO: 4028057 - DNA, 23 bp, Homo sapiens
acacgtacttaaatgaaagcatg

SEQ ID NO: 4028058 - DNA, 14 bp, Homo sapiens
acactaaaatttta

SEQ ID NO: 4028059 - DNA, 13 bp, Homo sapiens
acactaacatttc

SEQ ID NO: 4028060 - DNA, 14 bp, Homo sapiens
acactaacatttcc

SEQ ID NO: 4028061 - DNA, 22 bp, Homo sapiens
acactaaccaagctgagtttcc

SEQ ID NO: 4028062 - DNA, 12 bp, Homo sapiens
acactaattcat

SEQ ID NO: 4028063 - DNA, 20 bp, Homo sapiens
acactacagagcagctcccc

SEQ ID NO: 4028064 - DNA, 13 bp, Homo sapiens
acactagcctctc

SEQ ID NO: 4028065 - DNA, 23 bp, Homo sapiens
acactagccttggcctctttcct

SEQ ID NO: 4028066 - DNA, 18 bp, Homo sapiens
acactattaccatgagaa

SEQ ID NO: 4028067 - DNA, 18 bp, Homo sapiens
acactccaccctccacct

SEQ ID NO: 4028068 - DNA, 22 bp, Homo sapiens
acactccaccctccaccttcca

SEQ ID NO: 4028069 - DNA, 15 bp, Homo sapiens
acactccagtggcag

SEQ ID NO: 4028070 - DNA, 16 bp, Homo sapiens
acactccagtggcaga

SEQ ID NO: 4028071 - DNA, 16 bp, Homo sapiens
acactccatgagtgtc

SEQ ID NO: 4028072 - DNA, 15 bp, Homo sapiens
acactccccgaagtc

SEQ ID NO: 4028073 - DNA, 14 bp, Homo sapiens
acaagttttaaata

SEQ ID NO: 4028074 - DNA, 12 bp, Homo sapiens
acaataaatgta

SEQ ID NO: 4028075 - DNA, 18 bp, Homo sapiens
acaataaatgtattcaaa

SEQ ID NO: 4028076 - DNA, 14 bp, Homo sapiens
acaataaatgtgca

SEQ ID NO: 4028077 - DNA, 18 bp, Homo sapiens
acaataactactgtgttc

SEQ ID NO: 4028078 - DNA, 15 bp, Homo sapiens
acaataagcaaaaac

SEQ ID NO: 4028079 - DNA, 12 bp, Homo sapiens
acaatacaaatg

SEQ ID NO: 4028080 - DNA, 14 bp, Homo sapiens
acaatacaaatgga

SEQ ID NO: 4028081 - DNA, 12 bp, Homo sapiens
acaatacagata

SEQ ID NO: 4028082 - DNA, 15 bp, Homo sapiens
acaatatcatatcat

SEQ ID NO: 4028083 - DNA, 22 bp, Homo sapiens
acaatatgtatgctttttacct

SEQ ID NO: 4028084 - DNA, 15 bp, Homo sapiens
acaatattatgaaat

SEQ ID NO: 4028085 - DNA, 14 bp, Homo sapiens
acaatatttctgat

SEQ ID NO: 4028086 - DNA, 21 bp, Homo sapiens
acaatccctggggctgtgcat

SEQ ID NO: 4028087 - DNA, 17 bp, Homo sapiens
acaatgctgatttggtg

SEQ ID NO: 4028088 - DNA, 21 bp, Homo sapiens
acaatggctaattcccagagt

SEQ ID NO: 4028089 - DNA, 14 bp, Homo sapiens
acaatgtacacact

SEQ ID NO: 4028090 - DNA, 15 bp, Homo sapiens
acaatgtcagtattt

SEQ ID NO: 4028091 - DNA, 23 bp, Homo sapiens
acaatgtcagtatttcagtgtag

SEQ ID NO: 4028092 - DNA, 22 bp, Homo sapiens
acaatgtcctaactgaaagatg

SEQ ID NO: 4028093 - DNA, 12 bp, Homo sapiens
acaatgtgaact

SEQ ID NO: 4028094 - DNA, 22 bp, Homo sapiens
acaatgtgaactttattaaata

SEQ ID NO: 4028095 - DNA, 12 bp, Homo sapiens
acaatgtggagt

SEQ ID NO: 4028096 - DNA, 11 bp, Homo sapiens
acaatgttaag

SEQ ID NO: 4028097 - DNA, 14 bp, Homo sapiens
acaatgttaaggaa

SEQ ID NO: 4028098 - DNA, 16 bp, Homo sapiens
acaattactttagaaa

SEQ ID NO: 4028099 - DNA, 13 bp, Homo sapiens
acaattattggca

SEQ ID NO: 4028100 - DNA, 18 bp, Homo sapiens
acaattattggcaaagtt

SEQ ID NO: 4028101 - DNA, 22 bp, Homo sapiens
acaattggtaaaactcactgtg

SEQ ID NO: 4028102 - DNA, 23 bp, Homo sapiens
acaattggtaaaactcactgtga

SEQ ID NO: 4028103 - DNA, 14 bp, Homo sapiens
acaattgtgtagcc

SEQ ID NO: 4028104 - DNA, 21 bp, Homo sapiens
acaattgtgtagcctttttgt

SEQ ID NO: 4028105 - DNA, 21 bp, Homo sapiens
acaattgtgtgaattaatttc

SEQ ID NO: 4028106 - DNA, 16 bp, Homo sapiens
acaattgttttaatct

SEQ ID NO: 4028107 - DNA, 23 bp, Homo sapiens
acaattgttttaatctgaaattc

SEQ ID NO: 4028108 - DNA, 11 bp, Homo sapiens
acaatttctgt

SEQ ID NO: 4028109 - DNA, 14 bp, Homo sapiens
acaatttgatacat

SEQ ID NO: 4028110 - DNA, 12 bp, Homo sapiens
acaattttgtac

SEQ ID NO: 4028111 - DNA, 17 bp, Homo sapiens
acaattttttttttcct

SEQ ID NO: 4028112 - DNA, 14 bp, Homo sapiens
acacaaactgtaaa

SEQ ID NO: 4028113 - DNA, 15 bp, Homo sapiens
acacaaagcacattg

SEQ ID NO: 4028114 - DNA, 19 bp, Homo sapiens
acacaaggatagatgctgg

SEQ ID NO: 4028115 - DNA, 14 bp, Homo sapiens
acacaataagcaaa

SEQ ID NO: 4028116 - DNA, 14 bp, Homo sapiens
acacaatatgaata

SEQ ID NO: 4028117 - DNA, 18 bp, Homo sapiens
acacaatatgtatgcttt

SEQ ID NO: 4028118 - DNA, 14 bp, Homo sapiens
acacaattgtttta

SEQ ID NO: 4028119 - DNA, 21 bp, Homo sapiens
acacaatttaattcctctttt

SEQ ID NO: 4028120 - DNA, 14 bp, Homo sapiens
acacacaacaatta

SEQ ID NO: 4028121 - DNA, 9 bp, Homo sapiens
acacacaca

SEQ ID NO: 4028122 - DNA, 10 bp, Homo sapiens
acacacacaa

SEQ ID NO: 4028123 - DNA, 13 bp, Homo sapiens
acacacacaaacc

SEQ ID NO: 4028124 - DNA, 12 bp, Homo sapiens
acacacacacac

SEQ ID NO: 4028125 - DNA, 16 bp, Homo sapiens
acacacacacacacac

SEQ ID NO: 4028126 - DNA, 11 bp, Homo sapiens
acacacacact

SEQ ID NO: 4028127 - DNA, 12 bp, Homo sapiens
acacacacacta

SEQ ID NO: 4028128 - DNA, 12 bp, Homo sapiens
acacacacactc

SEQ ID NO: 4028129 - DNA, 13 bp, Homo sapiens
acacacacagaaa

SEQ ID NO: 4028130 - DNA, 11 bp, Homo sapiens
acacacacagg

SEQ ID NO: 4028131 - DNA, 14 bp, Homo sapiens
acacacacccaggc

SEQ ID NO: 4028132 - DNA, 14 bp, Homo sapiens
acacacacgcacgc

SEQ ID NO: 4028133 - DNA, 16 bp, Homo sapiens
acacacagaaaagcat

SEQ ID NO: 4028134 - DNA, 16 bp, Homo sapiens
aatttgtcagcgttct

SEQ ID NO: 4028135 - DNA, 18 bp, Homo sapiens
aatttgttgaaattatgt

SEQ ID NO: 4028136 - DNA, 17 bp, Homo sapiens
aatttgtttgaaatctt

SEQ ID NO: 4028137 - DNA, 22 bp, Homo sapiens
aatttgttttgctgagagcata

SEQ ID NO: 4028138 - DNA, 12 bp, Homo sapiens
aattttaaatta

SEQ ID NO: 4028139 - DNA, 22 bp, Homo sapiens
aattttaagtgctttgtaatgg

SEQ ID NO: 4028140 - DNA, 13 bp, Homo sapiens
aattttaatgcta

SEQ ID NO: 4028141 - DNA, 16 bp, Homo sapiens
aattttaatgtgaaga

SEQ ID NO: 4028142 - DNA, 21 bp, Homo sapiens
aattttaggaacttcagagat

SEQ ID NO: 4028143 - DNA, 19 bp, Homo sapiens
aattttagtagagacaggg

SEQ ID NO: 4028144 - DNA, 13 bp, Homo sapiens
aattttagtattc

SEQ ID NO: 4028145 - DNA, 19 bp, Homo sapiens
aattttatagctcagttta

SEQ ID NO: 4028146 - DNA, 20 bp, Homo sapiens
aattttatagctcagtttat

SEQ ID NO: 4028147 - DNA, 18 bp, Homo sapiens
aattttatattcagtgaa

SEQ ID NO: 4028148 - DNA, 13 bp, Homo sapiens
aattttatattct

SEQ ID NO: 4028149 - DNA, 23 bp, Homo sapiens
aattttattttgtgctcatttaa

SEQ ID NO: 4028150 - DNA, 22 bp, Homo sapiens
aattttcaactgtcttcctcaa

SEQ ID NO: 4028151 - DNA, 13 bp, Homo sapiens
aattttcacaaaa

SEQ ID NO: 4028152 - DNA, 21 bp, Homo sapiens
aattttcacaaaatgtctcag

SEQ ID NO: 4028153 - DNA, 21 bp, Homo sapiens
aattttcattaaacttgaagc

SEQ ID NO: 4028154 - DNA, 11 bp, Homo sapiens
aattttctaag

SEQ ID NO: 4028155 - DNA, 23 bp, Homo sapiens
aattttctcaaaagcatttatca

SEQ ID NO: 4028156 - DNA, 17 bp, Homo sapiens
aattttctcattttctt

SEQ ID NO: 4028157 - DNA, 18 bp, Homo sapiens
aattttctccctttatgt

SEQ ID NO: 4028158 - DNA, 19 bp, Homo sapiens
aattttctccctttatgta

SEQ ID NO: 4028159 - DNA, 22 bp, Homo sapiens
aattttctccctttatgtatct

SEQ ID NO: 4028160 - DNA, 19 bp, Homo sapiens
aattttgcaaatataaaca

SEQ ID NO: 4028161 - DNA, 20 bp, Homo sapiens
aattttgcaaatataaacat

SEQ ID NO: 4028162 - DNA, 18 bp, Homo sapiens
aattttgcttttaattaa

SEQ ID NO: 4028163 - DNA, 12 bp, Homo sapiens
aattttgtaaga

SEQ ID NO: 4028164 - DNA, 13 bp, Homo sapiens
aattttgtaagaa

SEQ ID NO: 4028165 - DNA, 20 bp, Homo sapiens
aatttttaccctaatgtctt

SEQ ID NO: 4028166 - DNA, 15 bp, Homo sapiens
aatttttatttttct

SEQ ID NO: 4028167 - DNA, 14 bp, Homo sapiens
aatttttccttcct

SEQ ID NO: 4028168 - DNA, 23 bp, Homo sapiens
aatttttggtgggtgaaaggaat

SEQ ID NO: 4028169 - DNA, 14 bp, Homo sapiens
aatttttgtaattt

SEQ ID NO: 4028170 - DNA, 14 bp, Homo sapiens
aaggcagccaccag

SEQ ID NO: 4028171 - DNA, 20 bp, Homo sapiens
aaggcagctcacccctgggc

SEQ ID NO: 4028172 - DNA, 23 bp, Homo sapiens
aaggcagctcacccctgggcagg

SEQ ID NO: 4028173 - DNA, 12 bp, Homo sapiens
aaggcagggacc

SEQ ID NO: 4028174 - DNA, 13 bp, Homo sapiens
aaggcatcccagc

SEQ ID NO: 4028175 - DNA, 15 bp, Homo sapiens
aaggcatcccagcct

SEQ ID NO: 4028176 - DNA, 15 bp, Homo sapiens
aaggcatgagaaaga

SEQ ID NO: 4028177 - DNA, 19 bp, Homo sapiens
aaggcattataaaaagaat

SEQ ID NO: 4028178 - DNA, 22 bp, Homo sapiens
aaggccagtccccatttctgcc

SEQ ID NO: 4028179 - DNA, 18 bp, Homo sapiens
aaggccataaaacaggta

SEQ ID NO: 4028180 - DNA, 22 bp, Homo sapiens
aaggcccaagagcagagtctgg

SEQ ID NO: 4028181 - DNA, 20 bp, Homo sapiens
aaggcccccaaacatagccc

SEQ ID NO: 4028182 - DNA, 23 bp, Homo sapiens
aaggcccccaaacatagcccctg

SEQ ID NO: 4028183 - DNA, 17 bp, Homo sapiens
aaggcccccacttctcc

SEQ ID NO: 4028184 - DNA, 13 bp, Homo sapiens
aaggccctgctga

SEQ ID NO: 4028185 - DNA, 23 bp, Homo sapiens
aaggccgagcgttcccagcaggg

SEQ ID NO: 4028186 - DNA, 17 bp, Homo sapiens
aaggccgtgtctctgag

SEQ ID NO: 4028187 - DNA, 24 bp, Homo sapiens
aaggcctccctcaggctctgtgga

SEQ ID NO: 4028188 - DNA, 13 bp, Homo sapiens
aaggcctcttgta

SEQ ID NO: 4028189 - DNA, 20 bp, Homo sapiens
aaggcctcttgtaaagactg

SEQ ID NO: 4028190 - DNA, 14 bp, Homo sapiens
aaggcctggctgga

SEQ ID NO: 4028191 - DNA, 20 bp, Homo sapiens
aaggcctggtgtttcttgat

SEQ ID NO: 4028192 - DNA, 12 bp, Homo sapiens
aaggccttctcc

SEQ ID NO: 4028193 - DNA, 18 bp, Homo sapiens
aaggcgggagcatctctt

SEQ ID NO: 4028194 - DNA, 22 bp, Homo sapiens
aaggcgtagcatcatcctgcag

SEQ ID NO: 4028195 - DNA, 15 bp, Homo sapiens
aaggctccaagacct

SEQ ID NO: 4028196 - DNA, 19 bp, Homo sapiens
aaggctctcacccccatcc

SEQ ID NO: 4028197 - DNA, 20 bp, Homo sapiens
aaggctgagggctgccagca

SEQ ID NO: 4028198 - DNA, 20 bp, Homo sapiens
aaggctggccagcaaggcag

SEQ ID NO: 4028199 - DNA, 15 bp, Homo sapiens
aaggctttatctcag

SEQ ID NO: 4028200 - DNA, 14 bp, Homo sapiens
aagggaagaaactg

SEQ ID NO: 4028201 - DNA, 13 bp, Homo sapiens
aagggaagacatt

SEQ ID NO: 4028202 - DNA, 14 bp, Homo sapiens
aagggaagacattt

SEQ ID NO: 4028203 - DNA, 18 bp, Homo sapiens
aagggaaggaactctggc

SEQ ID NO: 4028204 - DNA, 22 bp, Homo sapiens
aagggacacccctacacacacc

SEQ ID NO: 4028205 - DNA, 15 bp, Homo sapiens
aagggaccctttgcc

SEQ ID NO: 4028206 - DNA, 18 bp, Homo sapiens
aagggacttaacttgttt

SEQ ID NO: 4028207 - DNA, 23 bp, Homo sapiens
aagggagacattgtttggatttc

SEQ ID NO: 4028208 - DNA, 20 bp, Homo sapiens
aagggatggaaaaggaagac

SEQ ID NO: 4028209 - DNA, 22 bp, Homo sapiens
aagggatgttattatccttggg

SEQ ID NO: 4028210 - DNA, 22 bp, Homo sapiens
aagggcaggaaggagagcctgc

SEQ ID NO: 4028211 - DNA, 19 bp, Homo sapiens
aagggcatgccttgtgctg

SEQ ID NO: 4028212 - DNA, 14 bp, Homo sapiens
aagggcattttacc

SEQ ID NO: 4028213 - DNA, 13 bp, Homo sapiens
aagggccagagcc

SEQ ID NO: 4028214 - DNA, 16 bp, Homo sapiens
aagggccatgctgaag

SEQ ID NO: 4028215 - DNA, 17 bp, Homo sapiens
aagggccatgctgaagg

SEQ ID NO: 4028216 - DNA, 12 bp, Homo sapiens
aagggctggctc

SEQ ID NO: 4028217 - DNA, 17 bp, Homo sapiens
aagggctggctccccct

SEQ ID NO: 4028218 - DNA, 22 bp, Homo sapiens
aagggctggctccccctcccca

SEQ ID NO: 4028219 - DNA, 12 bp, Homo sapiens
aagggctgggtg

SEQ ID NO: 4028220 - DNA, 14 bp, Homo sapiens
aagggcttactatt

SEQ ID NO: 4028221 - DNA, 15 bp, Homo sapiens
aagggcttactattt

SEQ ID NO: 4028222 - DNA, 20 bp, Homo sapiens
aagggctttggttccttctc

SEQ ID NO: 4028223 - DNA, 11 bp, Homo sapiens
aaggggacagc

SEQ ID NO: 4028224 - DNA, 15 bp, Homo sapiens
aaggggagagcctgc

SEQ ID NO: 4028225 - DNA, 16 bp, Homo sapiens
aaggggaggcagccgg

SEQ ID NO: 4028226 - DNA, 13 bp, Homo sapiens
aaggggccttgct

SEQ ID NO: 4028227 - DNA, 13 bp, Homo sapiens
aaggggggagggg

SEQ ID NO: 4028228 - DNA, 18 bp, Homo sapiens
aagggggggctacattat

SEQ ID NO: 4028229 - DNA, 21 bp, Homo sapiens
aaggggggttgcagtggagag

SEQ ID NO: 4028230 - DNA, 14 bp, Homo sapiens
aaggggtgctttta

SEQ ID NO: 4028231 - DNA, 17 bp, Homo sapiens
aaggggtgcttttatag

SEQ ID NO: 4028232 - DNA, 16 bp, Homo sapiens
aagggtcaaacctgta

SEQ ID NO: 4028233 - DNA, 17 bp, Homo sapiens
aagggtcatagaaaggg

SEQ ID NO: 4028234 - DNA, 21 bp, Homo sapiens
aagggtggatgacagggcaga

SEQ ID NO: 4028235 - DNA, 16 bp, Homo sapiens
aagggtgggtgctcag

SEQ ID NO: 4028236 - DNA, 18 bp, Homo sapiens
aagggtgggtgctcagaa

SEQ ID NO: 4028237 - DNA, 14 bp, Homo sapiens
aagggttaagaaaa

SEQ ID NO: 4028238 - DNA, 15 bp, Homo sapiens
aagggttgagagcca

SEQ ID NO: 4028239 - DNA, 17 bp, Homo sapiens
aagggttgagagccagt

SEQ ID NO: 4028240 - DNA, 17 bp, Homo sapiens
aagggtttgtggctggg

SEQ ID NO: 4028241 - DNA, 20 bp, Homo sapiens
aaggtagcccagcactgtga

SEQ ID NO: 4028242 - DNA, 23 bp, Homo sapiens
aaggtatggtggggatattttta

SEQ ID NO: 4028243 - DNA, 22 bp, Homo sapiens
aaggtattccttttgtgtacag

SEQ ID NO: 4028244 - DNA, 19 bp, Homo sapiens
aaggtatttcgaaactgcc

SEQ ID NO: 4028245 - DNA, 20 bp, Homo sapiens
aaggtatttcgaaactgcca

SEQ ID NO: 4028246 - DNA, 18 bp, Homo sapiens
aaggtattttgtagatgt

SEQ ID NO: 4028247 - DNA, 17 bp, Homo sapiens
aaggtcatttcttcagt

SEQ ID NO: 4028248 - DNA, 21 bp, Homo sapiens
aaggtccaacaagaatgcatt

SEQ ID NO: 4028249 - DNA, 15 bp, Homo sapiens
aaggtctcattcttc

SEQ ID NO: 4028250 - DNA, 16 bp, Homo sapiens
aaggtgagtgtgactt

SEQ ID NO: 4028251 - DNA, 20 bp, Homo sapiens
aaggtgagtttgagctgcct

SEQ ID NO: 4028252 - DNA, 21 bp, Homo sapiens
aaggtgagtttgagctgcctt

SEQ ID NO: 4028253 - DNA, 18 bp, Homo sapiens
aaggtgctgacggccagg

SEQ ID NO: 4028254 - DNA, 17 bp, Homo sapiens
aaggtggagtttctctg

SEQ ID NO: 4028255 - DNA, 14 bp, Homo sapiens
aaggtggccacagc

SEQ ID NO: 4028256 - DNA, 16 bp, Homo sapiens
aaggttaataaagtaa

SEQ ID NO: 4028257 - DNA, 20 bp, Homo sapiens
aaggttaatgttcatcatcc

SEQ ID NO: 4028258 - DNA, 22 bp, Homo sapiens
aaggttaatttttccttcctct

SEQ ID NO: 4028259 - DNA, 17 bp, Homo sapiens
aaggttaggatttaaca

SEQ ID NO: 4028260 - DNA, 18 bp, Homo sapiens
aaggttaggatttaacag

SEQ ID NO: 4028261 - DNA, 22 bp, Homo sapiens
aaggttgacaataaatgtgctt

SEQ ID NO: 4028262 - DNA, 16 bp, Homo sapiens
aaggttggagcccagg

SEQ ID NO: 4028263 - DNA, 16 bp, Homo sapiens
aaggttgggcagggtg

SEQ ID NO: 4028264 - DNA, 20 bp, Homo sapiens
aaggttttgtattttttaaa

SEQ ID NO: 4028265 - DNA, 20 bp, Homo sapiens
aagtaaactttttgttctgg

SEQ ID NO: 4028266 - DNA, 12 bp, Homo sapiens
aagtaaatacaa

SEQ ID NO: 4028267 - DNA, 21 bp, Homo sapiens
aagtaaatacaagactgttgt

SEQ ID NO: 4028268 - DNA, 12 bp, Homo sapiens
aagtaaatgcta

SEQ ID NO: 4028269 - DNA, 16 bp, Homo sapiens
aagtaactcatttgtt

SEQ ID NO: 4028270 - DNA, 23 bp, Homo sapiens
aagtaactgggattacaggcatg

SEQ ID NO: 4028271 - DNA, 21 bp, Homo sapiens
aagtaagaaagtgaagcaaat

SEQ ID NO: 4028272 - DNA, 15 bp, Homo sapiens
aagtaagaagacatg

SEQ ID NO: 4028273 - DNA, 21 bp, Homo sapiens
aagtgtaccaacataagtgtt

SEQ ID NO: 4028274 - DNA, 22 bp, Homo sapiens
aagtgtatttttcaataaagca

SEQ ID NO: 4028275 - DNA, 16 bp, Homo sapiens
aagtgtcaactctttg

SEQ ID NO: 4028276 - DNA, 14 bp, Homo sapiens
aagtgtccttcttg

SEQ ID NO: 4028277 - DNA, 19 bp, Homo sapiens
aagtgtgaccccactgcca

SEQ ID NO: 4028278 - DNA, 21 bp, Homo sapiens
aagtgtgaccccactgccaag

SEQ ID NO: 4028279 - DNA, 13 bp, Homo sapiens
aagtgtgagcaaa

SEQ ID NO: 4028280 - DNA, 18 bp, Homo sapiens
aagtgtgagcgccttggt

SEQ ID NO: 4028281 - DNA, 18 bp, Homo sapiens
aagtgtgagctcttccct

SEQ ID NO: 4028282 - DNA, 19 bp, Homo sapiens
aagtgtgagctcttccctt

SEQ ID NO: 4028283 - DNA, 18 bp, Homo sapiens
aagtgtgtggtagaaaca

SEQ ID NO: 4028284 - DNA, 16 bp, Homo sapiens
aagtgtgttgttgctt

SEQ ID NO: 4028285 - DNA, 23 bp, Homo sapiens
aagtgttggctaatgaagggaaa

SEQ ID NO: 4028286 - DNA, 20 bp, Homo sapiens
aagtgttgtaaatatttatg

SEQ ID NO: 4028287 - DNA, 15 bp, Homo sapiens
aagtgttgtgttcct

SEQ ID NO: 4028288 - DNA, 21 bp, Homo sapiens
aagtgttgtgttcctggctga

SEQ ID NO: 4028289 - DNA, 15 bp, Homo sapiens
aagtgtttcagctaa

SEQ ID NO: 4028290 - DNA, 19 bp, Homo sapiens
aagtgttttattttcaaat

SEQ ID NO: 4028291 - DNA, 18 bp, Homo sapiens
aagttaaacattgaagta

SEQ ID NO: 4028292 - DNA, 20 bp, Homo sapiens
aagttaattcacctatgtta

SEQ ID NO: 4028293 - DNA, 23 bp, Homo sapiens
aagttacacagaaatgctgctgg

SEQ ID NO: 4028294 - DNA, 22 bp, Homo sapiens
aagttacctgttatatatctct

SEQ ID NO: 4028295 - DNA, 18 bp, Homo sapiens
aagttactaggtaacttc

SEQ ID NO: 4028296 - DNA, 21 bp, Homo sapiens
aagttactaggtaacttcata

SEQ ID NO: 4028297 - DNA, 11 bp, Homo sapiens
aagttactttg

SEQ ID NO: 4028298 - DNA, 13 bp, Homo sapiens
aagttactttgta

SEQ ID NO: 4028299 - DNA, 15 bp, Homo sapiens
aagttagggggttct

SEQ ID NO: 4028300 - DNA, 19 bp, Homo sapiens
aagttataaatcaatgtca

SEQ ID NO: 4028301 - DNA, 15 bp, Homo sapiens
aagttattaacttta

SEQ ID NO: 4028302 - DNA, 16 bp, Homo sapiens
aagttatttttgtaca

SEQ ID NO: 4028303 - DNA, 17 bp, Homo sapiens
aagttatttttgtacat

SEQ ID NO: 4028304 - DNA, 19 bp, Homo sapiens
aagttatttttgtacatgt

SEQ ID NO: 4028305 - DNA, 17 bp, Homo sapiens
aagttcacaaaatggtg

SEQ ID NO: 4028306 - DNA, 15 bp, Homo sapiens
aagttcatattccat

SEQ ID NO: 4028307 - DNA, 23 bp, Homo sapiens
aagttcatattccatatttattc

SEQ ID NO: 4028308 - DNA, 14 bp, Homo sapiens
aagttcctttgggt

SEQ ID NO: 4028309 - DNA, 17 bp, Homo sapiens
aagttctagagaagagg

SEQ ID NO: 4028310 - DNA, 19 bp, Homo sapiens
aagttcttatgaggagggg

SEQ ID NO: 4028311 - DNA, 20 bp, Homo sapiens
aagttcttcacctctatcca

SEQ ID NO: 4028312 - DNA, 17 bp, Homo sapiens
aagttgaagctaagatt

SEQ ID NO: 4028313 - DNA, 21 bp, Homo sapiens
aagttgagatttttaagaact

SEQ ID NO: 4028314 - DNA, 18 bp, Homo sapiens
aagttgcagatgtattga

SEQ ID NO: 4028315 - DNA, 16 bp, Homo sapiens
aagttgcagtgagctg

SEQ ID NO: 4028316 - DNA, 19 bp, Homo sapiens
aagttgcattcctttgtct

SEQ ID NO: 4028317 - DNA, 12 bp, Homo sapiens
aagttgcattta

SEQ ID NO: 4028318 - DNA, 22 bp, Homo sapiens
aagttgcgacggagagaaaaaa

SEQ ID NO: 4028319 - DNA, 23 bp, Homo sapiens
aagttgcgacggagagaaaaaag

SEQ ID NO: 4028320 - DNA, 15 bp, Homo sapiens
aagttgtaaaaatga

SEQ ID NO: 4028321 - DNA, 18 bp, Homo sapiens
aagttgtaacttatattg

SEQ ID NO: 4028322 - DNA, 17 bp, Homo sapiens
aagttgtacaaatgtat

SEQ ID NO: 4028323 - DNA, 18 bp, Homo sapiens
aagttgttgtaacctgct

SEQ ID NO: 4028324 - DNA, 18 bp, Homo sapiens
aagtttaaaaaacagaaa

SEQ ID NO: 4028325 - DNA, 19 bp, Homo sapiens
aagtttaaaacagtattta

SEQ ID NO: 4028326 - DNA, 15 bp, Homo sapiens
aagtttaaagttgca

SEQ ID NO: 4028327 - DNA, 23 bp, Homo sapiens
aagtttacaacttgattttttca

SEQ ID NO: 4028328 - DNA, 18 bp, Homo sapiens
aagtttacaatcaaagga

SEQ ID NO: 4028329 - DNA, 19 bp, Homo sapiens
aagtttacattgtaaatag

SEQ ID NO: 4028330 - DNA, 23 bp, Homo sapiens
aagtttacatttttatttatgaa

SEQ ID NO: 4028331 - DNA, 14 bp, Homo sapiens
aagtttattcagta

SEQ ID NO: 4028332 - DNA, 19 bp, Homo sapiens
aagtttattcagtaaacaa

SEQ ID NO: 4028333 - DNA, 16 bp, Homo sapiens
aagtttattctcattt

SEQ ID NO: 4028334 - DNA, 19 bp, Homo sapiens
aagtttcaggatacatgtg

SEQ ID NO: 4028335 - DNA, 17 bp, Homo sapiens
aagtttcaggtgacatg

SEQ ID NO: 4028336 - DNA, 21 bp, Homo sapiens
aagtttcaggtgacatgtgaa

SEQ ID NO: 4028337 - DNA, 14 bp, Homo sapiens
aagtttcccttcct

SEQ ID NO: 4028338 - DNA, 19 bp, Homo sapiens
aagtttctagctagaaata

SEQ ID NO: 4028339 - DNA, 17 bp, Homo sapiens
aagtttctattctgtca

SEQ ID NO: 4028340 - DNA, 14 bp, Homo sapiens
aagtttgcagattt

SEQ ID NO: 4028341 - DNA, 19 bp, Homo sapiens
aagtttgtagttgttttaa

SEQ ID NO: 4028342 - DNA, 14 bp, Homo sapiens
aagtttgtgggggc

SEQ ID NO: 4028343 - DNA, 23 bp, Homo sapiens
aagttttcagaacctcttcccca

SEQ ID NO: 4028344 - DNA, 11 bp, Homo sapiens
aagttttcagg

SEQ ID NO: 4028345 - DNA, 22 bp, Homo sapiens
aagttttctgtagtcatttact

SEQ ID NO: 4028346 - DNA, 13 bp, Homo sapiens
aagttttgaaaag

SEQ ID NO: 4028347 - DNA, 15 bp, Homo sapiens
aagttttgaaaagct

SEQ ID NO: 4028348 - DNA, 23 bp, Homo sapiens
aagttttgggtatgtttaatctg

SEQ ID NO: 4028349 - DNA, 13 bp, Homo sapiens
aagttttgtaaaa

SEQ ID NO: 4028350 - DNA, 17 bp, Homo sapiens
aataaaaaaagaaaaaa

SEQ ID NO: 4028351 - DNA, 13 bp, Homo sapiens
aataaaaaatgga

SEQ ID NO: 4028352 - DNA, 19 bp, Homo sapiens
aataaaaaattatgacaat

SEQ ID NO: 4028353 - DNA, 21 bp, Homo sapiens
aataaaacagctgtctctaac

SEQ ID NO: 4028354 - DNA, 21 bp, Homo sapiens
aataaaagcagcatctgctaa

SEQ ID NO: 4028355 - DNA, 13 bp, Homo sapiens
aataaaagctgtg

SEQ ID NO: 4028356 - DNA, 14 bp, Homo sapiens
aataaaaggaaaag

SEQ ID NO: 4028357 - DNA, 13 bp, Homo sapiens
aataaaagtgact

SEQ ID NO: 4028358 - DNA, 22 bp, Homo sapiens
aataaaagtttacaacttgatt

SEQ ID NO: 4028359 - DNA, 13 bp, Homo sapiens
aataaaatgaaaa

SEQ ID NO: 4028360 - DNA, 14 bp, Homo sapiens
aataaaatgtgatt

SEQ ID NO: 4028361 - DNA, 21 bp, Homo sapiens
aataaaatgtgatttttctga

SEQ ID NO: 4028362 - DNA, 15 bp, Homo sapiens
aataaaatttctaag

SEQ ID NO: 4028363 - DNA, 21 bp, Homo sapiens
aataaacagcttcatgccttt

SEQ ID NO: 4028364 - DNA, 13 bp, Homo sapiens
aataaacatcctt

SEQ ID NO: 4028365 - DNA, 13 bp, Homo sapiens
aattgtatctagt

SEQ ID NO: 4028366 - DNA, 23 bp, Homo sapiens
aattgtatctagtgcagctgatt

SEQ ID NO: 4028367 - DNA, 16 bp, Homo sapiens
aattgtcacctctgtt

SEQ ID NO: 4028368 - DNA, 17 bp, Homo sapiens
aattgtctaaaatgtca

SEQ ID NO: 4028369 - DNA, 12 bp, Homo sapiens
aattgtctcttc

SEQ ID NO: 4028370 - DNA, 14 bp, Homo sapiens
aattgtgagggaca

SEQ ID NO: 4028371 - DNA, 12 bp, Homo sapiens
aattgtgctgcc

SEQ ID NO: 4028372 - DNA, 15 bp, Homo sapiens
aattgtgtaaaaaat

SEQ ID NO: 4028373 - DNA, 13 bp, Homo sapiens
aattgttgtttct

SEQ ID NO: 4028374 - DNA, 17 bp, Homo sapiens
aattgttgtttctttct

SEQ ID NO: 4028375 - DNA, 19 bp, Homo sapiens
aattgttgtttctttctag

SEQ ID NO: 4028376 - DNA, 20 bp, Homo sapiens
aattgttgtttctttctagt

SEQ ID NO: 4028377 - DNA, 15 bp, Homo sapiens
aattgtttgtcctca

SEQ ID NO: 4028378 - DNA, 19 bp, Homo sapiens
aattgttttaatctgaaat

SEQ ID NO: 4028379 - DNA, 19 bp, Homo sapiens
aattgttttacctgttctg

SEQ ID NO: 4028380 - DNA, 14 bp, Homo sapiens
aattgttttcttta

SEQ ID NO: 4028381 - DNA, 20 bp, Homo sapiens
aattgttttgcactttttta

SEQ ID NO: 4028382 - DNA, 17 bp, Homo sapiens
aattgtttttgaattta

SEQ ID NO: 4028383 - DNA, 22 bp, Homo sapiens
aattgtttttgaatttaaataa

SEQ ID NO: 4028384 - DNA, 12 bp, Homo sapiens
aatttaaaatta

SEQ ID NO: 4028385 - DNA, 19 bp, Homo sapiens
aatttaaaattaagtagaa

SEQ ID NO: 4028386 - DNA, 9 bp, Homo sapiens
aatttaaac

SEQ ID NO: 4028387 - DNA, 15 bp, Homo sapiens
aatttaaacacctcc

SEQ ID NO: 4028388 - DNA, 19 bp, Homo sapiens
aatttaaacacctcctcat

SEQ ID NO: 4028389 - DNA, 20 bp, Homo sapiens
aatttaaacatttgttcctg

SEQ ID NO: 4028390 - DNA, 21 bp, Homo sapiens
aatttaaacatttgttcctgg

SEQ ID NO: 4028391 - DNA, 18 bp, Homo sapiens
aatttaaagggtgtactt

SEQ ID NO: 4028392 - DNA, 19 bp, Homo sapiens
aatttaaagggtgtactta

SEQ ID NO: 4028393 - DNA, 13 bp, Homo sapiens
aatttaaataaag

SEQ ID NO: 4028394 - DNA, 16 bp, Homo sapiens
aatttaaatataattc

SEQ ID NO: 4028395 - DNA, 23 bp, Homo sapiens
aatttaaatataattctgtaaat

SEQ ID NO: 4028396 - DNA, 11 bp, Homo sapiens
aatttaagcat

SEQ ID NO: 4028397 - DNA, 12 bp, Homo sapiens
aatttaagcatt

SEQ ID NO: 4028398 - DNA, 16 bp, Homo sapiens
aatttaagcattgttt

SEQ ID NO: 4028399 - DNA, 18 bp, Homo sapiens
acttgaagggccagagcc

SEQ ID NO: 4028400 - DNA, 16 bp, Homo sapiens
acttgacatgtagctt

SEQ ID NO: 4028401 - DNA, 18 bp, Homo sapiens
acttgacatgtagcttct

SEQ ID NO: 4028402 - DNA, 12 bp, Homo sapiens
acttgacctcat

SEQ ID NO: 4028403 - DNA, 18 bp, Homo sapiens
acttgactccatttcatc

SEQ ID NO: 4028404 - DNA, 17 bp, Homo sapiens
acttgacttttaaggct

SEQ ID NO: 4028405 - DNA, 17 bp, Homo sapiens
acttgagaacttgacaa

SEQ ID NO: 4028406 - DNA, 12 bp, Homo sapiens
acttgagaggat

SEQ ID NO: 4028407 - DNA, 15 bp, Homo sapiens
acttgagggcccaga

SEQ ID NO: 4028408 - DNA, 16 bp, Homo sapiens
acttgagggcccagag

SEQ ID NO: 4028409 - DNA, 19 bp, Homo sapiens
acttgagggcccagagcag

SEQ ID NO: 4028410 - DNA, 22 bp, Homo sapiens
acttgagtgtaatgtttgttac

SEQ ID NO: 4028411 - DNA, 15 bp, Homo sapiens
acttgagtgttcctt

SEQ ID NO: 4028412 - DNA, 22 bp, Homo sapiens
acttgagttggagtactatatt

SEQ ID NO: 4028413 - DNA, 24 bp, Homo sapiens
acttgagttggagtactatattta

SEQ ID NO: 4028414 - DNA, 23 bp, Homo sapiens
acttgatgtacataactcctgtc

SEQ ID NO: 4028415 - DNA, 16 bp, Homo sapiens
acttgatgtgccattt

SEQ ID NO: 4028416 - DNA, 18 bp, Homo sapiens
acttgatttgcatggatt

SEQ ID NO: 4028417 - DNA, 20 bp, Homo sapiens
acttgcagctgatgttggaa

SEQ ID NO: 4028418 - DNA, 14 bp, Homo sapiens
acttgcatgaagag

SEQ ID NO: 4028419 - DNA, 21 bp, Homo sapiens
acttgcatgaagagaagcaat

SEQ ID NO: 4028420 - DNA, 15 bp, Homo sapiens
acttgcatggagcag

SEQ ID NO: 4028421 - DNA, 11 bp, Homo sapiens
acttgcatttc

SEQ ID NO: 4028422 - DNA, 13 bp, Homo sapiens
acttgctcccaac

SEQ ID NO: 4028423 - DNA, 16 bp, Homo sapiens
acttgcttaaatttct

SEQ ID NO: 4028424 - DNA, 16 bp, Homo sapiens
acttggaatttgtaac

SEQ ID NO: 4028425 - DNA, 23 bp, Homo sapiens
acttggaatttgtaacctcagct

SEQ ID NO: 4028426 - DNA, 22 bp, Homo sapiens
acttggacaggagtcagtgtct

SEQ ID NO: 4028427 - DNA, 15 bp, Homo sapiens
acttggattctctaa

SEQ ID NO: 4028428 - DNA, 20 bp, Homo sapiens
acttggatttagtttcagta

SEQ ID NO: 4028429 - DNA, 11 bp, Homo sapiens
acttggcactt

SEQ ID NO: 4028430 - DNA, 23 bp, Homo sapiens
acttggggagttaagacctggca

SEQ ID NO: 4028431 - DNA, 19 bp, Homo sapiens
acttgggggttcaggcccg

SEQ ID NO: 4028432 - DNA, 22 bp, Homo sapiens
acttggtttgttatatcaggga

SEQ ID NO: 4028433 - DNA, 16 bp, Homo sapiens
acttgtaaatacacca

SEQ ID NO: 4028434 - DNA, 14 bp, Homo sapiens
acttgtatatttgt

SEQ ID NO: 4028435 - DNA, 15 bp, Homo sapiens
acttgtatatttgta

SEQ ID NO: 4028436 - DNA, 16 bp, Homo sapiens
acttgtatatttgtac

SEQ ID NO: 4028437 - DNA, 18 bp, Homo sapiens
acttgtatatttgtacaa

SEQ ID NO: 4028438 - DNA, 22 bp, Homo sapiens
acttgtatctgtccgtggaaaa

SEQ ID NO: 4028439 - DNA, 17 bp, Homo sapiens
acttgtcaatatttaaa

SEQ ID NO: 4028440 - DNA, 20 bp, Homo sapiens
acttgtcaatatttaaacat

SEQ ID NO: 4028441 - DNA, 15 bp, Homo sapiens
acttgtcggctccag

SEQ ID NO: 4028442 - DNA, 23 bp, Homo sapiens
acttgtctttctggggtttttct

SEQ ID NO: 4028443 - DNA, 15 bp, Homo sapiens
acttgtctttttctg

SEQ ID NO: 4028444 - DNA, 22 bp, Homo sapiens
acttgtgctgatcgtgctaaat

SEQ ID NO: 4028445 - DNA, 21 bp, Homo sapiens
acttgtgctttcagttagcct

SEQ ID NO: 4028446 - DNA, 21 bp, Homo sapiens
acttgtgtttgcttaaacaaa

SEQ ID NO: 4028447 - DNA, 15 bp, Homo sapiens
acttgttccagctct

SEQ ID NO: 4028448 - DNA, 12 bp, Homo sapiens
acttgttcttcc

SEQ ID NO: 4028449 - DNA, 19 bp, Homo sapiens
acttgttcttccaaagcag

SEQ ID NO: 4028450 - DNA, 18 bp, Homo sapiens
acttgtttcatctggttt

SEQ ID NO: 4028451 - DNA, 19 bp, Homo sapiens
acttgtttctctgttgtaa

SEQ ID NO: 4028452 - DNA, 17 bp, Homo sapiens
acttgtttgtcttccat

SEQ ID NO: 4028453 - DNA, 15 bp, Homo sapiens
actttaaaagaaaat

SEQ ID NO: 4028454 - DNA, 16 bp, Homo sapiens
actttaaatttaaagt

SEQ ID NO: 4028455 - DNA, 15 bp, Homo sapiens
actttaagcactaca

SEQ ID NO: 4028456 - DNA, 17 bp, Homo sapiens
actttaaggatttgaac

SEQ ID NO: 4028457 - DNA, 21 bp, Homo sapiens
actttagaagtgcatttctga

SEQ ID NO: 4028458 - DNA, 20 bp, Homo sapiens
actttagctagtatcttcaa

SEQ ID NO: 4028459 - DNA, 16 bp, Homo sapiens
actttagcttttcctt

SEQ ID NO: 4028460 - DNA, 15 bp, Homo sapiens
actttagggctgtaa

SEQ ID NO: 4028461 - DNA, 22 bp, Homo sapiens
actttagggctgtaaaatgcat

SEQ ID NO: 4028462 - DNA, 23 bp, Homo sapiens
actttagggctgtaaaatgcatg

SEQ ID NO: 4028463 - DNA, 12 bp, Homo sapiens
actttattaaat

SEQ ID NO: 4028464 - DNA, 18 bp, Homo sapiens
actttatttatttctagt

SEQ ID NO: 4028465 - DNA, 12 bp, Homo sapiens
actttatttctg

SEQ ID NO: 4028466 - DNA, 13 bp, Homo sapiens
actttattttctg

SEQ ID NO: 4028467 - DNA, 20 bp, Homo sapiens
actttcaaaattaaatctgt

SEQ ID NO: 4028468 - DNA, 13 bp, Homo sapiens
actttcactttga

SEQ ID NO: 4028469 - DNA, 17 bp, Homo sapiens
actttcagtaaacataa

SEQ ID NO: 4028470 - DNA, 23 bp, Homo sapiens
actttcatcctgactctgccccc

SEQ ID NO: 4028471 - DNA, 20 bp, Homo sapiens
actttcatctaccttttctg

SEQ ID NO: 4028472 - DNA, 18 bp, Homo sapiens
actttcattccttcagat

SEQ ID NO: 4028473 - DNA, 20 bp, Homo sapiens
actttcattccttcagattt

SEQ ID NO: 4028474 - DNA, 18 bp, Homo sapiens
actttccacttcttcctt

SEQ ID NO: 4028475 - DNA, 21 bp, Homo sapiens
actttcccaggttctgtttat

SEQ ID NO: 4028476 - DNA, 18 bp, Homo sapiens
actttcctccacctccca

SEQ ID NO: 4028477 - DNA, 14 bp, Homo sapiens
actttcctgcaact

SEQ ID NO: 4028478 - DNA, 22 bp, Homo sapiens
actttctatagcagattgtgta

SEQ ID NO: 4028479 - DNA, 13 bp, Homo sapiens
actttctgctttg

SEQ ID NO: 4028480 - DNA, 15 bp, Homo sapiens
actttctgttttctg

SEQ ID NO: 4028481 - DNA, 16 bp, Homo sapiens
actttcttattctgta

SEQ ID NO: 4028482 - DNA, 15 bp, Homo sapiens
actttcttttctgga

SEQ ID NO: 4028483 - DNA, 18 bp, Homo sapiens
actttgaaaggagatgtc

SEQ ID NO: 4028484 - DNA, 21 bp, Homo sapiens
actttgcactgatatatcatg

SEQ ID NO: 4028485 - DNA, 20 bp, Homo sapiens
actttgctctcaattaaagt

SEQ ID NO: 4028486 - DNA, 19 bp, Homo sapiens
actttgcttcccctccagg

SEQ ID NO: 4028487 - DNA, 18 bp, Homo sapiens
actttgcttgagaatcct

SEQ ID NO: 4028488 - DNA, 11 bp, Homo sapiens
actttgcttgc

SEQ ID NO: 4028489 - DNA, 23 bp, Homo sapiens
actttggagagtgagctacagag

SEQ ID NO: 4028490 - DNA, 13 bp, Homo sapiens
actttggctgatt

SEQ ID NO: 4028491 - DNA, 14 bp, Homo sapiens
actttgggaggcca

SEQ ID NO: 4028492 - DNA, 21 bp, Homo sapiens
actttgggaggccgaggcggg

SEQ ID NO: 4028493 - DNA, 15 bp, Homo sapiens
actttggggaaggga

SEQ ID NO: 4028494 - DNA, 19 bp, Homo sapiens
actttggttctctccagga

SEQ ID NO: 4028495 - DNA, 15 bp, Homo sapiens
actttgtaatttttg

SEQ ID NO: 4028496 - DNA, 15 bp, Homo sapiens
actttgttctttagg

SEQ ID NO: 4028497 - DNA, 17 bp, Homo sapiens
actttgttgcaagatgt

SEQ ID NO: 4028498 - DNA, 22 bp, Homo sapiens
actttgttgcaagatgtgaatt

SEQ ID NO: 4028499 - DNA, 14 bp, Homo sapiens
acttttaaggcagt

SEQ ID NO: 4028500 - DNA, 15 bp, Homo sapiens
acttttaatcagtga

SEQ ID NO: 4028501 - DNA, 13 bp, Homo sapiens
acttttaattcat

SEQ ID NO: 4028502 - DNA, 22 bp, Homo sapiens
actggtgaactgagctgggcag

SEQ ID NO: 4028503 - DNA, 19 bp, Homo sapiens
actggtgccaaaaccaggc

SEQ ID NO: 4028504 - DNA, 20 bp, Homo sapiens
actggtgccaaaaccaggcc

SEQ ID NO: 4028505 - DNA, 20 bp, Homo sapiens
actggtggcccgacagcctg

SEQ ID NO: 4028506 - DNA, 21 bp, Homo sapiens
actggtggcccgacagcctgg

SEQ ID NO: 4028507 - DNA, 23 bp, Homo sapiens
actggtggcccgacagcctggca

SEQ ID NO: 4028508 - DNA, 17 bp, Homo sapiens
actggtgggcagctgag

SEQ ID NO: 4028509 - DNA, 17 bp, Homo sapiens
actggtggtttttgctc

SEQ ID NO: 4028510 - DNA, 17 bp, Homo sapiens
actggtttacaggccct

SEQ ID NO: 4028511 - DNA, 18 bp, Homo sapiens
actggtttacaggccctg

SEQ ID NO: 4028512 - DNA, 22 bp, Homo sapiens
actggtttacaggccctgctcc

SEQ ID NO: 4028513 - DNA, 22 bp, Homo sapiens
actggtttgttgcagccaaaga

SEQ ID NO: 4028514 - DNA, 14 bp, Homo sapiens
actggttttctgcc

SEQ ID NO: 4028515 - DNA, 17 bp, Homo sapiens
actgtaaatacgaaccc

SEQ ID NO: 4028516 - DNA, 17 bp, Homo sapiens
actgtaaatatgaatct

SEQ ID NO: 4028517 - DNA, 17 bp, Homo sapiens
actgtaagaagagccat

SEQ ID NO: 4028518 - DNA, 21 bp, Homo sapiens
actgtaatacgtagctctctt

SEQ ID NO: 4028519 - DNA, 16 bp, Homo sapiens
actgtacaaagtagaa

SEQ ID NO: 4028520 - DNA, 14 bp, Homo sapiens
actgtacatttaaa

SEQ ID NO: 4028521 - DNA, 15 bp, Homo sapiens
actgtacatttaaaa

SEQ ID NO: 4028522 - DNA, 17 bp, Homo sapiens
actgtactgacttgagg

SEQ ID NO: 4028523 - DNA, 18 bp, Homo sapiens
actgtacttaataaattc

SEQ ID NO: 4028524 - DNA, 16 bp, Homo sapiens
actgtagattgcttct

SEQ ID NO: 4028525 - DNA, 21 bp, Homo sapiens
actgtagattgcttctgtagt

SEQ ID NO: 4028526 - DNA, 18 bp, Homo sapiens
actgtagccacagctgct

SEQ ID NO: 4028527 - DNA, 15 bp, Homo sapiens
actgtaggcacactt

SEQ ID NO: 4028528 - DNA, 21 bp, Homo sapiens
actgtaggtatgatctcttct

SEQ ID NO: 4028529 - DNA, 17 bp, Homo sapiens
actgtataaactttttt

SEQ ID NO: 4028530 - DNA, 13 bp, Homo sapiens
actgtataaatag

SEQ ID NO: 4028531 - DNA, 17 bp, Homo sapiens
actgtataaataggaga

SEQ ID NO: 4028532 - DNA, 22 bp, Homo sapiens
actgtataaataggagaggatg

SEQ ID NO: 4028533 - DNA, 22 bp, Homo sapiens
actgtataagtactagatgcat

SEQ ID NO: 4028534 - DNA, 15 bp, Homo sapiens
actgtatagacatgc

SEQ ID NO: 4028535 - DNA, 12 bp, Homo sapiens
actgtatgctca

SEQ ID NO: 4028536 - DNA, 22 bp, Homo sapiens
actgtatggaaacactgatttt

SEQ ID NO: 4028537 - DNA, 21 bp, Homo sapiens
actgtcaaggctgcttagaat

SEQ ID NO: 4028538 - DNA, 15 bp, Homo sapiens
actgtcaataaacag

SEQ ID NO: 4028539 - DNA, 21 bp, Homo sapiens
actgtcaataaacagcttcat

SEQ ID NO: 4028540 - DNA, 15 bp, Homo sapiens
actgtcaccctccac

SEQ ID NO: 4028541 - DNA, 17 bp, Homo sapiens
actgtcaccctccacct

SEQ ID NO: 4028542 - DNA, 20 bp, Homo sapiens
actgtcacggggttccctcc

SEQ ID NO: 4028543 - DNA, 15 bp, Homo sapiens
actgtcactcattgc

SEQ ID NO: 4028544 - DNA, 16 bp, Homo sapiens
actgtcactgtttctc

SEQ ID NO: 4028545 - DNA, 18 bp, Homo sapiens
actgtcactttgctctgg

SEQ ID NO: 4028546 - DNA, 23 bp, Homo sapiens
actgtccctatctattaaagtga

SEQ ID NO: 4028547 - DNA, 20 bp, Homo sapiens
actgtcctaccagttgccct

SEQ ID NO: 4028548 - DNA, 19 bp, Homo sapiens
actgtcctctcccctccag

SEQ ID NO: 4028549 - DNA, 20 bp, Homo sapiens
actgtcctctcccctccagc

SEQ ID NO: 4028550 - DNA, 12 bp, Homo sapiens
actgtcctgtcc

SEQ ID NO: 4028551 - DNA, 14 bp, Homo sapiens
actgtcctttcctt

SEQ ID NO: 4028552 - DNA, 17 bp, Homo sapiens
actgtcggagaggctgt

SEQ ID NO: 4028553 - DNA, 21 bp, Homo sapiens
actgtcggagaggctgtctgg

SEQ ID NO: 4028554 - DNA, 16 bp, Homo sapiens
actgtctaactttaga

SEQ ID NO: 4028555 - DNA, 18 bp, Homo sapiens
actgtctagcacttcctt

SEQ ID NO: 4028556 - DNA, 18 bp, Homo sapiens
actgtctcagtttcactt

SEQ ID NO: 4028557 - DNA, 17 bp, Homo sapiens
actgtctttaaaagaga

SEQ ID NO: 4028558 - DNA, 23 bp, Homo sapiens
actgtgaagttacatgcataaaa

SEQ ID NO: 4028559 - DNA, 14 bp, Homo sapiens
actgtgacatctct

SEQ ID NO: 4028560 - DNA, 23 bp, Homo sapiens
actgtgactctttttagggccag

SEQ ID NO: 4028561 - DNA, 23 bp, Homo sapiens
actgtgatcaggctatgtatgga

SEQ ID NO: 4028562 - DNA, 14 bp, Homo sapiens
actgtgcactgccc

SEQ ID NO: 4028563 - DNA, 15 bp, Homo sapiens
actgtgcactgccct

SEQ ID NO: 4028564 - DNA, 16 bp, Homo sapiens
actgtgcactgccctg

SEQ ID NO: 4028565 - DNA, 12 bp, Homo sapiens
actgtgcagaat

SEQ ID NO: 4028566 - DNA, 14 bp, Homo sapiens
actgtgccagaggc

SEQ ID NO: 4028567 - DNA, 17 bp, Homo sapiens
actgtgccagaggccag

SEQ ID NO: 4028568 - DNA, 20 bp, Homo sapiens
actgtggaaggcctccctct

SEQ ID NO: 4028569 - DNA, 21 bp, Homo sapiens
actgtggatacccttaccctt

SEQ ID NO: 4028570 - DNA, 16 bp, Homo sapiens
actgtgtatgtacata

SEQ ID NO: 4028571 - DNA, 20 bp, Homo sapiens
actgtgtatgtacatatata

SEQ ID NO: 4028572 - DNA, 17 bp, Homo sapiens
actgtgtggactgtgat

SEQ ID NO: 4028573 - DNA, 18 bp, Homo sapiens
actgtgtggactgtgatg

SEQ ID NO: 4028574 - DNA, 14 bp, Homo sapiens
actgtgtttcaagt

SEQ ID NO: 4028575 - DNA, 15 bp, Homo sapiens
actgtgtttcaagtt

SEQ ID NO: 4028576 - DNA, 18 bp, Homo sapiens
actgttaaccatttaagt

SEQ ID NO: 4028577 - DNA, 17 bp, Homo sapiens
acttcctgctgcaccct

SEQ ID NO: 4028578 - DNA, 22 bp, Homo sapiens
acttcctgctgcaccctgcgcc

SEQ ID NO: 4028579 - DNA, 18 bp, Homo sapiens
acttcctgtccagctcca

SEQ ID NO: 4028580 - DNA, 14 bp, Homo sapiens
acttccttgagaca

SEQ ID NO: 4028581 - DNA, 14 bp, Homo sapiens
acttctaatttata

SEQ ID NO: 4028582 - DNA, 17 bp, Homo sapiens
acttctcactaatttgt

SEQ ID NO: 4028583 - DNA, 22 bp, Homo sapiens
acttctccagacccaccacacc

SEQ ID NO: 4028584 - DNA, 12 bp, Homo sapiens
acttctccccag

SEQ ID NO: 4028585 - DNA, 21 bp, Homo sapiens
acttctctgcctttgacattt

SEQ ID NO: 4028586 - DNA, 21 bp, Homo sapiens
acttctcttgttaggtaattt

SEQ ID NO: 4028587 - DNA, 16 bp, Homo sapiens
acttctgactcttccc

SEQ ID NO: 4028588 - DNA, 18 bp, Homo sapiens
acttctgactcttcccca

SEQ ID NO: 4028589 - DNA, 14 bp, Homo sapiens
acttctgctggcat

SEQ ID NO: 4028590 - DNA, 11 bp, Homo sapiens
acttctgtggg

SEQ ID NO: 4028591 - DNA, 15 bp, Homo sapiens
acttctgtgggcccc

SEQ ID NO: 4028592 - DNA, 16 bp, Homo sapiens
acttctgtgggcccct

SEQ ID NO: 4028593 - DNA, 12 bp, Homo sapiens
acttcttaaata

SEQ ID NO: 4028594 - DNA, 19 bp, Homo sapiens
acttcttaaatatctttta

SEQ ID NO: 4028595 - DNA, 20 bp, Homo sapiens
acttcttaaatatcttttat

SEQ ID NO: 4028596 - DNA, 20 bp, Homo sapiens
acttcttatggaattgattt

SEQ ID NO: 4028597 - DNA, 23 bp, Homo sapiens
acttcttatggaattgatttgca

SEQ ID NO: 4028598 - DNA, 11 bp, Homo sapiens
acttcttcctg

SEQ ID NO: 4028599 - DNA, 18 bp, Homo sapiens
acttcttcctgtgaagtt

SEQ ID NO: 4028600 - DNA, 18 bp, Homo sapiens
acttcttctcttagattc

SEQ ID NO: 4028601 - DNA, 20 bp, Homo sapiens
acttcttctgtccaagcaga

SEQ ID NO: 4028602 - DNA, 20 bp, Homo sapiens
acttcttgaaggtgctgacg

SEQ ID NO: 4028603 - DNA, 22 bp, Homo sapiens
acttcttttttcaaaagaaagt

SEQ ID NO: 4028604 - DNA, 23 bp, Homo sapiens
acttcttttttcaaaagaaagtc

SEQ ID NO: 4028605 - DNA, 19 bp, Homo sapiens
acttgaaagattttattgt

SEQ ID NO: 4028606 - DNA, 13 bp, Homo sapiens
acttgaaagcatc

SEQ ID NO: 4028607 - DNA, 18 bp, Homo sapiens
acttgaaagcatccatgt

SEQ ID NO: 4028608 - DNA, 16 bp, Homo sapiens
actgcacccagctcca

SEQ ID NO: 4028609 - DNA, 17 bp, Homo sapiens
actgcacccagctccag

SEQ ID NO: 4028610 - DNA, 19 bp, Homo sapiens
actgcacccagctccaggg

SEQ ID NO: 4028611 - DNA, 16 bp, Homo sapiens
actgcaccgcctcagg

SEQ ID NO: 4028612 - DNA, 17 bp, Homo sapiens
actgcaccgcctcaggg

SEQ ID NO: 4028613 - DNA, 13 bp, Homo sapiens
actgcactccagc

SEQ ID NO: 4028614 - DNA, 22 bp, Homo sapiens
actgcagagtaaattgctctgt

SEQ ID NO: 4028615 - DNA, 15 bp, Homo sapiens
actgcagcacctcca

SEQ ID NO: 4028616 - DNA, 18 bp, Homo sapiens
actgcagcacctccaggc

SEQ ID NO: 4028617 - DNA, 22 bp, Homo sapiens
actgcagcacctccaggcctgt

SEQ ID NO: 4028618 - DNA, 23 bp, Homo sapiens
actgcaggagcagtttgccaccc

SEQ ID NO: 4028619 - DNA, 14 bp, Homo sapiens
actgcatggaccta

SEQ ID NO: 4028620 - DNA, 20 bp, Homo sapiens
actgcatggacctaacattc

SEQ ID NO: 4028621 - DNA, 21 bp, Homo sapiens
actgcatgtaccatttgcatg

SEQ ID NO: 4028622 - DNA, 21 bp, Homo sapiens
actgccaaagggaaatatcat

SEQ ID NO: 4028623 - DNA, 17 bp, Homo sapiens
actgccaggccagcctc

SEQ ID NO: 4028624 - DNA, 19 bp, Homo sapiens
actgccaggccagcctccg

SEQ ID NO: 4028625 - DNA, 13 bp, Homo sapiens
actgccaggctgc

SEQ ID NO: 4028626 - DNA, 21 bp, Homo sapiens
actgccatgtactagttttag

SEQ ID NO: 4028627 - DNA, 19 bp, Homo sapiens
actgccccacggagacaga

SEQ ID NO: 4028628 - DNA, 14 bp, Homo sapiens
actgcccccactgt

SEQ ID NO: 4028629 - DNA, 16 bp, Homo sapiens
actgcccgagctggtg

SEQ ID NO: 4028630 - DNA, 18 bp, Homo sapiens
actgcccgagctggtgca

SEQ ID NO: 4028631 - DNA, 19 bp, Homo sapiens
actgcccgagctggtgcat

SEQ ID NO: 4028632 - DNA, 20 bp, Homo sapiens
actgcccgagctggtgcatt

SEQ ID NO: 4028633 - DNA, 21 bp, Homo sapiens
actgcccgagctggtgcatta

SEQ ID NO: 4028634 - DNA, 19 bp, Homo sapiens
actgccctaagcccccagg

SEQ ID NO: 4028635 - DNA, 20 bp, Homo sapiens
actgccctaagcccccaggg

SEQ ID NO: 4028636 - DNA, 21 bp, Homo sapiens
actgccctaagcccccagggc

SEQ ID NO: 4028637 - DNA, 13 bp, Homo sapiens
actgccctgttca

SEQ ID NO: 4028638 - DNA, 12 bp, Homo sapiens
actgcctcccat

SEQ ID NO: 4028639 - DNA, 23 bp, Homo sapiens
actgcctcccatccttccctcat

SEQ ID NO: 4028640 - DNA, 21 bp, Homo sapiens
actgcctccccaaggccccct

SEQ ID NO: 4028641 - DNA, 13 bp, Homo sapiens
actgcctccccca

SEQ ID NO: 4028642 - DNA, 16 bp, Homo sapiens
actgccttctcctctc

SEQ ID NO: 4028643 - DNA, 19 bp, Homo sapiens
actgcgatcttcagagcag

SEQ ID NO: 4028644 - DNA, 15 bp, Homo sapiens
actgctaaattctat

SEQ ID NO: 4028645 - DNA, 16 bp, Homo sapiens
actgctacagcaattt

SEQ ID NO: 4028646 - DNA, 22 bp, Homo sapiens
actgctactgtaattttatatg

SEQ ID NO: 4028647 - DNA, 20 bp, Homo sapiens
actgctaggcgagtgccagg

SEQ ID NO: 4028648 - DNA, 16 bp, Homo sapiens
actgctcaagaagaca

SEQ ID NO: 4028649 - DNA, 23 bp, Homo sapiens
actgctccatttataaccccagc

SEQ ID NO: 4028650 - DNA, 18 bp, Homo sapiens
actgctcccatcattcct

SEQ ID NO: 4028651 - DNA, 20 bp, Homo sapiens
actgctccccagccctggct

SEQ ID NO: 4028652 - DNA, 21 bp, Homo sapiens
actgctccccagccctggctc

SEQ ID NO: 4028653 - DNA, 19 bp, Homo sapiens
actgctgcagattagttct

SEQ ID NO: 4028654 - DNA, 13 bp, Homo sapiens
actgctggctgcc

SEQ ID NO: 4028655 - DNA, 14 bp, Homo sapiens
actgctggctgcct

SEQ ID NO: 4028656 - DNA, 15 bp, Homo sapiens
actgctgtacccaga

SEQ ID NO: 4028657 - DNA, 23 bp, Homo sapiens
actgctgtcgttgttgtggaagc

SEQ ID NO: 4028658 - DNA, 22 bp, Homo sapiens
actgctgtgaaccctggggcct

SEQ ID NO: 4028659 - DNA, 19 bp, Homo sapiens
actgcttctaagatgccag

SEQ ID NO: 4028660 - DNA, 20 bp, Homo sapiens
actgcttgatgaagcaagga

SEQ ID NO: 4028661 - DNA, 23 bp, Homo sapiens
actgcttgattttaatacattga

SEQ ID NO: 4028662 - DNA, 17 bp, Homo sapiens
actggaaaggggagagc

SEQ ID NO: 4028663 - DNA, 23 bp, Homo sapiens
actggaaaggggagagcctgctg

SEQ ID NO: 4028664 - DNA, 15 bp, Homo sapiens
actggaacatggcta

SEQ ID NO: 4028665 - DNA, 16 bp, Homo sapiens
actggaaccagggaga

SEQ ID NO: 4028666 - DNA, 18 bp, Homo sapiens
actggaaggggaagggac

SEQ ID NO: 4028667 - DNA, 14 bp, Homo sapiens
actggactcacatt

SEQ ID NO: 4028668 - DNA, 15 bp, Homo sapiens
actggaggaggcctg

SEQ ID NO: 4028669 - DNA, 20 bp, Homo sapiens
actggaggaggcctgtccca

SEQ ID NO: 4028670 - DNA, 21 bp, Homo sapiens
actggaggaggcctgtcccaa

SEQ ID NO: 4028671 - DNA, 15 bp, Homo sapiens
actggaggcccctgg

SEQ ID NO: 4028672 - DNA, 21 bp, Homo sapiens
actggaggcccctggagccag

SEQ ID NO: 4028673 - DNA, 19 bp, Homo sapiens
actggaggttgaagccaag

SEQ ID NO: 4028674 - DNA, 15 bp, Homo sapiens
actggagtcagatga

SEQ ID NO: 4028675 - DNA, 18 bp, Homo sapiens
actggagtgcagggagga

SEQ ID NO: 4028676 - DNA, 15 bp, Homo sapiens
actggagttccttat

SEQ ID NO: 4028677 - DNA, 17 bp, Homo sapiens
actggatgcagaaacag

SEQ ID NO: 4028678 - DNA, 17 bp, Homo sapiens
actggattaaaacaatt

SEQ ID NO: 4028679 - DNA, 20 bp, Homo sapiens
actggcactgaattaatcat

SEQ ID NO: 4028680 - DNA, 23 bp, Homo sapiens
actggcactggtggtttttgctc

SEQ ID NO: 4028681 - DNA, 11 bp, Homo sapiens
actggccaggg

SEQ ID NO: 4028682 - DNA, 18 bp, Homo sapiens
actggctagagtcctcac

SEQ ID NO: 4028683 - DNA, 21 bp, Homo sapiens
actggctagagtcctcactcc

SEQ ID NO: 4028684 - DNA, 15 bp, Homo sapiens
actggctggcctgag

SEQ ID NO: 4028685 - DNA, 16 bp, Homo sapiens
actggctggcctgagc

SEQ ID NO: 4028686 - DNA, 15 bp, Homo sapiens
actgatgacttacta

SEQ ID NO: 4028687 - DNA, 15 bp, Homo sapiens
actgatgattttcct

SEQ ID NO: 4028688 - DNA, 11 bp, Homo sapiens
actgatgctgc

SEQ ID NO: 4028689 - DNA, 20 bp, Homo sapiens
actgatgctgcccctcatct

SEQ ID NO: 4028690 - DNA, 15 bp, Homo sapiens
actgattattttctt

SEQ ID NO: 4028691 - DNA, 14 bp, Homo sapiens
actgattctgtgta

SEQ ID NO: 4028692 - DNA, 13 bp, Homo sapiens
actgatttaattt

SEQ ID NO: 4028693 - DNA, 20 bp, Homo sapiens
actgatttcacaacagatca

SEQ ID NO: 4028694 - DNA, 14 bp, Homo sapiens
actgattttgtaaa

SEQ ID NO: 4028695 - DNA, 13 bp, Homo sapiens
actgcaaactttt

SEQ ID NO: 4028696 - DNA, 18 bp, Homo sapiens
actgcaaacttttttata

SEQ ID NO: 4028697 - DNA, 24 bp, Homo sapiens
actgcaaacttttttatatctttt

SEQ ID NO: 4028698 - DNA, 14 bp, Homo sapiens
actgcaaattttaa

SEQ ID NO: 4028699 - DNA, 18 bp, Homo sapiens
actgcaacaggcttgtgc

SEQ ID NO: 4028700 - DNA, 16 bp, Homo sapiens
actgcaataacttctg

SEQ ID NO: 4028701 - DNA, 16 bp, Homo sapiens
actgcaatagagactg

SEQ ID NO: 4028702 - DNA, 19 bp, Homo sapiens
actgcaatagagactgtag

SEQ ID NO: 4028703 - DNA, 22 bp, Homo sapiens
actgcaatagagactgtagatt

SEQ ID NO: 4028704 - DNA, 18 bp, Homo sapiens
actgcacagtgcatctca

SEQ ID NO: 4028705 - DNA, 23 bp, Homo sapiens
actgcacagtgcatctcagccca

SEQ ID NO: 4028706 - DNA, 17 bp, Homo sapiens
actgcacatgaaagttt

SEQ ID NO: 4028707 - DNA, 14 bp, Homo sapiens
actactctttgatt

SEQ ID NO: 4028708 - DNA, 15 bp, Homo sapiens
actactctttgattt

SEQ ID NO: 4028709 - DNA, 23 bp, Homo sapiens
actactgacatgtggggccaggt

SEQ ID NO: 4028710 - DNA, 19 bp, Homo sapiens
actactgaccagacaagct

SEQ ID NO: 4028711 - DNA, 15 bp, Homo sapiens
actactgcagcacct

SEQ ID NO: 4028712 - DNA, 23 bp, Homo sapiens
actactgggtgtcatttcattcc

SEQ ID NO: 4028713 - DNA, 22 bp, Homo sapiens
actactgttaggaacagcagtg

SEQ ID NO: 4028714 - DNA, 23 bp, Homo sapiens
actactgttaggaacagcagtgt

SEQ ID NO: 4028715 - DNA, 21 bp, Homo sapiens
actactttgccttcttttgta

SEQ ID NO: 4028716 - DNA, 16 bp, Homo sapiens
actagaactctccatc

SEQ ID NO: 4028717 - DNA, 23 bp, Homo sapiens
actagaagggccagtcctgcctg

SEQ ID NO: 4028718 - DNA, 15 bp, Homo sapiens
actagaatttattca

SEQ ID NO: 4028719 - DNA, 16 bp, Homo sapiens
actagacacagataat

SEQ ID NO: 4028720 - DNA, 19 bp, Homo sapiens
actagactcttcactgtta

SEQ ID NO: 4028721 - DNA, 21 bp, Homo sapiens
actagagtctgaacagctgta

SEQ ID NO: 4028722 - DNA, 23 bp, Homo sapiens
actagccaacggccccagcttct

SEQ ID NO: 4028723 - DNA, 16 bp, Homo sapiens
actagcctgtcatcct

SEQ ID NO: 4028724 - DNA, 17 bp, Homo sapiens
actagggattcaggctg

SEQ ID NO: 4028725 - DNA, 21 bp, Homo sapiens
actagggattcaggctgcttg

SEQ ID NO: 4028726 - DNA, 18 bp, Homo sapiens
actaggtcaaaaatctgt

SEQ ID NO: 4028727 - DNA, 16 bp, Homo sapiens
actaggtttttgcttc

SEQ ID NO: 4028728 - DNA, 16 bp, Homo sapiens
actagtacaaattata

SEQ ID NO: 4028729 - DNA, 15 bp, Homo sapiens
actagtgacagcttg

SEQ ID NO: 4028730 - DNA, 13 bp, Homo sapiens
actagtgttctgt

SEQ ID NO: 4028731 - DNA, 15 bp, Homo sapiens
actagttacacatct

SEQ ID NO: 4028732 - DNA, 18 bp, Homo sapiens
actagttacacatcttca

SEQ ID NO: 4028733 - DNA, 17 bp, Homo sapiens
actagttattttataat

SEQ ID NO: 4028734 - DNA, 17 bp, Homo sapiens
actagttttagttttct

SEQ ID NO: 4028735 - DNA, 13 bp, Homo sapiens
actataaagagaa

SEQ ID NO: 4028736 - DNA, 14 bp, Homo sapiens
actataaagagaag

SEQ ID NO: 4028737 - DNA, 16 bp, Homo sapiens
actataaatacaaatc

SEQ ID NO: 4028738 - DNA, 17 bp, Homo sapiens
actataaatacaaatct

SEQ ID NO: 4028739 - DNA, 17 bp, Homo sapiens
actataaggctgagggc

SEQ ID NO: 4028740 - DNA, 13 bp, Homo sapiens
actataatgtaag

SEQ ID NO: 4028741 - DNA, 14 bp, Homo sapiens
actatagcccaggt

SEQ ID NO: 4028742 - DNA, 23 bp, Homo sapiens
actatatgtgaaacattttttct

SEQ ID NO: 4028743 - DNA, 13 bp, Homo sapiens
actatcataaaat

SEQ ID NO: 4028744 - DNA, 19 bp, Homo sapiens
actatctccgttccatctg

SEQ ID NO: 4028745 - DNA, 14 bp, Homo sapiens
actatcttcttcaa

SEQ ID NO: 4028746 - DNA, 16 bp, Homo sapiens
actatcttcttcaaat

SEQ ID NO: 4028747 - DNA, 20 bp, Homo sapiens
actatcttcttcaaatacaa

SEQ ID NO: 4028748 - DNA, 12 bp, Homo sapiens
actatgacactg

SEQ ID NO: 4028749 - DNA, 20 bp, Homo sapiens
actatgcatggtgccccagg

SEQ ID NO: 4028750 - DNA, 24 bp, Homo sapiens
actatgcatggtgccccaggacca

SEQ ID NO: 4028751 - DNA, 13 bp, Homo sapiens
actatggggtggg

SEQ ID NO: 4028752 - DNA, 19 bp, Homo sapiens
actatggtatgctggccag

SEQ ID NO: 4028753 - DNA, 20 bp, Homo sapiens
actatggtatgctggccagc

SEQ ID NO: 4028754 - DNA, 16 bp, Homo sapiens
actatggtatttgagt

SEQ ID NO: 4028755 - DNA, 15 bp, Homo sapiens
actatggttcccaat

SEQ ID NO: 4028756 - DNA, 14 bp, Homo sapiens
actatgtaaactac

SEQ ID NO: 4028757 - DNA, 23 bp, Homo sapiens
actatgtatgtatgtattattat

SEQ ID NO: 4028758 - DNA, 18 bp, Homo sapiens
actatgtgccagttcctg

SEQ ID NO: 4028759 - DNA, 22 bp, Homo sapiens
actattcaggagagtagaacag

SEQ ID NO: 4028760 - DNA, 14 bp, Homo sapiens
actattgagtcttc

SEQ ID NO: 4028761 - DNA, 21 bp, Homo sapiens
actattggaatctgatatact

SEQ ID NO: 4028762 - DNA, 13 bp, Homo sapiens
actatttaaactt

SEQ ID NO: 4028763 - DNA, 21 bp, Homo sapiens
actatttaaacttataaatca

SEQ ID NO: 4028764 - DNA, 21 bp, Homo sapiens
actatttacaagatggactta

SEQ ID NO: 4028765 - DNA, 14 bp, Homo sapiens
actcaaatgagtaa

SEQ ID NO: 4028766 - DNA, 17 bp, Homo sapiens
actcaaatgagtaacat

SEQ ID NO: 4028767 - DNA, 22 bp, Homo sapiens
actcaacaaaacccatgcattt

SEQ ID NO: 4028768 - DNA, 22 bp, Homo sapiens
actcaacatgttactgaccagc

SEQ ID NO: 4028769 - DNA, 23 bp, Homo sapiens
actcaacatgttactgaccagca

SEQ ID NO: 4028770 - DNA, 23 bp, Homo sapiens
actcaagaagtgaagaatgcaca

SEQ ID NO: 4028771 - DNA, 19 bp, Homo sapiens
actcaataaattgcaacat

SEQ ID NO: 4028772 - DNA, 22 bp, Homo sapiens
actcacaagtgctcatctgttg

SEQ ID NO: 4028773 - DNA, 18 bp, Homo sapiens
actcaccatgaagcgaaa

SEQ ID NO: 4028774 - DNA, 15 bp, Homo sapiens
actcaccatgtaaaa

SEQ ID NO: 4028775 - DNA, 18 bp, Homo sapiens
actcaccctgggagccag

SEQ ID NO: 4028776 - DNA, 22 bp, Homo sapiens
actcaccctgggagccagtcct

SEQ ID NO: 4028777 - DNA, 16 bp, Homo sapiens
actcacctaatgttta

SEQ ID NO: 4028778 - DNA, 17 bp, Homo sapiens
actcacctaatgtttat

SEQ ID NO: 4028779 - DNA, 18 bp, Homo sapiens
actcactgaagcctgcgt

SEQ ID NO: 4028780 - DNA, 22 bp, Homo sapiens
actcactgctcaagaagacatg

SEQ ID NO: 4028781 - DNA, 22 bp, Homo sapiens
actcactggggcctacagcttt

SEQ ID NO: 4028782 - DNA, 16 bp, Homo sapiens
actcagaagtccagag

SEQ ID NO: 4028783 - DNA, 14 bp, Homo sapiens
actcagaatattgc

SEQ ID NO: 4028784 - DNA, 17 bp, Homo sapiens
actcagaattattttta

SEQ ID NO: 4028785 - DNA, 12 bp, Homo sapiens
actcagacctga

SEQ ID NO: 4028786 - DNA, 11 bp, Homo sapiens
actcagatcca

SEQ ID NO: 4028787 - DNA, 17 bp, Homo sapiens
actcagatccagggaca

SEQ ID NO: 4028788 - DNA, 19 bp, Homo sapiens
actcagatccagggacaga

SEQ ID NO: 4028789 - DNA, 16 bp, Homo sapiens
actcagatctgtctga

SEQ ID NO: 4028790 - DNA, 15 bp, Homo sapiens
actcagcagaatggt

SEQ ID NO: 4028791 - DNA, 12 bp, Homo sapiens
actcagcagtga

SEQ ID NO: 4028792 - DNA, 17 bp, Homo sapiens
actcagctgtcctgcag

SEQ ID NO: 4028793 - DNA, 18 bp, Homo sapiens
actcagctgtcctgcagc

SEQ ID NO: 4028794 - DNA, 18 bp, Homo sapiens
actcaggaggctgaggca

SEQ ID NO: 4028795 - DNA, 14 bp, Homo sapiens
actcaggcctgtgc

SEQ ID NO: 4028796 - DNA, 15 bp, Homo sapiens
actcaggcctgtgcc

SEQ ID NO: 4028797 - DNA, 21 bp, Homo sapiens
actcaggcctgtgcccactcc

SEQ ID NO: 4028798 - DNA, 17 bp, Homo sapiens
actcagggaccggtgct

SEQ ID NO: 4028799 - DNA, 22 bp, Homo sapiens
actcagggcagcgccaggctga

SEQ ID NO: 4028800 - DNA, 20 bp, Homo sapiens
actcagggttcatctgtcca

SEQ ID NO: 4028801 - DNA, 13 bp, Homo sapiens
actcaggtgggcc

SEQ ID NO: 4028802 - DNA, 22 bp, Homo sapiens
atcttgtgtgattaacttattt

SEQ ID NO: 4028803 - DNA, 18 bp, Homo sapiens
atcttgttttaagcaaat

SEQ ID NO: 4028804 - DNA, 21 bp, Homo sapiens
atctttacaagcaggcactgt

SEQ ID NO: 4028805 - DNA, 17 bp, Homo sapiens
atctttacctgtataca

SEQ ID NO: 4028806 - DNA, 14 bp, Homo sapiens
atctttattaatca

SEQ ID NO: 4028807 - DNA, 21 bp, Homo sapiens
atctttcacttgaaagatttt

SEQ ID NO: 4028808 - DNA, 23 bp, Homo sapiens
atctttccaggcttccctgactt

SEQ ID NO: 4028809 - DNA, 23 bp, Homo sapiens
atctttcctcaagtatcttctat

SEQ ID NO: 4028810 - DNA, 15 bp, Homo sapiens
atctttctacagaga

SEQ ID NO: 4028811 - DNA, 13 bp, Homo sapiens
atctttgccttgg

SEQ ID NO: 4028812 - DNA, 14 bp, Homo sapiens
atctttgccttggg

SEQ ID NO: 4028813 - DNA, 20 bp, Homo sapiens
atctttgccttgggctgctc

SEQ ID NO: 4028814 - DNA, 22 bp, Homo sapiens
atctttgccttgggctgctcct

SEQ ID NO: 4028815 - DNA, 14 bp, Homo sapiens
atctttgctgcaga

SEQ ID NO: 4028816 - DNA, 17 bp, Homo sapiens
atctttgttacttcctt

SEQ ID NO: 4028817 - DNA, 22 bp, Homo sapiens
atcttttaaagtgttacttttt

SEQ ID NO: 4028818 - DNA, 15 bp, Homo sapiens
atcttttatgtttga

SEQ ID NO: 4028819 - DNA, 16 bp, Homo sapiens
atcttttatgtttgaa

SEQ ID NO: 4028820 - DNA, 18 bp, Homo sapiens
atcttttatgtttgaata

SEQ ID NO: 4028821 - DNA, 12 bp, Homo sapiens
atcttttcataa

SEQ ID NO: 4028822 - DNA, 22 bp, Homo sapiens
atcttttcataaagggttgaaa

SEQ ID NO: 4028823 - DNA, 16 bp, Homo sapiens
atctttttctttttaa

SEQ ID NO: 4028824 - DNA, 16 bp, Homo sapiens
atcttttttagcataa

SEQ ID NO: 4028825 - DNA, 18 bp, Homo sapiens
atcttttttagcataaaa

SEQ ID NO: 4028826 - DNA, 14 bp, Homo sapiens
atcttttttataac

SEQ ID NO: 4028827 - DNA, 14 bp, Homo sapiens
atcttttttcaaaa

SEQ ID NO: 4028828 - DNA, 17 bp, Homo sapiens
atgaaaaatttaagcat

SEQ ID NO: 4028829 - DNA, 19 bp, Homo sapiens
atgaaaaatttaagcattg

SEQ ID NO: 4028830 - DNA, 20 bp, Homo sapiens
atgaaaacgttttattgtgt

SEQ ID NO: 4028831 - DNA, 14 bp, Homo sapiens
atgaaaactataca

SEQ ID NO: 4028832 - DNA, 15 bp, Homo sapiens
atgaaaactatacaa

SEQ ID NO: 4028833 - DNA, 17 bp, Homo sapiens
atgaaaactatacaaca

SEQ ID NO: 4028834 - DNA, 12 bp, Homo sapiens
atgaaaacttat

SEQ ID NO: 4028835 - DNA, 22 bp, Homo sapiens
atgaaaatacaacttaaataat

SEQ ID NO: 4028836 - DNA, 13 bp, Homo sapiens
atgaaaatgtcag

SEQ ID NO: 4028837 - DNA, 14 bp, Homo sapiens
atgaaaattgtatt

SEQ ID NO: 4028838 - DNA, 12 bp, Homo sapiens
atgaaacacagc

SEQ ID NO: 4028839 - DNA, 13 bp, Homo sapiens
atgaaagattaaa

SEQ ID NO: 4028840 - DNA, 19 bp, Homo sapiens
atgaaagattaaacagatg

SEQ ID NO: 4028841 - DNA, 13 bp, Homo sapiens
atgaaagcaacaa

SEQ ID NO: 4028842 - DNA, 21 bp, Homo sapiens
atgaaagcaacaaagaaatcc

SEQ ID NO: 4028843 - DNA, 20 bp, Homo sapiens
atgaaagcagggaatttcta

SEQ ID NO: 4028844 - DNA, 21 bp, Homo sapiens
atgaaagcagggaatttctat

SEQ ID NO: 4028845 - DNA, 23 bp, Homo sapiens
atgaaagctgattactgtcaata

SEQ ID NO: 4028846 - DNA, 20 bp, Homo sapiens
atgaaagtctagaaataaaa

SEQ ID NO: 4028847 - DNA, 17 bp, Homo sapiens
atgaaagtgactttaaa

SEQ ID NO: 4028848 - DNA, 16 bp, Homo sapiens
atgaaatccttttcct

SEQ ID NO: 4028849 - DNA, 20 bp, Homo sapiens
atgaaatctgctagaaagtt

SEQ ID NO: 4028850 - DNA, 16 bp, Homo sapiens
atgaaatggttaagaa

SEQ ID NO: 4028851 - DNA, 12 bp, Homo sapiens
atgaaatttcac

SEQ ID NO: 4028852 - DNA, 18 bp, Homo sapiens
atgaaatttgcaaaatca

SEQ ID NO: 4028853 - DNA, 14 bp, Homo sapiens
atgaacatcccttt

SEQ ID NO: 4028854 - DNA, 17 bp, Homo sapiens
atgaacatgcagttcat

SEQ ID NO: 4028855 - DNA, 19 bp, Homo sapiens
atgaacatgcagttcatta

SEQ ID NO: 4028856 - DNA, 12 bp, Homo sapiens
atgaactctgaa

SEQ ID NO: 4028857 - DNA, 15 bp, Homo sapiens
atgaactgaagtttc

SEQ ID NO: 4028858 - DNA, 16 bp, Homo sapiens
atgaagaatagaaaca

SEQ ID NO: 4028859 - DNA, 14 bp, Homo sapiens
atgaagacaatgat

SEQ ID NO: 4028860 - DNA, 16 bp, Homo sapiens
atgaagagtattaatg

SEQ ID NO: 4028861 - DNA, 21 bp, Homo sapiens
atgaagattggtgggattttt

SEQ ID NO: 4028862 - DNA, 13 bp, Homo sapiens
atgaagcaaggaa

SEQ ID NO: 4028863 - DNA, 16 bp, Homo sapiens
atgaagcaaggaagat

SEQ ID NO: 4028864 - DNA, 17 bp, Homo sapiens
atgaagcaattagtctg

SEQ ID NO: 4028865 - DNA, 15 bp, Homo sapiens
atgaagcagctttaa

SEQ ID NO: 4028866 - DNA, 22 bp, Homo sapiens
atgaagcagctttaaacaaatt

SEQ ID NO: 4028867 - DNA, 19 bp, Homo sapiens
atgaagcgaaacacagaga

SEQ ID NO: 4028868 - DNA, 22 bp, Homo sapiens
atgaaggaatcattccagtgct

SEQ ID NO: 4028869 - DNA, 21 bp, Homo sapiens
atgaaggagaggcaacatcca

SEQ ID NO: 4028870 - DNA, 16 bp, Homo sapiens
atgaaggttaggattt

SEQ ID NO: 4028871 - DNA, 20 bp, Homo sapiens
atgaagtcataggttacaga

SEQ ID NO: 4028872 - DNA, 16 bp, Homo sapiens
atgaagtgcgtgaatg

SEQ ID NO: 4028873 - DNA, 14 bp, Homo sapiens
atgaagttttacat

SEQ ID NO: 4028874 - DNA, 15 bp, Homo sapiens
atgaataaactgaat

SEQ ID NO: 4028875 - DNA, 23 bp, Homo sapiens
atgaataaactgaatattttgga

SEQ ID NO: 4028876 - DNA, 17 bp, Homo sapiens
atgaataaagaatgcca

SEQ ID NO: 4028877 - DNA, 23 bp, Homo sapiens
atgaataaagaatgccatttctc

SEQ ID NO: 4028878 - DNA, 22 bp, Homo sapiens
atgaataatttcccaattagga

SEQ ID NO: 4028879 - DNA, 14 bp, Homo sapiens
atgaatacatttcc

SEQ ID NO: 4028880 - DNA, 21 bp, Homo sapiens
atgaatacatttccaaaatgg

SEQ ID NO: 4028881 - DNA, 18 bp, Homo sapiens
atgaatatcatacaaatc

SEQ ID NO: 4028882 - DNA, 18 bp, Homo sapiens
atgaatatctattaatat

SEQ ID NO: 4028883 - DNA, 20 bp, Homo sapiens
atgaatctcgttcccaaaga

SEQ ID NO: 4028884 - DNA, 17 bp, Homo sapiens
atgaatctgctcacttt

SEQ ID NO: 4028885 - DNA, 18 bp, Homo sapiens
atgaatctgctcacttta

SEQ ID NO: 4028886 - DNA, 21 bp, Homo sapiens
atgaatgcccagtgagactgt

SEQ ID NO: 4028887 - DNA, 15 bp, Homo sapiens
atgaatgtatcagga

SEQ ID NO: 4028888 - DNA, 16 bp, Homo sapiens
atgaatgtatgtgcac

SEQ ID NO: 4028889 - DNA, 11 bp, Homo sapiens
atgaatgttta

SEQ ID NO: 4028890 - DNA, 19 bp, Homo sapiens
atgaattcaagaaaggaaa

SEQ ID NO: 4028891 - DNA, 13 bp, Homo sapiens
atgaatttaaata

SEQ ID NO: 4028892 - DNA, 13 bp, Homo sapiens
atgaattttccac

SEQ ID NO: 4028893 - DNA, 18 bp, Homo sapiens
atgacacaatccctgggg

SEQ ID NO: 4028894 - DNA, 20 bp, Homo sapiens
atgacacaatccctggggct

SEQ ID NO: 4028895 - DNA, 18 bp, Homo sapiens
atgacacccaccctgtgc

SEQ ID NO: 4028896 - DNA, 19 bp, Homo sapiens
atgacacccaccctgtgcc

SEQ ID NO: 4028897 - DNA, 15 bp, Homo sapiens
atgacaccctggcct

SEQ ID NO: 4028898 - DNA, 15 bp, Homo sapiens
atgacactcctagac

SEQ ID NO: 4028899 - DNA, 12 bp, Homo sapiens
atgacagagcga

SEQ ID NO: 4028900 - DNA, 21 bp, Homo sapiens
atgacagaggctgcacccctg

SEQ ID NO: 4028901 - DNA, 16 bp, Homo sapiens
atgacagatgttgaat

SEQ ID NO: 4028902 - DNA, 16 bp, Homo sapiens
atgacagcctgcagca

SEQ ID NO: 4028903 - DNA, 21 bp, Homo sapiens
atgacaggcgcctgccatcat

SEQ ID NO: 4028904 - DNA, 13 bp, Homo sapiens
atgacagggcaga

SEQ ID NO: 4028905 - DNA, 14 bp, Homo sapiens
atcagttcctttgt

SEQ ID NO: 4028906 - DNA, 17 bp, Homo sapiens
atcagttcctttgtgtg

SEQ ID NO: 4028907 - DNA, 16 bp, Homo sapiens
atcagtttcatgaaat

SEQ ID NO: 4028908 - DNA, 18 bp, Homo sapiens
atcagtttcatgaaatga

SEQ ID NO: 4028909 - DNA, 14 bp, Homo sapiens
atcataaaatcaaa

SEQ ID NO: 4028910 - DNA, 17 bp, Homo sapiens
atcataagtgaatttat

SEQ ID NO: 4028911 - DNA, 18 bp, Homo sapiens
atcataagtgaatttata

SEQ ID NO: 4028912 - DNA, 21 bp, Homo sapiens
atcatatgcctgaccccttgc

SEQ ID NO: 4028913 - DNA, 16 bp, Homo sapiens
atcatatgtgtcttta

SEQ ID NO: 4028914 - DNA, 13 bp, Homo sapiens
atcatattgatga

SEQ ID NO: 4028915 - DNA, 23 bp, Homo sapiens
atcatattggtatatccttttct

SEQ ID NO: 4028916 - DNA, 23 bp, Homo sapiens
atcatcaagcaggaattatgtcg

SEQ ID NO: 4028917 - DNA, 18 bp, Homo sapiens
atcatccccatcctccag

SEQ ID NO: 4028918 - DNA, 19 bp, Homo sapiens
atcatccctttcccttggt

SEQ ID NO: 4028919 - DNA, 22 bp, Homo sapiens
atcatcctttgttctgagcatt

SEQ ID NO: 4028920 - DNA, 16 bp, Homo sapiens
atcatcgccagaggtg

SEQ ID NO: 4028921 - DNA, 19 bp, Homo sapiens
atcatctatagaaagctat

SEQ ID NO: 4028922 - DNA, 14 bp, Homo sapiens
atcatctccatcat

SEQ ID NO: 4028923 - DNA, 16 bp, Homo sapiens
atcatgaaatatgcat

SEQ ID NO: 4028924 - DNA, 15 bp, Homo sapiens
atcatgagcctgctg

SEQ ID NO: 4028925 - DNA, 23 bp, Homo sapiens
atcatgagtgaataaatgtcttg

SEQ ID NO: 4028926 - DNA, 22 bp, Homo sapiens
atcatgcattgttgaggtggtc

SEQ ID NO: 4028927 - DNA, 18 bp, Homo sapiens
atcatggaatatttatag

SEQ ID NO: 4028928 - DNA, 12 bp, Homo sapiens
atcatggagaaa

SEQ ID NO: 4028929 - DNA, 19 bp, Homo sapiens
atcatggaggtttgaagat

SEQ ID NO: 4028930 - DNA, 20 bp, Homo sapiens
atgattttcctttttcttcg

SEQ ID NO: 4028931 - DNA, 23 bp, Homo sapiens
atgattttcctttttcttcgctg

SEQ ID NO: 4028932 - DNA, 19 bp, Homo sapiens
atgcaaaaattagccgggc

SEQ ID NO: 4028933 - DNA, 23 bp, Homo sapiens
atgcaaaccgttaggaaaaccag

SEQ ID NO: 4028934 - DNA, 16 bp, Homo sapiens
atgcaaataacacaaa

SEQ ID NO: 4028935 - DNA, 13 bp, Homo sapiens
atgcaacaaatga

SEQ ID NO: 4028936 - DNA, 21 bp, Homo sapiens
atgcaacaaatgaattttcca

SEQ ID NO: 4028937 - DNA, 23 bp, Homo sapiens
atgcaactggagttccttatccc

SEQ ID NO: 4028938 - DNA, 23 bp, Homo sapiens
atgcaagctagtggcttcaaaat

SEQ ID NO: 4028939 - DNA, 13 bp, Homo sapiens
atgcaaggaagga

SEQ ID NO: 4028940 - DNA, 14 bp, Homo sapiens
atgcaaggaaggaa

SEQ ID NO: 4028941 - DNA, 15 bp, Homo sapiens
atgcaaggaaggaaa

SEQ ID NO: 4028942 - DNA, 15 bp, Homo sapiens
atgcaaggaccagga

SEQ ID NO: 4028943 - DNA, 13 bp, Homo sapiens
atgcaatgtgcta

SEQ ID NO: 4028944 - DNA, 16 bp, Homo sapiens
atgcaatgtgctactg

SEQ ID NO: 4028945 - DNA, 12 bp, Homo sapiens
atgcaatttgat

SEQ ID NO: 4028946 - DNA, 17 bp, Homo sapiens
atgcaatttgattgact

SEQ ID NO: 4028947 - DNA, 15 bp, Homo sapiens
atgcacagtatcttt

SEQ ID NO: 4028948 - DNA, 14 bp, Homo sapiens
atgcacatccctgg

SEQ ID NO: 4028949 - DNA, 14 bp, Homo sapiens
atgcacccctgagc

SEQ ID NO: 4028950 - DNA, 20 bp, Homo sapiens
atgcaccctcatacacagaa

SEQ ID NO: 4028951 - DNA, 20 bp, Homo sapiens
atgcactgaaaacttagcca

SEQ ID NO: 4028952 - DNA, 13 bp, Homo sapiens
atgcactgtgaag

SEQ ID NO: 4028953 - DNA, 13 bp, Homo sapiens
atgcagaaaaaga

SEQ ID NO: 4028954 - DNA, 14 bp, Homo sapiens
atgcagaaaaagaa

SEQ ID NO: 4028955 - DNA, 15 bp, Homo sapiens
atgcagaaaaagaaa

SEQ ID NO: 4028956 - DNA, 19 bp, Homo sapiens
atgcagagagccattttgt

SEQ ID NO: 4028957 - DNA, 23 bp, Homo sapiens
atgcagagagccattttgtgaat

SEQ ID NO: 4028958 - DNA, 15 bp, Homo sapiens
atgcagaggaggtga

SEQ ID NO: 4028959 - DNA, 17 bp, Homo sapiens
atgcagatagaatcaat

SEQ ID NO: 4028960 - DNA, 16 bp, Homo sapiens
atgcagcaaggccctg

SEQ ID NO: 4028961 - DNA, 23 bp, Homo sapiens
atgcagcccatgcccacctgccc

SEQ ID NO: 4028962 - DNA, 15 bp, Homo sapiens
atgcagctcttcctg

SEQ ID NO: 4028963 - DNA, 12 bp, Homo sapiens
atgcaggacagg

SEQ ID NO: 4028964 - DNA, 13 bp, Homo sapiens
atgcaggacagga

SEQ ID NO: 4028965 - DNA, 16 bp, Homo sapiens
atgcaggacaggaggc

SEQ ID NO: 4028966 - DNA, 17 bp, Homo sapiens
atgcagggaggggaggc

SEQ ID NO: 4028967 - DNA, 14 bp, Homo sapiens
atgcagtcctgagg

SEQ ID NO: 4028968 - DNA, 16 bp, Homo sapiens
atgcagtgaattgtga

SEQ ID NO: 4028969 - DNA, 21 bp, Homo sapiens
atgcagtgatatggcagaaga

SEQ ID NO: 4028970 - DNA, 23 bp, Homo sapiens
atgcagtgatatggcagaagaca

SEQ ID NO: 4028971 - DNA, 19 bp, Homo sapiens
atgcagttcattattttgt

SEQ ID NO: 4028972 - DNA, 23 bp, Homo sapiens
atgcatatgtcactagaatggat

SEQ ID NO: 4028973 - DNA, 12 bp, Homo sapiens
atgcatcactgg

SEQ ID NO: 4028974 - DNA, 13 bp, Homo sapiens
atgcatgaagcaa

SEQ ID NO: 4028975 - DNA, 21 bp, Homo sapiens
atgcatgccctctctgagtct

SEQ ID NO: 4028976 - DNA, 22 bp, Homo sapiens
atgcatgccctctctgagtctg

SEQ ID NO: 4028977 - DNA, 22 bp, Homo sapiens
atgcatggtgccccaggaccag

SEQ ID NO: 4028978 - DNA, 15 bp, Homo sapiens
atgcattgttgaggt

SEQ ID NO: 4028979 - DNA, 12 bp, Homo sapiens
atgcattgttgg

SEQ ID NO: 4028980 - DNA, 18 bp, Homo sapiens
atgcattgttggctattt

SEQ ID NO: 4028981 - DNA, 19 bp, Homo sapiens
atgcattttgcagcagtga

SEQ ID NO: 4028982 - DNA, 18 bp, Homo sapiens
atgccaaagctagggtgg

SEQ ID NO: 4028983 - DNA, 16 bp, Homo sapiens
atgccaattattgtta

SEQ ID NO: 4028984 - DNA, 23 bp, Homo sapiens
atgccaccctcacacacacagct

SEQ ID NO: 4028985 - DNA, 20 bp, Homo sapiens
atgccaccctgttttcagct

SEQ ID NO: 4028986 - DNA, 14 bp, Homo sapiens
atgccacgttccac

SEQ ID NO: 4028987 - DNA, 17 bp, Homo sapiens
atgccactcctccctcc

SEQ ID NO: 4028988 - DNA, 18 bp, Homo sapiens
atgccactcctccctccg

SEQ ID NO: 4028989 - DNA, 19 bp, Homo sapiens
atgccagattctgcctctc

SEQ ID NO: 4028990 - DNA, 20 bp, Homo sapiens
atgccagcttctctctccag

SEQ ID NO: 4028991 - DNA, 21 bp, Homo sapiens
atgccagcttctctctccagg

SEQ ID NO: 4028992 - DNA, 15 bp, Homo sapiens
atgccatttctcacg

SEQ ID NO: 4028993 - DNA, 20 bp, Homo sapiens
atgcccaccccctgccctgc

SEQ ID NO: 4028994 - DNA, 20 bp, Homo sapiens
atgcccacctgcccatcaca

SEQ ID NO: 4028995 - DNA, 23 bp, Homo sapiens
atgcccactgctggtgccagggt

SEQ ID NO: 4028996 - DNA, 22 bp, Homo sapiens
atgcccagcaggggaggtgagg

SEQ ID NO: 4028997 - DNA, 13 bp, Homo sapiens
atgcccaggtacc

SEQ ID NO: 4028998 - DNA, 19 bp, Homo sapiens
atgccccttcttgggcccc

SEQ ID NO: 4028999 - DNA, 22 bp, Homo sapiens
atgccccttcttgggccccaga

SEQ ID NO: 4029000 - DNA, 23 bp, Homo sapiens
atgccccttcttgggccccagac

SEQ ID NO: 4029001 - DNA, 16 bp, Homo sapiens
atgccccttggctgga

SEQ ID NO: 4029002 - DNA, 19 bp, Homo sapiens
atgccccttggctggatca

SEQ ID NO: 4029003 - DNA, 23 bp, Homo sapiens
atgccctctctgagtctggactt

SEQ ID NO: 4029004 - DNA, 12 bp, Homo sapiens
atgccctgtgca

SEQ ID NO: 4029005 - DNA, 23 bp, Homo sapiens
atgccctgtgcaacctcttggcc

SEQ ID NO: 4029006 - DNA, 18 bp, Homo sapiens
atgcctacaaccatccct

SEQ ID NO: 4029007 - DNA, 19 bp, Homo sapiens
atgcctacaaccatccctg

SEQ ID NO: 4029008 - DNA, 23 bp, Homo sapiens
atgcctagacttcccaacagcct

SEQ ID NO: 4029009 - DNA, 17 bp, Homo sapiens
atgcctagcagagtgct

SEQ ID NO: 4029010 - DNA, 18 bp, Homo sapiens
atgcctagcagagtgctg

SEQ ID NO: 4029011 - DNA, 21 bp, Homo sapiens
atgcctagcagagtgctggca

SEQ ID NO: 4029012 - DNA, 22 bp, Homo sapiens
atgcctatattatcataagaat

SEQ ID NO: 4029013 - DNA, 12 bp, Homo sapiens
atgcctgacccc

SEQ ID NO: 4029014 - DNA, 19 bp, Homo sapiens
atgcctgaccccttgctcc

SEQ ID NO: 4029015 - DNA, 20 bp, Homo sapiens
atgcctgaccccttgctccc

SEQ ID NO: 4029016 - DNA, 14 bp, Homo sapiens
atgcctgagggtgg

SEQ ID NO: 4029017 - DNA, 15 bp, Homo sapiens
atgcctgagggtgga

SEQ ID NO: 4029018 - DNA, 19 bp, Homo sapiens
atgcctgccccaaacaaat

SEQ ID NO: 4029019 - DNA, 16 bp, Homo sapiens
atgcctgcgcctgctg

SEQ ID NO: 4029020 - DNA, 23 bp, Homo sapiens
atgcctgcgcctgctgcctgctg

SEQ ID NO: 4029021 - DNA, 15 bp, Homo sapiens
atgcctggagacaga

SEQ ID NO: 4029022 - DNA, 13 bp, Homo sapiens
atgcctgtgccaa

SEQ ID NO: 4029023 - DNA, 14 bp, Homo sapiens
atgcctttcatagt

SEQ ID NO: 4029024 - DNA, 19 bp, Homo sapiens
atgcctttcatagtttatt

SEQ ID NO: 4029025 - DNA, 14 bp, Homo sapiens
atgcctttgagaca

SEQ ID NO: 4029026 - DNA, 20 bp, Homo sapiens
atgcctttgagacagtttct

SEQ ID NO: 4029027 - DNA, 12 bp, Homo sapiens
atgcctttgtaa

SEQ ID NO: 4029028 - DNA, 15 bp, Homo sapiens
atgcctttgtaagtt

SEQ ID NO: 4029029 - DNA, 13 bp, Homo sapiens
atgcgccttgctg

SEQ ID NO: 4029030 - DNA, 20 bp, Homo sapiens
atgcgccttgctgatggctt

SEQ ID NO: 4029031 - DNA, 20 bp, Homo sapiens
atgcggtagccagcacacag

SEQ ID NO: 4029032 - DNA, 21 bp, Homo sapiens
atgcggttataaaaaatggtt

SEQ ID NO: 4029033 - DNA, 16 bp, Homo sapiens
atgcgtaaacgacact

SEQ ID NO: 4029034 - DNA, 15 bp, Homo sapiens
atgcgttcactccaa

SEQ ID NO: 4029035 - DNA, 15 bp, Homo sapiens
atgctaaaattctat

SEQ ID NO: 4029036 - DNA, 14 bp, Homo sapiens
atgctaacatctaa

SEQ ID NO: 4029037 - DNA, 14 bp, Homo sapiens
atgctaataaactg

SEQ ID NO: 4029038 - DNA, 16 bp, Homo sapiens
atgctaatttaaagag

SEQ ID NO: 4029039 - DNA, 18 bp, Homo sapiens
atgctaatttaaagagac

SEQ ID NO: 4029040 - DNA, 22 bp, Homo sapiens
atgctagaaaatcgagttggca

SEQ ID NO: 4029041 - DNA, 14 bp, Homo sapiens
atgctatttatgca

SEQ ID NO: 4029042 - DNA, 22 bp, Homo sapiens
atgctatttatgcaagttaggg

SEQ ID NO: 4029043 - DNA, 13 bp, Homo sapiens
atgctcacctcta

SEQ ID NO: 4029044 - DNA, 15 bp, Homo sapiens
atgctcactttatta

SEQ ID NO: 4029045 - DNA, 12 bp, Homo sapiens
atgctccccaca

SEQ ID NO: 4029046 - DNA, 14 bp, Homo sapiens
atgctccccacagc

SEQ ID NO: 4029047 - DNA, 17 bp, Homo sapiens
atgctccctcagcctca

SEQ ID NO: 4029048 - DNA, 22 bp, Homo sapiens
atgctccctcagcctcagagga

SEQ ID NO: 4029049 - DNA, 16 bp, Homo sapiens
atgctccctcccctgc

SEQ ID NO: 4029050 - DNA, 12 bp, Homo sapiens
atgctctatttt

SEQ ID NO: 4029051 - DNA, 18 bp, Homo sapiens
atgctctctcaaattgtc

SEQ ID NO: 4029052 - DNA, 19 bp, Homo sapiens
atgctctctcaaattgtca

SEQ ID NO: 4029053 - DNA, 17 bp, Homo sapiens
atgctgaaaaaacacct

SEQ ID NO: 4029054 - DNA, 23 bp, Homo sapiens
atgctgaatatacagcaggtgct

SEQ ID NO: 4029055 - DNA, 19 bp, Homo sapiens
atgctgactgtactcctcc

SEQ ID NO: 4029056 - DNA, 21 bp, Homo sapiens
atgctgactgtactcctccca

SEQ ID NO: 4029057 - DNA, 17 bp, Homo sapiens
atgctgagggtgtttct

SEQ ID NO: 4029058 - DNA, 20 bp, Homo sapiens
atgctgagggtgtttcttcc

SEQ ID NO: 4029059 - DNA, 23 bp, Homo sapiens
atgctgagggtgtttcttcctgc

SEQ ID NO: 4029060 - DNA, 13 bp, Homo sapiens
atgctgccagtgt

SEQ ID NO: 4029061 - DNA, 12 bp, Homo sapiens
atgctgcccctc

SEQ ID NO: 4029062 - DNA, 22 bp, Homo sapiens
atgctgccttcccatgaatctg

SEQ ID NO: 4029063 - DNA, 23 bp, Homo sapiens
atgctgccttcccatgaatctgt

SEQ ID NO: 4029064 - DNA, 13 bp, Homo sapiens
atgctggccagca

SEQ ID NO: 4029065 - DNA, 15 bp, Homo sapiens
atgctggccagcacc

SEQ ID NO: 4029066 - DNA, 20 bp, Homo sapiens
atgctggccagcaccctctc

SEQ ID NO: 4029067 - DNA, 15 bp, Homo sapiens
atgctggcccagggc

SEQ ID NO: 4029068 - DNA, 14 bp, Homo sapiens
atgctgggccactg

SEQ ID NO: 4029069 - DNA, 13 bp, Homo sapiens
atgctgggctggg

SEQ ID NO: 4029070 - DNA, 16 bp, Homo sapiens
atgctgggctgggccc

SEQ ID NO: 4029071 - DNA, 20 bp, Homo sapiens
atgctgtaacttaaaatagg

SEQ ID NO: 4029072 - DNA, 16 bp, Homo sapiens
atgctgtacatctatt

SEQ ID NO: 4029073 - DNA, 22 bp, Homo sapiens
atgctgtacatctattttggat

SEQ ID NO: 4029074 - DNA, 19 bp, Homo sapiens
atgctgtatatcctttcta

SEQ ID NO: 4029075 - DNA, 19 bp, Homo sapiens
atgctgtgggggactggct

SEQ ID NO: 4029076 - DNA, 21 bp, Homo sapiens
atgctgttagtaaatttctgt

SEQ ID NO: 4029077 - DNA, 18 bp, Homo sapiens
atgctgttctcttcttca

SEQ ID NO: 4029078 - DNA, 21 bp, Homo sapiens
atgctgttgcatttagaactt

SEQ ID NO: 4029079 - DNA, 22 bp, Homo sapiens
atgctgtttgtagtgaaataat

SEQ ID NO: 4029080 - DNA, 15 bp, Homo sapiens
atgcttaaaaggttg

SEQ ID NO: 4029081 - DNA, 20 bp, Homo sapiens
atgcttaaactaaataatga

SEQ ID NO: 4029082 - DNA, 13 bp, Homo sapiens
atgcttaatttct

SEQ ID NO: 4029083 - DNA, 15 bp, Homo sapiens
atgcttaatttctaa

SEQ ID NO: 4029084 - DNA, 16 bp, Homo sapiens
atgcttaatttctaaa

SEQ ID NO: 4029085 - DNA, 19 bp, Homo sapiens
atgcttcatatgaggagga

SEQ ID NO: 4029086 - DNA, 20 bp, Homo sapiens
atgcttcatcattccctctc

SEQ ID NO: 4029087 - DNA, 20 bp, Homo sapiens
atgcttcccagagggagcag

SEQ ID NO: 4029088 - DNA, 15 bp, Homo sapiens
atgcttcctgacaat

SEQ ID NO: 4029089 - DNA, 17 bp, Homo sapiens
atgcttctctccttgcc

SEQ ID NO: 4029090 - DNA, 22 bp, Homo sapiens
atgctttttattattattattt

SEQ ID NO: 4029091 - DNA, 16 bp, Homo sapiens
atggaaaaatggttga

SEQ ID NO: 4029092 - DNA, 21 bp, Homo sapiens
atggaaaaatggttgatggaa

SEQ ID NO: 4029093 - DNA, 19 bp, Homo sapiens
atggaaaactgtgttgcca

SEQ ID NO: 4029094 - DNA, 15 bp, Homo sapiens
atggaaaataaacat

SEQ ID NO: 4029095 - DNA, 17 bp, Homo sapiens
atggaaacactgatttt

SEQ ID NO: 4029096 - DNA, 20 bp, Homo sapiens
atggaaacactgattttgta

SEQ ID NO: 4029097 - DNA, 11 bp, Homo sapiens
atggaaagaat

SEQ ID NO: 4029098 - DNA, 17 bp, Homo sapiens
atggaaagaatctaata

SEQ ID NO: 4029099 - DNA, 16 bp, Homo sapiens
atggaaagacaaactg

SEQ ID NO: 4029100 - DNA, 14 bp, Homo sapiens
atggaaccttccct

SEQ ID NO: 4029101 - DNA, 15 bp, Homo sapiens
atggaaccttccctc

SEQ ID NO: 4029102 - DNA, 17 bp, Homo sapiens
atggaaccttccctcca

SEQ ID NO: 4029103 - DNA, 19 bp, Homo sapiens
atggaaccttccctccaaa

SEQ ID NO: 4029104 - DNA, 16 bp, Homo sapiens
atggaagattttaaat

SEQ ID NO: 4029105 - DNA, 15 bp, Homo sapiens
atggaagttttccta

SEQ ID NO: 4029106 - DNA, 15 bp, Homo sapiens
atggaataacatgta

SEQ ID NO: 4029107 - DNA, 16 bp, Homo sapiens
atggaataactctgtg

SEQ ID NO: 4029108 - DNA, 16 bp, Homo sapiens
atggaatacagtgtta

SEQ ID NO: 4029109 - DNA, 22 bp, Homo sapiens
atggaatacagtgttattttct

SEQ ID NO: 4029110 - DNA, 14 bp, Homo sapiens
atggaatatatcag

SEQ ID NO: 4029111 - DNA, 24 bp, Homo sapiens
atggaatatttataggccagggca

SEQ ID NO: 4029112 - DNA, 20 bp, Homo sapiens
atggaatcgatttcctccca

SEQ ID NO: 4029113 - DNA, 16 bp, Homo sapiens
atggaatgctgtgtta

SEQ ID NO: 4029114 - DNA, 21 bp, Homo sapiens
atggaatgctgtgttaaataa

SEQ ID NO: 4029115 - DNA, 18 bp, Homo sapiens
atggaattgatttgcatt

SEQ ID NO: 4029116 - DNA, 19 bp, Homo sapiens
atggaattgatttgcattg

SEQ ID NO: 4029117 - DNA, 22 bp, Homo sapiens
atggacaacttatttaaaaata

SEQ ID NO: 4029118 - DNA, 23 bp, Homo sapiens
atggacaacttatttaaaaatat

SEQ ID NO: 4029119 - DNA, 22 bp, Homo sapiens
atggacaccccttatccaggac

SEQ ID NO: 4029120 - DNA, 23 bp, Homo sapiens
atggacaccccttatccaggact

SEQ ID NO: 4029121 - DNA, 13 bp, Homo sapiens
atggacactccag

SEQ ID NO: 4029122 - DNA, 15 bp, Homo sapiens
atggacactccagtg

SEQ ID NO: 4029123 - DNA, 17 bp, Homo sapiens
atggacactccagtgcc

SEQ ID NO: 4029124 - DNA, 19 bp, Homo sapiens
atggacactccagtgccag

SEQ ID NO: 4029125 - DNA, 19 bp, Homo sapiens
atggacaggctggctccag

SEQ ID NO: 4029126 - DNA, 13 bp, Homo sapiens
atggacatcctgt

SEQ ID NO: 4029127 - DNA, 15 bp, Homo sapiens
atggacatcctgtat

SEQ ID NO: 4029128 - DNA, 23 bp, Homo sapiens
atggaccaacctgctctgtcccc

SEQ ID NO: 4029129 - DNA, 16 bp, Homo sapiens
atggactcttctcggc

SEQ ID NO: 4029130 - DNA, 18 bp, Homo sapiens
atggacttatttcttcaa

SEQ ID NO: 4029131 - DNA, 20 bp, Homo sapiens
atggacttatttcttcaaat

SEQ ID NO: 4029132 - DNA, 22 bp, Homo sapiens
atggacttgtatatttgtacaa

SEQ ID NO: 4029133 - DNA, 20 bp, Homo sapiens
atggagaatctgctgcatag

SEQ ID NO: 4029134 - DNA, 14 bp, Homo sapiens
atggagactcctgc

SEQ ID NO: 4029135 - DNA, 18 bp, Homo sapiens
atggagactcctgccctg

SEQ ID NO: 4029136 - DNA, 18 bp, Homo sapiens
atggagactgtctcaaga

SEQ ID NO: 4029137 - DNA, 21 bp, Homo sapiens
atggagccagctctgcattat

SEQ ID NO: 4029138 - DNA, 22 bp, Homo sapiens
atggagcccccagatagagctg

SEQ ID NO: 4029139 - DNA, 24 bp, Homo sapiens
atggagctcacactccagtggcag

SEQ ID NO: 4029140 - DNA, 15 bp, Homo sapiens
atggagctttctgta

SEQ ID NO: 4029141 - DNA, 12 bp, Homo sapiens
atggaggaaaaa

SEQ ID NO: 4029142 - DNA, 16 bp, Homo sapiens
atggaggaaaaccaag

SEQ ID NO: 4029143 - DNA, 16 bp, Homo sapiens
atggaggccctcctgt

SEQ ID NO: 4029144 - DNA, 20 bp, Homo sapiens
atggaggccctcctgtgctg

SEQ ID NO: 4029145 - DNA, 13 bp, Homo sapiens
atggagtagaggt

SEQ ID NO: 4029146 - DNA, 22 bp, Homo sapiens
atggagtagaggtactagaatg

SEQ ID NO: 4029147 - DNA, 11 bp, Homo sapiens
atggagtgacg

SEQ ID NO: 4029148 - DNA, 20 bp, Homo sapiens
atggagtgagtcacctgctc

SEQ ID NO: 4029149 - DNA, 13 bp, Homo sapiens
atggatactacat

SEQ ID NO: 4029150 - DNA, 15 bp, Homo sapiens
atggatcacaagatg

SEQ ID NO: 4029151 - DNA, 21 bp, Homo sapiens
atggatgaatctcccactcca

SEQ ID NO: 4029152 - DNA, 22 bp, Homo sapiens
atggatgaatctcccactccag

SEQ ID NO: 4029153 - DNA, 18 bp, Homo sapiens
atggatgattcagaaatt

SEQ ID NO: 4029154 - DNA, 21 bp, Homo sapiens
atggatgattcagaaattgga

SEQ ID NO: 4029155 - DNA, 22 bp, Homo sapiens
atggatgccaatattaaatctg

SEQ ID NO: 4029156 - DNA, 23 bp, Homo sapiens
atggatgccaatattaaatctgc

SEQ ID NO: 4029157 - DNA, 16 bp, Homo sapiens
atggattctcagatat

SEQ ID NO: 4029158 - DNA, 18 bp, Homo sapiens
atggattctcagatattt

SEQ ID NO: 4029159 - DNA, 15 bp, Homo sapiens
atggattggattatt

SEQ ID NO: 4029160 - DNA, 20 bp, Homo sapiens
atggattggattatttaata

SEQ ID NO: 4029161 - DNA, 17 bp, Homo sapiens
atggatttcagaagcct

SEQ ID NO: 4029162 - DNA, 21 bp, Homo sapiens
atggatttgcctgtgccaccc

SEQ ID NO: 4029163 - DNA, 14 bp, Homo sapiens
atggatttgttaca

SEQ ID NO: 4029164 - DNA, 20 bp, Homo sapiens
atggattttctattgttact

SEQ ID NO: 4029165 - DNA, 21 bp, Homo sapiens
atggattttctattgttactc

SEQ ID NO: 4029166 - DNA, 21 bp, Homo sapiens
atggattttggataaatcatt

SEQ ID NO: 4029167 - DNA, 15 bp, Homo sapiens
atggattttgggagt

SEQ ID NO: 4029168 - DNA, 16 bp, Homo sapiens
atggcaacagatctgg

SEQ ID NO: 4029169 - DNA, 20 bp, Homo sapiens
atggcaatgttttgcttttg

SEQ ID NO: 4029170 - DNA, 13 bp, Homo sapiens
atggcagaaggga

SEQ ID NO: 4029171 - DNA, 18 bp, Homo sapiens
atggcagctgtttctcat

SEQ ID NO: 4029172 - DNA, 21 bp, Homo sapiens
atggcagctgtttctcatgaa

SEQ ID NO: 4029173 - DNA, 15 bp, Homo sapiens
atggccacatttaat

SEQ ID NO: 4029174 - DNA, 12 bp, Homo sapiens
atggccagcccc

SEQ ID NO: 4029175 - DNA, 14 bp, Homo sapiens
atggccagcccctg

SEQ ID NO: 4029176 - DNA, 14 bp, Homo sapiens
atggcccccagggg

SEQ ID NO: 4029177 - DNA, 15 bp, Homo sapiens
atggcccccaggggc

SEQ ID NO: 4029178 - DNA, 22 bp, Homo sapiens
atggcccccaggggcaggactg

SEQ ID NO: 4029179 - DNA, 18 bp, Homo sapiens
atggcccggatgctgctt

SEQ ID NO: 4029180 - DNA, 19 bp, Homo sapiens
atggcccggatgctgcttc

SEQ ID NO: 4029181 - DNA, 11 bp, Homo sapiens
atggccctggg

SEQ ID NO: 4029182 - DNA, 11 bp, Homo sapiens
atggccctgtc

SEQ ID NO: 4029183 - DNA, 14 bp, Homo sapiens
atggccctgtccca

SEQ ID NO: 4029184 - DNA, 15 bp, Homo sapiens
atggccctgtcccag

SEQ ID NO: 4029185 - DNA, 16 bp, Homo sapiens
atggccctgtcccagg

SEQ ID NO: 4029186 - DNA, 17 bp, Homo sapiens
atggccctgtcccaggc

SEQ ID NO: 4029187 - DNA, 20 bp, Homo sapiens
atggccctgtcccaggccgg

SEQ ID NO: 4029188 - DNA, 14 bp, Homo sapiens
atggccgtggatgc

SEQ ID NO: 4029189 - DNA, 20 bp, Homo sapiens
atggcctattatattaaaat

SEQ ID NO: 4029190 - DNA, 21 bp, Homo sapiens
atggcctattatattaaaata

SEQ ID NO: 4029191 - DNA, 21 bp, Homo sapiens
atggcctcagctgcctcactt

SEQ ID NO: 4029192 - DNA, 17 bp, Homo sapiens
atggccttaatttcctt

SEQ ID NO: 4029193 - DNA, 16 bp, Homo sapiens
atggccttacactgaa

SEQ ID NO: 4029194 - DNA, 14 bp, Homo sapiens
atggcctttccttc

SEQ ID NO: 4029195 - DNA, 17 bp, Homo sapiens
atggcctttccttccct

SEQ ID NO: 4029196 - DNA, 22 bp, Homo sapiens
atggcctttccttccctctctg

SEQ ID NO: 4029197 - DNA, 16 bp, Homo sapiens
atggctaattcccaga

SEQ ID NO: 4029198 - DNA, 17 bp, Homo sapiens
atggctaattcccagag

SEQ ID NO: 4029199 - DNA, 16 bp, Homo sapiens
atggctataaatatat

SEQ ID NO: 4029200 - DNA, 14 bp, Homo sapiens
atggctgcccagga

SEQ ID NO: 4029201 - DNA, 15 bp, Homo sapiens
atggctgcccaggag

SEQ ID NO: 4029202 - DNA, 16 bp, Homo sapiens
atggcttaatgtttat

SEQ ID NO: 4029203 - DNA, 13 bp, Homo sapiens
atggcttgacatg

SEQ ID NO: 4029204 - DNA, 15 bp, Homo sapiens
atggcttgacatgtg

SEQ ID NO: 4029205 - DNA, 16 bp, Homo sapiens
atggcttgacatgtgc

SEQ ID NO: 4029206 - DNA, 18 bp, Homo sapiens
atggcttgacatgtgcaa

SEQ ID NO: 4029207 - DNA, 14 bp, Homo sapiens
atgggaaactgttg

SEQ ID NO: 4029208 - DNA, 23 bp, Homo sapiens
atgggaaagccacctctccctca

SEQ ID NO: 4029209 - DNA, 18 bp, Homo sapiens
atgggaatagggagacag

SEQ ID NO: 4029210 - DNA, 17 bp, Homo sapiens
atgggaatgaggtggga

SEQ ID NO: 4029211 - DNA, 17 bp, Homo sapiens
atgggacagggaggcca

SEQ ID NO: 4029212 - DNA, 18 bp, Homo sapiens
atgggacagggaggccac

SEQ ID NO: 4029213 - DNA, 22 bp, Homo sapiens
atgggactcattgtagaaagga

SEQ ID NO: 4029214 - DNA, 17 bp, Homo sapiens
atgggagacccttgaca

SEQ ID NO: 4029215 - DNA, 22 bp, Homo sapiens
atgggagccccagggtcttccc

SEQ ID NO: 4029216 - DNA, 19 bp, Homo sapiens
atgggagctcctctcctgg

SEQ ID NO: 4029217 - DNA, 21 bp, Homo sapiens
atgggagctcctctcctggag

SEQ ID NO: 4029218 - DNA, 24 bp, Homo sapiens
atgggagctcctctcctggaggat

SEQ ID NO: 4029219 - DNA, 23 bp, Homo sapiens
atgggagctgaggccacactcag

SEQ ID NO: 4029220 - DNA, 23 bp, Homo sapiens
atgggagggggcttgaagccaaa

SEQ ID NO: 4029221 - DNA, 13 bp, Homo sapiens
atgggagtgggca

SEQ ID NO: 4029222 - DNA, 14 bp, Homo sapiens
atgggagtgggcac

SEQ ID NO: 4029223 - DNA, 15 bp, Homo sapiens
atgggagtgggcacc

SEQ ID NO: 4029224 - DNA, 23 bp, Homo sapiens
atgggatttttcttttgaggcat

SEQ ID NO: 4029225 - DNA, 23 bp, Homo sapiens
atgggccagggtttacccagtgg

SEQ ID NO: 4029226 - DNA, 18 bp, Homo sapiens
atgggcctgccgggctga

SEQ ID NO: 4029227 - DNA, 15 bp, Homo sapiens
atgggcgggggtggt

SEQ ID NO: 4029228 - DNA, 16 bp, Homo sapiens
atgggctcctgcccct

SEQ ID NO: 4029229 - DNA, 18 bp, Homo sapiens
atgggcttgttttcttgc

SEQ ID NO: 4029230 - DNA, 17 bp, Homo sapiens
atggggataaaatgact

SEQ ID NO: 4029231 - DNA, 21 bp, Homo sapiens
atggggcaagacagaaaagtg

SEQ ID NO: 4029232 - DNA, 18 bp, Homo sapiens
atggggcctccctccttg

SEQ ID NO: 4029233 - DNA, 14 bp, Homo sapiens
atgggggtttcacc

SEQ ID NO: 4029234 - DNA, 19 bp, Homo sapiens
atggggtggggtagggctg

SEQ ID NO: 4029235 - DNA, 21 bp, Homo sapiens
atggggtttgggcccctcaga

SEQ ID NO: 4029236 - DNA, 13 bp, Homo sapiens
atgggtcagagct

SEQ ID NO: 4029237 - DNA, 14 bp, Homo sapiens
atgggtcagagcta

SEQ ID NO: 4029238 - DNA, 12 bp, Homo sapiens
atgggtccaggg

SEQ ID NO: 4029239 - DNA, 18 bp, Homo sapiens
atgacagggcagagcagg

SEQ ID NO: 4029240 - DNA, 22 bp, Homo sapiens
atgacagttatactgtcggttt

SEQ ID NO: 4029241 - DNA, 24 bp, Homo sapiens
atgacatcttcaaagcttgaagat

SEQ ID NO: 4029242 - DNA, 17 bp, Homo sapiens
atgacattaaatgcaat

SEQ ID NO: 4029243 - DNA, 23 bp, Homo sapiens
atgacattaaatgcaataatttt

SEQ ID NO: 4029244 - DNA, 20 bp, Homo sapiens
atgaccagggatgctgggct

SEQ ID NO: 4029245 - DNA, 22 bp, Homo sapiens
atgacccctcgtccacccccca

SEQ ID NO: 4029246 - DNA, 14 bp, Homo sapiens
atgacccctgccca

SEQ ID NO: 4029247 - DNA, 14 bp, Homo sapiens
atgacccctgggca

SEQ ID NO: 4029248 - DNA, 14 bp, Homo sapiens
atgacctggataac

SEQ ID NO: 4029249 - DNA, 21 bp, Homo sapiens
atgacctgtgaccagcactgt

SEQ ID NO: 4029250 - DNA, 17 bp, Homo sapiens
atgaccttggggtacaa

SEQ ID NO: 4029251 - DNA, 14 bp, Homo sapiens
atgacgcggctcaa

SEQ ID NO: 4029252 - DNA, 14 bp, Homo sapiens
atgactaaaaatat

SEQ ID NO: 4029253 - DNA, 13 bp, Homo sapiens
atgactaaagaga

SEQ ID NO: 4029254 - DNA, 16 bp, Homo sapiens
atgactaaagagagaa

SEQ ID NO: 4029255 - DNA, 17 bp, Homo sapiens
atgactaaagagagaat

SEQ ID NO: 4029256 - DNA, 20 bp, Homo sapiens
atgactaaagagagaatgta

SEQ ID NO: 4029257 - DNA, 23 bp, Homo sapiens
atgactaattagggtacatttat

SEQ ID NO: 4029258 - DNA, 16 bp, Homo sapiens
atgactgcacccagct

SEQ ID NO: 4029259 - DNA, 22 bp, Homo sapiens
atgactgctccccagccctggc

SEQ ID NO: 4029260 - DNA, 20 bp, Homo sapiens
atgactgtgaccaccttctg

SEQ ID NO: 4029261 - DNA, 16 bp, Homo sapiens
atgacttgctactttt

SEQ ID NO: 4029262 - DNA, 16 bp, Homo sapiens
atgagaagagggcctg

SEQ ID NO: 4029263 - DNA, 16 bp, Homo sapiens
atgagaaggaacttcc

SEQ ID NO: 4029264 - DNA, 21 bp, Homo sapiens
atgagacagggtcttgctctg

SEQ ID NO: 4029265 - DNA, 18 bp, Homo sapiens
atgagaccactgttatca

SEQ ID NO: 4029266 - DNA, 23 bp, Homo sapiens
atgagacttccaaacctgacaga

SEQ ID NO: 4029267 - DNA, 15 bp, Homo sapiens
atgagactttctgct

SEQ ID NO: 4029268 - DNA, 13 bp, Homo sapiens
atgagagcccaga

SEQ ID NO: 4029269 - DNA, 16 bp, Homo sapiens
atgagagcccagaggt

SEQ ID NO: 4029270 - DNA, 20 bp, Homo sapiens
atgagagcccagaggtaaca

SEQ ID NO: 4029271 - DNA, 17 bp, Homo sapiens
atgagatctgaatgtgg

SEQ ID NO: 4029272 - DNA, 12 bp, Homo sapiens
atgagatgctgg

SEQ ID NO: 4029273 - DNA, 13 bp, Homo sapiens
atgagattgaatt

SEQ ID NO: 4029274 - DNA, 14 bp, Homo sapiens
atgagcaaggacat

SEQ ID NO: 4029275 - DNA, 15 bp, Homo sapiens
atgagcaaggacatt

SEQ ID NO: 4029276 - DNA, 16 bp, Homo sapiens
atgagcaaggacattg

SEQ ID NO: 4029277 - DNA, 19 bp, Homo sapiens
atgagcaaggacattgccc

SEQ ID NO: 4029278 - DNA, 20 bp, Homo sapiens
atgagcaaggacattgcccc

SEQ ID NO: 4029279 - DNA, 14 bp, Homo sapiens
atgagcagtcacac

SEQ ID NO: 4029280 - DNA, 17 bp, Homo sapiens
atgagcagtcacactgt

SEQ ID NO: 4029281 - DNA, 11 bp, Homo sapiens
atgagccagac

SEQ ID NO: 4029282 - DNA, 22 bp, Homo sapiens
atgagccatcactagaagaaaa

SEQ ID NO: 4029283 - DNA, 12 bp, Homo sapiens
atgagcccagag

SEQ ID NO: 4029284 - DNA, 16 bp, Homo sapiens
atgagcccagagaaca

SEQ ID NO: 4029285 - DNA, 18 bp, Homo sapiens
atgagcctgcccgctgca

SEQ ID NO: 4029286 - DNA, 20 bp, Homo sapiens
atgagctatttccattccag

SEQ ID NO: 4029287 - DNA, 13 bp, Homo sapiens
atgagctgagggg

SEQ ID NO: 4029288 - DNA, 17 bp, Homo sapiens
atgaggaggggagggta

SEQ ID NO: 4029289 - DNA, 14 bp, Homo sapiens
atgaggagggtggg

SEQ ID NO: 4029290 - DNA, 16 bp, Homo sapiens
atgaggccatctcagg

SEQ ID NO: 4029291 - DNA, 11 bp, Homo sapiens
atgaggggaga

SEQ ID NO: 4029292 - DNA, 16 bp, Homo sapiens
atgaggtcccaggcag

SEQ ID NO: 4029293 - DNA, 18 bp, Homo sapiens
atgaggtcccaggcagag

SEQ ID NO: 4029294 - DNA, 19 bp, Homo sapiens
atgaggtcccaggcagaga

SEQ ID NO: 4029295 - DNA, 17 bp, Homo sapiens
atgaggtctgaaatgga

SEQ ID NO: 4029296 - DNA, 14 bp, Homo sapiens
atgaggtctgttta

SEQ ID NO: 4029297 - DNA, 22 bp, Homo sapiens
atgaggtgggaggtggaagaag

SEQ ID NO: 4029298 - DNA, 13 bp, Homo sapiens
atgaggttctgag

SEQ ID NO: 4029299 - DNA, 21 bp, Homo sapiens
atgagtaaaaaaaaaaacaat

SEQ ID NO: 4029300 - DNA, 19 bp, Homo sapiens
atgagtattagttccctgt

SEQ ID NO: 4029301 - DNA, 17 bp, Homo sapiens
atgagtatttggtccaa

SEQ ID NO: 4029302 - DNA, 19 bp, Homo sapiens
atgagtcaatgtgcagtgt

SEQ ID NO: 4029303 - DNA, 17 bp, Homo sapiens
atgagtgaataaatgtc

SEQ ID NO: 4029304 - DNA, 19 bp, Homo sapiens
atgagtgattgacacacag

SEQ ID NO: 4029305 - DNA, 13 bp, Homo sapiens
atgagtgtgaatg

SEQ ID NO: 4029306 - DNA, 14 bp, Homo sapiens
atgagttgtgatga

SEQ ID NO: 4029307 - DNA, 12 bp, Homo sapiens
atgataaaataa

SEQ ID NO: 4029308 - DNA, 14 bp, Homo sapiens
atgataaaataaat

SEQ ID NO: 4029309 - DNA, 14 bp, Homo sapiens
atgataacagaact

SEQ ID NO: 4029310 - DNA, 21 bp, Homo sapiens
atgatactatcatactactga

SEQ ID NO: 4029311 - DNA, 18 bp, Homo sapiens
atgatattgtttaaaatt

SEQ ID NO: 4029312 - DNA, 19 bp, Homo sapiens
atgatcagctgtttgtcat

SEQ ID NO: 4029313 - DNA, 22 bp, Homo sapiens
atgatcatttgcccttaaggac

SEQ ID NO: 4029314 - DNA, 16 bp, Homo sapiens
atgatccagaacagtg

SEQ ID NO: 4029315 - DNA, 21 bp, Homo sapiens
atgatccagaacagtggctcg

SEQ ID NO: 4029316 - DNA, 14 bp, Homo sapiens
atgatctactcaga

SEQ ID NO: 4029317 - DNA, 17 bp, Homo sapiens
atgatctctctagcttt

SEQ ID NO: 4029318 - DNA, 18 bp, Homo sapiens
atgatctctctagctttg

SEQ ID NO: 4029319 - DNA, 17 bp, Homo sapiens
atgatctgcctctaaaa

SEQ ID NO: 4029320 - DNA, 18 bp, Homo sapiens
atgatcttctttataatt

SEQ ID NO: 4029321 - DNA, 19 bp, Homo sapiens
atgatgattaaacacctga

SEQ ID NO: 4029322 - DNA, 20 bp, Homo sapiens
atgatgattaaacacctgac

SEQ ID NO: 4029323 - DNA, 23 bp, Homo sapiens
atgatgattaaacacctgacaca

SEQ ID NO: 4029324 - DNA, 16 bp, Homo sapiens
atgatgctctttccca

SEQ ID NO: 4029325 - DNA, 15 bp, Homo sapiens
atgatgggaaaatat

SEQ ID NO: 4029326 - DNA, 17 bp, Homo sapiens
atgatgggaaaatattt

SEQ ID NO: 4029327 - DNA, 21 bp, Homo sapiens
atgatgggaatagggagacag

SEQ ID NO: 4029328 - DNA, 18 bp, Homo sapiens
atgatgtccagaagaata

SEQ ID NO: 4029329 - DNA, 19 bp, Homo sapiens
atgatgtccagaagaatat

SEQ ID NO: 4029330 - DNA, 15 bp, Homo sapiens
atgattaaacacctg

SEQ ID NO: 4029331 - DNA, 14 bp, Homo sapiens
atgattcagaaatt

SEQ ID NO: 4029332 - DNA, 20 bp, Homo sapiens
atgattctttgttacaggca

SEQ ID NO: 4029333 - DNA, 20 bp, Homo sapiens
atgattgtttctcaaatctt

SEQ ID NO: 4029334 - DNA, 14 bp, Homo sapiens
atgatttaataaaa

SEQ ID NO: 4029335 - DNA, 20 bp, Homo sapiens
atgatttcactagaaaagct

SEQ ID NO: 4029336 - DNA, 21 bp, Homo sapiens
atgatttcagtcatagcaagc

SEQ ID NO: 4029337 - DNA, 16 bp, Homo sapiens
atgatttccttgaatg

SEQ ID NO: 4029338 - DNA, 19 bp, Homo sapiens
atgatttgggggaggcttt

SEQ ID NO: 4029339 - DNA, 14 bp, Homo sapiens
atgatttgttttga

SEQ ID NO: 4029340 - DNA, 16 bp, Homo sapiens
atgattttatttgaca

SEQ ID NO: 4029341 - DNA, 13 bp, Homo sapiens
atgattttccttt

SEQ ID NO: 4029342 - DNA, 19 bp, Homo sapiens
atggtcacacactgatgct

SEQ ID NO: 4029343 - DNA, 20 bp, Homo sapiens
atggtcacacactgatgctt

SEQ ID NO: 4029344 - DNA, 17 bp, Homo sapiens
atggtcattgcagttta

SEQ ID NO: 4029345 - DNA, 19 bp, Homo sapiens
atggtccaattagtttcct

SEQ ID NO: 4029346 - DNA, 20 bp, Homo sapiens
atggtccaattagtttcctt

SEQ ID NO: 4029347 - DNA, 12 bp, Homo sapiens
atggtccagaaa

SEQ ID NO: 4029348 - DNA, 15 bp, Homo sapiens
atggtcgcccaggag

SEQ ID NO: 4029349 - DNA, 12 bp, Homo sapiens
atggtgagaccc

SEQ ID NO: 4029350 - DNA, 16 bp, Homo sapiens
atggtgatcctctatt

SEQ ID NO: 4029351 - DNA, 17 bp, Homo sapiens
atggtgatcctctattt

SEQ ID NO: 4029352 - DNA, 19 bp, Homo sapiens
atggtgatcctctattttg

SEQ ID NO: 4029353 - DNA, 23 bp, Homo sapiens
atggtgatcctctattttgtgat

SEQ ID NO: 4029354 - DNA, 21 bp, Homo sapiens
atggtgcagagaagctggact

SEQ ID NO: 4029355 - DNA, 18 bp, Homo sapiens
atggtgcagttgacagca

SEQ ID NO: 4029356 - DNA, 15 bp, Homo sapiens
atggtgccccaggac

SEQ ID NO: 4029357 - DNA, 14 bp, Homo sapiens
atggtgcctgagag

SEQ ID NO: 4029358 - DNA, 15 bp, Homo sapiens
atggtggactaagca

SEQ ID NO: 4029359 - DNA, 14 bp, Homo sapiens
atggtgtaataaga

SEQ ID NO: 4029360 - DNA, 13 bp, Homo sapiens
atggtgtacataa

SEQ ID NO: 4029361 - DNA, 12 bp, Homo sapiens
atggtgtcccgg

SEQ ID NO: 4029362 - DNA, 21 bp, Homo sapiens
atggtgtcccggtaccttcca

SEQ ID NO: 4029363 - DNA, 20 bp, Homo sapiens
atggtgtgggtgtcctgcct

SEQ ID NO: 4029364 - DNA, 15 bp, Homo sapiens
atggttacaatcatt

SEQ ID NO: 4029365 - DNA, 19 bp, Homo sapiens
atggttacaatcattgctg

SEQ ID NO: 4029366 - DNA, 14 bp, Homo sapiens
atggttatgaaaga

SEQ ID NO: 4029367 - DNA, 18 bp, Homo sapiens
atggttatgaaagaatat

SEQ ID NO: 4029368 - DNA, 20 bp, Homo sapiens
atggttcagaattaaacttt

SEQ ID NO: 4029369 - DNA, 16 bp, Homo sapiens
atggttccatgcctga

SEQ ID NO: 4029370 - DNA, 18 bp, Homo sapiens
atggttccatgcctgagg

SEQ ID NO: 4029371 - DNA, 18 bp, Homo sapiens
atggttcccaataaaagt

SEQ ID NO: 4029372 - DNA, 19 bp, Homo sapiens
atggttcccaataaaagtg

SEQ ID NO: 4029373 - DNA, 20 bp, Homo sapiens
atggttcccctgttcactct

SEQ ID NO: 4029374 - DNA, 13 bp, Homo sapiens
atggttgatggaa

SEQ ID NO: 4029375 - DNA, 15 bp, Homo sapiens
atggttgatggaaaa

SEQ ID NO: 4029376 - DNA, 18 bp, Homo sapiens
atggttgtctgtttttgt

SEQ ID NO: 4029377 - DNA, 17 bp, Homo sapiens
atggtttccatttacta

SEQ ID NO: 4029378 - DNA, 15 bp, Homo sapiens
atggtttgtcctgat

SEQ ID NO: 4029379 - DNA, 14 bp, Homo sapiens
atggttttcaaaat

SEQ ID NO: 4029380 - DNA, 20 bp, Homo sapiens
atggtttttatttctcgggt

SEQ ID NO: 4029381 - DNA, 20 bp, Homo sapiens
atggtttttgcctaaaatat

SEQ ID NO: 4029382 - DNA, 11 bp, Homo sapiens
atgtaaaaaag

SEQ ID NO: 4029383 - DNA, 13 bp, Homo sapiens
atgtaaaaaagaa

SEQ ID NO: 4029384 - DNA, 12 bp, Homo sapiens
atgtaaaatgat

SEQ ID NO: 4029385 - DNA, 15 bp, Homo sapiens
atgtaaactttgtca

SEQ ID NO: 4029386 - DNA, 16 bp, Homo sapiens
atgtaaagaaatgtct

SEQ ID NO: 4029387 - DNA, 14 bp, Homo sapiens
atgtaaatccccac

SEQ ID NO: 4029388 - DNA, 19 bp, Homo sapiens
atgtaactaggtttttgct

SEQ ID NO: 4029389 - DNA, 16 bp, Homo sapiens
atgtaactccagatag

SEQ ID NO: 4029390 - DNA, 21 bp, Homo sapiens
atgtaactccagatagagaaa

SEQ ID NO: 4029391 - DNA, 22 bp, Homo sapiens
atgtaactccagatagagaaat

SEQ ID NO: 4029392 - DNA, 24 bp, Homo sapiens
atgtaactccagatagagaaatag

SEQ ID NO: 4029393 - DNA, 17 bp, Homo sapiens
atgtaagctctactgag

SEQ ID NO: 4029394 - DNA, 22 bp, Homo sapiens
atgtaatactggaataatttgt

SEQ ID NO: 4029395 - DNA, 20 bp, Homo sapiens
atgtaatctctctgcagctg

SEQ ID NO: 4029396 - DNA, 16 bp, Homo sapiens
atgtaatgcttccaat

SEQ ID NO: 4029397 - DNA, 20 bp, Homo sapiens
atgtaatgtgtggtggcctc

SEQ ID NO: 4029398 - DNA, 21 bp, Homo sapiens
atgtaatgtgtggtggcctca

SEQ ID NO: 4029399 - DNA, 14 bp, Homo sapiens
atgtaatttatgca

SEQ ID NO: 4029400 - DNA, 13 bp, Homo sapiens
atgtacataactc

SEQ ID NO: 4029401 - DNA, 17 bp, Homo sapiens
atgtacatttgtctttt

SEQ ID NO: 4029402 - DNA, 19 bp, Homo sapiens
atgtaccatatgatctgtt

SEQ ID NO: 4029403 - DNA, 15 bp, Homo sapiens
atgtaccatgtacat

SEQ ID NO: 4029404 - DNA, 16 bp, Homo sapiens
atgtaccgtaggcttt

SEQ ID NO: 4029405 - DNA, 15 bp, Homo sapiens
atgtactagtgttct

SEQ ID NO: 4029406 - DNA, 21 bp, Homo sapiens
atgtactagttttagttttct

SEQ ID NO: 4029407 - DNA, 18 bp, Homo sapiens
atgtagagagaacaggtg

SEQ ID NO: 4029408 - DNA, 17 bp, Homo sapiens
atgtagatgtgcatttt

SEQ ID NO: 4029409 - DNA, 16 bp, Homo sapiens
atgtagccagctgtgc

SEQ ID NO: 4029410 - DNA, 16 bp, Homo sapiens
atgtagcccatccttc

SEQ ID NO: 4029411 - DNA, 20 bp, Homo sapiens
atgtagcccatccttccctt

SEQ ID NO: 4029412 - DNA, 13 bp, Homo sapiens
atgtagcgtgttt

SEQ ID NO: 4029413 - DNA, 22 bp, Homo sapiens
atgtagcgtgtttacatgtgta

SEQ ID NO: 4029414 - DNA, 15 bp, Homo sapiens
atgtagcttcttctg

SEQ ID NO: 4029415 - DNA, 20 bp, Homo sapiens
atgtagcttcttctgaaaga

SEQ ID NO: 4029416 - DNA, 15 bp, Homo sapiens
atgtaggtgtctgca

SEQ ID NO: 4029417 - DNA, 16 bp, Homo sapiens
atgtagtaattgacat

SEQ ID NO: 4029418 - DNA, 23 bp, Homo sapiens
atgtataaacataagttgcattt

SEQ ID NO: 4029419 - DNA, 18 bp, Homo sapiens
atgtatatttttttaatt

SEQ ID NO: 4029420 - DNA, 15 bp, Homo sapiens
atgtatcaatgagta

SEQ ID NO: 4029421 - DNA, 22 bp, Homo sapiens
atgtatgaaggaatcattccag

SEQ ID NO: 4029422 - DNA, 14 bp, Homo sapiens
atgtatgattacat

SEQ ID NO: 4029423 - DNA, 18 bp, Homo sapiens
atgtatggaatacagtgt

SEQ ID NO: 4029424 - DNA, 16 bp, Homo sapiens
atgtatgtgtaagtat

SEQ ID NO: 4029425 - DNA, 12 bp, Homo sapiens
atgtatgtttac

SEQ ID NO: 4029426 - DNA, 13 bp, Homo sapiens
atgtatgtttaca

SEQ ID NO: 4029427 - DNA, 16 bp, Homo sapiens
atgtatgtttacatat

SEQ ID NO: 4029428 - DNA, 16 bp, Homo sapiens
atgtatgtttctgcat

SEQ ID NO: 4029429 - DNA, 13 bp, Homo sapiens
atgtattattctg

SEQ ID NO: 4029430 - DNA, 14 bp, Homo sapiens
atgtattattctgc

SEQ ID NO: 4029431 - DNA, 16 bp, Homo sapiens
atgtattattctgcag

SEQ ID NO: 4029432 - DNA, 15 bp, Homo sapiens
atgtattatttataa

SEQ ID NO: 4029433 - DNA, 17 bp, Homo sapiens
atgtattatttataatt

SEQ ID NO: 4029434 - DNA, 17 bp, Homo sapiens
atgtattgtaatctttc

SEQ ID NO: 4029435 - DNA, 14 bp, Homo sapiens
atgtattttgaaga

SEQ ID NO: 4029436 - DNA, 18 bp, Homo sapiens
atgtattttgaagaatat

SEQ ID NO: 4029437 - DNA, 20 bp, Homo sapiens
atgtattttgaagaatattt

SEQ ID NO: 4029438 - DNA, 23 bp, Homo sapiens
atgtattttgaagaatatttaag

SEQ ID NO: 4029439 - DNA, 20 bp, Homo sapiens
atgtcaaacagtgccaaatg

SEQ ID NO: 4029440 - DNA, 18 bp, Homo sapiens
atgtcaaagatatgttaa

SEQ ID NO: 4029441 - DNA, 14 bp, Homo sapiens
atgtcaacttctgg

SEQ ID NO: 4029442 - DNA, 18 bp, Homo sapiens
atgtcaacttctggctcc

SEQ ID NO: 4029443 - DNA, 22 bp, Homo sapiens
atgtcaaggaagacttttggta

SEQ ID NO: 4029444 - DNA, 23 bp, Homo sapiens
atgtcaataaacaacagctgaag

SEQ ID NO: 4029445 - DNA, 14 bp, Homo sapiens
attagactgtgatt

SEQ ID NO: 4029446 - DNA, 16 bp, Homo sapiens
attagattttatttta

SEQ ID NO: 4029447 - DNA, 18 bp, Homo sapiens
attagattttattttact

SEQ ID NO: 4029448 - DNA, 22 bp, Homo sapiens
attagattttattttactattg

SEQ ID NO: 4029449 - DNA, 14 bp, Homo sapiens
attagcaaggctgg

SEQ ID NO: 4029450 - DNA, 18 bp, Homo sapiens
attagcaaggtcatttct

SEQ ID NO: 4029451 - DNA, 22 bp, Homo sapiens
attagccaggatcatggtgtaa

SEQ ID NO: 4029452 - DNA, 13 bp, Homo sapiens
attagctttgtgt

SEQ ID NO: 4029453 - DNA, 15 bp, Homo sapiens
attagctttgtgttt

SEQ ID NO: 4029454 - DNA, 22 bp, Homo sapiens
attaggaagtgtaacagctgag

SEQ ID NO: 4029455 - DNA, 20 bp, Homo sapiens
attaggcaaggctatgtgat

SEQ ID NO: 4029456 - DNA, 17 bp, Homo sapiens
attagggagaaaattca

SEQ ID NO: 4029457 - DNA, 23 bp, Homo sapiens
attagggagaaaattcaattgta

SEQ ID NO: 4029458 - DNA, 22 bp, Homo sapiens
attaggggttaaagcagacagt

SEQ ID NO: 4029459 - DNA, 18 bp, Homo sapiens
attaggtagactttgctt

SEQ ID NO: 4029460 - DNA, 13 bp, Homo sapiens
attagtaaatgtc

SEQ ID NO: 4029461 - DNA, 22 bp, Homo sapiens
attagtaccatagtaccattta

SEQ ID NO: 4029462 - DNA, 19 bp, Homo sapiens
attagtcctaattcaatcc

SEQ ID NO: 4029463 - DNA, 13 bp, Homo sapiens
attagtctgaaac

SEQ ID NO: 4029464 - DNA, 18 bp, Homo sapiens
attagtgccagaatttta

SEQ ID NO: 4029465 - DNA, 22 bp, Homo sapiens
attagttgaaaggcctcaagaa

SEQ ID NO: 4029466 - DNA, 12 bp, Homo sapiens
attagtttcctt

SEQ ID NO: 4029467 - DNA, 17 bp, Homo sapiens
attagtttcctttttaa

SEQ ID NO: 4029468 - DNA, 20 bp, Homo sapiens
attagtttcctttttaatat

SEQ ID NO: 4029469 - DNA, 20 bp, Homo sapiens
attagttttagaggcattgt

SEQ ID NO: 4029470 - DNA, 19 bp, Homo sapiens
attataaactcattttgct

SEQ ID NO: 4029471 - DNA, 11 bp, Homo sapiens
attataaatga

SEQ ID NO: 4029472 - DNA, 16 bp, Homo sapiens
attataaatgttagtt

SEQ ID NO: 4029473 - DNA, 16 bp, Homo sapiens
attataacttaaaata

SEQ ID NO: 4029474 - DNA, 23 bp, Homo sapiens
attataagggagagctgagccag

SEQ ID NO: 4029475 - DNA, 13 bp, Homo sapiens
attatacaggaaa

SEQ ID NO: 4029476 - DNA, 22 bp, Homo sapiens
attatacatcaattggaaatca

SEQ ID NO: 4029477 - DNA, 14 bp, Homo sapiens
attatacgctggca

SEQ ID NO: 4029478 - DNA, 17 bp, Homo sapiens
attatactaacttattt

SEQ ID NO: 4029479 - DNA, 15 bp, Homo sapiens
attatactaagaaaa

SEQ ID NO: 4029480 - DNA, 17 bp, Homo sapiens
attataggagccttaat

SEQ ID NO: 4029481 - DNA, 23 bp, Homo sapiens
attatattggtgcgtttttacag

SEQ ID NO: 4029482 - DNA, 13 bp, Homo sapiens
attatattggtgg

SEQ ID NO: 4029483 - DNA, 16 bp, Homo sapiens
attatcggaagcagtg

SEQ ID NO: 4029484 - DNA, 21 bp, Homo sapiens
attatcggaagcagtgccttc

SEQ ID NO: 4029485 - DNA, 17 bp, Homo sapiens
attatcgggaacagtgt

SEQ ID NO: 4029486 - DNA, 18 bp, Homo sapiens
attatcgggaacagtgtt

SEQ ID NO: 4029487 - DNA, 20 bp, Homo sapiens
attatctatacatatcttta

SEQ ID NO: 4029488 - DNA, 22 bp, Homo sapiens
attatctatagctaagtacaca

SEQ ID NO: 4029489 - DNA, 13 bp, Homo sapiens
attatcttatgaa

SEQ ID NO: 4029490 - DNA, 18 bp, Homo sapiens
attatcttggaaagaaac

SEQ ID NO: 4029491 - DNA, 20 bp, Homo sapiens
attatgaaatttcacttcag

SEQ ID NO: 4029492 - DNA, 19 bp, Homo sapiens
attatgacagttatactgt

SEQ ID NO: 4029493 - DNA, 12 bp, Homo sapiens
attatgatattt

SEQ ID NO: 4029494 - DNA, 22 bp, Homo sapiens
attatgccacttccttttaact

SEQ ID NO: 4029495 - DNA, 16 bp, Homo sapiens
attatgtataaacata

SEQ ID NO: 4029496 - DNA, 13 bp, Homo sapiens
attatgtatctta

SEQ ID NO: 4029497 - DNA, 23 bp, Homo sapiens
attatgtcttttatatttgtatc

SEQ ID NO: 4029498 - DNA, 19 bp, Homo sapiens
attatgttggtactttcca

SEQ ID NO: 4029499 - DNA, 15 bp, Homo sapiens
attattaactacatt

SEQ ID NO: 4029500 - DNA, 20 bp, Homo sapiens
attattaactacatttatga

SEQ ID NO: 4029501 - DNA, 22 bp, Homo sapiens
attattatgaagaattgccaat

SEQ ID NO: 4029502 - DNA, 15 bp, Homo sapiens
attattcatttaaaa

SEQ ID NO: 4029503 - DNA, 18 bp, Homo sapiens
attattcatttaaaatga

SEQ ID NO: 4029504 - DNA, 20 bp, Homo sapiens
attattcatttaaaatgatt

SEQ ID NO: 4029505 - DNA, 13 bp, Homo sapiens
attattcatttag

SEQ ID NO: 4029506 - DNA, 12 bp, Homo sapiens
attattctctgc

SEQ ID NO: 4029507 - DNA, 21 bp, Homo sapiens
attattctcttttatctgttt

SEQ ID NO: 4029508 - DNA, 15 bp, Homo sapiens
attattctgttttgc

SEQ ID NO: 4029509 - DNA, 15 bp, Homo sapiens
attattgatagtact

SEQ ID NO: 4029510 - DNA, 15 bp, Homo sapiens
attattggctgcttt

SEQ ID NO: 4029511 - DNA, 15 bp, Homo sapiens
attattgtaagttgt

SEQ ID NO: 4029512 - DNA, 18 bp, Homo sapiens
attattgtaagttgtaca

SEQ ID NO: 4029513 - DNA, 12 bp, Homo sapiens
attatttaaata

SEQ ID NO: 4029514 - DNA, 16 bp, Homo sapiens
attatttaaataaaat

SEQ ID NO: 4029515 - DNA, 13 bp, Homo sapiens
attatttaataac

SEQ ID NO: 4029516 - DNA, 21 bp, Homo sapiens
attatttaataacattacctt

SEQ ID NO: 4029517 - DNA, 22 bp, Homo sapiens
attatttaataacattacctta

SEQ ID NO: 4029518 - DNA, 12 bp, Homo sapiens
attatttataat

SEQ ID NO: 4029519 - DNA, 16 bp, Homo sapiens
attatttatatatgta

SEQ ID NO: 4029520 - DNA, 22 bp, Homo sapiens
attatttatatggggaatatat

SEQ ID NO: 4029521 - DNA, 15 bp, Homo sapiens
attatttatttattt

SEQ ID NO: 4029522 - DNA, 15 bp, Homo sapiens
attatttgccttctg

SEQ ID NO: 4029523 - DNA, 13 bp, Homo sapiens
attatttgctaag

SEQ ID NO: 4029524 - DNA, 20 bp, Homo sapiens
attatttgggagggaaaagg

SEQ ID NO: 4029525 - DNA, 21 bp, Homo sapiens
attatttgggagggaaaaggg

SEQ ID NO: 4029526 - DNA, 15 bp, Homo sapiens
attattttaaaatat

SEQ ID NO: 4029527 - DNA, 23 bp, Homo sapiens
attattttgggaagaaaacctgt

SEQ ID NO: 4029528 - DNA, 22 bp, Homo sapiens
attattttggggtctcttttgt

SEQ ID NO: 4029529 - DNA, 20 bp, Homo sapiens
attattttggtacttttatg

SEQ ID NO: 4029530 - DNA, 14 bp, Homo sapiens
attatttttaccta

SEQ ID NO: 4029531 - DNA, 22 bp, Homo sapiens
attatttttccactttgttctt

SEQ ID NO: 4029532 - DNA, 22 bp, Homo sapiens
attcaaactggggcctccagaa

SEQ ID NO: 4029533 - DNA, 22 bp, Homo sapiens
attcaaagtagttttattttaa

SEQ ID NO: 4029534 - DNA, 23 bp, Homo sapiens
attcaaagtagttttattttaat

SEQ ID NO: 4029535 - DNA, 21 bp, Homo sapiens
attcaaagtgttgtgttcctg

SEQ ID NO: 4029536 - DNA, 18 bp, Homo sapiens
attcaagaaaataaaact

SEQ ID NO: 4029537 - DNA, 13 bp, Homo sapiens
attcaagaaagga

SEQ ID NO: 4029538 - DNA, 18 bp, Homo sapiens
attcaaggagaatatgat

SEQ ID NO: 4029539 - DNA, 20 bp, Homo sapiens
attcaaggagaatatgataa

SEQ ID NO: 4029540 - DNA, 21 bp, Homo sapiens
attcaaggcatttctatcaca

SEQ ID NO: 4029541 - DNA, 15 bp, Homo sapiens
attcaatattgacat

SEQ ID NO: 4029542 - DNA, 20 bp, Homo sapiens
attcaatattgacatttgta

SEQ ID NO: 4029543 - DNA, 20 bp, Homo sapiens
attcaatgtgaacactggca

SEQ ID NO: 4029544 - DNA, 22 bp, Homo sapiens
attcaattgtaaattgaatcag

SEQ ID NO: 4029545 - DNA, 14 bp, Homo sapiens
attcacaaactttt

SEQ ID NO: 4029546 - DNA, 17 bp, Homo sapiens
attcacaaacttttata

SEQ ID NO: 4029547 - DNA, 14 bp, Homo sapiens
attctacagaataa

SEQ ID NO: 4029548 - DNA, 15 bp, Homo sapiens
attgatttgcattga

SEQ ID NO: 4029549 - DNA, 13 bp, Homo sapiens
attgcaaagcaaa

SEQ ID NO: 4029550 - DNA, 12 bp, Homo sapiens
attgcaaatctt

SEQ ID NO: 4029551 - DNA, 16 bp, Homo sapiens
attgcaaatcttgaaa

SEQ ID NO: 4029552 - DNA, 15 bp, Homo sapiens
attgcacgtggcctc

SEQ ID NO: 4029553 - DNA, 17 bp, Homo sapiens
attgcacgtggcctctt

SEQ ID NO: 4029554 - DNA, 23 bp, Homo sapiens
attgcacgtggcctcttgagcag

SEQ ID NO: 4029555 - DNA, 13 bp, Homo sapiens
attgcactaaatg

SEQ ID NO: 4029556 - DNA, 16 bp, Homo sapiens
attgcattctattgcc

SEQ ID NO: 4029557 - DNA, 16 bp, Homo sapiens
attgcatttcctgaca

SEQ ID NO: 4029558 - DNA, 17 bp, Homo sapiens
attgcatttcctgacag

SEQ ID NO: 4029559 - DNA, 17 bp, Homo sapiens
attgccaatcttgtttt

SEQ ID NO: 4029560 - DNA, 19 bp, Homo sapiens
attgccaatcttgttttaa

SEQ ID NO: 4029561 - DNA, 14 bp, Homo sapiens
attgccaccaggag

SEQ ID NO: 4029562 - DNA, 13 bp, Homo sapiens
attgccccaagat

SEQ ID NO: 4029563 - DNA, 23 bp, Homo sapiens
attgccccatccagacctggctc

SEQ ID NO: 4029564 - DNA, 12 bp, Homo sapiens
attgccccctct

SEQ ID NO: 4029565 - DNA, 13 bp, Homo sapiens
attgcccctggct

SEQ ID NO: 4029566 - DNA, 16 bp, Homo sapiens
attgcccctggctttg

SEQ ID NO: 4029567 - DNA, 22 bp, Homo sapiens
attgcccctggctttgcctctt

SEQ ID NO: 4029568 - DNA, 16 bp, Homo sapiens
attgccttctttgaag

SEQ ID NO: 4029569 - DNA, 19 bp, Homo sapiens
attgccttctttgaagaag

SEQ ID NO: 4029570 - DNA, 15 bp, Homo sapiens
attgcggccccagga

SEQ ID NO: 4029571 - DNA, 15 bp, Homo sapiens
attgctagtatttga

SEQ ID NO: 4029572 - DNA, 15 bp, Homo sapiens
attgctatgttacta

SEQ ID NO: 4029573 - DNA, 16 bp, Homo sapiens
attgctccctaagact

SEQ ID NO: 4029574 - DNA, 15 bp, Homo sapiens
attgctctgttccca

SEQ ID NO: 4029575 - DNA, 21 bp, Homo sapiens
attgctgagagaaatatggaa

SEQ ID NO: 4029576 - DNA, 14 bp, Homo sapiens
attgctgagcctct

SEQ ID NO: 4029577 - DNA, 16 bp, Homo sapiens
attgctgagcctctgc

SEQ ID NO: 4029578 - DNA, 13 bp, Homo sapiens
attgctgctgccc

SEQ ID NO: 4029579 - DNA, 17 bp, Homo sapiens
attgctgttgtccctct

SEQ ID NO: 4029580 - DNA, 21 bp, Homo sapiens
attgcttacaagcctaagaat

SEQ ID NO: 4029581 - DNA, 14 bp, Homo sapiens
attgcttacatttt

SEQ ID NO: 4029582 - DNA, 22 bp, Homo sapiens
attgcttctgtagtactcctta

SEQ ID NO: 4029583 - DNA, 13 bp, Homo sapiens
attgcttcttctg

SEQ ID NO: 4029584 - DNA, 14 bp, Homo sapiens
attgcttcttctga

SEQ ID NO: 4029585 - DNA, 13 bp, Homo sapiens
attgctttctgaa

SEQ ID NO: 4029586 - DNA, 17 bp, Homo sapiens
attgctttctgaaatta

SEQ ID NO: 4029587 - DNA, 18 bp, Homo sapiens
attgctttggtcatatga

SEQ ID NO: 4029588 - DNA, 16 bp, Homo sapiens
attgcttttattttga

SEQ ID NO: 4029589 - DNA, 17 bp, Homo sapiens
attgcttttttaaatat

SEQ ID NO: 4029590 - DNA, 14 bp, Homo sapiens
attggaatgccttg

SEQ ID NO: 4029591 - DNA, 18 bp, Homo sapiens
attggaatgttctcagat

SEQ ID NO: 4029592 - DNA, 15 bp, Homo sapiens
attggaattaacctg

SEQ ID NO: 4029593 - DNA, 19 bp, Homo sapiens
attggaattaacctggtgc

SEQ ID NO: 4029594 - DNA, 19 bp, Homo sapiens
attggattatttaataaca

SEQ ID NO: 4029595 - DNA, 19 bp, Homo sapiens
attggcaaagtttaaatgt

SEQ ID NO: 4029596 - DNA, 21 bp, Homo sapiens
attggcacatgccacctggca

SEQ ID NO: 4029597 - DNA, 12 bp, Homo sapiens
attggcctgtag

SEQ ID NO: 4029598 - DNA, 21 bp, Homo sapiens
attggctcacccaagcaaggc

SEQ ID NO: 4029599 - DNA, 22 bp, Homo sapiens
attggctgctttgcctctacca

SEQ ID NO: 4029600 - DNA, 15 bp, Homo sapiens
attgggacaacagtg

SEQ ID NO: 4029601 - DNA, 22 bp, Homo sapiens
attgggcacagtccagacccaa

SEQ ID NO: 4029602 - DNA, 12 bp, Homo sapiens
attggggaggag

SEQ ID NO: 4029603 - DNA, 21 bp, Homo sapiens
attggtggcagattttacaaa

SEQ ID NO: 4029604 - DNA, 18 bp, Homo sapiens
attggtttctcttctccc

SEQ ID NO: 4029605 - DNA, 22 bp, Homo sapiens
attggttttggggaaatgtgga

SEQ ID NO: 4029606 - DNA, 23 bp, Homo sapiens
attggttttggggaaatgtggag

SEQ ID NO: 4029607 - DNA, 17 bp, Homo sapiens
attgtaaaaaaaaatgc

SEQ ID NO: 4029608 - DNA, 20 bp, Homo sapiens
attgtaaaaaaaaatgcctt

SEQ ID NO: 4029609 - DNA, 23 bp, Homo sapiens
attgtaaaaaaaaatgcctttga

SEQ ID NO: 4029610 - DNA, 14 bp, Homo sapiens
attgtaaatagtat

SEQ ID NO: 4029611 - DNA, 20 bp, Homo sapiens
attgtaaccatttctcacta

SEQ ID NO: 4029612 - DNA, 20 bp, Homo sapiens
attgtaagttgtacaaatgt

SEQ ID NO: 4029613 - DNA, 22 bp, Homo sapiens
attgtaagttgtacaaatgtat

SEQ ID NO: 4029614 - DNA, 12 bp, Homo sapiens
attgtacataaa

SEQ ID NO: 4029615 - DNA, 15 bp, Homo sapiens
attgtacataaaaga

SEQ ID NO: 4029616 - DNA, 17 bp, Homo sapiens
attgtaccatcatttta

SEQ ID NO: 4029617 - DNA, 15 bp, Homo sapiens
attgtaggtgcaaga

SEQ ID NO: 4029618 - DNA, 21 bp, Homo sapiens
attgtataaaaagtttcacag

SEQ ID NO: 4029619 - DNA, 14 bp, Homo sapiens
attgtatctagtgc

SEQ ID NO: 4029620 - DNA, 18 bp, Homo sapiens
attgtatctagtgcagct

SEQ ID NO: 4029621 - DNA, 15 bp, Homo sapiens
attgtattatttgga

SEQ ID NO: 4029622 - DNA, 17 bp, Homo sapiens
attgtattatttggagt

SEQ ID NO: 4029623 - DNA, 16 bp, Homo sapiens
attgtcacctgcttct

SEQ ID NO: 4029624 - DNA, 17 bp, Homo sapiens
attgtcacctgcttctc

SEQ ID NO: 4029625 - DNA, 14 bp, Homo sapiens
attgtcagatattt

SEQ ID NO: 4029626 - DNA, 23 bp, Homo sapiens
attgtcagatattttttcagaaa

SEQ ID NO: 4029627 - DNA, 13 bp, Homo sapiens
attgtcagctact

SEQ ID NO: 4029628 - DNA, 19 bp, Homo sapiens
attgtcagctactaatgat

SEQ ID NO: 4029629 - DNA, 16 bp, Homo sapiens
attgtcattattttgg

SEQ ID NO: 4029630 - DNA, 16 bp, Homo sapiens
attgtcctaagtgtca

SEQ ID NO: 4029631 - DNA, 15 bp, Homo sapiens
attgtcgctattgat

SEQ ID NO: 4029632 - DNA, 12 bp, Homo sapiens
attgtctattta

SEQ ID NO: 4029633 - DNA, 23 bp, Homo sapiens
attgtctcaacgcctccccctcc

SEQ ID NO: 4029634 - DNA, 16 bp, Homo sapiens
attgtctcccttccag

SEQ ID NO: 4029635 - DNA, 14 bp, Homo sapiens
attgtgaactcatt

SEQ ID NO: 4029636 - DNA, 15 bp, Homo sapiens
attgtgaactcattg

SEQ ID NO: 4029637 - DNA, 17 bp, Homo sapiens
attgtgaactcattgct

SEQ ID NO: 4029638 - DNA, 15 bp, Homo sapiens
attgtgaagtacata

SEQ ID NO: 4029639 - DNA, 15 bp, Homo sapiens
attgtgaccaagtta

SEQ ID NO: 4029640 - DNA, 17 bp, Homo sapiens
attgtgaccaagttata

SEQ ID NO: 4029641 - DNA, 16 bp, Homo sapiens
attgtgagggacatgc

SEQ ID NO: 4029642 - DNA, 23 bp, Homo sapiens
attgtgatcagaccataatgtta

SEQ ID NO: 4029643 - DNA, 15 bp, Homo sapiens
attgtgattctgttt

SEQ ID NO: 4029644 - DNA, 16 bp, Homo sapiens
attgtgattggcctgt

SEQ ID NO: 4029645 - DNA, 12 bp, Homo sapiens
attgtgctgcca

SEQ ID NO: 4029646 - DNA, 15 bp, Homo sapiens
attgtgctgccattt

SEQ ID NO: 4029647 - DNA, 15 bp, Homo sapiens
attgtgtaaaaaatg

SEQ ID NO: 4029648 - DNA, 23 bp, Homo sapiens
attgtgtaacaattttaatgcta

SEQ ID NO: 4029649 - DNA, 16 bp, Homo sapiens
attgtgtagccttttt

SEQ ID NO: 4029650 - DNA, 12 bp, Homo sapiens
attgtgtgaatt

SEQ ID NO: 4029651 - DNA, 19 bp, Homo sapiens
attgttcaaacaatatcat

SEQ ID NO: 4029652 - DNA, 24 bp, Homo sapiens
attgttcaaacaatatcatatcat

SEQ ID NO: 4029653 - DNA, 12 bp, Homo sapiens
attgttccaaga

SEQ ID NO: 4029654 - DNA, 16 bp, Homo sapiens
attgttccaagacatt

SEQ ID NO: 4029655 - DNA, 21 bp, Homo sapiens
attgttccaagacattgtcaa

SEQ ID NO: 4029656 - DNA, 19 bp, Homo sapiens
attgttgacaactgtgact

SEQ ID NO: 4029657 - DNA, 19 bp, Homo sapiens
attgttgagctattgctgt

SEQ ID NO: 4029658 - DNA, 20 bp, Homo sapiens
attgttgaggtggtctgaat

SEQ ID NO: 4029659 - DNA, 23 bp, Homo sapiens
attgttgaggtggtctgaatgtt

SEQ ID NO: 4029660 - DNA, 13 bp, Homo sapiens
attgttggctatt

SEQ ID NO: 4029661 - DNA, 23 bp, Homo sapiens
attgttggctatttgaaatacta

SEQ ID NO: 4029662 - DNA, 20 bp, Homo sapiens
attgttggtaattattttgg

SEQ ID NO: 4029663 - DNA, 13 bp, Homo sapiens
attgttgttgcca

SEQ ID NO: 4029664 - DNA, 12 bp, Homo sapiens
attgttgtttct

SEQ ID NO: 4029665 - DNA, 14 bp, Homo sapiens
attgttgtttcttt

SEQ ID NO: 4029666 - DNA, 16 bp, Homo sapiens
attgttgtttctttct

SEQ ID NO: 4029667 - DNA, 20 bp, Homo sapiens
attgttgtttctttctagtg

SEQ ID NO: 4029668 - DNA, 13 bp, Homo sapiens
attgtttaaaatt

SEQ ID NO: 4029669 - DNA, 13 bp, Homo sapiens
attgtttcagaat

SEQ ID NO: 4029670 - DNA, 22 bp, Homo sapiens
attgtttcattgcgaatctttt

SEQ ID NO: 4029671 - DNA, 17 bp, Homo sapiens
attgtttctcaaatctt

SEQ ID NO: 4029672 - DNA, 12 bp, Homo sapiens
attgtttgctgc

SEQ ID NO: 4029673 - DNA, 15 bp, Homo sapiens
attgtttgctgctat

SEQ ID NO: 4029674 - DNA, 18 bp, Homo sapiens
attgtttgcttattgttc

SEQ ID NO: 4029675 - DNA, 23 bp, Homo sapiens
attgtttgcttattgttccaaga

SEQ ID NO: 4029676 - DNA, 14 bp, Homo sapiens
attgtttggatttc

SEQ ID NO: 4029677 - DNA, 20 bp, Homo sapiens
attgtttggatttcctttat

SEQ ID NO: 4029678 - DNA, 20 bp, Homo sapiens
attgttttctgtaaataacc

SEQ ID NO: 4029679 - DNA, 21 bp, Homo sapiens
attgttttctgtaaataacct

SEQ ID NO: 4029680 - DNA, 19 bp, Homo sapiens
attgtttttgaatttaaat

SEQ ID NO: 4029681 - DNA, 20 bp, Homo sapiens
attgtttttgaatttaaata

SEQ ID NO: 4029682 - DNA, 22 bp, Homo sapiens
attgtttttgaatttaaataaa

SEQ ID NO: 4029683 - DNA, 23 bp, Homo sapiens
attgtttttgaatttaaataaag

SEQ ID NO: 4029684 - DNA, 13 bp, Homo sapiens
attgtttttgtat

SEQ ID NO: 4029685 - DNA, 16 bp, Homo sapiens
attgtttttgtattta

SEQ ID NO: 4029686 - DNA, 16 bp, Homo sapiens
atttaaaaaaatcaca

SEQ ID NO: 4029687 - DNA, 16 bp, Homo sapiens
atttaaaaataagaaa

SEQ ID NO: 4029688 - DNA, 15 bp, Homo sapiens
atttaaaaatatttc

SEQ ID NO: 4029689 - DNA, 22 bp, Homo sapiens
atttaaaaatatttcagatatc

SEQ ID NO: 4029690 - DNA, 10 bp, Homo sapiens
atttaaaatt

SEQ ID NO: 4029691 - DNA, 14 bp, Homo sapiens
atttaaaattccat

SEQ ID NO: 4029692 - DNA, 13 bp, Homo sapiens
atttaaacacaca

SEQ ID NO: 4029693 - DNA, 14 bp, Homo sapiens
atttaaacagcagt

SEQ ID NO: 4029694 - DNA, 20 bp, Homo sapiens
atttaaacagcagtgttccc

SEQ ID NO: 4029695 - DNA, 16 bp, Homo sapiens
atttaaacctttttct

SEQ ID NO: 4029696 - DNA, 11 bp, Homo sapiens
atttaaataaa

SEQ ID NO: 4029697 - DNA, 18 bp, Homo sapiens
atttaaataaaatcacca

SEQ ID NO: 4029698 - DNA, 13 bp, Homo sapiens
atttaaatataat

SEQ ID NO: 4029699 - DNA, 23 bp, Homo sapiens
atttaaatataattctgtaaatg

SEQ ID NO: 4029700 - DNA, 15 bp, Homo sapiens
atttaaatgtgtaca

SEQ ID NO: 4029701 - DNA, 16 bp, Homo sapiens
atttaaatgtgtacaa

SEQ ID NO: 4029702 - DNA, 18 bp, Homo sapiens
atttaacaaactaaaaat

SEQ ID NO: 4029703 - DNA, 15 bp, Homo sapiens
atttaacagctgaat

SEQ ID NO: 4029704 - DNA, 17 bp, Homo sapiens
atttaacattatttata

SEQ ID NO: 4029705 - DNA, 20 bp, Homo sapiens
atttaacttaacattctgta

SEQ ID NO: 4029706 - DNA, 21 bp, Homo sapiens
atttaacttaacattctgtaa

SEQ ID NO: 4029707 - DNA, 21 bp, Homo sapiens
atttaagaaaatacaataaac

SEQ ID NO: 4029708 - DNA, 16 bp, Homo sapiens
atttaagcaacatctt

SEQ ID NO: 4029709 - DNA, 18 bp, Homo sapiens
atttaagcacaaacttta

SEQ ID NO: 4029710 - DNA, 11 bp, Homo sapiens
atttaagcatt

SEQ ID NO: 4029711 - DNA, 13 bp, Homo sapiens
atttaagcattgt

SEQ ID NO: 4029712 - DNA, 14 bp, Homo sapiens
atttaagcattgtt

SEQ ID NO: 4029713 - DNA, 23 bp, Homo sapiens
atttaagccttataaaccaatct

SEQ ID NO: 4029714 - DNA, 16 bp, Homo sapiens
atttaagggaaagaaa

SEQ ID NO: 4029715 - DNA, 17 bp, Homo sapiens
atttaagggaaagaaaa

SEQ ID NO: 4029716 - DNA, 23 bp, Homo sapiens
atttaagggggaaaaagtgtcaa

SEQ ID NO: 4029717 - DNA, 22 bp, Homo sapiens
atttaagtagaaaagttgcaga

SEQ ID NO: 4029718 - DNA, 18 bp, Homo sapiens
atttaagttatcaacttt

SEQ ID NO: 4029719 - DNA, 22 bp, Homo sapiens
atttaataaagaaatatttacc

SEQ ID NO: 4029720 - DNA, 21 bp, Homo sapiens
atttaatatggatttgttaca

SEQ ID NO: 4029721 - DNA, 22 bp, Homo sapiens
atttaatggaagtgtatttatt

SEQ ID NO: 4029722 - DNA, 15 bp, Homo sapiens
atttaatggcagcta

SEQ ID NO: 4029723 - DNA, 22 bp, Homo sapiens
atttaatggcagctagtgcctt

SEQ ID NO: 4029724 - DNA, 13 bp, Homo sapiens
atttaattattaa

SEQ ID NO: 4029725 - DNA, 20 bp, Homo sapiens
atttaattattaactacatt

SEQ ID NO: 4029726 - DNA, 18 bp, Homo sapiens
atttaattcctcttttta

SEQ ID NO: 4029727 - DNA, 23 bp, Homo sapiens
atttacaaaaatataaaatatga

SEQ ID NO: 4029728 - DNA, 18 bp, Homo sapiens
atttacaagatggactta

SEQ ID NO: 4029729 - DNA, 13 bp, Homo sapiens
atttacaataaat

SEQ ID NO: 4029730 - DNA, 19 bp, Homo sapiens
atttacagatgaatgtatt

SEQ ID NO: 4029731 - DNA, 15 bp, Homo sapiens
atttacaggaacttc

SEQ ID NO: 4029732 - DNA, 16 bp, Homo sapiens
atttaccatcatctct

SEQ ID NO: 4029733 - DNA, 23 bp, Homo sapiens
atttacccttttcccccttccca

SEQ ID NO: 4029734 - DNA, 21 bp, Homo sapiens
atttacctgcaggctgagcca

SEQ ID NO: 4029735 - DNA, 13 bp, Homo sapiens
atttactaaacat

SEQ ID NO: 4029736 - DNA, 22 bp, Homo sapiens
atttactaaacatatgatttca

SEQ ID NO: 4029737 - DNA, 20 bp, Homo sapiens
atttactgagcttctctgtg

SEQ ID NO: 4029738 - DNA, 19 bp, Homo sapiens
atttacttctaatcttaaa

SEQ ID NO: 4029739 - DNA, 22 bp, Homo sapiens
atttagaaaatagagcttttaa

SEQ ID NO: 4029740 - DNA, 15 bp, Homo sapiens
atttagaactttaag

SEQ ID NO: 4029741 - DNA, 20 bp, Homo sapiens
atttagacaagagatgggaa

SEQ ID NO: 4029742 - DNA, 17 bp, Homo sapiens
atttagagataggaaac

SEQ ID NO: 4029743 - DNA, 22 bp, Homo sapiens
atttagagatgaattaaattta

SEQ ID NO: 4029744 - DNA, 16 bp, Homo sapiens
atttagagatgctgta

SEQ ID NO: 4029745 - DNA, 14 bp, Homo sapiens
atttagccctttaa

SEQ ID NO: 4029746 - DNA, 18 bp, Homo sapiens
atttagccctttaaaacg

SEQ ID NO: 4029747 - DNA, 18 bp, Homo sapiens
atttagcgtagctaagtg

SEQ ID NO: 4029748 - DNA, 21 bp, Homo sapiens
atttagctaaacggattccaa

SEQ ID NO: 4029749 - DNA, 22 bp, Homo sapiens
atttagctaaacggattccaaa

SEQ ID NO: 4029750 - DNA, 17 bp, Homo sapiens
atttagctgtaaactga

SEQ ID NO: 4029751 - DNA, 18 bp, Homo sapiens
atttagctgtaaactgaa

SEQ ID NO: 4029752 - DNA, 16 bp, Homo sapiens
atttaggaagttgact

SEQ ID NO: 4029753 - DNA, 17 bp, Homo sapiens
caaacactgaggcagcc

SEQ ID NO: 4029754 - DNA, 19 bp, Homo sapiens
caaacactgcagtttcctg

SEQ ID NO: 4029755 - DNA, 21 bp, Homo sapiens
caaacactgcagtttcctgga

SEQ ID NO: 4029756 - DNA, 15 bp, Homo sapiens
caaacagaacagggt

SEQ ID NO: 4029757 - DNA, 18 bp, Homo sapiens
caaacagccaagattttc

SEQ ID NO: 4029758 - DNA, 15 bp, Homo sapiens
caaacaggaacaatc

SEQ ID NO: 4029759 - DNA, 19 bp, Homo sapiens
caaacagtaggttggcagt

SEQ ID NO: 4029760 - DNA, 21 bp, Homo sapiens
caaacagtgccaaatgctggg

SEQ ID NO: 4029761 - DNA, 16 bp, Homo sapiens
caaacatagcccctgc

SEQ ID NO: 4029762 - DNA, 18 bp, Homo sapiens
caaacatcctatcaacaa

SEQ ID NO: 4029763 - DNA, 21 bp, Homo sapiens
caaacattcgtgagctgggga

SEQ ID NO: 4029764 - DNA, 22 bp, Homo sapiens
caaacattcgtgagctggggac

SEQ ID NO: 4029765 - DNA, 19 bp, Homo sapiens
cactaacgacttcagggca

SEQ ID NO: 4029766 - DNA, 21 bp, Homo sapiens
cactaaggccgtgtctctgag

SEQ ID NO: 4029767 - DNA, 23 bp, Homo sapiens
cactaaggccgtgtctctgagga

SEQ ID NO: 4029768 - DNA, 17 bp, Homo sapiens
cactaagttatagtata

SEQ ID NO: 4029769 - DNA, 12 bp, Homo sapiens
cactaattcata

SEQ ID NO: 4029770 - DNA, 15 bp, Homo sapiens
cactacacctggctg

SEQ ID NO: 4029771 - DNA, 15 bp, Homo sapiens
cactacagagcagct

SEQ ID NO: 4029772 - DNA, 20 bp, Homo sapiens
cactacagagcagctcccca

SEQ ID NO: 4029773 - DNA, 14 bp, Homo sapiens
cactacataaactg

SEQ ID NO: 4029774 - DNA, 23 bp, Homo sapiens
cactacatgcagcccatgcccac

SEQ ID NO: 4029775 - DNA, 15 bp, Homo sapiens
cactacattcattta

SEQ ID NO: 4029776 - DNA, 22 bp, Homo sapiens
cactaccccatatacacctgga

SEQ ID NO: 4029777 - DNA, 15 bp, Homo sapiens
cactaccgattcttt

SEQ ID NO: 4029778 - DNA, 13 bp, Homo sapiens
cactactgacatg

SEQ ID NO: 4029779 - DNA, 19 bp, Homo sapiens
cactactgcagcacctcca

SEQ ID NO: 4029780 - DNA, 15 bp, Homo sapiens
cactagaactctcca

SEQ ID NO: 4029781 - DNA, 14 bp, Homo sapiens
cactagcctctcca

SEQ ID NO: 4029782 - DNA, 20 bp, Homo sapiens
cactaggggatataggagag

SEQ ID NO: 4029783 - DNA, 14 bp, Homo sapiens
cactaggtaactta

SEQ ID NO: 4029784 - DNA, 15 bp, Homo sapiens
cactaggtaacttat

SEQ ID NO: 4029785 - DNA, 12 bp, Homo sapiens
cactagttttgt

SEQ ID NO: 4029786 - DNA, 17 bp, Homo sapiens
cactatagtttaaaaca

SEQ ID NO: 4029787 - DNA, 18 bp, Homo sapiens
cactatctcacactaatc

SEQ ID NO: 4029788 - DNA, 18 bp, Homo sapiens
cactatcttcttcaaata

SEQ ID NO: 4029789 - DNA, 21 bp, Homo sapiens
cactatcttcttcaaatacaa

SEQ ID NO: 4029790 - DNA, 19 bp, Homo sapiens
cactatggtatgctggcca

SEQ ID NO: 4029791 - DNA, 22 bp, Homo sapiens
cactatggtatgctggccagca

SEQ ID NO: 4029792 - DNA, 17 bp, Homo sapiens
cactatttttatttata

SEQ ID NO: 4029793 - DNA, 20 bp, Homo sapiens
cactcaaattaatctttctt

SEQ ID NO: 4029794 - DNA, 16 bp, Homo sapiens
cactcaactctgagcc

SEQ ID NO: 4029795 - DNA, 17 bp, Homo sapiens
cactcaactctgagccc

SEQ ID NO: 4029796 - DNA, 14 bp, Homo sapiens
cactcaagcactga

SEQ ID NO: 4029797 - DNA, 16 bp, Homo sapiens
cactcaagcactgata

SEQ ID NO: 4029798 - DNA, 13 bp, Homo sapiens
cactcaagcttgg

SEQ ID NO: 4029799 - DNA, 16 bp, Homo sapiens
cactcacccatgtgcc

SEQ ID NO: 4029800 - DNA, 16 bp, Homo sapiens
cactcaccccctttgc

SEQ ID NO: 4029801 - DNA, 12 bp, Homo sapiens
cactcagagcag

SEQ ID NO: 4029802 - DNA, 23 bp, Homo sapiens
cactcagccggcagccagatggc

SEQ ID NO: 4029803 - DNA, 22 bp, Homo sapiens
cactcagctgtcctgcagcaaa

SEQ ID NO: 4029804 - DNA, 20 bp, Homo sapiens
cactcaggaggctgaggcag

SEQ ID NO: 4029805 - DNA, 19 bp, Homo sapiens
cactcaggcctgtgcccac

SEQ ID NO: 4029806 - DNA, 22 bp, Homo sapiens
cactcaggcctgtgcccactcc

SEQ ID NO: 4029807 - DNA, 21 bp, Homo sapiens
cactcagtgagcctcctgtgc

SEQ ID NO: 4029808 - DNA, 22 bp, Homo sapiens
cactcagtgagcctcctgtgcc

SEQ ID NO: 4029809 - DNA, 23 bp, Homo sapiens
cactcagtgagcctcctgtgcct

SEQ ID NO: 4029810 - DNA, 22 bp, Homo sapiens
cactcattttctataacagata

SEQ ID NO: 4029811 - DNA, 14 bp, Homo sapiens
cactccacaaatga

SEQ ID NO: 4029812 - DNA, 15 bp, Homo sapiens
cactccacaaatgat

SEQ ID NO: 4029813 - DNA, 15 bp, Homo sapiens
cactccacagagtga

SEQ ID NO: 4029814 - DNA, 22 bp, Homo sapiens
cactccacataaggggtttagt

SEQ ID NO: 4029815 - DNA, 18 bp, Homo sapiens
cactccaccctccacctt

SEQ ID NO: 4029816 - DNA, 14 bp, Homo sapiens
cactccagacccct

SEQ ID NO: 4029817 - DNA, 16 bp, Homo sapiens
cactccagcctgggcg

SEQ ID NO: 4029818 - DNA, 16 bp, Homo sapiens
cactccagcctgggtg

SEQ ID NO: 4029819 - DNA, 13 bp, Homo sapiens
cactccaggcctc

SEQ ID NO: 4029820 - DNA, 17 bp, Homo sapiens
cactccagtgccagcaa

SEQ ID NO: 4029821 - DNA, 14 bp, Homo sapiens
cactccatctcctg

SEQ ID NO: 4029822 - DNA, 17 bp, Homo sapiens
cactccatctcctgctc

SEQ ID NO: 4029823 - DNA, 20 bp, Homo sapiens
cactccccaaggaagagcca

SEQ ID NO: 4029824 - DNA, 12 bp, Homo sapiens
cactccccaggg

SEQ ID NO: 4029825 - DNA, 21 bp, Homo sapiens
cactccccagggagctctggg

SEQ ID NO: 4029826 - DNA, 18 bp, Homo sapiens
cactccccatgccacgtt

SEQ ID NO: 4029827 - DNA, 13 bp, Homo sapiens
cactccccgcctt

SEQ ID NO: 4029828 - DNA, 14 bp, Homo sapiens
cactcccctagggg

SEQ ID NO: 4029829 - DNA, 23 bp, Homo sapiens
cactcccgcctcagggccaggcc

SEQ ID NO: 4029830 - DNA, 21 bp, Homo sapiens
cactccctatctccttcccac

SEQ ID NO: 4029831 - DNA, 14 bp, Homo sapiens
cactccctgctcca

SEQ ID NO: 4029832 - DNA, 16 bp, Homo sapiens
cactccctgctccacg

SEQ ID NO: 4029833 - DNA, 17 bp, Homo sapiens
cactccctgctccacga

SEQ ID NO: 4029834 - DNA, 18 bp, Homo sapiens
cactccctgcttgcagga

SEQ ID NO: 4029835 - DNA, 21 bp, Homo sapiens
cactcccttggtggcaagagc

SEQ ID NO: 4029836 - DNA, 20 bp, Homo sapiens
cactccggcctgatgacaga

SEQ ID NO: 4029837 - DNA, 13 bp, Homo sapiens
cactcctacctgg

SEQ ID NO: 4029838 - DNA, 14 bp, Homo sapiens
cactcctacctggt

SEQ ID NO: 4029839 - DNA, 12 bp, Homo sapiens
cactcctagaga

SEQ ID NO: 4029840 - DNA, 12 bp, Homo sapiens
cactcctccctc

SEQ ID NO: 4029841 - DNA, 11 bp, Homo sapiens
cactcctgctc

SEQ ID NO: 4029842 - DNA, 12 bp, Homo sapiens
cactcctgctct

SEQ ID NO: 4029843 - DNA, 10 bp, Homo sapiens
cactcctggg

SEQ ID NO: 4029844 - DNA, 13 bp, Homo sapiens
cactcctgtacac

SEQ ID NO: 4029845 - DNA, 18 bp, Homo sapiens
cactcctgttacttacct

SEQ ID NO: 4029846 - DNA, 14 bp, Homo sapiens
cactcgacccagaa

SEQ ID NO: 4029847 - DNA, 12 bp, Homo sapiens
cactcggtccca

SEQ ID NO: 4029848 - DNA, 14 bp, Homo sapiens
cactcggtcccagt

SEQ ID NO: 4029849 - DNA, 17 bp, Homo sapiens
cactcgtgcatccctga

SEQ ID NO: 4029850 - DNA, 15 bp, Homo sapiens
cactctaaaaaacat

SEQ ID NO: 4029851 - DNA, 19 bp, Homo sapiens
cactctaaaaaacattttt

SEQ ID NO: 4029852 - DNA, 21 bp, Homo sapiens
cactctaaactgcaaacagaa

SEQ ID NO: 4029853 - DNA, 19 bp, Homo sapiens
cactctaccaaataatttc

SEQ ID NO: 4029854 - DNA, 21 bp, Homo sapiens
cactctaccctcccaccccct

SEQ ID NO: 4029855 - DNA, 13 bp, Homo sapiens
cactctagcctgg

SEQ ID NO: 4029856 - DNA, 15 bp, Homo sapiens
cactctccccacact

SEQ ID NO: 4029857 - DNA, 21 bp, Homo sapiens
cactctccccacactaacctg

SEQ ID NO: 4029858 - DNA, 14 bp, Homo sapiens
cactctctaaatct

SEQ ID NO: 4029859 - DNA, 19 bp, Homo sapiens
cactctctaaatcttcctt

SEQ ID NO: 4029860 - DNA, 22 bp, Homo sapiens
cactctctattgtcatggggat

SEQ ID NO: 4029861 - DNA, 20 bp, Homo sapiens
cactctctgaagatgatcat

SEQ ID NO: 4029862 - DNA, 13 bp, Homo sapiens
cactctctggaag

SEQ ID NO: 4029863 - DNA, 23 bp, Homo sapiens
cactctgagtttaccatttgtaa

SEQ ID NO: 4029864 - DNA, 12 bp, Homo sapiens
cactctgctgtt

SEQ ID NO: 4029865 - DNA, 13 bp, Homo sapiens
cactctggcctca

SEQ ID NO: 4029866 - DNA, 14 bp, Homo sapiens
cactctgtcagcca

SEQ ID NO: 4029867 - DNA, 17 bp, Homo sapiens
cactctgtcagccagcc

SEQ ID NO: 4029868 - DNA, 18 bp, Homo sapiens
cactctgtcgagcctggg

SEQ ID NO: 4029869 - DNA, 11 bp, Homo sapiens
cacctccaccc

SEQ ID NO: 4029870 - DNA, 22 bp, Homo sapiens
cacctccactcccacctcaccc

SEQ ID NO: 4029871 - DNA, 15 bp, Homo sapiens
cacctccaggcctgt

SEQ ID NO: 4029872 - DNA, 18 bp, Homo sapiens
cacctccaggcctgttgc

SEQ ID NO: 4029873 - DNA, 14 bp, Homo sapiens
cacctcccaccctg

SEQ ID NO: 4029874 - DNA, 13 bp, Homo sapiens
cacctccccacat

SEQ ID NO: 4029875 - DNA, 20 bp, Homo sapiens
cacctccccacatcgcacac

SEQ ID NO: 4029876 - DNA, 16 bp, Homo sapiens
cacctccccgctggga

SEQ ID NO: 4029877 - DNA, 16 bp, Homo sapiens
cacctccctcccggca

SEQ ID NO: 4029878 - DNA, 18 bp, Homo sapiens
cacctccgagacagtcca

SEQ ID NO: 4029879 - DNA, 19 bp, Homo sapiens
cacctccgagacagtccag

SEQ ID NO: 4029880 - DNA, 21 bp, Homo sapiens
cacctccgagacagtccagtg

SEQ ID NO: 4029881 - DNA, 22 bp, Homo sapiens
cacctccgagacagtccagtgt

SEQ ID NO: 4029882 - DNA, 22 bp, Homo sapiens
cacctccttgtcactttattac

SEQ ID NO: 4029883 - DNA, 18 bp, Homo sapiens
cacctctccaagtctctc

SEQ ID NO: 4029884 - DNA, 23 bp, Homo sapiens
cacctctccaagtctctctgtga

SEQ ID NO: 4029885 - DNA, 13 bp, Homo sapiens
cacctctccaggt

SEQ ID NO: 4029886 - DNA, 12 bp, Homo sapiens
cacctctccctc

SEQ ID NO: 4029887 - DNA, 13 bp, Homo sapiens
cacctctccctca

SEQ ID NO: 4029888 - DNA, 14 bp, Homo sapiens
cacctctccctcaa

SEQ ID NO: 4029889 - DNA, 20 bp, Homo sapiens
cacctctctcagagcatctg

SEQ ID NO: 4029890 - DNA, 16 bp, Homo sapiens
cacctctctcctttgc

SEQ ID NO: 4029891 - DNA, 23 bp, Homo sapiens
cacctcttgtgcaaggtggcctt

SEQ ID NO: 4029892 - DNA, 11 bp, Homo sapiens
cacctgacaca

SEQ ID NO: 4029893 - DNA, 15 bp, Homo sapiens
cacctgcagctccct

SEQ ID NO: 4029894 - DNA, 16 bp, Homo sapiens
cacctgcagctccctc

SEQ ID NO: 4029895 - DNA, 16 bp, Homo sapiens
cacctgcatctggggc

SEQ ID NO: 4029896 - DNA, 16 bp, Homo sapiens
cacctgccccaactct

SEQ ID NO: 4029897 - DNA, 13 bp, Homo sapiens
cacctgccctgcc

SEQ ID NO: 4029898 - DNA, 20 bp, Homo sapiens
cacctgcctcaggactgcga

SEQ ID NO: 4029899 - DNA, 12 bp, Homo sapiens
cacctgctccag

SEQ ID NO: 4029900 - DNA, 14 bp, Homo sapiens
cacctgctccagaa

SEQ ID NO: 4029901 - DNA, 18 bp, Homo sapiens
cacctgcttctgaactca

SEQ ID NO: 4029902 - DNA, 19 bp, Homo sapiens
cacctggatctatccctgc

SEQ ID NO: 4029903 - DNA, 20 bp, Homo sapiens
cacctggctgagcagttccc

SEQ ID NO: 4029904 - DNA, 21 bp, Homo sapiens
cacctggctgaggttcctctg

SEQ ID NO: 4029905 - DNA, 15 bp, Homo sapiens
cacctgtagccatct

SEQ ID NO: 4029906 - DNA, 16 bp, Homo sapiens
cacctgtagccatctg

SEQ ID NO: 4029907 - DNA, 22 bp, Homo sapiens
cacctgtagccatctgcacaca

SEQ ID NO: 4029908 - DNA, 22 bp, Homo sapiens
cacctgtagtcccagctacttg

SEQ ID NO: 4029909 - DNA, 11 bp, Homo sapiens
cacctgtctgc

SEQ ID NO: 4029910 - DNA, 21 bp, Homo sapiens
cacctgtctgctccagctctg

SEQ ID NO: 4029911 - DNA, 19 bp, Homo sapiens
cacctgtgagtttaaagca

SEQ ID NO: 4029912 - DNA, 20 bp, Homo sapiens
cacctgtgagtttaaagcaa

SEQ ID NO: 4029913 - DNA, 23 bp, Homo sapiens
cacctgtgcagcgaagcttagcg

SEQ ID NO: 4029914 - DNA, 19 bp, Homo sapiens
cacctgttcacagaaaaag

SEQ ID NO: 4029915 - DNA, 21 bp, Homo sapiens
caccttcaatgacttctaatt

SEQ ID NO: 4029916 - DNA, 13 bp, Homo sapiens
caccttcagggct

SEQ ID NO: 4029917 - DNA, 18 bp, Homo sapiens
caccttcagggctgagtt

SEQ ID NO: 4029918 - DNA, 16 bp, Homo sapiens
caccttccagggccct

SEQ ID NO: 4029919 - DNA, 18 bp, Homo sapiens
caccttccattttccccc

SEQ ID NO: 4029920 - DNA, 21 bp, Homo sapiens
caccttctgtccccagccctg

SEQ ID NO: 4029921 - DNA, 18 bp, Homo sapiens
caccttgccaagctttct

SEQ ID NO: 4029922 - DNA, 23 bp, Homo sapiens
caccttgggctgggggactgggg

SEQ ID NO: 4029923 - DNA, 21 bp, Homo sapiens
caccttggggtccctccaccc

SEQ ID NO: 4029924 - DNA, 20 bp, Homo sapiens
cacctttgttttttgttgga

SEQ ID NO: 4029925 - DNA, 18 bp, Homo sapiens
caccttttaactcacctc

SEQ ID NO: 4029926 - DNA, 21 bp, Homo sapiens
caccttttctgtggctggctc

SEQ ID NO: 4029927 - DNA, 22 bp, Homo sapiens
caccttttctgtggctggctct

SEQ ID NO: 4029928 - DNA, 17 bp, Homo sapiens
cacgagggctggctggc

SEQ ID NO: 4029929 - DNA, 15 bp, Homo sapiens
cacgatgaaaaactt

SEQ ID NO: 4029930 - DNA, 13 bp, Homo sapiens
cacgattggagaa

SEQ ID NO: 4029931 - DNA, 18 bp, Homo sapiens
cacgcacaaacacacaca

SEQ ID NO: 4029932 - DNA, 21 bp, Homo sapiens
cacgcacaaacacacacacta

SEQ ID NO: 4029933 - DNA, 14 bp, Homo sapiens
cacgcacacacaca

SEQ ID NO: 4029934 - DNA, 14 bp, Homo sapiens
cacgcacgcacaca

SEQ ID NO: 4029935 - DNA, 13 bp, Homo sapiens
cacgcactgggcc

SEQ ID NO: 4029936 - DNA, 16 bp, Homo sapiens
cacgcactggtgccaa

SEQ ID NO: 4029937 - DNA, 17 bp, Homo sapiens
cacgcaggaactcccag

SEQ ID NO: 4029938 - DNA, 19 bp, Homo sapiens
cacgcaggctgagtccaga

SEQ ID NO: 4029939 - DNA, 21 bp, Homo sapiens
cacgccctgttcacgctcacc

SEQ ID NO: 4029940 - DNA, 14 bp, Homo sapiens
cacgcctcctggcc

SEQ ID NO: 4029941 - DNA, 22 bp, Homo sapiens
cacgcctgtaatcccagctact

SEQ ID NO: 4029942 - DNA, 15 bp, Homo sapiens
cacgctcgcgggcag

SEQ ID NO: 4029943 - DNA, 23 bp, Homo sapiens
cacgctcgcgggcagcgggccag

SEQ ID NO: 4029944 - DNA, 17 bp, Homo sapiens
cacgctggggctctctg

SEQ ID NO: 4029945 - DNA, 18 bp, Homo sapiens
cacgctggggctctctga

SEQ ID NO: 4029946 - DNA, 19 bp, Homo sapiens
cacgcttgcgtatgtctgt

SEQ ID NO: 4029947 - DNA, 14 bp, Homo sapiens
cacgctttctagct

SEQ ID NO: 4029948 - DNA, 14 bp, Homo sapiens
cacggactcccggg

SEQ ID NO: 4029949 - DNA, 17 bp, Homo sapiens
cacggagacagaggaaa

SEQ ID NO: 4029950 - DNA, 19 bp, Homo sapiens
cacggagacagaggaaagg

SEQ ID NO: 4029951 - DNA, 22 bp, Homo sapiens
cacggagcggattgcaaagcaa

SEQ ID NO: 4029952 - DNA, 23 bp, Homo sapiens
cacggagggggacggggctcagc

SEQ ID NO: 4029953 - DNA, 19 bp, Homo sapiens
cacggccacatcaaagagg

SEQ ID NO: 4029954 - DNA, 12 bp, Homo sapiens
cacggcctcctt

SEQ ID NO: 4029955 - DNA, 14 bp, Homo sapiens
cacggtagtgcctg

SEQ ID NO: 4029956 - DNA, 21 bp, Homo sapiens
cacggtcgccacctggcattc

SEQ ID NO: 4029957 - DNA, 14 bp, Homo sapiens
cacgtcatgggagg

SEQ ID NO: 4029958 - DNA, 12 bp, Homo sapiens
cacgtcccagca

SEQ ID NO: 4029959 - DNA, 19 bp, Homo sapiens
cacgtcgcccgctgagctg

SEQ ID NO: 4029960 - DNA, 12 bp, Homo sapiens
cacgtgcaagga

SEQ ID NO: 4029961 - DNA, 19 bp, Homo sapiens
cacgtgcaaggactcccgg

SEQ ID NO: 4029962 - DNA, 15 bp, Homo sapiens
cacgtggagagctgg

SEQ ID NO: 4029963 - DNA, 20 bp, Homo sapiens
cacgtggcctcttgagcagt

SEQ ID NO: 4029964 - DNA, 15 bp, Homo sapiens
cacgtggtcactgtg

SEQ ID NO: 4029965 - DNA, 14 bp, Homo sapiens
cacgttcataacca

SEQ ID NO: 4029966 - DNA, 16 bp, Homo sapiens
cactaaagccagcctg

SEQ ID NO: 4029967 - DNA, 17 bp, Homo sapiens
cactaaagccagcctga

SEQ ID NO: 4029968 - DNA, 17 bp, Homo sapiens
cactaaatgagctcctg

SEQ ID NO: 4029969 - DNA, 18 bp, Homo sapiens
cactaaatgagctcctgc

SEQ ID NO: 4029970 - DNA, 13 bp, Homo sapiens
cactaacatttcc

SEQ ID NO: 4029971 - DNA, 23 bp, Homo sapiens
cactaaccaagctgagtttccta

SEQ ID NO: 4029972 - DNA, 15 bp, Homo sapiens
caccccacgccctgt

SEQ ID NO: 4029973 - DNA, 21 bp, Homo sapiens
caccccagcctcgcctgtcac

SEQ ID NO: 4029974 - DNA, 14 bp, Homo sapiens
caccccaggccctt

SEQ ID NO: 4029975 - DNA, 11 bp, Homo sapiens
cacccccaccc

SEQ ID NO: 4029976 - DNA, 13 bp, Homo sapiens
cacccccatccct

SEQ ID NO: 4029977 - DNA, 17 bp, Homo sapiens
cacccccatctctccct

SEQ ID NO: 4029978 - DNA, 13 bp, Homo sapiens
caccccctccccg

SEQ ID NO: 4029979 - DNA, 19 bp, Homo sapiens
caccccctccccgcccctg

SEQ ID NO: 4029980 - DNA, 18 bp, Homo sapiens
caccccctgctccaccag

SEQ ID NO: 4029981 - DNA, 16 bp, Homo sapiens
cacccccttctctgct

SEQ ID NO: 4029982 - DNA, 18 bp, Homo sapiens
cacccccttctctgctcc

SEQ ID NO: 4029983 - DNA, 17 bp, Homo sapiens
caccccggcctcagggc

SEQ ID NO: 4029984 - DNA, 18 bp, Homo sapiens
caccccggcctcagggcg

SEQ ID NO: 4029985 - DNA, 15 bp, Homo sapiens
caccccgggctctct

SEQ ID NO: 4029986 - DNA, 18 bp, Homo sapiens
caccccggggaccctgtg

SEQ ID NO: 4029987 - DNA, 15 bp, Homo sapiens
cacccctacacacac

SEQ ID NO: 4029988 - DNA, 14 bp, Homo sapiens
cacccctagccacc

SEQ ID NO: 4029989 - DNA, 18 bp, Homo sapiens
cacccctagccaccagtg

SEQ ID NO: 4029990 - DNA, 16 bp, Homo sapiens
cacccctcactcccca

SEQ ID NO: 4029991 - DNA, 17 bp, Homo sapiens
cacccctcactccccag

SEQ ID NO: 4029992 - DNA, 11 bp, Homo sapiens
cacccctgccc

SEQ ID NO: 4029993 - DNA, 13 bp, Homo sapiens
cacccctgccccc

SEQ ID NO: 4029994 - DNA, 14 bp, Homo sapiens
cacccctgccccca

SEQ ID NO: 4029995 - DNA, 24 bp, Homo sapiens
cacccctgctctacccatgagcct

SEQ ID NO: 4029996 - DNA, 18 bp, Homo sapiens
cacccctggaagagccca

SEQ ID NO: 4029997 - DNA, 12 bp, Homo sapiens
cacccctgggca

SEQ ID NO: 4029998 - DNA, 12 bp, Homo sapiens
cacccctgggcc

SEQ ID NO: 4029999 - DNA, 13 bp, Homo sapiens
cacccctgggcca

SEQ ID NO: 4030000 - DNA, 16 bp, Homo sapiens
cacccctgtccagatt

SEQ ID NO: 4030001 - DNA, 17 bp, Homo sapiens
cacccctgtcccaccca

SEQ ID NO: 4030002 - DNA, 23 bp, Homo sapiens
cacccctgtcccacccacacagc

SEQ ID NO: 4030003 - DNA, 16 bp, Homo sapiens
caccccttatccagga

SEQ ID NO: 4030004 - DNA, 19 bp, Homo sapiens
caccccttatccaggactc

SEQ ID NO: 4030005 - DNA, 12 bp, Homo sapiens
caccccttctct

SEQ ID NO: 4030006 - DNA, 16 bp, Homo sapiens
cacccctttctgtccc

SEQ ID NO: 4030007 - DNA, 14 bp, Homo sapiens
cacccgacctggct

SEQ ID NO: 4030008 - DNA, 22 bp, Homo sapiens
cacccgccccgcgcaccccacg

SEQ ID NO: 4030009 - DNA, 12 bp, Homo sapiens
cacccggcctgg

SEQ ID NO: 4030010 - DNA, 21 bp, Homo sapiens
cacccggcctggatgccagct

SEQ ID NO: 4030011 - DNA, 22 bp, Homo sapiens
cacccggcctggatgccagctg

SEQ ID NO: 4030012 - DNA, 20 bp, Homo sapiens
cacccgggggagcccagtga

SEQ ID NO: 4030013 - DNA, 22 bp, Homo sapiens
cacccggtgacctctagccctg

SEQ ID NO: 4030014 - DNA, 16 bp, Homo sapiens
caccctagtttccctg

SEQ ID NO: 4030015 - DNA, 15 bp, Homo sapiens
caccctcacacacac

SEQ ID NO: 4030016 - DNA, 13 bp, Homo sapiens
caccctccacctt

SEQ ID NO: 4030017 - DNA, 15 bp, Homo sapiens
caccctccactcagc

SEQ ID NO: 4030018 - DNA, 18 bp, Homo sapiens
caccctccatgctcctca

SEQ ID NO: 4030019 - DNA, 14 bp, Homo sapiens
caccctccctgact

SEQ ID NO: 4030020 - DNA, 21 bp, Homo sapiens
caccctccctgactggcctgg

SEQ ID NO: 4030021 - DNA, 13 bp, Homo sapiens
caccctccctgga

SEQ ID NO: 4030022 - DNA, 15 bp, Homo sapiens
caccctccctggagt

SEQ ID NO: 4030023 - DNA, 16 bp, Homo sapiens
caccctccctggagtg

SEQ ID NO: 4030024 - DNA, 21 bp, Homo sapiens
caccctcctcctcttcaccag

SEQ ID NO: 4030025 - DNA, 15 bp, Homo sapiens
caccctcctgcccca

SEQ ID NO: 4030026 - DNA, 13 bp, Homo sapiens
caccctccttccc

SEQ ID NO: 4030027 - DNA, 20 bp, Homo sapiens
caccctccttcccactcttc

SEQ ID NO: 4030028 - DNA, 23 bp, Homo sapiens
caccctccttcccactcttctca

SEQ ID NO: 4030029 - DNA, 15 bp, Homo sapiens
caccctctcctgggg

SEQ ID NO: 4030030 - DNA, 21 bp, Homo sapiens
caccctgaacaaatcttgggt

SEQ ID NO: 4030031 - DNA, 15 bp, Homo sapiens
caccctgcactttcc

SEQ ID NO: 4030032 - DNA, 20 bp, Homo sapiens
caccctgccccaccccacct

SEQ ID NO: 4030033 - DNA, 13 bp, Homo sapiens
caccctgccttat

SEQ ID NO: 4030034 - DNA, 20 bp, Homo sapiens
caccctggggcctggacctg

SEQ ID NO: 4030035 - DNA, 13 bp, Homo sapiens
caccctgtcaagt

SEQ ID NO: 4030036 - DNA, 17 bp, Homo sapiens
caccctgtggccctggc

SEQ ID NO: 4030037 - DNA, 20 bp, Homo sapiens
caccctgtggccctggctct

SEQ ID NO: 4030038 - DNA, 14 bp, Homo sapiens
cacccttagaaaat

SEQ ID NO: 4030039 - DNA, 15 bp, Homo sapiens
cacccttagaaaatg

SEQ ID NO: 4030040 - DNA, 23 bp, Homo sapiens
cacccttggcctgtctcatcccc

SEQ ID NO: 4030041 - DNA, 14 bp, Homo sapiens
caccctttgcctta

SEQ ID NO: 4030042 - DNA, 13 bp, Homo sapiens
caccgaccaactg

SEQ ID NO: 4030043 - DNA, 15 bp, Homo sapiens
caccgaccaactgcc

SEQ ID NO: 4030044 - DNA, 16 bp, Homo sapiens
caccgaccaactgccc

SEQ ID NO: 4030045 - DNA, 18 bp, Homo sapiens
caccgacgcgtctcctgt

SEQ ID NO: 4030046 - DNA, 20 bp, Homo sapiens
caccgactagacacacaaag

SEQ ID NO: 4030047 - DNA, 15 bp, Homo sapiens
caccgagctggagcg

SEQ ID NO: 4030048 - DNA, 18 bp, Homo sapiens
caccgcttctgccttttc

SEQ ID NO: 4030049 - DNA, 19 bp, Homo sapiens
caccgcttttgttctcgca

SEQ ID NO: 4030050 - DNA, 16 bp, Homo sapiens
caccggcctggctgca

SEQ ID NO: 4030051 - DNA, 19 bp, Homo sapiens
caccggcctggctgcagct

SEQ ID NO: 4030052 - DNA, 22 bp, Homo sapiens
caccggcctggctgcagctggg

SEQ ID NO: 4030053 - DNA, 22 bp, Homo sapiens
caccgggcatgtctgcctggag

SEQ ID NO: 4030054 - DNA, 23 bp, Homo sapiens
caccgggcatgtctgcctggagt

SEQ ID NO: 4030055 - DNA, 20 bp, Homo sapiens
caccggggacaggccgcagc

SEQ ID NO: 4030056 - DNA, 15 bp, Homo sapiens
caccgtcatggctta

SEQ ID NO: 4030057 - DNA, 19 bp, Homo sapiens
caccgtcatggcttaatgt

SEQ ID NO: 4030058 - DNA, 19 bp, Homo sapiens
caccgtgcctggccagatt

SEQ ID NO: 4030059 - DNA, 18 bp, Homo sapiens
caccgtgtaaaccaaagc

SEQ ID NO: 4030060 - DNA, 19 bp, Homo sapiens
caccgtgtcaagctgctct

SEQ ID NO: 4030061 - DNA, 13 bp, Homo sapiens
caccgttctgtgc

SEQ ID NO: 4030062 - DNA, 21 bp, Homo sapiens
cacctaatgtttatgagccag

SEQ ID NO: 4030063 - DNA, 21 bp, Homo sapiens
cacctaattcgatgaaggctg

SEQ ID NO: 4030064 - DNA, 23 bp, Homo sapiens
cacctaattcgatgaaggctgcc

SEQ ID NO: 4030065 - DNA, 17 bp, Homo sapiens
cacctaccatcagggac

SEQ ID NO: 4030066 - DNA, 18 bp, Homo sapiens
cacctaccatcagggaca

SEQ ID NO: 4030067 - DNA, 18 bp, Homo sapiens
cacctatctcgtgggaga

SEQ ID NO: 4030068 - DNA, 12 bp, Homo sapiens
cacctatgtgcc

SEQ ID NO: 4030069 - DNA, 17 bp, Homo sapiens
cacctcagaaagtcacc

SEQ ID NO: 4030070 - DNA, 20 bp, Homo sapiens
cacctcagaaagtcaccagg

SEQ ID NO: 4030071 - DNA, 13 bp, Homo sapiens
cacctcagggcac

SEQ ID NO: 4030072 - DNA, 23 bp, Homo sapiens
cacctcagggcacgcaggaccag

SEQ ID NO: 4030073 - DNA, 20 bp, Homo sapiens
cacctcagttcccttggcct

SEQ ID NO: 4030074 - DNA, 15 bp, Homo sapiens
cacctcatgcccacc

SEQ ID NO: 4030075 - DNA, 22 bp, Homo sapiens
cacctcatgcccaccccctgcc

SEQ ID NO: 4030076 - DNA, 17 bp, Homo sapiens
caccaagcacagcagcc

SEQ ID NO: 4030077 - DNA, 19 bp, Homo sapiens
caccaagcacagcagcctg

SEQ ID NO: 4030078 - DNA, 13 bp, Homo sapiens
caccaagcagtgg

SEQ ID NO: 4030079 - DNA, 23 bp, Homo sapiens
caccaagcagtggcctttttctg

SEQ ID NO: 4030080 - DNA, 20 bp, Homo sapiens
caccaaggaaacgctacctc

SEQ ID NO: 4030081 - DNA, 14 bp, Homo sapiens
caccaaggtcttca

SEQ ID NO: 4030082 - DNA, 23 bp, Homo sapiens
caccaagttggaacatccttgga

SEQ ID NO: 4030083 - DNA, 20 bp, Homo sapiens
caccaataaatcagaccatg

SEQ ID NO: 4030084 - DNA, 14 bp, Homo sapiens
caccaatcccaggg

SEQ ID NO: 4030085 - DNA, 22 bp, Homo sapiens
caccaatcccagggctggctct

SEQ ID NO: 4030086 - DNA, 23 bp, Homo sapiens
caccaatcccagggctggctctg

SEQ ID NO: 4030087 - DNA, 12 bp, Homo sapiens
caccacagacac

SEQ ID NO: 4030088 - DNA, 21 bp, Homo sapiens
caccaccaaatgccaagaaaa

SEQ ID NO: 4030089 - DNA, 20 bp, Homo sapiens
caccaccccctcaagcccca

SEQ ID NO: 4030090 - DNA, 17 bp, Homo sapiens
caccacccgaaatgcca

SEQ ID NO: 4030091 - DNA, 23 bp, Homo sapiens
caccacccgctttcttgctggtt

SEQ ID NO: 4030092 - DNA, 17 bp, Homo sapiens
caccacctcactcctgt

SEQ ID NO: 4030093 - DNA, 13 bp, Homo sapiens
caccacctccctc

SEQ ID NO: 4030094 - DNA, 14 bp, Homo sapiens
caccacctctgtgg

SEQ ID NO: 4030095 - DNA, 11 bp, Homo sapiens
caccacctgcc

SEQ ID NO: 4030096 - DNA, 14 bp, Homo sapiens
caccacctgcctct

SEQ ID NO: 4030097 - DNA, 16 bp, Homo sapiens
caccacgattctccca

SEQ ID NO: 4030098 - DNA, 22 bp, Homo sapiens
caccacggcgttgtacctgtag

SEQ ID NO: 4030099 - DNA, 15 bp, Homo sapiens
caccacgtccagctg

SEQ ID NO: 4030100 - DNA, 20 bp, Homo sapiens
caccactaggaatcccagag

SEQ ID NO: 4030101 - DNA, 21 bp, Homo sapiens
caccactaggaatcccagagg

SEQ ID NO: 4030102 - DNA, 18 bp, Homo sapiens
caccactgcactccagcc

SEQ ID NO: 4030103 - DNA, 14 bp, Homo sapiens
caccagacacccag

SEQ ID NO: 4030104 - DNA, 17 bp, Homo sapiens
caccagacatcaccctt

SEQ ID NO: 4030105 - DNA, 19 bp, Homo sapiens
caccagacgtcaggccctg

SEQ ID NO: 4030106 - DNA, 22 bp, Homo sapiens
caccagagcaacctctcactcc

SEQ ID NO: 4030107 - DNA, 17 bp, Homo sapiens
caccagagcagatgcag

SEQ ID NO: 4030108 - DNA, 14 bp, Homo sapiens
caccagagcccatg

SEQ ID NO: 4030109 - DNA, 11 bp, Homo sapiens
caccagaggcc

SEQ ID NO: 4030110 - DNA, 13 bp, Homo sapiens
caccagaggccga

SEQ ID NO: 4030111 - DNA, 11 bp, Homo sapiens
caccagcacca

SEQ ID NO: 4030112 - DNA, 15 bp, Homo sapiens
caccagcagcatggc

SEQ ID NO: 4030113 - DNA, 20 bp, Homo sapiens
caccagcatccaccttggct

SEQ ID NO: 4030114 - DNA, 21 bp, Homo sapiens
caccagcatccaccttggctc

SEQ ID NO: 4030115 - DNA, 19 bp, Homo sapiens
caccagccacagcctcccc

SEQ ID NO: 4030116 - DNA, 20 bp, Homo sapiens
caccagccacagcctcccca

SEQ ID NO: 4030117 - DNA, 13 bp, Homo sapiens
caccagccatcct

SEQ ID NO: 4030118 - DNA, 18 bp, Homo sapiens
caccagcccccgccccag

SEQ ID NO: 4030119 - DNA, 21 bp, Homo sapiens
caccagcccccgccccagagt

SEQ ID NO: 4030120 - DNA, 16 bp, Homo sapiens
caccagcccggcctgc

SEQ ID NO: 4030121 - DNA, 14 bp, Homo sapiens
caccagccctgcag

SEQ ID NO: 4030122 - DNA, 14 bp, Homo sapiens
caccagctatctgt

SEQ ID NO: 4030123 - DNA, 22 bp, Homo sapiens
caccagctcgtttttcagcacc

SEQ ID NO: 4030124 - DNA, 13 bp, Homo sapiens
caccagctgcagc

SEQ ID NO: 4030125 - DNA, 16 bp, Homo sapiens
caccagctgcagcccc

SEQ ID NO: 4030126 - DNA, 20 bp, Homo sapiens
caccagcttcactctctccg

SEQ ID NO: 4030127 - DNA, 16 bp, Homo sapiens
caccagcttctccagg

SEQ ID NO: 4030128 - DNA, 19 bp, Homo sapiens
caccagcttctccaggctc

SEQ ID NO: 4030129 - DNA, 21 bp, Homo sapiens
caccaggacttggggtcagga

SEQ ID NO: 4030130 - DNA, 23 bp, Homo sapiens
caccaggacttggggtcaggaac

SEQ ID NO: 4030131 - DNA, 17 bp, Homo sapiens
caccaggagaaccacta

SEQ ID NO: 4030132 - DNA, 16 bp, Homo sapiens
caccaggcccccctgt

SEQ ID NO: 4030133 - DNA, 17 bp, Homo sapiens
caccaggcccccctgtc

SEQ ID NO: 4030134 - DNA, 18 bp, Homo sapiens
caccaggccgtgccttgt

SEQ ID NO: 4030135 - DNA, 16 bp, Homo sapiens
caccaggctgtgggcc

SEQ ID NO: 4030136 - DNA, 23 bp, Homo sapiens
caccagggcattcgggccacagg

SEQ ID NO: 4030137 - DNA, 15 bp, Homo sapiens
caccaggtgcatgca

SEQ ID NO: 4030138 - DNA, 16 bp, Homo sapiens
caccaggtgcatgcat

SEQ ID NO: 4030139 - DNA, 21 bp, Homo sapiens
caccaggtgcatgcatgccct

SEQ ID NO: 4030140 - DNA, 21 bp, Homo sapiens
caccatagagaggcgctagag

SEQ ID NO: 4030141 - DNA, 13 bp, Homo sapiens
caccatatgaatt

SEQ ID NO: 4030142 - DNA, 14 bp, Homo sapiens
caccatccctgatg

SEQ ID NO: 4030143 - DNA, 13 bp, Homo sapiens
caccatcctgctg

SEQ ID NO: 4030144 - DNA, 12 bp, Homo sapiens
caccatggccag

SEQ ID NO: 4030145 - DNA, 15 bp, Homo sapiens
caccatgggaaactg

SEQ ID NO: 4030146 - DNA, 20 bp, Homo sapiens
caccatgtattcatccagag

SEQ ID NO: 4030147 - DNA, 15 bp, Homo sapiens
caccatgtgccatct

SEQ ID NO: 4030148 - DNA, 20 bp, Homo sapiens
caccatgttggccaggctgg

SEQ ID NO: 4030149 - DNA, 21 bp, Homo sapiens
caccattgtgaagcacctact

SEQ ID NO: 4030150 - DNA, 17 bp, Homo sapiens
cacccaaatcacatctc

SEQ ID NO: 4030151 - DNA, 20 bp, Homo sapiens
cacccaaatcacatctcacc

SEQ ID NO: 4030152 - DNA, 23 bp, Homo sapiens
cacccaataaacattaagattga

SEQ ID NO: 4030153 - DNA, 21 bp, Homo sapiens
cacccaatcaagggaagaagg

SEQ ID NO: 4030154 - DNA, 14 bp, Homo sapiens
cacccacacagctg

SEQ ID NO: 4030155 - DNA, 16 bp, Homo sapiens
cacccacacagctgcc

SEQ ID NO: 4030156 - DNA, 17 bp, Homo sapiens
cacccacacagctgccc

SEQ ID NO: 4030157 - DNA, 14 bp, Homo sapiens
cacccacccctgca

SEQ ID NO: 4030158 - DNA, 13 bp, Homo sapiens
cacccaccctgtg

SEQ ID NO: 4030159 - DNA, 16 bp, Homo sapiens
cacccaccctgtgcca

SEQ ID NO: 4030160 - DNA, 13 bp, Homo sapiens
cacccaccgtgga

SEQ ID NO: 4030161 - DNA, 14 bp, Homo sapiens
cacccacctccacc

SEQ ID NO: 4030162 - DNA, 16 bp, Homo sapiens
cacccacctccaccca

SEQ ID NO: 4030163 - DNA, 20 bp, Homo sapiens
cacccacctccacccagccc

SEQ ID NO: 4030164 - DNA, 14 bp, Homo sapiens
cacccactcaggat

SEQ ID NO: 4030165 - DNA, 16 bp, Homo sapiens
cacccactcaggattg

SEQ ID NO: 4030166 - DNA, 15 bp, Homo sapiens
cacccagcccctggc

SEQ ID NO: 4030167 - DNA, 12 bp, Homo sapiens
cacccagctcca

SEQ ID NO: 4030168 - DNA, 13 bp, Homo sapiens
cacccagctccag

SEQ ID NO: 4030169 - DNA, 19 bp, Homo sapiens
cacccaggatgacccctgg

SEQ ID NO: 4030170 - DNA, 17 bp, Homo sapiens
cacccaggcccatgcca

SEQ ID NO: 4030171 - DNA, 20 bp, Homo sapiens
cacccaggctggactgcaat

SEQ ID NO: 4030172 - DNA, 11 bp, Homo sapiens
cacccagggaa

SEQ ID NO: 4030173 - DNA, 16 bp, Homo sapiens
cacccagtgggaagag

SEQ ID NO: 4030174 - DNA, 14 bp, Homo sapiens
cacccataaacagt

SEQ ID NO: 4030175 - DNA, 20 bp, Homo sapiens
cacccatgggctctgacaga

SEQ ID NO: 4030176 - DNA, 14 bp, Homo sapiens
cacccattatctgg

SEQ ID NO: 4030177 - DNA, 19 bp, Homo sapiens
caccccaccctccctggag

SEQ ID NO: 4030178 - DNA, 14 bp, Homo sapiens
caccccacccttcc

SEQ ID NO: 4030179 - DNA, 13 bp, Homo sapiens
caccccacctcca

SEQ ID NO: 4030180 - DNA, 20 bp, Homo sapiens
cacagctacttggtttgtgt

SEQ ID NO: 4030181 - DNA, 13 bp, Homo sapiens
cacagctcctttt

SEQ ID NO: 4030182 - DNA, 22 bp, Homo sapiens
cacagctccttttccagagcat

SEQ ID NO: 4030183 - DNA, 21 bp, Homo sapiens
cacagctcttcacaccattca

SEQ ID NO: 4030184 - DNA, 18 bp, Homo sapiens
cacagctgagcacttagc

SEQ ID NO: 4030185 - DNA, 12 bp, Homo sapiens
cacagctgccct

SEQ ID NO: 4030186 - DNA, 21 bp, Homo sapiens
cacagctgccctagctgaccc

SEQ ID NO: 4030187 - DNA, 21 bp, Homo sapiens
cacagctgctgttctcaggac

SEQ ID NO: 4030188 - DNA, 24 bp, Homo sapiens
cacagctgctgttctcaggacagc

SEQ ID NO: 4030189 - DNA, 12 bp, Homo sapiens
cacagctggatc

SEQ ID NO: 4030190 - DNA, 16 bp, Homo sapiens
cacagcttagatttca

SEQ ID NO: 4030191 - DNA, 12 bp, Homo sapiens
cacagcttttgc

SEQ ID NO: 4030192 - DNA, 14 bp, Homo sapiens
cacagcttttgcaa

SEQ ID NO: 4030193 - DNA, 23 bp, Homo sapiens
cacaggacatgcggtagccagca

SEQ ID NO: 4030194 - DNA, 17 bp, Homo sapiens
cacaggaggccagtggg

SEQ ID NO: 4030195 - DNA, 16 bp, Homo sapiens
cacaggagtgtcctct

SEQ ID NO: 4030196 - DNA, 19 bp, Homo sapiens
cacaggatcctattctcac

SEQ ID NO: 4030197 - DNA, 20 bp, Homo sapiens
cacaggatcctattctcacc

SEQ ID NO: 4030198 - DNA, 23 bp, Homo sapiens
cacaggatgaggtggtggagtgg

SEQ ID NO: 4030199 - DNA, 11 bp, Homo sapiens
cacaggcagct

SEQ ID NO: 4030200 - DNA, 21 bp, Homo sapiens
cacaggcagctggatgagact

SEQ ID NO: 4030201 - DNA, 19 bp, Homo sapiens
cacaggcagctttctagaa

SEQ ID NO: 4030202 - DNA, 18 bp, Homo sapiens
cacaggcatctacacagc

SEQ ID NO: 4030203 - DNA, 20 bp, Homo sapiens
cacaggcatctacacagcct

SEQ ID NO: 4030204 - DNA, 15 bp, Homo sapiens
cacaggccaccctgt

SEQ ID NO: 4030205 - DNA, 22 bp, Homo sapiens
cacaggcccccttgagtggggt

SEQ ID NO: 4030206 - DNA, 19 bp, Homo sapiens
cacaggcccttcctctcca

SEQ ID NO: 4030207 - DNA, 17 bp, Homo sapiens
cacagggaagggcttgg

SEQ ID NO: 4030208 - DNA, 21 bp, Homo sapiens
cacagggaagggcttggccag

SEQ ID NO: 4030209 - DNA, 15 bp, Homo sapiens
cacagggcaccagag

SEQ ID NO: 4030210 - DNA, 15 bp, Homo sapiens
cacagggccagaggg

SEQ ID NO: 4030211 - DNA, 13 bp, Homo sapiens
cacagggcgagac

SEQ ID NO: 4030212 - DNA, 22 bp, Homo sapiens
cacagggggattctgagcagtg

SEQ ID NO: 4030213 - DNA, 19 bp, Homo sapiens
cacagggtctgctctttct

SEQ ID NO: 4030214 - DNA, 14 bp, Homo sapiens
cacaggtcaggcta

SEQ ID NO: 4030215 - DNA, 13 bp, Homo sapiens
cacaggtggggac

SEQ ID NO: 4030216 - DNA, 21 bp, Homo sapiens
cacagtaaaaatggaaactat

SEQ ID NO: 4030217 - DNA, 13 bp, Homo sapiens
cacagtagaactg

SEQ ID NO: 4030218 - DNA, 13 bp, Homo sapiens
cacagtagtcttg

SEQ ID NO: 4030219 - DNA, 14 bp, Homo sapiens
cacagtcaaaataa

SEQ ID NO: 4030220 - DNA, 17 bp, Homo sapiens
cacagtcaaaataattc

SEQ ID NO: 4030221 - DNA, 20 bp, Homo sapiens
cacagtcagcatgcttccca

SEQ ID NO: 4030222 - DNA, 22 bp, Homo sapiens
cacagtcagcatgcttcccaga

SEQ ID NO: 4030223 - DNA, 18 bp, Homo sapiens
cacagtccagacccaagt

SEQ ID NO: 4030224 - DNA, 19 bp, Homo sapiens
cacagtccagacccaagtc

SEQ ID NO: 4030225 - DNA, 14 bp, Homo sapiens
cacagtctccccca

SEQ ID NO: 4030226 - DNA, 22 bp, Homo sapiens
cacagtctctttaatcttcagt

SEQ ID NO: 4030227 - DNA, 15 bp, Homo sapiens
cacagtgaagtgctg

SEQ ID NO: 4030228 - DNA, 17 bp, Homo sapiens
cacagtgcatctcagcc

SEQ ID NO: 4030229 - DNA, 23 bp, Homo sapiens
cacagtggactcagcagtgacca

SEQ ID NO: 4030230 - DNA, 15 bp, Homo sapiens
cacagtgtggggcag

SEQ ID NO: 4030231 - DNA, 16 bp, Homo sapiens
cacagtgttggaggtt

SEQ ID NO: 4030232 - DNA, 10 bp, Homo sapiens
cacagtgttt

SEQ ID NO: 4030233 - DNA, 22 bp, Homo sapiens
cacagttcttggtgactgtccc

SEQ ID NO: 4030234 - DNA, 20 bp, Homo sapiens
cacagttctttgggccagac

SEQ ID NO: 4030235 - DNA, 23 bp, Homo sapiens
cacagttgaagggaggggctgtg

SEQ ID NO: 4030236 - DNA, 12 bp, Homo sapiens
cacagttgccac

SEQ ID NO: 4030237 - DNA, 20 bp, Homo sapiens
cacagttgccaccacctctg

SEQ ID NO: 4030238 - DNA, 16 bp, Homo sapiens
cacatacaggtgctca

SEQ ID NO: 4030239 - DNA, 11 bp, Homo sapiens
cacatacatta

SEQ ID NO: 4030240 - DNA, 12 bp, Homo sapiens
cacatacattaa

SEQ ID NO: 4030241 - DNA, 16 bp, Homo sapiens
cacatacattaaaact

SEQ ID NO: 4030242 - DNA, 17 bp, Homo sapiens
cacatacattaaaacta

SEQ ID NO: 4030243 - DNA, 18 bp, Homo sapiens
cacatacattaaaactag

SEQ ID NO: 4030244 - DNA, 18 bp, Homo sapiens
cacatagcatgtaatggt

SEQ ID NO: 4030245 - DNA, 21 bp, Homo sapiens
cacatataaacatcacacaca

SEQ ID NO: 4030246 - DNA, 13 bp, Homo sapiens
cacatcaaagagg

SEQ ID NO: 4030247 - DNA, 16 bp, Homo sapiens
cacatccccaagccca

SEQ ID NO: 4030248 - DNA, 20 bp, Homo sapiens
cacatccggggccagctccg

SEQ ID NO: 4030249 - DNA, 18 bp, Homo sapiens
cacatcctccgtccagcc

SEQ ID NO: 4030250 - DNA, 15 bp, Homo sapiens
cacatcgcacactgg

SEQ ID NO: 4030251 - DNA, 14 bp, Homo sapiens
cacatctcacctcc

SEQ ID NO: 4030252 - DNA, 13 bp, Homo sapiens
cacatctgcattt

SEQ ID NO: 4030253 - DNA, 15 bp, Homo sapiens
cacatctgccagacc

SEQ ID NO: 4030254 - DNA, 16 bp, Homo sapiens
cacatctgccagacct

SEQ ID NO: 4030255 - DNA, 12 bp, Homo sapiens
cacatctgcctt

SEQ ID NO: 4030256 - DNA, 21 bp, Homo sapiens
cacatcttggctatgtaattc

SEQ ID NO: 4030257 - DNA, 14 bp, Homo sapiens
cacatgaatgcagt

SEQ ID NO: 4030258 - DNA, 18 bp, Homo sapiens
cacatgagctatttccat

SEQ ID NO: 4030259 - DNA, 16 bp, Homo sapiens
cacatgaggccatctc

SEQ ID NO: 4030260 - DNA, 19 bp, Homo sapiens
cacatgattgtataagcat

SEQ ID NO: 4030261 - DNA, 17 bp, Homo sapiens
cacatgccactgcctgc

SEQ ID NO: 4030262 - DNA, 19 bp, Homo sapiens
cacatgccactgcctgcac

SEQ ID NO: 4030263 - DNA, 17 bp, Homo sapiens
cacatggccccatccca

SEQ ID NO: 4030264 - DNA, 14 bp, Homo sapiens
cacatgtttaactt

SEQ ID NO: 4030265 - DNA, 13 bp, Homo sapiens
cacattaaaaaat

SEQ ID NO: 4030266 - DNA, 15 bp, Homo sapiens
cacattagaattagt

SEQ ID NO: 4030267 - DNA, 21 bp, Homo sapiens
cacattagattttattttact

SEQ ID NO: 4030268 - DNA, 15 bp, Homo sapiens
cacattatgtatctt

SEQ ID NO: 4030269 - DNA, 22 bp, Homo sapiens
cacattatgtatcttagttaca

SEQ ID NO: 4030270 - DNA, 14 bp, Homo sapiens
cacattcaggaaga

SEQ ID NO: 4030271 - DNA, 21 bp, Homo sapiens
cacattcccccaccagctgca

SEQ ID NO: 4030272 - DNA, 19 bp, Homo sapiens
cacattcgacataccccac

SEQ ID NO: 4030273 - DNA, 22 bp, Homo sapiens
cacattgagctgatataaattc

SEQ ID NO: 4030274 - DNA, 23 bp, Homo sapiens
cacattgcattctattgccttct

SEQ ID NO: 4030275 - DNA, 17 bp, Homo sapiens
cacattggaatgccttg

SEQ ID NO: 4030276 - DNA, 16 bp, Homo sapiens
cacatttcactgtctg

SEQ ID NO: 4030277 - DNA, 19 bp, Homo sapiens
cacatttctgatcagaggt

SEQ ID NO: 4030278 - DNA, 12 bp, Homo sapiens
cacatttgtaca

SEQ ID NO: 4030279 - DNA, 16 bp, Homo sapiens
cacatttttaaattgt

SEQ ID NO: 4030280 - DNA, 20 bp, Homo sapiens
caccaaaagtgctccccaaa

SEQ ID NO: 4030281 - DNA, 15 bp, Homo sapiens
caccaagaaagcagg

SEQ ID NO: 4030282 - DNA, 14 bp, Homo sapiens
caccaagcacagca

SEQ ID NO: 4030283 - DNA, 19 bp, Homo sapiens
cacacacgcacgcacacac

SEQ ID NO: 4030284 - DNA, 17 bp, Homo sapiens
cacacactgcctcccat

SEQ ID NO: 4030285 - DNA, 18 bp, Homo sapiens
cacacactgcctcccatc

SEQ ID NO: 4030286 - DNA, 14 bp, Homo sapiens
cacacagagtggtc

SEQ ID NO: 4030287 - DNA, 17 bp, Homo sapiens
cacacagatacacacac

SEQ ID NO: 4030288 - DNA, 15 bp, Homo sapiens
cacacagctgcccta

SEQ ID NO: 4030289 - DNA, 16 bp, Homo sapiens
cacacagctgccctag

SEQ ID NO: 4030290 - DNA, 14 bp, Homo sapiens
cacacagctgggca

SEQ ID NO: 4030291 - DNA, 20 bp, Homo sapiens
cacacaggtggggactgggc

SEQ ID NO: 4030292 - DNA, 23 bp, Homo sapiens
cacacaggtggggactgggcaca

SEQ ID NO: 4030293 - DNA, 23 bp, Homo sapiens
cacacatataaacatcacacaca

SEQ ID NO: 4030294 - DNA, 16 bp, Homo sapiens
cacacatttcactgtc

SEQ ID NO: 4030295 - DNA, 17 bp, Homo sapiens
cacaccaggctgtgggc

SEQ ID NO: 4030296 - DNA, 12 bp, Homo sapiens
cacaccagtggc

SEQ ID NO: 4030297 - DNA, 19 bp, Homo sapiens
cacacccagtgggaagagt

SEQ ID NO: 4030298 - DNA, 19 bp, Homo sapiens
cacaccccacaccccagcc

SEQ ID NO: 4030299 - DNA, 14 bp, Homo sapiens
cacaccccagccca

SEQ ID NO: 4030300 - DNA, 15 bp, Homo sapiens
cacaccccagcccac

SEQ ID NO: 4030301 - DNA, 21 bp, Homo sapiens
cacaccccagcccaccctgct

SEQ ID NO: 4030302 - DNA, 20 bp, Homo sapiens
cacaccgtgtaaaccaaagc

SEQ ID NO: 4030303 - DNA, 17 bp, Homo sapiens
cacacctcagttccctt

SEQ ID NO: 4030304 - DNA, 14 bp, Homo sapiens
cacacctctgccag

SEQ ID NO: 4030305 - DNA, 19 bp, Homo sapiens
cacacgcacaaacacacac

SEQ ID NO: 4030306 - DNA, 15 bp, Homo sapiens
cacacgcacgcacac

SEQ ID NO: 4030307 - DNA, 21 bp, Homo sapiens
cacacgcacgcacacacacaa

SEQ ID NO: 4030308 - DNA, 14 bp, Homo sapiens
cacacgcactggtg

SEQ ID NO: 4030309 - DNA, 14 bp, Homo sapiens
cacacgcaggaact

SEQ ID NO: 4030310 - DNA, 22 bp, Homo sapiens
cacacgcaggaactcccagcaa

SEQ ID NO: 4030311 - DNA, 17 bp, Homo sapiens
cacacggactcccgggc

SEQ ID NO: 4030312 - DNA, 19 bp, Homo sapiens
cacacggactcccgggcca

SEQ ID NO: 4030313 - DNA, 20 bp, Homo sapiens
cacacggactcccgggccac

SEQ ID NO: 4030314 - DNA, 19 bp, Homo sapiens
cacactaaccaagctgagt

SEQ ID NO: 4030315 - DNA, 19 bp, Homo sapiens
cacactagcctctccagga

SEQ ID NO: 4030316 - DNA, 20 bp, Homo sapiens
cacactattaccatgagaag

SEQ ID NO: 4030317 - DNA, 19 bp, Homo sapiens
cacactcaggcctgtgccc

SEQ ID NO: 4030318 - DNA, 22 bp, Homo sapiens
cacactcaggcctgtgcccact

SEQ ID NO: 4030319 - DNA, 14 bp, Homo sapiens
cacactccatctcc

SEQ ID NO: 4030320 - DNA, 17 bp, Homo sapiens
cacactccatctcctgc

SEQ ID NO: 4030321 - DNA, 22 bp, Homo sapiens
cacactccatctcctgctcacc

SEQ ID NO: 4030322 - DNA, 18 bp, Homo sapiens
cacactccccgccttaga

SEQ ID NO: 4030323 - DNA, 20 bp, Homo sapiens
cacactccctgcttgcagga

SEQ ID NO: 4030324 - DNA, 18 bp, Homo sapiens
cacactgcactgttttca

SEQ ID NO: 4030325 - DNA, 22 bp, Homo sapiens
cacactgggtggtggcctggtc

SEQ ID NO: 4030326 - DNA, 21 bp, Homo sapiens
cacactgtcatgcttcatcat

SEQ ID NO: 4030327 - DNA, 12 bp, Homo sapiens
cacacttagctg

SEQ ID NO: 4030328 - DNA, 21 bp, Homo sapiens
cacacttgagaggatgaatgt

SEQ ID NO: 4030329 - DNA, 23 bp, Homo sapiens
cacacttgtcggctccagtcccc

SEQ ID NO: 4030330 - DNA, 17 bp, Homo sapiens
cacacttgttccagctc

SEQ ID NO: 4030331 - DNA, 18 bp, Homo sapiens
cacacttgttccagctct

SEQ ID NO: 4030332 - DNA, 20 bp, Homo sapiens
cacacttgttccagctcttt

SEQ ID NO: 4030333 - DNA, 15 bp, Homo sapiens
cacagaaaaagcatg

SEQ ID NO: 4030334 - DNA, 13 bp, Homo sapiens
cacagaaaagcat

SEQ ID NO: 4030335 - DNA, 13 bp, Homo sapiens
cacagaaacacaa

SEQ ID NO: 4030336 - DNA, 19 bp, Homo sapiens
cacagaaatcagaggagag

SEQ ID NO: 4030337 - DNA, 16 bp, Homo sapiens
cacagaaatgctgctg

SEQ ID NO: 4030338 - DNA, 19 bp, Homo sapiens
cacagaaatgctgctggcc

SEQ ID NO: 4030339 - DNA, 20 bp, Homo sapiens
cacagaaatgctgctggcca

SEQ ID NO: 4030340 - DNA, 13 bp, Homo sapiens
cacagaacccttg

SEQ ID NO: 4030341 - DNA, 19 bp, Homo sapiens
cacagaaccttcaacccag

SEQ ID NO: 4030342 - DNA, 22 bp, Homo sapiens
cacagaaccttcaacccagtgg

SEQ ID NO: 4030343 - DNA, 23 bp, Homo sapiens
cacagaatttgtatgtattttca

SEQ ID NO: 4030344 - DNA, 13 bp, Homo sapiens
cacagacacacac

SEQ ID NO: 4030345 - DNA, 14 bp, Homo sapiens
cacagacacacaca

SEQ ID NO: 4030346 - DNA, 14 bp, Homo sapiens
cacagacccctagg

SEQ ID NO: 4030347 - DNA, 20 bp, Homo sapiens
cacagagagacagacttgag

SEQ ID NO: 4030348 - DNA, 18 bp, Homo sapiens
cacagagagggagagcag

SEQ ID NO: 4030349 - DNA, 14 bp, Homo sapiens
cacagagcctggcc

SEQ ID NO: 4030350 - DNA, 15 bp, Homo sapiens
cacagagcctggccc

SEQ ID NO: 4030351 - DNA, 19 bp, Homo sapiens
cacagagcgtccttccccc

SEQ ID NO: 4030352 - DNA, 17 bp, Homo sapiens
cacagaggagtgcagcc

SEQ ID NO: 4030353 - DNA, 13 bp, Homo sapiens
cacagaggctgcc

SEQ ID NO: 4030354 - DNA, 19 bp, Homo sapiens
cacagaggtcaggaagcag

SEQ ID NO: 4030355 - DNA, 13 bp, Homo sapiens
cacagagtgagcc

SEQ ID NO: 4030356 - DNA, 16 bp, Homo sapiens
cacagagtgagccagt

SEQ ID NO: 4030357 - DNA, 17 bp, Homo sapiens
cacagagtgagccagtg

SEQ ID NO: 4030358 - DNA, 18 bp, Homo sapiens
cacagagtgagccagtga

SEQ ID NO: 4030359 - DNA, 18 bp, Homo sapiens
cacagagtggtctttctg

SEQ ID NO: 4030360 - DNA, 11 bp, Homo sapiens
cacagatcatg

SEQ ID NO: 4030361 - DNA, 20 bp, Homo sapiens
cacagatggatttgcctgtg

SEQ ID NO: 4030362 - DNA, 19 bp, Homo sapiens
cacagatgtctctggggca

SEQ ID NO: 4030363 - DNA, 15 bp, Homo sapiens
cacagcacagccaac

SEQ ID NO: 4030364 - DNA, 16 bp, Homo sapiens
cacagcactctctaaa

SEQ ID NO: 4030365 - DNA, 11 bp, Homo sapiens
cacagcagccc

SEQ ID NO: 4030366 - DNA, 12 bp, Homo sapiens
cacagcagcccc

SEQ ID NO: 4030367 - DNA, 15 bp, Homo sapiens
cacagcagcttcacc

SEQ ID NO: 4030368 - DNA, 18 bp, Homo sapiens
cacagcagcttcaccaga

SEQ ID NO: 4030369 - DNA, 20 bp, Homo sapiens
cacagcatcattttgcattc

SEQ ID NO: 4030370 - DNA, 14 bp, Homo sapiens
cacagcatttcaag

SEQ ID NO: 4030371 - DNA, 22 bp, Homo sapiens
cacagccaacacgcacctgcct

SEQ ID NO: 4030372 - DNA, 14 bp, Homo sapiens
cacagccagaggag

SEQ ID NO: 4030373 - DNA, 16 bp, Homo sapiens
cacagccagaggaggg

SEQ ID NO: 4030374 - DNA, 19 bp, Homo sapiens
cacagccagaggagggcag

SEQ ID NO: 4030375 - DNA, 22 bp, Homo sapiens
cacagccctccgaccctcatgg

SEQ ID NO: 4030376 - DNA, 14 bp, Homo sapiens
cacagcctccaggg

SEQ ID NO: 4030377 - DNA, 15 bp, Homo sapiens
cacagcctccagggc

SEQ ID NO: 4030378 - DNA, 16 bp, Homo sapiens
cacagcctccagggcc

SEQ ID NO: 4030379 - DNA, 15 bp, Homo sapiens
cacagcctcctctgt

SEQ ID NO: 4030380 - DNA, 13 bp, Homo sapiens
cacagccttcgga

SEQ ID NO: 4030381 - DNA, 22 bp, Homo sapiens
cacagcggaggagaccagctca

SEQ ID NO: 4030382 - DNA, 23 bp, Homo sapiens
cacagcggaggagaccagctcag

SEQ ID NO: 4030383 - DNA, 21 bp, Homo sapiens
cacagcggagtctgtcctgtg

SEQ ID NO: 4030384 - DNA, 15 bp, Homo sapiens
cacagcgtccctggc

SEQ ID NO: 4030385 - DNA, 16 bp, Homo sapiens
cacagcgtccctggcg

SEQ ID NO: 4030386 - DNA, 18 bp, Homo sapiens
caatgggactggagtcag

SEQ ID NO: 4030387 - DNA, 23 bp, Homo sapiens
caatgggactggagtcagatgag

SEQ ID NO: 4030388 - DNA, 21 bp, Homo sapiens
caatggtgatcctctattttg

SEQ ID NO: 4030389 - DNA, 21 bp, Homo sapiens
caatggtgtcagtatccaggc

SEQ ID NO: 4030390 - DNA, 22 bp, Homo sapiens
caatggtgttgccctgagtgga

SEQ ID NO: 4030391 - DNA, 18 bp, Homo sapiens
caatgtcacaacctctct

SEQ ID NO: 4030392 - DNA, 21 bp, Homo sapiens
caatgtcaggaacagaaggat

SEQ ID NO: 4030393 - DNA, 21 bp, Homo sapiens
caatgtcagtatttcagtgta

SEQ ID NO: 4030394 - DNA, 21 bp, Homo sapiens
caatgtcatatactgccatgt

SEQ ID NO: 4030395 - DNA, 17 bp, Homo sapiens
caatgtccagcagtctg

SEQ ID NO: 4030396 - DNA, 16 bp, Homo sapiens
caatgtctgagtgaac

SEQ ID NO: 4030397 - DNA, 12 bp, Homo sapiens
caatgtgcagtg

SEQ ID NO: 4030398 - DNA, 13 bp, Homo sapiens
caatgtgcagtgt

SEQ ID NO: 4030399 - DNA, 18 bp, Homo sapiens
caatgtgcataatgataa

SEQ ID NO: 4030400 - DNA, 19 bp, Homo sapiens
caatgttaaggaaactctt

SEQ ID NO: 4030401 - DNA, 24 bp, Homo sapiens
caatgttaaggaaactcttatctc

SEQ ID NO: 4030402 - DNA, 12 bp, Homo sapiens
caatgttcattg

SEQ ID NO: 4030403 - DNA, 14 bp, Homo sapiens
caatgttcattgta

SEQ ID NO: 4030404 - DNA, 18 bp, Homo sapiens
caatgttcattgtaatgt

SEQ ID NO: 4030405 - DNA, 23 bp, Homo sapiens
caatgttcattgtaatgttactg

SEQ ID NO: 4030406 - DNA, 17 bp, Homo sapiens
caattaaaggtcctgcc

SEQ ID NO: 4030407 - DNA, 13 bp, Homo sapiens
caattaaatgtag

SEQ ID NO: 4030408 - DNA, 18 bp, Homo sapiens
caattaataaaaaatgga

SEQ ID NO: 4030409 - DNA, 19 bp, Homo sapiens
caattaatagtttgtctat

SEQ ID NO: 4030410 - DNA, 22 bp, Homo sapiens
caattaatagtttgtctatttt

SEQ ID NO: 4030411 - DNA, 15 bp, Homo sapiens
caattactttagaaa

SEQ ID NO: 4030412 - DNA, 16 bp, Homo sapiens
caattaggaagtgtaa

SEQ ID NO: 4030413 - DNA, 21 bp, Homo sapiens
caattagtctgaaactggctt

SEQ ID NO: 4030414 - DNA, 13 bp, Homo sapiens
caattagtttcct

SEQ ID NO: 4030415 - DNA, 14 bp, Homo sapiens
caattcagacaggc

SEQ ID NO: 4030416 - DNA, 19 bp, Homo sapiens
caattcatgcctttcatag

SEQ ID NO: 4030417 - DNA, 12 bp, Homo sapiens
caattcccctct

SEQ ID NO: 4030418 - DNA, 17 bp, Homo sapiens
caattcccctctgctgc

SEQ ID NO: 4030419 - DNA, 23 bp, Homo sapiens
caattccctctctcagcacagcc

SEQ ID NO: 4030420 - DNA, 15 bp, Homo sapiens
caattcctctgggaa

SEQ ID NO: 4030421 - DNA, 14 bp, Homo sapiens
caattctgcccgct

SEQ ID NO: 4030422 - DNA, 15 bp, Homo sapiens
caattgaagtaaact

SEQ ID NO: 4030423 - DNA, 21 bp, Homo sapiens
caattgatgtatatgtttata

SEQ ID NO: 4030424 - DNA, 23 bp, Homo sapiens
caattgatgtatatgtttatata

SEQ ID NO: 4030425 - DNA, 21 bp, Homo sapiens
caattggcagtgactttgtat

SEQ ID NO: 4030426 - DNA, 14 bp, Homo sapiens
caattgtaaattga

SEQ ID NO: 4030427 - DNA, 17 bp, Homo sapiens
caattgtcactttttat

SEQ ID NO: 4030428 - DNA, 18 bp, Homo sapiens
caattgtgagccaccacg

SEQ ID NO: 4030429 - DNA, 13 bp, Homo sapiens
caattgtgctgcc

SEQ ID NO: 4030430 - DNA, 20 bp, Homo sapiens
caattgtgtagcctttttgt

SEQ ID NO: 4030431 - DNA, 20 bp, Homo sapiens
caattgtgtgaattaatttc

SEQ ID NO: 4030432 - DNA, 21 bp, Homo sapiens
caattgttttaatctgaaatt

SEQ ID NO: 4030433 - DNA, 14 bp, Homo sapiens
caatttaaatgtta

SEQ ID NO: 4030434 - DNA, 14 bp, Homo sapiens
caatttcagactcc

SEQ ID NO: 4030435 - DNA, 23 bp, Homo sapiens
caatttccctcaggttctatttt

SEQ ID NO: 4030436 - DNA, 17 bp, Homo sapiens
caatttcggattttttc

SEQ ID NO: 4030437 - DNA, 22 bp, Homo sapiens
caatttcggattttttccaaaa

SEQ ID NO: 4030438 - DNA, 17 bp, Homo sapiens
caatttctaatttttaa

SEQ ID NO: 4030439 - DNA, 19 bp, Homo sapiens
caatttctaatttttaaga

SEQ ID NO: 4030440 - DNA, 17 bp, Homo sapiens
caatttgacaaaaccca

SEQ ID NO: 4030441 - DNA, 23 bp, Homo sapiens
caatttgcacatcttggctatgt

SEQ ID NO: 4030442 - DNA, 19 bp, Homo sapiens
caatttgtaaaaacagcat

SEQ ID NO: 4030443 - DNA, 22 bp, Homo sapiens
caatttgttcatcctattgttg

SEQ ID NO: 4030444 - DNA, 17 bp, Homo sapiens
caattttaatgctattt

SEQ ID NO: 4030445 - DNA, 18 bp, Homo sapiens
caatttttgtctcagaag

SEQ ID NO: 4030446 - DNA, 16 bp, Homo sapiens
caattttttttttcct

SEQ ID NO: 4030447 - DNA, 12 bp, Homo sapiens
cacaaaaatgaa

SEQ ID NO: 4030448 - DNA, 20 bp, Homo sapiens
cacaaaaatttgaacactgg

SEQ ID NO: 4030449 - DNA, 14 bp, Homo sapiens
cacaaacacacaca

SEQ ID NO: 4030450 - DNA, 16 bp, Homo sapiens
cacaaaccctgcctct

SEQ ID NO: 4030451 - DNA, 14 bp, Homo sapiens
cacaaactgtaaat

SEQ ID NO: 4030452 - DNA, 19 bp, Homo sapiens
cacaaagcggggggagggt

SEQ ID NO: 4030453 - DNA, 22 bp, Homo sapiens
cacaaatgatgttttcaggtgt

SEQ ID NO: 4030454 - DNA, 20 bp, Homo sapiens
cacaaatttcacttatacct

SEQ ID NO: 4030455 - DNA, 19 bp, Homo sapiens
cacaacatttgcagatgtt

SEQ ID NO: 4030456 - DNA, 16 bp, Homo sapiens
cacaaccagccaggca

SEQ ID NO: 4030457 - DNA, 19 bp, Homo sapiens
cacaacccaagcaacattt

SEQ ID NO: 4030458 - DNA, 17 bp, Homo sapiens
cacaacctctctgatct

SEQ ID NO: 4030459 - DNA, 17 bp, Homo sapiens
cacaaccttctgtggct

SEQ ID NO: 4030460 - DNA, 18 bp, Homo sapiens
cacaaccttctgtggctc

SEQ ID NO: 4030461 - DNA, 19 bp, Homo sapiens
cacaactatttttccaaaa

SEQ ID NO: 4030462 - DNA, 20 bp, Homo sapiens
cacaactgcaataacttctg

SEQ ID NO: 4030463 - DNA, 18 bp, Homo sapiens
cacaagatggaatttatc

SEQ ID NO: 4030464 - DNA, 21 bp, Homo sapiens
cacaagcagagtgcacagctg

SEQ ID NO: 4030465 - DNA, 15 bp, Homo sapiens
cacaagctggaagca

SEQ ID NO: 4030466 - DNA, 16 bp, Homo sapiens
cacaaggacttcctgt

SEQ ID NO: 4030467 - DNA, 17 bp, Homo sapiens
cacaaggctggccagca

SEQ ID NO: 4030468 - DNA, 12 bp, Homo sapiens
cacaagggctct

SEQ ID NO: 4030469 - DNA, 13 bp, Homo sapiens
cacaagtcttcca

SEQ ID NO: 4030470 - DNA, 20 bp, Homo sapiens
cacaataaatgtattcaaat

SEQ ID NO: 4030471 - DNA, 19 bp, Homo sapiens
cacaatccctggggctgtg

SEQ ID NO: 4030472 - DNA, 20 bp, Homo sapiens
cacaatggctaattcccaga

SEQ ID NO: 4030473 - DNA, 21 bp, Homo sapiens
cacaatggctaattcccagag

SEQ ID NO: 4030474 - DNA, 18 bp, Homo sapiens
cacaattttgataaaaat

SEQ ID NO: 4030475 - DNA, 13 bp, Homo sapiens
cacacaaaaaaag

SEQ ID NO: 4030476 - DNA, 10 bp, Homo sapiens
cacacacaca

SEQ ID NO: 4030477 - DNA, 15 bp, Homo sapiens
cacacacacaaacct

SEQ ID NO: 4030478 - DNA, 11 bp, Homo sapiens
cacacacacac

SEQ ID NO: 4030479 - DNA, 14 bp, Homo sapiens
cacacacacacaaa

SEQ ID NO: 4030480 - DNA, 16 bp, Homo sapiens
cacacacacacacaca

SEQ ID NO: 4030481 - DNA, 13 bp, Homo sapiens
cacacacacacag

SEQ ID NO: 4030482 - DNA, 13 bp, Homo sapiens
cacacacacactg

SEQ ID NO: 4030483 - DNA, 14 bp, Homo sapiens
cacacacacaggtg

SEQ ID NO: 4030484 - DNA, 12 bp, Homo sapiens
cacacacactcc

SEQ ID NO: 4030485 - DNA, 16 bp, Homo sapiens
cacacacagctgggca

SEQ ID NO: 4030486 - DNA, 13 bp, Homo sapiens
cacacacaggtgg

SEQ ID NO: 4030487 - DNA, 14 bp, Homo sapiens
cacacacaggtggg

SEQ ID NO: 4030488 - DNA, 14 bp, Homo sapiens
cacacacgcacgca

SEQ ID NO: 4030489 - DNA, 18 bp, Homo sapiens
caatctgtaaaactaaga

SEQ ID NO: 4030490 - DNA, 16 bp, Homo sapiens
caatcttaaacataat

SEQ ID NO: 4030491 - DNA, 20 bp, Homo sapiens
caatcttaaacataataaat

SEQ ID NO: 4030492 - DNA, 18 bp, Homo sapiens
caatctttagaaaaggca

SEQ ID NO: 4030493 - DNA, 14 bp, Homo sapiens
caatctttgccttt

SEQ ID NO: 4030494 - DNA, 19 bp, Homo sapiens
caatctttgcctttatctc

SEQ ID NO: 4030495 - DNA, 17 bp, Homo sapiens
caatgaaaaatgtaatt

SEQ ID NO: 4030496 - DNA, 18 bp, Homo sapiens
caatgaaaaatgtaattt

SEQ ID NO: 4030497 - DNA, 19 bp, Homo sapiens
caatgaaaactctttgctg

SEQ ID NO: 4030498 - DNA, 17 bp, Homo sapiens
caatgaacatccctttt

SEQ ID NO: 4030499 - DNA, 14 bp, Homo sapiens
caatgaatttgttc

SEQ ID NO: 4030500 - DNA, 23 bp, Homo sapiens
caatgaattttataatctgcagc

SEQ ID NO: 4030501 - DNA, 16 bp, Homo sapiens
caatgacatctcaggg

SEQ ID NO: 4030502 - DNA, 13 bp, Homo sapiens
caatgacttctaa

SEQ ID NO: 4030503 - DNA, 20 bp, Homo sapiens
caatgaggtgtccaactggc

SEQ ID NO: 4030504 - DNA, 23 bp, Homo sapiens
caatgagttcttctcaaaaaata

SEQ ID NO: 4030505 - DNA, 18 bp, Homo sapiens
caatgatgattaaacacc

SEQ ID NO: 4030506 - DNA, 18 bp, Homo sapiens
caatgatgtgaccctcaa

SEQ ID NO: 4030507 - DNA, 20 bp, Homo sapiens
caatgcagcaaggccctgct

SEQ ID NO: 4030508 - DNA, 22 bp, Homo sapiens
caatgcagcaaggccctgctgc

SEQ ID NO: 4030509 - DNA, 14 bp, Homo sapiens
caatggagaatata

SEQ ID NO: 4030510 - DNA, 15 bp, Homo sapiens
caatggcgcctgctc

SEQ ID NO: 4030511 - DNA, 21 bp, Homo sapiens
agttccagaaggatccaagac

SEQ ID NO: 4030512 - DNA, 15 bp, Homo sapiens
agttcccccagtacc

SEQ ID NO: 4030513 - DNA, 23 bp, Homo sapiens
agttcccccatcagttcccccag

SEQ ID NO: 4030514 - DNA, 14 bp, Homo sapiens
agttcccctggagc

SEQ ID NO: 4030515 - DNA, 14 bp, Homo sapiens
agttccctctgctc

SEQ ID NO: 4030516 - DNA, 19 bp, Homo sapiens
agttccctctgctcagcca

SEQ ID NO: 4030517 - DNA, 17 bp, Homo sapiens
agttcccttggcctcag

SEQ ID NO: 4030518 - DNA, 23 bp, Homo sapiens
agttcctgctacaacttcagcag

SEQ ID NO: 4030519 - DNA, 21 bp, Homo sapiens
agttccttatccctctcttcc

SEQ ID NO: 4030520 - DNA, 15 bp, Homo sapiens
agttctaaattttgt

SEQ ID NO: 4030521 - DNA, 14 bp, Homo sapiens
agttctagagaaga

SEQ ID NO: 4030522 - DNA, 20 bp, Homo sapiens
agttctagagaagaggctgg

SEQ ID NO: 4030523 - DNA, 23 bp, Homo sapiens
agttctatttatttgtgagactg

SEQ ID NO: 4030524 - DNA, 16 bp, Homo sapiens
agttctgccaggcaac

SEQ ID NO: 4030525 - DNA, 16 bp, Homo sapiens
agttctgctctggttg

SEQ ID NO: 4030526 - DNA, 14 bp, Homo sapiens
agttctgggtttct

SEQ ID NO: 4030527 - DNA, 22 bp, Homo sapiens
agttcttaaggattgtgatatt

SEQ ID NO: 4030528 - DNA, 21 bp, Homo sapiens
agttcttatgaggaggggagg

SEQ ID NO: 4030529 - DNA, 16 bp, Homo sapiens
agttcttcacctctat

SEQ ID NO: 4030530 - DNA, 17 bp, Homo sapiens
agttcttggtgctctgt

SEQ ID NO: 4030531 - DNA, 22 bp, Homo sapiens
agttcttggtgctctgtgttcc

SEQ ID NO: 4030532 - DNA, 19 bp, Homo sapiens
agttctttcctccccctgc

SEQ ID NO: 4030533 - DNA, 17 bp, Homo sapiens
agttctttgggccagac

SEQ ID NO: 4030534 - DNA, 16 bp, Homo sapiens
agttgaagctaagatt

SEQ ID NO: 4030535 - DNA, 17 bp, Homo sapiens
agttgacaacctagaat

SEQ ID NO: 4030536 - DNA, 18 bp, Homo sapiens
agttgacaacctagaatg

SEQ ID NO: 4030537 - DNA, 15 bp, Homo sapiens
agttgactcacaggc

SEQ ID NO: 4030538 - DNA, 23 bp, Homo sapiens
agttgactcacaggccctggaga

SEQ ID NO: 4030539 - DNA, 21 bp, Homo sapiens
agttgacttatagtacatgat

SEQ ID NO: 4030540 - DNA, 22 bp, Homo sapiens
agttgagatttttaagaacttc

SEQ ID NO: 4030541 - DNA, 19 bp, Homo sapiens
agttgagtctcctctctga

SEQ ID NO: 4030542 - DNA, 20 bp, Homo sapiens
agttgatctggaacccagac

SEQ ID NO: 4030543 - DNA, 21 bp, Homo sapiens
agttgatctggaacccagact

SEQ ID NO: 4030544 - DNA, 16 bp, Homo sapiens
agttgatgggggccag

SEQ ID NO: 4030545 - DNA, 23 bp, Homo sapiens
agttgatttttttttttttttcc

SEQ ID NO: 4030546 - DNA, 20 bp, Homo sapiens
agttgcaattgaattaaatt

SEQ ID NO: 4030547 - DNA, 11 bp, Homo sapiens
agttgcacatg

SEQ ID NO: 4030548 - DNA, 23 bp, Homo sapiens
agttgcacatgattgtataagca

SEQ ID NO: 4030549 - DNA, 19 bp, Homo sapiens
agttgcatttagcttcttt

SEQ ID NO: 4030550 - DNA, 22 bp, Homo sapiens
agttgcatttagcttctttccc

SEQ ID NO: 4030551 - DNA, 14 bp, Homo sapiens
agttgcccagcctc

SEQ ID NO: 4030552 - DNA, 20 bp, Homo sapiens
agttgcgacggagagaaaaa

SEQ ID NO: 4030553 - DNA, 21 bp, Homo sapiens
agttgcgacggagagaaaaaa

SEQ ID NO: 4030554 - DNA, 12 bp, Homo sapiens
agttgctgagag

SEQ ID NO: 4030555 - DNA, 16 bp, Homo sapiens
agttggaaagttggaa

SEQ ID NO: 4030556 - DNA, 15 bp, Homo sapiens
agttggaatttacca

SEQ ID NO: 4030557 - DNA, 11 bp, Homo sapiens
agttggacagt

SEQ ID NO: 4030558 - DNA, 17 bp, Homo sapiens
agttggacagtttaaag

SEQ ID NO: 4030559 - DNA, 15 bp, Homo sapiens
agttggactctcagg

SEQ ID NO: 4030560 - DNA, 17 bp, Homo sapiens
agttggactctcaggga

SEQ ID NO: 4030561 - DNA, 17 bp, Homo sapiens
agttggactgggttgcg

SEQ ID NO: 4030562 - DNA, 18 bp, Homo sapiens
agttggagtactatattt

SEQ ID NO: 4030563 - DNA, 14 bp, Homo sapiens
agttggcagacagc

SEQ ID NO: 4030564 - DNA, 16 bp, Homo sapiens
agttggccagagagcc

SEQ ID NO: 4030565 - DNA, 13 bp, Homo sapiens
agttgggagcact

SEQ ID NO: 4030566 - DNA, 16 bp, Homo sapiens
agttggttgtgtcttt

SEQ ID NO: 4030567 - DNA, 22 bp, Homo sapiens
agttgtaaaaatgaaagtgact

SEQ ID NO: 4030568 - DNA, 18 bp, Homo sapiens
agttgtaacttatattga

SEQ ID NO: 4030569 - DNA, 19 bp, Homo sapiens
agttgtaacttatattgaa

SEQ ID NO: 4030570 - DNA, 14 bp, Homo sapiens
agttgtacaaatgt

SEQ ID NO: 4030571 - DNA, 20 bp, Homo sapiens
agttgtgaaagaaagctgag

SEQ ID NO: 4030572 - DNA, 17 bp, Homo sapiens
agttgtttgtttttgct

SEQ ID NO: 4030573 - DNA, 15 bp, Homo sapiens
agtttaaaaaaattg

SEQ ID NO: 4030574 - DNA, 15 bp, Homo sapiens
agtttaaaacacatt

SEQ ID NO: 4030575 - DNA, 13 bp, Homo sapiens
agtttaaaacagt

SEQ ID NO: 4030576 - DNA, 15 bp, Homo sapiens
agtttaaagttgcac

SEQ ID NO: 4030577 - DNA, 13 bp, Homo sapiens
agtttaattgtct

SEQ ID NO: 4030578 - DNA, 14 bp, Homo sapiens
agtttacaacttga

SEQ ID NO: 4030579 - DNA, 10 bp, Homo sapiens
agtttacaat

SEQ ID NO: 4030580 - DNA, 19 bp, Homo sapiens
agtttacaatattatgaaa

SEQ ID NO: 4030581 - DNA, 13 bp, Homo sapiens
agtttacattgta

SEQ ID NO: 4030582 - DNA, 21 bp, Homo sapiens
agtttacatttttatttatga

SEQ ID NO: 4030583 - DNA, 18 bp, Homo sapiens
agtttaccatttgtaata

SEQ ID NO: 4030584 - DNA, 19 bp, Homo sapiens
agtttagaggaaaaaaatg

SEQ ID NO: 4030585 - DNA, 21 bp, Homo sapiens
agtttagaggaaaaaaatgac

SEQ ID NO: 4030586 - DNA, 16 bp, Homo sapiens
agtttaggataaaata

SEQ ID NO: 4030587 - DNA, 20 bp, Homo sapiens
agtttagtgtgtgtgcagag

SEQ ID NO: 4030588 - DNA, 14 bp, Homo sapiens
agtttattcagtaa

SEQ ID NO: 4030589 - DNA, 14 bp, Homo sapiens
agtttcagacaggg

SEQ ID NO: 4030590 - DNA, 22 bp, Homo sapiens
agtttcagcttaaaataaacag

SEQ ID NO: 4030591 - DNA, 11 bp, Homo sapiens
agtttcaggtg

SEQ ID NO: 4030592 - DNA, 15 bp, Homo sapiens
agtttcaggtgacat

SEQ ID NO: 4030593 - DNA, 21 bp, Homo sapiens
agtttcatgaaatgattggaa

SEQ ID NO: 4030594 - DNA, 15 bp, Homo sapiens
agtttcatgtacaag

SEQ ID NO: 4030595 - DNA, 21 bp, Homo sapiens
agtttcatgtacaagatgaag

SEQ ID NO: 4030596 - DNA, 17 bp, Homo sapiens
agtttccagtctcaaaa

SEQ ID NO: 4030597 - DNA, 17 bp, Homo sapiens
agtttccatagcaacag

SEQ ID NO: 4030598 - DNA, 20 bp, Homo sapiens
agtttccatagcaacaggaa

SEQ ID NO: 4030599 - DNA, 20 bp, Homo sapiens
agtttcccctctggcttgac

SEQ ID NO: 4030600 - DNA, 11 bp, Homo sapiens
agtttcctgga

SEQ ID NO: 4030601 - DNA, 16 bp, Homo sapiens
agtttctagctagaaa

SEQ ID NO: 4030602 - DNA, 17 bp, Homo sapiens
agtttctgggacctcag

SEQ ID NO: 4030603 - DNA, 14 bp, Homo sapiens
agtttctgtttgat

SEQ ID NO: 4030604 - DNA, 17 bp, Homo sapiens
agtttctgtttgattct

SEQ ID NO: 4030605 - DNA, 18 bp, Homo sapiens
agtttctgtttgattctt

SEQ ID NO: 4030606 - DNA, 13 bp, Homo sapiens
agtttctttggga

SEQ ID NO: 4030607 - DNA, 15 bp, Homo sapiens
agtttgaagaccgcc

SEQ ID NO: 4030608 - DNA, 18 bp, Homo sapiens
agtttgaagcctgtgcct

SEQ ID NO: 4030609 - DNA, 15 bp, Homo sapiens
agtttgagctgcctt

SEQ ID NO: 4030610 - DNA, 11 bp, Homo sapiens
agtttgcagtt

SEQ ID NO: 4030611 - DNA, 23 bp, Homo sapiens
agtttgctagcagaaatctagaa

SEQ ID NO: 4030612 - DNA, 11 bp, Homo sapiens
agtttgcttag

SEQ ID NO: 4030613 - DNA, 14 bp, Homo sapiens
agtttgcttagaaa

SEQ ID NO: 4030614 - DNA, 17 bp, Homo sapiens
agtgtgttctgattaga

SEQ ID NO: 4030615 - DNA, 21 bp, Homo sapiens
agtgtgttctgattagaaatg

SEQ ID NO: 4030616 - DNA, 15 bp, Homo sapiens
agtgttacctgtgtg

SEQ ID NO: 4030617 - DNA, 13 bp, Homo sapiens
agtgttagagaaa

SEQ ID NO: 4030618 - DNA, 18 bp, Homo sapiens
agtgttagttataaatag

SEQ ID NO: 4030619 - DNA, 22 bp, Homo sapiens
agtgttattttctttgaaattg

SEQ ID NO: 4030620 - DNA, 20 bp, Homo sapiens
agtgttatttttcaaggaag

SEQ ID NO: 4030621 - DNA, 21 bp, Homo sapiens
agtgttatttttcaaggaagg

SEQ ID NO: 4030622 - DNA, 19 bp, Homo sapiens
agtgttcctttttaaatgt

SEQ ID NO: 4030623 - DNA, 22 bp, Homo sapiens
agtgttcctttttaaatgtgaa

SEQ ID NO: 4030624 - DNA, 23 bp, Homo sapiens
agtgttctgctcctgcttttctg

SEQ ID NO: 4030625 - DNA, 22 bp, Homo sapiens
agtgttctgtttgttattgttt

SEQ ID NO: 4030626 - DNA, 19 bp, Homo sapiens
agtgttgaagggaggtggc

SEQ ID NO: 4030627 - DNA, 17 bp, Homo sapiens
agtgttgagccttttcc

SEQ ID NO: 4030628 - DNA, 16 bp, Homo sapiens
agtgttgctcagctcc

SEQ ID NO: 4030629 - DNA, 15 bp, Homo sapiens
agtgttgtgttcctg

SEQ ID NO: 4030630 - DNA, 20 bp, Homo sapiens
agtgttgtgttcctggctga

SEQ ID NO: 4030631 - DNA, 15 bp, Homo sapiens
agtgttgtttgtaaa

SEQ ID NO: 4030632 - DNA, 19 bp, Homo sapiens
agtgttgtttgtaaataag

SEQ ID NO: 4030633 - DNA, 21 bp, Homo sapiens
agtgttgtttgtaaataagag

SEQ ID NO: 4030634 - DNA, 22 bp, Homo sapiens
agtgttgtttgtaaataagaga

SEQ ID NO: 4030635 - DNA, 15 bp, Homo sapiens
agtgtttcccataat

SEQ ID NO: 4030636 - DNA, 17 bp, Homo sapiens
agtgtttctaataaact

SEQ ID NO: 4030637 - DNA, 12 bp, Homo sapiens
agtgtttgctgc

SEQ ID NO: 4030638 - DNA, 19 bp, Homo sapiens
agtgttttaaattctgaga

SEQ ID NO: 4030639 - DNA, 20 bp, Homo sapiens
agtgttttaagataaattat

SEQ ID NO: 4030640 - DNA, 22 bp, Homo sapiens
agtgttttattattatcgcttt

SEQ ID NO: 4030641 - DNA, 22 bp, Homo sapiens
agtgttttattttcaaatctgg

SEQ ID NO: 4030642 - DNA, 15 bp, Homo sapiens
agtgttttctgggat

SEQ ID NO: 4030643 - DNA, 15 bp, Homo sapiens
agtgttttggactcc

SEQ ID NO: 4030644 - DNA, 18 bp, Homo sapiens
agtgttttggactccatc

SEQ ID NO: 4030645 - DNA, 19 bp, Homo sapiens
agtgttttggactccatct

SEQ ID NO: 4030646 - DNA, 21 bp, Homo sapiens
agtgttttggactccatctct

SEQ ID NO: 4030647 - DNA, 13 bp, Homo sapiens
agttaacaaggaa

SEQ ID NO: 4030648 - DNA, 20 bp, Homo sapiens
agttaacaaggaatgcctgt

SEQ ID NO: 4030649 - DNA, 12 bp, Homo sapiens
agttaacagaga

SEQ ID NO: 4030650 - DNA, 15 bp, Homo sapiens
agttaagaagctgtt

SEQ ID NO: 4030651 - DNA, 17 bp, Homo sapiens
agttaagaagctgttgt

SEQ ID NO: 4030652 - DNA, 21 bp, Homo sapiens
agttaagaagctgttgtacat

SEQ ID NO: 4030653 - DNA, 22 bp, Homo sapiens
agttaagaagctgttgtacatt

SEQ ID NO: 4030654 - DNA, 20 bp, Homo sapiens
agttaagacatgatttcctt

SEQ ID NO: 4030655 - DNA, 17 bp, Homo sapiens
agttaagacctggcagc

SEQ ID NO: 4030656 - DNA, 13 bp, Homo sapiens
agttaagagaaac

SEQ ID NO: 4030657 - DNA, 14 bp, Homo sapiens
agttaagagaaact

SEQ ID NO: 4030658 - DNA, 15 bp, Homo sapiens
agttaagagaaactt

SEQ ID NO: 4030659 - DNA, 16 bp, Homo sapiens
agttaagagaaacttt

SEQ ID NO: 4030660 - DNA, 17 bp, Homo sapiens
agttaagagaaacttta

SEQ ID NO: 4030661 - DNA, 23 bp, Homo sapiens
agttaagagaaactttatacatt

SEQ ID NO: 4030662 - DNA, 14 bp, Homo sapiens
agttaagagtagca

SEQ ID NO: 4030663 - DNA, 16 bp, Homo sapiens
agttaatgagccatca

SEQ ID NO: 4030664 - DNA, 21 bp, Homo sapiens
agttacacagaaatgctgctg

SEQ ID NO: 4030665 - DNA, 18 bp, Homo sapiens
agttacactaaaaggtga

SEQ ID NO: 4030666 - DNA, 23 bp, Homo sapiens
agttacagcgagaggcagagaaa

SEQ ID NO: 4030667 - DNA, 15 bp, Homo sapiens
agttacatgcataaa

SEQ ID NO: 4030668 - DNA, 16 bp, Homo sapiens
agttacatgcataaaa

SEQ ID NO: 4030669 - DNA, 21 bp, Homo sapiens
agttactacctcctctcctga

SEQ ID NO: 4030670 - DNA, 22 bp, Homo sapiens
agttactaggtaacttcatatt

SEQ ID NO: 4030671 - DNA, 15 bp, Homo sapiens
agttacttgaatttc

SEQ ID NO: 4030672 - DNA, 22 bp, Homo sapiens
agttactttccaattctccttt

SEQ ID NO: 4030673 - DNA, 23 bp, Homo sapiens
agttactttccaattctccttta

SEQ ID NO: 4030674 - DNA, 12 bp, Homo sapiens
agttactttgta

SEQ ID NO: 4030675 - DNA, 13 bp, Homo sapiens
agttactttgtaa

SEQ ID NO: 4030676 - DNA, 18 bp, Homo sapiens
agttactttgtaattttt

SEQ ID NO: 4030677 - DNA, 14 bp, Homo sapiens
agttaggggcctta

SEQ ID NO: 4030678 - DNA, 18 bp, Homo sapiens
agttagggggttcttatt

SEQ ID NO: 4030679 - DNA, 22 bp, Homo sapiens
agttaggttgtctccaggccat

SEQ ID NO: 4030680 - DNA, 23 bp, Homo sapiens
agttagttctctcgtaactggtt

SEQ ID NO: 4030681 - DNA, 16 bp, Homo sapiens
agttagtttctttggg

SEQ ID NO: 4030682 - DNA, 17 bp, Homo sapiens
agttagtttctttggga

SEQ ID NO: 4030683 - DNA, 14 bp, Homo sapiens
agttataaatagcc

SEQ ID NO: 4030684 - DNA, 15 bp, Homo sapiens
agttataaatagcct

SEQ ID NO: 4030685 - DNA, 16 bp, Homo sapiens
agttataaatagcctt

SEQ ID NO: 4030686 - DNA, 20 bp, Homo sapiens
agttatataattcactcaag

SEQ ID NO: 4030687 - DNA, 18 bp, Homo sapiens
agttatcaactttagcta

SEQ ID NO: 4030688 - DNA, 18 bp, Homo sapiens
agttatggcctatacact

SEQ ID NO: 4030689 - DNA, 14 bp, Homo sapiens
agttatgtgatttt

SEQ ID NO: 4030690 - DNA, 12 bp, Homo sapiens
agttattaaata

SEQ ID NO: 4030691 - DNA, 18 bp, Homo sapiens
agttattccttgatcatt

SEQ ID NO: 4030692 - DNA, 22 bp, Homo sapiens
agttattgtccctggcttcctt

SEQ ID NO: 4030693 - DNA, 18 bp, Homo sapiens
agttatttacttttacca

SEQ ID NO: 4030694 - DNA, 21 bp, Homo sapiens
agttattttataatcaatgaa

SEQ ID NO: 4030695 - DNA, 23 bp, Homo sapiens
agttattttctacagtggtttta

SEQ ID NO: 4030696 - DNA, 15 bp, Homo sapiens
agttattttggatat

SEQ ID NO: 4030697 - DNA, 18 bp, Homo sapiens
agttattttggatatatt

SEQ ID NO: 4030698 - DNA, 21 bp, Homo sapiens
agttattttggatatattatt

SEQ ID NO: 4030699 - DNA, 17 bp, Homo sapiens
agttatttttctctttg

SEQ ID NO: 4030700 - DNA, 15 bp, Homo sapiens
agttatttttgtaca

SEQ ID NO: 4030701 - DNA, 17 bp, Homo sapiens
agttatttttgtacatg

SEQ ID NO: 4030702 - DNA, 18 bp, Homo sapiens
agttatttttgtacatgt

SEQ ID NO: 4030703 - DNA, 23 bp, Homo sapiens
agttcaataaacttaactttaac

SEQ ID NO: 4030704 - DNA, 14 bp, Homo sapiens
agttcacaggaggc

SEQ ID NO: 4030705 - DNA, 18 bp, Homo sapiens
agttcacaggaggccagt

SEQ ID NO: 4030706 - DNA, 22 bp, Homo sapiens
agttcacgtaagatacaagttt

SEQ ID NO: 4030707 - DNA, 18 bp, Homo sapiens
agttcagcaccaccctag

SEQ ID NO: 4030708 - DNA, 16 bp, Homo sapiens
agttcaggagtcccaa

SEQ ID NO: 4030709 - DNA, 19 bp, Homo sapiens
agttcaggagtcccaagga

SEQ ID NO: 4030710 - DNA, 21 bp, Homo sapiens
agttcaggagtcccaaggaaa

SEQ ID NO: 4030711 - DNA, 20 bp, Homo sapiens
agttcatattccatatttat

SEQ ID NO: 4030712 - DNA, 19 bp, Homo sapiens
agttcatcccttctcttcc

SEQ ID NO: 4030713 - DNA, 20 bp, Homo sapiens
agttcatcccttctcttcca

SEQ ID NO: 4030714 - DNA, 22 bp, Homo sapiens
agttcatcccttctcttccagg

SEQ ID NO: 4030715 - DNA, 20 bp, Homo sapiens
agttcattattttgtggttc

SEQ ID NO: 4030716 - DNA, 21 bp, Homo sapiens
agtgctgggatggaggggagt

SEQ ID NO: 4030717 - DNA, 22 bp, Homo sapiens
agtgctgggatggaggggagtg

SEQ ID NO: 4030718 - DNA, 16 bp, Homo sapiens
agtgcttaaaaatcat

SEQ ID NO: 4030719 - DNA, 17 bp, Homo sapiens
agtgcttaaaaatcatt

SEQ ID NO: 4030720 - DNA, 19 bp, Homo sapiens
agtgcttaaaaatcattga

SEQ ID NO: 4030721 - DNA, 14 bp, Homo sapiens
agtggaagcttcta

SEQ ID NO: 4030722 - DNA, 17 bp, Homo sapiens
agtggaaggtctattgg

SEQ ID NO: 4030723 - DNA, 19 bp, Homo sapiens
agtggaatagtgaatactt

SEQ ID NO: 4030724 - DNA, 22 bp, Homo sapiens
agtggaatcctatatagaatgc

SEQ ID NO: 4030725 - DNA, 16 bp, Homo sapiens
agtggactggcccctg

SEQ ID NO: 4030726 - DNA, 18 bp, Homo sapiens
agtggactggcccctggg

SEQ ID NO: 4030727 - DNA, 17 bp, Homo sapiens
agtggagagaagctctt

SEQ ID NO: 4030728 - DNA, 19 bp, Homo sapiens
agtggagcctgacagccag

SEQ ID NO: 4030729 - DNA, 14 bp, Homo sapiens
agtggaggcacttt

SEQ ID NO: 4030730 - DNA, 19 bp, Homo sapiens
agtggaggtgggctgggcc

SEQ ID NO: 4030731 - DNA, 14 bp, Homo sapiens
agtggaggtttgtc

SEQ ID NO: 4030732 - DNA, 23 bp, Homo sapiens
agtggatcccctgcggtcaggct

SEQ ID NO: 4030733 - DNA, 18 bp, Homo sapiens
agtggatctccaaggacc

SEQ ID NO: 4030734 - DNA, 21 bp, Homo sapiens
agtggattgtaggtgcaagat

SEQ ID NO: 4030735 - DNA, 13 bp, Homo sapiens
agtggcacctgtc

SEQ ID NO: 4030736 - DNA, 22 bp, Homo sapiens
agtggcatgttttgtgcatttg

SEQ ID NO: 4030737 - DNA, 14 bp, Homo sapiens
agtggccactcagc

SEQ ID NO: 4030738 - DNA, 18 bp, Homo sapiens
agtggcctccctgctgtg

SEQ ID NO: 4030739 - DNA, 19 bp, Homo sapiens
agtggcgtgggagccagcc

SEQ ID NO: 4030740 - DNA, 17 bp, Homo sapiens
agtggctcctcccggtg

SEQ ID NO: 4030741 - DNA, 14 bp, Homo sapiens
agtggctgggtggg

SEQ ID NO: 4030742 - DNA, 15 bp, Homo sapiens
agtggctggtccagg

SEQ ID NO: 4030743 - DNA, 19 bp, Homo sapiens
agtggctggtccagggcta

SEQ ID NO: 4030744 - DNA, 21 bp, Homo sapiens
agtgggaagagggggctggcc

SEQ ID NO: 4030745 - DNA, 22 bp, Homo sapiens
agtgggacagcccagagcctgg

SEQ ID NO: 4030746 - DNA, 15 bp, Homo sapiens
agtgggagaaggcag

SEQ ID NO: 4030747 - DNA, 20 bp, Homo sapiens
agtgggatctgtcacaccag

SEQ ID NO: 4030748 - DNA, 20 bp, Homo sapiens
agtgggcatcagcagcaggg

SEQ ID NO: 4030749 - DNA, 12 bp, Homo sapiens
agtgggccaggg

SEQ ID NO: 4030750 - DNA, 14 bp, Homo sapiens
agtgggccagggct

SEQ ID NO: 4030751 - DNA, 15 bp, Homo sapiens
agtgggccagggctg

SEQ ID NO: 4030752 - DNA, 17 bp, Homo sapiens
agtgggctgcatctggg

SEQ ID NO: 4030753 - DNA, 19 bp, Homo sapiens
agtggggaactgagggcaa

SEQ ID NO: 4030754 - DNA, 16 bp, Homo sapiens
agtggggatggggcct

SEQ ID NO: 4030755 - DNA, 16 bp, Homo sapiens
agtggggtgctgggag

SEQ ID NO: 4030756 - DNA, 18 bp, Homo sapiens
agtggggtgctgggagga

SEQ ID NO: 4030757 - DNA, 21 bp, Homo sapiens
agtggggttatctctgtgtta

SEQ ID NO: 4030758 - DNA, 23 bp, Homo sapiens
agtgggtctgggatatggctgcc

SEQ ID NO: 4030759 - DNA, 15 bp, Homo sapiens
agtgggttattctgg

SEQ ID NO: 4030760 - DNA, 18 bp, Homo sapiens
agtgggttattctggagt

SEQ ID NO: 4030761 - DNA, 19 bp, Homo sapiens
agtgggttattctggagtt

SEQ ID NO: 4030762 - DNA, 18 bp, Homo sapiens
agtggtaatcatatgtgt

SEQ ID NO: 4030763 - DNA, 23 bp, Homo sapiens
agtggtcaggagttgtttctgac

SEQ ID NO: 4030764 - DNA, 13 bp, Homo sapiens
agtggtctcccca

SEQ ID NO: 4030765 - DNA, 15 bp, Homo sapiens
agtggtctttctgga

SEQ ID NO: 4030766 - DNA, 18 bp, Homo sapiens
agtggtctttctggagag

SEQ ID NO: 4030767 - DNA, 20 bp, Homo sapiens
agtggtctttctggagaggt

SEQ ID NO: 4030768 - DNA, 14 bp, Homo sapiens
agtggtctttgtaa

SEQ ID NO: 4030769 - DNA, 15 bp, Homo sapiens
agtggtctttgtaag

SEQ ID NO: 4030770 - DNA, 21 bp, Homo sapiens
agtggtctttgtaagagtgta

SEQ ID NO: 4030771 - DNA, 22 bp, Homo sapiens
agtggtctttgtaagagtgtag

SEQ ID NO: 4030772 - DNA, 14 bp, Homo sapiens
agtggtgtgactct

SEQ ID NO: 4030773 - DNA, 18 bp, Homo sapiens
agtggttttatactgaag

SEQ ID NO: 4030774 - DNA, 21 bp, Homo sapiens
agtggttttatactgaaggaa

SEQ ID NO: 4030775 - DNA, 15 bp, Homo sapiens
agtgtaacaattgtg

SEQ ID NO: 4030776 - DNA, 14 bp, Homo sapiens
agtgtaacagctga

SEQ ID NO: 4030777 - DNA, 16 bp, Homo sapiens
agtgtaacttgcttaa

SEQ ID NO: 4030778 - DNA, 15 bp, Homo sapiens
agtgtaagtgaatta

SEQ ID NO: 4030779 - DNA, 22 bp, Homo sapiens
agtgtacatggaataacatgta

SEQ ID NO: 4030780 - DNA, 23 bp, Homo sapiens
agtgtacatggaataacatgtaa

SEQ ID NO: 4030781 - DNA, 17 bp, Homo sapiens
agtgtacctcctctcag

SEQ ID NO: 4030782 - DNA, 20 bp, Homo sapiens
agtgtacctgtgtacataac

SEQ ID NO: 4030783 - DNA, 14 bp, Homo sapiens
agtgtagaagcatt

SEQ ID NO: 4030784 - DNA, 15 bp, Homo sapiens
agtgtagaagcattc

SEQ ID NO: 4030785 - DNA, 14 bp, Homo sapiens
agtgtagtcaggtg

SEQ ID NO: 4030786 - DNA, 16 bp, Homo sapiens
agtgtagttaatttat

SEQ ID NO: 4030787 - DNA, 21 bp, Homo sapiens
agtgtatcaggtcagggactt

SEQ ID NO: 4030788 - DNA, 13 bp, Homo sapiens
agtgtatgtcttg

SEQ ID NO: 4030789 - DNA, 16 bp, Homo sapiens
agtgtatttttcaata

SEQ ID NO: 4030790 - DNA, 23 bp, Homo sapiens
agtgtcaagtcctgactgggctg

SEQ ID NO: 4030791 - DNA, 15 bp, Homo sapiens
agtgtcacctctctc

SEQ ID NO: 4030792 - DNA, 16 bp, Homo sapiens
agtgtcacctctctca

SEQ ID NO: 4030793 - DNA, 22 bp, Homo sapiens
agtgtcaggcccccagtgggac

SEQ ID NO: 4030794 - DNA, 20 bp, Homo sapiens
agtgtcatatgtaggtgtct

SEQ ID NO: 4030795 - DNA, 15 bp, Homo sapiens
agtgtcccctccact

SEQ ID NO: 4030796 - DNA, 21 bp, Homo sapiens
agtgtcccctccactgtcaca

SEQ ID NO: 4030797 - DNA, 17 bp, Homo sapiens
agtgtcctccaagtgcc

SEQ ID NO: 4030798 - DNA, 20 bp, Homo sapiens
agtgtcctccaagtgccccc

SEQ ID NO: 4030799 - DNA, 16 bp, Homo sapiens
agtgtcctgcccatgc

SEQ ID NO: 4030800 - DNA, 18 bp, Homo sapiens
agtgtcctgcccatgccc

SEQ ID NO: 4030801 - DNA, 14 bp, Homo sapiens
agtgtctaaaaaca

SEQ ID NO: 4030802 - DNA, 15 bp, Homo sapiens
agtgtctggcttttt

SEQ ID NO: 4030803 - DNA, 22 bp, Homo sapiens
agtgtctgtatcggagacagtg

SEQ ID NO: 4030804 - DNA, 15 bp, Homo sapiens
agtgtgacagggcca

SEQ ID NO: 4030805 - DNA, 17 bp, Homo sapiens
agtgtgacagggccagt

SEQ ID NO: 4030806 - DNA, 17 bp, Homo sapiens
agtgtgagctcttccct

SEQ ID NO: 4030807 - DNA, 12 bp, Homo sapiens
agtgtgagtaag

SEQ ID NO: 4030808 - DNA, 18 bp, Homo sapiens
agtgtgagtaagagctgg

SEQ ID NO: 4030809 - DNA, 18 bp, Homo sapiens
agtgtgcatggaggccct

SEQ ID NO: 4030810 - DNA, 12 bp, Homo sapiens
agtgtggagacc

SEQ ID NO: 4030811 - DNA, 17 bp, Homo sapiens
agtgtggagtgggtaat

SEQ ID NO: 4030812 - DNA, 20 bp, Homo sapiens
agtgtggctgaggaggcctc

SEQ ID NO: 4030813 - DNA, 18 bp, Homo sapiens
agtgtgggcttgaccagg

SEQ ID NO: 4030814 - DNA, 15 bp, Homo sapiens
agtgtggggggtcct

SEQ ID NO: 4030815 - DNA, 15 bp, Homo sapiens
agtgtgtattgttcc

SEQ ID NO: 4030816 - DNA, 20 bp, Homo sapiens
agtgtgtgtgcagagtccat

SEQ ID NO: 4030817 - DNA, 20 bp, Homo sapiens
agtgtgtgtgtgcatgtgtg

SEQ ID NO: 4030818 - DNA, 13 bp, Homo sapiens
agtgtgttctgat

SEQ ID NO: 4030819 - DNA, 19 bp, Homo sapiens
agtcatgctcccctgtgcc

SEQ ID NO: 4030820 - DNA, 21 bp, Homo sapiens
agtcatgctcccctgtgccag

SEQ ID NO: 4030821 - DNA, 20 bp, Homo sapiens
agtcattagactcctcctcc

SEQ ID NO: 4030822 - DNA, 22 bp, Homo sapiens
agtcattatgagaggcaatgat

SEQ ID NO: 4030823 - DNA, 13 bp, Homo sapiens
agtcattctttaa

SEQ ID NO: 4030824 - DNA, 13 bp, Homo sapiens
agtcattgtatgt

SEQ ID NO: 4030825 - DNA, 13 bp, Homo sapiens
agtcatttactaa

SEQ ID NO: 4030826 - DNA, 14 bp, Homo sapiens
agtcatttactaaa

SEQ ID NO: 4030827 - DNA, 23 bp, Homo sapiens
agtcatttactaaacatatgatt

SEQ ID NO: 4030828 - DNA, 15 bp, Homo sapiens
agtcatttatgagca

SEQ ID NO: 4030829 - DNA, 19 bp, Homo sapiens
agtcattttaactttatca

SEQ ID NO: 4030830 - DNA, 21 bp, Homo sapiens
agtcattttaactttatcaca

SEQ ID NO: 4030831 - DNA, 16 bp, Homo sapiens
agtccaaatgtcctcc

SEQ ID NO: 4030832 - DNA, 14 bp, Homo sapiens
agtccaagctggga

SEQ ID NO: 4030833 - DNA, 22 bp, Homo sapiens
agtccaaggggtcccctccagg

SEQ ID NO: 4030834 - DNA, 23 bp, Homo sapiens
agtccaaggggtcccctccagga

SEQ ID NO: 4030835 - DNA, 22 bp, Homo sapiens
agtccaggatgctaacatctaa

SEQ ID NO: 4030836 - DNA, 23 bp, Homo sapiens
agtccagggctcccggagaggga

SEQ ID NO: 4030837 - DNA, 17 bp, Homo sapiens
agtccagggtttctctg

SEQ ID NO: 4030838 - DNA, 17 bp, Homo sapiens
agtccagtgctctgcct

SEQ ID NO: 4030839 - DNA, 17 bp, Homo sapiens
agtccagtgtcacctct

SEQ ID NO: 4030840 - DNA, 22 bp, Homo sapiens
agtccagtgtcacctctctcag

SEQ ID NO: 4030841 - DNA, 17 bp, Homo sapiens
agtccattctcccaggt

SEQ ID NO: 4030842 - DNA, 17 bp, Homo sapiens
agtccatttatatatga

SEQ ID NO: 4030843 - DNA, 18 bp, Homo sapiens
agtccatttatatatgaa

SEQ ID NO: 4030844 - DNA, 22 bp, Homo sapiens
agtccatttatatatgaaaact

SEQ ID NO: 4030845 - DNA, 19 bp, Homo sapiens
agtccatttcccacatctt

SEQ ID NO: 4030846 - DNA, 11 bp, Homo sapiens
agtcccaaagc

SEQ ID NO: 4030847 - DNA, 14 bp, Homo sapiens
agtcccactccaag

SEQ ID NO: 4030848 - DNA, 18 bp, Homo sapiens
agtcccactccaagccag

SEQ ID NO: 4030849 - DNA, 11 bp, Homo sapiens
agtccccaccc

SEQ ID NO: 4030850 - DNA, 13 bp, Homo sapiens
agtccccacccct

SEQ ID NO: 4030851 - DNA, 15 bp, Homo sapiens
agtccccacccctgc

SEQ ID NO: 4030852 - DNA, 14 bp, Homo sapiens
agtccccagaactc

SEQ ID NO: 4030853 - DNA, 15 bp, Homo sapiens
agtccccctgtgcat

SEQ ID NO: 4030854 - DNA, 13 bp, Homo sapiens
agtcccttcccct

SEQ ID NO: 4030855 - DNA, 14 bp, Homo sapiens
agtcccttcccctc

SEQ ID NO: 4030856 - DNA, 19 bp, Homo sapiens
agtcccttcccctccctgg

SEQ ID NO: 4030857 - DNA, 17 bp, Homo sapiens
agtccgcagaagccctg

SEQ ID NO: 4030858 - DNA, 18 bp, Homo sapiens
agtcctcataaaaagcaa

SEQ ID NO: 4030859 - DNA, 12 bp, Homo sapiens
agtcctccagaa

SEQ ID NO: 4030860 - DNA, 21 bp, Homo sapiens
agtcctccagaactcttcctc

SEQ ID NO: 4030861 - DNA, 14 bp, Homo sapiens
agtcctgaaggaca

SEQ ID NO: 4030862 - DNA, 18 bp, Homo sapiens
agtcctgactgggctggg

SEQ ID NO: 4030863 - DNA, 17 bp, Homo sapiens
agtcctgcaaccaaact

SEQ ID NO: 4030864 - DNA, 16 bp, Homo sapiens
agtcctgcctcagcct

SEQ ID NO: 4030865 - DNA, 14 bp, Homo sapiens
agtcctgcctggcc

SEQ ID NO: 4030866 - DNA, 15 bp, Homo sapiens
agtcctgcctggcca

SEQ ID NO: 4030867 - DNA, 16 bp, Homo sapiens
agtcctgcctggccag

SEQ ID NO: 4030868 - DNA, 21 bp, Homo sapiens
agtcctgcctggccaggcaga

SEQ ID NO: 4030869 - DNA, 18 bp, Homo sapiens
agtcctggatgttgtgtg

SEQ ID NO: 4030870 - DNA, 14 bp, Homo sapiens
agtcctgtactgta

SEQ ID NO: 4030871 - DNA, 16 bp, Homo sapiens
agtgattgaaccagct

SEQ ID NO: 4030872 - DNA, 18 bp, Homo sapiens
agtgattgaaccagctca

SEQ ID NO: 4030873 - DNA, 15 bp, Homo sapiens
agtgattgacacaca

SEQ ID NO: 4030874 - DNA, 14 bp, Homo sapiens
agtgattgcagctt

SEQ ID NO: 4030875 - DNA, 13 bp, Homo sapiens
agtgcacagctgt

SEQ ID NO: 4030876 - DNA, 18 bp, Homo sapiens
agtgcacggggcacagcg

SEQ ID NO: 4030877 - DNA, 14 bp, Homo sapiens
agtgcactttctaa

SEQ ID NO: 4030878 - DNA, 18 bp, Homo sapiens
agtgcactttctaatgtt

SEQ ID NO: 4030879 - DNA, 21 bp, Homo sapiens
agtgcactttctaatgtttct

SEQ ID NO: 4030880 - DNA, 12 bp, Homo sapiens
agtgcagacagg

SEQ ID NO: 4030881 - DNA, 13 bp, Homo sapiens
agtgcagaggctc

SEQ ID NO: 4030882 - DNA, 14 bp, Homo sapiens
agtgcagccactgg

SEQ ID NO: 4030883 - DNA, 15 bp, Homo sapiens
agtgcagccactggc

SEQ ID NO: 4030884 - DNA, 15 bp, Homo sapiens
agtgcagctgatttt

SEQ ID NO: 4030885 - DNA, 16 bp, Homo sapiens
agtgcagctgatttta

SEQ ID NO: 4030886 - DNA, 15 bp, Homo sapiens
agtgcatttctgaat

SEQ ID NO: 4030887 - DNA, 16 bp, Homo sapiens
agtgcatttctgaata

SEQ ID NO: 4030888 - DNA, 22 bp, Homo sapiens
agtgcatttctgaatagaaatg

SEQ ID NO: 4030889 - DNA, 15 bp, Homo sapiens
agtgcattttcccag

SEQ ID NO: 4030890 - DNA, 16 bp, Homo sapiens
agtgccaaatgctggg

SEQ ID NO: 4030891 - DNA, 21 bp, Homo sapiens
agtgccactgcccgagctggt

SEQ ID NO: 4030892 - DNA, 22 bp, Homo sapiens
agtgccactgcccgagctggtg

SEQ ID NO: 4030893 - DNA, 13 bp, Homo sapiens
agtgccaggactc

SEQ ID NO: 4030894 - DNA, 16 bp, Homo sapiens
agtgccattccactcc

SEQ ID NO: 4030895 - DNA, 18 bp, Homo sapiens
agtgcccaccctgggaga

SEQ ID NO: 4030896 - DNA, 21 bp, Homo sapiens
agtgccccagggagtccaggg

SEQ ID NO: 4030897 - DNA, 18 bp, Homo sapiens
agtgcccccactgaccag

SEQ ID NO: 4030898 - DNA, 18 bp, Homo sapiens
agtgccccctcacctctc

SEQ ID NO: 4030899 - DNA, 20 bp, Homo sapiens
agtgccccctcacctctcca

SEQ ID NO: 4030900 - DNA, 21 bp, Homo sapiens
agtgccccgtctacagctccc

SEQ ID NO: 4030901 - DNA, 14 bp, Homo sapiens
agtgccctgctttg

SEQ ID NO: 4030902 - DNA, 18 bp, Homo sapiens
agtgccggctgtggagca

SEQ ID NO: 4030903 - DNA, 15 bp, Homo sapiens
agtgccgtagggagt

SEQ ID NO: 4030904 - DNA, 18 bp, Homo sapiens
agtgcctgacacactaac

SEQ ID NO: 4030905 - DNA, 23 bp, Homo sapiens
agtgcctggatcccctctgtcta

SEQ ID NO: 4030906 - DNA, 18 bp, Homo sapiens
agtgcctgggaatgtatt

SEQ ID NO: 4030907 - DNA, 22 bp, Homo sapiens
agtgcctgggaatgtattattc

SEQ ID NO: 4030908 - DNA, 20 bp, Homo sapiens
agtgccttctccttccccag

SEQ ID NO: 4030909 - DNA, 20 bp, Homo sapiens
agtgccttttgcagaagagg

SEQ ID NO: 4030910 - DNA, 15 bp, Homo sapiens
agtgccttttggaac

SEQ ID NO: 4030911 - DNA, 14 bp, Homo sapiens
agtgcggttcctca

SEQ ID NO: 4030912 - DNA, 18 bp, Homo sapiens
agtgcggttcctcatctg

SEQ ID NO: 4030913 - DNA, 16 bp, Homo sapiens
agtgcgtgccgtgtga

SEQ ID NO: 4030914 - DNA, 13 bp, Homo sapiens
agtgcgtggccca

SEQ ID NO: 4030915 - DNA, 13 bp, Homo sapiens
agtgctagaaaat

SEQ ID NO: 4030916 - DNA, 15 bp, Homo sapiens
agtgctcaccagccc

SEQ ID NO: 4030917 - DNA, 13 bp, Homo sapiens
agtgctctctcca

SEQ ID NO: 4030918 - DNA, 13 bp, Homo sapiens
agtgctctgcctc

SEQ ID NO: 4030919 - DNA, 16 bp, Homo sapiens
agtgctctgcctcaga

SEQ ID NO: 4030920 - DNA, 15 bp, Homo sapiens
agtgctgaacagtgg

SEQ ID NO: 4030921 - DNA, 14 bp, Homo sapiens
agtgctgaggccag

SEQ ID NO: 4030922 - DNA, 13 bp, Homo sapiens
agtgctggctcac

SEQ ID NO: 4030923 - DNA, 15 bp, Homo sapiens
agtgctggctcacag

SEQ ID NO: 4030924 - DNA, 17 bp, Homo sapiens
agtgctgggaccagagc

SEQ ID NO: 4030925 - DNA, 20 bp, Homo sapiens
ataataagagaatgttccta

SEQ ID NO: 4030926 - DNA, 23 bp, Homo sapiens
ataataagagaatgttcctactc

SEQ ID NO: 4030927 - DNA, 22 bp, Homo sapiens
ataataatttttatatttaatt

SEQ ID NO: 4030928 - DNA, 19 bp, Homo sapiens
ataataggtagtttggata

SEQ ID NO: 4030929 - DNA, 23 bp, Homo sapiens
ataatagtcaatttctacttctg

SEQ ID NO: 4030930 - DNA, 18 bp, Homo sapiens
ataatagttattatttaa

SEQ ID NO: 4030931 - DNA, 21 bp, Homo sapiens
ataatagttattatttaattg

SEQ ID NO: 4030932 - DNA, 14 bp, Homo sapiens
ataatagtttacat

SEQ ID NO: 4030933 - DNA, 14 bp, Homo sapiens
ataatatctgtgag

SEQ ID NO: 4030934 - DNA, 17 bp, Homo sapiens
ataatatggctatgctt

SEQ ID NO: 4030935 - DNA, 23 bp, Homo sapiens
ataatatggctatgcttaaaagg

SEQ ID NO: 4030936 - DNA, 17 bp, Homo sapiens
ataatattgttgtataa

SEQ ID NO: 4030937 - DNA, 19 bp, Homo sapiens
ataatattgttgtataatt

SEQ ID NO: 4030938 - DNA, 21 bp, Homo sapiens
ataatcaatgaatttgttctt

SEQ ID NO: 4030939 - DNA, 16 bp, Homo sapiens
ataatcagtgactgaa

SEQ ID NO: 4030940 - DNA, 14 bp, Homo sapiens
ataatctgaagata

SEQ ID NO: 4030941 - DNA, 15 bp, Homo sapiens
ataatcttattaggg

SEQ ID NO: 4030942 - DNA, 18 bp, Homo sapiens
ataatgaaataatcagtg

SEQ ID NO: 4030943 - DNA, 16 bp, Homo sapiens
ataatgaataaactga

SEQ ID NO: 4030944 - DNA, 18 bp, Homo sapiens
ataatgaataaactgaat

SEQ ID NO: 4030945 - DNA, 15 bp, Homo sapiens
ataatgcatgaagca

SEQ ID NO: 4030946 - DNA, 16 bp, Homo sapiens
ataatgcatgaagcaa

SEQ ID NO: 4030947 - DNA, 17 bp, Homo sapiens
ataatgctaatttaaag

SEQ ID NO: 4030948 - DNA, 17 bp, Homo sapiens
ataatgggtttctttca

SEQ ID NO: 4030949 - DNA, 14 bp, Homo sapiens
ataatgtaagctct

SEQ ID NO: 4030950 - DNA, 18 bp, Homo sapiens
ataatgtagttttgttta

SEQ ID NO: 4030951 - DNA, 16 bp, Homo sapiens
ataatgttaaatttgt

SEQ ID NO: 4030952 - DNA, 18 bp, Homo sapiens
ataatgttaaatttgtaa

SEQ ID NO: 4030953 - DNA, 14 bp, Homo sapiens
ataatgttgttatt

SEQ ID NO: 4030954 - DNA, 15 bp, Homo sapiens
ataatgtttaaatca

SEQ ID NO: 4030955 - DNA, 17 bp, Homo sapiens
ataattaaaatttatct

SEQ ID NO: 4030956 - DNA, 21 bp, Homo sapiens
ataattatcggaagcagtgcc

SEQ ID NO: 4030957 - DNA, 14 bp, Homo sapiens
ataattatgacagt

SEQ ID NO: 4030958 - DNA, 16 bp, Homo sapiens
ataattatgacagtta

SEQ ID NO: 4030959 - DNA, 19 bp, Homo sapiens
ataattatgacagttatac

SEQ ID NO: 4030960 - DNA, 20 bp, Homo sapiens
ataattatgacagttatact

SEQ ID NO: 4030961 - DNA, 17 bp, Homo sapiens
ataattccctatctttt

SEQ ID NO: 4030962 - DNA, 20 bp, Homo sapiens
ataattccctatcttttagt

SEQ ID NO: 4030963 - DNA, 21 bp, Homo sapiens
ataattctaagttatttactt

SEQ ID NO: 4030964 - DNA, 14 bp, Homo sapiens
ataattctgtaaat

SEQ ID NO: 4030965 - DNA, 21 bp, Homo sapiens
agtttggagagtcagatcttt

SEQ ID NO: 4030966 - DNA, 15 bp, Homo sapiens
agtttgtctatttta

SEQ ID NO: 4030967 - DNA, 16 bp, Homo sapiens
agtttgtctattttaa

SEQ ID NO: 4030968 - DNA, 21 bp, Homo sapiens
agtttgtctattttaaaataa

SEQ ID NO: 4030969 - DNA, 14 bp, Homo sapiens
agtttgtgtgtctt

SEQ ID NO: 4030970 - DNA, 22 bp, Homo sapiens
agttttaaaaagccagtttggg

SEQ ID NO: 4030971 - DNA, 15 bp, Homo sapiens
agttttagttgcaga

SEQ ID NO: 4030972 - DNA, 12 bp, Homo sapiens
agttttatcatt

SEQ ID NO: 4030973 - DNA, 14 bp, Homo sapiens
agttttattttaat

SEQ ID NO: 4030974 - DNA, 13 bp, Homo sapiens
agttttatttttg

SEQ ID NO: 4030975 - DNA, 15 bp, Homo sapiens
agttttatttttgcc

SEQ ID NO: 4030976 - DNA, 21 bp, Homo sapiens
agttttcaagtcaaattaata

SEQ ID NO: 4030977 - DNA, 18 bp, Homo sapiens
agttttcagaaaaagaaa

SEQ ID NO: 4030978 - DNA, 18 bp, Homo sapiens
agttttcagaacctcttc

SEQ ID NO: 4030979 - DNA, 21 bp, Homo sapiens
agttttcagaacctcttcccc

SEQ ID NO: 4030980 - DNA, 16 bp, Homo sapiens
agttttccatgaaaac

SEQ ID NO: 4030981 - DNA, 21 bp, Homo sapiens
agttttccatgaaaacgtttt

SEQ ID NO: 4030982 - DNA, 10 bp, Homo sapiens
agttttccta

SEQ ID NO: 4030983 - DNA, 13 bp, Homo sapiens
agttttctccttt

SEQ ID NO: 4030984 - DNA, 18 bp, Homo sapiens
agttttgaatgttaagaa

SEQ ID NO: 4030985 - DNA, 16 bp, Homo sapiens
agttttgtaaaagaaa

SEQ ID NO: 4030986 - DNA, 22 bp, Homo sapiens
agttttgtaaaagaaatcatgt

SEQ ID NO: 4030987 - DNA, 14 bp, Homo sapiens
agttttgttgcccc

SEQ ID NO: 4030988 - DNA, 18 bp, Homo sapiens
agtttttacagctgtgtt

SEQ ID NO: 4030989 - DNA, 23 bp, Homo sapiens
agtttttacctaccacagtgtct

SEQ ID NO: 4030990 - DNA, 16 bp, Homo sapiens
agtttttactttctgt

SEQ ID NO: 4030991 - DNA, 12 bp, Homo sapiens
agtttttcctcc

SEQ ID NO: 4030992 - DNA, 14 bp, Homo sapiens
agtttttcctccca

SEQ ID NO: 4030993 - DNA, 16 bp, Homo sapiens
agtttttgatagcttt

SEQ ID NO: 4030994 - DNA, 15 bp, Homo sapiens
agtttttgtatcttg

SEQ ID NO: 4030995 - DNA, 23 bp, Homo sapiens
agtttttgtatcttggggcaaga

SEQ ID NO: 4030996 - DNA, 21 bp, Homo sapiens
agttttttgaaattatgtgac

SEQ ID NO: 4030997 - DNA, 12 bp, Homo sapiens
ataaaaaaagaa

SEQ ID NO: 4030998 - DNA, 16 bp, Homo sapiens
ataaaaaaagaaaaaa

SEQ ID NO: 4030999 - DNA, 16 bp, Homo sapiens
ataaaaaaagaaagca

SEQ ID NO: 4031000 - DNA, 19 bp, Homo sapiens
ataaaaaagaacttttgta

SEQ ID NO: 4031001 - DNA, 12 bp, Homo sapiens
ataaaaaatgga

SEQ ID NO: 4031002 - DNA, 13 bp, Homo sapiens
ataaaaagaatga

SEQ ID NO: 4031003 - DNA, 20 bp, Homo sapiens
ataaaaagacattcttccaa

SEQ ID NO: 4031004 - DNA, 16 bp, Homo sapiens
ataaaaagcaaaacaa

SEQ ID NO: 4031005 - DNA, 18 bp, Homo sapiens
ataaaaagcagaatttta

SEQ ID NO: 4031006 - DNA, 20 bp, Homo sapiens
ataaaaagcagaattttaat

SEQ ID NO: 4031007 - DNA, 17 bp, Homo sapiens
ataaaaagcttccatga

SEQ ID NO: 4031008 - DNA, 20 bp, Homo sapiens
ataaaaagtgacacagcagc

SEQ ID NO: 4031009 - DNA, 14 bp, Homo sapiens
ataaccacaaggtc

SEQ ID NO: 4031010 - DNA, 13 bp, Homo sapiens
ataaccacttaaa

SEQ ID NO: 4031011 - DNA, 12 bp, Homo sapiens
ataaccatgaga

SEQ ID NO: 4031012 - DNA, 12 bp, Homo sapiens
ataaccccacct

SEQ ID NO: 4031013 - DNA, 20 bp, Homo sapiens
ataaccccagctccctagga

SEQ ID NO: 4031014 - DNA, 15 bp, Homo sapiens
ataaccctaacacac

SEQ ID NO: 4031015 - DNA, 18 bp, Homo sapiens
ataacgtttttcctttaa

SEQ ID NO: 4031016 - DNA, 18 bp, Homo sapiens
ataactactgtgttcctg

SEQ ID NO: 4031017 - DNA, 16 bp, Homo sapiens
ataactcatcataaaa

SEQ ID NO: 4031018 - DNA, 18 bp, Homo sapiens
ataactcctgtccctttt

SEQ ID NO: 4031019 - DNA, 21 bp, Homo sapiens
ataactcctgtcccttttccc

SEQ ID NO: 4031020 - DNA, 12 bp, Homo sapiens
ataactctgtaa

SEQ ID NO: 4031021 - DNA, 22 bp, Homo sapiens
ataactctgtggcattattgca

SEQ ID NO: 4031022 - DNA, 12 bp, Homo sapiens
ataactgtgaag

SEQ ID NO: 4031023 - DNA, 20 bp, Homo sapiens
ataacttaaaaatgtaaata

SEQ ID NO: 4031024 - DNA, 22 bp, Homo sapiens
ataacttctatattttaataga

SEQ ID NO: 4031025 - DNA, 23 bp, Homo sapiens
ataacttctatattttaatagaa

SEQ ID NO: 4031026 - DNA, 18 bp, Homo sapiens
ataacttttacacgacca

SEQ ID NO: 4031027 - DNA, 17 bp, Homo sapiens
ataagaaatgaacaaaa

SEQ ID NO: 4031028 - DNA, 14 bp, Homo sapiens
ataagaagcaaata

SEQ ID NO: 4031029 - DNA, 21 bp, Homo sapiens
ataagaatgctggttttccta

SEQ ID NO: 4031030 - DNA, 17 bp, Homo sapiens
ataagacttagattgtg

SEQ ID NO: 4031031 - DNA, 18 bp, Homo sapiens
ataagagaaagaaaatga

SEQ ID NO: 4031032 - DNA, 14 bp, Homo sapiens
ataagagcatgaaa

SEQ ID NO: 4031033 - DNA, 16 bp, Homo sapiens
ataagaggaatttctt

SEQ ID NO: 4031034 - DNA, 19 bp, Homo sapiens
ataagatatatacaaggtg

SEQ ID NO: 4031035 - DNA, 23 bp, Homo sapiens
ataagattagttggacagtttaa

SEQ ID NO: 4031036 - DNA, 14 bp, Homo sapiens
ataagattcatatt

SEQ ID NO: 4031037 - DNA, 20 bp, Homo sapiens
ataagcaaaaacaaaaagaa

SEQ ID NO: 4031038 - DNA, 15 bp, Homo sapiens
ataagcaagagagat

SEQ ID NO: 4031039 - DNA, 17 bp, Homo sapiens
ataagcaagagagatgt

SEQ ID NO: 4031040 - DNA, 14 bp, Homo sapiens
ataagcacttgaat

SEQ ID NO: 4031041 - DNA, 15 bp, Homo sapiens
ataagcattgaaatt

SEQ ID NO: 4031042 - DNA, 16 bp, Homo sapiens
ataagcattgaaatta

SEQ ID NO: 4031043 - DNA, 16 bp, Homo sapiens
ataagctaaagaggct

SEQ ID NO: 4031044 - DNA, 18 bp, Homo sapiens
ataaggaaagcaataaat

SEQ ID NO: 4031045 - DNA, 17 bp, Homo sapiens
ataaggccttaatatgt

SEQ ID NO: 4031046 - DNA, 19 bp, Homo sapiens
ataaggctgagggctgcca

SEQ ID NO: 4031047 - DNA, 18 bp, Homo sapiens
ataagggagagctgagcc

SEQ ID NO: 4031048 - DNA, 20 bp, Homo sapiens
ataagggagagctgagccag

SEQ ID NO: 4031049 - DNA, 17 bp, Homo sapiens
ataaggtcaagggaaaa

SEQ ID NO: 4031050 - DNA, 17 bp, Homo sapiens
ataaggtttaaaaagat

SEQ ID NO: 4031051 - DNA, 15 bp, Homo sapiens
ataagtaaatgctag

SEQ ID NO: 4031052 - DNA, 15 bp, Homo sapiens
ataagtatttataat

SEQ ID NO: 4031053 - DNA, 19 bp, Homo sapiens
ataagtatttataatagca

SEQ ID NO: 4031054 - DNA, 14 bp, Homo sapiens
ataagtgaaaatct

SEQ ID NO: 4031055 - DNA, 15 bp, Homo sapiens
ataagtgaagtgata

SEQ ID NO: 4031056 - DNA, 15 bp, Homo sapiens
ataagtgaatttata

SEQ ID NO: 4031057 - DNA, 18 bp, Homo sapiens
ataagtggaggcacttta

SEQ ID NO: 4031058 - DNA, 13 bp, Homo sapiens
ataagtgtacata

SEQ ID NO: 4031059 - DNA, 14 bp, Homo sapiens
ataagtgtacatat

SEQ ID NO: 4031060 - DNA, 13 bp, Homo sapiens
ataagttcacaaa

SEQ ID NO: 4031061 - DNA, 22 bp, Homo sapiens
ataagttgcatttagaaatcaa

SEQ ID NO: 4031062 - DNA, 14 bp, Homo sapiens
ataataaaaggaaa

SEQ ID NO: 4031063 - DNA, 15 bp, Homo sapiens
ataataaaaggaaaa

SEQ ID NO: 4031064 - DNA, 13 bp, Homo sapiens
ataataaagcaat

SEQ ID NO: 4031065 - DNA, 11 bp, Homo sapiens
ataataaagga

SEQ ID NO: 4031066 - DNA, 13 bp, Homo sapiens
ataataaatcaca

SEQ ID NO: 4031067 - DNA, 18 bp, Homo sapiens
ataataaatcacacattc

SEQ ID NO: 4031068 - DNA, 19 bp, Homo sapiens
ataataaatcacacattca

SEQ ID NO: 4031069 - DNA, 12 bp, Homo sapiens
ataataaattga

SEQ ID NO: 4031070 - DNA, 15 bp, Homo sapiens
ataataaattgaaat

SEQ ID NO: 4031071 - DNA, 16 bp, Homo sapiens
atagctcactgcagcc

SEQ ID NO: 4031072 - DNA, 17 bp, Homo sapiens
atagctctattttaaag

SEQ ID NO: 4031073 - DNA, 15 bp, Homo sapiens
atagctctttcaggg

SEQ ID NO: 4031074 - DNA, 17 bp, Homo sapiens
atagctgagattcctgg

SEQ ID NO: 4031075 - DNA, 21 bp, Homo sapiens
atagctgagattcctggttcg

SEQ ID NO: 4031076 - DNA, 19 bp, Homo sapiens
atagcttaactaatttgaa

SEQ ID NO: 4031077 - DNA, 20 bp, Homo sapiens
atagcttaactaatttgaat

SEQ ID NO: 4031078 - DNA, 10 bp, Homo sapiens
atagctttat

SEQ ID NO: 4031079 - DNA, 18 bp, Homo sapiens
atagctttattttttaag

SEQ ID NO: 4031080 - DNA, 23 bp, Homo sapiens
atagctttattttttaagtattt

SEQ ID NO: 4031081 - DNA, 16 bp, Homo sapiens
ataggaaactgaagca

SEQ ID NO: 4031082 - DNA, 15 bp, Homo sapiens
ataggaacatatgaa

SEQ ID NO: 4031083 - DNA, 16 bp, Homo sapiens
ataggaacatatgaaa

SEQ ID NO: 4031084 - DNA, 19 bp, Homo sapiens
ataggacatactgcatgta

SEQ ID NO: 4031085 - DNA, 19 bp, Homo sapiens
ataggagaggatgagagcc

SEQ ID NO: 4031086 - DNA, 20 bp, Homo sapiens
ataggagaggatgagagccc

SEQ ID NO: 4031087 - DNA, 21 bp, Homo sapiens
ataggagaggatgagagccca

SEQ ID NO: 4031088 - DNA, 16 bp, Homo sapiens
ataggagcctgctggt

SEQ ID NO: 4031089 - DNA, 21 bp, Homo sapiens
ataggccagggcatgtgtatg

SEQ ID NO: 4031090 - DNA, 23 bp, Homo sapiens
ataggcccaaggtcccctccaca

SEQ ID NO: 4031091 - DNA, 14 bp, Homo sapiens
ataggcctgggtgc

SEQ ID NO: 4031092 - DNA, 20 bp, Homo sapiens
ataggcctgtcccttgcctc

SEQ ID NO: 4031093 - DNA, 19 bp, Homo sapiens
ataggctctgcacagatgg

SEQ ID NO: 4031094 - DNA, 21 bp, Homo sapiens
ataggctcttaagcagcatgg

SEQ ID NO: 4031095 - DNA, 18 bp, Homo sapiens
ataggctggagaagctca

SEQ ID NO: 4031096 - DNA, 22 bp, Homo sapiens
atagggcctggtccctgggagg

SEQ ID NO: 4031097 - DNA, 19 bp, Homo sapiens
ataggggcacactacagag

SEQ ID NO: 4031098 - DNA, 13 bp, Homo sapiens
ataggtaagctgt

SEQ ID NO: 4031099 - DNA, 17 bp, Homo sapiens
ataggtaagctgtgcct

SEQ ID NO: 4031100 - DNA, 16 bp, Homo sapiens
ataggtaatcaatgaa

SEQ ID NO: 4031101 - DNA, 20 bp, Homo sapiens
ataggtaatcaatgaatatt

SEQ ID NO: 4031102 - DNA, 15 bp, Homo sapiens
ataggtagtttggat

SEQ ID NO: 4031103 - DNA, 15 bp, Homo sapiens
ataggtcactcctgg

SEQ ID NO: 4031104 - DNA, 18 bp, Homo sapiens
ataggtgagaaaaaaaca

SEQ ID NO: 4031105 - DNA, 22 bp, Homo sapiens
ataggtgcttattctcaaagca

SEQ ID NO: 4031106 - DNA, 18 bp, Homo sapiens
ataggtttctctccctcc

SEQ ID NO: 4031107 - DNA, 16 bp, Homo sapiens
atacatctctccccaa

SEQ ID NO: 4031108 - DNA, 17 bp, Homo sapiens
atacatgaaaattttaa

SEQ ID NO: 4031109 - DNA, 16 bp, Homo sapiens
atacatgcaaaaagaa

SEQ ID NO: 4031110 - DNA, 14 bp, Homo sapiens
atacattagtaaat

SEQ ID NO: 4031111 - DNA, 19 bp, Homo sapiens
atacattagtaaatgtctt

SEQ ID NO: 4031112 - DNA, 23 bp, Homo sapiens
atacattagtaaatgtctttgta

SEQ ID NO: 4031113 - DNA, 20 bp, Homo sapiens
atacattccctctaatttga

SEQ ID NO: 4031114 - DNA, 15 bp, Homo sapiens
atacatttataatgt

SEQ ID NO: 4031115 - DNA, 14 bp, Homo sapiens
ataccaagtattta

SEQ ID NO: 4031116 - DNA, 19 bp, Homo sapiens
ataccagcttgtatgcaat

SEQ ID NO: 4031117 - DNA, 17 bp, Homo sapiens
ataccatttcctcagct

SEQ ID NO: 4031118 - DNA, 17 bp, Homo sapiens
ataccccactgggcaca

SEQ ID NO: 4031119 - DNA, 15 bp, Homo sapiens
atacccccaggaaac

SEQ ID NO: 4031120 - DNA, 16 bp, Homo sapiens
atacccccaggaaact

SEQ ID NO: 4031121 - DNA, 14 bp, Homo sapiens
atacctgcacgttc

SEQ ID NO: 4031122 - DNA, 11 bp, Homo sapiens
atacctggagc

SEQ ID NO: 4031123 - DNA, 18 bp, Homo sapiens
atacctggcttttacttt

SEQ ID NO: 4031124 - DNA, 20 bp, Homo sapiens
atacgaacccaatctgcaca

SEQ ID NO: 4031125 - DNA, 17 bp, Homo sapiens
atacgagagcagaggtc

SEQ ID NO: 4031126 - DNA, 21 bp, Homo sapiens
atacgcctttaaaggttttta

SEQ ID NO: 4031127 - DNA, 20 bp, Homo sapiens
atacgctactataaagagaa

SEQ ID NO: 4031128 - DNA, 13 bp, Homo sapiens
atactaaaagcaa

SEQ ID NO: 4031129 - DNA, 17 bp, Homo sapiens
atactaccttgaaaata

SEQ ID NO: 4031130 - DNA, 22 bp, Homo sapiens
atactatttaaagcctcctcat

SEQ ID NO: 4031131 - DNA, 19 bp, Homo sapiens
atactcaaatgagtaacat

SEQ ID NO: 4031132 - DNA, 12 bp, Homo sapiens
atactcagcctg

SEQ ID NO: 4031133 - DNA, 18 bp, Homo sapiens
atactctctgcctggtgg

SEQ ID NO: 4031134 - DNA, 16 bp, Homo sapiens
atactctgcttagaat

SEQ ID NO: 4031135 - DNA, 14 bp, Homo sapiens
atactctgtcagat

SEQ ID NO: 4031136 - DNA, 15 bp, Homo sapiens
atactctgtcagatg

SEQ ID NO: 4031137 - DNA, 20 bp, Homo sapiens
atactgaaggaaaaacacaa

SEQ ID NO: 4031138 - DNA, 17 bp, Homo sapiens
atactgattatgtcttt

SEQ ID NO: 4031139 - DNA, 20 bp, Homo sapiens
atactgattatgtcttttat

SEQ ID NO: 4031140 - DNA, 14 bp, Homo sapiens
atactgcaagaaaa

SEQ ID NO: 4031141 - DNA, 13 bp, Homo sapiens
atactgcctcccc

SEQ ID NO: 4031142 - DNA, 13 bp, Homo sapiens
atactggaagttt

SEQ ID NO: 4031143 - DNA, 18 bp, Homo sapiens
atactggaataatttgta

SEQ ID NO: 4031144 - DNA, 16 bp, Homo sapiens
atactgggttcttgtt

SEQ ID NO: 4031145 - DNA, 23 bp, Homo sapiens
atactgggttcttgttttatata

SEQ ID NO: 4031146 - DNA, 18 bp, Homo sapiens
atattactgtttatttct

SEQ ID NO: 4031147 - DNA, 14 bp, Homo sapiens
atattagttaatga

SEQ ID NO: 4031148 - DNA, 17 bp, Homo sapiens
atattataagggagagc

SEQ ID NO: 4031149 - DNA, 22 bp, Homo sapiens
atattataagggagagctgagc

SEQ ID NO: 4031150 - DNA, 22 bp, Homo sapiens
atattataatttttttcaatat

SEQ ID NO: 4031151 - DNA, 20 bp, Homo sapiens
atattatactaagaaaagat

SEQ ID NO: 4031152 - DNA, 13 bp, Homo sapiens
atattatgaaatt

SEQ ID NO: 4031153 - DNA, 17 bp, Homo sapiens
atattatgtgtttccat

SEQ ID NO: 4031154 - DNA, 13 bp, Homo sapiens
atattattgtaag

SEQ ID NO: 4031155 - DNA, 19 bp, Homo sapiens
atattcaggagttggaatg

SEQ ID NO: 4031156 - DNA, 18 bp, Homo sapiens
atattcaggctactcatt

SEQ ID NO: 4031157 - DNA, 22 bp, Homo sapiens
atattcaggctactcattcagt

SEQ ID NO: 4031158 - DNA, 14 bp, Homo sapiens
atattcagtgaaaa

SEQ ID NO: 4031159 - DNA, 15 bp, Homo sapiens
atattcctgaatgaa

SEQ ID NO: 4031160 - DNA, 17 bp, Homo sapiens
atattcctgaatgaaat

SEQ ID NO: 4031161 - DNA, 18 bp, Homo sapiens
atattcctgaatgaaata

SEQ ID NO: 4031162 - DNA, 24 bp, Homo sapiens
atattctgaagcaacattttagct

SEQ ID NO: 4031163 - DNA, 15 bp, Homo sapiens
atattcttgtgcttt

SEQ ID NO: 4031164 - DNA, 20 bp, Homo sapiens
atattgaagacaatttgata

SEQ ID NO: 4031165 - DNA, 21 bp, Homo sapiens
atattgaagacaatttgatac

SEQ ID NO: 4031166 - DNA, 20 bp, Homo sapiens
atattgacactgtccctctt

SEQ ID NO: 4031167 - DNA, 13 bp, Homo sapiens
atattgacatttg

SEQ ID NO: 4031168 - DNA, 16 bp, Homo sapiens
atattgacatttgtag

SEQ ID NO: 4031169 - DNA, 16 bp, Homo sapiens
atattgacttgtatat

SEQ ID NO: 4031170 - DNA, 15 bp, Homo sapiens
atattgatatgctta

SEQ ID NO: 4031171 - DNA, 12 bp, Homo sapiens
atattggaactt

SEQ ID NO: 4031172 - DNA, 21 bp, Homo sapiens
atattggtatatccttttctg

SEQ ID NO: 4031173 - DNA, 15 bp, Homo sapiens
atattggtgcgtttt

SEQ ID NO: 4031174 - DNA, 21 bp, Homo sapiens
atattggtgcgtttttacagt

SEQ ID NO: 4031175 - DNA, 16 bp, Homo sapiens
atattgtacataaaag

SEQ ID NO: 4031176 - DNA, 20 bp, Homo sapiens
atcaattaactgagtagctc

SEQ ID NO: 4031177 - DNA, 21 bp, Homo sapiens
atcaattggcagtgactttgt

SEQ ID NO: 4031178 - DNA, 23 bp, Homo sapiens
atcaattttcattaaacttgaag

SEQ ID NO: 4031179 - DNA, 15 bp, Homo sapiens
atcaatttttaggaa

SEQ ID NO: 4031180 - DNA, 13 bp, Homo sapiens
atcacaaaaattt

SEQ ID NO: 4031181 - DNA, 14 bp, Homo sapiens
atcacaaatggaat

SEQ ID NO: 4031182 - DNA, 19 bp, Homo sapiens
atcacaaatttcacttata

SEQ ID NO: 4031183 - DNA, 16 bp, Homo sapiens
atcacaacaagaaatt

SEQ ID NO: 4031184 - DNA, 13 bp, Homo sapiens
atcacaatacaga

SEQ ID NO: 4031185 - DNA, 12 bp, Homo sapiens
atcacagcagcc

SEQ ID NO: 4031186 - DNA, 15 bp, Homo sapiens
atcacagcctccagg

SEQ ID NO: 4031187 - DNA, 16 bp, Homo sapiens
atcacagcctccaggg

SEQ ID NO: 4031188 - DNA, 12 bp, Homo sapiens
atcacagctgct

SEQ ID NO: 4031189 - DNA, 16 bp, Homo sapiens
atcacagctgctttct

SEQ ID NO: 4031190 - DNA, 14 bp, Homo sapiens
atcacatctcacct

SEQ ID NO: 4031191 - DNA, 16 bp, Homo sapiens
atcacatctcacctcc

SEQ ID NO: 4031192 - DNA, 15 bp, Homo sapiens
atcaccagcccggcc

SEQ ID NO: 4031193 - DNA, 13 bp, Homo sapiens
atcaccagggcca

SEQ ID NO: 4031194 - DNA, 15 bp, Homo sapiens
atcaccatgtaagca

SEQ ID NO: 4031195 - DNA, 19 bp, Homo sapiens
atcaccccctccctacaca

SEQ ID NO: 4031196 - DNA, 18 bp, Homo sapiens
atcaccctttgccttagc

SEQ ID NO: 4031197 - DNA, 22 bp, Homo sapiens
atcacctctctgtagtttatgg

SEQ ID NO: 4031198 - DNA, 19 bp, Homo sapiens
atcacctgcatcacagccc

SEQ ID NO: 4031199 - DNA, 12 bp, Homo sapiens
atcacctggctg

SEQ ID NO: 4031200 - DNA, 16 bp, Homo sapiens
atcacctggctgagca

SEQ ID NO: 4031201 - DNA, 20 bp, Homo sapiens
atcactaaaccgataatgca

SEQ ID NO: 4031202 - DNA, 22 bp, Homo sapiens
atcactaaaccgataatgcatg

SEQ ID NO: 4031203 - DNA, 22 bp, Homo sapiens
atcactaggtaacttattagaa

SEQ ID NO: 4031204 - DNA, 15 bp, Homo sapiens
atcactatctttctg

SEQ ID NO: 4031205 - DNA, 18 bp, Homo sapiens
atcactcagagcagtctg

SEQ ID NO: 4031206 - DNA, 20 bp, Homo sapiens
atcactctaattaattgtaa

SEQ ID NO: 4031207 - DNA, 20 bp, Homo sapiens
atcactgaacaaactaaagg

SEQ ID NO: 4031208 - DNA, 15 bp, Homo sapiens
atcactgaatttata

SEQ ID NO: 4031209 - DNA, 20 bp, Homo sapiens
atcactgaatttataaagta

SEQ ID NO: 4031210 - DNA, 18 bp, Homo sapiens
atcactggcaatgaaaaa

SEQ ID NO: 4031211 - DNA, 22 bp, Homo sapiens
atcactggcaatgaaaaattct

SEQ ID NO: 4031212 - DNA, 20 bp, Homo sapiens
atcactggctggcctgagca

SEQ ID NO: 4031213 - DNA, 19 bp, Homo sapiens
atcacttgaggtcaggagt

SEQ ID NO: 4031214 - DNA, 14 bp, Homo sapiens
atcagaaattttta

SEQ ID NO: 4031215 - DNA, 22 bp, Homo sapiens
atcagaactcaaatggggccag

SEQ ID NO: 4031216 - DNA, 23 bp, Homo sapiens
atcagaactcaaatggggccaga

SEQ ID NO: 4031217 - DNA, 13 bp, Homo sapiens
atcagaagataac

SEQ ID NO: 4031218 - DNA, 11 bp, Homo sapiens
atcagaataaa

SEQ ID NO: 4031219 - DNA, 11 bp, Homo sapiens
atcagaattct

SEQ ID NO: 4031220 - DNA, 16 bp, Homo sapiens
atcagaccataatgtt

SEQ ID NO: 4031221 - DNA, 15 bp, Homo sapiens
atcagacctgtcttc

SEQ ID NO: 4031222 - DNA, 14 bp, Homo sapiens
atcagaggtgtaca

SEQ ID NO: 4031223 - DNA, 18 bp, Homo sapiens
atcagaggtgtacactaa

SEQ ID NO: 4031224 - DNA, 18 bp, Homo sapiens
atcagagtagaaataaaa

SEQ ID NO: 4031225 - DNA, 19 bp, Homo sapiens
atcagataagacatatctc

SEQ ID NO: 4031226 - DNA, 13 bp, Homo sapiens
atcagatacatca

SEQ ID NO: 4031227 - DNA, 14 bp, Homo sapiens
atcagatacatcac

SEQ ID NO: 4031228 - DNA, 17 bp, Homo sapiens
atcagatacatcactgc

SEQ ID NO: 4031229 - DNA, 15 bp, Homo sapiens
atcagcatgaaaatg

SEQ ID NO: 4031230 - DNA, 18 bp, Homo sapiens
atcagcctgagtctcctg

SEQ ID NO: 4031231 - DNA, 19 bp, Homo sapiens
atcagcctgagtctcctgt

SEQ ID NO: 4031232 - DNA, 14 bp, Homo sapiens
atcagctatttact

SEQ ID NO: 4031233 - DNA, 18 bp, Homo sapiens
atcagctgagccttctga

SEQ ID NO: 4031234 - DNA, 12 bp, Homo sapiens
atcagctgctac

SEQ ID NO: 4031235 - DNA, 23 bp, Homo sapiens
atcagctgctactactcctgtag

SEQ ID NO: 4031236 - DNA, 13 bp, Homo sapiens
atcaggaggaagt

SEQ ID NO: 4031237 - DNA, 13 bp, Homo sapiens
atcaggctgaggt

SEQ ID NO: 4031238 - DNA, 18 bp, Homo sapiens
atcagggaatccagctcc

SEQ ID NO: 4031239 - DNA, 21 bp, Homo sapiens
atcagggcaatcccaacacat

SEQ ID NO: 4031240 - DNA, 20 bp, Homo sapiens
atcagggcctggggcctgag

SEQ ID NO: 4031241 - DNA, 23 bp, Homo sapiens
atcagggcctggggcctgagaga

SEQ ID NO: 4031242 - DNA, 20 bp, Homo sapiens
atcaggggtgcattctggcc

SEQ ID NO: 4031243 - DNA, 14 bp, Homo sapiens
atcaggtcctgctc

SEQ ID NO: 4031244 - DNA, 19 bp, Homo sapiens
atcaggtcctgctcagcag

SEQ ID NO: 4031245 - DNA, 13 bp, Homo sapiens
atcaggtgtttta

SEQ ID NO: 4031246 - DNA, 16 bp, Homo sapiens
atcagtaggatatact

SEQ ID NO: 4031247 - DNA, 13 bp, Homo sapiens
atcagtgactgaa

SEQ ID NO: 4031248 - DNA, 13 bp, Homo sapiens
atcagtgtccttt

SEQ ID NO: 4031249 - DNA, 19 bp, Homo sapiens
atcagtgtgtctaaatttg

SEQ ID NO: 4031250 - DNA, 17 bp, Homo sapiens
atcagtgttttaaattc

SEQ ID NO: 4031251 - DNA, 18 bp, Homo sapiens
atcagttaactattgcat

SEQ ID NO: 4031252 - DNA, 14 bp, Homo sapiens
aggcctctgtgtcc

SEQ ID NO: 4031253 - DNA, 23 bp, Homo sapiens
aggcctctgtgtccttccctgca

SEQ ID NO: 4031254 - DNA, 17 bp, Homo sapiens
aggcctgaaagaggctg

SEQ ID NO: 4031255 - DNA, 22 bp, Homo sapiens
aggcctgaatcatgagcctgct

SEQ ID NO: 4031256 - DNA, 16 bp, Homo sapiens
aggcctgacttctgct

SEQ ID NO: 4031257 - DNA, 18 bp, Homo sapiens
aggcctgatcttgcctgt

SEQ ID NO: 4031258 - DNA, 17 bp, Homo sapiens
aggcctgccctcaggga

SEQ ID NO: 4031259 - DNA, 17 bp, Homo sapiens
aggcctgctgccagtgc

SEQ ID NO: 4031260 - DNA, 20 bp, Homo sapiens
aggcctgctttgtctcctct

SEQ ID NO: 4031261 - DNA, 17 bp, Homo sapiens
aggcctggctggaagag

SEQ ID NO: 4031262 - DNA, 21 bp, Homo sapiens
aggcctggctggaggagcagc

SEQ ID NO: 4031263 - DNA, 16 bp, Homo sapiens
aggcctgggtctgtgt

SEQ ID NO: 4031264 - DNA, 21 bp, Homo sapiens
aggcctgggtctgtgtctctt

SEQ ID NO: 4031265 - DNA, 17 bp, Homo sapiens
aggcctgggtgctggct

SEQ ID NO: 4031266 - DNA, 18 bp, Homo sapiens
aggcctgtcccaattctg

SEQ ID NO: 4031267 - DNA, 14 bp, Homo sapiens
aggcctgtgcccac

SEQ ID NO: 4031268 - DNA, 12 bp, Homo sapiens
aggcctgtgtgt

SEQ ID NO: 4031269 - DNA, 15 bp, Homo sapiens
aggccttccagctgc

SEQ ID NO: 4031270 - DNA, 17 bp, Homo sapiens
aggccttgggctctgct

SEQ ID NO: 4031271 - DNA, 18 bp, Homo sapiens
aggcgacgcggttttttc

SEQ ID NO: 4031272 - DNA, 23 bp, Homo sapiens
aggcgagagaggagccagacaga

SEQ ID NO: 4031273 - DNA, 17 bp, Homo sapiens
aggcgagtgccaggact

SEQ ID NO: 4031274 - DNA, 15 bp, Homo sapiens
aggcgatgccacgct

SEQ ID NO: 4031275 - DNA, 14 bp, Homo sapiens
aggcggcccctccc

SEQ ID NO: 4031276 - DNA, 20 bp, Homo sapiens
aggcggcccggccagcgggc

SEQ ID NO: 4031277 - DNA, 16 bp, Homo sapiens
aggcggcgatttttgt

SEQ ID NO: 4031278 - DNA, 15 bp, Homo sapiens
aggcgggcggtcagg

SEQ ID NO: 4031279 - DNA, 19 bp, Homo sapiens
aggctaaggcaggaaaatt

SEQ ID NO: 4031280 - DNA, 23 bp, Homo sapiens
aggctaatgttggcagatgcagc

SEQ ID NO: 4031281 - DNA, 22 bp, Homo sapiens
aggctactagaattctgtattg

SEQ ID NO: 4031282 - DNA, 21 bp, Homo sapiens
aggctagtcttgaatttctga

SEQ ID NO: 4031283 - DNA, 17 bp, Homo sapiens
aggctatgtgattacaa

SEQ ID NO: 4031284 - DNA, 15 bp, Homo sapiens
aggctcactgccagg

SEQ ID NO: 4031285 - DNA, 17 bp, Homo sapiens
aggctcactgccaggcc

SEQ ID NO: 4031286 - DNA, 19 bp, Homo sapiens
aggctcactgccaggccag

SEQ ID NO: 4031287 - DNA, 23 bp, Homo sapiens
aggctcactgccaggccagcctc

SEQ ID NO: 4031288 - DNA, 13 bp, Homo sapiens
aggctcagagact

SEQ ID NO: 4031289 - DNA, 17 bp, Homo sapiens
aggctcagagactgcaa

SEQ ID NO: 4031290 - DNA, 24 bp, Homo sapiens
aggctcagagatgtgcacccatgg

SEQ ID NO: 4031291 - DNA, 14 bp, Homo sapiens
aggctccaggcagc

SEQ ID NO: 4031292 - DNA, 15 bp, Homo sapiens
aggctccaggcagca

SEQ ID NO: 4031293 - DNA, 23 bp, Homo sapiens
aggctccttagggttttctctct

SEQ ID NO: 4031294 - DNA, 21 bp, Homo sapiens
aggctctggacagcagaagcc

SEQ ID NO: 4031295 - DNA, 14 bp, Homo sapiens
aggctctggggcag

SEQ ID NO: 4031296 - DNA, 19 bp, Homo sapiens
aggctctgtggagggcatt

SEQ ID NO: 4031297 - DNA, 18 bp, Homo sapiens
aggctcttaagcagcatg

SEQ ID NO: 4031298 - DNA, 21 bp, Homo sapiens
aggctctttggggtcagccag

SEQ ID NO: 4031299 - DNA, 23 bp, Homo sapiens
aggctctttggggtcagccaggg

SEQ ID NO: 4031300 - DNA, 16 bp, Homo sapiens
aggctgaaagaggcca

SEQ ID NO: 4031301 - DNA, 14 bp, Homo sapiens
aggctgaccacagc

SEQ ID NO: 4031302 - DNA, 16 bp, Homo sapiens
aggctgaccacagcac

SEQ ID NO: 4031303 - DNA, 21 bp, Homo sapiens
aggctgaccacagcacagcca

SEQ ID NO: 4031304 - DNA, 16 bp, Homo sapiens
aggctgacgtgtgagg

SEQ ID NO: 4031305 - DNA, 18 bp, Homo sapiens
aggctgagacaggagaat

SEQ ID NO: 4031306 - DNA, 15 bp, Homo sapiens
aggctgagggctgcc

SEQ ID NO: 4031307 - DNA, 19 bp, Homo sapiens
aggctgagggctgccagca

SEQ ID NO: 4031308 - DNA, 20 bp, Homo sapiens
aggctgagggctgccagcag

SEQ ID NO: 4031309 - DNA, 24 bp, Homo sapiens
aggctgagtccagagcttgtgctc

SEQ ID NO: 4031310 - DNA, 17 bp, Homo sapiens
aggctgagtgagccaca

SEQ ID NO: 4031311 - DNA, 22 bp, Homo sapiens
aggctgagtgagccacagacca

SEQ ID NO: 4031312 - DNA, 18 bp, Homo sapiens
aggctgcacccctgggcc

SEQ ID NO: 4031313 - DNA, 21 bp, Homo sapiens
aggctgcagtcagtcatgatg

SEQ ID NO: 4031314 - DNA, 22 bp, Homo sapiens
aggctgcccccggccccctggt

SEQ ID NO: 4031315 - DNA, 17 bp, Homo sapiens
aggctgcccctctcacc

SEQ ID NO: 4031316 - DNA, 19 bp, Homo sapiens
aggctgcctatgttggggg

SEQ ID NO: 4031317 - DNA, 16 bp, Homo sapiens
aggctgcctcctgccc

SEQ ID NO: 4031318 - DNA, 12 bp, Homo sapiens
aggcttctcctt

SEQ ID NO: 4031319 - DNA, 13 bp, Homo sapiens
aggcttctccttc

SEQ ID NO: 4031320 - DNA, 18 bp, Homo sapiens
aggctttggtaactgcgg

SEQ ID NO: 4031321 - DNA, 13 bp, Homo sapiens
agggaaagaaaat

SEQ ID NO: 4031322 - DNA, 15 bp, Homo sapiens
agggaaaggttttgt

SEQ ID NO: 4031323 - DNA, 18 bp, Homo sapiens
agggaaaggttttgtatt

SEQ ID NO: 4031324 - DNA, 15 bp, Homo sapiens
agggaagaaggagga

SEQ ID NO: 4031325 - DNA, 12 bp, Homo sapiens
agggaagagcag

SEQ ID NO: 4031326 - DNA, 14 bp, Homo sapiens
agggaaggcctgac

SEQ ID NO: 4031327 - DNA, 13 bp, Homo sapiens
agggaaggtggcc

SEQ ID NO: 4031328 - DNA, 14 bp, Homo sapiens
agggaaggttcttc

SEQ ID NO: 4031329 - DNA, 15 bp, Homo sapiens
agggaagtagtcctt

SEQ ID NO: 4031330 - DNA, 13 bp, Homo sapiens
agggaagtggtct

SEQ ID NO: 4031331 - DNA, 22 bp, Homo sapiens
agggaagtgtgagcgccttggt

SEQ ID NO: 4031332 - DNA, 16 bp, Homo sapiens
agggaatgcaatcctt

SEQ ID NO: 4031333 - DNA, 22 bp, Homo sapiens
agggaatttctatctaaatgat

SEQ ID NO: 4031334 - DNA, 14 bp, Homo sapiens
agggacagagccat

SEQ ID NO: 4031335 - DNA, 20 bp, Homo sapiens
agggacagcccactgagaag

SEQ ID NO: 4031336 - DNA, 13 bp, Homo sapiens
agggacagggtct

SEQ ID NO: 4031337 - DNA, 18 bp, Homo sapiens
agggacatatcagtgacc

SEQ ID NO: 4031338 - DNA, 19 bp, Homo sapiens
agggacatgctcacctcta

SEQ ID NO: 4031339 - DNA, 16 bp, Homo sapiens
agggaccaactgggcc

SEQ ID NO: 4031340 - DNA, 14 bp, Homo sapiens
agggaccaccctcc

SEQ ID NO: 4031341 - DNA, 15 bp, Homo sapiens
agggaccaccctccc

SEQ ID NO: 4031342 - DNA, 18 bp, Homo sapiens
agggaccatcaagaacct

SEQ ID NO: 4031343 - DNA, 23 bp, Homo sapiens
agggaccctttgcctttcttctg

SEQ ID NO: 4031344 - DNA, 15 bp, Homo sapiens
agggaccggtgctgc

SEQ ID NO: 4031345 - DNA, 14 bp, Homo sapiens
agggactctgaagc

SEQ ID NO: 4031346 - DNA, 21 bp, Homo sapiens
agggactctgaagcctctggg

SEQ ID NO: 4031347 - DNA, 16 bp, Homo sapiens
agggacttaacttgtt

SEQ ID NO: 4031348 - DNA, 13 bp, Homo sapiens
agggacttggaca

SEQ ID NO: 4031349 - DNA, 17 bp, Homo sapiens
agggacttggacaggag

SEQ ID NO: 4031350 - DNA, 18 bp, Homo sapiens
agggacttggacaggagt

SEQ ID NO: 4031351 - DNA, 20 bp, Homo sapiens
agggacttggacaggagtca

SEQ ID NO: 4031352 - DNA, 13 bp, Homo sapiens
agggagaaatgtt

SEQ ID NO: 4031353 - DNA, 16 bp, Homo sapiens
agggagaagaaaggtg

SEQ ID NO: 4031354 - DNA, 15 bp, Homo sapiens
agggagaaggatcta

SEQ ID NO: 4031355 - DNA, 18 bp, Homo sapiens
agggagaagggatggagg

SEQ ID NO: 4031356 - DNA, 15 bp, Homo sapiens
agggagacagggtag

SEQ ID NO: 4031357 - DNA, 16 bp, Homo sapiens
agggagacagggtagg

SEQ ID NO: 4031358 - DNA, 23 bp, Homo sapiens
agggagagagagagagagaggac

SEQ ID NO: 4031359 - DNA, 15 bp, Homo sapiens
agggagagctgagcc

SEQ ID NO: 4031360 - DNA, 16 bp, Homo sapiens
agggagagctgagcca

SEQ ID NO: 4031361 - DNA, 17 bp, Homo sapiens
agggagcaagacagaga

SEQ ID NO: 4031362 - DNA, 21 bp, Homo sapiens
agggagcacaacccccagctc

SEQ ID NO: 4031363 - DNA, 14 bp, Homo sapiens
agggagcagacagg

SEQ ID NO: 4031364 - DNA, 16 bp, Homo sapiens
agggagcagggaaggc

SEQ ID NO: 4031365 - DNA, 23 bp, Homo sapiens
agggagcctccccatctgtccag

SEQ ID NO: 4031366 - DNA, 14 bp, Homo sapiens
agggagcctcccct

SEQ ID NO: 4031367 - DNA, 19 bp, Homo sapiens
agggagcggccggccagcc

SEQ ID NO: 4031368 - DNA, 22 bp, Homo sapiens
agggagcggccggccagcccct

SEQ ID NO: 4031369 - DNA, 14 bp, Homo sapiens
agggagctctgggg

SEQ ID NO: 4031370 - DNA, 20 bp, Homo sapiens
agggagctggctccagcctg

SEQ ID NO: 4031371 - DNA, 14 bp, Homo sapiens
agggaggagtggag

SEQ ID NO: 4031372 - DNA, 15 bp, Homo sapiens
agggaggagtggagg

SEQ ID NO: 4031373 - DNA, 17 bp, Homo sapiens
agggaggcagcctccag

SEQ ID NO: 4031374 - DNA, 23 bp, Homo sapiens
agggagggaagtgtgagcgcctt

SEQ ID NO: 4031375 - DNA, 13 bp, Homo sapiens
agggaggggaaat

SEQ ID NO: 4031376 - DNA, 17 bp, Homo sapiens
agggaggggaaatgtaa

SEQ ID NO: 4031377 - DNA, 18 bp, Homo sapiens
agggaggggaaatgtaat

SEQ ID NO: 4031378 - DNA, 13 bp, Homo sapiens
agggaggggaggc

SEQ ID NO: 4031379 - DNA, 18 bp, Homo sapiens
agggaggtttgtgagagc

SEQ ID NO: 4031380 - DNA, 15 bp, Homo sapiens
agggagtacctgctg

SEQ ID NO: 4031381 - DNA, 16 bp, Homo sapiens
agggagtacctgctgc

SEQ ID NO: 4031382 - DNA, 17 bp, Homo sapiens
agggagtacctgctgcc

SEQ ID NO: 4031383 - DNA, 22 bp, Homo sapiens
agggagtgatgatttgggggag

SEQ ID NO: 4031384 - DNA, 23 bp, Homo sapiens
agcttccattccaagcctgacca

SEQ ID NO: 4031385 - DNA, 13 bp, Homo sapiens
agcttccctccat

SEQ ID NO: 4031386 - DNA, 12 bp, Homo sapiens
agcttccctccc

SEQ ID NO: 4031387 - DNA, 16 bp, Homo sapiens
agcttccctccctgct

SEQ ID NO: 4031388 - DNA, 13 bp, Homo sapiens
agcttcctcacac

SEQ ID NO: 4031389 - DNA, 15 bp, Homo sapiens
agcttcctcacaccc

SEQ ID NO: 4031390 - DNA, 18 bp, Homo sapiens
agcttcctcacacccctg

SEQ ID NO: 4031391 - DNA, 22 bp, Homo sapiens
agcttcctcacacccctgtccc

SEQ ID NO: 4031392 - DNA, 21 bp, Homo sapiens
agcttcggagggcccctgcgt

SEQ ID NO: 4031393 - DNA, 20 bp, Homo sapiens
agcttctaaatggtgctgca

SEQ ID NO: 4031394 - DNA, 22 bp, Homo sapiens
agcttctactcctgcctcatgc

SEQ ID NO: 4031395 - DNA, 17 bp, Homo sapiens
agcttctatcccaggag

SEQ ID NO: 4031396 - DNA, 12 bp, Homo sapiens
agcttctccagg

SEQ ID NO: 4031397 - DNA, 23 bp, Homo sapiens
agcttctccaggctctttggggt

SEQ ID NO: 4031398 - DNA, 14 bp, Homo sapiens
agcttctctgtgaa

SEQ ID NO: 4031399 - DNA, 23 bp, Homo sapiens
agcttctgcttttctgccctggc

SEQ ID NO: 4031400 - DNA, 21 bp, Homo sapiens
agcttctggaatttgttcaag

SEQ ID NO: 4031401 - DNA, 21 bp, Homo sapiens
agcttcttaattaatttgatt

SEQ ID NO: 4031402 - DNA, 13 bp, Homo sapiens
agcttcttcacag

SEQ ID NO: 4031403 - DNA, 16 bp, Homo sapiens
agcttgaaagttttca

SEQ ID NO: 4031404 - DNA, 22 bp, Homo sapiens
agcttgaaagttttcagaacct

SEQ ID NO: 4031405 - DNA, 18 bp, Homo sapiens
agcttgacacagtcagca

SEQ ID NO: 4031406 - DNA, 18 bp, Homo sapiens
agcttgcacatgaatgca

SEQ ID NO: 4031407 - DNA, 18 bp, Homo sapiens
agcttgctttgatttaca

SEQ ID NO: 4031408 - DNA, 22 bp, Homo sapiens
agcttgctttgatttacagcaa

SEQ ID NO: 4031409 - DNA, 16 bp, Homo sapiens
agcttggagggatgga

SEQ ID NO: 4031410 - DNA, 23 bp, Homo sapiens
agcttgggcagtgccccagggag

SEQ ID NO: 4031411 - DNA, 23 bp, Homo sapiens
agggcatctcctgtgcatgggtg

SEQ ID NO: 4031412 - DNA, 18 bp, Homo sapiens
agggcatcttgctggcta

SEQ ID NO: 4031413 - DNA, 18 bp, Homo sapiens
agggcattcgggccacag

SEQ ID NO: 4031414 - DNA, 19 bp, Homo sapiens
agggcattcgggccacagg

SEQ ID NO: 4031415 - DNA, 18 bp, Homo sapiens
agggccaaaagcttccct

SEQ ID NO: 4031416 - DNA, 19 bp, Homo sapiens
agggccaaaagcttccctc

SEQ ID NO: 4031417 - DNA, 18 bp, Homo sapiens
agggccacactattacca

SEQ ID NO: 4031418 - DNA, 11 bp, Homo sapiens
agggccagagc

SEQ ID NO: 4031419 - DNA, 16 bp, Homo sapiens
agggccagagccaggg

SEQ ID NO: 4031420 - DNA, 22 bp, Homo sapiens
agggccaggcaggtgcctggac

SEQ ID NO: 4031421 - DNA, 13 bp, Homo sapiens
agggccaggccca

SEQ ID NO: 4031422 - DNA, 16 bp, Homo sapiens
agggccaggcccaggc

SEQ ID NO: 4031423 - DNA, 18 bp, Homo sapiens
agggccaggcccaggcct

SEQ ID NO: 4031424 - DNA, 21 bp, Homo sapiens
agggccaggggtctccctgga

SEQ ID NO: 4031425 - DNA, 16 bp, Homo sapiens
agggccagtcctgcct

SEQ ID NO: 4031426 - DNA, 23 bp, Homo sapiens
agggccagtcctgcctggccagg

SEQ ID NO: 4031427 - DNA, 14 bp, Homo sapiens
agggcccaccccag

SEQ ID NO: 4031428 - DNA, 18 bp, Homo sapiens
agggcccaccccagcctc

SEQ ID NO: 4031429 - DNA, 22 bp, Homo sapiens
agggcccaccccagcctcgcct

SEQ ID NO: 4031430 - DNA, 13 bp, Homo sapiens
agggcccagagcc

SEQ ID NO: 4031431 - DNA, 14 bp, Homo sapiens
agggcccagccagg

SEQ ID NO: 4031432 - DNA, 15 bp, Homo sapiens
agggcccagcccaga

SEQ ID NO: 4031433 - DNA, 17 bp, Homo sapiens
agggcccagcccagagc

SEQ ID NO: 4031434 - DNA, 23 bp, Homo sapiens
agggcccagcccagagccacctg

SEQ ID NO: 4031435 - DNA, 21 bp, Homo sapiens
agggccccccaaatcccaggg

SEQ ID NO: 4031436 - DNA, 11 bp, Homo sapiens
agggccctggc

SEQ ID NO: 4031437 - DNA, 16 bp, Homo sapiens
agggccctggccagcc

SEQ ID NO: 4031438 - DNA, 17 bp, Homo sapiens
agggcccttggggctgg

SEQ ID NO: 4031439 - DNA, 20 bp, Homo sapiens
agggccgaggaggtgcctgg

SEQ ID NO: 4031440 - DNA, 13 bp, Homo sapiens
agggcctccaggg

SEQ ID NO: 4031441 - DNA, 17 bp, Homo sapiens
agggcctgcctggcccc

SEQ ID NO: 4031442 - DNA, 13 bp, Homo sapiens
agggcctgctgga

SEQ ID NO: 4031443 - DNA, 14 bp, Homo sapiens
agggcctgctggag

SEQ ID NO: 4031444 - DNA, 15 bp, Homo sapiens
agggcctgctggagg

SEQ ID NO: 4031445 - DNA, 18 bp, Homo sapiens
agggcctgctggaggcct

SEQ ID NO: 4031446 - DNA, 21 bp, Homo sapiens
agggcctgctggaggcctcag

SEQ ID NO: 4031447 - DNA, 22 bp, Homo sapiens
agggcctgctggaggcctcagg

SEQ ID NO: 4031448 - DNA, 12 bp, Homo sapiens
agggcctggagc

SEQ ID NO: 4031449 - DNA, 20 bp, Homo sapiens
agggcctggggcctgagaga

SEQ ID NO: 4031450 - DNA, 17 bp, Homo sapiens
agggcctggtccctggg

SEQ ID NO: 4031451 - DNA, 12 bp, Homo sapiens
agggcgctcaga

SEQ ID NO: 4031452 - DNA, 15 bp, Homo sapiens
agggcgctcagacgg

SEQ ID NO: 4031453 - DNA, 21 bp, Homo sapiens
agggcgctcagacggcggcca

SEQ ID NO: 4031454 - DNA, 23 bp, Homo sapiens
agggcgctcagacggcggccagg

SEQ ID NO: 4031455 - DNA, 19 bp, Homo sapiens
agggcgggcagagggctgg

SEQ ID NO: 4031456 - DNA, 24 bp, Homo sapiens
agggctagtgacttgtgtcccatg

SEQ ID NO: 4031457 - DNA, 19 bp, Homo sapiens
agggctcccggagagggag

SEQ ID NO: 4031458 - DNA, 15 bp, Homo sapiens
agggctctaaaaaaa

SEQ ID NO: 4031459 - DNA, 17 bp, Homo sapiens
agggctctgacaaagct

SEQ ID NO: 4031460 - DNA, 15 bp, Homo sapiens
agggctctgatattc

SEQ ID NO: 4031461 - DNA, 17 bp, Homo sapiens
agggctgccagcagccc

SEQ ID NO: 4031462 - DNA, 19 bp, Homo sapiens
agggctgccagcagccccg

SEQ ID NO: 4031463 - DNA, 23 bp, Homo sapiens
agggctgccctgagaagctgctc

SEQ ID NO: 4031464 - DNA, 18 bp, Homo sapiens
agggctggaggcccaggc

SEQ ID NO: 4031465 - DNA, 14 bp, Homo sapiens
agggctggccccag

SEQ ID NO: 4031466 - DNA, 22 bp, Homo sapiens
agggctggctccccctccccag

SEQ ID NO: 4031467 - DNA, 23 bp, Homo sapiens
agggctggctctgcactaagaga

SEQ ID NO: 4031468 - DNA, 12 bp, Homo sapiens
agggctggctgg

SEQ ID NO: 4031469 - DNA, 18 bp, Homo sapiens
agggctggggcagcctct

SEQ ID NO: 4031470 - DNA, 13 bp, Homo sapiens
agggctggtttgt

SEQ ID NO: 4031471 - DNA, 16 bp, Homo sapiens
agggctggtttgttct

SEQ ID NO: 4031472 - DNA, 15 bp, Homo sapiens
agggctgtcccagcc

SEQ ID NO: 4031473 - DNA, 15 bp, Homo sapiens
agggcttactatttc

SEQ ID NO: 4031474 - DNA, 15 bp, Homo sapiens
agggttaaggcctga

SEQ ID NO: 4031475 - DNA, 16 bp, Homo sapiens
agggttaaggcctgaa

SEQ ID NO: 4031476 - DNA, 20 bp, Homo sapiens
agggttacagagacctatgt

SEQ ID NO: 4031477 - DNA, 13 bp, Homo sapiens
agggttataataa

SEQ ID NO: 4031478 - DNA, 22 bp, Homo sapiens
agggttcaaaatgtctgtagct

SEQ ID NO: 4031479 - DNA, 21 bp, Homo sapiens
agggttcctgtagacctaggg

SEQ ID NO: 4031480 - DNA, 21 bp, Homo sapiens
agggttgagttacttcctatc

SEQ ID NO: 4031481 - DNA, 15 bp, Homo sapiens
agggttggcacctgc

SEQ ID NO: 4031482 - DNA, 16 bp, Homo sapiens
agggttggcacctgca

SEQ ID NO: 4031483 - DNA, 18 bp, Homo sapiens
agggttggcacctgcaca

SEQ ID NO: 4031484 - DNA, 20 bp, Homo sapiens
agggttggcacctgcacact

SEQ ID NO: 4031485 - DNA, 15 bp, Homo sapiens
agggttggggagggg

SEQ ID NO: 4031486 - DNA, 23 bp, Homo sapiens
agggttgggttcatctgagcaag

SEQ ID NO: 4031487 - DNA, 12 bp, Homo sapiens
agggtttctctg

SEQ ID NO: 4031488 - DNA, 23 bp, Homo sapiens
agggtttgaattgttttctttaa

SEQ ID NO: 4031489 - DNA, 15 bp, Homo sapiens
agggttttgcaataa

SEQ ID NO: 4031490 - DNA, 17 bp, Homo sapiens
agggttttgcaataact

SEQ ID NO: 4031491 - DNA, 13 bp, Homo sapiens
agggtttttacct

SEQ ID NO: 4031492 - DNA, 22 bp, Homo sapiens
agggtttttacctgtcacattg

SEQ ID NO: 4031493 - DNA, 13 bp, Homo sapiens
aggtaacagaaca

SEQ ID NO: 4031494 - DNA, 18 bp, Homo sapiens
aggtaacagaacagcttc

SEQ ID NO: 4031495 - DNA, 15 bp, Homo sapiens
aggtaagaagtttta

SEQ ID NO: 4031496 - DNA, 17 bp, Homo sapiens
aggtaagctgtgccttc

SEQ ID NO: 4031497 - DNA, 18 bp, Homo sapiens
aggtaatcaatgaatatt

SEQ ID NO: 4031498 - DNA, 13 bp, Homo sapiens
aggtaatgaggga

SEQ ID NO: 4031499 - DNA, 23 bp, Homo sapiens
aggtaatttttaccctaatgtct

SEQ ID NO: 4031500 - DNA, 17 bp, Homo sapiens
aggtaatttttttcacc

SEQ ID NO: 4031501 - DNA, 19 bp, Homo sapiens
aggtacagggtttttacct

SEQ ID NO: 4031502 - DNA, 20 bp, Homo sapiens
aggtaccacccttcagaccc

SEQ ID NO: 4031503 - DNA, 13 bp, Homo sapiens
aggtaccagctgc

SEQ ID NO: 4031504 - DNA, 14 bp, Homo sapiens
aggtactattctga

SEQ ID NO: 4031505 - DNA, 17 bp, Homo sapiens
aggtagaaatatctgaa

SEQ ID NO: 4031506 - DNA, 15 bp, Homo sapiens
aggtagaacgccagg

SEQ ID NO: 4031507 - DNA, 18 bp, Homo sapiens
aggtagagccacaaaaga

SEQ ID NO: 4031508 - DNA, 17 bp, Homo sapiens
aggtagagtttgaagga

SEQ ID NO: 4031509 - DNA, 20 bp, Homo sapiens
aggtagagtttgaaggaggt

SEQ ID NO: 4031510 - DNA, 21 bp, Homo sapiens
aggtagagtttgaaggaggtg

SEQ ID NO: 4031511 - DNA, 15 bp, Homo sapiens
aggtagcccagcact

SEQ ID NO: 4031512 - DNA, 16 bp, Homo sapiens
aggtagcccagcactg

SEQ ID NO: 4031513 - DNA, 17 bp, Homo sapiens
aggtagccccctcttcc

SEQ ID NO: 4031514 - DNA, 16 bp, Homo sapiens
aggtagccttgtgttc

SEQ ID NO: 4031515 - DNA, 16 bp, Homo sapiens
aggacatactgcatgt

SEQ ID NO: 4031516 - DNA, 16 bp, Homo sapiens
aggacatcagcaaaca

SEQ ID NO: 4031517 - DNA, 20 bp, Homo sapiens
aggacatgcggtagccagca

SEQ ID NO: 4031518 - DNA, 15 bp, Homo sapiens
aggacatggcttctg

SEQ ID NO: 4031519 - DNA, 14 bp, Homo sapiens
aggacattgcccca

SEQ ID NO: 4031520 - DNA, 18 bp, Homo sapiens
aggaccagctcaggacag

SEQ ID NO: 4031521 - DNA, 23 bp, Homo sapiens
aggaccagctcaggacagatgcc

SEQ ID NO: 4031522 - DNA, 24 bp, Homo sapiens
aggaccagctcaggacagatgcca

SEQ ID NO: 4031523 - DNA, 22 bp, Homo sapiens
aggaccaggactatagcccagg

SEQ ID NO: 4031524 - DNA, 13 bp, Homo sapiens
aggaccaggactc

SEQ ID NO: 4031525 - DNA, 16 bp, Homo sapiens
aggaccaggactccct

SEQ ID NO: 4031526 - DNA, 21 bp, Homo sapiens
aggaccaggactccctcctca

SEQ ID NO: 4031527 - DNA, 18 bp, Homo sapiens
aggaccctaacacagtat

SEQ ID NO: 4031528 - DNA, 15 bp, Homo sapiens
aggaccctgaagggg

SEQ ID NO: 4031529 - DNA, 16 bp, Homo sapiens
aggaccggcggctcgg

SEQ ID NO: 4031530 - DNA, 12 bp, Homo sapiens
aggacctgcccc

SEQ ID NO: 4031531 - DNA, 19 bp, Homo sapiens
aggacctggcatcatggtg

SEQ ID NO: 4031532 - DNA, 13 bp, Homo sapiens
aggacctgtgtcc

SEQ ID NO: 4031533 - DNA, 15 bp, Homo sapiens
aggacgcttctgaat

SEQ ID NO: 4031534 - DNA, 20 bp, Homo sapiens
aggactacgttaagggaagg

SEQ ID NO: 4031535 - DNA, 19 bp, Homo sapiens
aggactatagcccaggtcc

SEQ ID NO: 4031536 - DNA, 20 bp, Homo sapiens
aggactatatttgggcctgc

SEQ ID NO: 4031537 - DNA, 15 bp, Homo sapiens
aggactccaggccca

SEQ ID NO: 4031538 - DNA, 13 bp, Homo sapiens
aggactccccagg

SEQ ID NO: 4031539 - DNA, 16 bp, Homo sapiens
aggactccccaggcca

SEQ ID NO: 4031540 - DNA, 12 bp, Homo sapiens
aggactccctcc

SEQ ID NO: 4031541 - DNA, 14 bp, Homo sapiens
aggactccctcctc

SEQ ID NO: 4031542 - DNA, 19 bp, Homo sapiens
aggactcctcctttttcca

SEQ ID NO: 4031543 - DNA, 19 bp, Homo sapiens
aggactgagcaccctctgg

SEQ ID NO: 4031544 - DNA, 23 bp, Homo sapiens
aggactgagtcccctccaggaag

SEQ ID NO: 4031545 - DNA, 21 bp, Homo sapiens
aggacttcctgtccagctcca

SEQ ID NO: 4031546 - DNA, 13 bp, Homo sapiens
aggacttctgcag

SEQ ID NO: 4031547 - DNA, 15 bp, Homo sapiens
aggacttctgcagct

SEQ ID NO: 4031548 - DNA, 16 bp, Homo sapiens
aggacttgaaagcatc

SEQ ID NO: 4031549 - DNA, 19 bp, Homo sapiens
aggacttgaaagcatccat

SEQ ID NO: 4031550 - DNA, 17 bp, Homo sapiens
aggacttgatgtacata

SEQ ID NO: 4031551 - DNA, 16 bp, Homo sapiens
aggacttggggtcagg

SEQ ID NO: 4031552 - DNA, 18 bp, Homo sapiens
aggactttgaggcaagtg

SEQ ID NO: 4031553 - DNA, 15 bp, Homo sapiens
aggagaaccactaca

SEQ ID NO: 4031554 - DNA, 13 bp, Homo sapiens
aggagaagccagg

SEQ ID NO: 4031555 - DNA, 14 bp, Homo sapiens
aggagaagccagga

SEQ ID NO: 4031556 - DNA, 15 bp, Homo sapiens
aggagaagccaggaa

SEQ ID NO: 4031557 - DNA, 16 bp, Homo sapiens
aggagaatgaaatgta

SEQ ID NO: 4031558 - DNA, 14 bp, Homo sapiens
aggagaccaaggcg

SEQ ID NO: 4031559 - DNA, 13 bp, Homo sapiens
aggagaccagctc

SEQ ID NO: 4031560 - DNA, 14 bp, Homo sapiens
aggagaccagctca

SEQ ID NO: 4031561 - DNA, 19 bp, Homo sapiens
aggagactgaggcttagag

SEQ ID NO: 4031562 - DNA, 23 bp, Homo sapiens
aggagagacggtgttgggagccc

SEQ ID NO: 4031563 - DNA, 18 bp, Homo sapiens
aggagagcctgctgcatg

SEQ ID NO: 4031564 - DNA, 13 bp, Homo sapiens
aggagaggatgag

SEQ ID NO: 4031565 - DNA, 20 bp, Homo sapiens
aggagaggatgagagcccag

SEQ ID NO: 4031566 - DNA, 16 bp, Homo sapiens
aggagaggatggccca

SEQ ID NO: 4031567 - DNA, 18 bp, Homo sapiens
aggagaggggaagggcca

SEQ ID NO: 4031568 - DNA, 22 bp, Homo sapiens
aggagatccagggcaaggccat

SEQ ID NO: 4031569 - DNA, 14 bp, Homo sapiens
aggagatgaccagg

SEQ ID NO: 4031570 - DNA, 19 bp, Homo sapiens
aggagatgaccagggatgc

SEQ ID NO: 4031571 - DNA, 22 bp, Homo sapiens
aggagatgaccagggatgctgg

SEQ ID NO: 4031572 - DNA, 20 bp, Homo sapiens
aggagatggaagttgcagtg

SEQ ID NO: 4031573 - DNA, 14 bp, Homo sapiens
aggagatggccata

SEQ ID NO: 4031574 - DNA, 16 bp, Homo sapiens
aggagcaaacactgaa

SEQ ID NO: 4031575 - DNA, 19 bp, Homo sapiens
aggagcaaacactgaaata

SEQ ID NO: 4031576 - DNA, 13 bp, Homo sapiens
aggagcaatggga

SEQ ID NO: 4031577 - DNA, 15 bp, Homo sapiens
aggagcaatgggact

SEQ ID NO: 4031578 - DNA, 20 bp, Homo sapiens
aggagcaatgggactggagt

SEQ ID NO: 4031579 - DNA, 16 bp, Homo sapiens
aggagcacaagccaca

SEQ ID NO: 4031580 - DNA, 15 bp, Homo sapiens
aggagcacaggcagc

SEQ ID NO: 4031581 - DNA, 22 bp, Homo sapiens
aggagcacaggcagctggatga

SEQ ID NO: 4031582 - DNA, 17 bp, Homo sapiens
aggagcacttccaaaat

SEQ ID NO: 4031583 - DNA, 14 bp, Homo sapiens
aggagcagcagctt

SEQ ID NO: 4031584 - DNA, 19 bp, Homo sapiens
aggagcatttttttattca

SEQ ID NO: 4031585 - DNA, 14 bp, Homo sapiens
aggagccagacaga

SEQ ID NO: 4031586 - DNA, 23 bp, Homo sapiens
aggagccagtttgccggatacaa

SEQ ID NO: 4031587 - DNA, 12 bp, Homo sapiens
aggcaagcagga

SEQ ID NO: 4031588 - DNA, 19 bp, Homo sapiens
aggcaagcaggacctggca

SEQ ID NO: 4031589 - DNA, 20 bp, Homo sapiens
aggcaaggctatgtgattac

SEQ ID NO: 4031590 - DNA, 19 bp, Homo sapiens
aggcaagttaagagaaact

SEQ ID NO: 4031591 - DNA, 19 bp, Homo sapiens
aggcaatgtcaggaacaga

SEQ ID NO: 4031592 - DNA, 15 bp, Homo sapiens
aggcacacacagccc

SEQ ID NO: 4031593 - DNA, 18 bp, Homo sapiens
aggcacacagcagccccc

SEQ ID NO: 4031594 - DNA, 15 bp, Homo sapiens
aggcacacagctact

SEQ ID NO: 4031595 - DNA, 17 bp, Homo sapiens
aggcacagggcccgcag

SEQ ID NO: 4031596 - DNA, 13 bp, Homo sapiens
aggcaccagaaga

SEQ ID NO: 4031597 - DNA, 12 bp, Homo sapiens
aggcaccagcat

SEQ ID NO: 4031598 - DNA, 13 bp, Homo sapiens
aggcaccagcatc

SEQ ID NO: 4031599 - DNA, 14 bp, Homo sapiens
aggcaccagcatcc

SEQ ID NO: 4031600 - DNA, 16 bp, Homo sapiens
aggcaccagcatccac

SEQ ID NO: 4031601 - DNA, 15 bp, Homo sapiens
aggcaccccctggag

SEQ ID NO: 4031602 - DNA, 19 bp, Homo sapiens
aggcaccccctggagagaa

SEQ ID NO: 4031603 - DNA, 13 bp, Homo sapiens
aggcaccctcagg

SEQ ID NO: 4031604 - DNA, 17 bp, Homo sapiens
aggcaccctcagggagc

SEQ ID NO: 4031605 - DNA, 14 bp, Homo sapiens
aggcaccgccacgt

SEQ ID NO: 4031606 - DNA, 13 bp, Homo sapiens
aggcacctcttcc

SEQ ID NO: 4031607 - DNA, 15 bp, Homo sapiens
aggcactcagtgagc

SEQ ID NO: 4031608 - DNA, 22 bp, Homo sapiens
aggcactcagtgagcctcctgt

SEQ ID NO: 4031609 - DNA, 15 bp, Homo sapiens
aggcactgccttctc

SEQ ID NO: 4031610 - DNA, 20 bp, Homo sapiens
aggcactttagggctgtaaa

SEQ ID NO: 4031611 - DNA, 15 bp, Homo sapiens
aggcagagaaagaag

SEQ ID NO: 4031612 - DNA, 19 bp, Homo sapiens
aggcagagaaagaagagac

SEQ ID NO: 4031613 - DNA, 11 bp, Homo sapiens
aggcagatcca

SEQ ID NO: 4031614 - DNA, 15 bp, Homo sapiens
aggcagatccaggac

SEQ ID NO: 4031615 - DNA, 17 bp, Homo sapiens
aggcagatccaggacta

SEQ ID NO: 4031616 - DNA, 22 bp, Homo sapiens
aggcagatctgtgccccatgcc

SEQ ID NO: 4031617 - DNA, 15 bp, Homo sapiens
aggcagatgtttgcc

SEQ ID NO: 4031618 - DNA, 18 bp, Homo sapiens
aggcagatgtttgcctca

SEQ ID NO: 4031619 - DNA, 19 bp, Homo sapiens
aggcagccaacctaagcaa

SEQ ID NO: 4031620 - DNA, 13 bp, Homo sapiens
agctgcctcactt

SEQ ID NO: 4031621 - DNA, 15 bp, Homo sapiens
agctgcctctgggcc

SEQ ID NO: 4031622 - DNA, 18 bp, Homo sapiens
agctgcctgaaacagcca

SEQ ID NO: 4031623 - DNA, 19 bp, Homo sapiens
agctgcctgaaacagccat

SEQ ID NO: 4031624 - DNA, 10 bp, Homo sapiens
agctgcctgg

SEQ ID NO: 4031625 - DNA, 19 bp, Homo sapiens
agctgcctggagagggtct

SEQ ID NO: 4031626 - DNA, 11 bp, Homo sapiens
agctgcctggg

SEQ ID NO: 4031627 - DNA, 14 bp, Homo sapiens
agctgcctgggccc

SEQ ID NO: 4031628 - DNA, 13 bp, Homo sapiens
agctgccttccct

SEQ ID NO: 4031629 - DNA, 20 bp, Homo sapiens
agctgccttggctcagacat

SEQ ID NO: 4031630 - DNA, 17 bp, Homo sapiens
agctgcgcttgcttttc

SEQ ID NO: 4031631 - DNA, 17 bp, Homo sapiens
agctgctccaggcctgc

SEQ ID NO: 4031632 - DNA, 17 bp, Homo sapiens
agctgctccctggcatt

SEQ ID NO: 4031633 - DNA, 22 bp, Homo sapiens
agctgctgaccaattgtgctgc

SEQ ID NO: 4031634 - DNA, 12 bp, Homo sapiens
agctgctgtctt

SEQ ID NO: 4031635 - DNA, 20 bp, Homo sapiens
agctgctgttctcaggacag

SEQ ID NO: 4031636 - DNA, 21 bp, Homo sapiens
agccagtttgccggatacaaa

SEQ ID NO: 4031637 - DNA, 23 bp, Homo sapiens
agccagtttgggtaaaatacttt

SEQ ID NO: 4031638 - DNA, 16 bp, Homo sapiens
agccatagaccctgag

SEQ ID NO: 4031639 - DNA, 17 bp, Homo sapiens
agccatagaccctgagg

SEQ ID NO: 4031640 - DNA, 17 bp, Homo sapiens
agccataggcccaggat

SEQ ID NO: 4031641 - DNA, 13 bp, Homo sapiens
agccatcaaaatg

SEQ ID NO: 4031642 - DNA, 18 bp, Homo sapiens
agccatcaacaagagttg

SEQ ID NO: 4031643 - DNA, 15 bp, Homo sapiens
agccatcctccctcc

SEQ ID NO: 4031644 - DNA, 16 bp, Homo sapiens
agccatcctccctcca

SEQ ID NO: 4031645 - DNA, 23 bp, Homo sapiens
agccatctcatgaggggagagga

SEQ ID NO: 4031646 - DNA, 15 bp, Homo sapiens
agccatgcccgcatt

SEQ ID NO: 4031647 - DNA, 13 bp, Homo sapiens
agccatggctggg

SEQ ID NO: 4031648 - DNA, 15 bp, Homo sapiens
agccatgtataaatg

SEQ ID NO: 4031649 - DNA, 16 bp, Homo sapiens
agccatgtataaatgt

SEQ ID NO: 4031650 - DNA, 16 bp, Homo sapiens
agccatgtccaagttc

SEQ ID NO: 4031651 - DNA, 21 bp, Homo sapiens
agccatgtccaagttcttcac

SEQ ID NO: 4031652 - DNA, 23 bp, Homo sapiens
agccatgtccaagttcttcacct

SEQ ID NO: 4031653 - DNA, 15 bp, Homo sapiens
agccattgaccaccc

SEQ ID NO: 4031654 - DNA, 16 bp, Homo sapiens
agccattgcggcccca

SEQ ID NO: 4031655 - DNA, 19 bp, Homo sapiens
agccattgcggccccagga

SEQ ID NO: 4031656 - DNA, 20 bp, Homo sapiens
agccattgcggccccaggag

SEQ ID NO: 4031657 - DNA, 21 bp, Homo sapiens
agccattgcggccccaggagg

SEQ ID NO: 4031658 - DNA, 15 bp, Homo sapiens
agcccaaaacccagg

SEQ ID NO: 4031659 - DNA, 16 bp, Homo sapiens
agcccaaaacccaggg

SEQ ID NO: 4031660 - DNA, 15 bp, Homo sapiens
agcccaagcttccct

SEQ ID NO: 4031661 - DNA, 19 bp, Homo sapiens
agcccaagcttccctccat

SEQ ID NO: 4031662 - DNA, 15 bp, Homo sapiens
agcccacacttgaga

SEQ ID NO: 4031663 - DNA, 23 bp, Homo sapiens
agcccacattggattcatcagca

SEQ ID NO: 4031664 - DNA, 15 bp, Homo sapiens
agcccaccaggtgtc

SEQ ID NO: 4031665 - DNA, 18 bp, Homo sapiens
agcccactgtcctgggcc

SEQ ID NO: 4031666 - DNA, 20 bp, Homo sapiens
agcccactgtcctgggcctg

SEQ ID NO: 4031667 - DNA, 14 bp, Homo sapiens
agcccagactctga

SEQ ID NO: 4031668 - DNA, 15 bp, Homo sapiens
agcccagagaacagc

SEQ ID NO: 4031669 - DNA, 13 bp, Homo sapiens
agcccagagccac

SEQ ID NO: 4031670 - DNA, 15 bp, Homo sapiens
agcccagagccacct

SEQ ID NO: 4031671 - DNA, 16 bp, Homo sapiens
agcccagagccacctg

SEQ ID NO: 4031672 - DNA, 17 bp, Homo sapiens
agcccagagcctggctg

SEQ ID NO: 4031673 - DNA, 15 bp, Homo sapiens
agcccagaggtaaca

SEQ ID NO: 4031674 - DNA, 16 bp, Homo sapiens
agcccagaggtaacag

SEQ ID NO: 4031675 - DNA, 17 bp, Homo sapiens
agcccagattcccctgt

SEQ ID NO: 4031676 - DNA, 15 bp, Homo sapiens
agcccagcagggcct

SEQ ID NO: 4031677 - DNA, 20 bp, Homo sapiens
agcccagcagggcctcaaag

SEQ ID NO: 4031678 - DNA, 16 bp, Homo sapiens
agcccagcagtgtgga

SEQ ID NO: 4031679 - DNA, 12 bp, Homo sapiens
agcccagccagg

SEQ ID NO: 4031680 - DNA, 14 bp, Homo sapiens
agcccagccaggcc

SEQ ID NO: 4031681 - DNA, 20 bp, Homo sapiens
agcccagcccctactgctgt

SEQ ID NO: 4031682 - DNA, 13 bp, Homo sapiens
agcccagccctcc

SEQ ID NO: 4031683 - DNA, 14 bp, Homo sapiens
agcccagcctggga

SEQ ID NO: 4031684 - DNA, 12 bp, Homo sapiens
agcccagctcca

SEQ ID NO: 4031685 - DNA, 15 bp, Homo sapiens
agcccagctgggtca

SEQ ID NO: 4031686 - DNA, 17 bp, Homo sapiens
agcccagctgggtcagg

SEQ ID NO: 4031687 - DNA, 19 bp, Homo sapiens
agcccagctgggtcaggca

SEQ ID NO: 4031688 - DNA, 12 bp, Homo sapiens
agcccaggaggg

SEQ ID NO: 4031689 - DNA, 19 bp, Homo sapiens
agcccagggcatcttgctg

SEQ ID NO: 4031690 - DNA, 23 bp, Homo sapiens
agcccaggtcctctgatacccag

SEQ ID NO: 4031691 - DNA, 22 bp, Homo sapiens
agcccaggtgccagcctgaggc

SEQ ID NO: 4031692 - DNA, 14 bp, Homo sapiens
agcccagtgaagcc

SEQ ID NO: 4031693 - DNA, 15 bp, Homo sapiens
agcccagtgaagcct

SEQ ID NO: 4031694 - DNA, 18 bp, Homo sapiens
agcccagtgaagcctctg

SEQ ID NO: 4031695 - DNA, 16 bp, Homo sapiens
agcccatactcagcct

SEQ ID NO: 4031696 - DNA, 18 bp, Homo sapiens
agcccatactcagcctgc

SEQ ID NO: 4031697 - DNA, 20 bp, Homo sapiens
agcccatactcagcctgctg

SEQ ID NO: 4031698 - DNA, 20 bp, Homo sapiens
agcccatccattaggccagc

SEQ ID NO: 4031699 - DNA, 18 bp, Homo sapiens
agcccatccttccctttg

SEQ ID NO: 4031700 - DNA, 21 bp, Homo sapiens
agccccaaattgtcacctgct

SEQ ID NO: 4031701 - DNA, 12 bp, Homo sapiens
agccccacacag

SEQ ID NO: 4031702 - DNA, 17 bp, Homo sapiens
agccccacagtggaatt

SEQ ID NO: 4031703 - DNA, 20 bp, Homo sapiens
agccccacccaggagggagg

SEQ ID NO: 4031704 - DNA, 19 bp, Homo sapiens
agccccacctctccaagtc

SEQ ID NO: 4031705 - DNA, 14 bp, Homo sapiens
agccccagaagaaa

SEQ ID NO: 4031706 - DNA, 12 bp, Homo sapiens
agccccagcact

SEQ ID NO: 4031707 - DNA, 18 bp, Homo sapiens
agccccagcagccctcaa

SEQ ID NO: 4031708 - DNA, 20 bp, Homo sapiens
agccccagcagccctcaaca

SEQ ID NO: 4031709 - DNA, 18 bp, Homo sapiens
agccccagggatcactgg

SEQ ID NO: 4031710 - DNA, 18 bp, Homo sapiens
agccccagggtcttccct

SEQ ID NO: 4031711 - DNA, 19 bp, Homo sapiens
agccccatcagaacctgag

SEQ ID NO: 4031712 - DNA, 20 bp, Homo sapiens
agccccatcagaacctgagc

SEQ ID NO: 4031713 - DNA, 15 bp, Homo sapiens
agccccatccctgtc

SEQ ID NO: 4031714 - DNA, 17 bp, Homo sapiens
agccccatcggccaaga

SEQ ID NO: 4031715 - DNA, 19 bp, Homo sapiens
agcccccagatagagctgg

SEQ ID NO: 4031716 - DNA, 17 bp, Homo sapiens
agcccccagcagaggca

SEQ ID NO: 4031717 - DNA, 23 bp, Homo sapiens
agcccccagcagaggcaggctgg

SEQ ID NO: 4031718 - DNA, 18 bp, Homo sapiens
agcccccagcccctcccc

SEQ ID NO: 4031719 - DNA, 18 bp, Homo sapiens
agcccccagggcctccag

SEQ ID NO: 4031720 - DNA, 13 bp, Homo sapiens
agccccccagcac

SEQ ID NO: 4031721 - DNA, 17 bp, Homo sapiens
agccccctccacaccag

SEQ ID NO: 4031722 - DNA, 14 bp, Homo sapiens
agccccctcttccc

SEQ ID NO: 4031723 - DNA, 15 bp, Homo sapiens
agccccctcttccct

SEQ ID NO: 4031724 - DNA, 16 bp, Homo sapiens
agcccccttgacaccg

SEQ ID NO: 4031725 - DNA, 16 bp, Homo sapiens
agccccggcaagccac

SEQ ID NO: 4031726 - DNA, 18 bp, Homo sapiens
agccccggccctgggctc

SEQ ID NO: 4031727 - DNA, 19 bp, Homo sapiens
agccccggtggctgggcag

SEQ ID NO: 4031728 - DNA, 16 bp, Homo sapiens
agccccgtctgcccac

SEQ ID NO: 4031729 - DNA, 18 bp, Homo sapiens
agccccgtctgcccacca

SEQ ID NO: 4031730 - DNA, 15 bp, Homo sapiens
agcccctactgctgt

SEQ ID NO: 4031731 - DNA, 18 bp, Homo sapiens
agcccctcccccatctcc

SEQ ID NO: 4031732 - DNA, 12 bp, Homo sapiens
agcccctgtccc

SEQ ID NO: 4031733 - DNA, 20 bp, Homo sapiens
agcccctgtttactggttct

SEQ ID NO: 4031734 - DNA, 22 bp, Homo sapiens
agccccttcgggagcagggctg

SEQ ID NO: 4031735 - DNA, 14 bp, Homo sapiens
agccccttctccca

SEQ ID NO: 4031736 - DNA, 22 bp, Homo sapiens
agccccttctgctcagctctgg

SEQ ID NO: 4031737 - DNA, 23 bp, Homo sapiens
agcccctttttcatatgttgctc

SEQ ID NO: 4031738 - DNA, 11 bp, Homo sapiens
agcccggcctg

SEQ ID NO: 4031739 - DNA, 18 bp, Homo sapiens
agcccggcgcccctgcca

SEQ ID NO: 4031740 - DNA, 21 bp, Homo sapiens
agcccggcgcccctgccacct

SEQ ID NO: 4031741 - DNA, 22 bp, Homo sapiens
agcccggcgcccctgccacctc

SEQ ID NO: 4031742 - DNA, 15 bp, Homo sapiens
agcccgtctcagtgt

SEQ ID NO: 4031743 - DNA, 16 bp, Homo sapiens
agcccgttagccccag

SEQ ID NO: 4031744 - DNA, 22 bp, Homo sapiens
agccctaaaattccactgcgtt

SEQ ID NO: 4031745 - DNA, 22 bp, Homo sapiens
agccctaagtggctgccttctt

SEQ ID NO: 4031746 - DNA, 15 bp, Homo sapiens
agccctacagagctg

SEQ ID NO: 4031747 - DNA, 18 bp, Homo sapiens
agccctacagagctgtgg

SEQ ID NO: 4031748 - DNA, 17 bp, Homo sapiens
agccctcaacaggccca

SEQ ID NO: 4031749 - DNA, 20 bp, Homo sapiens
agccctcaacaggcccaggg

SEQ ID NO: 4031750 - DNA, 21 bp, Homo sapiens
agccctccccatggagccagc

SEQ ID NO: 4031751 - DNA, 14 bp, Homo sapiens
agccctccccctca

SEQ ID NO: 4031752 - DNA, 23 bp, Homo sapiens
agccctccccctcaacctcacca

SEQ ID NO: 4031753 - DNA, 21 bp, Homo sapiens
agccctcttgggggcactgct

SEQ ID NO: 4031754 - DNA, 15 bp, Homo sapiens
agccctgcagcccaa

SEQ ID NO: 4031755 - DNA, 18 bp, Homo sapiens
agccctgcagcccaccag

SEQ ID NO: 4031756 - DNA, 22 bp, Homo sapiens
agccctgcagcccaccagacgt

SEQ ID NO: 4031757 - DNA, 11 bp, Homo sapiens
agccctgctcc

SEQ ID NO: 4031758 - DNA, 20 bp, Homo sapiens
agccctgctttgggctgccc

SEQ ID NO: 4031759 - DNA, 21 bp, Homo sapiens
agccctgctttgggctgccct

SEQ ID NO: 4031760 - DNA, 22 bp, Homo sapiens
agccctgctttgggctgccctg

SEQ ID NO: 4031761 - DNA, 17 bp, Homo sapiens
agccctggacacccctg

SEQ ID NO: 4031762 - DNA, 21 bp, Homo sapiens
agccctggacacccctgctct

SEQ ID NO: 4031763 - DNA, 12 bp, Homo sapiens
agccctggagac

SEQ ID NO: 4031764 - DNA, 13 bp, Homo sapiens
agccctggctggg

SEQ ID NO: 4031765 - DNA, 22 bp, Homo sapiens
agccctggggactgttccaaag

SEQ ID NO: 4031766 - DNA, 22 bp, Homo sapiens
agccctgtatcgtattcacctt

SEQ ID NO: 4031767 - DNA, 14 bp, Homo sapiens
agccctgtcctggt

SEQ ID NO: 4031768 - DNA, 17 bp, Homo sapiens
agccctgttcctccctc

SEQ ID NO: 4031769 - DNA, 21 bp, Homo sapiens
agccctgttcctccctcccac

SEQ ID NO: 4031770 - DNA, 11 bp, Homo sapiens
agcccttccct

SEQ ID NO: 4031771 - DNA, 15 bp, Homo sapiens
agcccttccctgagt

SEQ ID NO: 4031772 - DNA, 17 bp, Homo sapiens
agcccttcctctgctcc

SEQ ID NO: 4031773 - DNA, 18 bp, Homo sapiens
agcccttcctctgctccc

SEQ ID NO: 4031774 - DNA, 19 bp, Homo sapiens
agcccttcctctgctcccc

SEQ ID NO: 4031775 - DNA, 12 bp, Homo sapiens
agcccttgcctc

SEQ ID NO: 4031776 - DNA, 13 bp, Homo sapiens
agcccttgcctcc

SEQ ID NO: 4031777 - DNA, 13 bp, Homo sapiens
agccgactctggc

SEQ ID NO: 4031778 - DNA, 17 bp, Homo sapiens
agccgactctggccctg

SEQ ID NO: 4031779 - DNA, 18 bp, Homo sapiens
agccgactctggccctgg

SEQ ID NO: 4031780 - DNA, 21 bp, Homo sapiens
agccgactctggccctggccc

SEQ ID NO: 4031781 - DNA, 17 bp, Homo sapiens
agccgagccgggcctgg

SEQ ID NO: 4031782 - DNA, 21 bp, Homo sapiens
agccgagccgggcctggggct

SEQ ID NO: 4031783 - DNA, 15 bp, Homo sapiens
agccgccagctggga

SEQ ID NO: 4031784 - DNA, 20 bp, Homo sapiens
agccgccattgccaccagga

SEQ ID NO: 4031785 - DNA, 22 bp, Homo sapiens
agccgccattgccaccaggaga

SEQ ID NO: 4031786 - DNA, 24 bp, Homo sapiens
agccgccctgggctgtctgtcacc

SEQ ID NO: 4031787 - DNA, 21 bp, Homo sapiens
agccgcggggaagctggcttt

SEQ ID NO: 4031788 - DNA, 16 bp, Homo sapiens
agccggcacagggtct

SEQ ID NO: 4031789 - DNA, 16 bp, Homo sapiens
agccggcttgatttcc

SEQ ID NO: 4031790 - DNA, 16 bp, Homo sapiens
agccgggagcttggct

SEQ ID NO: 4031791 - DNA, 14 bp, Homo sapiens
agccgggcccctgg

SEQ ID NO: 4031792 - DNA, 16 bp, Homo sapiens
agccgggcccctgggc

SEQ ID NO: 4031793 - DNA, 17 bp, Homo sapiens
agccgggcccctgggct

SEQ ID NO: 4031794 - DNA, 13 bp, Homo sapiens
agccgggcctggg

SEQ ID NO: 4031795 - DNA, 14 bp, Homo sapiens
agccgggctctgca

SEQ ID NO: 4031796 - DNA, 21 bp, Homo sapiens
agccggggtgtaacttcctgc

SEQ ID NO: 4031797 - DNA, 22 bp, Homo sapiens
agccggggtgtaacttcctgct

SEQ ID NO: 4031798 - DNA, 17 bp, Homo sapiens
agccggtaactgtcctg

SEQ ID NO: 4031799 - DNA, 20 bp, Homo sapiens
agccggtaactgtcctgtcc

SEQ ID NO: 4031800 - DNA, 16 bp, Homo sapiens
agccgtcgtctccctc

SEQ ID NO: 4031801 - DNA, 18 bp, Homo sapiens
agccgtgatgctcaggct

SEQ ID NO: 4031802 - DNA, 19 bp, Homo sapiens
agccgtgatgctcaggctt

SEQ ID NO: 4031803 - DNA, 20 bp, Homo sapiens
agccgtgatgctcaggcttg

SEQ ID NO: 4031804 - DNA, 17 bp, Homo sapiens
agccgtgccttcagctc

SEQ ID NO: 4031805 - DNA, 18 bp, Homo sapiens
agcctaaagtacagcctg

SEQ ID NO: 4031806 - DNA, 16 bp, Homo sapiens
agcctacagatgaact

SEQ ID NO: 4031807 - DNA, 16 bp, Homo sapiens
agcctacctgctctcc

SEQ ID NO: 4031808 - DNA, 17 bp, Homo sapiens
agcctacctgctctcca

SEQ ID NO: 4031809 - DNA, 20 bp, Homo sapiens
agcctagcggagcccagcct

SEQ ID NO: 4031810 - DNA, 21 bp, Homo sapiens
agcctagcggagcccagcctg

SEQ ID NO: 4031811 - DNA, 22 bp, Homo sapiens
agcctagcggagcccagcctgg

SEQ ID NO: 4031812 - DNA, 23 bp, Homo sapiens
agcctagcggagcccagcctggg

SEQ ID NO: 4031813 - DNA, 22 bp, Homo sapiens
agcctataagaggaatttcttt

SEQ ID NO: 4031814 - DNA, 13 bp, Homo sapiens
agcctatgttgtg

SEQ ID NO: 4031815 - DNA, 15 bp, Homo sapiens
agcctatttacctgc

SEQ ID NO: 4031816 - DNA, 21 bp, Homo sapiens
agcctatttacctgcaggctg

SEQ ID NO: 4031817 - DNA, 20 bp, Homo sapiens
agcctcacccggtgacctct

SEQ ID NO: 4031818 - DNA, 13 bp, Homo sapiens
agcctcactgata

SEQ ID NO: 4031819 - DNA, 16 bp, Homo sapiens
agcctcacttgaatgt

SEQ ID NO: 4031820 - DNA, 17 bp, Homo sapiens
agcctcacttgaatgtg

SEQ ID NO: 4031821 - DNA, 12 bp, Homo sapiens
agcctcagagtg

SEQ ID NO: 4031822 - DNA, 19 bp, Homo sapiens
agcctcatatttaaagaca

SEQ ID NO: 4031823 - DNA, 22 bp, Homo sapiens
agcctcatgccaaccctgggct

SEQ ID NO: 4031824 - DNA, 12 bp, Homo sapiens
agcctccagcct

SEQ ID NO: 4031825 - DNA, 21 bp, Homo sapiens
agcctttgaataaaaatgcac

SEQ ID NO: 4031826 - DNA, 17 bp, Homo sapiens
agccttttcacccttct

SEQ ID NO: 4031827 - DNA, 18 bp, Homo sapiens
agccttttccctctttgg

SEQ ID NO: 4031828 - DNA, 13 bp, Homo sapiens
agccttttgctct

SEQ ID NO: 4031829 - DNA, 14 bp, Homo sapiens
agccttttgctctc

SEQ ID NO: 4031830 - DNA, 15 bp, Homo sapiens
agccttttgctctct

SEQ ID NO: 4031831 - DNA, 14 bp, Homo sapiens
agcgaagcagagag

SEQ ID NO: 4031832 - DNA, 15 bp, Homo sapiens
agcgaagcagagagg

SEQ ID NO: 4031833 - DNA, 20 bp, Homo sapiens
agcgaatgctaggtctcgga

SEQ ID NO: 4031834 - DNA, 19 bp, Homo sapiens
agcgattattatctaaagt

SEQ ID NO: 4031835 - DNA, 20 bp, Homo sapiens
agcgccaagtgcgtgccgtg

SEQ ID NO: 4031836 - DNA, 14 bp, Homo sapiens
agcgcccctgctgt

SEQ ID NO: 4031837 - DNA, 15 bp, Homo sapiens
agcgcccctgctgtc

SEQ ID NO: 4031838 - DNA, 21 bp, Homo sapiens
cctttaatcaggtcctgctca

SEQ ID NO: 4031839 - DNA, 19 bp, Homo sapiens
cctttaccctctttgctgc

SEQ ID NO: 4031840 - DNA, 19 bp, Homo sapiens
cctttacgtgtttaaaaaa

SEQ ID NO: 4031841 - DNA, 15 bp, Homo sapiens
cctttacttgacctc

SEQ ID NO: 4031842 - DNA, 13 bp, Homo sapiens
cctttatactgtg

SEQ ID NO: 4031843 - DNA, 15 bp, Homo sapiens
cctttatactgtgaa

SEQ ID NO: 4031844 - DNA, 13 bp, Homo sapiens
cctttcccaccct

SEQ ID NO: 4031845 - DNA, 16 bp, Homo sapiens
cctttcccaccctcct

SEQ ID NO: 4031846 - DNA, 17 bp, Homo sapiens
cctttcccaccctcctg

SEQ ID NO: 4031847 - DNA, 21 bp, Homo sapiens
cctttcccaccctcctgcccc

SEQ ID NO: 4031848 - DNA, 23 bp, Homo sapiens
cctttcccaccctcctgccccac

SEQ ID NO: 4031849 - DNA, 16 bp, Homo sapiens
cctttccccagcatca

SEQ ID NO: 4031850 - DNA, 17 bp, Homo sapiens
cctttccccagcatcac

SEQ ID NO: 4031851 - DNA, 21 bp, Homo sapiens
cctttccccagcatcactccc

SEQ ID NO: 4031852 - DNA, 18 bp, Homo sapiens
cctttcccccttctctta

SEQ ID NO: 4031853 - DNA, 13 bp, Homo sapiens
cctttcccttggt

SEQ ID NO: 4031854 - DNA, 17 bp, Homo sapiens
cctttccgcggagccct

SEQ ID NO: 4031855 - DNA, 11 bp, Homo sapiens
cctttcctgtc

SEQ ID NO: 4031856 - DNA, 14 bp, Homo sapiens
cctttcctgtccca

SEQ ID NO: 4031857 - DNA, 13 bp, Homo sapiens
cctttccttccct

SEQ ID NO: 4031858 - DNA, 21 bp, Homo sapiens
cctttcggcagaggaaccccc

SEQ ID NO: 4031859 - DNA, 23 bp, Homo sapiens
cctttcggcagaggaacccccac

SEQ ID NO: 4031860 - DNA, 14 bp, Homo sapiens
cctttctacaactg

SEQ ID NO: 4031861 - DNA, 13 bp, Homo sapiens
cctttctccagcc

SEQ ID NO: 4031862 - DNA, 16 bp, Homo sapiens
cctttctccagccagc

SEQ ID NO: 4031863 - DNA, 17 bp, Homo sapiens
cctttctccagccagca

SEQ ID NO: 4031864 - DNA, 22 bp, Homo sapiens
cctttctctctttatacagctg

SEQ ID NO: 4031865 - DNA, 20 bp, Homo sapiens
cctttctcttttcccctttc

SEQ ID NO: 4031866 - DNA, 18 bp, Homo sapiens
cctttctgcccacttccc

SEQ ID NO: 4031867 - DNA, 14 bp, Homo sapiens
cctttctgtgccct

SEQ ID NO: 4031868 - DNA, 10 bp, Homo sapiens
cctttcttcc

SEQ ID NO: 4031869 - DNA, 19 bp, Homo sapiens
cctttcttcctcattccct

SEQ ID NO: 4031870 - DNA, 17 bp, Homo sapiens
cctttcttctcccccat

SEQ ID NO: 4031871 - DNA, 13 bp, Homo sapiens
cctttcttggttc

SEQ ID NO: 4031872 - DNA, 13 bp, Homo sapiens
cctttctttgcct

SEQ ID NO: 4031873 - DNA, 14 bp, Homo sapiens
cctttctttgcctc

SEQ ID NO: 4031874 - DNA, 17 bp, Homo sapiens
cctttctttgcctctgc

SEQ ID NO: 4031875 - DNA, 18 bp, Homo sapiens
cctttctttgcctctgca

SEQ ID NO: 4031876 - DNA, 12 bp, Homo sapiens
cctttcttttcc

SEQ ID NO: 4031877 - DNA, 15 bp, Homo sapiens
cctttgacaaaagta

SEQ ID NO: 4031878 - DNA, 14 bp, Homo sapiens
cctttgacatttaa

SEQ ID NO: 4031879 - DNA, 13 bp, Homo sapiens
cctttgacttcag

SEQ ID NO: 4031880 - DNA, 14 bp, Homo sapiens
cctttgacttcagc

SEQ ID NO: 4031881 - DNA, 17 bp, Homo sapiens
cctttgagacagtttct

SEQ ID NO: 4031882 - DNA, 17 bp, Homo sapiens
cctttgcaagatgcttg

SEQ ID NO: 4031883 - DNA, 20 bp, Homo sapiens
cctttgcaagatgcttggtt

SEQ ID NO: 4031884 - DNA, 14 bp, Homo sapiens
cctttgcactgagg

SEQ ID NO: 4031885 - DNA, 18 bp, Homo sapiens
cctttgcactgagggcca

SEQ ID NO: 4031886 - DNA, 19 bp, Homo sapiens
cctttgcactgagggccac

SEQ ID NO: 4031887 - DNA, 15 bp, Homo sapiens
cctttgcagggcagc

SEQ ID NO: 4031888 - DNA, 17 bp, Homo sapiens
cctttgcagggcagccc

SEQ ID NO: 4031889 - DNA, 21 bp, Homo sapiens
cctttgcctttcttctgccct

SEQ ID NO: 4031890 - DNA, 23 bp, Homo sapiens
cctttgctgtgaggctgtcctgt

SEQ ID NO: 4031891 - DNA, 16 bp, Homo sapiens
cctttggatgaccaga

SEQ ID NO: 4031892 - DNA, 15 bp, Homo sapiens
cctttggccttggct

SEQ ID NO: 4031893 - DNA, 15 bp, Homo sapiens
cctttggttctggcc

SEQ ID NO: 4031894 - DNA, 16 bp, Homo sapiens
cctttgtcctcctgct

SEQ ID NO: 4031895 - DNA, 21 bp, Homo sapiens
cctttgtgtgtgtgtcagctg

SEQ ID NO: 4031896 - DNA, 21 bp, Homo sapiens
ccttttagcctagttcatcca

SEQ ID NO: 4031897 - DNA, 15 bp, Homo sapiens
ccttttatctgcaga

SEQ ID NO: 4031898 - DNA, 19 bp, Homo sapiens
ccttttatctgcagaacat

SEQ ID NO: 4031899 - DNA, 13 bp, Homo sapiens
ccttttcagctga

SEQ ID NO: 4031900 - DNA, 22 bp, Homo sapiens
ccttttcagctgagccctgggg

SEQ ID NO: 4031901 - DNA, 20 bp, Homo sapiens
ccttttccagagcattccag

SEQ ID NO: 4031902 - DNA, 15 bp, Homo sapiens
ccttttccgttctgt

SEQ ID NO: 4031903 - DNA, 15 bp, Homo sapiens
ccttttctctgccct

SEQ ID NO: 4031904 - DNA, 14 bp, Homo sapiens
ccttttctgtgttt

SEQ ID NO: 4031905 - DNA, 11 bp, Homo sapiens
ccttttcttca

SEQ ID NO: 4031906 - DNA, 22 bp, Homo sapiens
ccttttctttttcccttgaact

SEQ ID NO: 4031907 - DNA, 23 bp, Homo sapiens
ccttttgaggagccccagctacc

SEQ ID NO: 4031908 - DNA, 19 bp, Homo sapiens
ccttttgcagaagagggtg

SEQ ID NO: 4031909 - DNA, 19 bp, Homo sapiens
ccttttgctctctgtgacc

SEQ ID NO: 4031910 - DNA, 21 bp, Homo sapiens
ccttttggtgaaagctgagaa

SEQ ID NO: 4031911 - DNA, 14 bp, Homo sapiens
cctttttccatcat

SEQ ID NO: 4031912 - DNA, 14 bp, Homo sapiens
cctttttctgagat

SEQ ID NO: 4031913 - DNA, 20 bp, Homo sapiens
cctttttctttataaacttt

SEQ ID NO: 4031914 - DNA, 15 bp, Homo sapiens
cctttttgacactga

SEQ ID NO: 4031915 - DNA, 16 bp, Homo sapiens
cctttttgacactgaa

SEQ ID NO: 4031916 - DNA, 14 bp, Homo sapiens
cctttttgtataaa

SEQ ID NO: 4031917 - DNA, 19 bp, Homo sapiens
ccttttttaagatttttct

SEQ ID NO: 4031918 - DNA, 17 bp, Homo sapiens
cgaaacacagaaacctt

SEQ ID NO: 4031919 - DNA, 14 bp, Homo sapiens
cgaaactaagccag

SEQ ID NO: 4031920 - DNA, 10 bp, Homo sapiens
cgaaactgcc

SEQ ID NO: 4031921 - DNA, 16 bp, Homo sapiens
cgaaataaaaatggca

SEQ ID NO: 4031922 - DNA, 16 bp, Homo sapiens
cgaaataacaatgtta

SEQ ID NO: 4031923 - DNA, 17 bp, Homo sapiens
cgaaataacaatgttaa

SEQ ID NO: 4031924 - DNA, 19 bp, Homo sapiens
cgaaatgccacgtggtcac

SEQ ID NO: 4031925 - DNA, 16 bp, Homo sapiens
cgaacgacaatagctt

SEQ ID NO: 4031926 - DNA, 18 bp, Homo sapiens
cgaagaaaaaaaataaca

SEQ ID NO: 4031927 - DNA, 20 bp, Homo sapiens
cgaagaatgaacccaagagc

SEQ ID NO: 4031928 - DNA, 18 bp, Homo sapiens
cgaagaccctcttgccca

SEQ ID NO: 4031929 - DNA, 20 bp, Homo sapiens
cgaagaccctcttgcccatc

SEQ ID NO: 4031930 - DNA, 23 bp, Homo sapiens
cgaagaccctcttgcccatcctg

SEQ ID NO: 4031931 - DNA, 15 bp, Homo sapiens
cgaagtagcttgctc

SEQ ID NO: 4031932 - DNA, 21 bp, Homo sapiens
cgaagtagcttgctccctgtg

SEQ ID NO: 4031933 - DNA, 17 bp, Homo sapiens
cgaatctactaattcca

SEQ ID NO: 4031934 - DNA, 14 bp, Homo sapiens
cgacaaatctgtct

SEQ ID NO: 4031935 - DNA, 15 bp, Homo sapiens
cgacaaatctgtctg

SEQ ID NO: 4031936 - DNA, 18 bp, Homo sapiens
cgacagagcagttgagag

SEQ ID NO: 4031937 - DNA, 12 bp, Homo sapiens
cgacagcctggc

SEQ ID NO: 4031938 - DNA, 14 bp, Homo sapiens
cgacagcgcccctg

SEQ ID NO: 4031939 - DNA, 21 bp, Homo sapiens
cgacaggcgagagaggagcca

SEQ ID NO: 4031940 - DNA, 23 bp, Homo sapiens
cgacaggcgagagaggagccaga

SEQ ID NO: 4031941 - DNA, 14 bp, Homo sapiens
cgacagggcctgga

SEQ ID NO: 4031942 - DNA, 11 bp, Homo sapiens
ccttccctctg

SEQ ID NO: 4031943 - DNA, 20 bp, Homo sapiens
ccttccctctgggcacgcct

SEQ ID NO: 4031944 - DNA, 13 bp, Homo sapiens
ccttccctgcact

SEQ ID NO: 4031945 - DNA, 18 bp, Homo sapiens
ccttcccttttctgttct

SEQ ID NO: 4031946 - DNA, 17 bp, Homo sapiens
ccttcctcatccacccc

SEQ ID NO: 4031947 - DNA, 15 bp, Homo sapiens
ccttcctctccactg

SEQ ID NO: 4031948 - DNA, 20 bp, Homo sapiens
ccttcctctccactgccttc

SEQ ID NO: 4031949 - DNA, 14 bp, Homo sapiens
ccttcctggaggct

SEQ ID NO: 4031950 - DNA, 19 bp, Homo sapiens
ccttcctggaggctgccta

SEQ ID NO: 4031951 - DNA, 16 bp, Homo sapiens
ccttcctggcctgaga

SEQ ID NO: 4031952 - DNA, 14 bp, Homo sapiens
ccttcctgtccctg

SEQ ID NO: 4031953 - DNA, 23 bp, Homo sapiens
ccttcctgtgggtgttctttcct

SEQ ID NO: 4031954 - DNA, 16 bp, Homo sapiens
ccttccttcccgccag

SEQ ID NO: 4031955 - DNA, 16 bp, Homo sapiens
ccttcctttctccagg

SEQ ID NO: 4031956 - DNA, 19 bp, Homo sapiens
ccttcctttctccaggacc

SEQ ID NO: 4031957 - DNA, 13 bp, Homo sapiens
ccttccttttccc

SEQ ID NO: 4031958 - DNA, 16 bp, Homo sapiens
ccttccttttccctgc

SEQ ID NO: 4031959 - DNA, 21 bp, Homo sapiens
ccttccttttccctgcttcca

SEQ ID NO: 4031960 - DNA, 22 bp, Homo sapiens
ccttcgtgaacatcccctccca

SEQ ID NO: 4031961 - DNA, 20 bp, Homo sapiens
ccttctaacatgttatcaaa

SEQ ID NO: 4031962 - DNA, 15 bp, Homo sapiens
ccttctactcccctt

SEQ ID NO: 4031963 - DNA, 19 bp, Homo sapiens
ccttctcattacccacccg

SEQ ID NO: 4031964 - DNA, 19 bp, Homo sapiens
ccttctcctctctgggcct

SEQ ID NO: 4031965 - DNA, 16 bp, Homo sapiens
ccttctccttccccag

SEQ ID NO: 4031966 - DNA, 22 bp, Homo sapiens
ccttctctattgggcacagcct

SEQ ID NO: 4031967 - DNA, 17 bp, Homo sapiens
ccttctctcctccccaa

SEQ ID NO: 4031968 - DNA, 18 bp, Homo sapiens
ccttctctgaacacaggc

SEQ ID NO: 4031969 - DNA, 17 bp, Homo sapiens
ccttctctgctccacca

SEQ ID NO: 4031970 - DNA, 22 bp, Homo sapiens
ccttctctgctccaccacatcc

SEQ ID NO: 4031971 - DNA, 17 bp, Homo sapiens
ccttctcttccaggcag

SEQ ID NO: 4031972 - DNA, 13 bp, Homo sapiens
ccttctgatgtct

SEQ ID NO: 4031973 - DNA, 17 bp, Homo sapiens
ccttctgctcagctctg

SEQ ID NO: 4031974 - DNA, 20 bp, Homo sapiens
ccttctgctggataaaatga

SEQ ID NO: 4031975 - DNA, 18 bp, Homo sapiens
ccttctggcctctgctga

SEQ ID NO: 4031976 - DNA, 11 bp, Homo sapiens
ccttctggctg

SEQ ID NO: 4031977 - DNA, 16 bp, Homo sapiens
ccttctgtccccagcc

SEQ ID NO: 4031978 - DNA, 19 bp, Homo sapiens
ccttcttcacccagctaat

SEQ ID NO: 4031979 - DNA, 17 bp, Homo sapiens
ccttcttgggccccaga

SEQ ID NO: 4031980 - DNA, 14 bp, Homo sapiens
ccttctttgaagaa

SEQ ID NO: 4031981 - DNA, 18 bp, Homo sapiens
ccttctttgataatgtta

SEQ ID NO: 4031982 - DNA, 16 bp, Homo sapiens
ccttgaacctgtgagt

SEQ ID NO: 4031983 - DNA, 17 bp, Homo sapiens
ccttgaacctgtgagta

SEQ ID NO: 4031984 - DNA, 18 bp, Homo sapiens
ccttgaagaacctctcac

SEQ ID NO: 4031985 - DNA, 15 bp, Homo sapiens
ccttgaatgctgcca

SEQ ID NO: 4031986 - DNA, 16 bp, Homo sapiens
ccttgaatgctgccag

SEQ ID NO: 4031987 - DNA, 18 bp, Homo sapiens
ccttgaatgctgccagtg

SEQ ID NO: 4031988 - DNA, 19 bp, Homo sapiens
ccttgaatgctgccagtgt

SEQ ID NO: 4031989 - DNA, 20 bp, Homo sapiens
ccttgaatgctgccagtgtg

SEQ ID NO: 4031990 - DNA, 22 bp, Homo sapiens
ccttgaatgctgccagtgtgga

SEQ ID NO: 4031991 - DNA, 14 bp, Homo sapiens
ccttgacacctgct

SEQ ID NO: 4031992 - DNA, 20 bp, Homo sapiens
ccttgacgtcaagtctcctt

SEQ ID NO: 4031993 - DNA, 14 bp, Homo sapiens
ccttgagccctggc

SEQ ID NO: 4031994 - DNA, 21 bp, Homo sapiens
ccttgaggggagccaggaggg

SEQ ID NO: 4031995 - DNA, 23 bp, Homo sapiens
ccttgaggtcttttgacatgtgg

SEQ ID NO: 4031996 - DNA, 22 bp, Homo sapiens
ccttgagtggggttatctctgt

SEQ ID NO: 4031997 - DNA, 23 bp, Homo sapiens
ccttgcaaagaccataaagtcca

SEQ ID NO: 4031998 - DNA, 15 bp, Homo sapiens
ccttgcagctagttt

SEQ ID NO: 4031999 - DNA, 19 bp, Homo sapiens
ccttgcaggggtcccccct

SEQ ID NO: 4032000 - DNA, 23 bp, Homo sapiens
ccttgcagttcagcaccacccta

SEQ ID NO: 4032001 - DNA, 17 bp, Homo sapiens
ccttgccaccccaccct

SEQ ID NO: 4032002 - DNA, 19 bp, Homo sapiens
ccttgccaccccaccctcc

SEQ ID NO: 4032003 - DNA, 24 bp, Homo sapiens
ccttgccaccccaccctccctgga

SEQ ID NO: 4032004 - DNA, 20 bp, Homo sapiens
ccttgcccagactacagggc

SEQ ID NO: 4032005 - DNA, 17 bp, Homo sapiens
ccttgcctccccatttc

SEQ ID NO: 4032006 - DNA, 19 bp, Homo sapiens
ccttgcctttcgaggcctg

SEQ ID NO: 4032007 - DNA, 21 bp, Homo sapiens
ccttgcgcctcagccctcagt

SEQ ID NO: 4032008 - DNA, 14 bp, Homo sapiens
ccttgctaattttc

SEQ ID NO: 4032009 - DNA, 16 bp, Homo sapiens
ccttgctgatggcttg

SEQ ID NO: 4032010 - DNA, 22 bp, Homo sapiens
ccttgctggacggggactgggg

SEQ ID NO: 4032011 - DNA, 12 bp, Homo sapiens
ccttgcttctgt

SEQ ID NO: 4032012 - DNA, 20 bp, Homo sapiens
ccttgcttctgtatttcctt

SEQ ID NO: 4032013 - DNA, 12 bp, Homo sapiens
ccttgcttgtta

SEQ ID NO: 4032014 - DNA, 23 bp, Homo sapiens
ccttggaaatagaaagaagccat

SEQ ID NO: 4032015 - DNA, 17 bp, Homo sapiens
ccttggaaccagcccca

SEQ ID NO: 4032016 - DNA, 17 bp, Homo sapiens
ccttggattttcctgaa

SEQ ID NO: 4032017 - DNA, 21 bp, Homo sapiens
ccttggcaccagacacccagg

SEQ ID NO: 4032018 - DNA, 16 bp, Homo sapiens
ccttggcatagacatg

SEQ ID NO: 4032019 - DNA, 13 bp, Homo sapiens
ccttggcccctcg

SEQ ID NO: 4032020 - DNA, 13 bp, Homo sapiens
ccttggcctcaga

SEQ ID NO: 4032021 - DNA, 23 bp, Homo sapiens
ccttggcctgtctcatccccagg

SEQ ID NO: 4032022 - DNA, 15 bp, Homo sapiens
ccttggctcagacat

SEQ ID NO: 4032023 - DNA, 14 bp, Homo sapiens
ccttggctctgcca

SEQ ID NO: 4032024 - DNA, 17 bp, Homo sapiens
ccttggcttacctgacc

SEQ ID NO: 4032025 - DNA, 19 bp, Homo sapiens
ccttggctttatgcacatt

SEQ ID NO: 4032026 - DNA, 15 bp, Homo sapiens
ccttgggacagccag

SEQ ID NO: 4032027 - DNA, 21 bp, Homo sapiens
ccttgggacagccagagctgg

SEQ ID NO: 4032028 - DNA, 18 bp, Homo sapiens
ccttgggcctgggcctct

SEQ ID NO: 4032029 - DNA, 18 bp, Homo sapiens
ccttgggccttgctgctg

SEQ ID NO: 4032030 - DNA, 17 bp, Homo sapiens
ccttgggctgctcctca

SEQ ID NO: 4032031 - DNA, 15 bp, Homo sapiens
ccttgggggctccca

SEQ ID NO: 4032032 - DNA, 21 bp, Homo sapiens
ccttgggtatttgcaatattc

SEQ ID NO: 4032033 - DNA, 19 bp, Homo sapiens
ccttggtgtgaccctctga

SEQ ID NO: 4032034 - DNA, 16 bp, Homo sapiens
ccttgtaattctaaat

SEQ ID NO: 4032035 - DNA, 16 bp, Homo sapiens
ccttgtacagtgtctg

SEQ ID NO: 4032036 - DNA, 14 bp, Homo sapiens
ccttgtccacccac

SEQ ID NO: 4032037 - DNA, 20 bp, Homo sapiens
ccttgtctcctactcctgac

SEQ ID NO: 4032038 - DNA, 16 bp, Homo sapiens
ccttgtgtatatttgt

SEQ ID NO: 4032039 - DNA, 21 bp, Homo sapiens
ccttgtttgagtttttcctcc

SEQ ID NO: 4032040 - DNA, 16 bp, Homo sapiens
ccttgttttggacagt

SEQ ID NO: 4032041 - DNA, 19 bp, Homo sapiens
cctttaacacagaccccta

SEQ ID NO: 4032042 - DNA, 19 bp, Homo sapiens
cctttaacttttttttctc

SEQ ID NO: 4032043 - DNA, 20 bp, Homo sapiens
cctttaagatatccatcttt

SEQ ID NO: 4032044 - DNA, 19 bp, Homo sapiens
cctttaatcaggtcctgct

SEQ ID NO: 4032045 - DNA, 13 bp, Homo sapiens
cctgtgggtcccc

SEQ ID NO: 4032046 - DNA, 22 bp, Homo sapiens
cctgtgggtccccactcacccc

SEQ ID NO: 4032047 - DNA, 18 bp, Homo sapiens
cctgtgggtgtagccagg

SEQ ID NO: 4032048 - DNA, 22 bp, Homo sapiens
cctgtgggtgttctttcctgcc

SEQ ID NO: 4032049 - DNA, 16 bp, Homo sapiens
cctgtggttacagtgc

SEQ ID NO: 4032050 - DNA, 21 bp, Homo sapiens
cctgtggttacagtgcagaca

SEQ ID NO: 4032051 - DNA, 23 bp, Homo sapiens
cctgtggttacagtgcagacagg

SEQ ID NO: 4032052 - DNA, 20 bp, Homo sapiens
cctgtgtatggaaaaaccat

SEQ ID NO: 4032053 - DNA, 18 bp, Homo sapiens
cctgtgtattcaccacca

SEQ ID NO: 4032054 - DNA, 18 bp, Homo sapiens
cctgtgtccacctgtggg

SEQ ID NO: 4032055 - DNA, 19 bp, Homo sapiens
cctgtgtccacctgtgggt

SEQ ID NO: 4032056 - DNA, 13 bp, Homo sapiens
cctgtgtcctgaa

SEQ ID NO: 4032057 - DNA, 16 bp, Homo sapiens
cctgtgtgtaggctgg

SEQ ID NO: 4032058 - DNA, 21 bp, Homo sapiens
cctgtgtgtgaaaggaagctc

SEQ ID NO: 4032059 - DNA, 22 bp, Homo sapiens
cctgttaaacagtagttgtatt

SEQ ID NO: 4032060 - DNA, 14 bp, Homo sapiens
cctgttacttacct

SEQ ID NO: 4032061 - DNA, 16 bp, Homo sapiens
cctgttagcagacagg

SEQ ID NO: 4032062 - DNA, 17 bp, Homo sapiens
cctgttatgtatgaagg

SEQ ID NO: 4032063 - DNA, 21 bp, Homo sapiens
cctgttcacagaaaaagcatg

SEQ ID NO: 4032064 - DNA, 16 bp, Homo sapiens
cctgttcacgctcacc

SEQ ID NO: 4032065 - DNA, 19 bp, Homo sapiens
cctgttcacgctcacccag

SEQ ID NO: 4032066 - DNA, 21 bp, Homo sapiens
cctgttcactctacttagcat

SEQ ID NO: 4032067 - DNA, 17 bp, Homo sapiens
cctgttcccctcactgg

SEQ ID NO: 4032068 - DNA, 12 bp, Homo sapiens
cctgttctaagg

SEQ ID NO: 4032069 - DNA, 21 bp, Homo sapiens
cctgttctaagggggagggga

SEQ ID NO: 4032070 - DNA, 12 bp, Homo sapiens
cctgttcttcct

SEQ ID NO: 4032071 - DNA, 13 bp, Homo sapiens
cctgttcttcctc

SEQ ID NO: 4032072 - DNA, 20 bp, Homo sapiens
cctgttcttcctccagctgc

SEQ ID NO: 4032073 - DNA, 19 bp, Homo sapiens
cctgttgctatagagccta

SEQ ID NO: 4032074 - DNA, 18 bp, Homo sapiens
cctgtttataatctgaag

SEQ ID NO: 4032075 - DNA, 19 bp, Homo sapiens
cctgtttattcccatcttt

SEQ ID NO: 4032076 - DNA, 18 bp, Homo sapiens
cctgtttcagaccccccc

SEQ ID NO: 4032077 - DNA, 18 bp, Homo sapiens
cctgttttgttggaaggt

SEQ ID NO: 4032078 - DNA, 18 bp, Homo sapiens
cctgtttttaagctgttt

SEQ ID NO: 4032079 - DNA, 13 bp, Homo sapiens
ccttaaaaatcac

SEQ ID NO: 4032080 - DNA, 15 bp, Homo sapiens
ccttaaaaccaaaga

SEQ ID NO: 4032081 - DNA, 13 bp, Homo sapiens
ccttaaaatggaa

SEQ ID NO: 4032082 - DNA, 18 bp, Homo sapiens
ccttaacccacctctcct

SEQ ID NO: 4032083 - DNA, 19 bp, Homo sapiens
ccttaagccataggcccag

SEQ ID NO: 4032084 - DNA, 14 bp, Homo sapiens
ccttaatctaatct

SEQ ID NO: 4032085 - DNA, 19 bp, Homo sapiens
ccttaatctaatctaaaag

SEQ ID NO: 4032086 - DNA, 23 bp, Homo sapiens
ccttaatctaatctaaaagctct

SEQ ID NO: 4032087 - DNA, 19 bp, Homo sapiens
ccttaatttcctttttgac

SEQ ID NO: 4032088 - DNA, 19 bp, Homo sapiens
ccttaatttttttttcata

SEQ ID NO: 4032089 - DNA, 22 bp, Homo sapiens
ccttacacactcaggcctgtgc

SEQ ID NO: 4032090 - DNA, 13 bp, Homo sapiens
ccttacatttgtg

SEQ ID NO: 4032091 - DNA, 20 bp, Homo sapiens
ccttaccagagacgcccagc

SEQ ID NO: 4032092 - DNA, 22 bp, Homo sapiens
ccttaccagagacgcccagccc

SEQ ID NO: 4032093 - DNA, 18 bp, Homo sapiens
ccttagaaacactgcaaa

SEQ ID NO: 4032094 - DNA, 20 bp, Homo sapiens
ccttagaacattttaattca

SEQ ID NO: 4032095 - DNA, 17 bp, Homo sapiens
ccttagactcttttcct

SEQ ID NO: 4032096 - DNA, 22 bp, Homo sapiens
ccttagcaccttcagggctgag

SEQ ID NO: 4032097 - DNA, 14 bp, Homo sapiens
ccttagcctccctg

SEQ ID NO: 4032098 - DNA, 19 bp, Homo sapiens
ccttaggcctacctgatgg

SEQ ID NO: 4032099 - DNA, 13 bp, Homo sapiens
ccttaggccttcc

SEQ ID NO: 4032100 - DNA, 14 bp, Homo sapiens
ccttaggccttcct

SEQ ID NO: 4032101 - DNA, 15 bp, Homo sapiens
ccttagttggctgga

SEQ ID NO: 4032102 - DNA, 17 bp, Homo sapiens
ccttataaaccaatctt

SEQ ID NO: 4032103 - DNA, 15 bp, Homo sapiens
ccttatatttacaat

SEQ ID NO: 4032104 - DNA, 22 bp, Homo sapiens
ccttatatttacaataaatgaa

SEQ ID NO: 4032105 - DNA, 17 bp, Homo sapiens
ccttatccaggactctg

SEQ ID NO: 4032106 - DNA, 14 bp, Homo sapiens
ccttatttgccttc

SEQ ID NO: 4032107 - DNA, 16 bp, Homo sapiens
ccttatttgccttcta

SEQ ID NO: 4032108 - DNA, 14 bp, Homo sapiens
ccttcaacaaggct

SEQ ID NO: 4032109 - DNA, 24 bp, Homo sapiens
ccttcaactgaaaagactcagtgt

SEQ ID NO: 4032110 - DNA, 19 bp, Homo sapiens
ccttcaagaactctgggct

SEQ ID NO: 4032111 - DNA, 14 bp, Homo sapiens
ccttcacaccccag

SEQ ID NO: 4032112 - DNA, 15 bp, Homo sapiens
ccttcacaccccagg

SEQ ID NO: 4032113 - DNA, 15 bp, Homo sapiens
ccttcagaccccagt

SEQ ID NO: 4032114 - DNA, 17 bp, Homo sapiens
ccttcagaccccagttc

SEQ ID NO: 4032115 - DNA, 13 bp, Homo sapiens
ccttcagccccca

SEQ ID NO: 4032116 - DNA, 17 bp, Homo sapiens
ccttcagcccccagccc

SEQ ID NO: 4032117 - DNA, 24 bp, Homo sapiens
ccttcagtaccctctcagctccag

SEQ ID NO: 4032118 - DNA, 15 bp, Homo sapiens
ccttcatctgaaacc

SEQ ID NO: 4032119 - DNA, 17 bp, Homo sapiens
ccttcatcttcctgtgt

SEQ ID NO: 4032120 - DNA, 16 bp, Homo sapiens
ccttccacctccctcc

SEQ ID NO: 4032121 - DNA, 17 bp, Homo sapiens
ccttccacctctgggag

SEQ ID NO: 4032122 - DNA, 18 bp, Homo sapiens
ccttccacctgctctgct

SEQ ID NO: 4032123 - DNA, 12 bp, Homo sapiens
ccttccagctgc

SEQ ID NO: 4032124 - DNA, 14 bp, Homo sapiens
ccttccatacattt

SEQ ID NO: 4032125 - DNA, 12 bp, Homo sapiens
ccttccatccct

SEQ ID NO: 4032126 - DNA, 23 bp, Homo sapiens
ccttccatgtgcctttctttgcc

SEQ ID NO: 4032127 - DNA, 19 bp, Homo sapiens
ccttccattttcccccact

SEQ ID NO: 4032128 - DNA, 13 bp, Homo sapiens
ccttcccacccct

SEQ ID NO: 4032129 - DNA, 20 bp, Homo sapiens
ccttcccacccctacacaca

SEQ ID NO: 4032130 - DNA, 15 bp, Homo sapiens
ccttcccactcaccc

SEQ ID NO: 4032131 - DNA, 15 bp, Homo sapiens
ccttcccatcgctgt

SEQ ID NO: 4032132 - DNA, 15 bp, Homo sapiens
ccttcccatctcttc

SEQ ID NO: 4032133 - DNA, 18 bp, Homo sapiens
ccttcccatttctctaca

SEQ ID NO: 4032134 - DNA, 14 bp, Homo sapiens
ccttccccaggatg

SEQ ID NO: 4032135 - DNA, 17 bp, Homo sapiens
ccttcccccagcccatc

SEQ ID NO: 4032136 - DNA, 19 bp, Homo sapiens
ccttccccctgtagactag

SEQ ID NO: 4032137 - DNA, 20 bp, Homo sapiens
ccttccccctgtagactagt

SEQ ID NO: 4032138 - DNA, 15 bp, Homo sapiens
ccttcccctccctgg

SEQ ID NO: 4032139 - DNA, 18 bp, Homo sapiens
ccttcccctccctggctc

SEQ ID NO: 4032140 - DNA, 19 bp, Homo sapiens
ccttcccctccctggctcc

SEQ ID NO: 4032141 - DNA, 16 bp, Homo sapiens
ccttcccctccttctc

SEQ ID NO: 4032142 - DNA, 13 bp, Homo sapiens
ccttccccttcct

SEQ ID NO: 4032143 - DNA, 18 bp, Homo sapiens
ccttccccttctgtgtca

SEQ ID NO: 4032144 - DNA, 21 bp, Homo sapiens
ccttccccttctgtgtcacag

SEQ ID NO: 4032145 - DNA, 16 bp, Homo sapiens
ccttccctcaccccca

SEQ ID NO: 4032146 - DNA, 23 bp, Homo sapiens
ccttccctcaccttggcaccaga

SEQ ID NO: 4032147 - DNA, 15 bp, Homo sapiens
ccttccctctctgat

SEQ ID NO: 4032148 - DNA, 13 bp, Homo sapiens
cctggtctctggt

SEQ ID NO: 4032149 - DNA, 14 bp, Homo sapiens
cctggtctctggtc

SEQ ID NO: 4032150 - DNA, 17 bp, Homo sapiens
cctggtctgaggatgta

SEQ ID NO: 4032151 - DNA, 16 bp, Homo sapiens
cctggtcttgagatgt

SEQ ID NO: 4032152 - DNA, 17 bp, Homo sapiens
cctggtgaatcacctgg

SEQ ID NO: 4032153 - DNA, 19 bp, Homo sapiens
cctggtgaatcacctggct

SEQ ID NO: 4032154 - DNA, 13 bp, Homo sapiens
cctggtgctgctg

SEQ ID NO: 4032155 - DNA, 15 bp, Homo sapiens
cctggtgcttccaaa

SEQ ID NO: 4032156 - DNA, 13 bp, Homo sapiens
cctggtggcacca

SEQ ID NO: 4032157 - DNA, 14 bp, Homo sapiens
cctggtggcaccag

SEQ ID NO: 4032158 - DNA, 18 bp, Homo sapiens
cctggtggcaccagatgc

SEQ ID NO: 4032159 - DNA, 18 bp, Homo sapiens
cctggtggtcagatgcag

SEQ ID NO: 4032160 - DNA, 22 bp, Homo sapiens
cctggttccttcctatgcccag

SEQ ID NO: 4032161 - DNA, 13 bp, Homo sapiens
cctggtttaattc

SEQ ID NO: 4032162 - DNA, 15 bp, Homo sapiens
cctggttttgtacac

SEQ ID NO: 4032163 - DNA, 20 bp, Homo sapiens
cctggttttgtacactgctg

SEQ ID NO: 4032164 - DNA, 22 bp, Homo sapiens
cctggttttgtacactgctgta

SEQ ID NO: 4032165 - DNA, 15 bp, Homo sapiens
cctggtttttctcaa

SEQ ID NO: 4032166 - DNA, 19 bp, Homo sapiens
cctgtaacaggtgtgggga

SEQ ID NO: 4032167 - DNA, 19 bp, Homo sapiens
cctgtaagcctgcaagcct

SEQ ID NO: 4032168 - DNA, 15 bp, Homo sapiens
cctgtaatcccagct

SEQ ID NO: 4032169 - DNA, 12 bp, Homo sapiens
cctgtacactga

SEQ ID NO: 4032170 - DNA, 16 bp, Homo sapiens
cctgtacctcatccca

SEQ ID NO: 4032171 - DNA, 22 bp, Homo sapiens
cctgtaccttttgaggagcccc

SEQ ID NO: 4032172 - DNA, 20 bp, Homo sapiens
cctgtactgttctgtgtctt

SEQ ID NO: 4032173 - DNA, 22 bp, Homo sapiens
cctgtagacctagggaggacct

SEQ ID NO: 4032174 - DNA, 18 bp, Homo sapiens
cctgtagatgcagaaaaa

SEQ ID NO: 4032175 - DNA, 23 bp, Homo sapiens
cctgtagatgcagaaaaagaaaa

SEQ ID NO: 4032176 - DNA, 16 bp, Homo sapiens
cctgtagccatctgca

SEQ ID NO: 4032177 - DNA, 14 bp, Homo sapiens
cctgtatacagtgc

SEQ ID NO: 4032178 - DNA, 16 bp, Homo sapiens
cctgtatacagtgcag

SEQ ID NO: 4032179 - DNA, 18 bp, Homo sapiens
cctgtatacagtgcagag

SEQ ID NO: 4032180 - DNA, 22 bp, Homo sapiens
cctgtatgtcaataaacaacag

SEQ ID NO: 4032181 - DNA, 15 bp, Homo sapiens
cctgtcaagttaaca

SEQ ID NO: 4032182 - DNA, 16 bp, Homo sapiens
cctgtcaagttaacaa

SEQ ID NO: 4032183 - DNA, 17 bp, Homo sapiens
cctgtcacccccactcc

SEQ ID NO: 4032184 - DNA, 18 bp, Homo sapiens
cctgtcacccccactccc

SEQ ID NO: 4032185 - DNA, 22 bp, Homo sapiens
cctgtccaaaagcgccctcact

SEQ ID NO: 4032186 - DNA, 12 bp, Homo sapiens
cctgtccagcct

SEQ ID NO: 4032187 - DNA, 22 bp, Homo sapiens
cctgtccagcctgggcagccag

SEQ ID NO: 4032188 - DNA, 10 bp, Homo sapiens
cctgtcccaa

SEQ ID NO: 4032189 - DNA, 12 bp, Homo sapiens
cctgtcccaccc

SEQ ID NO: 4032190 - DNA, 16 bp, Homo sapiens
cctgtcccacccacac

SEQ ID NO: 4032191 - DNA, 13 bp, Homo sapiens
cctgtcccacccc

SEQ ID NO: 4032192 - DNA, 17 bp, Homo sapiens
cctgtcccacccccacc

SEQ ID NO: 4032193 - DNA, 16 bp, Homo sapiens
cctgtcccaccccctt

SEQ ID NO: 4032194 - DNA, 21 bp, Homo sapiens
cctgtcccaggccggcccaga

SEQ ID NO: 4032195 - DNA, 12 bp, Homo sapiens
cctgtccctgag

SEQ ID NO: 4032196 - DNA, 16 bp, Homo sapiens
cctgtccctgtccccc

SEQ ID NO: 4032197 - DNA, 12 bp, Homo sapiens
cctgtccctttt

SEQ ID NO: 4032198 - DNA, 13 bp, Homo sapiens
cctgtcccttttc

SEQ ID NO: 4032199 - DNA, 16 bp, Homo sapiens
cctgtcccttttccct

SEQ ID NO: 4032200 - DNA, 17 bp, Homo sapiens
cctgtcctaaggaacct

SEQ ID NO: 4032201 - DNA, 17 bp, Homo sapiens
cctgtcctcccatcccc

SEQ ID NO: 4032202 - DNA, 21 bp, Homo sapiens
cctgtcctcccatcccctgga

SEQ ID NO: 4032203 - DNA, 23 bp, Homo sapiens
cctgtcctcccatcccctggact

SEQ ID NO: 4032204 - DNA, 20 bp, Homo sapiens
cctgtcgagacacttgcctt

SEQ ID NO: 4032205 - DNA, 14 bp, Homo sapiens
cctgtctaggtctc

SEQ ID NO: 4032206 - DNA, 20 bp, Homo sapiens
cctgtctaggtctcctcagg

SEQ ID NO: 4032207 - DNA, 15 bp, Homo sapiens
cctgtctcagcctcc

SEQ ID NO: 4032208 - DNA, 20 bp, Homo sapiens
cctgtctcatccccaggggt

SEQ ID NO: 4032209 - DNA, 16 bp, Homo sapiens
cctgtctccagctgcc

SEQ ID NO: 4032210 - DNA, 17 bp, Homo sapiens
cctgtctccagctgcct

SEQ ID NO: 4032211 - DNA, 21 bp, Homo sapiens
cctgtctccagctgcctgggc

SEQ ID NO: 4032212 - DNA, 19 bp, Homo sapiens
cctgtctgaatgtacctgt

SEQ ID NO: 4032213 - DNA, 20 bp, Homo sapiens
cctgtctgagactcacagga

SEQ ID NO: 4032214 - DNA, 22 bp, Homo sapiens
cctgtctgctaggcgctgggga

SEQ ID NO: 4032215 - DNA, 18 bp, Homo sapiens
cctgtcttcggccgagct

SEQ ID NO: 4032216 - DNA, 21 bp, Homo sapiens
cctgtcttctgggcacagtgg

SEQ ID NO: 4032217 - DNA, 14 bp, Homo sapiens
cctgtctttaagga

SEQ ID NO: 4032218 - DNA, 17 bp, Homo sapiens
cctgtctttaaggaaaa

SEQ ID NO: 4032219 - DNA, 22 bp, Homo sapiens
cctgtgaagtttaattgtctca

SEQ ID NO: 4032220 - DNA, 17 bp, Homo sapiens
cctgtgaatcaatcctg

SEQ ID NO: 4032221 - DNA, 18 bp, Homo sapiens
cctgtgacatggtgcctg

SEQ ID NO: 4032222 - DNA, 21 bp, Homo sapiens
cctgtgacatggtgcctgaga

SEQ ID NO: 4032223 - DNA, 20 bp, Homo sapiens
cctgtgagcccagctgggtc

SEQ ID NO: 4032224 - DNA, 14 bp, Homo sapiens
cctgtgagctgcac

SEQ ID NO: 4032225 - DNA, 17 bp, Homo sapiens
cctgtgagtaaatattg

SEQ ID NO: 4032226 - DNA, 19 bp, Homo sapiens
cctgtgccagcccagaggc

SEQ ID NO: 4032227 - DNA, 13 bp, Homo sapiens
cctgtgcccactc

SEQ ID NO: 4032228 - DNA, 14 bp, Homo sapiens
cctgtgcccactcc

SEQ ID NO: 4032229 - DNA, 15 bp, Homo sapiens
cctgtgcccactccc

SEQ ID NO: 4032230 - DNA, 21 bp, Homo sapiens
cctgtgcccactccctatctc

SEQ ID NO: 4032231 - DNA, 18 bp, Homo sapiens
cctgtgcccgactgactg

SEQ ID NO: 4032232 - DNA, 17 bp, Homo sapiens
cctgtgcctcccagctt

SEQ ID NO: 4032233 - DNA, 19 bp, Homo sapiens
cctgtgcctctgggactgg

SEQ ID NO: 4032234 - DNA, 13 bp, Homo sapiens
cctgtgcctggcc

SEQ ID NO: 4032235 - DNA, 17 bp, Homo sapiens
cctgtgcctggccccag

SEQ ID NO: 4032236 - DNA, 19 bp, Homo sapiens
cctgtggaacataaaaagg

SEQ ID NO: 4032237 - DNA, 23 bp, Homo sapiens
cctgtggaacataaaaaggacat

SEQ ID NO: 4032238 - DNA, 24 bp, Homo sapiens
cctgtggaacataaaaaggacatc

SEQ ID NO: 4032239 - DNA, 19 bp, Homo sapiens
cctgtggaagagtgtgtgt

SEQ ID NO: 4032240 - DNA, 23 bp, Homo sapiens
cctgtggaatgagtgtgcatgga

SEQ ID NO: 4032241 - DNA, 15 bp, Homo sapiens
cctgtggagctcagc

SEQ ID NO: 4032242 - DNA, 16 bp, Homo sapiens
cctgtggagctcagcc

SEQ ID NO: 4032243 - DNA, 17 bp, Homo sapiens
cctgtggagctcagccc

SEQ ID NO: 4032244 - DNA, 15 bp, Homo sapiens
cctgtggccctggcc

SEQ ID NO: 4032245 - DNA, 17 bp, Homo sapiens
cctgtggccctggccac

SEQ ID NO: 4032246 - DNA, 16 bp, Homo sapiens
cctgtggcctgccagt

SEQ ID NO: 4032247 - DNA, 15 bp, Homo sapiens
cctgtgggagcctgc

SEQ ID NO: 4032248 - DNA, 15 bp, Homo sapiens
cctgtgggggtggcc

SEQ ID NO: 4032249 - DNA, 18 bp, Homo sapiens
cctgtgggggtggccatc

SEQ ID NO: 4032250 - DNA, 22 bp, Homo sapiens
cctgtgggggtggccatccctg

SEQ ID NO: 4032251 - DNA, 16 bp, Homo sapiens
cctggccaccagccat

SEQ ID NO: 4032252 - DNA, 13 bp, Homo sapiens
cctggccacctct

SEQ ID NO: 4032253 - DNA, 14 bp, Homo sapiens
cctggccacctctc

SEQ ID NO: 4032254 - DNA, 18 bp, Homo sapiens
cctggccacctctctcct

SEQ ID NO: 4032255 - DNA, 16 bp, Homo sapiens
cctggccactaaagct

SEQ ID NO: 4032256 - DNA, 18 bp, Homo sapiens
cctggccagacacaggcc

SEQ ID NO: 4032257 - DNA, 16 bp, Homo sapiens
cctggccagatggccc

SEQ ID NO: 4032258 - DNA, 19 bp, Homo sapiens
cctggccagatggcccgga

SEQ ID NO: 4032259 - DNA, 18 bp, Homo sapiens
cctggccaggagctcttc

SEQ ID NO: 4032260 - DNA, 21 bp, Homo sapiens
cctggccaggagctcttcagg

SEQ ID NO: 4032261 - DNA, 12 bp, Homo sapiens
cctggccaggca

SEQ ID NO: 4032262 - DNA, 15 bp, Homo sapiens
cctggccccagcctg

SEQ ID NO: 4032263 - DNA, 22 bp, Homo sapiens
cctggccccaggccccagacag

SEQ ID NO: 4032264 - DNA, 19 bp, Homo sapiens
cctggcccccaacctcagg

SEQ ID NO: 4032265 - DNA, 12 bp, Homo sapiens
cctggcccttac

SEQ ID NO: 4032266 - DNA, 18 bp, Homo sapiens
cctggccgagtccaagct

SEQ ID NO: 4032267 - DNA, 12 bp, Homo sapiens
cctggccgcccc

SEQ ID NO: 4032268 - DNA, 14 bp, Homo sapiens
cctggccgccccct

SEQ ID NO: 4032269 - DNA, 20 bp, Homo sapiens
cctggccgccccctgccccc

SEQ ID NO: 4032270 - DNA, 21 bp, Homo sapiens
cctggccgccccctgcccccc

SEQ ID NO: 4032271 - DNA, 22 bp, Homo sapiens
cctggcctctgcctccaccctc

SEQ ID NO: 4032272 - DNA, 14 bp, Homo sapiens
cctggcctctgtgc

SEQ ID NO: 4032273 - DNA, 20 bp, Homo sapiens
cctggcctgaactgaggaga

SEQ ID NO: 4032274 - DNA, 13 bp, Homo sapiens
cctggcctgtctg

SEQ ID NO: 4032275 - DNA, 17 bp, Homo sapiens
cctggcctgtctgtgaa

SEQ ID NO: 4032276 - DNA, 22 bp, Homo sapiens
cctggcgcaggtgggctggact

SEQ ID NO: 4032277 - DNA, 19 bp, Homo sapiens
cctggctacatcccagcct

SEQ ID NO: 4032278 - DNA, 12 bp, Homo sapiens
cctggctccact

SEQ ID NO: 4032279 - DNA, 23 bp, Homo sapiens
cctggctcccacaggcccttcct

SEQ ID NO: 4032280 - DNA, 23 bp, Homo sapiens
cctggctccctcctccaggcctg

SEQ ID NO: 4032281 - DNA, 14 bp, Homo sapiens
cctggctgagcagt

SEQ ID NO: 4032282 - DNA, 22 bp, Homo sapiens
cctggctgatgatccagaacag

SEQ ID NO: 4032283 - DNA, 14 bp, Homo sapiens
cctggctgcagctg

SEQ ID NO: 4032284 - DNA, 15 bp, Homo sapiens
cctggctgcccatca

SEQ ID NO: 4032285 - DNA, 12 bp, Homo sapiens
cctggctgcccc

SEQ ID NO: 4032286 - DNA, 19 bp, Homo sapiens
cctggctgcccctcacctt

SEQ ID NO: 4032287 - DNA, 18 bp, Homo sapiens
cctggctgctgcccccac

SEQ ID NO: 4032288 - DNA, 24 bp, Homo sapiens
cctggctgggacgtggctcagcca

SEQ ID NO: 4032289 - DNA, 12 bp, Homo sapiens
cctggctgggcc

SEQ ID NO: 4032290 - DNA, 19 bp, Homo sapiens
cctggctgggttcaggtcc

SEQ ID NO: 4032291 - DNA, 14 bp, Homo sapiens
cctggctggtcctc

SEQ ID NO: 4032292 - DNA, 18 bp, Homo sapiens
cctggctggtcctcccat

SEQ ID NO: 4032293 - DNA, 19 bp, Homo sapiens
cctggctggtcctcccatt

SEQ ID NO: 4032294 - DNA, 15 bp, Homo sapiens
cctggctttgcctct

SEQ ID NO: 4032295 - DNA, 16 bp, Homo sapiens
cctggcttttacttta

SEQ ID NO: 4032296 - DNA, 16 bp, Homo sapiens
cctggcttttcactgc

SEQ ID NO: 4032297 - DNA, 24 bp, Homo sapiens
cctggcttttcactgctggctgcc

SEQ ID NO: 4032298 - DNA, 19 bp, Homo sapiens
cctgggaagatgaggttct

SEQ ID NO: 4032299 - DNA, 23 bp, Homo sapiens
cctgggaagatgaggttctgaga

SEQ ID NO: 4032300 - DNA, 23 bp, Homo sapiens
cctgggaaggcgagtctggggac

SEQ ID NO: 4032301 - DNA, 12 bp, Homo sapiens
cctgggacacag

SEQ ID NO: 4032302 - DNA, 18 bp, Homo sapiens
cctgggacttccatgcct

SEQ ID NO: 4032303 - DNA, 14 bp, Homo sapiens
cctgggagacagac

SEQ ID NO: 4032304 - DNA, 12 bp, Homo sapiens
cctgggaggccc

SEQ ID NO: 4032305 - DNA, 14 bp, Homo sapiens
cctgggaggcggag

SEQ ID NO: 4032306 - DNA, 17 bp, Homo sapiens
cctgggataggggcaga

SEQ ID NO: 4032307 - DNA, 18 bp, Homo sapiens
cctgggataggggcagag

SEQ ID NO: 4032308 - DNA, 22 bp, Homo sapiens
cctgggatgaggggtgctgggt

SEQ ID NO: 4032309 - DNA, 16 bp, Homo sapiens
cctgggatgggaccag

SEQ ID NO: 4032310 - DNA, 18 bp, Homo sapiens
cctgggcaatcagacacc

SEQ ID NO: 4032311 - DNA, 17 bp, Homo sapiens
cctgggcagccaggctg

SEQ ID NO: 4032312 - DNA, 23 bp, Homo sapiens
cctgggcagccaggctgccaagg

SEQ ID NO: 4032313 - DNA, 23 bp, Homo sapiens
cctgggcatatccaccacctccc

SEQ ID NO: 4032314 - DNA, 16 bp, Homo sapiens
cctgggcattgctttc

SEQ ID NO: 4032315 - DNA, 16 bp, Homo sapiens
cctgggccagggtctg

SEQ ID NO: 4032316 - DNA, 14 bp, Homo sapiens
cctgggcctgcccc

SEQ ID NO: 4032317 - DNA, 19 bp, Homo sapiens
cctgggcctttgcaagatg

SEQ ID NO: 4032318 - DNA, 22 bp, Homo sapiens
cctgggcctttgcaagatgctt

SEQ ID NO: 4032319 - DNA, 23 bp, Homo sapiens
cctgggctcaagcaatcctcctg

SEQ ID NO: 4032320 - DNA, 16 bp, Homo sapiens
cctgggctcggaggct

SEQ ID NO: 4032321 - DNA, 18 bp, Homo sapiens
cctgggctcggaggctgc

SEQ ID NO: 4032322 - DNA, 21 bp, Homo sapiens
cctgggctcggaggctgcccc

SEQ ID NO: 4032323 - DNA, 12 bp, Homo sapiens
cctgggctgcca

SEQ ID NO: 4032324 - DNA, 14 bp, Homo sapiens
cctgggctgccacc

SEQ ID NO: 4032325 - DNA, 13 bp, Homo sapiens
cctgggctggact

SEQ ID NO: 4032326 - DNA, 17 bp, Homo sapiens
cctgggctggggccacc

SEQ ID NO: 4032327 - DNA, 17 bp, Homo sapiens
cctggggaaggagccag

SEQ ID NO: 4032328 - DNA, 13 bp, Homo sapiens
cctggggaccccc

SEQ ID NO: 4032329 - DNA, 22 bp, Homo sapiens
cctggggagggggtcattgttc

SEQ ID NO: 4032330 - DNA, 21 bp, Homo sapiens
cctggggagtggttaggcagc

SEQ ID NO: 4032331 - DNA, 19 bp, Homo sapiens
cctggggcaaacctagccg

SEQ ID NO: 4032332 - DNA, 13 bp, Homo sapiens
cctggggcctgac

SEQ ID NO: 4032333 - DNA, 18 bp, Homo sapiens
cctggggcctgactgctc

SEQ ID NO: 4032334 - DNA, 15 bp, Homo sapiens
cctggggcctgagag

SEQ ID NO: 4032335 - DNA, 16 bp, Homo sapiens
cctggggcctggacct

SEQ ID NO: 4032336 - DNA, 16 bp, Homo sapiens
cctggggctcctttct

SEQ ID NO: 4032337 - DNA, 21 bp, Homo sapiens
cctggggctcctttctccagc

SEQ ID NO: 4032338 - DNA, 19 bp, Homo sapiens
cctggggctggcctcccaa

SEQ ID NO: 4032339 - DNA, 13 bp, Homo sapiens
cctgggggagaga

SEQ ID NO: 4032340 - DNA, 18 bp, Homo sapiens
cctgggggccagtgggga

SEQ ID NO: 4032341 - DNA, 22 bp, Homo sapiens
cctgggggccttgggtgagtgg

SEQ ID NO: 4032342 - DNA, 22 bp, Homo sapiens
cctgggggtggcaggcacacag

SEQ ID NO: 4032343 - DNA, 21 bp, Homo sapiens
cctggggtataaaactttcct

SEQ ID NO: 4032344 - DNA, 15 bp, Homo sapiens
cctggggtctgagca

SEQ ID NO: 4032345 - DNA, 14 bp, Homo sapiens
cctgggtcagtctg

SEQ ID NO: 4032346 - DNA, 15 bp, Homo sapiens
cctgggtccccagcc

SEQ ID NO: 4032347 - DNA, 16 bp, Homo sapiens
cctgggtgggctctgt

SEQ ID NO: 4032348 - DNA, 14 bp, Homo sapiens
cctgggtttccagg

SEQ ID NO: 4032349 - DNA, 14 bp, Homo sapiens
cctggtaagaaaaa

SEQ ID NO: 4032350 - DNA, 15 bp, Homo sapiens
cctggtaagaaaaag

SEQ ID NO: 4032351 - DNA, 19 bp, Homo sapiens
cctggtaagaaaaagcaaa

SEQ ID NO: 4032352 - DNA, 14 bp, Homo sapiens
cctggtaccctcct

SEQ ID NO: 4032353 - DNA, 20 bp, Homo sapiens
cctggtcagggtgagcccat

SEQ ID NO: 4032354 - DNA, 18 bp, Homo sapiens
cgcatattaagcacttta

SEQ ID NO: 4032355 - DNA, 18 bp, Homo sapiens
cgcatggagtgtgtattg

SEQ ID NO: 4032356 - DNA, 15 bp, Homo sapiens
cgccaatctggccct

SEQ ID NO: 4032357 - DNA, 16 bp, Homo sapiens
cgccaatctggccctt

SEQ ID NO: 4032358 - DNA, 21 bp, Homo sapiens
cgccaatctggcccttacaca

SEQ ID NO: 4032359 - DNA, 23 bp, Homo sapiens
cgccaatctggcccttacacact

SEQ ID NO: 4032360 - DNA, 11 bp, Homo sapiens
cgccacatccc

SEQ ID NO: 4032361 - DNA, 22 bp, Homo sapiens
cgccaccgggcatgtctgcctg

SEQ ID NO: 4032362 - DNA, 16 bp, Homo sapiens
cgccaccgtgcctggc

SEQ ID NO: 4032363 - DNA, 13 bp, Homo sapiens
cgccacctcaggg

SEQ ID NO: 4032364 - DNA, 20 bp, Homo sapiens
cgccacctggcattccttct

SEQ ID NO: 4032365 - DNA, 21 bp, Homo sapiens
cgccacctggcattccttctg

SEQ ID NO: 4032366 - DNA, 21 bp, Homo sapiens
cgccacgtcccagcatccctg

SEQ ID NO: 4032367 - DNA, 15 bp, Homo sapiens
cgccactcctgaacc

SEQ ID NO: 4032368 - DNA, 14 bp, Homo sapiens
cgccagagggcttg

SEQ ID NO: 4032369 - DNA, 20 bp, Homo sapiens
cgccagctgggagcactggt

SEQ ID NO: 4032370 - DNA, 14 bp, Homo sapiens
cgccaggaagccag

SEQ ID NO: 4032371 - DNA, 16 bp, Homo sapiens
cgccaggctgaccaca

SEQ ID NO: 4032372 - DNA, 17 bp, Homo sapiens
cgccagggaccccagaa

SEQ ID NO: 4032373 - DNA, 19 bp, Homo sapiens
cgccagggaccccagaatc

SEQ ID NO: 4032374 - DNA, 21 bp, Homo sapiens
cgccattggttggaagctacc

SEQ ID NO: 4032375 - DNA, 14 bp, Homo sapiens
cgcccagccccatc

SEQ ID NO: 4032376 - DNA, 15 bp, Homo sapiens
cgcccagccccatcc

SEQ ID NO: 4032377 - DNA, 15 bp, Homo sapiens
cgcccaggagacatc

SEQ ID NO: 4032378 - DNA, 14 bp, Homo sapiens
cgcccatctcagga

SEQ ID NO: 4032379 - DNA, 16 bp, Homo sapiens
cgccccagagtggccc

SEQ ID NO: 4032380 - DNA, 13 bp, Homo sapiens
cgccccatgggcc

SEQ ID NO: 4032381 - DNA, 18 bp, Homo sapiens
cgcccccagtccccaccc

SEQ ID NO: 4032382 - DNA, 12 bp, Homo sapiens
cgcccctgctgt

SEQ ID NO: 4032383 - DNA, 17 bp, Homo sapiens
cgcccgctcctgccgca

SEQ ID NO: 4032384 - DNA, 18 bp, Homo sapiens
cgcccgctcctgccgcag

SEQ ID NO: 4032385 - DNA, 20 bp, Homo sapiens
cgccctcctcgggccgaggc

SEQ ID NO: 4032386 - DNA, 16 bp, Homo sapiens
cgccctcctttctgtg

SEQ ID NO: 4032387 - DNA, 17 bp, Homo sapiens
cgccctgggctggactg

SEQ ID NO: 4032388 - DNA, 21 bp, Homo sapiens
cgccctgggctggactggagg

SEQ ID NO: 4032389 - DNA, 14 bp, Homo sapiens
cgccctgggctgtc

SEQ ID NO: 4032390 - DNA, 15 bp, Homo sapiens
cgccctgggctgtct

SEQ ID NO: 4032391 - DNA, 14 bp, Homo sapiens
cgcccttccatgtg

SEQ ID NO: 4032392 - DNA, 22 bp, Homo sapiens
cgcccttccatgtgcctttctt

SEQ ID NO: 4032393 - DNA, 14 bp, Homo sapiens
cgccctttcctcct

SEQ ID NO: 4032394 - DNA, 16 bp, Homo sapiens
cgccctttcctcctca

SEQ ID NO: 4032395 - DNA, 12 bp, Homo sapiens
cgccgcaggtgt

SEQ ID NO: 4032396 - DNA, 20 bp, Homo sapiens
cgccggggacagaggcctgc

SEQ ID NO: 4032397 - DNA, 22 bp, Homo sapiens
cgccggggacagaggcctgccc

SEQ ID NO: 4032398 - DNA, 18 bp, Homo sapiens
cgcctaaggtcacagcta

SEQ ID NO: 4032399 - DNA, 22 bp, Homo sapiens
cgcctacccttcccgcctccct

SEQ ID NO: 4032400 - DNA, 21 bp, Homo sapiens
cgcctactcttcagggtctaa

SEQ ID NO: 4032401 - DNA, 15 bp, Homo sapiens
cgcctcagccctcag

SEQ ID NO: 4032402 - DNA, 18 bp, Homo sapiens
cgcctcagggccaggccc

SEQ ID NO: 4032403 - DNA, 15 bp, Homo sapiens
cgcctccctctcaga

SEQ ID NO: 4032404 - DNA, 20 bp, Homo sapiens
cgcctgacaaccactggtct

SEQ ID NO: 4032405 - DNA, 14 bp, Homo sapiens
cgcctgagctcctg

SEQ ID NO: 4032406 - DNA, 14 bp, Homo sapiens
cgcctgcaggcaga

SEQ ID NO: 4032407 - DNA, 20 bp, Homo sapiens
cgcctgccctcatggcccct

SEQ ID NO: 4032408 - DNA, 18 bp, Homo sapiens
cgcctgcctgcagcaggc

SEQ ID NO: 4032409 - DNA, 18 bp, Homo sapiens
cgcctgtagtcccagcca

SEQ ID NO: 4032410 - DNA, 20 bp, Homo sapiens
cgcctgtagtcctagccact

SEQ ID NO: 4032411 - DNA, 17 bp, Homo sapiens
cgcctgtgatgctgggc

SEQ ID NO: 4032412 - DNA, 14 bp, Homo sapiens
cgccttaagctgat

SEQ ID NO: 4032413 - DNA, 14 bp, Homo sapiens
cgccttagagcctc

SEQ ID NO: 4032414 - DNA, 17 bp, Homo sapiens
cgccttagagcctcgtc

SEQ ID NO: 4032415 - DNA, 20 bp, Homo sapiens
cgccttccacctctgggagc

SEQ ID NO: 4032416 - DNA, 17 bp, Homo sapiens
cgcctttccgcggagcc

SEQ ID NO: 4032417 - DNA, 16 bp, Homo sapiens
cgcgatcccacacagg

SEQ ID NO: 4032418 - DNA, 17 bp, Homo sapiens
cgcgctcgcccagcagg

SEQ ID NO: 4032419 - DNA, 14 bp, Homo sapiens
cgcggccagccccg

SEQ ID NO: 4032420 - DNA, 15 bp, Homo sapiens
cgcggccagccccgg

SEQ ID NO: 4032421 - DNA, 19 bp, Homo sapiens
cgcggccagcgtcccaggg

SEQ ID NO: 4032422 - DNA, 18 bp, Homo sapiens
cgcgggcagcgggccagg

SEQ ID NO: 4032423 - DNA, 19 bp, Homo sapiens
cgcgggcagcgggccaggc

SEQ ID NO: 4032424 - DNA, 18 bp, Homo sapiens
cgcggggaagctggcttt

SEQ ID NO: 4032425 - DNA, 22 bp, Homo sapiens
cgcggtgccatgtctgcagtgt

SEQ ID NO: 4032426 - DNA, 13 bp, Homo sapiens
cgcggtggctcac

SEQ ID NO: 4032427 - DNA, 13 bp, Homo sapiens
cgcgtctcctgtt

SEQ ID NO: 4032428 - DNA, 19 bp, Homo sapiens
cgcgtgccctcgctgcttc

SEQ ID NO: 4032429 - DNA, 19 bp, Homo sapiens
cgctaaagagcccttgcct

SEQ ID NO: 4032430 - DNA, 21 bp, Homo sapiens
cgctaaagagcccttgcctcc

SEQ ID NO: 4032431 - DNA, 12 bp, Homo sapiens
cgctacctccct

SEQ ID NO: 4032432 - DNA, 15 bp, Homo sapiens
cgctacctccctccc

SEQ ID NO: 4032433 - DNA, 13 bp, Homo sapiens
cgctattacaaat

SEQ ID NO: 4032434 - DNA, 14 bp, Homo sapiens
cgctattacaaata

SEQ ID NO: 4032435 - DNA, 17 bp, Homo sapiens
cgctcagacggcggcca

SEQ ID NO: 4032436 - DNA, 23 bp, Homo sapiens
cgctcagacggcggccaggcaca

SEQ ID NO: 4032437 - DNA, 12 bp, Homo sapiens
cgctcagccctc

SEQ ID NO: 4032438 - DNA, 16 bp, Homo sapiens
cgctccagctgccccg

SEQ ID NO: 4032439 - DNA, 21 bp, Homo sapiens
cgctcccaggttcccccagca

SEQ ID NO: 4032440 - DNA, 16 bp, Homo sapiens
cgctcctgccgcagac

SEQ ID NO: 4032441 - DNA, 13 bp, Homo sapiens
cgctcgcgggcag

SEQ ID NO: 4032442 - DNA, 14 bp, Homo sapiens
cgctcgcgggcagc

SEQ ID NO: 4032443 - DNA, 13 bp, Homo sapiens
cgctctgctgtgg

SEQ ID NO: 4032444 - DNA, 15 bp, Homo sapiens
cgctgagctgagtgg

SEQ ID NO: 4032445 - DNA, 21 bp, Homo sapiens
cgctgaggtgtctggcctgag

SEQ ID NO: 4032446 - DNA, 23 bp, Homo sapiens
cgctgaggtgtctggcctgaggt

SEQ ID NO: 4032447 - DNA, 15 bp, Homo sapiens
cgctgcatgagacat

SEQ ID NO: 4032448 - DNA, 23 bp, Homo sapiens
cgctgccagccttgagccctggc

SEQ ID NO: 4032449 - DNA, 15 bp, Homo sapiens
cgctgctgctgctgc

SEQ ID NO: 4032450 - DNA, 20 bp, Homo sapiens
cgctgctgctgctgcgccct

SEQ ID NO: 4032451 - DNA, 14 bp, Homo sapiens
cgctggggctctct

SEQ ID NO: 4032452 - DNA, 14 bp, Homo sapiens
cgctgggtggtacc

SEQ ID NO: 4032453 - DNA, 16 bp, Homo sapiens
cgctgtataaagcatg

SEQ ID NO: 4032454 - DNA, 15 bp, Homo sapiens
cgctgtcactggctg

SEQ ID NO: 4032455 - DNA, 20 bp, Homo sapiens
cgctgtcactggctggctcc

SEQ ID NO: 4032456 - DNA, 16 bp, Homo sapiens
cgctgtcctctcgagc

SEQ ID NO: 4032457 - DNA, 16 bp, Homo sapiens
cgctgtcgccccaggc

SEQ ID NO: 4032458 - DNA, 14 bp, Homo sapiens
cgacataccccact

SEQ ID NO: 4032459 - DNA, 20 bp, Homo sapiens
cgacccagaatggagcctgc

SEQ ID NO: 4032460 - DNA, 13 bp, Homo sapiens
cgaccctcatggc

SEQ ID NO: 4032461 - DNA, 15 bp, Homo sapiens
cgaccctcatggccc

SEQ ID NO: 4032462 - DNA, 22 bp, Homo sapiens
cgaccctcatggcccccagggg

SEQ ID NO: 4032463 - DNA, 13 bp, Homo sapiens
cgaccgccccctc

SEQ ID NO: 4032464 - DNA, 16 bp, Homo sapiens
cgacctggctgcccct

SEQ ID NO: 4032465 - DNA, 17 bp, Homo sapiens
cgacctggctgcccctc

SEQ ID NO: 4032466 - DNA, 21 bp, Homo sapiens
cgacctggctgcccctcacct

SEQ ID NO: 4032467 - DNA, 19 bp, Homo sapiens
cgaccttgcaacctcacct

SEQ ID NO: 4032468 - DNA, 15 bp, Homo sapiens
cgacgcgtctcctgt

SEQ ID NO: 4032469 - DNA, 16 bp, Homo sapiens
cgactagacacacaaa

SEQ ID NO: 4032470 - DNA, 20 bp, Homo sapiens
cgactagacacacaaagcag

SEQ ID NO: 4032471 - DNA, 13 bp, Homo sapiens
cgactagccagga

SEQ ID NO: 4032472 - DNA, 18 bp, Homo sapiens
cgacttgtgcacaggcag

SEQ ID NO: 4032473 - DNA, 19 bp, Homo sapiens
cgacttgtgcacaggcaga

SEQ ID NO: 4032474 - DNA, 13 bp, Homo sapiens
cgactttattttc

SEQ ID NO: 4032475 - DNA, 20 bp, Homo sapiens
cgagacacaggcacgggtcc

SEQ ID NO: 4032476 - DNA, 14 bp, Homo sapiens
cgagacagtccagt

SEQ ID NO: 4032477 - DNA, 17 bp, Homo sapiens
cgagaccatcctggcta

SEQ ID NO: 4032478 - DNA, 21 bp, Homo sapiens
cgagagaggagccagacagac

SEQ ID NO: 4032479 - DNA, 14 bp, Homo sapiens
cgagagggagagag

SEQ ID NO: 4032480 - DNA, 17 bp, Homo sapiens
cgagatccccagggcag

SEQ ID NO: 4032481 - DNA, 11 bp, Homo sapiens
cgagcagggct

SEQ ID NO: 4032482 - DNA, 17 bp, Homo sapiens
cgagcagtcctgcctca

SEQ ID NO: 4032483 - DNA, 14 bp, Homo sapiens
cgagccgggcctgg

SEQ ID NO: 4032484 - DNA, 15 bp, Homo sapiens
cgagccgggcctggg

SEQ ID NO: 4032485 - DNA, 18 bp, Homo sapiens
cgagcgctttctggaaaa

SEQ ID NO: 4032486 - DNA, 14 bp, Homo sapiens
cgagctcttggcct

SEQ ID NO: 4032487 - DNA, 19 bp, Homo sapiens
cgagctggggggttggcag

SEQ ID NO: 4032488 - DNA, 21 bp, Homo sapiens
cgagctggggggttggcagcc

SEQ ID NO: 4032489 - DNA, 22 bp, Homo sapiens
cgagctggggggttggcagccc

SEQ ID NO: 4032490 - DNA, 22 bp, Homo sapiens
cgagctggtgcattacagagag

SEQ ID NO: 4032491 - DNA, 23 bp, Homo sapiens
cgagctggtgcattacagagagg

SEQ ID NO: 4032492 - DNA, 12 bp, Homo sapiens
cgagctggtttc

SEQ ID NO: 4032493 - DNA, 19 bp, Homo sapiens
cgagctggtttcctgccca

SEQ ID NO: 4032494 - DNA, 22 bp, Homo sapiens
cgaggaatctgtgggtctggga

SEQ ID NO: 4032495 - DNA, 12 bp, Homo sapiens
cgaggagtaaca

SEQ ID NO: 4032496 - DNA, 13 bp, Homo sapiens
cgaggagtaacaa

SEQ ID NO: 4032497 - DNA, 22 bp, Homo sapiens
cgaggagtaacaatacaaatgg

SEQ ID NO: 4032498 - DNA, 11 bp, Homo sapiens
cgaggcccagc

SEQ ID NO: 4032499 - DNA, 17 bp, Homo sapiens
cgaggcccagcgggcag

SEQ ID NO: 4032500 - DNA, 19 bp, Homo sapiens
cgaggcccagcgggcagat

SEQ ID NO: 4032501 - DNA, 10 bp, Homo sapiens
cgaggcctga

SEQ ID NO: 4032502 - DNA, 11 bp, Homo sapiens
cgaggcctgaa

SEQ ID NO: 4032503 - DNA, 20 bp, Homo sapiens
cgaggggctctcagctcagc

SEQ ID NO: 4032504 - DNA, 20 bp, Homo sapiens
cgagtaattgcatttgcttt

SEQ ID NO: 4032505 - DNA, 18 bp, Homo sapiens
cgagtcattcgttctgtg

SEQ ID NO: 4032506 - DNA, 17 bp, Homo sapiens
cgagtctcttctccact

SEQ ID NO: 4032507 - DNA, 18 bp, Homo sapiens
cgagtctcttctccactg

SEQ ID NO: 4032508 - DNA, 20 bp, Homo sapiens
cgagtctcttctccactgga

SEQ ID NO: 4032509 - DNA, 21 bp, Homo sapiens
cgagtctcttctccactggat

SEQ ID NO: 4032510 - DNA, 17 bp, Homo sapiens
cgagtgtgtttcatcct

SEQ ID NO: 4032511 - DNA, 18 bp, Homo sapiens
cgagtttgcaatgtcaca

SEQ ID NO: 4032512 - DNA, 21 bp, Homo sapiens
cgataaaattacaaaagagca

SEQ ID NO: 4032513 - DNA, 20 bp, Homo sapiens
cgataatgcatgaagcaacg

SEQ ID NO: 4032514 - DNA, 20 bp, Homo sapiens
cgatacaccgggcctggaga

SEQ ID NO: 4032515 - DNA, 12 bp, Homo sapiens
cgatcaggagga

SEQ ID NO: 4032516 - DNA, 16 bp, Homo sapiens
cgatctcattcagtat

SEQ ID NO: 4032517 - DNA, 15 bp, Homo sapiens
cgatctctcctggcc

SEQ ID NO: 4032518 - DNA, 21 bp, Homo sapiens
cgatgaggggacattttctgg

SEQ ID NO: 4032519 - DNA, 11 bp, Homo sapiens
cgatgctccct

SEQ ID NO: 4032520 - DNA, 22 bp, Homo sapiens
cgatgctccctcagcctcagag

SEQ ID NO: 4032521 - DNA, 20 bp, Homo sapiens
cgatggggcaagacagaaaa

SEQ ID NO: 4032522 - DNA, 16 bp, Homo sapiens
cgatgtttatgttctt

SEQ ID NO: 4032523 - DNA, 12 bp, Homo sapiens
cgattccttctc

SEQ ID NO: 4032524 - DNA, 13 bp, Homo sapiens
cgattccttctct

SEQ ID NO: 4032525 - DNA, 21 bp, Homo sapiens
cgattctcccaaagtaccttg

SEQ ID NO: 4032526 - DNA, 14 bp, Homo sapiens
cgattggccacctg

SEQ ID NO: 4032527 - DNA, 24 bp, Homo sapiens
cgattggccacctgtagccatctg

SEQ ID NO: 4032528 - DNA, 21 bp, Homo sapiens
cgatttcctcccacctccgtg

SEQ ID NO: 4032529 - DNA, 15 bp, Homo sapiens
cgcacaaacacacac

SEQ ID NO: 4032530 - DNA, 16 bp, Homo sapiens
cgcacacagctgagca

SEQ ID NO: 4032531 - DNA, 16 bp, Homo sapiens
cgcaccaggccgggct

SEQ ID NO: 4032532 - DNA, 21 bp, Homo sapiens
cgcaccattctcctgcctcag

SEQ ID NO: 4032533 - DNA, 20 bp, Homo sapiens
cgcaccccacgccctgttca

SEQ ID NO: 4032534 - DNA, 21 bp, Homo sapiens
cgcacccccctgttctaaggg

SEQ ID NO: 4032535 - DNA, 18 bp, Homo sapiens
cgcaccccggcctcaggg

SEQ ID NO: 4032536 - DNA, 19 bp, Homo sapiens
cgcaccccggcctcagggc

SEQ ID NO: 4032537 - DNA, 20 bp, Homo sapiens
cgcaccccggcctcagggcg

SEQ ID NO: 4032538 - DNA, 21 bp, Homo sapiens
cgcaccggcctggctgcagct

SEQ ID NO: 4032539 - DNA, 16 bp, Homo sapiens
cgcacctaccatcagg

SEQ ID NO: 4032540 - DNA, 19 bp, Homo sapiens
cgcacctaccatcagggac

SEQ ID NO: 4032541 - DNA, 14 bp, Homo sapiens
cgcacctgcctcag

SEQ ID NO: 4032542 - DNA, 15 bp, Homo sapiens
cgcacgcacacacac

SEQ ID NO: 4032543 - DNA, 15 bp, Homo sapiens
cgcactggtgccaaa

SEQ ID NO: 4032544 - DNA, 17 bp, Homo sapiens
cgcactgtgacccccag

SEQ ID NO: 4032545 - DNA, 14 bp, Homo sapiens
cgcactttccactt

SEQ ID NO: 4032546 - DNA, 15 bp, Homo sapiens
cgcactttccacttc

SEQ ID NO: 4032547 - DNA, 20 bp, Homo sapiens
cgcactttccacttcttcct

SEQ ID NO: 4032548 - DNA, 15 bp, Homo sapiens
cgcagacgggcacag

SEQ ID NO: 4032549 - DNA, 16 bp, Homo sapiens
cgcagacgggcacaga

SEQ ID NO: 4032550 - DNA, 19 bp, Homo sapiens
cgcagacgggcacagacac

SEQ ID NO: 4032551 - DNA, 19 bp, Homo sapiens
cgcagccctagagcctgcc

SEQ ID NO: 4032552 - DNA, 20 bp, Homo sapiens
cgcagccctagagcctgcct

SEQ ID NO: 4032553 - DNA, 15 bp, Homo sapiens
cgcagccctgctttg

SEQ ID NO: 4032554 - DNA, 17 bp, Homo sapiens
cgcagctggactctgca

SEQ ID NO: 4032555 - DNA, 22 bp, Homo sapiens
cgcaggaccagtttgattgagg

SEQ ID NO: 4032556 - DNA, 23 bp, Homo sapiens
cgcaggagtctctgccacccact

SEQ ID NO: 4032557 - DNA, 18 bp, Homo sapiens
cgcaggctgagtccagag

SEQ ID NO: 4032558 - DNA, 13 bp, Homo sapiens
cgcaggtgggctg

SEQ ID NO: 4032559 - DNA, 20 bp, Homo sapiens
cgcagtgctgggaccagagc

SEQ ID NO: 4032560 - DNA, 21 bp, Homo sapiens
cgcagtgctgggaccagagcc

SEQ ID NO: 4032561 - DNA, 17 bp, Homo sapiens
cgctgtcgccccaggcc

SEQ ID NO: 4032562 - DNA, 23 bp, Homo sapiens
cgctgtcgccccaggccctccct

SEQ ID NO: 4032563 - DNA, 16 bp, Homo sapiens
cgctgtgagcccctgg

SEQ ID NO: 4032564 - DNA, 18 bp, Homo sapiens
cgcttgcttttctgtatt

SEQ ID NO: 4032565 - DNA, 12 bp, Homo sapiens
cgcttgtagaac

SEQ ID NO: 4032566 - DNA, 20 bp, Homo sapiens
cgcttgtagaactcactctg

SEQ ID NO: 4032567 - DNA, 23 bp, Homo sapiens
cgcttgtagaactcactctgggc

SEQ ID NO: 4032568 - DNA, 16 bp, Homo sapiens
cgctttctagctgttg

SEQ ID NO: 4032569 - DNA, 22 bp, Homo sapiens
cgctttctagctgttgagctgt

SEQ ID NO: 4032570 - DNA, 19 bp, Homo sapiens
cggaaagtttttagaatgt

SEQ ID NO: 4032571 - DNA, 13 bp, Homo sapiens
cggaacagcagat

SEQ ID NO: 4032572 - DNA, 20 bp, Homo sapiens
cggaaccacagggccagagg

SEQ ID NO: 4032573 - DNA, 22 bp, Homo sapiens
cggaagcagtgccttccataat

SEQ ID NO: 4032574 - DNA, 23 bp, Homo sapiens
cggaagggctttggttccttctc

SEQ ID NO: 4032575 - DNA, 20 bp, Homo sapiens
cggaataaactagagaaggg

SEQ ID NO: 4032576 - DNA, 20 bp, Homo sapiens
cggacaagacccccagcact

SEQ ID NO: 4032577 - DNA, 14 bp, Homo sapiens
cggacactcctaga

SEQ ID NO: 4032578 - DNA, 21 bp, Homo sapiens
cggactaagcctacctgctct

SEQ ID NO: 4032579 - DNA, 18 bp, Homo sapiens
cggactcccgggccacgc

SEQ ID NO: 4032580 - DNA, 19 bp, Homo sapiens
cggactcccgggccacgcc

SEQ ID NO: 4032581 - DNA, 22 bp, Homo sapiens
cggactcccgggccacgcccca

SEQ ID NO: 4032582 - DNA, 13 bp, Homo sapiens
cggagagaaaaaa

SEQ ID NO: 4032583 - DNA, 15 bp, Homo sapiens
cggagagcagcagca

SEQ ID NO: 4032584 - DNA, 16 bp, Homo sapiens
cggagagcagcagcac

SEQ ID NO: 4032585 - DNA, 21 bp, Homo sapiens
cggagagggagtcagtcttca

SEQ ID NO: 4032586 - DNA, 14 bp, Homo sapiens
cggagcccagcctg

SEQ ID NO: 4032587 - DNA, 16 bp, Homo sapiens
cggagcctgtgcagcc

SEQ ID NO: 4032588 - DNA, 18 bp, Homo sapiens
cggagcctgtgcagcctt

SEQ ID NO: 4032589 - DNA, 16 bp, Homo sapiens
cggaggagaccagctc

SEQ ID NO: 4032590 - DNA, 17 bp, Homo sapiens
cggaggagaccagctca

SEQ ID NO: 4032591 - DNA, 20 bp, Homo sapiens
cggaggagaccagctcagag

SEQ ID NO: 4032592 - DNA, 14 bp, Homo sapiens
cggaggagctgcct

SEQ ID NO: 4032593 - DNA, 15 bp, Homo sapiens
cggaggagctgcctg

SEQ ID NO: 4032594 - DNA, 16 bp, Homo sapiens
cggaggctgcccccgg

SEQ ID NO: 4032595 - DNA, 13 bp, Homo sapiens
cggaggctgggcc

SEQ ID NO: 4032596 - DNA, 18 bp, Homo sapiens
cggaggctgggcccctgg

SEQ ID NO: 4032597 - DNA, 12 bp, Homo sapiens
cggaggctgtgt

SEQ ID NO: 4032598 - DNA, 22 bp, Homo sapiens
cggaggttgcagtgagctgaga

SEQ ID NO: 4032599 - DNA, 16 bp, Homo sapiens
cggagttcctaacagg

SEQ ID NO: 4032600 - DNA, 17 bp, Homo sapiens
cggagttcctaacagga

SEQ ID NO: 4032601 - DNA, 18 bp, Homo sapiens
cggatgacaccctggcct

SEQ ID NO: 4032602 - DNA, 20 bp, Homo sapiens
cggatgacaccctggcctga

SEQ ID NO: 4032603 - DNA, 18 bp, Homo sapiens
cggatggaccaacctgct

SEQ ID NO: 4032604 - DNA, 24 bp, Homo sapiens
cggattccaaagagtagaattgca

SEQ ID NO: 4032605 - DNA, 15 bp, Homo sapiens
cggattgcaaagcaa

SEQ ID NO: 4032606 - DNA, 16 bp, Homo sapiens
cggattttttccaaaa

SEQ ID NO: 4032607 - DNA, 21 bp, Homo sapiens
cggcacagggtctgctctttc

SEQ ID NO: 4032608 - DNA, 20 bp, Homo sapiens
cggcacccacaagtgccact

SEQ ID NO: 4032609 - DNA, 18 bp, Homo sapiens
cggcaggctcactgccag

SEQ ID NO: 4032610 - DNA, 23 bp, Homo sapiens
cggcaggctcactgccaggccag

SEQ ID NO: 4032611 - DNA, 22 bp, Homo sapiens
cggcatgggaaagccacctctc

SEQ ID NO: 4032612 - DNA, 16 bp, Homo sapiens
cggccaggcacagggc

SEQ ID NO: 4032613 - DNA, 17 bp, Homo sapiens
cggcccagatgtgtccc

SEQ ID NO: 4032614 - DNA, 14 bp, Homo sapiens
cggccccagcttct

SEQ ID NO: 4032615 - DNA, 19 bp, Homo sapiens
cggccccagcttctcagct

SEQ ID NO: 4032616 - DNA, 22 bp, Homo sapiens
cggccccccgcgctcgcccagc

SEQ ID NO: 4032617 - DNA, 18 bp, Homo sapiens
cggccccctggtctctgg

SEQ ID NO: 4032618 - DNA, 13 bp, Homo sapiens
cggccctgggctc

SEQ ID NO: 4032619 - DNA, 18 bp, Homo sapiens
cggccctgggctcggagg

SEQ ID NO: 4032620 - DNA, 22 bp, Homo sapiens
cggccctgggctcggaggctgc

SEQ ID NO: 4032621 - DNA, 14 bp, Homo sapiens
cggccggccagccc

SEQ ID NO: 4032622 - DNA, 15 bp, Homo sapiens
cggcctcagggcgct

SEQ ID NO: 4032623 - DNA, 20 bp, Homo sapiens
cggcctctctgccccaccca

SEQ ID NO: 4032624 - DNA, 19 bp, Homo sapiens
cggcctgatgctccctccc

SEQ ID NO: 4032625 - DNA, 13 bp, Homo sapiens
cggcctgctccca

SEQ ID NO: 4032626 - DNA, 19 bp, Homo sapiens
cggcctgctcccagcagcc

SEQ ID NO: 4032627 - DNA, 15 bp, Homo sapiens
cggcctggctgcagc

SEQ ID NO: 4032628 - DNA, 12 bp, Homo sapiens
cggcctgtcctc

SEQ ID NO: 4032629 - DNA, 17 bp, Homo sapiens
cggcgcccccagtgtgc

SEQ ID NO: 4032630 - DNA, 15 bp, Homo sapiens
cggcggaaagcctgt

SEQ ID NO: 4032631 - DNA, 12 bp, Homo sapiens
cggcggccaggc

SEQ ID NO: 4032632 - DNA, 13 bp, Homo sapiens
cggcggccaggca

SEQ ID NO: 4032633 - DNA, 16 bp, Homo sapiens
cggcggccaggcacag

SEQ ID NO: 4032634 - DNA, 21 bp, Homo sapiens
cggcggtggactgcgctggac

SEQ ID NO: 4032635 - DNA, 15 bp, Homo sapiens
cggctactctggaat

SEQ ID NO: 4032636 - DNA, 12 bp, Homo sapiens
cggctcaggctc

SEQ ID NO: 4032637 - DNA, 13 bp, Homo sapiens
cggctcaggctct

SEQ ID NO: 4032638 - DNA, 19 bp, Homo sapiens
cggctccagtccccagaac

SEQ ID NO: 4032639 - DNA, 20 bp, Homo sapiens
cggctccccatgtgtcctgg

SEQ ID NO: 4032640 - DNA, 14 bp, Homo sapiens
cggctcccctctgc

SEQ ID NO: 4032641 - DNA, 15 bp, Homo sapiens
cggctcccctctgct

SEQ ID NO: 4032642 - DNA, 19 bp, Homo sapiens
cggctcccctctgcttctc

SEQ ID NO: 4032643 - DNA, 13 bp, Homo sapiens
cggctcctcagag

SEQ ID NO: 4032644 - DNA, 15 bp, Homo sapiens
cggctcctcagagcg

SEQ ID NO: 4032645 - DNA, 16 bp, Homo sapiens
cggctcctcagagcgc

SEQ ID NO: 4032646 - DNA, 20 bp, Homo sapiens
cggctcctcagagcgccagg

SEQ ID NO: 4032647 - DNA, 19 bp, Homo sapiens
cggctgcctgacactgagc

SEQ ID NO: 4032648 - DNA, 20 bp, Homo sapiens
cggctgggtcggccctgccc

SEQ ID NO: 4032649 - DNA, 22 bp, Homo sapiens
cggctgtggagcaaaaggcagc

SEQ ID NO: 4032650 - DNA, 23 bp, Homo sapiens
cggctgtggagcaaaaggcagct

SEQ ID NO: 4032651 - DNA, 15 bp, Homo sapiens
cggcttcatgccagc

SEQ ID NO: 4032652 - DNA, 16 bp, Homo sapiens
cggcttgtgggctggt

SEQ ID NO: 4032653 - DNA, 17 bp, Homo sapiens
cggcttgtgggctggtg

SEQ ID NO: 4032654 - DNA, 13 bp, Homo sapiens
cgggaacagtgtt

SEQ ID NO: 4032655 - DNA, 20 bp, Homo sapiens
cgggaacagtgtttcccata

SEQ ID NO: 4032656 - DNA, 22 bp, Homo sapiens
cgggaacagtgtttcccataat

SEQ ID NO: 4032657 - DNA, 16 bp, Homo sapiens
cgggaagcagccagct

SEQ ID NO: 4032658 - DNA, 17 bp, Homo sapiens
cgggaataaccttccat

SEQ ID NO: 4032659 - DNA, 15 bp, Homo sapiens
cgggacacctgccct

SEQ ID NO: 4032660 - DNA, 18 bp, Homo sapiens
cgggacacctgccctgcc

SEQ ID NO: 4032661 - DNA, 12 bp, Homo sapiens
cgggacagacct

SEQ ID NO: 4032662 - DNA, 14 bp, Homo sapiens
cgggacagacctgg

SEQ ID NO: 4032663 - DNA, 16 bp, Homo sapiens
cgggagaaggcatgag

SEQ ID NO: 4032664 - DNA, 13 bp, Homo sapiens
cgggagcacccag

SEQ ID NO: 4032665 - DNA, 17 bp, Homo sapiens
cgggagcacccagagca

SEQ ID NO: 4032666 - DNA, 18 bp, Homo sapiens
cgggagcacccagagcac

SEQ ID NO: 4032667 - DNA, 20 bp, Homo sapiens
cgggagcagtgtcttccata

SEQ ID NO: 4032668 - DNA, 14 bp, Homo sapiens
cgggagcatctctt

SEQ ID NO: 4032669 - DNA, 14 bp, Homo sapiens
cgggagcctccccc

SEQ ID NO: 4032670 - DNA, 13 bp, Homo sapiens
cgggaggctgaga

SEQ ID NO: 4032671 - DNA, 16 bp, Homo sapiens
cgggaggctgagacag

SEQ ID NO: 4032672 - DNA, 18 bp, Homo sapiens
cgggaggctgagacagga

SEQ ID NO: 4032673 - DNA, 23 bp, Homo sapiens
cgggaggctgagacaggagaatc

SEQ ID NO: 4032674 - DNA, 13 bp, Homo sapiens
cgggaggctgggc

SEQ ID NO: 4032675 - DNA, 22 bp, Homo sapiens
cgggatgtcagcagacacacat

SEQ ID NO: 4032676 - DNA, 23 bp, Homo sapiens
cgggatgtcagcagacacacatg

SEQ ID NO: 4032677 - DNA, 24 bp, Homo sapiens
cgggatgtcagcagacacacatgg

SEQ ID NO: 4032678 - DNA, 14 bp, Homo sapiens
cgggcacagggcac

SEQ ID NO: 4032679 - DNA, 20 bp, Homo sapiens
cgggcacagggcaccagagg

SEQ ID NO: 4032680 - DNA, 21 bp, Homo sapiens
cgggcacagggcaccagaggc

SEQ ID NO: 4032681 - DNA, 17 bp, Homo sapiens
cgggcacggtcacacgg

SEQ ID NO: 4032682 - DNA, 16 bp, Homo sapiens
cgggcagagggctgga

SEQ ID NO: 4032683 - DNA, 12 bp, Homo sapiens
cgggcagatggg

SEQ ID NO: 4032684 - DNA, 13 bp, Homo sapiens
cgggcagccagca

SEQ ID NO: 4032685 - DNA, 15 bp, Homo sapiens
cgggcagccagcaga

SEQ ID NO: 4032686 - DNA, 14 bp, Homo sapiens
cgggcagcgggcca

SEQ ID NO: 4032687 - DNA, 17 bp, Homo sapiens
cgggcaggtcctgccca

SEQ ID NO: 4032688 - DNA, 15 bp, Homo sapiens
cgggcatgggcactc

SEQ ID NO: 4032689 - DNA, 17 bp, Homo sapiens
cgggcatgggcactccc

SEQ ID NO: 4032690 - DNA, 13 bp, Homo sapiens
cgggccacagggc

SEQ ID NO: 4032691 - DNA, 18 bp, Homo sapiens
cgggccacagggcggtgc

SEQ ID NO: 4032692 - DNA, 13 bp, Homo sapiens
cgggccaggcact

SEQ ID NO: 4032693 - DNA, 13 bp, Homo sapiens
cgggccaggcccg

SEQ ID NO: 4032694 - DNA, 15 bp, Homo sapiens
cgggccaggcccgca

SEQ ID NO: 4032695 - DNA, 23 bp, Homo sapiens
cgggccaggcccgcaccccggcc

SEQ ID NO: 4032696 - DNA, 13 bp, Homo sapiens
cgggccagggctg

SEQ ID NO: 4032697 - DNA, 18 bp, Homo sapiens
cgggccagggctgcccct

SEQ ID NO: 4032698 - DNA, 14 bp, Homo sapiens
cgggccatgaggga

SEQ ID NO: 4032699 - DNA, 21 bp, Homo sapiens
cgggccatgagggacagggtc

SEQ ID NO: 4032700 - DNA, 22 bp, Homo sapiens
cgggccatgagggacagggtct

SEQ ID NO: 4032701 - DNA, 15 bp, Homo sapiens
cgggccccacctgca

SEQ ID NO: 4032702 - DNA, 19 bp, Homo sapiens
cgggccccacctgcagctc

SEQ ID NO: 4032703 - DNA, 21 bp, Homo sapiens
cgggccccatcctcatccctg

SEQ ID NO: 4032704 - DNA, 19 bp, Homo sapiens
cgggcccctccatccaccc

SEQ ID NO: 4032705 - DNA, 23 bp, Homo sapiens
cgggcccctgggcttggcctgct

SEQ ID NO: 4032706 - DNA, 14 bp, Homo sapiens
cgggccgaggccca

SEQ ID NO: 4032707 - DNA, 15 bp, Homo sapiens
cgggccgaggcccag

SEQ ID NO: 4032708 - DNA, 21 bp, Homo sapiens
cgggctaacgggaggctgggc

SEQ ID NO: 4032709 - DNA, 22 bp, Homo sapiens
cgggctaacgggaggctgggca

SEQ ID NO: 4032710 - DNA, 23 bp, Homo sapiens
cgggctaacgggaggctgggcac

SEQ ID NO: 4032711 - DNA, 13 bp, Homo sapiens
cgggctccagcca

SEQ ID NO: 4032712 - DNA, 14 bp, Homo sapiens
cgggctctctgctg

SEQ ID NO: 4032713 - DNA, 15 bp, Homo sapiens
cgggctctctgctgt

SEQ ID NO: 4032714 - DNA, 16 bp, Homo sapiens
cgggctgaggccagag

SEQ ID NO: 4032715 - DNA, 17 bp, Homo sapiens
cgggctgaggccagagt

SEQ ID NO: 4032716 - DNA, 16 bp, Homo sapiens
cggggaagctgccagc

SEQ ID NO: 4032717 - DNA, 13 bp, Homo sapiens
cggggaagtgctc

SEQ ID NO: 4032718 - DNA, 16 bp, Homo sapiens
cggggacagaggcctg

SEQ ID NO: 4032719 - DNA, 23 bp, Homo sapiens
cggggagcggcggaaagcctgta

SEQ ID NO: 4032720 - DNA, 15 bp, Homo sapiens
cggggcagggccttc

SEQ ID NO: 4032721 - DNA, 22 bp, Homo sapiens
cggggccttatcgggctccagc

SEQ ID NO: 4032722 - DNA, 14 bp, Homo sapiens
cgggggagcccagt

SEQ ID NO: 4032723 - DNA, 16 bp, Homo sapiens
cgggggctgaggggca

SEQ ID NO: 4032724 - DNA, 15 bp, Homo sapiens
cggggtatcctgggg

SEQ ID NO: 4032725 - DNA, 22 bp, Homo sapiens
cggggtgagtccattctcccag

SEQ ID NO: 4032726 - DNA, 23 bp, Homo sapiens
cggggtgagtccattctcccagg

SEQ ID NO: 4032727 - DNA, 12 bp, Homo sapiens
cggggtggagca

SEQ ID NO: 4032728 - DNA, 22 bp, Homo sapiens
cggggtgtaacttcctgctgca

SEQ ID NO: 4032729 - DNA, 12 bp, Homo sapiens
cgggtcttccta

SEQ ID NO: 4032730 - DNA, 21 bp, Homo sapiens
cgggtgaacaaagcagccacg

SEQ ID NO: 4032731 - DNA, 18 bp, Homo sapiens
cgggtgatggccagcccc

SEQ ID NO: 4032732 - DNA, 22 bp, Homo sapiens
cgggtgtggcctcagccctcag

SEQ ID NO: 4032733 - DNA, 15 bp, Homo sapiens
cggtaactgtcctgt

SEQ ID NO: 4032734 - DNA, 15 bp, Homo sapiens
cggtagggaggcagc

SEQ ID NO: 4032735 - DNA, 17 bp, Homo sapiens
cggtagggaggcagcct

SEQ ID NO: 4032736 - DNA, 13 bp, Homo sapiens
cggtcacacggcc

SEQ ID NO: 4032737 - DNA, 12 bp, Homo sapiens
cggtccccatcc

SEQ ID NO: 4032738 - DNA, 23 bp, Homo sapiens
cggtccccatccccaccagctcg

SEQ ID NO: 4032739 - DNA, 14 bp, Homo sapiens
cggtccctgtccct

SEQ ID NO: 4032740 - DNA, 16 bp, Homo sapiens
cggtgaccactcttct

SEQ ID NO: 4032741 - DNA, 16 bp, Homo sapiens
cggtgctgcaggagtg

SEQ ID NO: 4032742 - DNA, 19 bp, Homo sapiens
cggtggcctattccaggaa

SEQ ID NO: 4032743 - DNA, 15 bp, Homo sapiens
cggtggcgggcacct

SEQ ID NO: 4032744 - DNA, 11 bp, Homo sapiens
cggtggctcac

SEQ ID NO: 4032745 - DNA, 16 bp, Homo sapiens
cggtggctgccccggc

SEQ ID NO: 4032746 - DNA, 12 bp, Homo sapiens
cggtggctgggc

SEQ ID NO: 4032747 - DNA, 16 bp, Homo sapiens
cggtgggggggcagag

SEQ ID NO: 4032748 - DNA, 20 bp, Homo sapiens
cggtgtggtgcagtgtgaaa

SEQ ID NO: 4032749 - DNA, 18 bp, Homo sapiens
cggttataaaaaatggtt

SEQ ID NO: 4032750 - DNA, 21 bp, Homo sapiens
cggttataaaaaatggttcag

SEQ ID NO: 4032751 - DNA, 20 bp, Homo sapiens
cggttatgaaattcaccccc

SEQ ID NO: 4032752 - DNA, 16 bp, Homo sapiens
cggttcagacccctgc

SEQ ID NO: 4032753 - DNA, 18 bp, Homo sapiens
cggtttagtcatccaaca

SEQ ID NO: 4032754 - DNA, 22 bp, Homo sapiens
cggtttatcgccctggcaggca

SEQ ID NO: 4032755 - DNA, 12 bp, Homo sapiens
cgtaaagatttg

SEQ ID NO: 4032756 - DNA, 14 bp, Homo sapiens
cgtaaccagccaga

SEQ ID NO: 4032757 - DNA, 14 bp, Homo sapiens
cgtacatctgcaat

SEQ ID NO: 4032758 - DNA, 14 bp, Homo sapiens
cgtactctcacatg

SEQ ID NO: 4032759 - DNA, 17 bp, Homo sapiens
cgtactctcacatgtgg

SEQ ID NO: 4032760 - DNA, 20 bp, Homo sapiens
cgtagcgtgcccgtgtgcat

SEQ ID NO: 4032761 - DNA, 17 bp, Homo sapiens
cgtagggagtacctgct

SEQ ID NO: 4032762 - DNA, 20 bp, Homo sapiens
cgtatgtctgttaccatgtc

SEQ ID NO: 4032763 - DNA, 18 bp, Homo sapiens
cgtcagggttggtgtgct

SEQ ID NO: 4032764 - DNA, 20 bp, Homo sapiens
cgtccaccccccacacacac

SEQ ID NO: 4032765 - DNA, 21 bp, Homo sapiens
cgtccaggggagatggggagg

SEQ ID NO: 4032766 - DNA, 21 bp, Homo sapiens
cgtccatcagggatctcagag

SEQ ID NO: 4032767 - DNA, 15 bp, Homo sapiens
cgtcccagcatccct

SEQ ID NO: 4032768 - DNA, 21 bp, Homo sapiens
cccatgagcctgcccgctgca

SEQ ID NO: 4032769 - DNA, 20 bp, Homo sapiens
cccatgagttgtcagctttg

SEQ ID NO: 4032770 - DNA, 12 bp, Homo sapiens
cccatgcactgt

SEQ ID NO: 4032771 - DNA, 18 bp, Homo sapiens
cccatgcactgtgaagga

SEQ ID NO: 4032772 - DNA, 14 bp, Homo sapiens
cccatgcaggccct

SEQ ID NO: 4032773 - DNA, 19 bp, Homo sapiens
cccatgcaggccctttgaa

SEQ ID NO: 4032774 - DNA, 13 bp, Homo sapiens
cccatgcctgtcc

SEQ ID NO: 4032775 - DNA, 20 bp, Homo sapiens
cccatgctcaaccactgtgg

SEQ ID NO: 4032776 - DNA, 15 bp, Homo sapiens
cccatggacactcca

SEQ ID NO: 4032777 - DNA, 20 bp, Homo sapiens
cccatggacactccagtgcc

SEQ ID NO: 4032778 - DNA, 20 bp, Homo sapiens
cccatggacaggctggctcc

SEQ ID NO: 4032779 - DNA, 22 bp, Homo sapiens
cccatggacaggctggctccag

SEQ ID NO: 4032780 - DNA, 13 bp, Homo sapiens
cccatggagccag

SEQ ID NO: 4032781 - DNA, 19 bp, Homo sapiens
cccatggagccagctccct

SEQ ID NO: 4032782 - DNA, 13 bp, Homo sapiens
cccatgggcccct

SEQ ID NO: 4032783 - DNA, 20 bp, Homo sapiens
cccatgggctcctgcccctt

SEQ ID NO: 4032784 - DNA, 14 bp, Homo sapiens
cccatgggctctga

SEQ ID NO: 4032785 - DNA, 22 bp, Homo sapiens
cccatgggttgtgtgtttattt

SEQ ID NO: 4032786 - DNA, 22 bp, Homo sapiens
cccatgtagccccctggcctct

SEQ ID NO: 4032787 - DNA, 23 bp, Homo sapiens
agccaggtaatgagggactggaa

SEQ ID NO: 4032788 - DNA, 16 bp, Homo sapiens
agccagtgaaatgtga

SEQ ID NO: 4032789 - DNA, 20 bp, Homo sapiens
agccagttgtcctatggaca

SEQ ID NO: 4032790 - DNA, 21 bp, Homo sapiens
agccagttgtcctatggacaa

SEQ ID NO: 4032791 - DNA, 20 bp, Homo sapiens
ccatgacagaggctgcaccc

SEQ ID NO: 4032792 - DNA, 19 bp, Homo sapiens
ccatgactgcacccagctc

SEQ ID NO: 4032793 - DNA, 20 bp, Homo sapiens
ccatgactgcacccagctcc

SEQ ID NO: 4032794 - DNA, 13 bp, Homo sapiens
ccatgagaagagg

SEQ ID NO: 4032795 - DNA, 19 bp, Homo sapiens
ccatgagaagagggcctgt

SEQ ID NO: 4032796 - DNA, 22 bp, Homo sapiens
ccatgagaataagagaaagaaa

SEQ ID NO: 4032797 - DNA, 15 bp, Homo sapiens
ccatgagaccctggt

SEQ ID NO: 4032798 - DNA, 23 bp, Homo sapiens
ccatgagaccctggtgcctggct

SEQ ID NO: 4032799 - DNA, 23 bp, Homo sapiens
ccatgagatgatacatccaaagc

SEQ ID NO: 4032800 - DNA, 22 bp, Homo sapiens
ccatgagcaccccaaggctgcg

SEQ ID NO: 4032801 - DNA, 12 bp, Homo sapiens
ccatgagcctgc

SEQ ID NO: 4032802 - DNA, 17 bp, Homo sapiens
ccatgaggaaggaacag

SEQ ID NO: 4032803 - DNA, 17 bp, Homo sapiens
ccatgatccctgtgttg

SEQ ID NO: 4032804 - DNA, 16 bp, Homo sapiens
ccatgatggcaacaga

SEQ ID NO: 4032805 - DNA, 23 bp, Homo sapiens
ccatgattctatttatatgtaca

SEQ ID NO: 4032806 - DNA, 16 bp, Homo sapiens
ccatgcactgtgaagg

SEQ ID NO: 4032807 - DNA, 17 bp, Homo sapiens
ccatgcactgtgaagga

SEQ ID NO: 4032808 - DNA, 20 bp, Homo sapiens
ccatgcatttcataaactaa

SEQ ID NO: 4032809 - DNA, 13 bp, Homo sapiens
ccatgccaaggcc

SEQ ID NO: 4032810 - DNA, 22 bp, Homo sapiens
ccatgccaaggcctccctcagg

SEQ ID NO: 4032811 - DNA, 20 bp, Homo sapiens
ccatgccagattctgcctct

SEQ ID NO: 4032812 - DNA, 16 bp, Homo sapiens
ccatgcccacctgccc

SEQ ID NO: 4032813 - DNA, 13 bp, Homo sapiens
ccatgcccactgc

SEQ ID NO: 4032814 - DNA, 16 bp, Homo sapiens
ccatgcccactgctgg

SEQ ID NO: 4032815 - DNA, 15 bp, Homo sapiens
ccatgcctagcagag

SEQ ID NO: 4032816 - DNA, 17 bp, Homo sapiens
ccatgcctgagggtgga

SEQ ID NO: 4032817 - DNA, 22 bp, Homo sapiens
ccatgcctgcccccctcatctc

SEQ ID NO: 4032818 - DNA, 19 bp, Homo sapiens
ccatgcctgtccagcctgg

SEQ ID NO: 4032819 - DNA, 16 bp, Homo sapiens
ccatgccttaaaccta

SEQ ID NO: 4032820 - DNA, 17 bp, Homo sapiens
ccatgctgggccactgg

SEQ ID NO: 4032821 - DNA, 17 bp, Homo sapiens
ccatggacactccagtg

SEQ ID NO: 4032822 - DNA, 14 bp, Homo sapiens
ccatggacaggctg

SEQ ID NO: 4032823 - DNA, 18 bp, Homo sapiens
ccatggacaggctggctc

SEQ ID NO: 4032824 - DNA, 14 bp, Homo sapiens
ccatggccttatga

SEQ ID NO: 4032825 - DNA, 21 bp, Homo sapiens
ccatgggaaatgtcaacaagt

SEQ ID NO: 4032826 - DNA, 17 bp, Homo sapiens
ccatgggatatgtggtg

SEQ ID NO: 4032827 - DNA, 13 bp, Homo sapiens
ccatgggctctga

SEQ ID NO: 4032828 - DNA, 19 bp, Homo sapiens
ccatgggcttcactgtata

SEQ ID NO: 4032829 - DNA, 20 bp, Homo sapiens
ccatgggcttcactgtataa

SEQ ID NO: 4032830 - DNA, 13 bp, Homo sapiens
ccatggggccctc

SEQ ID NO: 4032831 - DNA, 15 bp, Homo sapiens
ccatggggccctccc

SEQ ID NO: 4032832 - DNA, 14 bp, Homo sapiens
ccatggttgagaaa

SEQ ID NO: 4032833 - DNA, 13 bp, Homo sapiens
ccatgtactgtag

SEQ ID NO: 4032834 - DNA, 14 bp, Homo sapiens
ccatgtactgtagt

SEQ ID NO: 4032835 - DNA, 22 bp, Homo sapiens
ccatgtactgtagtttttcttc

SEQ ID NO: 4032836 - DNA, 20 bp, Homo sapiens
ccatgtagccccctggcctc

SEQ ID NO: 4032837 - DNA, 23 bp, Homo sapiens
ccatgtagccccctggcctctgt

SEQ ID NO: 4032838 - DNA, 14 bp, Homo sapiens
ccatgtccaaagag

SEQ ID NO: 4032839 - DNA, 17 bp, Homo sapiens
ccatgtccaaagaggct

SEQ ID NO: 4032840 - DNA, 15 bp, Homo sapiens
ccatgtccaagttct

SEQ ID NO: 4032841 - DNA, 20 bp, Homo sapiens
ccatgtccaagttcttcacc

SEQ ID NO: 4032842 - DNA, 20 bp, Homo sapiens
ccatgtctgcagtgtgcccc

SEQ ID NO: 4032843 - DNA, 21 bp, Homo sapiens
ccatgtctttctccaaagtta

SEQ ID NO: 4032844 - DNA, 16 bp, Homo sapiens
ccatgtgagctgctgc

SEQ ID NO: 4032845 - DNA, 21 bp, Homo sapiens
ccatgtgagctgctgccatga

SEQ ID NO: 4032846 - DNA, 19 bp, Homo sapiens
ccatgtgcacccggcctgg

SEQ ID NO: 4032847 - DNA, 20 bp, Homo sapiens
ccatgtgcacccggcctgga

SEQ ID NO: 4032848 - DNA, 19 bp, Homo sapiens
ccatgtgccatctgtacat

SEQ ID NO: 4032849 - DNA, 22 bp, Homo sapiens
ccatgtgccatctgtacatatt

SEQ ID NO: 4032850 - DNA, 18 bp, Homo sapiens
ccatgtgcctttctttgc

SEQ ID NO: 4032851 - DNA, 20 bp, Homo sapiens
ccatgtgcctttctttgcct

SEQ ID NO: 4032852 - DNA, 23 bp, Homo sapiens
ccatgtgcctttctttgcctctg

SEQ ID NO: 4032853 - DNA, 21 bp, Homo sapiens
ccatgtggataactttacaga

SEQ ID NO: 4032854 - DNA, 16 bp, Homo sapiens
ccatgtgggcacggag

SEQ ID NO: 4032855 - DNA, 18 bp, Homo sapiens
ccatgtggtggcacaggc

SEQ ID NO: 4032856 - DNA, 20 bp, Homo sapiens
ccatgtgtcacttgtgcttt

SEQ ID NO: 4032857 - DNA, 13 bp, Homo sapiens
ccatgtgtcccct

SEQ ID NO: 4032858 - DNA, 14 bp, Homo sapiens
ccatgtgtcccctc

SEQ ID NO: 4032859 - DNA, 16 bp, Homo sapiens
ccatgtgtcccctcac

SEQ ID NO: 4032860 - DNA, 20 bp, Homo sapiens
ccatgtgtcccctcactctg

SEQ ID NO: 4032861 - DNA, 17 bp, Homo sapiens
ccatgtgtcctggttcc

SEQ ID NO: 4032862 - DNA, 15 bp, Homo sapiens
ccatgtgtggactca

SEQ ID NO: 4032863 - DNA, 16 bp, Homo sapiens
ccattaaagtctgaat

SEQ ID NO: 4032864 - DNA, 14 bp, Homo sapiens
ccattaataaagac

SEQ ID NO: 4032865 - DNA, 18 bp, Homo sapiens
ccattaatcatttcccca

SEQ ID NO: 4032866 - DNA, 21 bp, Homo sapiens
ccattacacgatcacctgcat

SEQ ID NO: 4032867 - DNA, 20 bp, Homo sapiens
ccattaggccagcaacgctt

SEQ ID NO: 4032868 - DNA, 21 bp, Homo sapiens
ccattatccctgaatccccct

SEQ ID NO: 4032869 - DNA, 15 bp, Homo sapiens
ccattcatccttcca

SEQ ID NO: 4032870 - DNA, 16 bp, Homo sapiens
ccattcatccttccat

SEQ ID NO: 4032871 - DNA, 19 bp, Homo sapiens
ccattcatccttccatcca

SEQ ID NO: 4032872 - DNA, 20 bp, Homo sapiens
ccattcatccttccatccat

SEQ ID NO: 4032873 - DNA, 22 bp, Homo sapiens
ccattccaaagctttattacca

SEQ ID NO: 4032874 - DNA, 21 bp, Homo sapiens
ccattccttgcgcctcagccc

SEQ ID NO: 4032875 - DNA, 17 bp, Homo sapiens
ccattctattttagaat

SEQ ID NO: 4032876 - DNA, 18 bp, Homo sapiens
ccattctccacagcaacc

SEQ ID NO: 4032877 - DNA, 11 bp, Homo sapiens
ccattctccca

SEQ ID NO: 4032878 - DNA, 23 bp, Homo sapiens
ccattctcccaggtaccagctgc

SEQ ID NO: 4032879 - DNA, 19 bp, Homo sapiens
ccattctgtcctaccttta

SEQ ID NO: 4032880 - DNA, 19 bp, Homo sapiens
ccattgaagccgactctgg

SEQ ID NO: 4032881 - DNA, 23 bp, Homo sapiens
ccattgaagccgactctggccct

SEQ ID NO: 4032882 - DNA, 21 bp, Homo sapiens
ccattgccaccaggagaacca

SEQ ID NO: 4032883 - DNA, 17 bp, Homo sapiens
ccattgcctagctcttt

SEQ ID NO: 4032884 - DNA, 14 bp, Homo sapiens
ccattgcggcccca

SEQ ID NO: 4032885 - DNA, 20 bp, Homo sapiens
ccattgcggccccaggaggg

SEQ ID NO: 4032886 - DNA, 21 bp, Homo sapiens
ccattgctcttagtcccaagc

SEQ ID NO: 4032887 - DNA, 20 bp, Homo sapiens
ccattggctatttaaaactt

SEQ ID NO: 4032888 - DNA, 22 bp, Homo sapiens
ccattggttggaagctaccaga

SEQ ID NO: 4032889 - DNA, 20 bp, Homo sapiens
ccattgtgcctaagtccagt

SEQ ID NO: 4032890 - DNA, 14 bp, Homo sapiens
ccatttaaaaagtt

SEQ ID NO: 4032891 - DNA, 14 bp, Homo sapiens
ccatttaataaaga

SEQ ID NO: 4032892 - DNA, 21 bp, Homo sapiens
ccatttaataaagaaatattt

SEQ ID NO: 4032893 - DNA, 16 bp, Homo sapiens
ccagtgggacagagga

SEQ ID NO: 4032894 - DNA, 17 bp, Homo sapiens
ccagtgggacagaggag

SEQ ID NO: 4032895 - DNA, 17 bp, Homo sapiens
ccagtgggatgggacag

SEQ ID NO: 4032896 - DNA, 19 bp, Homo sapiens
ccagtggggaactgagggc

SEQ ID NO: 4032897 - DNA, 22 bp, Homo sapiens
ccagtggggcctgtggaatgag

SEQ ID NO: 4032898 - DNA, 16 bp, Homo sapiens
ccagtgggtctgggat

SEQ ID NO: 4032899 - DNA, 20 bp, Homo sapiens
ccagtgtatcaggtcaggga

SEQ ID NO: 4032900 - DNA, 16 bp, Homo sapiens
ccagtgtcacctctct

SEQ ID NO: 4032901 - DNA, 13 bp, Homo sapiens
ccagtgtcctcca

SEQ ID NO: 4032902 - DNA, 17 bp, Homo sapiens
ccagtgtcctccaagtg

SEQ ID NO: 4032903 - DNA, 22 bp, Homo sapiens
ccagtgtcctccaagtgccccc

SEQ ID NO: 4032904 - DNA, 18 bp, Homo sapiens
ccagtgtgggcttgacca

SEQ ID NO: 4032905 - DNA, 13 bp, Homo sapiens
ccagttaattttt

SEQ ID NO: 4032906 - DNA, 18 bp, Homo sapiens
ccagttcattgcactttg

SEQ ID NO: 4032907 - DNA, 12 bp, Homo sapiens
ccagttgggact

SEQ ID NO: 4032908 - DNA, 18 bp, Homo sapiens
ccagttgggactcaggat

SEQ ID NO: 4032909 - DNA, 19 bp, Homo sapiens
ccagtttctgtaaggtctt

SEQ ID NO: 4032910 - DNA, 18 bp, Homo sapiens
ccagtttgaagcctgtgc

SEQ ID NO: 4032911 - DNA, 20 bp, Homo sapiens
ccagtttgaagcctgtgcct

SEQ ID NO: 4032912 - DNA, 21 bp, Homo sapiens
ccagtttgaagcctgtgcctc

SEQ ID NO: 4032913 - DNA, 12 bp, Homo sapiens
ccagttttccct

SEQ ID NO: 4032914 - DNA, 20 bp, Homo sapiens
ccagttttccctggaactcc

SEQ ID NO: 4032915 - DNA, 18 bp, Homo sapiens
ccataaacagtaatgact

SEQ ID NO: 4032916 - DNA, 13 bp, Homo sapiens
ccataacagccaa

SEQ ID NO: 4032917 - DNA, 17 bp, Homo sapiens
ccataagcctccattta

SEQ ID NO: 4032918 - DNA, 19 bp, Homo sapiens
ccataataaaaggctttga

SEQ ID NO: 4032919 - DNA, 24 bp, Homo sapiens
ccataataaagcaatctgattcag

SEQ ID NO: 4032920 - DNA, 22 bp, Homo sapiens
ccataataagagaatgttccta

SEQ ID NO: 4032921 - DNA, 15 bp, Homo sapiens
ccatactcagcctgc

SEQ ID NO: 4032922 - DNA, 21 bp, Homo sapiens
ccatactccttgcttcctgat

SEQ ID NO: 4032923 - DNA, 22 bp, Homo sapiens
ccatacttttggctcctctagt

SEQ ID NO: 4032924 - DNA, 16 bp, Homo sapiens
ccatagaccctgaggc

SEQ ID NO: 4032925 - DNA, 14 bp, Homo sapiens
ccataggacatact

SEQ ID NO: 4032926 - DNA, 12 bp, Homo sapiens
ccataggagagg

SEQ ID NO: 4032927 - DNA, 18 bp, Homo sapiens
ccataggtttctctccct

SEQ ID NO: 4032928 - DNA, 18 bp, Homo sapiens
ccatagttgacagttcca

SEQ ID NO: 4032929 - DNA, 18 bp, Homo sapiens
ccatatatgaccagaagc

SEQ ID NO: 4032930 - DNA, 19 bp, Homo sapiens
ccatatatgaccagaagcc

SEQ ID NO: 4032931 - DNA, 20 bp, Homo sapiens
ccatatatgaccagaagcct

SEQ ID NO: 4032932 - DNA, 21 bp, Homo sapiens
ccatatcaaaagacacagggg

SEQ ID NO: 4032933 - DNA, 12 bp, Homo sapiens
ccatatcctggt

SEQ ID NO: 4032934 - DNA, 17 bp, Homo sapiens
ccatatccttctggctg

SEQ ID NO: 4032935 - DNA, 18 bp, Homo sapiens
ccatatctccatggccct

SEQ ID NO: 4032936 - DNA, 17 bp, Homo sapiens
ccatatgaattgtacag

SEQ ID NO: 4032937 - DNA, 15 bp, Homo sapiens
ccatattacctggat

SEQ ID NO: 4032938 - DNA, 14 bp, Homo sapiens
ccatattggccagt

SEQ ID NO: 4032939 - DNA, 22 bp, Homo sapiens
ccatatttacattctagttcag

SEQ ID NO: 4032940 - DNA, 23 bp, Homo sapiens
ccatatttacattctagttcaga

SEQ ID NO: 4032941 - DNA, 18 bp, Homo sapiens
ccatatttactaccttat

SEQ ID NO: 4032942 - DNA, 19 bp, Homo sapiens
ccatcaaaatgctttttat

SEQ ID NO: 4032943 - DNA, 23 bp, Homo sapiens
ccatcaactcccaacttcttcct

SEQ ID NO: 4032944 - DNA, 22 bp, Homo sapiens
ccatcaagaacctacagactcc

SEQ ID NO: 4032945 - DNA, 17 bp, Homo sapiens
ccatcacaatacagata

SEQ ID NO: 4032946 - DNA, 20 bp, Homo sapiens
ccatcacagggttgggccca

SEQ ID NO: 4032947 - DNA, 19 bp, Homo sapiens
ccatcaccataacctctgg

SEQ ID NO: 4032948 - DNA, 13 bp, Homo sapiens
ccatcagctccct

SEQ ID NO: 4032949 - DNA, 19 bp, Homo sapiens
ccatcagctgtaagaagag

SEQ ID NO: 4032950 - DNA, 20 bp, Homo sapiens
ccatcagggttctcttagca

SEQ ID NO: 4032951 - DNA, 17 bp, Homo sapiens
ccatcattataaacgtg

SEQ ID NO: 4032952 - DNA, 11 bp, Homo sapiens
ccatcatttta

SEQ ID NO: 4032953 - DNA, 16 bp, Homo sapiens
ccatcattttacagtg

SEQ ID NO: 4032954 - DNA, 21 bp, Homo sapiens
ccatcattttacagtgacctt

SEQ ID NO: 4032955 - DNA, 20 bp, Homo sapiens
ccatccaggtcttgactcat

SEQ ID NO: 4032956 - DNA, 21 bp, Homo sapiens
ccatccataaatccagttcta

SEQ ID NO: 4032957 - DNA, 14 bp, Homo sapiens
ccatccatctccag

SEQ ID NO: 4032958 - DNA, 16 bp, Homo sapiens
ccatccatctccaggg

SEQ ID NO: 4032959 - DNA, 15 bp, Homo sapiens
ccatccccaccagct

SEQ ID NO: 4032960 - DNA, 16 bp, Homo sapiens
ccatccccaccagctc

SEQ ID NO: 4032961 - DNA, 23 bp, Homo sapiens
ccatccctcgggaagcagccagc

SEQ ID NO: 4032962 - DNA, 11 bp, Homo sapiens
ccatccctgcc

SEQ ID NO: 4032963 - DNA, 20 bp, Homo sapiens
ccatccctgggcccctccac

SEQ ID NO: 4032964 - DNA, 19 bp, Homo sapiens
ccatcctatccactgggca

SEQ ID NO: 4032965 - DNA, 13 bp, Homo sapiens
ccatcctgactga

SEQ ID NO: 4032966 - DNA, 11 bp, Homo sapiens
ccatcctgcca

SEQ ID NO: 4032967 - DNA, 12 bp, Homo sapiens
ccatcctggcta

SEQ ID NO: 4032968 - DNA, 17 bp, Homo sapiens
ccatccttcaccagagc

SEQ ID NO: 4032969 - DNA, 19 bp, Homo sapiens
ccatccttcaccagagccc

SEQ ID NO: 4032970 - DNA, 14 bp, Homo sapiens
ccatctagccagcc

SEQ ID NO: 4032971 - DNA, 17 bp, Homo sapiens
ccatctcagcctcctga

SEQ ID NO: 4032972 - DNA, 22 bp, Homo sapiens
ccatctcagcctcctgagcctg

SEQ ID NO: 4032973 - DNA, 20 bp, Homo sapiens
ccatctcatgtatcatctgg

SEQ ID NO: 4032974 - DNA, 17 bp, Homo sapiens
ccatctcccaccctgta

SEQ ID NO: 4032975 - DNA, 20 bp, Homo sapiens
ccatctcctgctcaccacct

SEQ ID NO: 4032976 - DNA, 18 bp, Homo sapiens
ccatctctcatcctccag

SEQ ID NO: 4032977 - DNA, 17 bp, Homo sapiens
ccatctctccctcccct

SEQ ID NO: 4032978 - DNA, 23 bp, Homo sapiens
ccatctctccctcccctgccatt

SEQ ID NO: 4032979 - DNA, 13 bp, Homo sapiens
ccatctcttccta

SEQ ID NO: 4032980 - DNA, 20 bp, Homo sapiens
ccatctgatccccatgccta

SEQ ID NO: 4032981 - DNA, 17 bp, Homo sapiens
ccatctgattaaaacaa

SEQ ID NO: 4032982 - DNA, 20 bp, Homo sapiens
ccatctgcaccccttctctc

SEQ ID NO: 4032983 - DNA, 20 bp, Homo sapiens
ccatctgcgtgacaataaaa

SEQ ID NO: 4032984 - DNA, 23 bp, Homo sapiens
ccatctgcgtgacaataaaacat

SEQ ID NO: 4032985 - DNA, 17 bp, Homo sapiens
ccatctgggtccttgca

SEQ ID NO: 4032986 - DNA, 12 bp, Homo sapiens
ccatctgtccag

SEQ ID NO: 4032987 - DNA, 15 bp, Homo sapiens
ccatcttacttgagc

SEQ ID NO: 4032988 - DNA, 15 bp, Homo sapiens
ccatcttcataattt

SEQ ID NO: 4032989 - DNA, 17 bp, Homo sapiens
ccatctttactcccaag

SEQ ID NO: 4032990 - DNA, 19 bp, Homo sapiens
ccatgaaaacgttttattg

SEQ ID NO: 4032991 - DNA, 13 bp, Homo sapiens
ccatgaaacaaag

SEQ ID NO: 4032992 - DNA, 22 bp, Homo sapiens
ccatgaactgtcaagtgtgtgt

SEQ ID NO: 4032993 - DNA, 13 bp, Homo sapiens
ccatgaagacagg

SEQ ID NO: 4032994 - DNA, 15 bp, Homo sapiens
ccatgaagacaggat

SEQ ID NO: 4032995 - DNA, 19 bp, Homo sapiens
ccatgacagaggctgcacc

SEQ ID NO: 4032996 - DNA, 17 bp, Homo sapiens
ccaggctgtgggcctca

SEQ ID NO: 4032997 - DNA, 21 bp, Homo sapiens
ccaggctgtgggcctcaagga

SEQ ID NO: 4032998 - DNA, 20 bp, Homo sapiens
ccaggctgtgggtagatgtg

SEQ ID NO: 4032999 - DNA, 14 bp, Homo sapiens
ccaggctgttctcc

SEQ ID NO: 4033000 - DNA, 18 bp, Homo sapiens
ccaggctgttctccaggc

SEQ ID NO: 4033001 - DNA, 14 bp, Homo sapiens
ccaggcttcacagt

SEQ ID NO: 4033002 - DNA, 16 bp, Homo sapiens
ccaggcttcacagtct

SEQ ID NO: 4033003 - DNA, 14 bp, Homo sapiens
ccaggcttcttcct

SEQ ID NO: 4033004 - DNA, 18 bp, Homo sapiens
ccaggctttgtacagagt

SEQ ID NO: 4033005 - DNA, 17 bp, Homo sapiens
ccagggaagctgtccct

SEQ ID NO: 4033006 - DNA, 23 bp, Homo sapiens
ccagggacagaggccccagcctc

SEQ ID NO: 4033007 - DNA, 16 bp, Homo sapiens
ccagggagcaagacag

SEQ ID NO: 4033008 - DNA, 22 bp, Homo sapiens
ccagggagcttgaaagttttca

SEQ ID NO: 4033009 - DNA, 13 bp, Homo sapiens
ccagggagtccag

SEQ ID NO: 4033010 - DNA, 16 bp, Homo sapiens
ccagggagtccagggt

SEQ ID NO: 4033011 - DNA, 15 bp, Homo sapiens
ccagggatgctgggc

SEQ ID NO: 4033012 - DNA, 17 bp, Homo sapiens
ccagggatgctgggctg

SEQ ID NO: 4033013 - DNA, 20 bp, Homo sapiens
ccagggatgctgggctgggc

SEQ ID NO: 4033014 - DNA, 21 bp, Homo sapiens
ccagggatgggggatgggcca

SEQ ID NO: 4033015 - DNA, 23 bp, Homo sapiens
ccagggcattcgggccacagggc

SEQ ID NO: 4033016 - DNA, 14 bp, Homo sapiens
ccagggccacgctc

SEQ ID NO: 4033017 - DNA, 18 bp, Homo sapiens
ccagggccacgctccagc

SEQ ID NO: 4033018 - DNA, 19 bp, Homo sapiens
ccagggccacgctccagct

SEQ ID NO: 4033019 - DNA, 19 bp, Homo sapiens
ccagggcccaccccagcct

SEQ ID NO: 4033020 - DNA, 14 bp, Homo sapiens
ccagggcccagagc

SEQ ID NO: 4033021 - DNA, 15 bp, Homo sapiens
ccagggcccagagcc

SEQ ID NO: 4033022 - DNA, 18 bp, Homo sapiens
ccagggcccagagcccag

SEQ ID NO: 4033023 - DNA, 19 bp, Homo sapiens
ccagggcccagagcccagc

SEQ ID NO: 4033024 - DNA, 22 bp, Homo sapiens
ccagggcccctcaccctgcctt

SEQ ID NO: 4033025 - DNA, 15 bp, Homo sapiens
ccagggccctggcca

SEQ ID NO: 4033026 - DNA, 16 bp, Homo sapiens
ccagggccgaggaggt

SEQ ID NO: 4033027 - DNA, 13 bp, Homo sapiens
ccagggcctccag

SEQ ID NO: 4033028 - DNA, 17 bp, Homo sapiens
ccagggcctccagggcc

SEQ ID NO: 4033029 - DNA, 19 bp, Homo sapiens
ccagggcctgacaccccct

SEQ ID NO: 4033030 - DNA, 19 bp, Homo sapiens
ccagggctagtgacttgtg

SEQ ID NO: 4033031 - DNA, 14 bp, Homo sapiens
ccagggctggctct

SEQ ID NO: 4033032 - DNA, 14 bp, Homo sapiens
ccagggctggggac

SEQ ID NO: 4033033 - DNA, 21 bp, Homo sapiens
ccagggctggggcagcctctg

SEQ ID NO: 4033034 - DNA, 16 bp, Homo sapiens
ccaggggaaggccctg

SEQ ID NO: 4033035 - DNA, 18 bp, Homo sapiens
ccaggggaaggccctgag

SEQ ID NO: 4033036 - DNA, 18 bp, Homo sapiens
ccaggggagatggggagg

SEQ ID NO: 4033037 - DNA, 18 bp, Homo sapiens
ccaggggcccacagggaa

SEQ ID NO: 4033038 - DNA, 14 bp, Homo sapiens
ccaggggcccttgg

SEQ ID NO: 4033039 - DNA, 21 bp, Homo sapiens
ccaggggctggtgggacagtg

SEQ ID NO: 4033040 - DNA, 20 bp, Homo sapiens
ccaggggggtgaggagctgg

SEQ ID NO: 4033041 - DNA, 16 bp, Homo sapiens
ccaggggtctccctgg

SEQ ID NO: 4033042 - DNA, 18 bp, Homo sapiens
ccaggggtctccctggag

SEQ ID NO: 4033043 - DNA, 15 bp, Homo sapiens
ccaggggtctgtctg

SEQ ID NO: 4033044 - DNA, 18 bp, Homo sapiens
ccagggtctctccctcag

SEQ ID NO: 4033045 - DNA, 20 bp, Homo sapiens
ccagggtctgtgtgaatgtg

SEQ ID NO: 4033046 - DNA, 14 bp, Homo sapiens
ccagggtgagagct

SEQ ID NO: 4033047 - DNA, 16 bp, Homo sapiens
ccagggttgatcacac

SEQ ID NO: 4033048 - DNA, 17 bp, Homo sapiens
ccagggtttacccagtg

SEQ ID NO: 4033049 - DNA, 16 bp, Homo sapiens
ccaggtaatgagggac

SEQ ID NO: 4033050 - DNA, 16 bp, Homo sapiens
ccaggtacctcatggg

SEQ ID NO: 4033051 - DNA, 17 bp, Homo sapiens
ccaggtatggctctgca

SEQ ID NO: 4033052 - DNA, 14 bp, Homo sapiens
ccaggtcacacgac

SEQ ID NO: 4033053 - DNA, 22 bp, Homo sapiens
ccaggtcctctgatacccagag

SEQ ID NO: 4033054 - DNA, 15 bp, Homo sapiens
ccaggtcttgactca

SEQ ID NO: 4033055 - DNA, 15 bp, Homo sapiens
ccaggtgagctctga

SEQ ID NO: 4033056 - DNA, 17 bp, Homo sapiens
ccaggtgagctctgacc

SEQ ID NO: 4033057 - DNA, 16 bp, Homo sapiens
ccaggtggagggcaca

SEQ ID NO: 4033058 - DNA, 19 bp, Homo sapiens
ccaggtggagggcacagcc

SEQ ID NO: 4033059 - DNA, 20 bp, Homo sapiens
ccaggtggagggcacagccc

SEQ ID NO: 4033060 - DNA, 20 bp, Homo sapiens
ccaggttcaacccacagcta

SEQ ID NO: 4033061 - DNA, 16 bp, Homo sapiens
ccaggttgaaagacct

SEQ ID NO: 4033062 - DNA, 22 bp, Homo sapiens
ccagtaaaatactattgcctca

SEQ ID NO: 4033063 - DNA, 18 bp, Homo sapiens
ccagtacctccaagcaag

SEQ ID NO: 4033064 - DNA, 16 bp, Homo sapiens
ccagtacgtgctaaca

SEQ ID NO: 4033065 - DNA, 13 bp, Homo sapiens
ccagtcacctccc

SEQ ID NO: 4033066 - DNA, 22 bp, Homo sapiens
ccagtcactccctctgccttca

SEQ ID NO: 4033067 - DNA, 21 bp, Homo sapiens
ccagtcaggctgcagaggcac

SEQ ID NO: 4033068 - DNA, 14 bp, Homo sapiens
ccagtcccattcct

SEQ ID NO: 4033069 - DNA, 15 bp, Homo sapiens
ccagtccccacccct

SEQ ID NO: 4033070 - DNA, 16 bp, Homo sapiens
ccagtccccacccctg

SEQ ID NO: 4033071 - DNA, 18 bp, Homo sapiens
ccagtccccacccctgcc

SEQ ID NO: 4033072 - DNA, 15 bp, Homo sapiens
ccagtccccccaccc

SEQ ID NO: 4033073 - DNA, 17 bp, Homo sapiens
ccagtcctgcctggcca

SEQ ID NO: 4033074 - DNA, 18 bp, Homo sapiens
ccagtcctgcctggccag

SEQ ID NO: 4033075 - DNA, 22 bp, Homo sapiens
ccagtcctgcctggccaggcag

SEQ ID NO: 4033076 - DNA, 15 bp, Homo sapiens
ccagtcctgctacct

SEQ ID NO: 4033077 - DNA, 12 bp, Homo sapiens
ccagtctcccag

SEQ ID NO: 4033078 - DNA, 16 bp, Homo sapiens
ccagtctctcttaaag

SEQ ID NO: 4033079 - DNA, 16 bp, Homo sapiens
ccagtctgttccccat

SEQ ID NO: 4033080 - DNA, 13 bp, Homo sapiens
ccagtgaaatgtg

SEQ ID NO: 4033081 - DNA, 22 bp, Homo sapiens
ccagtgaactcctgccaggcac

SEQ ID NO: 4033082 - DNA, 15 bp, Homo sapiens
ccagtgaagcctctg

SEQ ID NO: 4033083 - DNA, 16 bp, Homo sapiens
ccagtgacacttcaga

SEQ ID NO: 4033084 - DNA, 19 bp, Homo sapiens
ccagtgacacttcagagag

SEQ ID NO: 4033085 - DNA, 24 bp, Homo sapiens
ccagtgacacttcagagagctggt

SEQ ID NO: 4033086 - DNA, 17 bp, Homo sapiens
ccagtgacccctgacct

SEQ ID NO: 4033087 - DNA, 23 bp, Homo sapiens
ccagtgacctggaaggcccagca

SEQ ID NO: 4033088 - DNA, 19 bp, Homo sapiens
ccagtgagactgccccacg

SEQ ID NO: 4033089 - DNA, 13 bp, Homo sapiens
ccagtgcagccac

SEQ ID NO: 4033090 - DNA, 14 bp, Homo sapiens
ccagtgcagccact

SEQ ID NO: 4033091 - DNA, 15 bp, Homo sapiens
ccagtgcagccactg

SEQ ID NO: 4033092 - DNA, 16 bp, Homo sapiens
ccagtgcagccactgg

SEQ ID NO: 4033093 - DNA, 21 bp, Homo sapiens
ccagtgcggttcctcatctga

SEQ ID NO: 4033094 - DNA, 13 bp, Homo sapiens
ccagtgctctgcc

SEQ ID NO: 4033095 - DNA, 18 bp, Homo sapiens
ccagtgctctgcctcaga

SEQ ID NO: 4033096 - DNA, 16 bp, Homo sapiens
ccagtggaggtttgtc

SEQ ID NO: 4033097 - DNA, 22 bp, Homo sapiens
ccagtggattcttgttttgctt

SEQ ID NO: 4033098 - DNA, 18 bp, Homo sapiens
ccagtggctatggcctgt

SEQ ID NO: 4033099 - DNA, 17 bp, Homo sapiens
ccatttacatgttttaa

SEQ ID NO: 4033100 - DNA, 20 bp, Homo sapiens
ccatttacatgttttaaaga

SEQ ID NO: 4033101 - DNA, 17 bp, Homo sapiens
ccatttcaggaatttaa

SEQ ID NO: 4033102 - DNA, 16 bp, Homo sapiens
ccatttcagtggcttc

SEQ ID NO: 4033103 - DNA, 16 bp, Homo sapiens
ccatttcccacatctt

SEQ ID NO: 4033104 - DNA, 18 bp, Homo sapiens
ccatttcccacatctttc

SEQ ID NO: 4033105 - DNA, 13 bp, Homo sapiens
ccatttcccatct

SEQ ID NO: 4033106 - DNA, 15 bp, Homo sapiens
ccatttcccatctgc

SEQ ID NO: 4033107 - DNA, 17 bp, Homo sapiens
ccatttcccatctgcac

SEQ ID NO: 4033108 - DNA, 14 bp, Homo sapiens
ccatttccttggag

SEQ ID NO: 4033109 - DNA, 23 bp, Homo sapiens
ccatttctaaagctgaatgtcaa

SEQ ID NO: 4033110 - DNA, 14 bp, Homo sapiens
ccatttctatttat

SEQ ID NO: 4033111 - DNA, 19 bp, Homo sapiens
ccatttctcactagtgtca

SEQ ID NO: 4033112 - DNA, 14 bp, Homo sapiens
ccatttctcactga

SEQ ID NO: 4033113 - DNA, 12 bp, Homo sapiens
ccatttctgcct

SEQ ID NO: 4033114 - DNA, 13 bp, Homo sapiens
ccatttgtaataa

SEQ ID NO: 4033115 - DNA, 13 bp, Homo sapiens
ccatttgtcccag

SEQ ID NO: 4033116 - DNA, 14 bp, Homo sapiens
ccatttgttcctgc

SEQ ID NO: 4033117 - DNA, 16 bp, Homo sapiens
ccatttgttcctgctt

SEQ ID NO: 4033118 - DNA, 18 bp, Homo sapiens
ccattttcaactgctttg

SEQ ID NO: 4033119 - DNA, 17 bp, Homo sapiens
ccattttctatcatgga

SEQ ID NO: 4033120 - DNA, 14 bp, Homo sapiens
ccattttgtgaatg

SEQ ID NO: 4033121 - DNA, 15 bp, Homo sapiens
cccaaaacccagggc

SEQ ID NO: 4033122 - DNA, 14 bp, Homo sapiens
cccaaacatagccc

SEQ ID NO: 4033123 - DNA, 15 bp, Homo sapiens
cccaaagctttcctg

SEQ ID NO: 4033124 - DNA, 20 bp, Homo sapiens
cccaaagctttcctgcccca

SEQ ID NO: 4033125 - DNA, 14 bp, Homo sapiens
cccaaatgagccat

SEQ ID NO: 4033126 - DNA, 19 bp, Homo sapiens
cccaaatttgattgatttg

SEQ ID NO: 4033127 - DNA, 16 bp, Homo sapiens
cccaacagccttagct

SEQ ID NO: 4033128 - DNA, 19 bp, Homo sapiens
cccaacagccttagctgcc

SEQ ID NO: 4033129 - DNA, 20 bp, Homo sapiens
cccaacccattcactacagg

SEQ ID NO: 4033130 - DNA, 12 bp, Homo sapiens
cccaacccccac

SEQ ID NO: 4033131 - DNA, 19 bp, Homo sapiens
cccaacctcagggctccca

SEQ ID NO: 4033132 - DNA, 22 bp, Homo sapiens
cccaacctcagggctcccaggg

SEQ ID NO: 4033133 - DNA, 15 bp, Homo sapiens
cccaactctcccctg

SEQ ID NO: 4033134 - DNA, 11 bp, Homo sapiens
cccaactgtct

SEQ ID NO: 4033135 - DNA, 17 bp, Homo sapiens
cccaactgtgagcaagg

SEQ ID NO: 4033136 - DNA, 18 bp, Homo sapiens
cccaagacagatgcccca

SEQ ID NO: 4033137 - DNA, 20 bp, Homo sapiens
cccaagacagatgccccaga

SEQ ID NO: 4033138 - DNA, 14 bp, Homo sapiens
cccaagagcaaggg

SEQ ID NO: 4033139 - DNA, 16 bp, Homo sapiens
cccaagcccaggccac

SEQ ID NO: 4033140 - DNA, 12 bp, Homo sapiens
cccaagctcaga

SEQ ID NO: 4033141 - DNA, 20 bp, Homo sapiens
cccaagcttaatagccctcc

SEQ ID NO: 4033142 - DNA, 14 bp, Homo sapiens
cccaagcttagaac

SEQ ID NO: 4033143 - DNA, 14 bp, Homo sapiens
cccaaggaaagccc

SEQ ID NO: 4033144 - DNA, 19 bp, Homo sapiens
cccaaggaaagccccagca

SEQ ID NO: 4033145 - DNA, 12 bp, Homo sapiens
cccaaggacaag

SEQ ID NO: 4033146 - DNA, 15 bp, Homo sapiens
cccaaggactgaggg

SEQ ID NO: 4033147 - DNA, 19 bp, Homo sapiens
cccaaggtcccctccacat

SEQ ID NO: 4033148 - DNA, 14 bp, Homo sapiens
cccaaggtcctctc

SEQ ID NO: 4033149 - DNA, 17 bp, Homo sapiens
cccaaggtcctctcagt

SEQ ID NO: 4033150 - DNA, 22 bp, Homo sapiens
cccaaggttctgggtgcaggag

SEQ ID NO: 4033151 - DNA, 15 bp, Homo sapiens
cccaaggttggagcc

SEQ ID NO: 4033152 - DNA, 19 bp, Homo sapiens
cccaaggttggagcccagg

SEQ ID NO: 4033153 - DNA, 17 bp, Homo sapiens
cccaagtcacacccact

SEQ ID NO: 4033154 - DNA, 19 bp, Homo sapiens
cccaagtgcactttctaat

SEQ ID NO: 4033155 - DNA, 18 bp, Homo sapiens
cccaagtggtgaatgaca

SEQ ID NO: 4033156 - DNA, 21 bp, Homo sapiens
cccaagtttccatagcaacag

SEQ ID NO: 4033157 - DNA, 11 bp, Homo sapiens
cccaataaaag

SEQ ID NO: 4033158 - DNA, 12 bp, Homo sapiens
cccaataaaagt

SEQ ID NO: 4033159 - DNA, 14 bp, Homo sapiens
cccaataaaagtga

SEQ ID NO: 4033160 - DNA, 19 bp, Homo sapiens
cccaataaaagtgactctc

SEQ ID NO: 4033161 - DNA, 16 bp, Homo sapiens
cccaatccatcagtgc

SEQ ID NO: 4033162 - DNA, 22 bp, Homo sapiens
cccaatttcggattttttccaa

SEQ ID NO: 4033163 - DNA, 11 bp, Homo sapiens
cccacacacac

SEQ ID NO: 4033164 - DNA, 16 bp, Homo sapiens
cccacacagctgccct

SEQ ID NO: 4033165 - DNA, 13 bp, Homo sapiens
cccacaccagcct

SEQ ID NO: 4033166 - DNA, 16 bp, Homo sapiens
cccacaccccagccca

SEQ ID NO: 4033167 - DNA, 15 bp, Homo sapiens
cccacacctctgcca

SEQ ID NO: 4033168 - DNA, 18 bp, Homo sapiens
cccacaccttccagggcc

SEQ ID NO: 4033169 - DNA, 20 bp, Homo sapiens
cccacactccccgccttaga

SEQ ID NO: 4033170 - DNA, 19 bp, Homo sapiens
cccacacttgagaggatga

SEQ ID NO: 4033171 - DNA, 13 bp, Homo sapiens
cccacagaacctt

SEQ ID NO: 4033172 - DNA, 22 bp, Homo sapiens
cccacagatgtctctggggcag

SEQ ID NO: 4033173 - DNA, 17 bp, Homo sapiens
cccacagcgtccctggc

SEQ ID NO: 4033174 - DNA, 19 bp, Homo sapiens
cccacagctacctgagacg

SEQ ID NO: 4033175 - DNA, 18 bp, Homo sapiens
cccacaggcccttcctct

SEQ ID NO: 4033176 - DNA, 13 bp, Homo sapiens
cccacatcccagg

SEQ ID NO: 4033177 - DNA, 17 bp, Homo sapiens
cccacatcgcacactgg

SEQ ID NO: 4033178 - DNA, 18 bp, Homo sapiens
cccacatgaggccatctc

SEQ ID NO: 4033179 - DNA, 20 bp, Homo sapiens
cccacatgaggccatctcag

SEQ ID NO: 4033180 - DNA, 13 bp, Homo sapiens
cccaccagctgca

SEQ ID NO: 4033181 - DNA, 14 bp, Homo sapiens
cccaccagctgcag

SEQ ID NO: 4033182 - DNA, 15 bp, Homo sapiens
cccaccaggtgtcag

SEQ ID NO: 4033183 - DNA, 14 bp, Homo sapiens
cccacccacctcca

SEQ ID NO: 4033184 - DNA, 12 bp, Homo sapiens
cccacccaggag

SEQ ID NO: 4033185 - DNA, 13 bp, Homo sapiens
cccaccccagcct

SEQ ID NO: 4033186 - DNA, 13 bp, Homo sapiens
cccaccccctgcc

SEQ ID NO: 4033187 - DNA, 22 bp, Homo sapiens
cccacccccttctctgctccac

SEQ ID NO: 4033188 - DNA, 17 bp, Homo sapiens
cccacccctacacacac

SEQ ID NO: 4033189 - DNA, 11 bp, Homo sapiens
cccacccctca

SEQ ID NO: 4033190 - DNA, 12 bp, Homo sapiens
cccacccctgca

SEQ ID NO: 4033191 - DNA, 14 bp, Homo sapiens
cccaccctccactc

SEQ ID NO: 4033192 - DNA, 15 bp, Homo sapiens
cccaccctccatgct

SEQ ID NO: 4033193 - DNA, 16 bp, Homo sapiens
cccaccctccatgctc

SEQ ID NO: 4033194 - DNA, 18 bp, Homo sapiens
cccaccctccatgctcct

SEQ ID NO: 4033195 - DNA, 15 bp, Homo sapiens
cccaccctccccttc

SEQ ID NO: 4033196 - DNA, 15 bp, Homo sapiens
cccaccctccctgga

SEQ ID NO: 4033197 - DNA, 22 bp, Homo sapiens
cccaccctgctcctcctgccct

SEQ ID NO: 4033198 - DNA, 13 bp, Homo sapiens
cccaccctgtgcc

SEQ ID NO: 4033199 - DNA, 20 bp, Homo sapiens
cccaccgatggagcccccag

SEQ ID NO: 4033200 - DNA, 21 bp, Homo sapiens
cccaccgatggagcccccaga

SEQ ID NO: 4033201 - DNA, 15 bp, Homo sapiens
cccaccgtgggcagg

SEQ ID NO: 4033202 - DNA, 16 bp, Homo sapiens
cccacctatgtgccaa

SEQ ID NO: 4033203 - DNA, 21 bp, Homo sapiens
cccacctcacccggcctcttc

SEQ ID NO: 4033204 - DNA, 23 bp, Homo sapiens
ccctcccttgctgaacacacaca

SEQ ID NO: 4033205 - DNA, 18 bp, Homo sapiens
ccctccggactggtgccc

SEQ ID NO: 4033206 - DNA, 15 bp, Homo sapiens
ccctcctagacccag

SEQ ID NO: 4033207 - DNA, 18 bp, Homo sapiens
ccctcctccagcccctgt

SEQ ID NO: 4033208 - DNA, 15 bp, Homo sapiens
ccctcctccaggcct

SEQ ID NO: 4033209 - DNA, 23 bp, Homo sapiens
ccctcctccaggcctgcctccca

SEQ ID NO: 4033210 - DNA, 14 bp, Homo sapiens
ccctcctcgggccg

SEQ ID NO: 4033211 - DNA, 18 bp, Homo sapiens
ccctcctctagctgtggg

SEQ ID NO: 4033212 - DNA, 20 bp, Homo sapiens
ccctcctgccccacactccc

SEQ ID NO: 4033213 - DNA, 13 bp, Homo sapiens
ccctcctgtaaat

SEQ ID NO: 4033214 - DNA, 23 bp, Homo sapiens
ccctcctgtgctgggggaatgag

SEQ ID NO: 4033215 - DNA, 18 bp, Homo sapiens
ccctccttccctcacccc

SEQ ID NO: 4033216 - DNA, 23 bp, Homo sapiens
ccctccttgggtcattgacctct

SEQ ID NO: 4033217 - DNA, 23 bp, Homo sapiens
ccctcgcctgtggagctcagccc

SEQ ID NO: 4033218 - DNA, 15 bp, Homo sapiens
ccctcgctgcttctg

SEQ ID NO: 4033219 - DNA, 19 bp, Homo sapiens
ccctcggagttcttcttga

SEQ ID NO: 4033220 - DNA, 17 bp, Homo sapiens
ccctcgggaagcagcca

SEQ ID NO: 4033221 - DNA, 18 bp, Homo sapiens
ccctcgggaagcagccag

SEQ ID NO: 4033222 - DNA, 20 bp, Homo sapiens
ccctcgggaagcagccagct

SEQ ID NO: 4033223 - DNA, 19 bp, Homo sapiens
ccctcgtccaccccccaca

SEQ ID NO: 4033224 - DNA, 13 bp, Homo sapiens
ccctcgtctttcc

SEQ ID NO: 4033225 - DNA, 14 bp, Homo sapiens
ccctctagtgcctt

SEQ ID NO: 4033226 - DNA, 19 bp, Homo sapiens
ccctctcagaggcctgctg

SEQ ID NO: 4033227 - DNA, 14 bp, Homo sapiens
ccctctcagctcca

SEQ ID NO: 4033228 - DNA, 16 bp, Homo sapiens
ccctctcatctcaggt

SEQ ID NO: 4033229 - DNA, 20 bp, Homo sapiens
ccctctcatctcaggtagaa

SEQ ID NO: 4033230 - DNA, 12 bp, Homo sapiens
ccctctcctgcc

SEQ ID NO: 4033231 - DNA, 13 bp, Homo sapiens
ccctctcctgccc

SEQ ID NO: 4033232 - DNA, 19 bp, Homo sapiens
ccctctctcagcacagcct

SEQ ID NO: 4033233 - DNA, 14 bp, Homo sapiens
ccctctctctgggc

SEQ ID NO: 4033234 - DNA, 13 bp, Homo sapiens
ccctctctcttct

SEQ ID NO: 4033235 - DNA, 14 bp, Homo sapiens
ccctctctcttctg

SEQ ID NO: 4033236 - DNA, 15 bp, Homo sapiens
ccctctctcttctgc

SEQ ID NO: 4033237 - DNA, 22 bp, Homo sapiens
ccctctctcttctgctccaccc

SEQ ID NO: 4033238 - DNA, 19 bp, Homo sapiens
ccctctgaatggtccaggg

SEQ ID NO: 4033239 - DNA, 22 bp, Homo sapiens
ccctctgaatggtccagggttg

SEQ ID NO: 4033240 - DNA, 14 bp, Homo sapiens
ccctctgacctgca

SEQ ID NO: 4033241 - DNA, 16 bp, Homo sapiens
ccctctgacctgcact

SEQ ID NO: 4033242 - DNA, 19 bp, Homo sapiens
ccctctgacctgcactggg

SEQ ID NO: 4033243 - DNA, 20 bp, Homo sapiens
ccctctgattggttttgggg

SEQ ID NO: 4033244 - DNA, 14 bp, Homo sapiens
ccctctgctcagcc

SEQ ID NO: 4033245 - DNA, 15 bp, Homo sapiens
ccctctgctcagcca

SEQ ID NO: 4033246 - DNA, 15 bp, Homo sapiens
ccctctgctgctgtc

SEQ ID NO: 4033247 - DNA, 21 bp, Homo sapiens
ccctctggaggggtgtggctc

SEQ ID NO: 4033248 - DNA, 18 bp, Homo sapiens
ccctctggccaggatgga

SEQ ID NO: 4033249 - DNA, 14 bp, Homo sapiens
ccctctgtcccacc

SEQ ID NO: 4033250 - DNA, 15 bp, Homo sapiens
ccctctgtcccaccc

SEQ ID NO: 4033251 - DNA, 21 bp, Homo sapiens
ccctctgtcccacccctagcc

SEQ ID NO: 4033252 - DNA, 19 bp, Homo sapiens
ccctcttgacccatctccc

SEQ ID NO: 4033253 - DNA, 13 bp, Homo sapiens
ccctcttgcccat

SEQ ID NO: 4033254 - DNA, 21 bp, Homo sapiens
ccctcttgtaagtcatctact

SEQ ID NO: 4033255 - DNA, 21 bp, Homo sapiens
ccctcttgtccctttccctac

SEQ ID NO: 4033256 - DNA, 15 bp, Homo sapiens
ccctctttccctgcg

SEQ ID NO: 4033257 - DNA, 18 bp, Homo sapiens
ccctctttccctgcgaga

SEQ ID NO: 4033258 - DNA, 20 bp, Homo sapiens
ccctctttggctcccctgta

SEQ ID NO: 4033259 - DNA, 21 bp, Homo sapiens
ccctgaaacctagtactgccc

SEQ ID NO: 4033260 - DNA, 22 bp, Homo sapiens
ccctgaacaacgagccttttca

SEQ ID NO: 4033261 - DNA, 20 bp, Homo sapiens
ccctgaagtgagcacagcct

SEQ ID NO: 4033262 - DNA, 15 bp, Homo sapiens
ccctgacctcactgt

SEQ ID NO: 4033263 - DNA, 15 bp, Homo sapiens
ccctgacctccgccc

SEQ ID NO: 4033264 - DNA, 20 bp, Homo sapiens
ccctgaccttggctgactgg

SEQ ID NO: 4033265 - DNA, 23 bp, Homo sapiens
ccctgaccttggctgactggggc

SEQ ID NO: 4033266 - DNA, 23 bp, Homo sapiens
ccctgactcctctggctttccca

SEQ ID NO: 4033267 - DNA, 20 bp, Homo sapiens
ccctgagaagctgctccagg

SEQ ID NO: 4033268 - DNA, 23 bp, Homo sapiens
ccctgagaggaggtcgaatgggt

SEQ ID NO: 4033269 - DNA, 14 bp, Homo sapiens
ccctgagatcccct

SEQ ID NO: 4033270 - DNA, 19 bp, Homo sapiens
ccctgagatcccctgagcc

SEQ ID NO: 4033271 - DNA, 20 bp, Homo sapiens
ccctgagatcccctgagccc

SEQ ID NO: 4033272 - DNA, 15 bp, Homo sapiens
ccctgagctgcagct

SEQ ID NO: 4033273 - DNA, 14 bp, Homo sapiens
ccctgaggagccag

SEQ ID NO: 4033274 - DNA, 20 bp, Homo sapiens
ccctgagttcatccaggccc

SEQ ID NO: 4033275 - DNA, 16 bp, Homo sapiens
ccctgatcccttccac

SEQ ID NO: 4033276 - DNA, 13 bp, Homo sapiens
ccctgatgacacc

SEQ ID NO: 4033277 - DNA, 22 bp, Homo sapiens
ccctgatgacacccaccctgtg

SEQ ID NO: 4033278 - DNA, 18 bp, Homo sapiens
ccctgattgacctgctcc

SEQ ID NO: 4033279 - DNA, 21 bp, Homo sapiens
ccctgattgacctgctccgct

SEQ ID NO: 4033280 - DNA, 22 bp, Homo sapiens
ccctgattgacctgctccgctg

SEQ ID NO: 4033281 - DNA, 24 bp, Homo sapiens
ccctgcaaacagaacagggtcatg

SEQ ID NO: 4033282 - DNA, 21 bp, Homo sapiens
ccctgcaacttccgctgaggg

SEQ ID NO: 4033283 - DNA, 12 bp, Homo sapiens
ccctgcaccctt

SEQ ID NO: 4033284 - DNA, 21 bp, Homo sapiens
ccctgcactaaagccagcctg

SEQ ID NO: 4033285 - DNA, 22 bp, Homo sapiens
ccctgcactaaagccagcctga

SEQ ID NO: 4033286 - DNA, 19 bp, Homo sapiens
ccctgcagacctcaagcca

SEQ ID NO: 4033287 - DNA, 14 bp, Homo sapiens
ccctgcagccagct

SEQ ID NO: 4033288 - DNA, 12 bp, Homo sapiens
ccctgcagccca

SEQ ID NO: 4033289 - DNA, 22 bp, Homo sapiens
ccctgcagcccaaaacccaggg

SEQ ID NO: 4033290 - DNA, 18 bp, Homo sapiens
ccctgcagcccccactca

SEQ ID NO: 4033291 - DNA, 17 bp, Homo sapiens
ccctgccacagccagag

SEQ ID NO: 4033292 - DNA, 19 bp, Homo sapiens
ccctgccacagccagagga

SEQ ID NO: 4033293 - DNA, 20 bp, Homo sapiens
ccctgccacagccagaggag

SEQ ID NO: 4033294 - DNA, 21 bp, Homo sapiens
ccctgccacatacaggtgctc

SEQ ID NO: 4033295 - DNA, 14 bp, Homo sapiens
ccctgccacctccc

SEQ ID NO: 4033296 - DNA, 20 bp, Homo sapiens
ccctgcccagatcagccaga

SEQ ID NO: 4033297 - DNA, 22 bp, Homo sapiens
ccctgcccagatcagccagaag

SEQ ID NO: 4033298 - DNA, 15 bp, Homo sapiens
ccctgccccccagcc

SEQ ID NO: 4033299 - DNA, 19 bp, Homo sapiens
ccctgccccccagcctctg

SEQ ID NO: 4033300 - DNA, 13 bp, Homo sapiens
ccctgccctgcac

SEQ ID NO: 4033301 - DNA, 12 bp, Homo sapiens
ccctgccctggt

SEQ ID NO: 4033302 - DNA, 15 bp, Homo sapiens
ccctgccctggtcca

SEQ ID NO: 4033303 - DNA, 13 bp, Homo sapiens
ccctgcctcagct

SEQ ID NO: 4033304 - DNA, 15 bp, Homo sapiens
ccctgcctcagctga

SEQ ID NO: 4033305 - DNA, 13 bp, Homo sapiens
ccctgcctcctgg

SEQ ID NO: 4033306 - DNA, 23 bp, Homo sapiens
ccctgcctgccctgtcaggaggc

SEQ ID NO: 4033307 - DNA, 21 bp, Homo sapiens
cccggccccctggtctctggt

SEQ ID NO: 4033308 - DNA, 16 bp, Homo sapiens
cccggccctgcctgct

SEQ ID NO: 4033309 - DNA, 22 bp, Homo sapiens
cccggccctgggctcggaggct

SEQ ID NO: 4033310 - DNA, 12 bp, Homo sapiens
cccggcctcagg

SEQ ID NO: 4033311 - DNA, 17 bp, Homo sapiens
cccggcctcagggcgct

SEQ ID NO: 4033312 - DNA, 23 bp, Homo sapiens
cccggcctcctcggagagcagca

SEQ ID NO: 4033313 - DNA, 19 bp, Homo sapiens
cccggcctctctgccccac

SEQ ID NO: 4033314 - DNA, 17 bp, Homo sapiens
cccggcctggatgccag

SEQ ID NO: 4033315 - DNA, 14 bp, Homo sapiens
cccgggagcggagg

SEQ ID NO: 4033316 - DNA, 23 bp, Homo sapiens
cccgggaggcagaggttgcagtg

SEQ ID NO: 4033317 - DNA, 23 bp, Homo sapiens
cccgggagggcggcacaggtcgg

SEQ ID NO: 4033318 - DNA, 22 bp, Homo sapiens
cccgggccacgccccagcccga

SEQ ID NO: 4033319 - DNA, 15 bp, Homo sapiens
cccgggccagggctg

SEQ ID NO: 4033320 - DNA, 19 bp, Homo sapiens
cccgggcgcggccagcccc

SEQ ID NO: 4033321 - DNA, 21 bp, Homo sapiens
cccgggcgcggccagccccgg

SEQ ID NO: 4033322 - DNA, 17 bp, Homo sapiens
cccgggctctctgctgt

SEQ ID NO: 4033323 - DNA, 21 bp, Homo sapiens
cccggggaccctgtgacatgg

SEQ ID NO: 4033324 - DNA, 16 bp, Homo sapiens
cccgggttcagcctgg

SEQ ID NO: 4033325 - DNA, 17 bp, Homo sapiens
cccgggttcagcctggc

SEQ ID NO: 4033326 - DNA, 19 bp, Homo sapiens
cccgggttcagcctggcct

SEQ ID NO: 4033327 - DNA, 12 bp, Homo sapiens
cccgtctgccca

SEQ ID NO: 4033328 - DNA, 16 bp, Homo sapiens
cccgtctgcccaccat

SEQ ID NO: 4033329 - DNA, 17 bp, Homo sapiens
cccgtctggacctgggg

SEQ ID NO: 4033330 - DNA, 20 bp, Homo sapiens
cccgtgaaagaattattttt

SEQ ID NO: 4033331 - DNA, 21 bp, Homo sapiens
cccgtgcatcccccctgctca

SEQ ID NO: 4033332 - DNA, 18 bp, Homo sapiens
ccctaaactttggccttt

SEQ ID NO: 4033333 - DNA, 14 bp, Homo sapiens
ccctaactgcagac

SEQ ID NO: 4033334 - DNA, 23 bp, Homo sapiens
ccctaagcccccagggcctccag

SEQ ID NO: 4033335 - DNA, 13 bp, Homo sapiens
ccctacacacaca

SEQ ID NO: 4033336 - DNA, 21 bp, Homo sapiens
ccctacacacacactccctgc

SEQ ID NO: 4033337 - DNA, 14 bp, Homo sapiens
ccctacatgtattg

SEQ ID NO: 4033338 - DNA, 13 bp, Homo sapiens
ccctacccaccga

SEQ ID NO: 4033339 - DNA, 13 bp, Homo sapiens
ccctacctcaggc

SEQ ID NO: 4033340 - DNA, 16 bp, Homo sapiens
ccctacctcaggcagg

SEQ ID NO: 4033341 - DNA, 12 bp, Homo sapiens
ccctacctgctt

SEQ ID NO: 4033342 - DNA, 18 bp, Homo sapiens
ccctagagcctgcctgga

SEQ ID NO: 4033343 - DNA, 19 bp, Homo sapiens
ccctagagggttcctgtag

SEQ ID NO: 4033344 - DNA, 12 bp, Homo sapiens
ccctagccacca

SEQ ID NO: 4033345 - DNA, 13 bp, Homo sapiens
ccctagccaccag

SEQ ID NO: 4033346 - DNA, 16 bp, Homo sapiens
ccctagccaccagtgt

SEQ ID NO: 4033347 - DNA, 15 bp, Homo sapiens
ccctagcccagactc

SEQ ID NO: 4033348 - DNA, 20 bp, Homo sapiens
ccctagcggcagaaaggaaa

SEQ ID NO: 4033349 - DNA, 17 bp, Homo sapiens
ccctaggaactcagtcc

SEQ ID NO: 4033350 - DNA, 19 bp, Homo sapiens
ccctaggttccctgttctt

SEQ ID NO: 4033351 - DNA, 23 bp, Homo sapiens
ccctaggttccctgttcttcctc

SEQ ID NO: 4033352 - DNA, 16 bp, Homo sapiens
ccctagttccctctgc

SEQ ID NO: 4033353 - DNA, 23 bp, Homo sapiens
ccctatatgtagtataaagaaaa

SEQ ID NO: 4033354 - DNA, 14 bp, Homo sapiens
ccctatcctctgag

SEQ ID NO: 4033355 - DNA, 20 bp, Homo sapiens
ccctatctattaaagtgact

SEQ ID NO: 4033356 - DNA, 21 bp, Homo sapiens
ccctatctattaaagtgactt

SEQ ID NO: 4033357 - DNA, 21 bp, Homo sapiens
ccctatgggcctgccgggctg

SEQ ID NO: 4033358 - DNA, 16 bp, Homo sapiens
ccctatggggatggtc

SEQ ID NO: 4033359 - DNA, 16 bp, Homo sapiens
ccctcaaagaggcctt

SEQ ID NO: 4033360 - DNA, 17 bp, Homo sapiens
ccctcaacaagggagag

SEQ ID NO: 4033361 - DNA, 15 bp, Homo sapiens
ccctcaacaggccca

SEQ ID NO: 4033362 - DNA, 17 bp, Homo sapiens
ccctcaagccccagcag

SEQ ID NO: 4033363 - DNA, 17 bp, Homo sapiens
ccctcacacacacagct

SEQ ID NO: 4033364 - DNA, 18 bp, Homo sapiens
ccctcacacacacagctg

SEQ ID NO: 4033365 - DNA, 20 bp, Homo sapiens
ccctcacacacacagctggg

SEQ ID NO: 4033366 - DNA, 13 bp, Homo sapiens
ccctcacattcct

SEQ ID NO: 4033367 - DNA, 16 bp, Homo sapiens
ccctcacccccagcac

SEQ ID NO: 4033368 - DNA, 16 bp, Homo sapiens
ccctcaccctgcctta

SEQ ID NO: 4033369 - DNA, 14 bp, Homo sapiens
ccctcacctcctct

SEQ ID NO: 4033370 - DNA, 12 bp, Homo sapiens
ccctcacctctc

SEQ ID NO: 4033371 - DNA, 14 bp, Homo sapiens
ccctcacctctcca

SEQ ID NO: 4033372 - DNA, 23 bp, Homo sapiens
ccctcaccttggcaccagacacc

SEQ ID NO: 4033373 - DNA, 13 bp, Homo sapiens
ccctcaccttggg

SEQ ID NO: 4033374 - DNA, 16 bp, Homo sapiens
ccctcactccccaggg

SEQ ID NO: 4033375 - DNA, 14 bp, Homo sapiens
ccctcagagccctg

SEQ ID NO: 4033376 - DNA, 18 bp, Homo sapiens
ccctcagagccctgccct

SEQ ID NO: 4033377 - DNA, 19 bp, Homo sapiens
ccctcagagccctgccctg

SEQ ID NO: 4033378 - DNA, 14 bp, Homo sapiens
ccctcagcctcaga

SEQ ID NO: 4033379 - DNA, 16 bp, Homo sapiens
ccctcagctctctggg

SEQ ID NO: 4033380 - DNA, 18 bp, Homo sapiens
ccctcaggctctgtggag

SEQ ID NO: 4033381 - DNA, 20 bp, Homo sapiens
ccctcagggagcctccccat

SEQ ID NO: 4033382 - DNA, 20 bp, Homo sapiens
ccctcaggttctattttctt

SEQ ID NO: 4033383 - DNA, 17 bp, Homo sapiens
ccctcatggcccctctg

SEQ ID NO: 4033384 - DNA, 23 bp, Homo sapiens
ccctccaaacctccagcctccct

SEQ ID NO: 4033385 - DNA, 17 bp, Homo sapiens
ccctccacgcctcctgg

SEQ ID NO: 4033386 - DNA, 18 bp, Homo sapiens
ccctccacgcctcctggc

SEQ ID NO: 4033387 - DNA, 20 bp, Homo sapiens
ccctccacgcctcctggcca

SEQ ID NO: 4033388 - DNA, 21 bp, Homo sapiens
ccctccactcagctgtcctgc

SEQ ID NO: 4033389 - DNA, 19 bp, Homo sapiens
ccctccagaacacggctca

SEQ ID NO: 4033390 - DNA, 10 bp, Homo sapiens
ccctccagga

SEQ ID NO: 4033391 - DNA, 21 bp, Homo sapiens
ccctccaggaagaagcagggg

SEQ ID NO: 4033392 - DNA, 11 bp, Homo sapiens
ccctccaggag

SEQ ID NO: 4033393 - DNA, 12 bp, Homo sapiens
ccctccaggagg

SEQ ID NO: 4033394 - DNA, 14 bp, Homo sapiens
ccctccatccaccc

SEQ ID NO: 4033395 - DNA, 15 bp, Homo sapiens
ccctccattgggcac

SEQ ID NO: 4033396 - DNA, 13 bp, Homo sapiens
ccctcccaccccc

SEQ ID NO: 4033397 - DNA, 15 bp, Homo sapiens
ccctcccagtcctcc

SEQ ID NO: 4033398 - DNA, 11 bp, Homo sapiens
ccctcccatgg

SEQ ID NO: 4033399 - DNA, 15 bp, Homo sapiens
ccctccccaggctgg

SEQ ID NO: 4033400 - DNA, 15 bp, Homo sapiens
ccctcccccccatgc

SEQ ID NO: 4033401 - DNA, 16 bp, Homo sapiens
ccctccccctcaacct

SEQ ID NO: 4033402 - DNA, 13 bp, Homo sapiens
ccctcccccttgt

SEQ ID NO: 4033403 - DNA, 21 bp, Homo sapiens
ccctccccgcccctgtggccc

SEQ ID NO: 4033404 - DNA, 18 bp, Homo sapiens
ccctcccctcccagtcct

SEQ ID NO: 4033405 - DNA, 13 bp, Homo sapiens
ccctcccctgccc

SEQ ID NO: 4033406 - DNA, 14 bp, Homo sapiens
ccctcccctgccct

SEQ ID NO: 4033407 - DNA, 16 bp, Homo sapiens
ccctcccggcatggga

SEQ ID NO: 4033408 - DNA, 14 bp, Homo sapiens
ccctccctggagtg

SEQ ID NO: 4033409 - DNA, 20 bp, Homo sapiens
ccctccctgttccccagaga

SEQ ID NO: 4033410 - DNA, 18 bp, Homo sapiens
ccctcccttgctgaacac

SEQ ID NO: 4033411 - DNA, 13 bp, Homo sapiens
ccccggccccctg

SEQ ID NO: 4033412 - DNA, 13 bp, Homo sapiens
ccccggccctggg

SEQ ID NO: 4033413 - DNA, 16 bp, Homo sapiens
ccccggggaccctgtg

SEQ ID NO: 4033414 - DNA, 15 bp, Homo sapiens
ccccggtggctgggc

SEQ ID NO: 4033415 - DNA, 21 bp, Homo sapiens
ccccgttcctgacatcacagc

SEQ ID NO: 4033416 - DNA, 22 bp, Homo sapiens
cccctacacacacactccctgc

SEQ ID NO: 4033417 - DNA, 14 bp, Homo sapiens
cccctacacacacc

SEQ ID NO: 4033418 - DNA, 15 bp, Homo sapiens
cccctacgcgccttg

SEQ ID NO: 4033419 - DNA, 14 bp, Homo sapiens
cccctagccaccag

SEQ ID NO: 4033420 - DNA, 15 bp, Homo sapiens
cccctagttccctct

SEQ ID NO: 4033421 - DNA, 11 bp, Homo sapiens
cccctcaaccc

SEQ ID NO: 4033422 - DNA, 15 bp, Homo sapiens
cccctcaagccccag

SEQ ID NO: 4033423 - DNA, 16 bp, Homo sapiens
cccctcaccctgcctt

SEQ ID NO: 4033424 - DNA, 14 bp, Homo sapiens
cccctcacctctcc

SEQ ID NO: 4033425 - DNA, 22 bp, Homo sapiens
cccctcactctgtcagccagcc

SEQ ID NO: 4033426 - DNA, 20 bp, Homo sapiens
cccctcagatgatctctcca

SEQ ID NO: 4033427 - DNA, 23 bp, Homo sapiens
cccctcagatgatctctccacgg

SEQ ID NO: 4033428 - DNA, 15 bp, Homo sapiens
cccctcaggactgca

SEQ ID NO: 4033429 - DNA, 17 bp, Homo sapiens
cccctccattggctccc

SEQ ID NO: 4033430 - DNA, 13 bp, Homo sapiens
cccctccctctgt

SEQ ID NO: 4033431 - DNA, 12 bp, Homo sapiens
cccctccctggc

SEQ ID NO: 4033432 - DNA, 14 bp, Homo sapiens
cccctccctggctc

SEQ ID NO: 4033433 - DNA, 13 bp, Homo sapiens
cccctccctgtca

SEQ ID NO: 4033434 - DNA, 15 bp, Homo sapiens
cccctctgacctgca

SEQ ID NO: 4033435 - DNA, 12 bp, Homo sapiens
cccctctggctt

SEQ ID NO: 4033436 - DNA, 12 bp, Homo sapiens
cccctctgtctt

SEQ ID NO: 4033437 - DNA, 14 bp, Homo sapiens
cccctcttccctgg

SEQ ID NO: 4033438 - DNA, 14 bp, Homo sapiens
cccctgactcatca

SEQ ID NO: 4033439 - DNA, 17 bp, Homo sapiens
cccctgagatcccctga

SEQ ID NO: 4033440 - DNA, 24 bp, Homo sapiens
cccctgcatctatcgagtttgcaa

SEQ ID NO: 4033441 - DNA, 21 bp, Homo sapiens
cccctgccacctccctgaccc

SEQ ID NO: 4033442 - DNA, 17 bp, Homo sapiens
cccctgccccccagcct

SEQ ID NO: 4033443 - DNA, 13 bp, Homo sapiens
cccctgccctggt

SEQ ID NO: 4033444 - DNA, 17 bp, Homo sapiens
cccctgccctggtccag

SEQ ID NO: 4033445 - DNA, 22 bp, Homo sapiens
cccctgcggtcaggctgggcag

SEQ ID NO: 4033446 - DNA, 14 bp, Homo sapiens
cccctgcgtggggg

SEQ ID NO: 4033447 - DNA, 23 bp, Homo sapiens
cccctgctctacccatgagcctg

SEQ ID NO: 4033448 - DNA, 16 bp, Homo sapiens
cccctgctgtcttccc

SEQ ID NO: 4033449 - DNA, 17 bp, Homo sapiens
cccctggaagagcccag

SEQ ID NO: 4033450 - DNA, 20 bp, Homo sapiens
cccctggaagagcccagtct

SEQ ID NO: 4033451 - DNA, 15 bp, Homo sapiens
cccctggacctggga

SEQ ID NO: 4033452 - DNA, 15 bp, Homo sapiens
cccctggactgggag

SEQ ID NO: 4033453 - DNA, 19 bp, Homo sapiens
cccctggcccatctcagcc

SEQ ID NO: 4033454 - DNA, 14 bp, Homo sapiens
cccctggcctctgt

SEQ ID NO: 4033455 - DNA, 23 bp, Homo sapiens
cccctggctgggacgtggctcag

SEQ ID NO: 4033456 - DNA, 11 bp, Homo sapiens
cccctggcttt

SEQ ID NO: 4033457 - DNA, 18 bp, Homo sapiens
cccctggctttgcctctt

SEQ ID NO: 4033458 - DNA, 22 bp, Homo sapiens
cccctggctttgcctcttcttt

SEQ ID NO: 4033459 - DNA, 12 bp, Homo sapiens
cccctgggcagg

SEQ ID NO: 4033460 - DNA, 18 bp, Homo sapiens
cccctgggcttggcctgc

SEQ ID NO: 4033461 - DNA, 23 bp, Homo sapiens
cccctgggcttggcctgctgtga

SEQ ID NO: 4033462 - DNA, 14 bp, Homo sapiens
cccctggggctccc

SEQ ID NO: 4033463 - DNA, 20 bp, Homo sapiens
cccctgggggtttcacctgg

SEQ ID NO: 4033464 - DNA, 19 bp, Homo sapiens
cccctggggtggccaccag

SEQ ID NO: 4033465 - DNA, 20 bp, Homo sapiens
cccctgggtcagtctggtgg

SEQ ID NO: 4033466 - DNA, 18 bp, Homo sapiens
cccctgtcccatgcaggc

SEQ ID NO: 4033467 - DNA, 17 bp, Homo sapiens
cccctgtggccctggcc

SEQ ID NO: 4033468 - DNA, 18 bp, Homo sapiens
cccctgtggccctggcca

SEQ ID NO: 4033469 - DNA, 24 bp, Homo sapiens
cccctgtgtgagttgagtctcctc

SEQ ID NO: 4033470 - DNA, 14 bp, Homo sapiens
ccccttatccagga

SEQ ID NO: 4033471 - DNA, 16 bp, Homo sapiens
ccccttcatcctctga

SEQ ID NO: 4033472 - DNA, 11 bp, Homo sapiens
ccccttcctgt

SEQ ID NO: 4033473 - DNA, 17 bp, Homo sapiens
ccccttcctgtttcaga

SEQ ID NO: 4033474 - DNA, 20 bp, Homo sapiens
ccccttcctgtttcagaccc

SEQ ID NO: 4033475 - DNA, 13 bp, Homo sapiens
ccccttcgggagc

SEQ ID NO: 4033476 - DNA, 16 bp, Homo sapiens
ccccttctcccagcac

SEQ ID NO: 4033477 - DNA, 19 bp, Homo sapiens
ccccttctctcctccccaa

SEQ ID NO: 4033478 - DNA, 14 bp, Homo sapiens
ccccttctgctcag

SEQ ID NO: 4033479 - DNA, 21 bp, Homo sapiens
ccccttctgctcagctctggg

SEQ ID NO: 4033480 - DNA, 16 bp, Homo sapiens
ccccttgctcccttca

SEQ ID NO: 4033481 - DNA, 17 bp, Homo sapiens
ccccttggcaggtcctg

SEQ ID NO: 4033482 - DNA, 15 bp, Homo sapiens
ccccttgtcctttcc

SEQ ID NO: 4033483 - DNA, 20 bp, Homo sapiens
cccctttaccctctttgctg

SEQ ID NO: 4033484 - DNA, 10 bp, Homo sapiens
cccctttcct

SEQ ID NO: 4033485 - DNA, 13 bp, Homo sapiens
cccctttcttcct

SEQ ID NO: 4033486 - DNA, 21 bp, Homo sapiens
ccccttttcagctgagccctg

SEQ ID NO: 4033487 - DNA, 14 bp, Homo sapiens
ccccttttctgcat

SEQ ID NO: 4033488 - DNA, 16 bp, Homo sapiens
ccccttttctgcattt

SEQ ID NO: 4033489 - DNA, 18 bp, Homo sapiens
cccctttttttccttttt

SEQ ID NO: 4033490 - DNA, 18 bp, Homo sapiens
cccgacctggctgcccct

SEQ ID NO: 4033491 - DNA, 20 bp, Homo sapiens
cccgagctcttggcctttgc

SEQ ID NO: 4033492 - DNA, 19 bp, Homo sapiens
cccgaggccgcgtgcgtga

SEQ ID NO: 4033493 - DNA, 12 bp, Homo sapiens
cccgcacacctg

SEQ ID NO: 4033494 - DNA, 18 bp, Homo sapiens
cccgcaccccggcctcag

SEQ ID NO: 4033495 - DNA, 21 bp, Homo sapiens
cccgcagtgctgggaccagag

SEQ ID NO: 4033496 - DNA, 22 bp, Homo sapiens
cccgcagtgctgggaccagagc

SEQ ID NO: 4033497 - DNA, 24 bp, Homo sapiens
cccgcagtgctgggaccagagcca

SEQ ID NO: 4033498 - DNA, 16 bp, Homo sapiens
cccgccacctcagggc

SEQ ID NO: 4033499 - DNA, 14 bp, Homo sapiens
cccgcccctgtggc

SEQ ID NO: 4033500 - DNA, 19 bp, Homo sapiens
cccgcccctgtggccctgg

SEQ ID NO: 4033501 - DNA, 21 bp, Homo sapiens
cccgcccttccatgtgccttt

SEQ ID NO: 4033502 - DNA, 12 bp, Homo sapiens
cccgcctgccct

SEQ ID NO: 4033503 - DNA, 13 bp, Homo sapiens
cccgcctgccctc

SEQ ID NO: 4033504 - DNA, 18 bp, Homo sapiens
cccgccttagagcctcgt

SEQ ID NO: 4033505 - DNA, 21 bp, Homo sapiens
cccgctgagctgagtggccag

SEQ ID NO: 4033506 - DNA, 15 bp, Homo sapiens
cccgctgctgctgct

SEQ ID NO: 4033507 - DNA, 16 bp, Homo sapiens
cccggaagggctttgg

SEQ ID NO: 4033508 - DNA, 18 bp, Homo sapiens
cccggagagggagtcagt

SEQ ID NO: 4033509 - DNA, 18 bp, Homo sapiens
cccggaggttgggtgggc

SEQ ID NO: 4033510 - DNA, 13 bp, Homo sapiens
cccggccagcggg

SEQ ID NO: 4033511 - DNA, 17 bp, Homo sapiens
cccggccagcgggcaca

SEQ ID NO: 4033512 - DNA, 20 bp, Homo sapiens
cccggccagcgggcacaggg

SEQ ID NO: 4033513 - DNA, 21 bp, Homo sapiens
cccggccccccgcgctcgccc

SEQ ID NO: 4033514 - DNA, 12 bp, Homo sapiens
cccggccccctg

SEQ ID NO: 4033515 - DNA, 13 bp, Homo sapiens
ccccagctccggc

SEQ ID NO: 4033516 - DNA, 15 bp, Homo sapiens
ccccagctgactgtg

SEQ ID NO: 4033517 - DNA, 21 bp, Homo sapiens
ccccagcttctcagctcgctg

SEQ ID NO: 4033518 - DNA, 19 bp, Homo sapiens
ccccaggaaactagctttt

SEQ ID NO: 4033519 - DNA, 18 bp, Homo sapiens
ccccaggaagcccaggag

SEQ ID NO: 4033520 - DNA, 13 bp, Homo sapiens
ccccaggaccagc

SEQ ID NO: 4033521 - DNA, 16 bp, Homo sapiens
ccccaggaccagctca

SEQ ID NO: 4033522 - DNA, 19 bp, Homo sapiens
ccccaggaccagctcagga

SEQ ID NO: 4033523 - DNA, 16 bp, Homo sapiens
ccccaggccctccctg

SEQ ID NO: 4033524 - DNA, 20 bp, Homo sapiens
ccccaggcccttcaggaact

SEQ ID NO: 4033525 - DNA, 11 bp, Homo sapiens
ccccaggctgg

SEQ ID NO: 4033526 - DNA, 14 bp, Homo sapiens
ccccagggagctct

SEQ ID NO: 4033527 - DNA, 17 bp, Homo sapiens
ccccaggggaaaatgaa

SEQ ID NO: 4033528 - DNA, 18 bp, Homo sapiens
ccccaggggaaaatgaag

SEQ ID NO: 4033529 - DNA, 22 bp, Homo sapiens
ccccaggggtcccagccacccc

SEQ ID NO: 4033530 - DNA, 16 bp, Homo sapiens
ccccagggtcttccct

SEQ ID NO: 4033531 - DNA, 14 bp, Homo sapiens
cccagcctgctgag

SEQ ID NO: 4033532 - DNA, 15 bp, Homo sapiens
cccagcctgctgaga

SEQ ID NO: 4033533 - DNA, 20 bp, Homo sapiens
cccagcctgggagcccagag

SEQ ID NO: 4033534 - DNA, 23 bp, Homo sapiens
cccagcctgggataggggcagag

SEQ ID NO: 4033535 - DNA, 12 bp, Homo sapiens
cccagcctgggc

SEQ ID NO: 4033536 - DNA, 14 bp, Homo sapiens
cccagcctgggcca

SEQ ID NO: 4033537 - DNA, 15 bp, Homo sapiens
cccagcctgggccat

SEQ ID NO: 4033538 - DNA, 22 bp, Homo sapiens
cccagcctgggccatctcttag

SEQ ID NO: 4033539 - DNA, 23 bp, Homo sapiens
cccagcgcggccagcgtcccagg

SEQ ID NO: 4033540 - DNA, 13 bp, Homo sapiens
cccagcgggcaga

SEQ ID NO: 4033541 - DNA, 16 bp, Homo sapiens
cccagcgggcagatgg

SEQ ID NO: 4033542 - DNA, 22 bp, Homo sapiens
cccagctaagaacctggaactt

SEQ ID NO: 4033543 - DNA, 20 bp, Homo sapiens
cccagctaatctgtagggct

SEQ ID NO: 4033544 - DNA, 22 bp, Homo sapiens
cccagctaccctttttctccag

SEQ ID NO: 4033545 - DNA, 16 bp, Homo sapiens
cccagctacttgggaa

SEQ ID NO: 4033546 - DNA, 18 bp, Homo sapiens
cccagctacttgggaagc

SEQ ID NO: 4033547 - DNA, 19 bp, Homo sapiens
cccagctacttgggaagct

SEQ ID NO: 4033548 - DNA, 23 bp, Homo sapiens
cccagctacttgggaggctgagg

SEQ ID NO: 4033549 - DNA, 13 bp, Homo sapiens
cccagctaggaag

SEQ ID NO: 4033550 - DNA, 22 bp, Homo sapiens
cccagctaggaagagcaggact

SEQ ID NO: 4033551 - DNA, 15 bp, Homo sapiens
cccagctccctagga

SEQ ID NO: 4033552 - DNA, 14 bp, Homo sapiens
cccagctctgaccc

SEQ ID NO: 4033553 - DNA, 16 bp, Homo sapiens
cccagcttctcagctc

SEQ ID NO: 4033554 - DNA, 20 bp, Homo sapiens
cccacctccacccagcccct

SEQ ID NO: 4033555 - DNA, 19 bp, Homo sapiens
cccacctcccccactccca

SEQ ID NO: 4033556 - DNA, 13 bp, Homo sapiens
cccaccttcccac

SEQ ID NO: 4033557 - DNA, 20 bp, Homo sapiens
cccaccttgccaagctttct

SEQ ID NO: 4033558 - DNA, 13 bp, Homo sapiens
cccacgagggctg

SEQ ID NO: 4033559 - DNA, 16 bp, Homo sapiens
cccacgagggtcagga

SEQ ID NO: 4033560 - DNA, 13 bp, Homo sapiens
cccacgccctgtt

SEQ ID NO: 4033561 - DNA, 15 bp, Homo sapiens
cccacggagacagag

SEQ ID NO: 4033562 - DNA, 18 bp, Homo sapiens
cccacggagacagaggaa

SEQ ID NO: 4033563 - DNA, 15 bp, Homo sapiens
cccactactgcagca

SEQ ID NO: 4033564 - DNA, 16 bp, Homo sapiens
cccactcaggattggg

SEQ ID NO: 4033565 - DNA, 21 bp, Homo sapiens
cccactcccccgtttctcctt

SEQ ID NO: 4033566 - DNA, 15 bp, Homo sapiens
cccactcccgcctca

SEQ ID NO: 4033567 - DNA, 23 bp, Homo sapiens
cccactcccgcctcagggccagg

SEQ ID NO: 4033568 - DNA, 20 bp, Homo sapiens
cccactccctatctccttcc

SEQ ID NO: 4033569 - DNA, 14 bp, Homo sapiens
cccactcctgctct

SEQ ID NO: 4033570 - DNA, 18 bp, Homo sapiens
cccactcctgctctgctc

SEQ ID NO: 4033571 - DNA, 11 bp, Homo sapiens
cccactctccc

SEQ ID NO: 4033572 - DNA, 12 bp, Homo sapiens
cccactgatgct

SEQ ID NO: 4033573 - DNA, 22 bp, Homo sapiens
cccactgatgctgttctcttct

SEQ ID NO: 4033574 - DNA, 17 bp, Homo sapiens
cccactgctggtgccag

SEQ ID NO: 4033575 - DNA, 19 bp, Homo sapiens
cccactgctggtgccaggg

SEQ ID NO: 4033576 - DNA, 13 bp, Homo sapiens
cccactgggccag

SEQ ID NO: 4033577 - DNA, 18 bp, Homo sapiens
cccactgggccagccctg

SEQ ID NO: 4033578 - DNA, 20 bp, Homo sapiens
cccactgggccagccctgca

SEQ ID NO: 4033579 - DNA, 22 bp, Homo sapiens
cccactgtccccctacccaccg

SEQ ID NO: 4033580 - DNA, 19 bp, Homo sapiens
cccagaactgcccccactg

SEQ ID NO: 4033581 - DNA, 17 bp, Homo sapiens
cccagaatggagcctgc

SEQ ID NO: 4033582 - DNA, 20 bp, Homo sapiens
cccagaatggagcctgctct

SEQ ID NO: 4033583 - DNA, 23 bp, Homo sapiens
cccagacagacatctctgcaccc

SEQ ID NO: 4033584 - DNA, 22 bp, Homo sapiens
cccagacagggtgggcttcctg

SEQ ID NO: 4033585 - DNA, 19 bp, Homo sapiens
cccagacccttcttgcctg

SEQ ID NO: 4033586 - DNA, 20 bp, Homo sapiens
cccagacccttcttgcctgc

SEQ ID NO: 4033587 - DNA, 21 bp, Homo sapiens
cccagacctgttagcagacag

SEQ ID NO: 4033588 - DNA, 22 bp, Homo sapiens
cccagacctgttagcagacagg

SEQ ID NO: 4033589 - DNA, 24 bp, Homo sapiens
cccagactaaaggatccagagagc

SEQ ID NO: 4033590 - DNA, 13 bp, Homo sapiens
cccagactcagac

SEQ ID NO: 4033591 - DNA, 13 bp, Homo sapiens
cccagagaacagc

SEQ ID NO: 4033592 - DNA, 18 bp, Homo sapiens
cccagagacatacttgaa

SEQ ID NO: 4033593 - DNA, 21 bp, Homo sapiens
cccagagacatacttgaaggg

SEQ ID NO: 4033594 - DNA, 14 bp, Homo sapiens
cccagagagaggat

SEQ ID NO: 4033595 - DNA, 12 bp, Homo sapiens
cccagagaggca

SEQ ID NO: 4033596 - DNA, 17 bp, Homo sapiens
cccagagaggcactcag

SEQ ID NO: 4033597 - DNA, 22 bp, Homo sapiens
cccagagaggcactcagtgagc

SEQ ID NO: 4033598 - DNA, 14 bp, Homo sapiens
cccagagcaccccc

SEQ ID NO: 4033599 - DNA, 20 bp, Homo sapiens
cccagagcaccccctgctcc

SEQ ID NO: 4033600 - DNA, 22 bp, Homo sapiens
cccagagcattacgtgagccag

SEQ ID NO: 4033601 - DNA, 14 bp, Homo sapiens
cccagagccacctg

SEQ ID NO: 4033602 - DNA, 16 bp, Homo sapiens
cccagagccacctgga

SEQ ID NO: 4033603 - DNA, 18 bp, Homo sapiens
cccagagccacctggatc

SEQ ID NO: 4033604 - DNA, 17 bp, Homo sapiens
cccagagcccagctcca

SEQ ID NO: 4033605 - DNA, 20 bp, Homo sapiens
cccagagcccctcctccagc

SEQ ID NO: 4033606 - DNA, 20 bp, Homo sapiens
cccagagctgtttatggcct

SEQ ID NO: 4033607 - DNA, 21 bp, Homo sapiens
cccagagctgtttatggcctc

SEQ ID NO: 4033608 - DNA, 22 bp, Homo sapiens
cccagaggtaacagaacagctt

SEQ ID NO: 4033609 - DNA, 23 bp, Homo sapiens
cccagaggtaacagaacagcttc

SEQ ID NO: 4033610 - DNA, 20 bp, Homo sapiens
cccagaggtgggatcctccc

SEQ ID NO: 4033611 - DNA, 23 bp, Homo sapiens
cccagaggtgggatcctccctca

SEQ ID NO: 4033612 - DNA, 15 bp, Homo sapiens
cccagagtcatctga

SEQ ID NO: 4033613 - DNA, 23 bp, Homo sapiens
cccagatagagctgggtggcctg

SEQ ID NO: 4033614 - DNA, 14 bp, Homo sapiens
cccagatcagccag

SEQ ID NO: 4033615 - DNA, 17 bp, Homo sapiens
cccagatctcccactgc

SEQ ID NO: 4033616 - DNA, 19 bp, Homo sapiens
cccagatctggtcccttgc

SEQ ID NO: 4033617 - DNA, 23 bp, Homo sapiens
cccagatggctggaaggggtcca

SEQ ID NO: 4033618 - DNA, 16 bp, Homo sapiens
cccagattcccctgtg

SEQ ID NO: 4033619 - DNA, 19 bp, Homo sapiens
cccagattttgctgtatat

SEQ ID NO: 4033620 - DNA, 22 bp, Homo sapiens
cccagcacagggggattctgag

SEQ ID NO: 4033621 - DNA, 11 bp, Homo sapiens
cccagcactgt

SEQ ID NO: 4033622 - DNA, 13 bp, Homo sapiens
cccagcactgtga

SEQ ID NO: 4033623 - DNA, 14 bp, Homo sapiens
cccagcactgtgaa

SEQ ID NO: 4033624 - DNA, 22 bp, Homo sapiens
cccagcactgtgaagacccagc

SEQ ID NO: 4033625 - DNA, 14 bp, Homo sapiens
cccagcagaggcag

SEQ ID NO: 4033626 - DNA, 19 bp, Homo sapiens
cccagcagaggcaggctgg

SEQ ID NO: 4033627 - DNA, 12 bp, Homo sapiens
cccagcagccct

SEQ ID NO: 4033628 - DNA, 22 bp, Homo sapiens
cccagcagccctaaggatctct

SEQ ID NO: 4033629 - DNA, 16 bp, Homo sapiens
cccagcagccctcaac

SEQ ID NO: 4033630 - DNA, 13 bp, Homo sapiens
cccagcaggaagc

SEQ ID NO: 4033631 - DNA, 19 bp, Homo sapiens
cccagcaggaagccaggct

SEQ ID NO: 4033632 - DNA, 21 bp, Homo sapiens
cccagcaggaagccaggctga

SEQ ID NO: 4033633 - DNA, 14 bp, Homo sapiens
cccagcagtgtgga

SEQ ID NO: 4033634 - DNA, 17 bp, Homo sapiens
cccagcatcactcccca

SEQ ID NO: 4033635 - DNA, 17 bp, Homo sapiens
cccagcatccctggagc

SEQ ID NO: 4033636 - DNA, 20 bp, Homo sapiens
cccagcatccctggagcagg

SEQ ID NO: 4033637 - DNA, 14 bp, Homo sapiens
cccagccaccccgg

SEQ ID NO: 4033638 - DNA, 12 bp, Homo sapiens
cccagccaggcc

SEQ ID NO: 4033639 - DNA, 22 bp, Homo sapiens
cccagccaggccaacagcacct

SEQ ID NO: 4033640 - DNA, 16 bp, Homo sapiens
cccagcccaccctgct

SEQ ID NO: 4033641 - DNA, 21 bp, Homo sapiens
cccagcccagagccacctgga

SEQ ID NO: 4033642 - DNA, 12 bp, Homo sapiens
cccagcccagat

SEQ ID NO: 4033643 - DNA, 20 bp, Homo sapiens
cccagcccagattcccctgt

SEQ ID NO: 4033644 - DNA, 21 bp, Homo sapiens
cccagcccagattcccctgtg

SEQ ID NO: 4033645 - DNA, 20 bp, Homo sapiens
cccagccccggtggctgggc

SEQ ID NO: 4033646 - DNA, 22 bp, Homo sapiens
cccagccccggtggctgggcag

SEQ ID NO: 4033647 - DNA, 15 bp, Homo sapiens
cccagcccctactgc

SEQ ID NO: 4033648 - DNA, 16 bp, Homo sapiens
cccagcccctccccca

SEQ ID NO: 4033649 - DNA, 12 bp, Homo sapiens
cccagcccctgg

SEQ ID NO: 4033650 - DNA, 20 bp, Homo sapiens
cccagcccggaccttggcag

SEQ ID NO: 4033651 - DNA, 14 bp, Homo sapiens
cccagccctggctc

SEQ ID NO: 4033652 - DNA, 20 bp, Homo sapiens
cccagccctgtcctggttcc

SEQ ID NO: 4033653 - DNA, 16 bp, Homo sapiens
cccagcctccctgaag

SEQ ID NO: 4033654 - DNA, 21 bp, Homo sapiens
cccagcctcgcctgtcacccc

SEQ ID NO: 4033655 - DNA, 13 bp, Homo sapiens
cccagcctgacct

SEQ ID NO: 4033656 - DNA, 19 bp, Homo sapiens
cccagcctgacctgagact

SEQ ID NO: 4033657 - DNA, 21 bp, Homo sapiens
cctatgtcctaaggacacact

SEQ ID NO: 4033658 - DNA, 23 bp, Homo sapiens
cctatgtcctaaggacacactaa

SEQ ID NO: 4033659 - DNA, 21 bp, Homo sapiens
cctattccaggaattcctctt

SEQ ID NO: 4033660 - DNA, 13 bp, Homo sapiens
cctattctcacca

SEQ ID NO: 4033661 - DNA, 23 bp, Homo sapiens
cctatttcagtgttacctgtgtg

SEQ ID NO: 4033662 - DNA, 12 bp, Homo sapiens
cctatttgtgtg

SEQ ID NO: 4033663 - DNA, 13 bp, Homo sapiens
cctatttttgtag

SEQ ID NO: 4033664 - DNA, 14 bp, Homo sapiens
cctcaaagaggcag

SEQ ID NO: 4033665 - DNA, 16 bp, Homo sapiens
cctcaaaggcccgctc

SEQ ID NO: 4033666 - DNA, 15 bp, Homo sapiens
cctcaacaagggaga

SEQ ID NO: 4033667 - DNA, 21 bp, Homo sapiens
cctcaacaagggagagacctc

SEQ ID NO: 4033668 - DNA, 13 bp, Homo sapiens
cctcaacaggccc

SEQ ID NO: 4033669 - DNA, 15 bp, Homo sapiens
cctcaacaggcccag

SEQ ID NO: 4033670 - DNA, 16 bp, Homo sapiens
cctcaacaggcccagg

SEQ ID NO: 4033671 - DNA, 20 bp, Homo sapiens
cctcaacaggcccagggagg

SEQ ID NO: 4033672 - DNA, 19 bp, Homo sapiens
cctcaacgttgctccccat

SEQ ID NO: 4033673 - DNA, 16 bp, Homo sapiens
cctcaagaaataaaag

SEQ ID NO: 4033674 - DNA, 14 bp, Homo sapiens
cctcaagccccagc

SEQ ID NO: 4033675 - DNA, 19 bp, Homo sapiens
cctcaagccccagcagccc

SEQ ID NO: 4033676 - DNA, 20 bp, Homo sapiens
cctcaagccccatttcctca

SEQ ID NO: 4033677 - DNA, 12 bp, Homo sapiens
cctcaaggactt

SEQ ID NO: 4033678 - DNA, 19 bp, Homo sapiens
cctcaaggacttgaaagca

SEQ ID NO: 4033679 - DNA, 20 bp, Homo sapiens
cctcaaggacttgaaagcat

SEQ ID NO: 4033680 - DNA, 16 bp, Homo sapiens
cctcaatccaccttca

SEQ ID NO: 4033681 - DNA, 23 bp, Homo sapiens
cctcaatgccagtaacgcgtctt

SEQ ID NO: 4033682 - DNA, 14 bp, Homo sapiens
cctcaatgtgacca

SEQ ID NO: 4033683 - DNA, 12 bp, Homo sapiens
cctcaatttcaa

SEQ ID NO: 4033684 - DNA, 23 bp, Homo sapiens
cctcacacaccctgaggtcaggg

SEQ ID NO: 4033685 - DNA, 20 bp, Homo sapiens
cctcacacccctgtcccacc

SEQ ID NO: 4033686 - DNA, 21 bp, Homo sapiens
cctcacacccctgtcccaccc

SEQ ID NO: 4033687 - DNA, 23 bp, Homo sapiens
cctcacccggtgacctctagccc

SEQ ID NO: 4033688 - DNA, 14 bp, Homo sapiens
cctcaccctgcctt

SEQ ID NO: 4033689 - DNA, 22 bp, Homo sapiens
cctcacctaataggctgggaga

SEQ ID NO: 4033690 - DNA, 14 bp, Homo sapiens
cctcacctcatgcc

SEQ ID NO: 4033691 - DNA, 16 bp, Homo sapiens
cctcacctcatgccca

SEQ ID NO: 4033692 - DNA, 12 bp, Homo sapiens
cctcacctctgg

SEQ ID NO: 4033693 - DNA, 15 bp, Homo sapiens
cctcacctgtagcag

SEQ ID NO: 4033694 - DNA, 15 bp, Homo sapiens
cctcaccttggcacc

SEQ ID NO: 4033695 - DNA, 13 bp, Homo sapiens
cctcaccttgggc

SEQ ID NO: 4033696 - DNA, 19 bp, Homo sapiens
cctcaccttgggctggggg

SEQ ID NO: 4033697 - DNA, 17 bp, Homo sapiens
cctcacctttcccatct

SEQ ID NO: 4033698 - DNA, 24 bp, Homo sapiens
cctcactatggtatgctggccagc

SEQ ID NO: 4033699 - DNA, 19 bp, Homo sapiens
cctcactctgtcagccagc

SEQ ID NO: 4033700 - DNA, 20 bp, Homo sapiens
cctcactctgtcagccagcc

SEQ ID NO: 4033701 - DNA, 13 bp, Homo sapiens
cctcactgaagga

SEQ ID NO: 4033702 - DNA, 12 bp, Homo sapiens
cctcactgggtg

SEQ ID NO: 4033703 - DNA, 14 bp, Homo sapiens
cctcacttggggga

SEQ ID NO: 4033704 - DNA, 15 bp, Homo sapiens
cctcagaaagtcacc

SEQ ID NO: 4033705 - DNA, 22 bp, Homo sapiens
cctcagaaagtcaccaggactt

SEQ ID NO: 4033706 - DNA, 14 bp, Homo sapiens
cctcagaccaactc

SEQ ID NO: 4033707 - DNA, 18 bp, Homo sapiens
cctcagaccaactctctc

SEQ ID NO: 4033708 - DNA, 22 bp, Homo sapiens
cctcagaccaactctctcctgt

SEQ ID NO: 4033709 - DNA, 16 bp, Homo sapiens
cctcagacgttgcctg

SEQ ID NO: 4033710 - DNA, 17 bp, Homo sapiens
cctcagacgttgcctga

SEQ ID NO: 4033711 - DNA, 17 bp, Homo sapiens
cctcagacttaccagga

SEQ ID NO: 4033712 - DNA, 19 bp, Homo sapiens
cctcagagccctgccctgc

SEQ ID NO: 4033713 - DNA, 14 bp, Homo sapiens
cctcagaggcagct

SEQ ID NO: 4033714 - DNA, 15 bp, Homo sapiens
cctcagaggcagctt

SEQ ID NO: 4033715 - DNA, 14 bp, Homo sapiens
cctcagatgatctc

SEQ ID NO: 4033716 - DNA, 17 bp, Homo sapiens
cctcagattagatgtgc

SEQ ID NO: 4033717 - DNA, 13 bp, Homo sapiens
cctcagattcttc

SEQ ID NO: 4033718 - DNA, 16 bp, Homo sapiens
cctcagattcttcatt

SEQ ID NO: 4033719 - DNA, 19 bp, Homo sapiens
cctcagcatttccttccag

SEQ ID NO: 4033720 - DNA, 16 bp, Homo sapiens
cctcagccacacccag

SEQ ID NO: 4033721 - DNA, 11 bp, Homo sapiens
cctcagccctc

SEQ ID NO: 4033722 - DNA, 12 bp, Homo sapiens
cctcagccctca

SEQ ID NO: 4033723 - DNA, 13 bp, Homo sapiens
cctcagccctcag

SEQ ID NO: 4033724 - DNA, 16 bp, Homo sapiens
cctcagccctcagaac

SEQ ID NO: 4033725 - DNA, 17 bp, Homo sapiens
cctcagcctcagaggag

SEQ ID NO: 4033726 - DNA, 14 bp, Homo sapiens
cctcagcctggcca

SEQ ID NO: 4033727 - DNA, 15 bp, Homo sapiens
cctcagcctggccag

SEQ ID NO: 4033728 - DNA, 16 bp, Homo sapiens
cctcagcctggccaga

SEQ ID NO: 4033729 - DNA, 17 bp, Homo sapiens
cctcagcctggccagac

SEQ ID NO: 4033730 - DNA, 18 bp, Homo sapiens
cctcagcctggccagaca

SEQ ID NO: 4033731 - DNA, 19 bp, Homo sapiens
cctcagcctggccagacac

SEQ ID NO: 4033732 - DNA, 22 bp, Homo sapiens
cctcagcctggccagacacagg

SEQ ID NO: 4033733 - DNA, 13 bp, Homo sapiens
cctcagccttcca

SEQ ID NO: 4033734 - DNA, 20 bp, Homo sapiens
cctcagccttgccagagatc

SEQ ID NO: 4033735 - DNA, 22 bp, Homo sapiens
cctcagccttgccagagatcca

SEQ ID NO: 4033736 - DNA, 14 bp, Homo sapiens
cctcagctctggga

SEQ ID NO: 4033737 - DNA, 17 bp, Homo sapiens
cctcagctctgggagag

SEQ ID NO: 4033738 - DNA, 18 bp, Homo sapiens
cctcagctctgggagagg

SEQ ID NO: 4033739 - DNA, 21 bp, Homo sapiens
cctcagctgacccggcctctc

SEQ ID NO: 4033740 - DNA, 13 bp, Homo sapiens
cctcagctgcctc

SEQ ID NO: 4033741 - DNA, 15 bp, Homo sapiens
cctcagctgcctcac

SEQ ID NO: 4033742 - DNA, 19 bp, Homo sapiens
cctcagctgcctcacttcc

SEQ ID NO: 4033743 - DNA, 14 bp, Homo sapiens
cctcagctgcctcc

SEQ ID NO: 4033744 - DNA, 23 bp, Homo sapiens
cctcagctggttactcagggttc

SEQ ID NO: 4033745 - DNA, 14 bp, Homo sapiens
cctcaggcagctca

SEQ ID NO: 4033746 - DNA, 22 bp, Homo sapiens
cctcaggcataggcctgggtgc

SEQ ID NO: 4033747 - DNA, 18 bp, Homo sapiens
cctcaggctctgtggagg

SEQ ID NO: 4033748 - DNA, 21 bp, Homo sapiens
cctcagggagcagggaaggcc

SEQ ID NO: 4033749 - DNA, 19 bp, Homo sapiens
cctcagggcacgcaggacc

SEQ ID NO: 4033750 - DNA, 14 bp, Homo sapiens
cctcagggctccca

SEQ ID NO: 4033751 - DNA, 16 bp, Homo sapiens
cctcagggctcccagg

SEQ ID NO: 4033752 - DNA, 14 bp, Homo sapiens
cctcagggctgtcc

SEQ ID NO: 4033753 - DNA, 16 bp, Homo sapiens
cctcagggctgtccca

SEQ ID NO: 4033754 - DNA, 18 bp, Homo sapiens
cctcagggctgtcccagc

SEQ ID NO: 4033755 - DNA, 22 bp, Homo sapiens
cctcagggttttggggtcctgg

SEQ ID NO: 4033756 - DNA, 14 bp, Homo sapiens
cctcaggtgctgtc

SEQ ID NO: 4033757 - DNA, 24 bp, Homo sapiens
cctcaggtgttttttatgaagtgc

SEQ ID NO: 4033758 - DNA, 22 bp, Homo sapiens
cctcaggttctattttcttaaa

SEQ ID NO: 4033759 - DNA, 12 bp, Homo sapiens
cctcagtgtcat

SEQ ID NO: 4033760 - DNA, 16 bp, Homo sapiens
cctcagttcaacctgg

SEQ ID NO: 4033761 - DNA, 22 bp, Homo sapiens
cctaataaacatccttcaagaa

SEQ ID NO: 4033762 - DNA, 17 bp, Homo sapiens
cctaatcaggctgaggt

SEQ ID NO: 4033763 - DNA, 19 bp, Homo sapiens
cctaatccaggcagatcca

SEQ ID NO: 4033764 - DNA, 20 bp, Homo sapiens
cctaatccaggcagatccag

SEQ ID NO: 4033765 - DNA, 21 bp, Homo sapiens
cctaatccctgggcattgctt

SEQ ID NO: 4033766 - DNA, 13 bp, Homo sapiens
cctaatctctgta

SEQ ID NO: 4033767 - DNA, 18 bp, Homo sapiens
cctaatgtctcactgttc

SEQ ID NO: 4033768 - DNA, 19 bp, Homo sapiens
cctaatgtctcactgttct

SEQ ID NO: 4033769 - DNA, 15 bp, Homo sapiens
cctaattcttctgtc

SEQ ID NO: 4033770 - DNA, 20 bp, Homo sapiens
cctaatttctcctcccttcc

SEQ ID NO: 4033771 - DNA, 18 bp, Homo sapiens
cctacaaccatccctgcc

SEQ ID NO: 4033772 - DNA, 20 bp, Homo sapiens
cctacaaccatccctgccac

SEQ ID NO: 4033773 - DNA, 17 bp, Homo sapiens
cctacaagagcagcctg

SEQ ID NO: 4033774 - DNA, 18 bp, Homo sapiens
cctacaagagcagcctgt

SEQ ID NO: 4033775 - DNA, 19 bp, Homo sapiens
cctacaagagcagcctgtg

SEQ ID NO: 4033776 - DNA, 21 bp, Homo sapiens
cctacaagagcagcctgtggc

SEQ ID NO: 4033777 - DNA, 11 bp, Homo sapiens
cctacacacac

SEQ ID NO: 4033778 - DNA, 14 bp, Homo sapiens
cctacacacacact

SEQ ID NO: 4033779 - DNA, 17 bp, Homo sapiens
cctacacacacactccc

SEQ ID NO: 4033780 - DNA, 18 bp, Homo sapiens
cctacacacacactccct

SEQ ID NO: 4033781 - DNA, 14 bp, Homo sapiens
cctacacacaccca

SEQ ID NO: 4033782 - DNA, 15 bp, Homo sapiens
cctacacacacccag

SEQ ID NO: 4033783 - DNA, 16 bp, Homo sapiens
cctacagactccatct

SEQ ID NO: 4033784 - DNA, 20 bp, Homo sapiens
cctacagactccatctcttc

SEQ ID NO: 4033785 - DNA, 13 bp, Homo sapiens
cctacagagctgt

SEQ ID NO: 4033786 - DNA, 18 bp, Homo sapiens
cctacagcactactgggt

SEQ ID NO: 4033787 - DNA, 22 bp, Homo sapiens
cctacagcactactgggtgtca

SEQ ID NO: 4033788 - DNA, 14 bp, Homo sapiens
cctacagccccttt

SEQ ID NO: 4033789 - DNA, 15 bp, Homo sapiens
cctacattccctctc

SEQ ID NO: 4033790 - DNA, 19 bp, Homo sapiens
cctaccagttgccctagcc

SEQ ID NO: 4033791 - DNA, 16 bp, Homo sapiens
cctacccacacctctg

SEQ ID NO: 4033792 - DNA, 17 bp, Homo sapiens
cctacccacacctctgc

SEQ ID NO: 4033793 - DNA, 19 bp, Homo sapiens
cctacccacacctctgcca

SEQ ID NO: 4033794 - DNA, 17 bp, Homo sapiens
cctaccgagtctcttct

SEQ ID NO: 4033795 - DNA, 15 bp, Homo sapiens
cctacctctgtgcca

SEQ ID NO: 4033796 - DNA, 14 bp, Homo sapiens
cctacctgccctgg

SEQ ID NO: 4033797 - DNA, 15 bp, Homo sapiens
cctacctgccctgga

SEQ ID NO: 4033798 - DNA, 16 bp, Homo sapiens
cctacctgctctccaa

SEQ ID NO: 4033799 - DNA, 12 bp, Homo sapiens
cctacctgcttc

SEQ ID NO: 4033800 - DNA, 17 bp, Homo sapiens
cctacggagtcagccag

SEQ ID NO: 4033801 - DNA, 13 bp, Homo sapiens
cctacgtccaagg

SEQ ID NO: 4033802 - DNA, 14 bp, Homo sapiens
cctactatgtgctg

SEQ ID NO: 4033803 - DNA, 17 bp, Homo sapiens
cctactatgtgctgggt

SEQ ID NO: 4033804 - DNA, 23 bp, Homo sapiens
cctactatgtgctgggtgcctcc

SEQ ID NO: 4033805 - DNA, 18 bp, Homo sapiens
cctactcacacttcagct

SEQ ID NO: 4033806 - DNA, 13 bp, Homo sapiens
cctactcctgact

SEQ ID NO: 4033807 - DNA, 18 bp, Homo sapiens
cctactcttctctctgct

SEQ ID NO: 4033808 - DNA, 20 bp, Homo sapiens
cctactcttctctctgctct

SEQ ID NO: 4033809 - DNA, 21 bp, Homo sapiens
cctactcttctctctgctctg

SEQ ID NO: 4033810 - DNA, 11 bp, Homo sapiens
cctactgctgt

SEQ ID NO: 4033811 - DNA, 12 bp, Homo sapiens
cctactgctgtg

SEQ ID NO: 4033812 - DNA, 15 bp, Homo sapiens
cctactgggagactg

SEQ ID NO: 4033813 - DNA, 22 bp, Homo sapiens
cctactgggagactgggacacc

SEQ ID NO: 4033814 - DNA, 11 bp, Homo sapiens
cctagaatgtc

SEQ ID NO: 4033815 - DNA, 17 bp, Homo sapiens
cctagagaacgcagccc

SEQ ID NO: 4033816 - DNA, 19 bp, Homo sapiens
cctagagaacgcagcccta

SEQ ID NO: 4033817 - DNA, 15 bp, Homo sapiens
cctagcaagctggcc

SEQ ID NO: 4033818 - DNA, 17 bp, Homo sapiens
cctagcagacagaaact

SEQ ID NO: 4033819 - DNA, 19 bp, Homo sapiens
cctagcagacagaaactgg

SEQ ID NO: 4033820 - DNA, 13 bp, Homo sapiens
cctagcagagtgc

SEQ ID NO: 4033821 - DNA, 14 bp, Homo sapiens
cctagcagagtgct

SEQ ID NO: 4033822 - DNA, 12 bp, Homo sapiens
cctagcagcacc

SEQ ID NO: 4033823 - DNA, 20 bp, Homo sapiens
cctagcagcaccgttctgtg

SEQ ID NO: 4033824 - DNA, 21 bp, Homo sapiens
cctagcagcaccgttctgtgc

SEQ ID NO: 4033825 - DNA, 13 bp, Homo sapiens
cctagccaccagt

SEQ ID NO: 4033826 - DNA, 17 bp, Homo sapiens
cctagccaccagtgtcc

SEQ ID NO: 4033827 - DNA, 20 bp, Homo sapiens
cctagccaccagtgtcctcc

SEQ ID NO: 4033828 - DNA, 19 bp, Homo sapiens
cctagcccttccctgagtg

SEQ ID NO: 4033829 - DNA, 20 bp, Homo sapiens
cctagcctgtgcctctggga

SEQ ID NO: 4033830 - DNA, 17 bp, Homo sapiens
cctagcggagcccagcc

SEQ ID NO: 4033831 - DNA, 22 bp, Homo sapiens
cctagctctcccagtgaactcc

SEQ ID NO: 4033832 - DNA, 21 bp, Homo sapiens
cctagctgaccccgagaagtg

SEQ ID NO: 4033833 - DNA, 17 bp, Homo sapiens
cctagctttagaccctg

SEQ ID NO: 4033834 - DNA, 18 bp, Homo sapiens
cctagctttagaccctgg

SEQ ID NO: 4033835 - DNA, 20 bp, Homo sapiens
cctagctttagaccctgggt

SEQ ID NO: 4033836 - DNA, 21 bp, Homo sapiens
cctagctttagaccctgggtg

SEQ ID NO: 4033837 - DNA, 16 bp, Homo sapiens
cctaggaaactcacac

SEQ ID NO: 4033838 - DNA, 12 bp, Homo sapiens
cctaggagacca

SEQ ID NO: 4033839 - DNA, 21 bp, Homo sapiens
cctaggagagccaacctcggc

SEQ ID NO: 4033840 - DNA, 15 bp, Homo sapiens
cctaggcccctccta

SEQ ID NO: 4033841 - DNA, 14 bp, Homo sapiens
cctaggctcatgga

SEQ ID NO: 4033842 - DNA, 17 bp, Homo sapiens
cctaggggaacagacca

SEQ ID NO: 4033843 - DNA, 16 bp, Homo sapiens
cctaggtagccccctc

SEQ ID NO: 4033844 - DNA, 18 bp, Homo sapiens
cctaggttccctgttctt

SEQ ID NO: 4033845 - DNA, 21 bp, Homo sapiens
cctaggttccctgttcttcct

SEQ ID NO: 4033846 - DNA, 15 bp, Homo sapiens
cctagtcccttcccc

SEQ ID NO: 4033847 - DNA, 16 bp, Homo sapiens
cctagtgtctttaaat

SEQ ID NO: 4033848 - DNA, 18 bp, Homo sapiens
cctagttccctctgctca

SEQ ID NO: 4033849 - DNA, 18 bp, Homo sapiens
cctatagcactgagctca

SEQ ID NO: 4033850 - DNA, 14 bp, Homo sapiens
cctatatgtagtat

SEQ ID NO: 4033851 - DNA, 18 bp, Homo sapiens
cctatattgttttcagtg

SEQ ID NO: 4033852 - DNA, 22 bp, Homo sapiens
cctatattgttttcagtgtaca

SEQ ID NO: 4033853 - DNA, 17 bp, Homo sapiens
cctatcacctatttcca

SEQ ID NO: 4033854 - DNA, 15 bp, Homo sapiens
cctatccgctgccag

SEQ ID NO: 4033855 - DNA, 17 bp, Homo sapiens
cctatccgctgccagcc

SEQ ID NO: 4033856 - DNA, 14 bp, Homo sapiens
cctatcctctgagt

SEQ ID NO: 4033857 - DNA, 21 bp, Homo sapiens
cctatctatcttccaaatgca

SEQ ID NO: 4033858 - DNA, 21 bp, Homo sapiens
cctatctattaaagtgacttt

SEQ ID NO: 4033859 - DNA, 20 bp, Homo sapiens
cctatctcgtgggagagcca

SEQ ID NO: 4033860 - DNA, 13 bp, Homo sapiens
cctatcttgtgaa

SEQ ID NO: 4033861 - DNA, 15 bp, Homo sapiens
cctatcttgtgaagt

SEQ ID NO: 4033862 - DNA, 17 bp, Homo sapiens
cctatgggcctgccggg

SEQ ID NO: 4033863 - DNA, 19 bp, Homo sapiens
cctatgggcctgccgggct

SEQ ID NO: 4033864 - DNA, 22 bp, Homo sapiens
cctatgtaagaattcagaagac

SEQ ID NO: 4033865 - DNA, 14 bp, Homo sapiens
ccggcctcagggcg

SEQ ID NO: 4033866 - DNA, 11 bp, Homo sapiens
ccggcctcctc

SEQ ID NO: 4033867 - DNA, 19 bp, Homo sapiens
ccggcctggatgccagctg

SEQ ID NO: 4033868 - DNA, 17 bp, Homo sapiens
ccggcggctactctgga

SEQ ID NO: 4033869 - DNA, 22 bp, Homo sapiens
ccggctgggtcggccctgccca

SEQ ID NO: 4033870 - DNA, 16 bp, Homo sapiens
ccgggacagacctgga

SEQ ID NO: 4033871 - DNA, 18 bp, Homo sapiens
ccgggacagacctggaca

SEQ ID NO: 4033872 - DNA, 22 bp, Homo sapiens
ccgggagcctccccctcagatg

SEQ ID NO: 4033873 - DNA, 23 bp, Homo sapiens
ccgggcacggtcacacggccacc

SEQ ID NO: 4033874 - DNA, 17 bp, Homo sapiens
ccgggccacgccccagc

SEQ ID NO: 4033875 - DNA, 21 bp, Homo sapiens
ccgggccacgccccagcccga

SEQ ID NO: 4033876 - DNA, 13 bp, Homo sapiens
ccgggccagggct

SEQ ID NO: 4033877 - DNA, 21 bp, Homo sapiens
ccgggcccctgggcttggcct

SEQ ID NO: 4033878 - DNA, 23 bp, Homo sapiens
ccgggcccctgggcttggcctgc

SEQ ID NO: 4033879 - DNA, 15 bp, Homo sapiens
ccgggcgcggccagc

SEQ ID NO: 4033880 - DNA, 21 bp, Homo sapiens
ccgggcgcggtggcgggcacc

SEQ ID NO: 4033881 - DNA, 13 bp, Homo sapiens
ccgggctctctgc

SEQ ID NO: 4033882 - DNA, 11 bp, Homo sapiens
ccgggctctgc

SEQ ID NO: 4033883 - DNA, 21 bp, Homo sapiens
ccgggcttgggccctgcacag

SEQ ID NO: 4033884 - DNA, 16 bp, Homo sapiens
ccggggaagctgccag

SEQ ID NO: 4033885 - DNA, 15 bp, Homo sapiens
ccggggacagaggcc

SEQ ID NO: 4033886 - DNA, 16 bp, Homo sapiens
ccggggccagcaccac

SEQ ID NO: 4033887 - DNA, 15 bp, Homo sapiens
ccggggccagcactt

SEQ ID NO: 4033888 - DNA, 14 bp, Homo sapiens
ccgggggagcccag

SEQ ID NO: 4033889 - DNA, 20 bp, Homo sapiens
ccggggtgcccacaggccgc

SEQ ID NO: 4033890 - DNA, 21 bp, Homo sapiens
ccggggtggagcatgggcctg

SEQ ID NO: 4033891 - DNA, 17 bp, Homo sapiens
ccggggtgtaacttcct

SEQ ID NO: 4033892 - DNA, 18 bp, Homo sapiens
ccggggtgtaacttcctg

SEQ ID NO: 4033893 - DNA, 13 bp, Homo sapiens
ccgggtcttccta

SEQ ID NO: 4033894 - DNA, 13 bp, Homo sapiens
ccgggtgtggcct

SEQ ID NO: 4033895 - DNA, 14 bp, Homo sapiens
ccgggtgtggcctc

SEQ ID NO: 4033896 - DNA, 21 bp, Homo sapiens
ccgggtgtggcctcagccctc

SEQ ID NO: 4033897 - DNA, 17 bp, Homo sapiens
ccgggttcagcctggcc

SEQ ID NO: 4033898 - DNA, 18 bp, Homo sapiens
ccgggttcagcctggcct

SEQ ID NO: 4033899 - DNA, 18 bp, Homo sapiens
ccggtaactgtcctgtcc

SEQ ID NO: 4033900 - DNA, 19 bp, Homo sapiens
ccggtaactgtcctgtcct

SEQ ID NO: 4033901 - DNA, 17 bp, Homo sapiens
ccggtagggaggcagcc

SEQ ID NO: 4033902 - DNA, 20 bp, Homo sapiens
ccggtcagtgccttttggaa

SEQ ID NO: 4033903 - DNA, 16 bp, Homo sapiens
ccggtcgggcagccag

SEQ ID NO: 4033904 - DNA, 19 bp, Homo sapiens
ccggtcgggcagccagcag

SEQ ID NO: 4033905 - DNA, 20 bp, Homo sapiens
ccggtcgggcagccagcaga

SEQ ID NO: 4033906 - DNA, 21 bp, Homo sapiens
ccggtcgggcagccagcagag

SEQ ID NO: 4033907 - DNA, 13 bp, Homo sapiens
ccggtgctgcagg

SEQ ID NO: 4033908 - DNA, 20 bp, Homo sapiens
ccggttcagacccctgcctg

SEQ ID NO: 4033909 - DNA, 15 bp, Homo sapiens
ccgtagggagtacct

SEQ ID NO: 4033910 - DNA, 20 bp, Homo sapiens
ccgtagggtctttcttggga

SEQ ID NO: 4033911 - DNA, 17 bp, Homo sapiens
ccgtcagccaaatgtaa

SEQ ID NO: 4033912 - DNA, 15 bp, Homo sapiens
ccgtcatgttcctca

SEQ ID NO: 4033913 - DNA, 16 bp, Homo sapiens
ccgtcatgttcctcaa

SEQ ID NO: 4033914 - DNA, 21 bp, Homo sapiens
ccgtccaggggagatggggag

SEQ ID NO: 4033915 - DNA, 18 bp, Homo sapiens
ccgtccatatcagaactg

SEQ ID NO: 4033916 - DNA, 16 bp, Homo sapiens
ccgtcccctccttccc

SEQ ID NO: 4033917 - DNA, 22 bp, Homo sapiens
ccgtctacagctcccccagctc

SEQ ID NO: 4033918 - DNA, 19 bp, Homo sapiens
ccgtctgcccaccattccc

SEQ ID NO: 4033919 - DNA, 18 bp, Homo sapiens
ccgtctggacctggggag

SEQ ID NO: 4033920 - DNA, 18 bp, Homo sapiens
ccgtgaaccagagggtgt

SEQ ID NO: 4033921 - DNA, 22 bp, Homo sapiens
ccgtgccctggtgaatcacctg

SEQ ID NO: 4033922 - DNA, 13 bp, Homo sapiens
ccgtgcctggcca

SEQ ID NO: 4033923 - DNA, 15 bp, Homo sapiens
ccgtgcctggccaga

SEQ ID NO: 4033924 - DNA, 14 bp, Homo sapiens
ccgtgccttcagct

SEQ ID NO: 4033925 - DNA, 21 bp, Homo sapiens
ccgtgcttttaaggaaaggca

SEQ ID NO: 4033926 - DNA, 16 bp, Homo sapiens
ccgtggagactgagat

SEQ ID NO: 4033927 - DNA, 16 bp, Homo sapiens
ccgtggaggaggaagg

SEQ ID NO: 4033928 - DNA, 21 bp, Homo sapiens
ccgtggatggccgtggatgcg

SEQ ID NO: 4033929 - DNA, 19 bp, Homo sapiens
ccgtggattgcacgtggcc

SEQ ID NO: 4033930 - DNA, 20 bp, Homo sapiens
ccgtggattgcacgtggcct

SEQ ID NO: 4033931 - DNA, 15 bp, Homo sapiens
ccgtggtatgtctgc

SEQ ID NO: 4033932 - DNA, 18 bp, Homo sapiens
ccgtggtatgtctgccat

SEQ ID NO: 4033933 - DNA, 18 bp, Homo sapiens
ccgtggtccagctcttgg

SEQ ID NO: 4033934 - DNA, 16 bp, Homo sapiens
ccgtgtaaaccaaagc

SEQ ID NO: 4033935 - DNA, 18 bp, Homo sapiens
ccgtgtcaagctgctctg

SEQ ID NO: 4033936 - DNA, 23 bp, Homo sapiens
ccgtgtcaagctgctctgagcca

SEQ ID NO: 4033937 - DNA, 23 bp, Homo sapiens
ccgtgtccagcacagaaggaatc

SEQ ID NO: 4033938 - DNA, 21 bp, Homo sapiens
ccgtgtgagtgtgacagggcc

SEQ ID NO: 4033939 - DNA, 22 bp, Homo sapiens
ccgtgttgcatgaaggagcagc

SEQ ID NO: 4033940 - DNA, 15 bp, Homo sapiens
ccgttaacctttttg

SEQ ID NO: 4033941 - DNA, 20 bp, Homo sapiens
ccgttcagtgtcccaggcag

SEQ ID NO: 4033942 - DNA, 18 bp, Homo sapiens
ccgttcctgacatcacag

SEQ ID NO: 4033943 - DNA, 19 bp, Homo sapiens
ccgttcctgacatcacagc

SEQ ID NO: 4033944 - DNA, 23 bp, Homo sapiens
ccgttcctgacatcacagcagcc

SEQ ID NO: 4033945 - DNA, 13 bp, Homo sapiens
ccgttctgttctg

SEQ ID NO: 4033946 - DNA, 18 bp, Homo sapiens
ccgttctgttctgctggg

SEQ ID NO: 4033947 - DNA, 13 bp, Homo sapiens
ccgttgaccagat

SEQ ID NO: 4033948 - DNA, 23 bp, Homo sapiens
ccgtttcatttagtcatgtgacc

SEQ ID NO: 4033949 - DNA, 15 bp, Homo sapiens
cctaaaagtaaacat

SEQ ID NO: 4033950 - DNA, 22 bp, Homo sapiens
cctaaaagtgggcttgattctg

SEQ ID NO: 4033951 - DNA, 15 bp, Homo sapiens
cctaaaatacattta

SEQ ID NO: 4033952 - DNA, 13 bp, Homo sapiens
cctaaaatataat

SEQ ID NO: 4033953 - DNA, 14 bp, Homo sapiens
cctaaacccaatga

SEQ ID NO: 4033954 - DNA, 15 bp, Homo sapiens
cctaaacccctgtcc

SEQ ID NO: 4033955 - DNA, 22 bp, Homo sapiens
cctaaaccgtcccctccttccc

SEQ ID NO: 4033956 - DNA, 16 bp, Homo sapiens
cctaaactttggcctt

SEQ ID NO: 4033957 - DNA, 17 bp, Homo sapiens
cctaaagacgtctcttt

SEQ ID NO: 4033958 - DNA, 19 bp, Homo sapiens
cctaaagacgtctcttttt

SEQ ID NO: 4033959 - DNA, 20 bp, Homo sapiens
cctaaagtacagcctggacc

SEQ ID NO: 4033960 - DNA, 20 bp, Homo sapiens
cctaaataaaaaaagacaaa

SEQ ID NO: 4033961 - DNA, 20 bp, Homo sapiens
cctaagaaatatgtgagatt

SEQ ID NO: 4033962 - DNA, 22 bp, Homo sapiens
cctaagacatgtgaggaggaaa

SEQ ID NO: 4033963 - DNA, 18 bp, Homo sapiens
cctaagcccccagggcct

SEQ ID NO: 4033964 - DNA, 19 bp, Homo sapiens
cctaagcccccagggcctc

SEQ ID NO: 4033965 - DNA, 16 bp, Homo sapiens
cctaaggatctctcag

SEQ ID NO: 4033966 - DNA, 18 bp, Homo sapiens
cctaataaacatccttca

SEQ ID NO: 4033967 - DNA, 11 bp, Homo sapiens
ccgagctcttg

SEQ ID NO: 4033968 - DNA, 22 bp, Homo sapiens
ccgagctggggggttggcagcc

SEQ ID NO: 4033969 - DNA, 16 bp, Homo sapiens
ccgagctggtgcatta

SEQ ID NO: 4033970 - DNA, 20 bp, Homo sapiens
ccgagctggtgcattacaga

SEQ ID NO: 4033971 - DNA, 15 bp, Homo sapiens
ccgagctggtttcct

SEQ ID NO: 4033972 - DNA, 13 bp, Homo sapiens
ccgagctgtcccc

SEQ ID NO: 4033973 - DNA, 16 bp, Homo sapiens
ccgaggcccagcgggc

SEQ ID NO: 4033974 - DNA, 19 bp, Homo sapiens
ccgaggcccagcgggcaga

SEQ ID NO: 4033975 - DNA, 20 bp, Homo sapiens
ccgaggcgggtggatcacga

SEQ ID NO: 4033976 - DNA, 16 bp, Homo sapiens
ccgaggggagggcagg

SEQ ID NO: 4033977 - DNA, 15 bp, Homo sapiens
ccgaggggccgggga

SEQ ID NO: 4033978 - DNA, 17 bp, Homo sapiens
ccgagggtcctggctcc

SEQ ID NO: 4033979 - DNA, 12 bp, Homo sapiens
ccgagtccaagc

SEQ ID NO: 4033980 - DNA, 18 bp, Homo sapiens
ccgagtctcttctccact

SEQ ID NO: 4033981 - DNA, 21 bp, Homo sapiens
ccgagtctcttctccactgga

SEQ ID NO: 4033982 - DNA, 22 bp, Homo sapiens
ccgagtctcttctccactggat

SEQ ID NO: 4033983 - DNA, 15 bp, Homo sapiens
ccgcaaggcctccag

SEQ ID NO: 4033984 - DNA, 18 bp, Homo sapiens
ccgcacatggtgtggggg

SEQ ID NO: 4033985 - DNA, 17 bp, Homo sapiens
ccgcactttccacttct

SEQ ID NO: 4033986 - DNA, 18 bp, Homo sapiens
ccgcagacgggcacagac

SEQ ID NO: 4033987 - DNA, 21 bp, Homo sapiens
ccgcaggtgggtgctgccctg

SEQ ID NO: 4033988 - DNA, 15 bp, Homo sapiens
ccgcagtgctgggac

SEQ ID NO: 4033989 - DNA, 18 bp, Homo sapiens
ccgcagtgctgggaccag

SEQ ID NO: 4033990 - DNA, 16 bp, Homo sapiens
ccgcagtgtttgtgtg

SEQ ID NO: 4033991 - DNA, 15 bp, Homo sapiens
ccgccaatctggccc

SEQ ID NO: 4033992 - DNA, 13 bp, Homo sapiens
ccgccacctcagg

SEQ ID NO: 4033993 - DNA, 14 bp, Homo sapiens
ccgccacgtcccag

SEQ ID NO: 4033994 - DNA, 15 bp, Homo sapiens
ccgccagagggcttg

SEQ ID NO: 4033995 - DNA, 14 bp, Homo sapiens
ccgccagctgggag

SEQ ID NO: 4033996 - DNA, 15 bp, Homo sapiens
ccgccagggctgggg

SEQ ID NO: 4033997 - DNA, 16 bp, Homo sapiens
ccgccagggctgggga

SEQ ID NO: 4033998 - DNA, 18 bp, Homo sapiens
ccgccatccttcaccaga

SEQ ID NO: 4033999 - DNA, 20 bp, Homo sapiens
ccgccatccttcaccagagc

SEQ ID NO: 4034000 - DNA, 22 bp, Homo sapiens
ccgccatccttcaccagagccc

SEQ ID NO: 4034001 - DNA, 17 bp, Homo sapiens
ccgccatggtgtcccgg

SEQ ID NO: 4034002 - DNA, 21 bp, Homo sapiens
ccgccccatgggcccctcacc

SEQ ID NO: 4034003 - DNA, 13 bp, Homo sapiens
ccgcccccagtcc

SEQ ID NO: 4034004 - DNA, 17 bp, Homo sapiens
ccgcccctgtggccctg

SEQ ID NO: 4034005 - DNA, 14 bp, Homo sapiens
ccgccctcctcggg

SEQ ID NO: 4034006 - DNA, 14 bp, Homo sapiens
ccgccctgggctgg

SEQ ID NO: 4034007 - DNA, 15 bp, Homo sapiens
ccgccctgggctgga

SEQ ID NO: 4034008 - DNA, 16 bp, Homo sapiens
ccgccctgggctggac

SEQ ID NO: 4034009 - DNA, 20 bp, Homo sapiens
ccgcccttccatgtgccttt

SEQ ID NO: 4034010 - DNA, 17 bp, Homo sapiens
ccgcctcagggccaggc

SEQ ID NO: 4034011 - DNA, 14 bp, Homo sapiens
ccgcctccctctca

SEQ ID NO: 4034012 - DNA, 21 bp, Homo sapiens
ccgcctccctctcagaggcct

SEQ ID NO: 4034013 - DNA, 22 bp, Homo sapiens
ccgcctggatgcggatggccgg

SEQ ID NO: 4034014 - DNA, 16 bp, Homo sapiens
ccgccttaagctgatc

SEQ ID NO: 4034015 - DNA, 19 bp, Homo sapiens
ccgccttctcccacatgag

SEQ ID NO: 4034016 - DNA, 18 bp, Homo sapiens
ccgcgcaccccacgccct

SEQ ID NO: 4034017 - DNA, 15 bp, Homo sapiens
ccgcggagcccttgg

SEQ ID NO: 4034018 - DNA, 18 bp, Homo sapiens
ccgcggggaagctggctt

SEQ ID NO: 4034019 - DNA, 19 bp, Homo sapiens
ccgcgggttccgcaggcag

SEQ ID NO: 4034020 - DNA, 13 bp, Homo sapiens
ccgctcagccctc

SEQ ID NO: 4034021 - DNA, 19 bp, Homo sapiens
ccgctcagccctccctgcc

SEQ ID NO: 4034022 - DNA, 22 bp, Homo sapiens
ccgctcagccctccctgcccct

SEQ ID NO: 4034023 - DNA, 15 bp, Homo sapiens
ccgctcctgccgcag

SEQ ID NO: 4034024 - DNA, 18 bp, Homo sapiens
ccgctctacatcttctgc

SEQ ID NO: 4034025 - DNA, 19 bp, Homo sapiens
ccgctgagctgagtggcca

SEQ ID NO: 4034026 - DNA, 22 bp, Homo sapiens
ccgctgagctgagtggccagcc

SEQ ID NO: 4034027 - DNA, 13 bp, Homo sapiens
ccgctgaggggtc

SEQ ID NO: 4034028 - DNA, 13 bp, Homo sapiens
ccgctgataagca

SEQ ID NO: 4034029 - DNA, 19 bp, Homo sapiens
ccgctgcaatgcctagact

SEQ ID NO: 4034030 - DNA, 18 bp, Homo sapiens
ccgctgccgctgcaccac

SEQ ID NO: 4034031 - DNA, 14 bp, Homo sapiens
ccgctgctgctgct

SEQ ID NO: 4034032 - DNA, 15 bp, Homo sapiens
ccgctgtgagcccct

SEQ ID NO: 4034033 - DNA, 18 bp, Homo sapiens
ccgctgtgagcccctggt

SEQ ID NO: 4034034 - DNA, 19 bp, Homo sapiens
ccgctgtgagcccctggtc

SEQ ID NO: 4034035 - DNA, 20 bp, Homo sapiens
ccgctgtgagcccctggtcc

SEQ ID NO: 4034036 - DNA, 19 bp, Homo sapiens
ccgcttgaaaagctagtgt

SEQ ID NO: 4034037 - DNA, 23 bp, Homo sapiens
ccgcttgaaaagctagtgtacct

SEQ ID NO: 4034038 - DNA, 19 bp, Homo sapiens
ccgcttttgttctcgcaaa

SEQ ID NO: 4034039 - DNA, 14 bp, Homo sapiens
ccggaaccacaggg

SEQ ID NO: 4034040 - DNA, 17 bp, Homo sapiens
ccggaaccacagggcca

SEQ ID NO: 4034041 - DNA, 21 bp, Homo sapiens
ccggaaccacagggccagagg

SEQ ID NO: 4034042 - DNA, 17 bp, Homo sapiens
ccggacactcctagaga

SEQ ID NO: 4034043 - DNA, 17 bp, Homo sapiens
ccggactggtgccctcc

SEQ ID NO: 4034044 - DNA, 14 bp, Homo sapiens
ccggagaggaccgg

SEQ ID NO: 4034045 - DNA, 17 bp, Homo sapiens
ccggagatgtagcaaaa

SEQ ID NO: 4034046 - DNA, 18 bp, Homo sapiens
ccggagatgtagcaaaac

SEQ ID NO: 4034047 - DNA, 19 bp, Homo sapiens
ccggagattggacggcctg

SEQ ID NO: 4034048 - DNA, 20 bp, Homo sapiens
ccggagattggacggcctga

SEQ ID NO: 4034049 - DNA, 14 bp, Homo sapiens
ccggagcctgtgca

SEQ ID NO: 4034050 - DNA, 16 bp, Homo sapiens
ccggaggggcctggca

SEQ ID NO: 4034051 - DNA, 21 bp, Homo sapiens
ccggaggggcctggcagccgt

SEQ ID NO: 4034052 - DNA, 18 bp, Homo sapiens
ccggagggtgtttatgta

SEQ ID NO: 4034053 - DNA, 19 bp, Homo sapiens
ccggcaagcagcgggctaa

SEQ ID NO: 4034054 - DNA, 15 bp, Homo sapiens
ccggcaagccacagg

SEQ ID NO: 4034055 - DNA, 19 bp, Homo sapiens
ccggcacagggtctgctct

SEQ ID NO: 4034056 - DNA, 11 bp, Homo sapiens
ccggcagggcg

SEQ ID NO: 4034057 - DNA, 16 bp, Homo sapiens
ccggcagggcgggcag

SEQ ID NO: 4034058 - DNA, 21 bp, Homo sapiens
ccggcagggcgggcagagggc

SEQ ID NO: 4034059 - DNA, 11 bp, Homo sapiens
ccggccagccc

SEQ ID NO: 4034060 - DNA, 17 bp, Homo sapiens
ccggccagcgggcacag

SEQ ID NO: 4034061 - DNA, 21 bp, Homo sapiens
ccggccagcgggcacagggca

SEQ ID NO: 4034062 - DNA, 15 bp, Homo sapiens
ccggccatactgcct

SEQ ID NO: 4034063 - DNA, 19 bp, Homo sapiens
ccggcccagatgtgtcccc

SEQ ID NO: 4034064 - DNA, 15 bp, Homo sapiens
ccggccccctggtct

SEQ ID NO: 4034065 - DNA, 17 bp, Homo sapiens
ccggcccctccccctga

SEQ ID NO: 4034066 - DNA, 24 bp, Homo sapiens
ccggccctgggctcggaggctgcc

SEQ ID NO: 4034067 - DNA, 16 bp, Homo sapiens
ccggccggcctggcac

SEQ ID NO: 4034068 - DNA, 17 bp, Homo sapiens
ccggccggcctggcacc

SEQ ID NO: 4034069 - DNA, 13 bp, Homo sapiens
ccggcctcagggc

SEQ ID NO: 4034070 - DNA, 14 bp, Homo sapiens
ccctgcctggactt

SEQ ID NO: 4034071 - DNA, 21 bp, Homo sapiens
ccctgcctggcccccaacctc

SEQ ID NO: 4034072 - DNA, 22 bp, Homo sapiens
ccctgccttgggccttgctgct

SEQ ID NO: 4034073 - DNA, 13 bp, Homo sapiens
ccctgcgcctcca

SEQ ID NO: 4034074 - DNA, 15 bp, Homo sapiens
ccctgcgcctccaga

SEQ ID NO: 4034075 - DNA, 23 bp, Homo sapiens
ccctgcggtcaggctgggcagcc

SEQ ID NO: 4034076 - DNA, 12 bp, Homo sapiens
ccctgctcagca

SEQ ID NO: 4034077 - DNA, 17 bp, Homo sapiens
ccctgctccaccagcag

SEQ ID NO: 4034078 - DNA, 20 bp, Homo sapiens
ccctgctccaccagcagcat

SEQ ID NO: 4034079 - DNA, 10 bp, Homo sapiens
ccctgctccc

SEQ ID NO: 4034080 - DNA, 17 bp, Homo sapiens
ccctgctcccacagaac

SEQ ID NO: 4034081 - DNA, 18 bp, Homo sapiens
ccctgctcccagcctgct

SEQ ID NO: 4034082 - DNA, 14 bp, Homo sapiens
ccctgctcccattc

SEQ ID NO: 4034083 - DNA, 17 bp, Homo sapiens
ccctgctcccattcctc

SEQ ID NO: 4034084 - DNA, 19 bp, Homo sapiens
ccctgctcctcctgccctg

SEQ ID NO: 4034085 - DNA, 13 bp, Homo sapiens
ccctgctcctgca

SEQ ID NO: 4034086 - DNA, 14 bp, Homo sapiens
ccctgctcctgcag

SEQ ID NO: 4034087 - DNA, 13 bp, Homo sapiens
ccctgctgcccaa

SEQ ID NO: 4034088 - DNA, 14 bp, Homo sapiens
ccctgctggctctt

SEQ ID NO: 4034089 - DNA, 19 bp, Homo sapiens
ccctgctttggctgagggg

SEQ ID NO: 4034090 - DNA, 22 bp, Homo sapiens
ccctgctttgggctgccctggt

SEQ ID NO: 4034091 - DNA, 23 bp, Homo sapiens
ccctgctttgggctgccctggtg

SEQ ID NO: 4034092 - DNA, 19 bp, Homo sapiens
ccctggaactcctggcctt

SEQ ID NO: 4034093 - DNA, 15 bp, Homo sapiens
ccctggaagagccca

SEQ ID NO: 4034094 - DNA, 13 bp, Homo sapiens
ccctggacctggg

SEQ ID NO: 4034095 - DNA, 13 bp, Homo sapiens
ccctggactggga

SEQ ID NO: 4034096 - DNA, 13 bp, Homo sapiens
ccctggagcagga

SEQ ID NO: 4034097 - DNA, 15 bp, Homo sapiens
ccctggagcaggagc

SEQ ID NO: 4034098 - DNA, 12 bp, Homo sapiens
ccctggagccca

SEQ ID NO: 4034099 - DNA, 19 bp, Homo sapiens
ccctggaggcactgaagtg

SEQ ID NO: 4034100 - DNA, 23 bp, Homo sapiens
ccctggatcacgacgctgcagag

SEQ ID NO: 4034101 - DNA, 24 bp, Homo sapiens
ccctggatcacgacgctgcagagc

SEQ ID NO: 4034102 - DNA, 18 bp, Homo sapiens
ccctggccactaaagctt

SEQ ID NO: 4034103 - DNA, 21 bp, Homo sapiens
ccctggccactaaagcttcag

SEQ ID NO: 4034104 - DNA, 23 bp, Homo sapiens
ccctggccactaaagcttcagac

SEQ ID NO: 4034105 - DNA, 13 bp, Homo sapiens
ccctggcctctgt

SEQ ID NO: 4034106 - DNA, 20 bp, Homo sapiens
ccctggcctgaactgaggag

SEQ ID NO: 4034107 - DNA, 21 bp, Homo sapiens
ccctggcctgaactgaggaga

SEQ ID NO: 4034108 - DNA, 17 bp, Homo sapiens
ccctggctcccacaggc

SEQ ID NO: 4034109 - DNA, 14 bp, Homo sapiens
ccctggctcccatg

SEQ ID NO: 4034110 - DNA, 18 bp, Homo sapiens
ccctggctccctcctcca

SEQ ID NO: 4034111 - DNA, 23 bp, Homo sapiens
ccctggctccctcctccaggcct

SEQ ID NO: 4034112 - DNA, 17 bp, Homo sapiens
ccctggctgagggcagc

SEQ ID NO: 4034113 - DNA, 15 bp, Homo sapiens
ccctggctttgcctc

SEQ ID NO: 4034114 - DNA, 19 bp, Homo sapiens
ccctggctttgcctcttct

SEQ ID NO: 4034115 - DNA, 18 bp, Homo sapiens
ccctggcttttcactgct

SEQ ID NO: 4034116 - DNA, 21 bp, Homo sapiens
ccctgggacacagacccagga

SEQ ID NO: 4034117 - DNA, 15 bp, Homo sapiens
ccctgggcccctcca

SEQ ID NO: 4034118 - DNA, 16 bp, Homo sapiens
ccctgggcccctccac

SEQ ID NO: 4034119 - DNA, 13 bp, Homo sapiens
ccctgggcctcag

SEQ ID NO: 4034120 - DNA, 14 bp, Homo sapiens
ccctgggcctcagt

SEQ ID NO: 4034121 - DNA, 21 bp, Homo sapiens
ccctgggctgccaccagcccc

SEQ ID NO: 4034122 - DNA, 12 bp, Homo sapiens
ccctgggctgga

SEQ ID NO: 4034123 - DNA, 16 bp, Homo sapiens
ccctgggctggactgg

SEQ ID NO: 4034124 - DNA, 18 bp, Homo sapiens
ccctgggctgggtgctgg

SEQ ID NO: 4034125 - DNA, 19 bp, Homo sapiens
ccctgggctgtctgtcacc

SEQ ID NO: 4034126 - DNA, 20 bp, Homo sapiens
ccctgggctgtctgtcacca

SEQ ID NO: 4034127 - DNA, 17 bp, Homo sapiens
ccctgggcttggcctgc

SEQ ID NO: 4034128 - DNA, 19 bp, Homo sapiens
ccctgggcttggcctgctg

SEQ ID NO: 4034129 - DNA, 20 bp, Homo sapiens
ccctgggcttggcctgctgt

SEQ ID NO: 4034130 - DNA, 22 bp, Homo sapiens
ccctgggcttggcctgctgtga

SEQ ID NO: 4034131 - DNA, 23 bp, Homo sapiens
ccctggggactgttccaaagcca

SEQ ID NO: 4034132 - DNA, 13 bp, Homo sapiens
ccctggggcccag

SEQ ID NO: 4034133 - DNA, 18 bp, Homo sapiens
ccctggggcccagcccct

SEQ ID NO: 4034134 - DNA, 14 bp, Homo sapiens
ccctggggcctgac

SEQ ID NO: 4034135 - DNA, 21 bp, Homo sapiens
ccctggggcctgactgctcag

SEQ ID NO: 4034136 - DNA, 14 bp, Homo sapiens
ccctggggcctgga

SEQ ID NO: 4034137 - DNA, 21 bp, Homo sapiens
ccctggggcctggacctgcct

SEQ ID NO: 4034138 - DNA, 23 bp, Homo sapiens
ccctggggcctggacctgcctcc

SEQ ID NO: 4034139 - DNA, 17 bp, Homo sapiens
ccctggggctgtgcatt

SEQ ID NO: 4034140 - DNA, 18 bp, Homo sapiens
ccctgggtgggctctgtg

SEQ ID NO: 4034141 - DNA, 13 bp, Homo sapiens
ccctggtctctgg

SEQ ID NO: 4034142 - DNA, 15 bp, Homo sapiens
ccctggtctctggtc

SEQ ID NO: 4034143 - DNA, 13 bp, Homo sapiens
ccctggtgctgcc

SEQ ID NO: 4034144 - DNA, 15 bp, Homo sapiens
ccctggtgctgccac

SEQ ID NO: 4034145 - DNA, 16 bp, Homo sapiens
ccctggtgctgccaca

SEQ ID NO: 4034146 - DNA, 16 bp, Homo sapiens
ccctgtacctcatccc

SEQ ID NO: 4034147 - DNA, 18 bp, Homo sapiens
ccctgtcaagttaacaag

SEQ ID NO: 4034148 - DNA, 20 bp, Homo sapiens
ccctgtcatttgaacctgga

SEQ ID NO: 4034149 - DNA, 14 bp, Homo sapiens
ccctgtccaaaagc

SEQ ID NO: 4034150 - DNA, 14 bp, Homo sapiens
ccctgtcccaccca

SEQ ID NO: 4034151 - DNA, 23 bp, Homo sapiens
ccctgtcccacccacacagctgc

SEQ ID NO: 4034152 - DNA, 12 bp, Homo sapiens
ccctgtcccagg

SEQ ID NO: 4034153 - DNA, 13 bp, Homo sapiens
ccctgtcccaggc

SEQ ID NO: 4034154 - DNA, 21 bp, Homo sapiens
ccctgtcccatgcaggccctt

SEQ ID NO: 4034155 - DNA, 22 bp, Homo sapiens
ccctgtccccctcccctcccag

SEQ ID NO: 4034156 - DNA, 17 bp, Homo sapiens
ccctgtcctcatgaccc

SEQ ID NO: 4034157 - DNA, 14 bp, Homo sapiens
ccctgtctccagct

SEQ ID NO: 4034158 - DNA, 23 bp, Homo sapiens
ccctgtctctactaaaaatgcaa

SEQ ID NO: 4034159 - DNA, 20 bp, Homo sapiens
ccctgtgacatggtgcctga

SEQ ID NO: 4034160 - DNA, 16 bp, Homo sapiens
ccctgtgccatcacca

SEQ ID NO: 4034161 - DNA, 14 bp, Homo sapiens
ccctgtggccctgg

SEQ ID NO: 4034162 - DNA, 15 bp, Homo sapiens
ccctgtggccctggc

SEQ ID NO: 4034163 - DNA, 12 bp, Homo sapiens
ccctgtgggggt

SEQ ID NO: 4034164 - DNA, 23 bp, Homo sapiens
ccctgtgggggtggccatccctg

SEQ ID NO: 4034165 - DNA, 24 bp, Homo sapiens
ccctgtgggggtggccatccctgg

SEQ ID NO: 4034166 - DNA, 21 bp, Homo sapiens
ccctgtgtccacctgtgggtg

SEQ ID NO: 4034167 - DNA, 18 bp, Homo sapiens
ccctgtgtgtaggctggg

SEQ ID NO: 4034168 - DNA, 16 bp, Homo sapiens
ccctgtgttgtctcta

SEQ ID NO: 4034169 - DNA, 23 bp, Homo sapiens
ccctgttcacgctcacccagtca

SEQ ID NO: 4034170 - DNA, 17 bp, Homo sapiens
ccctgttcatgtgcctc

SEQ ID NO: 4034171 - DNA, 14 bp, Homo sapiens
ccctgttccccaga

SEQ ID NO: 4034172 - DNA, 21 bp, Homo sapiens
ccctgttctaagggggagggg

SEQ ID NO: 4034173 - DNA, 16 bp, Homo sapiens
ccctgttcttcctcca

SEQ ID NO: 4034174 - DNA, 21 bp, Homo sapiens
ccctgtttaatatttaaacag

SEQ ID NO: 4034175 - DNA, 19 bp, Homo sapiens
ccctgtttactggttcttg

SEQ ID NO: 4034176 - DNA, 21 bp, Homo sapiens
cccttaaacacaggctgtcct

SEQ ID NO: 4034177 - DNA, 22 bp, Homo sapiens
cccttaaacacaggctgtcctt

SEQ ID NO: 4034178 - DNA, 13 bp, Homo sapiens
cccttacacactc

SEQ ID NO: 4034179 - DNA, 16 bp, Homo sapiens
cccttacacgtacctc

SEQ ID NO: 4034180 - DNA, 17 bp, Homo sapiens
cccttaccccttagcct

SEQ ID NO: 4034181 - DNA, 22 bp, Homo sapiens
cccttaccccttagcctccctg

SEQ ID NO: 4034182 - DNA, 12 bp, Homo sapiens
cccttatccagg

SEQ ID NO: 4034183 - DNA, 15 bp, Homo sapiens
cccttatccaggact

SEQ ID NO: 4034184 - DNA, 15 bp, Homo sapiens
cccttcacaccccag

SEQ ID NO: 4034185 - DNA, 13 bp, Homo sapiens
cccttcaggaact

SEQ ID NO: 4034186 - DNA, 15 bp, Homo sapiens
cccttcatcttcctg

SEQ ID NO: 4034187 - DNA, 16 bp, Homo sapiens
cccttcatcttcctgt

SEQ ID NO: 4034188 - DNA, 18 bp, Homo sapiens
cccttccagtttattcca

SEQ ID NO: 4034189 - DNA, 15 bp, Homo sapiens
cccttccatgtgcct

SEQ ID NO: 4034190 - DNA, 17 bp, Homo sapiens
cccttccatgtgccttt

SEQ ID NO: 4034191 - DNA, 20 bp, Homo sapiens
cccttccatttctgcctttt

SEQ ID NO: 4034192 - DNA, 18 bp, Homo sapiens
cccttcccatctcttcct

SEQ ID NO: 4034193 - DNA, 17 bp, Homo sapiens
cccttcccatttcttcc

SEQ ID NO: 4034194 - DNA, 14 bp, Homo sapiens
cccttccccttcct

SEQ ID NO: 4034195 - DNA, 16 bp, Homo sapiens
cccttcccgcctccct

SEQ ID NO: 4034196 - DNA, 21 bp, Homo sapiens
cccttccctctgggcacgcct

SEQ ID NO: 4034197 - DNA, 13 bp, Homo sapiens
cccttccctgcac

SEQ ID NO: 4034198 - DNA, 17 bp, Homo sapiens
cccttcctctccactgc

SEQ ID NO: 4034199 - DNA, 20 bp, Homo sapiens
cccttcctctccactgcctt

SEQ ID NO: 4034200 - DNA, 14 bp, Homo sapiens
cccttcctctgctc

SEQ ID NO: 4034201 - DNA, 16 bp, Homo sapiens
cccttcctctgctccc

SEQ ID NO: 4034202 - DNA, 23 bp, Homo sapiens
cccttcctggaggctgcctatgt

SEQ ID NO: 4034203 - DNA, 22 bp, Homo sapiens
cccttccttttccctgcttcca

SEQ ID NO: 4034204 - DNA, 14 bp, Homo sapiens
cccttctctgctcc

SEQ ID NO: 4034205 - DNA, 17 bp, Homo sapiens
cccttctctgctccacc

SEQ ID NO: 4034206 - DNA, 14 bp, Homo sapiens
cccttctcttccag

SEQ ID NO: 4034207 - DNA, 19 bp, Homo sapiens
cccttctcttccaggcagc

SEQ ID NO: 4034208 - DNA, 23 bp, Homo sapiens
cccttctgctcagctctgggcca

SEQ ID NO: 4034209 - DNA, 18 bp, Homo sapiens
cccttcttgcctgctggg

SEQ ID NO: 4034210 - DNA, 19 bp, Homo sapiens
cccttcttgcctgctgggc

SEQ ID NO: 4034211 - DNA, 19 bp, Homo sapiens
cccttcttgggccccagac

SEQ ID NO: 4034212 - DNA, 14 bp, Homo sapiens
cccttgagaaacct

SEQ ID NO: 4034213 - DNA, 19 bp, Homo sapiens
cccttgatttaaacacaca

SEQ ID NO: 4034214 - DNA, 20 bp, Homo sapiens
cccttgatttaaacacacag

SEQ ID NO: 4034215 - DNA, 21 bp, Homo sapiens
cccttgatttaaacacacaga

SEQ ID NO: 4034216 - DNA, 18 bp, Homo sapiens
cccttgccaccccaccct

SEQ ID NO: 4034217 - DNA, 12 bp, Homo sapiens
cccttgcctccc

SEQ ID NO: 4034218 - DNA, 20 bp, Homo sapiens
cccttgcctccccatttccc

SEQ ID NO: 4034219 - DNA, 22 bp, Homo sapiens
cccttgcctctgccctggattg

SEQ ID NO: 4034220 - DNA, 22 bp, Homo sapiens
cccttgctaccacggcctcctt

SEQ ID NO: 4034221 - DNA, 13 bp, Homo sapiens
cccttgctctcag

SEQ ID NO: 4034222 - DNA, 13 bp, Homo sapiens
cccttgctgaaca

SEQ ID NO: 4034223 - DNA, 17 bp, Homo sapiens
cccttgctttcctgggc

SEQ ID NO: 4034224 - DNA, 18 bp, Homo sapiens
cccttgctttcctgggcc

SEQ ID NO: 4034225 - DNA, 20 bp, Homo sapiens
cccttgctttcctgggcctt

SEQ ID NO: 4034226 - DNA, 19 bp, Homo sapiens
cccttgctttgttttaata

SEQ ID NO: 4034227 - DNA, 20 bp, Homo sapiens
cccttggcaggtcctggcca

SEQ ID NO: 4034228 - DNA, 21 bp, Homo sapiens
cccttggcaggtcctggccag

SEQ ID NO: 4034229 - DNA, 12 bp, Homo sapiens
cccttggcctca

SEQ ID NO: 4034230 - DNA, 19 bp, Homo sapiens
cccttggcctgtctcatcc

SEQ ID NO: 4034231 - DNA, 22 bp, Homo sapiens
cccttgggacagccagagctgg

SEQ ID NO: 4034232 - DNA, 22 bp, Homo sapiens
cccttgggcagttctcactcct

SEQ ID NO: 4034233 - DNA, 20 bp, Homo sapiens
cccttgggcctgggcctctg

SEQ ID NO: 4034234 - DNA, 21 bp, Homo sapiens
cccttgggcctgggcctctgc

SEQ ID NO: 4034235 - DNA, 15 bp, Homo sapiens
cccttgggttctgat

SEQ ID NO: 4034236 - DNA, 10 bp, Homo sapiens
cccttgtggg

SEQ ID NO: 4034237 - DNA, 19 bp, Homo sapiens
cccttgtttgtcccttcta

SEQ ID NO: 4034238 - DNA, 14 bp, Homo sapiens
ccctttcaggccta

SEQ ID NO: 4034239 - DNA, 15 bp, Homo sapiens
ccctttccctacctt

SEQ ID NO: 4034240 - DNA, 17 bp, Homo sapiens
ccctttcctcctcaggc

SEQ ID NO: 4034241 - DNA, 15 bp, Homo sapiens
ccctttcctgtccca

SEQ ID NO: 4034242 - DNA, 14 bp, Homo sapiens
ccctttcttctccc

SEQ ID NO: 4034243 - DNA, 17 bp, Homo sapiens
ccctttgaagcctcagc

SEQ ID NO: 4034244 - DNA, 20 bp, Homo sapiens
ccctttgacttcagctgcct

SEQ ID NO: 4034245 - DNA, 12 bp, Homo sapiens
cccttttacttt

SEQ ID NO: 4034246 - DNA, 18 bp, Homo sapiens
cccttttcagctgagccc

SEQ ID NO: 4034247 - DNA, 19 bp, Homo sapiens
cccttttcagctgagccct

SEQ ID NO: 4034248 - DNA, 21 bp, Homo sapiens
cccttttcagctgagccctgg

SEQ ID NO: 4034249 - DNA, 14 bp, Homo sapiens
cccttttctctcac

SEQ ID NO: 4034250 - DNA, 14 bp, Homo sapiens
ccctttttcaatga

SEQ ID NO: 4034251 - DNA, 12 bp, Homo sapiens
ccgaaatgccac

SEQ ID NO: 4034252 - DNA, 20 bp, Homo sapiens
ccgaactgttcaagtgtccc

SEQ ID NO: 4034253 - DNA, 16 bp, Homo sapiens
ccgaaggtgcctcaga

SEQ ID NO: 4034254 - DNA, 20 bp, Homo sapiens
ccgaatgtgcaggtttgtta

SEQ ID NO: 4034255 - DNA, 12 bp, Homo sapiens
ccgacagcctgg

SEQ ID NO: 4034256 - DNA, 13 bp, Homo sapiens
ccgacagcctggc

SEQ ID NO: 4034257 - DNA, 15 bp, Homo sapiens
ccgacagcctggcac

SEQ ID NO: 4034258 - DNA, 15 bp, Homo sapiens
ccgacagctttccag

SEQ ID NO: 4034259 - DNA, 17 bp, Homo sapiens
ccgaccacttccagggg

SEQ ID NO: 4034260 - DNA, 23 bp, Homo sapiens
ccgaccctcatggcccccagggg

SEQ ID NO: 4034261 - DNA, 22 bp, Homo sapiens
ccgacctgaggacatggcttct

SEQ ID NO: 4034262 - DNA, 18 bp, Homo sapiens
ccgacctggcctgtctgt

SEQ ID NO: 4034263 - DNA, 23 bp, Homo sapiens
ccgaccttccctccgccttctcc

SEQ ID NO: 4034264 - DNA, 23 bp, Homo sapiens
ccgacgccgtcccaccagcttca

SEQ ID NO: 4034265 - DNA, 16 bp, Homo sapiens
ccgactagacacacaa

SEQ ID NO: 4034266 - DNA, 20 bp, Homo sapiens
ccgactagacacacaaagca

SEQ ID NO: 4034267 - DNA, 13 bp, Homo sapiens
ccgactctggccc

SEQ ID NO: 4034268 - DNA, 18 bp, Homo sapiens
ccgactgactggaggagg

SEQ ID NO: 4034269 - DNA, 22 bp, Homo sapiens
ccgactgactggaggaggcctg

SEQ ID NO: 4034270 - DNA, 13 bp, Homo sapiens
ccgagacagtcca

SEQ ID NO: 4034271 - DNA, 19 bp, Homo sapiens
ccgagatccccagggcagc

SEQ ID NO: 4034272 - DNA, 20 bp, Homo sapiens
ccgagcaatggcgcctgctc

SEQ ID NO: 4034273 - DNA, 19 bp, Homo sapiens
ccgagccgggcctggggct

SEQ ID NO: 4034274 - DNA, 12 bp, Homo sapiens
ccgagcgctggt

SEQ ID NO: 4034275 - DNA, 19 bp, Homo sapiens
ccgagcgttcccagcaggg

SEQ ID NO: 4034276 - DNA, 17 bp, Homo sapiens
cctgctcattatgccac

SEQ ID NO: 4034277 - DNA, 15 bp, Homo sapiens
cctgctccaccagca

SEQ ID NO: 4034278 - DNA, 12 bp, Homo sapiens
cctgctccagaa

SEQ ID NO: 4034279 - DNA, 13 bp, Homo sapiens
cctgctccagaag

SEQ ID NO: 4034280 - DNA, 22 bp, Homo sapiens
cctgctccagaagatgccagct

SEQ ID NO: 4034281 - DNA, 16 bp, Homo sapiens
cctgctccagacctga

SEQ ID NO: 4034282 - DNA, 14 bp, Homo sapiens
cctgctcccagcag

SEQ ID NO: 4034283 - DNA, 16 bp, Homo sapiens
cctgctcccagcagcc

SEQ ID NO: 4034284 - DNA, 23 bp, Homo sapiens
cctgctcccagcagccctaagga

SEQ ID NO: 4034285 - DNA, 13 bp, Homo sapiens
cctgctcccagcc

SEQ ID NO: 4034286 - DNA, 15 bp, Homo sapiens
cctgctcccagcctg

SEQ ID NO: 4034287 - DNA, 17 bp, Homo sapiens
cctgctcccagcctgct

SEQ ID NO: 4034288 - DNA, 20 bp, Homo sapiens
cctgctcccattcctccctc

SEQ ID NO: 4034289 - DNA, 15 bp, Homo sapiens
cctgctccctccaga

SEQ ID NO: 4034290 - DNA, 20 bp, Homo sapiens
cctgctccctccagaatgga

SEQ ID NO: 4034291 - DNA, 20 bp, Homo sapiens
cctgctccgctgctccttgg

SEQ ID NO: 4034292 - DNA, 13 bp, Homo sapiens
cctgctcctgcag

SEQ ID NO: 4034293 - DNA, 19 bp, Homo sapiens
cctgctctacccatgagcc

SEQ ID NO: 4034294 - DNA, 13 bp, Homo sapiens
cctgctctgtccc

SEQ ID NO: 4034295 - DNA, 24 bp, Homo sapiens
cctgctctttctacatgactgggc

SEQ ID NO: 4034296 - DNA, 13 bp, Homo sapiens
cctgctgagagcc

SEQ ID NO: 4034297 - DNA, 11 bp, Homo sapiens
cctgctgcacc

SEQ ID NO: 4034298 - DNA, 13 bp, Homo sapiens
cctgctgccagtg

SEQ ID NO: 4034299 - DNA, 14 bp, Homo sapiens
cctgctgccagtgc

SEQ ID NO: 4034300 - DNA, 17 bp, Homo sapiens
cctgctgccagtgcagc

SEQ ID NO: 4034301 - DNA, 22 bp, Homo sapiens
cctgctgccagtgcagccactg

SEQ ID NO: 4034302 - DNA, 13 bp, Homo sapiens
cctgctgccccag

SEQ ID NO: 4034303 - DNA, 17 bp, Homo sapiens
cctgctgccccagctga

SEQ ID NO: 4034304 - DNA, 14 bp, Homo sapiens
cctgctgcctgctg

SEQ ID NO: 4034305 - DNA, 16 bp, Homo sapiens
cctgctgcctgctgag

SEQ ID NO: 4034306 - DNA, 18 bp, Homo sapiens
cctgctgcggaggagctg

SEQ ID NO: 4034307 - DNA, 12 bp, Homo sapiens
cctgctggaggc

SEQ ID NO: 4034308 - DNA, 17 bp, Homo sapiens
cctgctggaggcctcag

SEQ ID NO: 4034309 - DNA, 9 bp, Homo sapiens
cctgctggc

SEQ ID NO: 4034310 - DNA, 19 bp, Homo sapiens
cctgctggcacccaccgtg

SEQ ID NO: 4034311 - DNA, 13 bp, Homo sapiens
cctgctggctctt

SEQ ID NO: 4034312 - DNA, 19 bp, Homo sapiens
cctgctggctcttctgccc

SEQ ID NO: 4034313 - DNA, 19 bp, Homo sapiens
cctgctgggctccccccag

SEQ ID NO: 4034314 - DNA, 23 bp, Homo sapiens
cctgctgggctccccccagtggg

SEQ ID NO: 4034315 - DNA, 20 bp, Homo sapiens
cctgctggtcacagcctcct

SEQ ID NO: 4034316 - DNA, 15 bp, Homo sapiens
cctgctgtcattgct

SEQ ID NO: 4034317 - DNA, 16 bp, Homo sapiens
cctgctgtcttcccca

SEQ ID NO: 4034318 - DNA, 18 bp, Homo sapiens
cctgctgtcttccccacc

SEQ ID NO: 4034319 - DNA, 21 bp, Homo sapiens
cctgcttccaggaaactccac

SEQ ID NO: 4034320 - DNA, 12 bp, Homo sapiens
cctgcttctctg

SEQ ID NO: 4034321 - DNA, 14 bp, Homo sapiens
cctgcttctctgcc

SEQ ID NO: 4034322 - DNA, 17 bp, Homo sapiens
cctgcttgcaggaggcc

SEQ ID NO: 4034323 - DNA, 21 bp, Homo sapiens
cctgctttgcaaacatcaacc

SEQ ID NO: 4034324 - DNA, 12 bp, Homo sapiens
cctgctttgcat

SEQ ID NO: 4034325 - DNA, 17 bp, Homo sapiens
cctgctttggctgaggg

SEQ ID NO: 4034326 - DNA, 20 bp, Homo sapiens
cctgctttggctgaggggct

SEQ ID NO: 4034327 - DNA, 18 bp, Homo sapiens
cctgctttgggctgccct

SEQ ID NO: 4034328 - DNA, 19 bp, Homo sapiens
cctgctttgggctgccctg

SEQ ID NO: 4034329 - DNA, 21 bp, Homo sapiens
cctgctttgggctgccctggt

SEQ ID NO: 4034330 - DNA, 21 bp, Homo sapiens
cctgcttttctgtcctgggca

SEQ ID NO: 4034331 - DNA, 15 bp, Homo sapiens
cctggaaacctgtct

SEQ ID NO: 4034332 - DNA, 24 bp, Homo sapiens
cctggaacatcctttgcagggcag

SEQ ID NO: 4034333 - DNA, 13 bp, Homo sapiens
cctggaaccaatc

SEQ ID NO: 4034334 - DNA, 15 bp, Homo sapiens
cctggaaccttgctg

SEQ ID NO: 4034335 - DNA, 17 bp, Homo sapiens
cctggaaccttgctgtc

SEQ ID NO: 4034336 - DNA, 14 bp, Homo sapiens
cctggaagagccca

SEQ ID NO: 4034337 - DNA, 15 bp, Homo sapiens
cctggaagagcccag

SEQ ID NO: 4034338 - DNA, 20 bp, Homo sapiens
cctggacacccctgctctac

SEQ ID NO: 4034339 - DNA, 20 bp, Homo sapiens
cctggacatttgccttgctg

SEQ ID NO: 4034340 - DNA, 23 bp, Homo sapiens
cctggacctgccctgggccacac

SEQ ID NO: 4034341 - DNA, 14 bp, Homo sapiens
cctggacctgcctc

SEQ ID NO: 4034342 - DNA, 15 bp, Homo sapiens
cctggacctgggaac

SEQ ID NO: 4034343 - DNA, 23 bp, Homo sapiens
cctggactctgccccacgctgtg

SEQ ID NO: 4034344 - DNA, 13 bp, Homo sapiens
cctggactgggag

SEQ ID NO: 4034345 - DNA, 12 bp, Homo sapiens
cctggagaacta

SEQ ID NO: 4034346 - DNA, 13 bp, Homo sapiens
cctggagaactag

SEQ ID NO: 4034347 - DNA, 11 bp, Homo sapiens
cctggagaagc

SEQ ID NO: 4034348 - DNA, 17 bp, Homo sapiens
cctggagaagctgatgc

SEQ ID NO: 4034349 - DNA, 15 bp, Homo sapiens
cctggagagggtctc

SEQ ID NO: 4034350 - DNA, 12 bp, Homo sapiens
cctggagcagag

SEQ ID NO: 4034351 - DNA, 23 bp, Homo sapiens
cctggagcagaggaggggaaagt

SEQ ID NO: 4034352 - DNA, 22 bp, Homo sapiens
cctggagcgtttctagcaagtg

SEQ ID NO: 4034353 - DNA, 18 bp, Homo sapiens
cctggaggaattcagctc

SEQ ID NO: 4034354 - DNA, 22 bp, Homo sapiens
cctggaggcactgaagtgctta

SEQ ID NO: 4034355 - DNA, 14 bp, Homo sapiens
cctggaggcccagt

SEQ ID NO: 4034356 - DNA, 22 bp, Homo sapiens
cctggagggacttttaatcagt

SEQ ID NO: 4034357 - DNA, 16 bp, Homo sapiens
cctggagtgctgtgct

SEQ ID NO: 4034358 - DNA, 17 bp, Homo sapiens
cctggagtgctgtgctg

SEQ ID NO: 4034359 - DNA, 18 bp, Homo sapiens
cctggagtgctgtgctgt

SEQ ID NO: 4034360 - DNA, 21 bp, Homo sapiens
cctggatcacgacgctgcaga

SEQ ID NO: 4034361 - DNA, 15 bp, Homo sapiens
cctggatccagcact

SEQ ID NO: 4034362 - DNA, 17 bp, Homo sapiens
cctggatccagcactgg

SEQ ID NO: 4034363 - DNA, 20 bp, Homo sapiens
cctggatctatccctgcggc

SEQ ID NO: 4034364 - DNA, 13 bp, Homo sapiens
cctggatgccagc

SEQ ID NO: 4034365 - DNA, 14 bp, Homo sapiens
cctggatgccagct

SEQ ID NO: 4034366 - DNA, 19 bp, Homo sapiens
cctggatgccagctgtgtc

SEQ ID NO: 4034367 - DNA, 17 bp, Homo sapiens
cctggatgttgtgtgta

SEQ ID NO: 4034368 - DNA, 18 bp, Homo sapiens
cctggattggttggcaaa

SEQ ID NO: 4034369 - DNA, 21 bp, Homo sapiens
cctggcaatagtgtgttctga

SEQ ID NO: 4034370 - DNA, 17 bp, Homo sapiens
cctggcacagggcagtg

SEQ ID NO: 4034371 - DNA, 18 bp, Homo sapiens
cctggcacggtggctcag

SEQ ID NO: 4034372 - DNA, 12 bp, Homo sapiens
cctggcagccgt

SEQ ID NO: 4034373 - DNA, 18 bp, Homo sapiens
cctggcagccgtgccttc

SEQ ID NO: 4034374 - DNA, 13 bp, Homo sapiens
cctggcagctctg

SEQ ID NO: 4034375 - DNA, 14 bp, Homo sapiens
cctggcagctctgg

SEQ ID NO: 4034376 - DNA, 15 bp, Homo sapiens
cctggcagctctgga

SEQ ID NO: 4034377 - DNA, 13 bp, Homo sapiens
cctggcaggcagg

SEQ ID NO: 4034378 - DNA, 22 bp, Homo sapiens
cctggcagggtcatcctgtgct

SEQ ID NO: 4034379 - DNA, 23 bp, Homo sapiens
cctggcagggtcatcctgtgctc

SEQ ID NO: 4034380 - DNA, 20 bp, Homo sapiens
cctgcactaaagccagcctg

SEQ ID NO: 4034381 - DNA, 21 bp, Homo sapiens
cctgcactaaagccagcctga

SEQ ID NO: 4034382 - DNA, 14 bp, Homo sapiens
cctgcactggggag

SEQ ID NO: 4034383 - DNA, 18 bp, Homo sapiens
cctgcactttcctccacc

SEQ ID NO: 4034384 - DNA, 16 bp, Homo sapiens
cctgcagaatttgggt

SEQ ID NO: 4034385 - DNA, 21 bp, Homo sapiens
cctgcagacctcaagccatca

SEQ ID NO: 4034386 - DNA, 12 bp, Homo sapiens
cctgcagcaggc

SEQ ID NO: 4034387 - DNA, 16 bp, Homo sapiens
cctgcagcatggtccc

SEQ ID NO: 4034388 - DNA, 18 bp, Homo sapiens
cctgcagcatggtccctg

SEQ ID NO: 4034389 - DNA, 13 bp, Homo sapiens
cctgcagccagct

SEQ ID NO: 4034390 - DNA, 18 bp, Homo sapiens
cctgcagcccaaaaccca

SEQ ID NO: 4034391 - DNA, 12 bp, Homo sapiens
cctgcaggcaga

SEQ ID NO: 4034392 - DNA, 15 bp, Homo sapiens
cctgcaggctgagcc

SEQ ID NO: 4034393 - DNA, 14 bp, Homo sapiens
cctgcatctggggc

SEQ ID NO: 4034394 - DNA, 15 bp, Homo sapiens
cctgcatctggggcc

SEQ ID NO: 4034395 - DNA, 14 bp, Homo sapiens
cctgcattcatgta

SEQ ID NO: 4034396 - DNA, 14 bp, Homo sapiens
cctgcatttctgag

SEQ ID NO: 4034397 - DNA, 15 bp, Homo sapiens
cctgccacagccaga

SEQ ID NO: 4034398 - DNA, 18 bp, Homo sapiens
cctgccacatacaggtgc

SEQ ID NO: 4034399 - DNA, 20 bp, Homo sapiens
cctgccacatacaggtgctc

SEQ ID NO: 4034400 - DNA, 16 bp, Homo sapiens
cctgccacctccctga

SEQ ID NO: 4034401 - DNA, 18 bp, Homo sapiens
cctgccagaggggaagga

SEQ ID NO: 4034402 - DNA, 12 bp, Homo sapiens
cctgccagcccc

SEQ ID NO: 4034403 - DNA, 15 bp, Homo sapiens
cctgccagccccaca

SEQ ID NO: 4034404 - DNA, 18 bp, Homo sapiens
cctgccagccccacacag

SEQ ID NO: 4034405 - DNA, 16 bp, Homo sapiens
cctgccagctgcactg

SEQ ID NO: 4034406 - DNA, 17 bp, Homo sapiens
cctgccagctgcactga

SEQ ID NO: 4034407 - DNA, 13 bp, Homo sapiens
cctgccaggcaca

SEQ ID NO: 4034408 - DNA, 15 bp, Homo sapiens
cctgccatgccagga

SEQ ID NO: 4034409 - DNA, 14 bp, Homo sapiens
cctgccatttaaaa

SEQ ID NO: 4034410 - DNA, 17 bp, Homo sapiens
cctgcccaagcccaggc

SEQ ID NO: 4034411 - DNA, 23 bp, Homo sapiens
cctgcccaatgagactctagggt

SEQ ID NO: 4034412 - DNA, 22 bp, Homo sapiens
cctgcccagatcagccagaagc

SEQ ID NO: 4034413 - DNA, 20 bp, Homo sapiens
cctgcccagatgccctttgg

SEQ ID NO: 4034414 - DNA, 12 bp, Homo sapiens
cctgcccagcct

SEQ ID NO: 4034415 - DNA, 15 bp, Homo sapiens
cctgcccagcctggg

SEQ ID NO: 4034416 - DNA, 11 bp, Homo sapiens
cctgcccagtg

SEQ ID NO: 4034417 - DNA, 13 bp, Homo sapiens
cctgcccagtgtt

SEQ ID NO: 4034418 - DNA, 16 bp, Homo sapiens
cctgcccatgtgtccc

SEQ ID NO: 4034419 - DNA, 22 bp, Homo sapiens
cctgcccatgtgtcccctcact

SEQ ID NO: 4034420 - DNA, 11 bp, Homo sapiens
cctgccccaca

SEQ ID NO: 4034421 - DNA, 13 bp, Homo sapiens
cctgccccacact

SEQ ID NO: 4034422 - DNA, 14 bp, Homo sapiens
cctgccccacactc

SEQ ID NO: 4034423 - DNA, 16 bp, Homo sapiens
cctgccccaccccacc

SEQ ID NO: 4034424 - DNA, 20 bp, Homo sapiens
cctgccccaccccacctcca

SEQ ID NO: 4034425 - DNA, 16 bp, Homo sapiens
cctgccccaggcctga

SEQ ID NO: 4034426 - DNA, 13 bp, Homo sapiens
cctgcccccagcc

SEQ ID NO: 4034427 - DNA, 22 bp, Homo sapiens
cctgccccccagcctctggcat

SEQ ID NO: 4034428 - DNA, 13 bp, Homo sapiens
cctgccccgcccc

SEQ ID NO: 4034429 - DNA, 18 bp, Homo sapiens
cctgccccgcccccagtc

SEQ ID NO: 4034430 - DNA, 15 bp, Homo sapiens
cctgccccggaggaa

SEQ ID NO: 4034431 - DNA, 12 bp, Homo sapiens
cctgcccctaga

SEQ ID NO: 4034432 - DNA, 16 bp, Homo sapiens
cctgcccctctcccgc

SEQ ID NO: 4034433 - DNA, 16 bp, Homo sapiens
cctgcccgctgcaatg

SEQ ID NO: 4034434 - DNA, 21 bp, Homo sapiens
cctgccctcatggcccctctg

SEQ ID NO: 4034435 - DNA, 11 bp, Homo sapiens
cctgccctgca

SEQ ID NO: 4034436 - DNA, 15 bp, Homo sapiens
cctgccctgccccca

SEQ ID NO: 4034437 - DNA, 21 bp, Homo sapiens
cctgccctgtcaggaggcaga

SEQ ID NO: 4034438 - DNA, 12 bp, Homo sapiens
cctgccctgtcc

SEQ ID NO: 4034439 - DNA, 17 bp, Homo sapiens
cctgccctgtccctgtc

SEQ ID NO: 4034440 - DNA, 21 bp, Homo sapiens
cctgccctgtccctgtccccc

SEQ ID NO: 4034441 - DNA, 21 bp, Homo sapiens
cctgccctgttgtgtatagat

SEQ ID NO: 4034442 - DNA, 17 bp, Homo sapiens
cctgcccttccctctgg

SEQ ID NO: 4034443 - DNA, 19 bp, Homo sapiens
cctgcccttccctctgggc

SEQ ID NO: 4034444 - DNA, 19 bp, Homo sapiens
cctgccctttgtcctcctg

SEQ ID NO: 4034445 - DNA, 21 bp, Homo sapiens
cctgccctttgtcctcctgct

SEQ ID NO: 4034446 - DNA, 21 bp, Homo sapiens
cctgccgcagacgggcacaga

SEQ ID NO: 4034447 - DNA, 23 bp, Homo sapiens
cctgccgcagacgggcacagaca

SEQ ID NO: 4034448 - DNA, 16 bp, Homo sapiens
cctgccgggctgaggg

SEQ ID NO: 4034449 - DNA, 20 bp, Homo sapiens
cctgccgggctgagggcctg

SEQ ID NO: 4034450 - DNA, 12 bp, Homo sapiens
cctgcctcagcc

SEQ ID NO: 4034451 - DNA, 14 bp, Homo sapiens
cctgcctcagcctt

SEQ ID NO: 4034452 - DNA, 16 bp, Homo sapiens
cctgcctcagccttcc

SEQ ID NO: 4034453 - DNA, 20 bp, Homo sapiens
cctgcctcccacttcactgc

SEQ ID NO: 4034454 - DNA, 12 bp, Homo sapiens
cctgcctcctgc

SEQ ID NO: 4034455 - DNA, 13 bp, Homo sapiens
cctgcctcctggg

SEQ ID NO: 4034456 - DNA, 16 bp, Homo sapiens
cctgcctgcagcaggc

SEQ ID NO: 4034457 - DNA, 16 bp, Homo sapiens
cctgcctgccctgtca

SEQ ID NO: 4034458 - DNA, 18 bp, Homo sapiens
cctgcctgccctgtcagg

SEQ ID NO: 4034459 - DNA, 22 bp, Homo sapiens
cctgcctggcacttactggtcc

SEQ ID NO: 4034460 - DNA, 12 bp, Homo sapiens
cctgcctggcca

SEQ ID NO: 4034461 - DNA, 18 bp, Homo sapiens
cctgcctggccaggcaga

SEQ ID NO: 4034462 - DNA, 22 bp, Homo sapiens
cctgcctggccaggcagatctg

SEQ ID NO: 4034463 - DNA, 13 bp, Homo sapiens
cctgcctgtctgc

SEQ ID NO: 4034464 - DNA, 21 bp, Homo sapiens
cctgccttgcccactcctgct

SEQ ID NO: 4034465 - DNA, 23 bp, Homo sapiens
cctgccttggcctcccaaagtgc

SEQ ID NO: 4034466 - DNA, 18 bp, Homo sapiens
cctgccttgggccttgct

SEQ ID NO: 4034467 - DNA, 11 bp, Homo sapiens
cctgcctttta

SEQ ID NO: 4034468 - DNA, 20 bp, Homo sapiens
cctgcgagacgcacacagct

SEQ ID NO: 4034469 - DNA, 23 bp, Homo sapiens
cctgcgagacgcacacagctgag

SEQ ID NO: 4034470 - DNA, 17 bp, Homo sapiens
cctgcgccctgtgcccg

SEQ ID NO: 4034471 - DNA, 16 bp, Homo sapiens
cctgcgcctgctgcct

SEQ ID NO: 4034472 - DNA, 18 bp, Homo sapiens
cctgcgcctgctgcctgc

SEQ ID NO: 4034473 - DNA, 21 bp, Homo sapiens
cctgcgcgggaccatctggaa

SEQ ID NO: 4034474 - DNA, 23 bp, Homo sapiens
cctgcggtagatgggagggaggc

SEQ ID NO: 4034475 - DNA, 13 bp, Homo sapiens
cctgcggtcaggc

SEQ ID NO: 4034476 - DNA, 20 bp, Homo sapiens
cctgcggtcaggctgggcag

SEQ ID NO: 4034477 - DNA, 13 bp, Homo sapiens
cctgcgtcctcct

SEQ ID NO: 4034478 - DNA, 17 bp, Homo sapiens
cctgcgtcctcctcacc

SEQ ID NO: 4034479 - DNA, 19 bp, Homo sapiens
cctgcgtcctcctcacctc

SEQ ID NO: 4034480 - DNA, 20 bp, Homo sapiens
cctgcgtcctcctcacctca

SEQ ID NO: 4034481 - DNA, 12 bp, Homo sapiens
cctgcgtggggg

SEQ ID NO: 4034482 - DNA, 17 bp, Homo sapiens
cctgctcaactctaccc

SEQ ID NO: 4034483 - DNA, 14 bp, Homo sapiens
cctgctcaccacct

SEQ ID NO: 4034484 - DNA, 13 bp, Homo sapiens
cctgaactgagga

SEQ ID NO: 4034485 - DNA, 20 bp, Homo sapiens
cctgaaggggccatgatggc

SEQ ID NO: 4034486 - DNA, 17 bp, Homo sapiens
cctgaatcatgagcctg

SEQ ID NO: 4034487 - DNA, 19 bp, Homo sapiens
cctgaatcatgagcctgct

SEQ ID NO: 4034488 - DNA, 12 bp, Homo sapiens
cctgaatcattc

SEQ ID NO: 4034489 - DNA, 19 bp, Homo sapiens
cctgaatccaaaagaaaaa

SEQ ID NO: 4034490 - DNA, 22 bp, Homo sapiens
cctgaatctgtgcctgcactga

SEQ ID NO: 4034491 - DNA, 13 bp, Homo sapiens
cctgaatgaaata

SEQ ID NO: 4034492 - DNA, 22 bp, Homo sapiens
cctgaatggttccatgcctgag

SEQ ID NO: 4034493 - DNA, 23 bp, Homo sapiens
cctgaatggttccatgcctgagg

SEQ ID NO: 4034494 - DNA, 18 bp, Homo sapiens
cctgacaaccactggtct

SEQ ID NO: 4034495 - DNA, 14 bp, Homo sapiens
cctgacaagcactg

SEQ ID NO: 4034496 - DNA, 20 bp, Homo sapiens
cctgacaagcactgctaggc

SEQ ID NO: 4034497 - DNA, 13 bp, Homo sapiens
cctgacaccccct

SEQ ID NO: 4034498 - DNA, 18 bp, Homo sapiens
cctgacaccccctccccg

SEQ ID NO: 4034499 - DNA, 18 bp, Homo sapiens
cctgacactgagccccac

SEQ ID NO: 4034500 - DNA, 20 bp, Homo sapiens
cctgacagcccctccctcct

SEQ ID NO: 4034501 - DNA, 14 bp, Homo sapiens
cctgacatcacagc

SEQ ID NO: 4034502 - DNA, 18 bp, Homo sapiens
cctgacatcacagcagcc

SEQ ID NO: 4034503 - DNA, 20 bp, Homo sapiens
cctgacatcacagcagcctc

SEQ ID NO: 4034504 - DNA, 20 bp, Homo sapiens
cctgaccacgctttctagct

SEQ ID NO: 4034505 - DNA, 22 bp, Homo sapiens
cctgacccccttcctgtcccca

SEQ ID NO: 4034506 - DNA, 19 bp, Homo sapiens
cctgaccccttgctccctt

SEQ ID NO: 4034507 - DNA, 22 bp, Homo sapiens
cctgacccgtctaatatataaa

SEQ ID NO: 4034508 - DNA, 23 bp, Homo sapiens
cctgacctaaattagataaattg

SEQ ID NO: 4034509 - DNA, 15 bp, Homo sapiens
cctgacctcttgctg

SEQ ID NO: 4034510 - DNA, 20 bp, Homo sapiens
cctgacctcttgctgtctct

SEQ ID NO: 4034511 - DNA, 19 bp, Homo sapiens
cctgacctgtgagcccagc

SEQ ID NO: 4034512 - DNA, 17 bp, Homo sapiens
cctgaccttccttcctg

SEQ ID NO: 4034513 - DNA, 20 bp, Homo sapiens
cctgacggcgcccccagtgt

SEQ ID NO: 4034514 - DNA, 21 bp, Homo sapiens
cctgacggcgcccccagtgtg

SEQ ID NO: 4034515 - DNA, 20 bp, Homo sapiens
cctgacgtctgaagcttgac

SEQ ID NO: 4034516 - DNA, 10 bp, Homo sapiens
cctgactcaa

SEQ ID NO: 4034517 - DNA, 16 bp, Homo sapiens
cctgactcatcatttg

SEQ ID NO: 4034518 - DNA, 16 bp, Homo sapiens
cctgactccctgtggg

SEQ ID NO: 4034519 - DNA, 17 bp, Homo sapiens
cctgactccctgtgggg

SEQ ID NO: 4034520 - DNA, 13 bp, Homo sapiens
cctgactcctcta

SEQ ID NO: 4034521 - DNA, 16 bp, Homo sapiens
cctgactcctctggct

SEQ ID NO: 4034522 - DNA, 18 bp, Homo sapiens
cctgactcctctggcttt

SEQ ID NO: 4034523 - DNA, 15 bp, Homo sapiens
cctgactgggctggg

SEQ ID NO: 4034524 - DNA, 23 bp, Homo sapiens
cctgactggtgctataggctgga

SEQ ID NO: 4034525 - DNA, 15 bp, Homo sapiens
cctgagaagctgctc

SEQ ID NO: 4034526 - DNA, 17 bp, Homo sapiens
cctgagaagctgctcca

SEQ ID NO: 4034527 - DNA, 22 bp, Homo sapiens
cctgagaagtgtctaaaaacac

SEQ ID NO: 4034528 - DNA, 14 bp, Homo sapiens
cctgagaggcaggc

SEQ ID NO: 4034529 - DNA, 15 bp, Homo sapiens
cctgagaggcaggca

SEQ ID NO: 4034530 - DNA, 15 bp, Homo sapiens
cctgagagtcagctc

SEQ ID NO: 4034531 - DNA, 20 bp, Homo sapiens
cctgagagtcagctctctgc

SEQ ID NO: 4034532 - DNA, 22 bp, Homo sapiens
cctgagagtcagctctctgccc

SEQ ID NO: 4034533 - DNA, 15 bp, Homo sapiens
cctgagatcccctga

SEQ ID NO: 4034534 - DNA, 17 bp, Homo sapiens
cctgagatcccctgagc

SEQ ID NO: 4034535 - DNA, 17 bp, Homo sapiens
cctgagattcagatgtc

SEQ ID NO: 4034536 - DNA, 13 bp, Homo sapiens
cctgagcaactct

SEQ ID NO: 4034537 - DNA, 15 bp, Homo sapiens
cctgagcctgtgggt

SEQ ID NO: 4034538 - DNA, 22 bp, Homo sapiens
cctgagctattttcctctggcc

SEQ ID NO: 4034539 - DNA, 17 bp, Homo sapiens
cctgagctgcagctgag

SEQ ID NO: 4034540 - DNA, 21 bp, Homo sapiens
cctgagctgcagctgagcctg

SEQ ID NO: 4034541 - DNA, 15 bp, Homo sapiens
cctgagctggccagg

SEQ ID NO: 4034542 - DNA, 17 bp, Homo sapiens
cctgagctggccaggcc

SEQ ID NO: 4034543 - DNA, 19 bp, Homo sapiens
cctgagctggccaggccct

SEQ ID NO: 4034544 - DNA, 14 bp, Homo sapiens
cctgagctggggaa

SEQ ID NO: 4034545 - DNA, 22 bp, Homo sapiens
cctgaggccctgggctgggtgc

SEQ ID NO: 4034546 - DNA, 15 bp, Homo sapiens
cctgaggcggaggct

SEQ ID NO: 4034547 - DNA, 22 bp, Homo sapiens
cctgaggctttggatttgacat

SEQ ID NO: 4034548 - DNA, 12 bp, Homo sapiens
cctgagggcagt

SEQ ID NO: 4034549 - DNA, 15 bp, Homo sapiens
cctgaggggcagcct

SEQ ID NO: 4034550 - DNA, 19 bp, Homo sapiens
cctgaggggcatctgcccc

SEQ ID NO: 4034551 - DNA, 13 bp, Homo sapiens
cctgagggtcccc

SEQ ID NO: 4034552 - DNA, 15 bp, Homo sapiens
cctgagggtggagac

SEQ ID NO: 4034553 - DNA, 16 bp, Homo sapiens
cctgagggtggagact

SEQ ID NO: 4034554 - DNA, 20 bp, Homo sapiens
cctgaggtcagggagtgctg

SEQ ID NO: 4034555 - DNA, 22 bp, Homo sapiens
cctgaggtcagggagtgctggc

SEQ ID NO: 4034556 - DNA, 21 bp, Homo sapiens
cctgaggttaaacggtgccca

SEQ ID NO: 4034557 - DNA, 22 bp, Homo sapiens
cctgatcccttccacctgctct

SEQ ID NO: 4034558 - DNA, 20 bp, Homo sapiens
cctgatcctggaggcccagt

SEQ ID NO: 4034559 - DNA, 14 bp, Homo sapiens
cctgatctgtgata

SEQ ID NO: 4034560 - DNA, 19 bp, Homo sapiens
cctgatgacacccaccctg

SEQ ID NO: 4034561 - DNA, 16 bp, Homo sapiens
cctgatgacagagcga

SEQ ID NO: 4034562 - DNA, 14 bp, Homo sapiens
cctgatgctccctc

SEQ ID NO: 4034563 - DNA, 20 bp, Homo sapiens
cctgatgctccctcccctgc

SEQ ID NO: 4034564 - DNA, 13 bp, Homo sapiens
cctgatgctgaca

SEQ ID NO: 4034565 - DNA, 20 bp, Homo sapiens
cctgatggcagaactcccac

SEQ ID NO: 4034566 - DNA, 19 bp, Homo sapiens
cctgatgtgtcctcaggga

SEQ ID NO: 4034567 - DNA, 19 bp, Homo sapiens
cctgatttaggagaagcca

SEQ ID NO: 4034568 - DNA, 20 bp, Homo sapiens
cctgatttaggagaagccag

SEQ ID NO: 4034569 - DNA, 21 bp, Homo sapiens
cctgatttaggagaagccagg

SEQ ID NO: 4034570 - DNA, 18 bp, Homo sapiens
cctgcaaacagaacaggg

SEQ ID NO: 4034571 - DNA, 20 bp, Homo sapiens
cctgcaaacagaacagggtc

SEQ ID NO: 4034572 - DNA, 15 bp, Homo sapiens
cctgcaaactcactg

SEQ ID NO: 4034573 - DNA, 17 bp, Homo sapiens
cctgcaaactcactgct

SEQ ID NO: 4034574 - DNA, 22 bp, Homo sapiens
cctgcaaactcactgctcaaga

SEQ ID NO: 4034575 - DNA, 18 bp, Homo sapiens
cctgcaactcaaggactt

SEQ ID NO: 4034576 - DNA, 18 bp, Homo sapiens
cctgcaacttccgctgag

SEQ ID NO: 4034577 - DNA, 19 bp, Homo sapiens
cctgcaacttccgctgagg

SEQ ID NO: 4034578 - DNA, 20 bp, Homo sapiens
cctgcaacttccgctgaggg

SEQ ID NO: 4034579 - DNA, 16 bp, Homo sapiens
cctgcaatatttgaat

SEQ ID NO: 4034580 - DNA, 19 bp, Homo sapiens
cctgcaatttcatatgctg

SEQ ID NO: 4034581 - DNA, 20 bp, Homo sapiens
cctgcacactccatctcctg

SEQ ID NO: 4034582 - DNA, 19 bp, Homo sapiens
cctgcacagatatttccat

SEQ ID NO: 4034583 - DNA, 13 bp, Homo sapiens
cctgcacctttcg

SEQ ID NO: 4034584 - DNA, 15 bp, Homo sapiens
cctgcacctttcggc

SEQ ID NO: 4034585 - DNA, 19 bp, Homo sapiens
cctgcacgtcatgggaggg

SEQ ID NO: 4034586 - DNA, 19 bp, Homo sapiens
cctgcactaaagccagcct

SEQ ID NO: 4034587 - DNA, 22 bp, Homo sapiens
cctcagttcaacctggtggcac

SEQ ID NO: 4034588 - DNA, 15 bp, Homo sapiens
cctcagttcccttgg

SEQ ID NO: 4034589 - DNA, 16 bp, Homo sapiens
cctcagttcccttggc

SEQ ID NO: 4034590 - DNA, 18 bp, Homo sapiens
cctcagttcccttggcct

SEQ ID NO: 4034591 - DNA, 22 bp, Homo sapiens
cctcagttcccttggcctcaga

SEQ ID NO: 4034592 - DNA, 15 bp, Homo sapiens
cctcagttccttcat

SEQ ID NO: 4034593 - DNA, 14 bp, Homo sapiens
cctcatactcctgg

SEQ ID NO: 4034594 - DNA, 17 bp, Homo sapiens
cctcatactcctgggct

SEQ ID NO: 4034595 - DNA, 22 bp, Homo sapiens
cctcatactcctgggctcaagc

SEQ ID NO: 4034596 - DNA, 13 bp, Homo sapiens
cctcatcaggatg

SEQ ID NO: 4034597 - DNA, 22 bp, Homo sapiens
cctcatccaccccatccctccc

SEQ ID NO: 4034598 - DNA, 20 bp, Homo sapiens
cctcatcccgtgttctcctt

SEQ ID NO: 4034599 - DNA, 13 bp, Homo sapiens
cctcatccctgac

SEQ ID NO: 4034600 - DNA, 23 bp, Homo sapiens
cctcatctccaaggcagggacca

SEQ ID NO: 4034601 - DNA, 14 bp, Homo sapiens
cctcatctcccgag

SEQ ID NO: 4034602 - DNA, 13 bp, Homo sapiens
cctcatctgagag

SEQ ID NO: 4034603 - DNA, 19 bp, Homo sapiens
cctcatctgagaggctctc

SEQ ID NO: 4034604 - DNA, 21 bp, Homo sapiens
cctcatctgagaggctctccg

SEQ ID NO: 4034605 - DNA, 15 bp, Homo sapiens
cctcatgccaaccct

SEQ ID NO: 4034606 - DNA, 23 bp, Homo sapiens
cctcatgcccaccccctgccctg

SEQ ID NO: 4034607 - DNA, 21 bp, Homo sapiens
cctcatggcccccaggggcag

SEQ ID NO: 4034608 - DNA, 15 bp, Homo sapiens
cctcatggcccctct

SEQ ID NO: 4034609 - DNA, 15 bp, Homo sapiens
cctcatgggaagcat

SEQ ID NO: 4034610 - DNA, 19 bp, Homo sapiens
cctcatgggaagcatgtgg

SEQ ID NO: 4034611 - DNA, 13 bp, Homo sapiens
cctcatgggtcct

SEQ ID NO: 4034612 - DNA, 16 bp, Homo sapiens
cctcatgggtcctagc

SEQ ID NO: 4034613 - DNA, 14 bp, Homo sapiens
cctccaaacctcca

SEQ ID NO: 4034614 - DNA, 15 bp, Homo sapiens
cctccaaacctccag

SEQ ID NO: 4034615 - DNA, 17 bp, Homo sapiens
cctccaaacctccagcc

SEQ ID NO: 4034616 - DNA, 23 bp, Homo sapiens
cctccaacacaaggctccaagac

SEQ ID NO: 4034617 - DNA, 19 bp, Homo sapiens
cctccaacaccaagcacag

SEQ ID NO: 4034618 - DNA, 22 bp, Homo sapiens
cctccaatcccaccaaccctca

SEQ ID NO: 4034619 - DNA, 23 bp, Homo sapiens
cctccacaccagtggcctcgtgg

SEQ ID NO: 4034620 - DNA, 19 bp, Homo sapiens
cctccacatcccagcagcc

SEQ ID NO: 4034621 - DNA, 10 bp, Homo sapiens
cctccaccca

SEQ ID NO: 4034622 - DNA, 13 bp, Homo sapiens
cctccacccagcc

SEQ ID NO: 4034623 - DNA, 11 bp, Homo sapiens
cctccaccctc

SEQ ID NO: 4034624 - DNA, 12 bp, Homo sapiens
cctccaccctcc

SEQ ID NO: 4034625 - DNA, 13 bp, Homo sapiens
cctccacctcaag

SEQ ID NO: 4034626 - DNA, 15 bp, Homo sapiens
cctccacctcccacc

SEQ ID NO: 4034627 - DNA, 18 bp, Homo sapiens
cctccacctcccaccctg

SEQ ID NO: 4034628 - DNA, 13 bp, Homo sapiens
cctccaccttcca

SEQ ID NO: 4034629 - DNA, 16 bp, Homo sapiens
cctccactcccacctc

SEQ ID NO: 4034630 - DNA, 21 bp, Homo sapiens
cctccactcccacctcacccg

SEQ ID NO: 4034631 - DNA, 22 bp, Homo sapiens
cctccagaactcactggggcct

SEQ ID NO: 4034632 - DNA, 17 bp, Homo sapiens
cctccagaagcctctgg

SEQ ID NO: 4034633 - DNA, 15 bp, Homo sapiens
cctccagaccaccag

SEQ ID NO: 4034634 - DNA, 16 bp, Homo sapiens
cctccagaggtcctcc

SEQ ID NO: 4034635 - DNA, 15 bp, Homo sapiens
cctccagcccctgtc

SEQ ID NO: 4034636 - DNA, 23 bp, Homo sapiens
cctccagcctccctgtctccagc

SEQ ID NO: 4034637 - DNA, 21 bp, Homo sapiens
cctccagcctgcccaagccca

SEQ ID NO: 4034638 - DNA, 20 bp, Homo sapiens
cctccagcttcaggcaggcc

SEQ ID NO: 4034639 - DNA, 12 bp, Homo sapiens
cctccaggagct

SEQ ID NO: 4034640 - DNA, 18 bp, Homo sapiens
cctccaggagcttcttgt

SEQ ID NO: 4034641 - DNA, 19 bp, Homo sapiens
cctccaggagggaccaccc

SEQ ID NO: 4034642 - DNA, 22 bp, Homo sapiens
cctccaggagggaccaccctcc

SEQ ID NO: 4034643 - DNA, 13 bp, Homo sapiens
cctccaggcaaaa

SEQ ID NO: 4034644 - DNA, 19 bp, Homo sapiens
cctccaggcctgcctccca

SEQ ID NO: 4034645 - DNA, 14 bp, Homo sapiens
cctccagggcccag

SEQ ID NO: 4034646 - DNA, 17 bp, Homo sapiens
cctccagggtgtgtgct

SEQ ID NO: 4034647 - DNA, 14 bp, Homo sapiens
cctccatccatcct

SEQ ID NO: 4034648 - DNA, 24 bp, Homo sapiens
cctccatctcatgtatcatctgga

SEQ ID NO: 4034649 - DNA, 18 bp, Homo sapiens
cctccatgctcctcacct

SEQ ID NO: 4034650 - DNA, 22 bp, Homo sapiens
cctccatgctcctcacctgtct

SEQ ID NO: 4034651 - DNA, 17 bp, Homo sapiens
cctccattcatccttcc

SEQ ID NO: 4034652 - DNA, 23 bp, Homo sapiens
cctccattcatccttccatccat

SEQ ID NO: 4034653 - DNA, 21 bp, Homo sapiens
cctccattggctcccaagtca

SEQ ID NO: 4034654 - DNA, 20 bp, Homo sapiens
cctccattgggcacagtcca

SEQ ID NO: 4034655 - DNA, 20 bp, Homo sapiens
cctcccaaggtcctctcagt

SEQ ID NO: 4034656 - DNA, 20 bp, Homo sapiens
cctcccaatttcagactccc

SEQ ID NO: 4034657 - DNA, 16 bp, Homo sapiens
cctcccacacttgctg

SEQ ID NO: 4034658 - DNA, 21 bp, Homo sapiens
cctcccacacttgctggggct

SEQ ID NO: 4034659 - DNA, 13 bp, Homo sapiens
cctcccaccccct

SEQ ID NO: 4034660 - DNA, 20 bp, Homo sapiens
cctcccacccccttctctgc

SEQ ID NO: 4034661 - DNA, 16 bp, Homo sapiens
cctcccacctccgtgt

SEQ ID NO: 4034662 - DNA, 14 bp, Homo sapiens
cctcccaggcgccc

SEQ ID NO: 4034663 - DNA, 16 bp, Homo sapiens
cctcccagtgagactg

SEQ ID NO: 4034664 - DNA, 19 bp, Homo sapiens
cctcccagtgagactgccc

SEQ ID NO: 4034665 - DNA, 18 bp, Homo sapiens
cctcccatccttccctca

SEQ ID NO: 4034666 - DNA, 17 bp, Homo sapiens
cctcccatttctaaagc

SEQ ID NO: 4034667 - DNA, 22 bp, Homo sapiens
cctccccaaggccccctgcctg

SEQ ID NO: 4034668 - DNA, 14 bp, Homo sapiens
cctccccaggctgg

SEQ ID NO: 4034669 - DNA, 16 bp, Homo sapiens
cctccccatctgtcca

SEQ ID NO: 4034670 - DNA, 16 bp, Homo sapiens
cctccccatggagcca

SEQ ID NO: 4034671 - DNA, 21 bp, Homo sapiens
cctccccatttcccatctgca

SEQ ID NO: 4034672 - DNA, 16 bp, Homo sapiens
cctcccccccatgcac

SEQ ID NO: 4034673 - DNA, 12 bp, Homo sapiens
cctccccctgca

SEQ ID NO: 4034674 - DNA, 14 bp, Homo sapiens
cctccccctgcaac

SEQ ID NO: 4034675 - DNA, 15 bp, Homo sapiens
cctccccgctgggaa

SEQ ID NO: 4034676 - DNA, 16 bp, Homo sapiens
cctcccctcccagtcc

SEQ ID NO: 4034677 - DNA, 15 bp, Homo sapiens
cctcccctgccctgg

SEQ ID NO: 4034678 - DNA, 16 bp, Homo sapiens
cctcccctgccctggt

SEQ ID NO: 4034679 - DNA, 22 bp, Homo sapiens
cctcccggccctgcctgctggt

SEQ ID NO: 4034680 - DNA, 15 bp, Homo sapiens
cctccctacacacac

SEQ ID NO: 4034681 - DNA, 22 bp, Homo sapiens
cctccctcactgaaggacctga

SEQ ID NO: 4034682 - DNA, 15 bp, Homo sapiens
cctccctccacctca

SEQ ID NO: 4034683 - DNA, 14 bp, Homo sapiens
cctccctcccggca

SEQ ID NO: 4034684 - DNA, 19 bp, Homo sapiens
cctccctcccggcatggga

SEQ ID NO: 4034685 - DNA, 20 bp, Homo sapiens
cctccctctctcttctgctc

SEQ ID NO: 4034686 - DNA, 22 bp, Homo sapiens
cctccctctctcttctgctcca

SEQ ID NO: 4034687 - DNA, 13 bp, Homo sapiens
cctccctgccagt

SEQ ID NO: 4034688 - DNA, 13 bp, Homo sapiens
cctccctgcccct

SEQ ID NO: 4034689 - DNA, 14 bp, Homo sapiens
cctccctgctgtca

SEQ ID NO: 4034690 - DNA, 19 bp, Homo sapiens
cctctccccattcggtgtg

SEQ ID NO: 4034691 - DNA, 18 bp, Homo sapiens
cctctccccgcagtgttt

SEQ ID NO: 4034692 - DNA, 14 bp, Homo sapiens
cctctcccctccag

SEQ ID NO: 4034693 - DNA, 11 bp, Homo sapiens
cctctccctca

SEQ ID NO: 4034694 - DNA, 10 bp, Homo sapiens
cctctccctg

SEQ ID NO: 4034695 - DNA, 14 bp, Homo sapiens
cctctccgtttatt

SEQ ID NO: 4034696 - DNA, 16 bp, Homo sapiens
cctctcctgccctgtg

SEQ ID NO: 4034697 - DNA, 17 bp, Homo sapiens
cctctcctgccctgtga

SEQ ID NO: 4034698 - DNA, 18 bp, Homo sapiens
cctctcctgccctgtgat

SEQ ID NO: 4034699 - DNA, 13 bp, Homo sapiens
cctctcctggagg

SEQ ID NO: 4034700 - DNA, 15 bp, Homo sapiens
cctctcctggaggat

SEQ ID NO: 4034701 - DNA, 12 bp, Homo sapiens
cctctcctgggg

SEQ ID NO: 4034702 - DNA, 17 bp, Homo sapiens
cctctccttttgaggct

SEQ ID NO: 4034703 - DNA, 16 bp, Homo sapiens
cctctcgagcccagat

SEQ ID NO: 4034704 - DNA, 16 bp, Homo sapiens
cctctcgagggcaggg

SEQ ID NO: 4034705 - DNA, 19 bp, Homo sapiens
cctctctcagcacagcctg

SEQ ID NO: 4034706 - DNA, 14 bp, Homo sapiens
cctctctcctttgc

SEQ ID NO: 4034707 - DNA, 16 bp, Homo sapiens
cctctctcttctgctc

SEQ ID NO: 4034708 - DNA, 18 bp, Homo sapiens
cctctctcttctgctcca

SEQ ID NO: 4034709 - DNA, 21 bp, Homo sapiens
cctctctcttctgctccaccc

SEQ ID NO: 4034710 - DNA, 20 bp, Homo sapiens
cctctctctttcctccaccc

SEQ ID NO: 4034711 - DNA, 22 bp, Homo sapiens
cctctctctttcctccacccat

SEQ ID NO: 4034712 - DNA, 14 bp, Homo sapiens
cctctctgagtctg

SEQ ID NO: 4034713 - DNA, 23 bp, Homo sapiens
cctctctgatcttgtgctcagca

SEQ ID NO: 4034714 - DNA, 19 bp, Homo sapiens
cctctctgccccacccaag

SEQ ID NO: 4034715 - DNA, 12 bp, Homo sapiens
cctctctgggcc

SEQ ID NO: 4034716 - DNA, 12 bp, Homo sapiens
cctctcttcccc

SEQ ID NO: 4034717 - DNA, 17 bp, Homo sapiens
cctctcttctcaccttt

SEQ ID NO: 4034718 - DNA, 15 bp, Homo sapiens
cctctgaacttgcct

SEQ ID NO: 4034719 - DNA, 17 bp, Homo sapiens
cctctgacctgcactgg

SEQ ID NO: 4034720 - DNA, 14 bp, Homo sapiens
cctctgactctgag

SEQ ID NO: 4034721 - DNA, 19 bp, Homo sapiens
cctctgagaattccaagga

SEQ ID NO: 4034722 - DNA, 13 bp, Homo sapiens
cctctgagaggcg

SEQ ID NO: 4034723 - DNA, 18 bp, Homo sapiens
cctctgagcccagctgcc

SEQ ID NO: 4034724 - DNA, 19 bp, Homo sapiens
cctctgcaagcttcttgct

SEQ ID NO: 4034725 - DNA, 14 bp, Homo sapiens
cctctgcagtctca

SEQ ID NO: 4034726 - DNA, 21 bp, Homo sapiens
cctctgcagtctcatttctca

SEQ ID NO: 4034727 - DNA, 11 bp, Homo sapiens
cctctgccaga

SEQ ID NO: 4034728 - DNA, 23 bp, Homo sapiens
cctctgccagaagatcccctcag

SEQ ID NO: 4034729 - DNA, 10 bp, Homo sapiens
cctctgcccc

SEQ ID NO: 4034730 - DNA, 15 bp, Homo sapiens
cctctgcccctccca

SEQ ID NO: 4034731 - DNA, 23 bp, Homo sapiens
cctctgccctcattactgggcct

SEQ ID NO: 4034732 - DNA, 14 bp, Homo sapiens
cctctgccctggat

SEQ ID NO: 4034733 - DNA, 20 bp, Homo sapiens
cctctgccggtcgggcagcc

SEQ ID NO: 4034734 - DNA, 16 bp, Homo sapiens
cctctgcctccaccct

SEQ ID NO: 4034735 - DNA, 12 bp, Homo sapiens
cctctgcctgcc

SEQ ID NO: 4034736 - DNA, 13 bp, Homo sapiens
cctctgcctgccc

SEQ ID NO: 4034737 - DNA, 17 bp, Homo sapiens
cctctgccttcaggctt

SEQ ID NO: 4034738 - DNA, 19 bp, Homo sapiens
cctctgccttcaggcttct

SEQ ID NO: 4034739 - DNA, 20 bp, Homo sapiens
cctctgctcaccgcccatca

SEQ ID NO: 4034740 - DNA, 12 bp, Homo sapiens
cctctgctcagc

SEQ ID NO: 4034741 - DNA, 17 bp, Homo sapiens
cctctgctgaatgcagg

SEQ ID NO: 4034742 - DNA, 21 bp, Homo sapiens
cctctgctgccgcccttcctg

SEQ ID NO: 4034743 - DNA, 14 bp, Homo sapiens
cctctgctgctgtc

SEQ ID NO: 4034744 - DNA, 20 bp, Homo sapiens
cctctgctgctgtccctccc

SEQ ID NO: 4034745 - DNA, 18 bp, Homo sapiens
cctctgcttctcatccca

SEQ ID NO: 4034746 - DNA, 16 bp, Homo sapiens
cctctggaatgcactg

SEQ ID NO: 4034747 - DNA, 16 bp, Homo sapiens
cctctggaattgctca

SEQ ID NO: 4034748 - DNA, 20 bp, Homo sapiens
cctctggaggggtgtggctc

SEQ ID NO: 4034749 - DNA, 15 bp, Homo sapiens
cctctggccaggatg

SEQ ID NO: 4034750 - DNA, 13 bp, Homo sapiens
cctctggctagag

SEQ ID NO: 4034751 - DNA, 22 bp, Homo sapiens
cctctggcttgggcagggtctg

SEQ ID NO: 4034752 - DNA, 17 bp, Homo sapiens
cctctggctttcccagg

SEQ ID NO: 4034753 - DNA, 23 bp, Homo sapiens
cctctgggaaatgagaaggcagc

SEQ ID NO: 4034754 - DNA, 11 bp, Homo sapiens
cctctgggccc

SEQ ID NO: 4034755 - DNA, 20 bp, Homo sapiens
cctctggggaccccaacctc

SEQ ID NO: 4034756 - DNA, 23 bp, Homo sapiens
cctctggtgtgtggtgaggggct

SEQ ID NO: 4034757 - DNA, 18 bp, Homo sapiens
cctctgtaggcagcagag

SEQ ID NO: 4034758 - DNA, 21 bp, Homo sapiens
cctctgtcagtcacagccacc

SEQ ID NO: 4034759 - DNA, 14 bp, Homo sapiens
cctctgtcatttgt

SEQ ID NO: 4034760 - DNA, 16 bp, Homo sapiens
cctctgtcatttgttg

SEQ ID NO: 4034761 - DNA, 16 bp, Homo sapiens
cctctgtcccacccct

SEQ ID NO: 4034762 - DNA, 19 bp, Homo sapiens
cctctgtcccacccctagc

SEQ ID NO: 4034763 - DNA, 21 bp, Homo sapiens
cctctgtcctaaaccgtcccc

SEQ ID NO: 4034764 - DNA, 18 bp, Homo sapiens
cctctgtctcatcctcct

SEQ ID NO: 4034765 - DNA, 13 bp, Homo sapiens
cctctgtctgccc

SEQ ID NO: 4034766 - DNA, 17 bp, Homo sapiens
cctctgtcttcaggctc

SEQ ID NO: 4034767 - DNA, 16 bp, Homo sapiens
cctcttcaccaggtgc

SEQ ID NO: 4034768 - DNA, 13 bp, Homo sapiens
cctcttcaccccc

SEQ ID NO: 4034769 - DNA, 13 bp, Homo sapiens
cctcttcccatga

SEQ ID NO: 4034770 - DNA, 21 bp, Homo sapiens
cctcttcccatgactgcaccc

SEQ ID NO: 4034771 - DNA, 13 bp, Homo sapiens
cctcttccccaga

SEQ ID NO: 4034772 - DNA, 15 bp, Homo sapiens
cctcttcctttagga

SEQ ID NO: 4034773 - DNA, 17 bp, Homo sapiens
cctcttctgctcttttc

SEQ ID NO: 4034774 - DNA, 20 bp, Homo sapiens
cctcttctgtccctgttaga

SEQ ID NO: 4034775 - DNA, 16 bp, Homo sapiens
cctcttcttcttcaga

SEQ ID NO: 4034776 - DNA, 16 bp, Homo sapiens
cctcttctttgtgcct

SEQ ID NO: 4034777 - DNA, 21 bp, Homo sapiens
cctcttctttgtgcctttggc

SEQ ID NO: 4034778 - DNA, 23 bp, Homo sapiens
cctcttctttgtgcctttggcct

SEQ ID NO: 4034779 - DNA, 17 bp, Homo sapiens
cctcttgagcagtggct

SEQ ID NO: 4034780 - DNA, 16 bp, Homo sapiens
cctcttgctgtctctg

SEQ ID NO: 4034781 - DNA, 19 bp, Homo sapiens
cctcttgctgtctctgctc

SEQ ID NO: 4034782 - DNA, 18 bp, Homo sapiens
cctcttgggggcactgct

SEQ ID NO: 4034783 - DNA, 19 bp, Homo sapiens
cctcttgtccctttcccta

SEQ ID NO: 4034784 - DNA, 14 bp, Homo sapiens
cctctttgctgcag

SEQ ID NO: 4034785 - DNA, 18 bp, Homo sapiens
cctctttttcctcctgga

SEQ ID NO: 4034786 - DNA, 22 bp, Homo sapiens
cctgaaaatgtttttctgccag

SEQ ID NO: 4034787 - DNA, 23 bp, Homo sapiens
cctgaaaatgtttttctgccagg

SEQ ID NO: 4034788 - DNA, 15 bp, Homo sapiens
cctgaaacaacttgg

SEQ ID NO: 4034789 - DNA, 20 bp, Homo sapiens
cctgaaacctagtactgccc

SEQ ID NO: 4034790 - DNA, 19 bp, Homo sapiens
cctgaaacgctcctttgtg

SEQ ID NO: 4034791 - DNA, 20 bp, Homo sapiens
cctgaaacgctcctttgtgt

SEQ ID NO: 4034792 - DNA, 20 bp, Homo sapiens
cctgaacaaatcttgggtgg

SEQ ID NO: 4034793 - DNA, 14 bp, Homo sapiens
cctgaacagaagct

SEQ ID NO: 4034794 - DNA, 12 bp, Homo sapiens
cctccctggagt

SEQ ID NO: 4034795 - DNA, 12 bp, Homo sapiens
cctccctggctc

SEQ ID NO: 4034796 - DNA, 13 bp, Homo sapiens
cctccctggctcc

SEQ ID NO: 4034797 - DNA, 15 bp, Homo sapiens
cctccctggctccca

SEQ ID NO: 4034798 - DNA, 15 bp, Homo sapiens
cctccctgtctccag

SEQ ID NO: 4034799 - DNA, 21 bp, Homo sapiens
cctccctgtctccagctgcct

SEQ ID NO: 4034800 - DNA, 23 bp, Homo sapiens
cctccctgtctccagctgcctgg

SEQ ID NO: 4034801 - DNA, 16 bp, Homo sapiens
cctcccttccttttcc

SEQ ID NO: 4034802 - DNA, 21 bp, Homo sapiens
cctcccttccttttccctgct

SEQ ID NO: 4034803 - DNA, 13 bp, Homo sapiens
cctcccttgcctt

SEQ ID NO: 4034804 - DNA, 18 bp, Homo sapiens
cctcccttgctgaacaca

SEQ ID NO: 4034805 - DNA, 18 bp, Homo sapiens
cctccgaccctcatggcc

SEQ ID NO: 4034806 - DNA, 12 bp, Homo sapiens
cctccgagacag

SEQ ID NO: 4034807 - DNA, 22 bp, Homo sapiens
cctccgagacagtccagtgtca

SEQ ID NO: 4034808 - DNA, 16 bp, Homo sapiens
cctccgagagggagag

SEQ ID NO: 4034809 - DNA, 13 bp, Homo sapiens
cctccgcccctgc

SEQ ID NO: 4034810 - DNA, 13 bp, Homo sapiens
cctccggactggt

SEQ ID NO: 4034811 - DNA, 15 bp, Homo sapiens
cctccggactggtgc

SEQ ID NO: 4034812 - DNA, 16 bp, Homo sapiens
cctccggactggtgcc

SEQ ID NO: 4034813 - DNA, 21 bp, Homo sapiens
cctccgtagggtctttcttgg

SEQ ID NO: 4034814 - DNA, 22 bp, Homo sapiens
cctccgtagggtctttcttggg

SEQ ID NO: 4034815 - DNA, 15 bp, Homo sapiens
cctccgtccatatca

SEQ ID NO: 4034816 - DNA, 23 bp, Homo sapiens
cctccgtgatccatccatctcca

SEQ ID NO: 4034817 - DNA, 14 bp, Homo sapiens
cctcctagacccag

SEQ ID NO: 4034818 - DNA, 14 bp, Homo sapiens
cctcctcacctcat

SEQ ID NO: 4034819 - DNA, 19 bp, Homo sapiens
cctcctcacctcatgccca

SEQ ID NO: 4034820 - DNA, 23 bp, Homo sapiens
cctcctcatcccgtgttctcctt

SEQ ID NO: 4034821 - DNA, 20 bp, Homo sapiens
cctcctccagcccctgtccc

SEQ ID NO: 4034822 - DNA, 12 bp, Homo sapiens
cctcctccaggg

SEQ ID NO: 4034823 - DNA, 14 bp, Homo sapiens
cctcctccccactt

SEQ ID NO: 4034824 - DNA, 13 bp, Homo sapiens
cctcctccttcct

SEQ ID NO: 4034825 - DNA, 15 bp, Homo sapiens
cctcctccttcctag

SEQ ID NO: 4034826 - DNA, 14 bp, Homo sapiens
cctcctcgggccga

SEQ ID NO: 4034827 - DNA, 14 bp, Homo sapiens
cctcctctcagtgt

SEQ ID NO: 4034828 - DNA, 14 bp, Homo sapiens
cctcctctgcctac

SEQ ID NO: 4034829 - DNA, 19 bp, Homo sapiens
cctcctctgcctacagcca

SEQ ID NO: 4034830 - DNA, 21 bp, Homo sapiens
cctcctctgcctacagccagg

SEQ ID NO: 4034831 - DNA, 21 bp, Homo sapiens
cctcctctggacggcaggctc

SEQ ID NO: 4034832 - DNA, 13 bp, Homo sapiens
cctcctctgtctg

SEQ ID NO: 4034833 - DNA, 16 bp, Homo sapiens
cctcctgagcctgtgg

SEQ ID NO: 4034834 - DNA, 18 bp, Homo sapiens
cctcctgagcctgtgggt

SEQ ID NO: 4034835 - DNA, 13 bp, Homo sapiens
cctcctgccccac

SEQ ID NO: 4034836 - DNA, 14 bp, Homo sapiens
cctcctgccccaca

SEQ ID NO: 4034837 - DNA, 17 bp, Homo sapiens
cctcctgccctgtccct

SEQ ID NO: 4034838 - DNA, 23 bp, Homo sapiens
cctcctgccctgtccctgtcccc

SEQ ID NO: 4034839 - DNA, 17 bp, Homo sapiens
cctcctgcctcagcctt

SEQ ID NO: 4034840 - DNA, 19 bp, Homo sapiens
cctcctggaaccttgctgt

SEQ ID NO: 4034841 - DNA, 20 bp, Homo sapiens
cctcctggaaccttgctgtc

SEQ ID NO: 4034842 - DNA, 22 bp, Homo sapiens
cctcctggaaccttgctgtcct

SEQ ID NO: 4034843 - DNA, 17 bp, Homo sapiens
cctcctggccagacgct

SEQ ID NO: 4034844 - DNA, 11 bp, Homo sapiens
cctcctgtgcc

SEQ ID NO: 4034845 - DNA, 19 bp, Homo sapiens
cctcctgtgcctggcccca

SEQ ID NO: 4034846 - DNA, 18 bp, Homo sapiens
cctcctgtggggaaaggg

SEQ ID NO: 4034847 - DNA, 12 bp, Homo sapiens
cctccttcagac

SEQ ID NO: 4034848 - DNA, 16 bp, Homo sapiens
cctccttccacctccc

SEQ ID NO: 4034849 - DNA, 17 bp, Homo sapiens
cctccttccacctccct

SEQ ID NO: 4034850 - DNA, 12 bp, Homo sapiens
cctccttcccac

SEQ ID NO: 4034851 - DNA, 13 bp, Homo sapiens
cctccttctcctt

SEQ ID NO: 4034852 - DNA, 18 bp, Homo sapiens
cctccttttgcttgaaac

SEQ ID NO: 4034853 - DNA, 13 bp, Homo sapiens
cctcctttttcca

SEQ ID NO: 4034854 - DNA, 22 bp, Homo sapiens
cctcgacagcgcccctgctgtc

SEQ ID NO: 4034855 - DNA, 19 bp, Homo sapiens
cctcgcaggcctccctgcc

SEQ ID NO: 4034856 - DNA, 12 bp, Homo sapiens
cctcgcctgtgg

SEQ ID NO: 4034857 - DNA, 15 bp, Homo sapiens
cctcgcctgtggagc

SEQ ID NO: 4034858 - DNA, 21 bp, Homo sapiens
cctcgctcaccgctggccctt

SEQ ID NO: 4034859 - DNA, 13 bp, Homo sapiens
cctcgctgcttct

SEQ ID NO: 4034860 - DNA, 19 bp, Homo sapiens
cctcggacagcccatctgc

SEQ ID NO: 4034861 - DNA, 13 bp, Homo sapiens
cctcgtccacccc

SEQ ID NO: 4034862 - DNA, 19 bp, Homo sapiens
cctcgtccaccccccacac

SEQ ID NO: 4034863 - DNA, 22 bp, Homo sapiens
cctcgtccatcagggatctcag

SEQ ID NO: 4034864 - DNA, 23 bp, Homo sapiens
cctcgtccatcagggatctcaga

SEQ ID NO: 4034865 - DNA, 13 bp, Homo sapiens
cctcgtccctccc

SEQ ID NO: 4034866 - DNA, 18 bp, Homo sapiens
cctcgtccctccctcact

SEQ ID NO: 4034867 - DNA, 20 bp, Homo sapiens
cctcgttggaagaggaacag

SEQ ID NO: 4034868 - DNA, 22 bp, Homo sapiens
cctctaaagcagaggcaacact

SEQ ID NO: 4034869 - DNA, 18 bp, Homo sapiens
cctctaatctgagctgca

SEQ ID NO: 4034870 - DNA, 20 bp, Homo sapiens
cctctaatctgagctgcagc

SEQ ID NO: 4034871 - DNA, 22 bp, Homo sapiens
cctctaatctgagctgcagcct

SEQ ID NO: 4034872 - DNA, 21 bp, Homo sapiens
cctctaccagttggcagacag

SEQ ID NO: 4034873 - DNA, 20 bp, Homo sapiens
cctctacttaatgagatagt

SEQ ID NO: 4034874 - DNA, 13 bp, Homo sapiens
cctctagccctgc

SEQ ID NO: 4034875 - DNA, 23 bp, Homo sapiens
cctctaggcaagcaggacctggc

SEQ ID NO: 4034876 - DNA, 16 bp, Homo sapiens
cctctatacatctctc

SEQ ID NO: 4034877 - DNA, 17 bp, Homo sapiens
cctctatacatctctcc

SEQ ID NO: 4034878 - DNA, 21 bp, Homo sapiens
cctctatacatctctccccaa

SEQ ID NO: 4034879 - DNA, 12 bp, Homo sapiens
cctctattttgt

SEQ ID NO: 4034880 - DNA, 14 bp, Homo sapiens
cctctcactgcctc

SEQ ID NO: 4034881 - DNA, 16 bp, Homo sapiens
cctctcagctccaggt

SEQ ID NO: 4034882 - DNA, 17 bp, Homo sapiens
cctctcagttctctccc

SEQ ID NO: 4034883 - DNA, 22 bp, Homo sapiens
cctctcagttctctcccttcct

SEQ ID NO: 4034884 - DNA, 23 bp, Homo sapiens
cctctcatcagtgtcctcttgct

SEQ ID NO: 4034885 - DNA, 21 bp, Homo sapiens
cctctccaagtctctctgtga

SEQ ID NO: 4034886 - DNA, 15 bp, Homo sapiens
cctctccactccatg

SEQ ID NO: 4034887 - DNA, 16 bp, Homo sapiens
cctctccactccatgt

SEQ ID NO: 4034888 - DNA, 14 bp, Homo sapiens
cctctccactgcct

SEQ ID NO: 4034889 - DNA, 19 bp, Homo sapiens
cctctccactgccttcgat

SEQ ID NO: 4034890 - DNA, 16 bp, Homo sapiens
cctctccaggtgctca

SEQ ID NO: 4034891 - DNA, 18 bp, Homo sapiens
cctctccagtttgcacct

SEQ ID NO: 4034892 - DNA, 21 bp, Homo sapiens
cctctccagtttgcacctgtc

SEQ ID NO: 4034893 - DNA, 12 bp, Homo sapiens
cctctccccagc

SEQ ID NO: 4034894 - DNA, 14 bp, Homo sapiens
cctctccccagccc

SEQ ID NO: 4034895 - DNA, 16 bp, Homo sapiens
cctctccccagcccag

SEQ ID NO: 4034896 - DNA, 17 bp, Homo sapiens
cctctccccagcccaga

SEQ ID NO: 4034897 - DNA, 20 bp, Homo sapiens
cctctccccagcccagagac

SEQ ID NO: 4034898 - DNA, 13 bp, Homo sapiens
cattatttctagt

SEQ ID NO: 4034899 - DNA, 14 bp, Homo sapiens
cattatttgcatgt

SEQ ID NO: 4034900 - DNA, 14 bp, Homo sapiens
cattattttgtggt

SEQ ID NO: 4034901 - DNA, 21 bp, Homo sapiens
cattattttgtggttctattt

SEQ ID NO: 4034902 - DNA, 22 bp, Homo sapiens
cattattttgtggttctatttt

SEQ ID NO: 4034903 - DNA, 23 bp, Homo sapiens
cattattttgtggttctatttta

SEQ ID NO: 4034904 - DNA, 23 bp, Homo sapiens
cattcaaattaagggttaagaaa

SEQ ID NO: 4034905 - DNA, 16 bp, Homo sapiens
cattcaatacaagtgt

SEQ ID NO: 4034906 - DNA, 21 bp, Homo sapiens
cattcaatattgacatttgta

SEQ ID NO: 4034907 - DNA, 22 bp, Homo sapiens
cattcacactttttatttaatt

SEQ ID NO: 4034908 - DNA, 23 bp, Homo sapiens
cattcacagttctttgggccaga

SEQ ID NO: 4034909 - DNA, 15 bp, Homo sapiens
cattcacctgcccca

SEQ ID NO: 4034910 - DNA, 16 bp, Homo sapiens
cattcacctgccccaa

SEQ ID NO: 4034911 - DNA, 12 bp, Homo sapiens
cattcagagagc

SEQ ID NO: 4034912 - DNA, 17 bp, Homo sapiens
cattcaggaagatgaaa

SEQ ID NO: 4034913 - DNA, 14 bp, Homo sapiens
cattcagtcccaaa

SEQ ID NO: 4034914 - DNA, 23 bp, Homo sapiens
cattcatcaatatccctcttgta

SEQ ID NO: 4034915 - DNA, 20 bp, Homo sapiens
cattcatttagctaaacgga

SEQ ID NO: 4034916 - DNA, 11 bp, Homo sapiens
cattcattttt

SEQ ID NO: 4034917 - DNA, 17 bp, Homo sapiens
cattccaaagctttatt

SEQ ID NO: 4034918 - DNA, 12 bp, Homo sapiens
cattccactcca

SEQ ID NO: 4034919 - DNA, 13 bp, Homo sapiens
cattccagtgcta

SEQ ID NO: 4034920 - DNA, 19 bp, Homo sapiens
cattccagtgctagaaaat

SEQ ID NO: 4034921 - DNA, 14 bp, Homo sapiens
cattccattgccta

SEQ ID NO: 4034922 - DNA, 21 bp, Homo sapiens
cattccattgcctagctcttt

SEQ ID NO: 4034923 - DNA, 14 bp, Homo sapiens
cattcccccaccag

SEQ ID NO: 4034924 - DNA, 18 bp, Homo sapiens
cattcccccaccagctgc

SEQ ID NO: 4034925 - DNA, 23 bp, Homo sapiens
cattcctaacacagcatgtgtat

SEQ ID NO: 4034926 - DNA, 12 bp, Homo sapiens
cattcctccctc

SEQ ID NO: 4034927 - DNA, 13 bp, Homo sapiens
cattcctgaaaga

SEQ ID NO: 4034928 - DNA, 13 bp, Homo sapiens
cattcctgaagaa

SEQ ID NO: 4034929 - DNA, 16 bp, Homo sapiens
cattcctgaagaacca

SEQ ID NO: 4034930 - DNA, 19 bp, Homo sapiens
cattcgacataccccactg

SEQ ID NO: 4034931 - DNA, 22 bp, Homo sapiens
cattcgggccccacctgcagct

SEQ ID NO: 4034932 - DNA, 16 bp, Homo sapiens
cattcggtgtggtgca

SEQ ID NO: 4034933 - DNA, 17 bp, Homo sapiens
cattcgtgagctgggga

SEQ ID NO: 4034934 - DNA, 19 bp, Homo sapiens
cattcgtgagctggggact

SEQ ID NO: 4034935 - DNA, 23 bp, Homo sapiens
cattcgtgagctggggactcagg

SEQ ID NO: 4034936 - DNA, 21 bp, Homo sapiens
cattcgttgtgttttttaaga

SEQ ID NO: 4034937 - DNA, 16 bp, Homo sapiens
cattctacagaataat

SEQ ID NO: 4034938 - DNA, 15 bp, Homo sapiens
cattctaggatgtgg

SEQ ID NO: 4034939 - DNA, 20 bp, Homo sapiens
cattctaggatgtggagcta

SEQ ID NO: 4034940 - DNA, 23 bp, Homo sapiens
cattctaggtaggggcccacttc

SEQ ID NO: 4034941 - DNA, 23 bp, Homo sapiens
cattctatccccaatcagctcct

SEQ ID NO: 4034942 - DNA, 15 bp, Homo sapiens
cattctatcgttatt

SEQ ID NO: 4034943 - DNA, 22 bp, Homo sapiens
cattctatcgttattataaatg

SEQ ID NO: 4034944 - DNA, 23 bp, Homo sapiens
cattctatcgttattataaatgt

SEQ ID NO: 4034945 - DNA, 14 bp, Homo sapiens
cattctattgcctt

SEQ ID NO: 4034946 - DNA, 21 bp, Homo sapiens
cattctcaagggacgtcctcc

SEQ ID NO: 4034947 - DNA, 17 bp, Homo sapiens
cattctcataattccta

SEQ ID NO: 4034948 - DNA, 18 bp, Homo sapiens
cattctcataattcctac

SEQ ID NO: 4034949 - DNA, 23 bp, Homo sapiens
cattctcataattcctacagcac

SEQ ID NO: 4034950 - DNA, 19 bp, Homo sapiens
cattctcattgcagaataa

SEQ ID NO: 4034951 - DNA, 15 bp, Homo sapiens
cattctccacagcaa

SEQ ID NO: 4034952 - DNA, 12 bp, Homo sapiens
cattctccccag

SEQ ID NO: 4034953 - DNA, 16 bp, Homo sapiens
cattctcctgcctcag

SEQ ID NO: 4034954 - DNA, 15 bp, Homo sapiens
cattctccttgttgt

SEQ ID NO: 4034955 - DNA, 20 bp, Homo sapiens
cattctgcattgctagataa

SEQ ID NO: 4034956 - DNA, 12 bp, Homo sapiens
cattctggaggg

SEQ ID NO: 4034957 - DNA, 16 bp, Homo sapiens
cattctgtgatcattt

SEQ ID NO: 4034958 - DNA, 17 bp, Homo sapiens
cattgaaagaagagatg

SEQ ID NO: 4034959 - DNA, 22 bp, Homo sapiens
cattgaacacaaactgtaaata

SEQ ID NO: 4034960 - DNA, 20 bp, Homo sapiens
cattgaacattttatcatta

SEQ ID NO: 4034961 - DNA, 16 bp, Homo sapiens
cattgaagccgactct

SEQ ID NO: 4034962 - DNA, 17 bp, Homo sapiens
cattgaagccgactctg

SEQ ID NO: 4034963 - DNA, 23 bp, Homo sapiens
cattgaagccgactctggccctg

SEQ ID NO: 4034964 - DNA, 16 bp, Homo sapiens
cattgaccaagaactg

SEQ ID NO: 4034965 - DNA, 17 bp, Homo sapiens
cattgaccaagaactgc

SEQ ID NO: 4034966 - DNA, 20 bp, Homo sapiens
cattgaccaagaactgcatg

SEQ ID NO: 4034967 - DNA, 22 bp, Homo sapiens
cattgaccgcgactaatttcaa

SEQ ID NO: 4034968 - DNA, 15 bp, Homo sapiens
cattgacctctcagg

SEQ ID NO: 4034969 - DNA, 19 bp, Homo sapiens
cattgacctctcagggcct

SEQ ID NO: 4034970 - DNA, 20 bp, Homo sapiens
cattgacctctcagggcctg

SEQ ID NO: 4034971 - DNA, 21 bp, Homo sapiens
cattgacctctcagggcctgg

SEQ ID NO: 4034972 - DNA, 23 bp, Homo sapiens
cattgacgattccttctctgaac

SEQ ID NO: 4034973 - DNA, 15 bp, Homo sapiens
cattgactcttgcgt

SEQ ID NO: 4034974 - DNA, 22 bp, Homo sapiens
cattgactggtttacaggccct

SEQ ID NO: 4034975 - DNA, 18 bp, Homo sapiens
cattgagctgatataaat

SEQ ID NO: 4034976 - DNA, 19 bp, Homo sapiens
cattgagctgatataaatt

SEQ ID NO: 4034977 - DNA, 20 bp, Homo sapiens
cattgagctgatataaattc

SEQ ID NO: 4034978 - DNA, 21 bp, Homo sapiens
cattgagctgatataaattct

SEQ ID NO: 4034979 - DNA, 17 bp, Homo sapiens
cattgatcataaactga

SEQ ID NO: 4034980 - DNA, 15 bp, Homo sapiens
cattgattcagcctg

SEQ ID NO: 4034981 - DNA, 18 bp, Homo sapiens
cattgattgtcagctact

SEQ ID NO: 4034982 - DNA, 12 bp, Homo sapiens
cattgcactcca

SEQ ID NO: 4034983 - DNA, 16 bp, Homo sapiens
cattgcagaataatgt

SEQ ID NO: 4034984 - DNA, 22 bp, Homo sapiens
cattgcagaataatgttctatt

SEQ ID NO: 4034985 - DNA, 20 bp, Homo sapiens
cattgcagtttaagagcaga

SEQ ID NO: 4034986 - DNA, 16 bp, Homo sapiens
cattgcattctattgc

SEQ ID NO: 4034987 - DNA, 14 bp, Homo sapiens
cattgccaccagga

SEQ ID NO: 4034988 - DNA, 15 bp, Homo sapiens
cattgccaccaggag

SEQ ID NO: 4034989 - DNA, 16 bp, Homo sapiens
cattgccaccaggaga

SEQ ID NO: 4034990 - DNA, 20 bp, Homo sapiens
cattgccaccaggagaacca

SEQ ID NO: 4034991 - DNA, 23 bp, Homo sapiens
cattgccccaaatggattcctgt

SEQ ID NO: 4034992 - DNA, 14 bp, Homo sapiens
cattgccccaagat

SEQ ID NO: 4034993 - DNA, 21 bp, Homo sapiens
cattgccccagacctggaaga

SEQ ID NO: 4034994 - DNA, 15 bp, Homo sapiens
cattgcggccccagg

SEQ ID NO: 4034995 - DNA, 17 bp, Homo sapiens
cattgcggccccaggag

SEQ ID NO: 4034996 - DNA, 18 bp, Homo sapiens
cattgcggccccaggagg

SEQ ID NO: 4034997 - DNA, 15 bp, Homo sapiens
cattgctagataaaa

SEQ ID NO: 4034998 - DNA, 19 bp, Homo sapiens
cattgctccctaagactgt

SEQ ID NO: 4034999 - DNA, 16 bp, Homo sapiens
cattgctgaaaatggt

SEQ ID NO: 4035000 - DNA, 18 bp, Homo sapiens
cattgctgagcctctgct

SEQ ID NO: 4035001 - DNA, 22 bp, Homo sapiens
cattgcttgtgccacaccctcc

SEQ ID NO: 4035002 - DNA, 20 bp, Homo sapiens
cattggcacctaatccaggc

SEQ ID NO: 4035003 - DNA, 16 bp, Homo sapiens
cattgggcacagtcca

SEQ ID NO: 4035004 - DNA, 19 bp, Homo sapiens
cattgtaaatagtatttga

SEQ ID NO: 4035005 - DNA, 18 bp, Homo sapiens
cattgtaatgttactgat

SEQ ID NO: 4035006 - DNA, 15 bp, Homo sapiens
cattgtgaagcacct

SEQ ID NO: 4035007 - DNA, 16 bp, Homo sapiens
cattgttatttataca

SEQ ID NO: 4035008 - DNA, 11 bp, Homo sapiens
cattgttctcc

SEQ ID NO: 4035009 - DNA, 21 bp, Homo sapiens
cattgttgaggtggtctgaat

SEQ ID NO: 4035010 - DNA, 18 bp, Homo sapiens
cattgttggcgctgaggt

SEQ ID NO: 4035011 - DNA, 19 bp, Homo sapiens
cattgttggcgctgaggtg

SEQ ID NO: 4035012 - DNA, 18 bp, Homo sapiens
cattgttggctatttgaa

SEQ ID NO: 4035013 - DNA, 21 bp, Homo sapiens
cattgttggctatttgaaata

SEQ ID NO: 4035014 - DNA, 14 bp, Homo sapiens
cattgtttgcttat

SEQ ID NO: 4035015 - DNA, 21 bp, Homo sapiens
catttaaaaaaaaaatttgtt

SEQ ID NO: 4035016 - DNA, 15 bp, Homo sapiens
catttaaaatgatta

SEQ ID NO: 4035017 - DNA, 16 bp, Homo sapiens
catttaaaatgattag

SEQ ID NO: 4035018 - DNA, 20 bp, Homo sapiens
catttaaaattgctatgtta

SEQ ID NO: 4035019 - DNA, 22 bp, Homo sapiens
catttaaaattgctatgttact

SEQ ID NO: 4035020 - DNA, 18 bp, Homo sapiens
catttaaagcattgctgt

SEQ ID NO: 4035021 - DNA, 12 bp, Homo sapiens
catttaagtttc

SEQ ID NO: 4035022 - DNA, 13 bp, Homo sapiens
catttaataaaga

SEQ ID NO: 4035023 - DNA, 20 bp, Homo sapiens
catttaataaagaaatattt

SEQ ID NO: 4035024 - DNA, 15 bp, Homo sapiens
catttaatttgttat

SEQ ID NO: 4035025 - DNA, 19 bp, Homo sapiens
catttactaaacatatgat

SEQ ID NO: 4035026 - DNA, 20 bp, Homo sapiens
catttactaaacatatgatt

SEQ ID NO: 4035027 - DNA, 12 bp, Homo sapiens
catttactttta

SEQ ID NO: 4035028 - DNA, 15 bp, Homo sapiens
catttacttttaata

SEQ ID NO: 4035029 - DNA, 12 bp, Homo sapiens
catttagaaatc

SEQ ID NO: 4035030 - DNA, 17 bp, Homo sapiens
catttagcttctttccc

SEQ ID NO: 4035031 - DNA, 17 bp, Homo sapiens
catttagtcatgtgacc

SEQ ID NO: 4035032 - DNA, 15 bp, Homo sapiens
catttagtcctgtac

SEQ ID NO: 4035033 - DNA, 20 bp, Homo sapiens
catttagttctttgttattt

SEQ ID NO: 4035034 - DNA, 14 bp, Homo sapiens
catttataatgttt

SEQ ID NO: 4035035 - DNA, 21 bp, Homo sapiens
catttataatgtttgctattg

SEQ ID NO: 4035036 - DNA, 12 bp, Homo sapiens
catttatacaaa

SEQ ID NO: 4035037 - DNA, 15 bp, Homo sapiens
catttatacaaatta

SEQ ID NO: 4035038 - DNA, 18 bp, Homo sapiens
catttatacaaattagaa

SEQ ID NO: 4035039 - DNA, 15 bp, Homo sapiens
catttatatatgaaa

SEQ ID NO: 4035040 - DNA, 16 bp, Homo sapiens
catttatatatgaaaa

SEQ ID NO: 4035041 - DNA, 15 bp, Homo sapiens
catttatatattgaa

SEQ ID NO: 4035042 - DNA, 15 bp, Homo sapiens
catttatatttttat

SEQ ID NO: 4035043 - DNA, 12 bp, Homo sapiens
catttatcattc

SEQ ID NO: 4035044 - DNA, 15 bp, Homo sapiens
catttatcattcttg

SEQ ID NO: 4035045 - DNA, 14 bp, Homo sapiens
catttatgcacatt

SEQ ID NO: 4035046 - DNA, 16 bp, Homo sapiens
catttatttattactg

SEQ ID NO: 4035047 - DNA, 19 bp, Homo sapiens
catttattttttacattat

SEQ ID NO: 4035048 - DNA, 22 bp, Homo sapiens
catttcaaaaccaaggaagcag

SEQ ID NO: 4035049 - DNA, 15 bp, Homo sapiens
catttcactgtctgt

SEQ ID NO: 4035050 - DNA, 13 bp, Homo sapiens
catttcaggaggg

SEQ ID NO: 4035051 - DNA, 16 bp, Homo sapiens
catttcagtggcttcc

SEQ ID NO: 4035052 - DNA, 15 bp, Homo sapiens
catttcataaactaa

SEQ ID NO: 4035053 - DNA, 13 bp, Homo sapiens
catttcattccat

SEQ ID NO: 4035054 - DNA, 19 bp, Homo sapiens
catttcattccattgccta

SEQ ID NO: 4035055 - DNA, 15 bp, Homo sapiens
catttcattcctaac

SEQ ID NO: 4035056 - DNA, 21 bp, Homo sapiens
catttcattcctaacacagca

SEQ ID NO: 4035057 - DNA, 13 bp, Homo sapiens
catttccaacacc

SEQ ID NO: 4035058 - DNA, 22 bp, Homo sapiens
catttccaacaccacagacaca

SEQ ID NO: 4035059 - DNA, 16 bp, Homo sapiens
catttccaccaggccg

SEQ ID NO: 4035060 - DNA, 21 bp, Homo sapiens
catttccaccaggccgtgcct

SEQ ID NO: 4035061 - DNA, 17 bp, Homo sapiens
catttccagctgtgcag

SEQ ID NO: 4035062 - DNA, 15 bp, Homo sapiens
catttcccatctgca

SEQ ID NO: 4035063 - DNA, 16 bp, Homo sapiens
catttcccccaaaggc

SEQ ID NO: 4035064 - DNA, 23 bp, Homo sapiens
catttcctatcacctatttccat

SEQ ID NO: 4035065 - DNA, 15 bp, Homo sapiens
catttccttgtcccg

SEQ ID NO: 4035066 - DNA, 19 bp, Homo sapiens
catttccttttctctgccc

SEQ ID NO: 4035067 - DNA, 17 bp, Homo sapiens
catttctatcagtactt

SEQ ID NO: 4035068 - DNA, 13 bp, Homo sapiens
catttctatttat

SEQ ID NO: 4035069 - DNA, 14 bp, Homo sapiens
catttctatttatt

SEQ ID NO: 4035070 - DNA, 19 bp, Homo sapiens
catttctcactagtgtcag

SEQ ID NO: 4035071 - DNA, 19 bp, Homo sapiens
catttctcataattttgca

SEQ ID NO: 4035072 - DNA, 24 bp, Homo sapiens
catttctgccttttgttcatttca

SEQ ID NO: 4035073 - DNA, 16 bp, Homo sapiens
catttctgctctcagc

SEQ ID NO: 4035074 - DNA, 12 bp, Homo sapiens
catttcttccca

SEQ ID NO: 4035075 - DNA, 15 bp, Homo sapiens
catttcttcctcagc

SEQ ID NO: 4035076 - DNA, 18 bp, Homo sapiens
catttcttcctcagctgg

SEQ ID NO: 4035077 - DNA, 19 bp, Homo sapiens
catttcttcctcagctggt

SEQ ID NO: 4035078 - DNA, 13 bp, Homo sapiens
catttctttgcat

SEQ ID NO: 4035079 - DNA, 13 bp, Homo sapiens
catttcttttctg

SEQ ID NO: 4035080 - DNA, 17 bp, Homo sapiens
catttgaacctggatcc

SEQ ID NO: 4035081 - DNA, 19 bp, Homo sapiens
catttgaagtgtacctgtg

SEQ ID NO: 4035082 - DNA, 21 bp, Homo sapiens
catttgacaaaactaaccttg

SEQ ID NO: 4035083 - DNA, 23 bp, Homo sapiens
catttgactgaagatgcagctca

SEQ ID NO: 4035084 - DNA, 23 bp, Homo sapiens
catttgagagaagccacgctgtc

SEQ ID NO: 4035085 - DNA, 20 bp, Homo sapiens
catttgagggcccagccagg

SEQ ID NO: 4035086 - DNA, 22 bp, Homo sapiens
catttgagggcccagccaggag

SEQ ID NO: 4035087 - DNA, 16 bp, Homo sapiens
catttgatattatcta

SEQ ID NO: 4035088 - DNA, 14 bp, Homo sapiens
catttgcagggtcc

SEQ ID NO: 4035089 - DNA, 17 bp, Homo sapiens
catttgcctttctggga

SEQ ID NO: 4035090 - DNA, 23 bp, Homo sapiens
catttgcctttctgggagcagaa

SEQ ID NO: 4035091 - DNA, 15 bp, Homo sapiens
catttgctgttttaa

SEQ ID NO: 4035092 - DNA, 21 bp, Homo sapiens
catttggagacacaactattt

SEQ ID NO: 4035093 - DNA, 15 bp, Homo sapiens
catttggattggatg

SEQ ID NO: 4035094 - DNA, 20 bp, Homo sapiens
catttggttcattaattcta

SEQ ID NO: 4035095 - DNA, 12 bp, Homo sapiens
catttgtaataa

SEQ ID NO: 4035096 - DNA, 20 bp, Homo sapiens
catttgtacagaattttgga

SEQ ID NO: 4035097 - DNA, 14 bp, Homo sapiens
catttgtcacagaa

SEQ ID NO: 4035098 - DNA, 11 bp, Homo sapiens
catttgtgagg

SEQ ID NO: 4035099 - DNA, 12 bp, Homo sapiens
catttgtgaggc

SEQ ID NO: 4035100 - DNA, 19 bp, Homo sapiens
catttgtgtacacagtcag

SEQ ID NO: 4035101 - DNA, 22 bp, Homo sapiens
catttgttcactgaaggtgatt

SEQ ID NO: 4035102 - DNA, 13 bp, Homo sapiens
catttgttcctgg

SEQ ID NO: 4035103 - DNA, 21 bp, Homo sapiens
cattttaaaaacatagaaaaa

SEQ ID NO: 4035104 - DNA, 17 bp, Homo sapiens
ccacaaggtccactccc

SEQ ID NO: 4035105 - DNA, 18 bp, Homo sapiens
ccacaaggtccactccct

SEQ ID NO: 4035106 - DNA, 21 bp, Homo sapiens
ccacaatgatgattaaacacc

SEQ ID NO: 4035107 - DNA, 14 bp, Homo sapiens
ccacacacacaaaa

SEQ ID NO: 4035108 - DNA, 13 bp, Homo sapiens
ccacacagagtgg

SEQ ID NO: 4035109 - DNA, 14 bp, Homo sapiens
ccacacagggtggc

SEQ ID NO: 4035110 - DNA, 20 bp, Homo sapiens
ccacacatttcactgtctgt

SEQ ID NO: 4035111 - DNA, 15 bp, Homo sapiens
ccacaccagtggcct

SEQ ID NO: 4035112 - DNA, 20 bp, Homo sapiens
ccacaccccagcccaccctg

SEQ ID NO: 4035113 - DNA, 19 bp, Homo sapiens
ccacaccctgtactgttct

SEQ ID NO: 4035114 - DNA, 23 bp, Homo sapiens
ccacaccctgtactgttctgtgt

SEQ ID NO: 4035115 - DNA, 16 bp, Homo sapiens
ccacaccgtgtaaacc

SEQ ID NO: 4035116 - DNA, 19 bp, Homo sapiens
ccacacctcagttcccttg

SEQ ID NO: 4035117 - DNA, 22 bp, Homo sapiens
ccacacctcagttcccttggcc

SEQ ID NO: 4035118 - DNA, 14 bp, Homo sapiens
ccacacctctgcca

SEQ ID NO: 4035119 - DNA, 15 bp, Homo sapiens
ccacaccttccaggg

SEQ ID NO: 4035120 - DNA, 16 bp, Homo sapiens
ccacaccttccagggc

SEQ ID NO: 4035121 - DNA, 17 bp, Homo sapiens
ccacaccttccagggcc

SEQ ID NO: 4035122 - DNA, 15 bp, Homo sapiens
ccacacgcactggtg

SEQ ID NO: 4035123 - DNA, 16 bp, Homo sapiens
ccacacgcactggtgc

SEQ ID NO: 4035124 - DNA, 18 bp, Homo sapiens
ccacacgcactggtgcca

SEQ ID NO: 4035125 - DNA, 16 bp, Homo sapiens
ccacacggactcccgg

SEQ ID NO: 4035126 - DNA, 16 bp, Homo sapiens
ccacactaacctgggt

SEQ ID NO: 4035127 - DNA, 14 bp, Homo sapiens
ccacactcagcaca

SEQ ID NO: 4035128 - DNA, 19 bp, Homo sapiens
ccacactcgccatctcctg

SEQ ID NO: 4035129 - DNA, 20 bp, Homo sapiens
ccacacttcaggctcttctc

SEQ ID NO: 4035130 - DNA, 21 bp, Homo sapiens
ccacacttgttccagctcttt

SEQ ID NO: 4035131 - DNA, 16 bp, Homo sapiens
ccacagacagatccca

SEQ ID NO: 4035132 - DNA, 17 bp, Homo sapiens
ccacagacagatcccat

SEQ ID NO: 4035133 - DNA, 14 bp, Homo sapiens
ccacagcaggtcct

SEQ ID NO: 4035134 - DNA, 21 bp, Homo sapiens
ccacagccagaggagggcaga

SEQ ID NO: 4035135 - DNA, 16 bp, Homo sapiens
ccacagcctccccacc

SEQ ID NO: 4035136 - DNA, 19 bp, Homo sapiens
ccacagccttcggacagac

SEQ ID NO: 4035137 - DNA, 21 bp, Homo sapiens
ccacagcggaggagaccagct

SEQ ID NO: 4035138 - DNA, 15 bp, Homo sapiens
ccacagctgctgttc

SEQ ID NO: 4035139 - DNA, 19 bp, Homo sapiens
ccacagctgctgttctcag

SEQ ID NO: 4035140 - DNA, 21 bp, Homo sapiens
ccacagctgctgttctcagga

SEQ ID NO: 4035141 - DNA, 13 bp, Homo sapiens
ccacagcttttgc

SEQ ID NO: 4035142 - DNA, 23 bp, Homo sapiens
ccacaggaagcctgcagtcctgg

SEQ ID NO: 4035143 - DNA, 23 bp, Homo sapiens
ccacaggcatctacacagcctgg

SEQ ID NO: 4035144 - DNA, 16 bp, Homo sapiens
ccacaggcatgtccca

SEQ ID NO: 4035145 - DNA, 15 bp, Homo sapiens
ccacaggccctggct

SEQ ID NO: 4035146 - DNA, 15 bp, Homo sapiens
ccacaggcccttcct

SEQ ID NO: 4035147 - DNA, 16 bp, Homo sapiens
ccacaggcccttcctc

SEQ ID NO: 4035148 - DNA, 17 bp, Homo sapiens
ccacaggcccttcctct

SEQ ID NO: 4035149 - DNA, 18 bp, Homo sapiens
ccacaggcccttcctctc

SEQ ID NO: 4035150 - DNA, 23 bp, Homo sapiens
ccacaggcccttcctctccactg

SEQ ID NO: 4035151 - DNA, 16 bp, Homo sapiens
ccacaggccgccctgc

SEQ ID NO: 4035152 - DNA, 12 bp, Homo sapiens
ccacagggccag

SEQ ID NO: 4035153 - DNA, 19 bp, Homo sapiens
ccacagggccagagggagc

SEQ ID NO: 4035154 - DNA, 22 bp, Homo sapiens
ccacagggttcaaaatgtctgt

SEQ ID NO: 4035155 - DNA, 16 bp, Homo sapiens
ccacagttgccaccac

SEQ ID NO: 4035156 - DNA, 22 bp, Homo sapiens
ccacagttgccaccacctctgt

SEQ ID NO: 4035157 - DNA, 21 bp, Homo sapiens
ccacatagtgatggttcccct

SEQ ID NO: 4035158 - DNA, 14 bp, Homo sapiens
ccacatcaaagagg

SEQ ID NO: 4035159 - DNA, 14 bp, Homo sapiens
ccacatcccagcag

SEQ ID NO: 4035160 - DNA, 19 bp, Homo sapiens
ccacatcccagcagcccaa

SEQ ID NO: 4035161 - DNA, 12 bp, Homo sapiens
ccacatcccagg

SEQ ID NO: 4035162 - DNA, 15 bp, Homo sapiens
ccacatcccaggctt

SEQ ID NO: 4035163 - DNA, 19 bp, Homo sapiens
ccacatccccaagcccacc

SEQ ID NO: 4035164 - DNA, 22 bp, Homo sapiens
ccacatccccaagcccaccagg

SEQ ID NO: 4035165 - DNA, 17 bp, Homo sapiens
ccacatccctttgaaac

SEQ ID NO: 4035166 - DNA, 21 bp, Homo sapiens
ccacatccggggccagctccg

SEQ ID NO: 4035167 - DNA, 20 bp, Homo sapiens
ccacatcctccgtccagccg

SEQ ID NO: 4035168 - DNA, 14 bp, Homo sapiens
ccacatgaaaccta

SEQ ID NO: 4035169 - DNA, 13 bp, Homo sapiens
ccacatgaggcca

SEQ ID NO: 4035170 - DNA, 18 bp, Homo sapiens
ccacatgccactgcctgc

SEQ ID NO: 4035171 - DNA, 22 bp, Homo sapiens
ccacatgccactgcctgcacct

SEQ ID NO: 4035172 - DNA, 22 bp, Homo sapiens
ccacatgcctgcgcctgctgcc

SEQ ID NO: 4035173 - DNA, 22 bp, Homo sapiens
ccacatgtatttattcctctgt

SEQ ID NO: 4035174 - DNA, 12 bp, Homo sapiens
ccacatttctga

SEQ ID NO: 4035175 - DNA, 13 bp, Homo sapiens
ccacatttggaat

SEQ ID NO: 4035176 - DNA, 16 bp, Homo sapiens
ccacatttgtcacaga

SEQ ID NO: 4035177 - DNA, 15 bp, Homo sapiens
ccaccaaccctcaga

SEQ ID NO: 4035178 - DNA, 17 bp, Homo sapiens
ccaccaagacttgtttt

SEQ ID NO: 4035179 - DNA, 11 bp, Homo sapiens
ccaccaaggtc

SEQ ID NO: 4035180 - DNA, 17 bp, Homo sapiens
ccaccaaggtcttcagc

SEQ ID NO: 4035181 - DNA, 14 bp, Homo sapiens
ccaccacccccttt

SEQ ID NO: 4035182 - DNA, 12 bp, Homo sapiens
ccaccacctccc

SEQ ID NO: 4035183 - DNA, 17 bp, Homo sapiens
ccaccacctccctcacc

SEQ ID NO: 4035184 - DNA, 17 bp, Homo sapiens
ccaccagacatcaccct

SEQ ID NO: 4035185 - DNA, 11 bp, Homo sapiens
ccaccagcagc

SEQ ID NO: 4035186 - DNA, 13 bp, Homo sapiens
ccaccagccatcc

SEQ ID NO: 4035187 - DNA, 11 bp, Homo sapiens
ccaccagcccc

SEQ ID NO: 4035188 - DNA, 20 bp, Homo sapiens
ccaccagcccccgccccaga

SEQ ID NO: 4035189 - DNA, 13 bp, Homo sapiens
ccaccagccgccc

SEQ ID NO: 4035190 - DNA, 18 bp, Homo sapiens
ccaccagccgccccagcc

SEQ ID NO: 4035191 - DNA, 15 bp, Homo sapiens
ccaccagctgcagcc

SEQ ID NO: 4035192 - DNA, 21 bp, Homo sapiens
ccaccagtgtcctccaagtgc

SEQ ID NO: 4035193 - DNA, 17 bp, Homo sapiens
ccaccatatgaattgta

SEQ ID NO: 4035194 - DNA, 20 bp, Homo sapiens
ccaccatatgaattgtacag

SEQ ID NO: 4035195 - DNA, 11 bp, Homo sapiens
ccaccatccct

SEQ ID NO: 4035196 - DNA, 21 bp, Homo sapiens
ccaccatggccagccaacttt

SEQ ID NO: 4035197 - DNA, 15 bp, Homo sapiens
ccacccaagcaggag

SEQ ID NO: 4035198 - DNA, 14 bp, Homo sapiens
ccacccacacagct

SEQ ID NO: 4035199 - DNA, 15 bp, Homo sapiens
ccacccacacagctg

SEQ ID NO: 4035200 - DNA, 21 bp, Homo sapiens
ccacccacacagctgccctag

SEQ ID NO: 4035201 - DNA, 24 bp, Homo sapiens
ccacccacacagctgccctagctg

SEQ ID NO: 4035202 - DNA, 11 bp, Homo sapiens
ccacccagccc

SEQ ID NO: 4035203 - DNA, 14 bp, Homo sapiens
ccacccagcccctg

SEQ ID NO: 4035204 - DNA, 17 bp, Homo sapiens
ccacccaggagggaggg

SEQ ID NO: 4035205 - DNA, 18 bp, Homo sapiens
ccacccaggagggagggg

SEQ ID NO: 4035206 - DNA, 13 bp, Homo sapiens
ccaccccacactt

SEQ ID NO: 4035207 - DNA, 13 bp, Homo sapiens
ccaccccacctcc

SEQ ID NO: 4035208 - DNA, 18 bp, Homo sapiens
ccaaccctggggaaggag

SEQ ID NO: 4035209 - DNA, 13 bp, Homo sapiens
ccaaccgacaggc

SEQ ID NO: 4035210 - DNA, 16 bp, Homo sapiens
ccaaccgacaggccct

SEQ ID NO: 4035211 - DNA, 18 bp, Homo sapiens
ccaaccgacaggccctgg

SEQ ID NO: 4035212 - DNA, 17 bp, Homo sapiens
ccaacctcagaggcagc

SEQ ID NO: 4035213 - DNA, 20 bp, Homo sapiens
ccaacctcagaggcagcttc

SEQ ID NO: 4035214 - DNA, 14 bp, Homo sapiens
ccaacctcagggct

SEQ ID NO: 4035215 - DNA, 18 bp, Homo sapiens
ccaacctcagggctccca

SEQ ID NO: 4035216 - DNA, 19 bp, Homo sapiens
ccaacctgcaaagatctgt

SEQ ID NO: 4035217 - DNA, 16 bp, Homo sapiens
ccaactctctcctgta

SEQ ID NO: 4035218 - DNA, 16 bp, Homo sapiens
ccaactgccaggctgc

SEQ ID NO: 4035219 - DNA, 17 bp, Homo sapiens
ccaactgggcccaagac

SEQ ID NO: 4035220 - DNA, 13 bp, Homo sapiens
ccaactgtgagca

SEQ ID NO: 4035221 - DNA, 20 bp, Homo sapiens
ccaacttctcttgctttcta

SEQ ID NO: 4035222 - DNA, 21 bp, Homo sapiens
ccaacttgagggcccagagca

SEQ ID NO: 4035223 - DNA, 17 bp, Homo sapiens
ccaacttgtaaatacac

SEQ ID NO: 4035224 - DNA, 15 bp, Homo sapiens
ccaagaaacctgact

SEQ ID NO: 4035225 - DNA, 14 bp, Homo sapiens
ccaagaaacgtctt

SEQ ID NO: 4035226 - DNA, 23 bp, Homo sapiens
ccaagaaagcttcttcagagtga

SEQ ID NO: 4035227 - DNA, 19 bp, Homo sapiens
ccaagaatagatgctgact

SEQ ID NO: 4035228 - DNA, 11 bp, Homo sapiens
ccaagacattg

SEQ ID NO: 4035229 - DNA, 19 bp, Homo sapiens
ccaagacttcattgtccct

SEQ ID NO: 4035230 - DNA, 11 bp, Homo sapiens
ccaagagaagg

SEQ ID NO: 4035231 - DNA, 15 bp, Homo sapiens
ccaagagcagagtct

SEQ ID NO: 4035232 - DNA, 16 bp, Homo sapiens
ccaagagcagagtctg

SEQ ID NO: 4035233 - DNA, 17 bp, Homo sapiens
ccaagatcaattccctc

SEQ ID NO: 4035234 - DNA, 13 bp, Homo sapiens
ccaagatctataa

SEQ ID NO: 4035235 - DNA, 17 bp, Homo sapiens
ccaagatgactggggtg

SEQ ID NO: 4035236 - DNA, 19 bp, Homo sapiens
ccaagattttcctcttgtg

SEQ ID NO: 4035237 - DNA, 14 bp, Homo sapiens
ccaagcaagtagct

SEQ ID NO: 4035238 - DNA, 12 bp, Homo sapiens
ccaagcacagca

SEQ ID NO: 4035239 - DNA, 17 bp, Homo sapiens
ccaagcacagcagcctg

SEQ ID NO: 4035240 - DNA, 13 bp, Homo sapiens
ccaagcctgacca

SEQ ID NO: 4035241 - DNA, 16 bp, Homo sapiens
ccaagccttaaactgt

SEQ ID NO: 4035242 - DNA, 23 bp, Homo sapiens
ccaagccttaaactgtacagaat

SEQ ID NO: 4035243 - DNA, 18 bp, Homo sapiens
ccaagctatctaaagttt

SEQ ID NO: 4035244 - DNA, 16 bp, Homo sapiens
ccaagctgagtttcct

SEQ ID NO: 4035245 - DNA, 19 bp, Homo sapiens
ccaagctgagtttcctatg

SEQ ID NO: 4035246 - DNA, 17 bp, Homo sapiens
ccaagctgcctctgggc

SEQ ID NO: 4035247 - DNA, 18 bp, Homo sapiens
ccaagctgcctctgggcc

SEQ ID NO: 4035248 - DNA, 19 bp, Homo sapiens
ccaagctgcctctgggcca

SEQ ID NO: 4035249 - DNA, 20 bp, Homo sapiens
ccaagcttaatagccctccc

SEQ ID NO: 4035250 - DNA, 21 bp, Homo sapiens
ccaagcttaatagccctcccc

SEQ ID NO: 4035251 - DNA, 13 bp, Homo sapiens
ccaagcttccctc

SEQ ID NO: 4035252 - DNA, 15 bp, Homo sapiens
ccaagcttgttatca

SEQ ID NO: 4035253 - DNA, 17 bp, Homo sapiens
ccaagcttgttatcagc

SEQ ID NO: 4035254 - DNA, 22 bp, Homo sapiens
ccaaggacagaaggctcctgcc

SEQ ID NO: 4035255 - DNA, 15 bp, Homo sapiens
ccaaggactgaggga

SEQ ID NO: 4035256 - DNA, 23 bp, Homo sapiens
ccaaggactgagggactctgaag

SEQ ID NO: 4035257 - DNA, 15 bp, Homo sapiens
ccaaggatcctctcc

SEQ ID NO: 4035258 - DNA, 15 bp, Homo sapiens
ccaaggcaaaaaact

SEQ ID NO: 4035259 - DNA, 15 bp, Homo sapiens
ccaaggccagagtgg

SEQ ID NO: 4035260 - DNA, 18 bp, Homo sapiens
ccaaggccagagtggcct

SEQ ID NO: 4035261 - DNA, 17 bp, Homo sapiens
ccaaggccccctgcctg

SEQ ID NO: 4035262 - DNA, 21 bp, Homo sapiens
ccaaggccccctgcctgccct

SEQ ID NO: 4035263 - DNA, 14 bp, Homo sapiens
ccaaggcggcccct

SEQ ID NO: 4035264 - DNA, 19 bp, Homo sapiens
ccaaggggaatcagaactc

SEQ ID NO: 4035265 - DNA, 18 bp, Homo sapiens
ccaaggggtgggccacag

SEQ ID NO: 4035266 - DNA, 14 bp, Homo sapiens
ccaaggtcctctca

SEQ ID NO: 4035267 - DNA, 19 bp, Homo sapiens
ccaaggtcttcagccatca

SEQ ID NO: 4035268 - DNA, 16 bp, Homo sapiens
ccaaggtcttcttaat

SEQ ID NO: 4035269 - DNA, 17 bp, Homo sapiens
ccaaggtggcagatgtc

SEQ ID NO: 4035270 - DNA, 22 bp, Homo sapiens
ccaaggttggagcccagggcat

SEQ ID NO: 4035271 - DNA, 20 bp, Homo sapiens
ccaagtaactgggattacag

SEQ ID NO: 4035272 - DNA, 20 bp, Homo sapiens
ccaagtagctgggattacag

SEQ ID NO: 4035273 - DNA, 13 bp, Homo sapiens
ccaagtcacacag

SEQ ID NO: 4035274 - DNA, 17 bp, Homo sapiens
ccaagtcacacccactc

SEQ ID NO: 4035275 - DNA, 18 bp, Homo sapiens
ccaagtcctccctctcta

SEQ ID NO: 4035276 - DNA, 16 bp, Homo sapiens
ccaagtctctctgtga

SEQ ID NO: 4035277 - DNA, 19 bp, Homo sapiens
ccaagtctctctgtgaata

SEQ ID NO: 4035278 - DNA, 21 bp, Homo sapiens
ccaagtctctctgtgaataca

SEQ ID NO: 4035279 - DNA, 16 bp, Homo sapiens
ccaagtgccccctcac

SEQ ID NO: 4035280 - DNA, 20 bp, Homo sapiens
ccaagtggaccttgagacca

SEQ ID NO: 4035281 - DNA, 23 bp, Homo sapiens
ccaagtggagcctgacagccaga

SEQ ID NO: 4035282 - DNA, 18 bp, Homo sapiens
ccaagttcttcacctcta

SEQ ID NO: 4035283 - DNA, 20 bp, Homo sapiens
ccaagtttattcagtaaaca

SEQ ID NO: 4035284 - DNA, 10 bp, Homo sapiens
ccaataaaaa

SEQ ID NO: 4035285 - DNA, 21 bp, Homo sapiens
ccaataaaaacattttgaagt

SEQ ID NO: 4035286 - DNA, 23 bp, Homo sapiens
ccaataaaaacattttgaagtgt

SEQ ID NO: 4035287 - DNA, 13 bp, Homo sapiens
ccaataaaagtga

SEQ ID NO: 4035288 - DNA, 15 bp, Homo sapiens
ccaataaaagtgact

SEQ ID NO: 4035289 - DNA, 14 bp, Homo sapiens
ccaataaaccaggt

SEQ ID NO: 4035290 - DNA, 22 bp, Homo sapiens
ccaataataaatgccctcttct

SEQ ID NO: 4035291 - DNA, 13 bp, Homo sapiens
ccaatattataat

SEQ ID NO: 4035292 - DNA, 14 bp, Homo sapiens
ccaatcattttaat

SEQ ID NO: 4035293 - DNA, 13 bp, Homo sapiens
ccaatcccagggc

SEQ ID NO: 4035294 - DNA, 19 bp, Homo sapiens
ccaatctattgcttcacca

SEQ ID NO: 4035295 - DNA, 18 bp, Homo sapiens
ccaatctgcacactccag

SEQ ID NO: 4035296 - DNA, 13 bp, Homo sapiens
ccaatctggccct

SEQ ID NO: 4035297 - DNA, 14 bp, Homo sapiens
ccaatcttgctttg

SEQ ID NO: 4035298 - DNA, 14 bp, Homo sapiens
ccaatcttgtttta

SEQ ID NO: 4035299 - DNA, 20 bp, Homo sapiens
ccaatcttgttttaagcaaa

SEQ ID NO: 4035300 - DNA, 16 bp, Homo sapiens
ccaatgcccagcaggg

SEQ ID NO: 4035301 - DNA, 16 bp, Homo sapiens
ccaatggtgatcctct

SEQ ID NO: 4035302 - DNA, 20 bp, Homo sapiens
ccaatggtgatcctctattt

SEQ ID NO: 4035303 - DNA, 21 bp, Homo sapiens
ccaatggtgatcctctatttt

SEQ ID NO: 4035304 - DNA, 23 bp, Homo sapiens
ccaatggtgatcctctattttgt

SEQ ID NO: 4035305 - DNA, 23 bp, Homo sapiens
ccaattaggaagtgtaacagctg

SEQ ID NO: 4035306 - DNA, 16 bp, Homo sapiens
ccaattagtttccttt

SEQ ID NO: 4035307 - DNA, 14 bp, Homo sapiens
ccaattcagacagg

SEQ ID NO: 4035308 - DNA, 14 bp, Homo sapiens
ccaattctcccctc

SEQ ID NO: 4035309 - DNA, 22 bp, Homo sapiens
ccacaaatgggaaaaccagact

SEQ ID NO: 4035310 - DNA, 18 bp, Homo sapiens
ccacaaggctggccagca

SEQ ID NO: 4035311 - DNA, 20 bp, Homo sapiens
cattttacagtgaccttttc

SEQ ID NO: 4035312 - DNA, 14 bp, Homo sapiens
cattttatttttga

SEQ ID NO: 4035313 - DNA, 15 bp, Homo sapiens
cattttcaactgctt

SEQ ID NO: 4035314 - DNA, 16 bp, Homo sapiens
cattttcccatcatcc

SEQ ID NO: 4035315 - DNA, 19 bp, Homo sapiens
cattttcccatcatccttt

SEQ ID NO: 4035316 - DNA, 14 bp, Homo sapiens
cattttccccccac

SEQ ID NO: 4035317 - DNA, 15 bp, Homo sapiens
cattttccccccact

SEQ ID NO: 4035318 - DNA, 11 bp, Homo sapiens
cattttcctcc

SEQ ID NO: 4035319 - DNA, 15 bp, Homo sapiens
cattttcctcctctg

SEQ ID NO: 4035320 - DNA, 12 bp, Homo sapiens
cattttcctgtt

SEQ ID NO: 4035321 - DNA, 18 bp, Homo sapiens
cattttctggtttggcat

SEQ ID NO: 4035322 - DNA, 20 bp, Homo sapiens
cattttcttattgcgctgct

SEQ ID NO: 4035323 - DNA, 20 bp, Homo sapiens
cattttgagtgactcgaggg

SEQ ID NO: 4035324 - DNA, 12 bp, Homo sapiens
cattttgcaaaa

SEQ ID NO: 4035325 - DNA, 22 bp, Homo sapiens
cattttgcagcagtgagtctct

SEQ ID NO: 4035326 - DNA, 13 bp, Homo sapiens
cattttgcattca

SEQ ID NO: 4035327 - DNA, 22 bp, Homo sapiens
cattttggaagttttcaggact

SEQ ID NO: 4035328 - DNA, 20 bp, Homo sapiens
cattttggagagtttcctga

SEQ ID NO: 4035329 - DNA, 22 bp, Homo sapiens
cattttggagagtttcctgaaa

SEQ ID NO: 4035330 - DNA, 12 bp, Homo sapiens
cattttggagct

SEQ ID NO: 4035331 - DNA, 21 bp, Homo sapiens
cattttggcgctattacaaat

SEQ ID NO: 4035332 - DNA, 22 bp, Homo sapiens
cattttggcgctattacaaata

SEQ ID NO: 4035333 - DNA, 22 bp, Homo sapiens
cattttgggacaattgttttaa

SEQ ID NO: 4035334 - DNA, 21 bp, Homo sapiens
cattttggtttatttttgtaa

SEQ ID NO: 4035335 - DNA, 22 bp, Homo sapiens
cattttggtttatttttgtaat

SEQ ID NO: 4035336 - DNA, 23 bp, Homo sapiens
cattttggtttatttttgtaatg

SEQ ID NO: 4035337 - DNA, 15 bp, Homo sapiens
cattttgtgaatgga

SEQ ID NO: 4035338 - DNA, 16 bp, Homo sapiens
cattttgtgaatggat

SEQ ID NO: 4035339 - DNA, 18 bp, Homo sapiens
cattttgtgaatggattg

SEQ ID NO: 4035340 - DNA, 15 bp, Homo sapiens
catttttaattttca

SEQ ID NO: 4035341 - DNA, 15 bp, Homo sapiens
catttttacaataaa

SEQ ID NO: 4035342 - DNA, 16 bp, Homo sapiens
catttttatttatgaa

SEQ ID NO: 4035343 - DNA, 16 bp, Homo sapiens
catttttctcccaaga

SEQ ID NO: 4035344 - DNA, 20 bp, Homo sapiens
catttttctcccaagaaacc

SEQ ID NO: 4035345 - DNA, 17 bp, Homo sapiens
cattttttcttctgaag

SEQ ID NO: 4035346 - DNA, 14 bp, Homo sapiens
cattttttgctata

SEQ ID NO: 4035347 - DNA, 18 bp, Homo sapiens
catttttttattcagcag

SEQ ID NO: 4035348 - DNA, 13 bp, Homo sapiens
ccaaaaaaaaaag

SEQ ID NO: 4035349 - DNA, 14 bp, Homo sapiens
ccaaaaaaaggaaa

SEQ ID NO: 4035350 - DNA, 15 bp, Homo sapiens
ccaaaaaaaggaaaa

SEQ ID NO: 4035351 - DNA, 22 bp, Homo sapiens
ccaaaaaattctacaacacaca

SEQ ID NO: 4035352 - DNA, 19 bp, Homo sapiens
ccaaaaagattttcagaaa

SEQ ID NO: 4035353 - DNA, 13 bp, Homo sapiens
ccaaaaattatta

SEQ ID NO: 4035354 - DNA, 19 bp, Homo sapiens
ccaaaaccaggcctctgct

SEQ ID NO: 4035355 - DNA, 16 bp, Homo sapiens
ccaaaacccagggcaa

SEQ ID NO: 4035356 - DNA, 11 bp, Homo sapiens
ccaaaagaaaa

SEQ ID NO: 4035357 - DNA, 15 bp, Homo sapiens
ccaaaagcagtaaat

SEQ ID NO: 4035358 - DNA, 15 bp, Homo sapiens
ccaaaagctagacag

SEQ ID NO: 4035359 - DNA, 18 bp, Homo sapiens
ccaaaatccaaaacttct

SEQ ID NO: 4035360 - DNA, 15 bp, Homo sapiens
ccaaacaccttccag

SEQ ID NO: 4035361 - DNA, 22 bp, Homo sapiens
ccaaacaccttccagctcctgt

SEQ ID NO: 4035362 - DNA, 17 bp, Homo sapiens
ccaaacactgaggcagc

SEQ ID NO: 4035363 - DNA, 21 bp, Homo sapiens
ccaaacatcagacctgtcttc

SEQ ID NO: 4035364 - DNA, 19 bp, Homo sapiens
ccaaacccccattctgtcc

SEQ ID NO: 4035365 - DNA, 14 bp, Homo sapiens
ccaaacctccagcc

SEQ ID NO: 4035366 - DNA, 17 bp, Homo sapiens
ccaaacctccagcctcc

SEQ ID NO: 4035367 - DNA, 14 bp, Homo sapiens
ccaaacctgggacc

SEQ ID NO: 4035368 - DNA, 13 bp, Homo sapiens
ccaaacgcctccc

SEQ ID NO: 4035369 - DNA, 14 bp, Homo sapiens
ccaaactgtccctc

SEQ ID NO: 4035370 - DNA, 12 bp, Homo sapiens
ccaaagagcctg

SEQ ID NO: 4035371 - DNA, 18 bp, Homo sapiens
ccaaagagcctggagaag

SEQ ID NO: 4035372 - DNA, 22 bp, Homo sapiens
ccaaagagcctggagaagctga

SEQ ID NO: 4035373 - DNA, 19 bp, Homo sapiens
ccaaagagggcttcctcta

SEQ ID NO: 4035374 - DNA, 22 bp, Homo sapiens
ccaaagagtagaattgcattga

SEQ ID NO: 4035375 - DNA, 13 bp, Homo sapiens
ccaaagcagacag

SEQ ID NO: 4035376 - DNA, 20 bp, Homo sapiens
ccaaagccacctctgtcatt

SEQ ID NO: 4035377 - DNA, 16 bp, Homo sapiens
ccaaaggatgtgatat

SEQ ID NO: 4035378 - DNA, 12 bp, Homo sapiens
ccaaaggctggt

SEQ ID NO: 4035379 - DNA, 21 bp, Homo sapiens
ccaaaggctggtggcaagtgc

SEQ ID NO: 4035380 - DNA, 21 bp, Homo sapiens
ccaaagggtgaagctatttat

SEQ ID NO: 4035381 - DNA, 15 bp, Homo sapiens
ccaaataagaaacct

SEQ ID NO: 4035382 - DNA, 16 bp, Homo sapiens
ccaaatcccagggaag

SEQ ID NO: 4035383 - DNA, 23 bp, Homo sapiens
ccaaatgcagggaggggaggcag

SEQ ID NO: 4035384 - DNA, 13 bp, Homo sapiens
ccaaatgctgggg

SEQ ID NO: 4035385 - DNA, 20 bp, Homo sapiens
ccaaatgctggggcaggggg

SEQ ID NO: 4035386 - DNA, 22 bp, Homo sapiens
ccaaatgtaattgaataaagtt

SEQ ID NO: 4035387 - DNA, 15 bp, Homo sapiens
ccaaattcagtttca

SEQ ID NO: 4035388 - DNA, 20 bp, Homo sapiens
ccaaattgctgggattacag

SEQ ID NO: 4035389 - DNA, 22 bp, Homo sapiens
ccaaattgtcacctgcttctct

SEQ ID NO: 4035390 - DNA, 12 bp, Homo sapiens
ccaaatttatca

SEQ ID NO: 4035391 - DNA, 21 bp, Homo sapiens
ccaaattttggccaaagtgtt

SEQ ID NO: 4035392 - DNA, 11 bp, Homo sapiens
ccaacaaacca

SEQ ID NO: 4035393 - DNA, 19 bp, Homo sapiens
ccaacaaagaacactaact

SEQ ID NO: 4035394 - DNA, 14 bp, Homo sapiens
ccaacaagaagaaa

SEQ ID NO: 4035395 - DNA, 21 bp, Homo sapiens
ccaacaaggttggcaccccag

SEQ ID NO: 4035396 - DNA, 17 bp, Homo sapiens
ccaacacagttgggacc

SEQ ID NO: 4035397 - DNA, 13 bp, Homo sapiens
ccaacaccaagca

SEQ ID NO: 4035398 - DNA, 16 bp, Homo sapiens
ccaacaccaagcacag

SEQ ID NO: 4035399 - DNA, 19 bp, Homo sapiens
ccaacaccaagcacagcag

SEQ ID NO: 4035400 - DNA, 16 bp, Homo sapiens
ccaacaccacagacac

SEQ ID NO: 4035401 - DNA, 17 bp, Homo sapiens
ccaacaccacagacaca

SEQ ID NO: 4035402 - DNA, 20 bp, Homo sapiens
ccaacaccctgtctaaaaaa

SEQ ID NO: 4035403 - DNA, 20 bp, Homo sapiens
ccaacacgcacctgcctcag

SEQ ID NO: 4035404 - DNA, 18 bp, Homo sapiens
ccaacagaactaaatgtt

SEQ ID NO: 4035405 - DNA, 17 bp, Homo sapiens
ccaacagcacctccccg

SEQ ID NO: 4035406 - DNA, 14 bp, Homo sapiens
ccaacaggtggcag

SEQ ID NO: 4035407 - DNA, 15 bp, Homo sapiens
ccaacaggtggcagg

SEQ ID NO: 4035408 - DNA, 18 bp, Homo sapiens
ccaacaggtggcaggacc

SEQ ID NO: 4035409 - DNA, 12 bp, Homo sapiens
ccaacatctttg

SEQ ID NO: 4035410 - DNA, 14 bp, Homo sapiens
ccaaccacagagaa

SEQ ID NO: 4035411 - DNA, 16 bp, Homo sapiens
ccaacccccaccccac

SEQ ID NO: 4035412 - DNA, 18 bp, Homo sapiens
ccaacccccaccccacac

SEQ ID NO: 4035413 - DNA, 20 bp, Homo sapiens
ccaacccccaccccacactt

SEQ ID NO: 4035414 - DNA, 16 bp, Homo sapiens
ccaaccctggggaagg

SEQ ID NO: 4035415 - DNA, 21 bp, Homo sapiens
catgtcaccggtcagtgcctt

SEQ ID NO: 4035416 - DNA, 23 bp, Homo sapiens
catgtcaccggtcagtgcctttt

SEQ ID NO: 4035417 - DNA, 15 bp, Homo sapiens
catgtccaaagaggc

SEQ ID NO: 4035418 - DNA, 18 bp, Homo sapiens
catgtcctaattcttctg

SEQ ID NO: 4035419 - DNA, 19 bp, Homo sapiens
catgtcctaattcttctgt

SEQ ID NO: 4035420 - DNA, 16 bp, Homo sapiens
catgtcctgctggctt

SEQ ID NO: 4035421 - DNA, 21 bp, Homo sapiens
catgtcgctagccagtgctcc

SEQ ID NO: 4035422 - DNA, 15 bp, Homo sapiens
catgtctgcctggag

SEQ ID NO: 4035423 - DNA, 13 bp, Homo sapiens
catgtctgcttgt

SEQ ID NO: 4035424 - DNA, 22 bp, Homo sapiens
catgtctgcttgtcaaaagaaa

SEQ ID NO: 4035425 - DNA, 18 bp, Homo sapiens
catgtcttatcttgtttc

SEQ ID NO: 4035426 - DNA, 20 bp, Homo sapiens
catgtctttctccaaagtta

SEQ ID NO: 4035427 - DNA, 13 bp, Homo sapiens
catgtgaaacctt

SEQ ID NO: 4035428 - DNA, 14 bp, Homo sapiens
catgtgaaaccttt

SEQ ID NO: 4035429 - DNA, 21 bp, Homo sapiens
catgtgaaaccttttttaaga

SEQ ID NO: 4035430 - DNA, 13 bp, Homo sapiens
catgtgaagaggg

SEQ ID NO: 4035431 - DNA, 12 bp, Homo sapiens
catgtgacattt

SEQ ID NO: 4035432 - DNA, 17 bp, Homo sapiens
catgtgagccaccgctg

SEQ ID NO: 4035433 - DNA, 18 bp, Homo sapiens
catgtgagccaccgctgc

SEQ ID NO: 4035434 - DNA, 15 bp, Homo sapiens
catgtgaggaggaaa

SEQ ID NO: 4035435 - DNA, 14 bp, Homo sapiens
catgtgcacccggc

SEQ ID NO: 4035436 - DNA, 20 bp, Homo sapiens
catgtgcacccggcctggat

SEQ ID NO: 4035437 - DNA, 17 bp, Homo sapiens
catgtgccatctgtaca

SEQ ID NO: 4035438 - DNA, 21 bp, Homo sapiens
catgtgcctttctttgcctct

SEQ ID NO: 4035439 - DNA, 22 bp, Homo sapiens
catgtgcctttctttgcctctg

SEQ ID NO: 4035440 - DNA, 17 bp, Homo sapiens
catgtggcaaaatatgg

SEQ ID NO: 4035441 - DNA, 21 bp, Homo sapiens
catgtggcaaaatatggtttg

SEQ ID NO: 4035442 - DNA, 14 bp, Homo sapiens
catgtggggccagg

SEQ ID NO: 4035443 - DNA, 15 bp, Homo sapiens
catgtggggccaggt

SEQ ID NO: 4035444 - DNA, 18 bp, Homo sapiens
catgtggggccaggtcac

SEQ ID NO: 4035445 - DNA, 23 bp, Homo sapiens
catgtggggccaggtcacccttt

SEQ ID NO: 4035446 - DNA, 17 bp, Homo sapiens
catgtgggtgagccagt

SEQ ID NO: 4035447 - DNA, 18 bp, Homo sapiens
catgtgggtgagccagtg

SEQ ID NO: 4035448 - DNA, 15 bp, Homo sapiens
catgtgggtgagtta

SEQ ID NO: 4035449 - DNA, 22 bp, Homo sapiens
catgtggtggcacaggccccct

SEQ ID NO: 4035450 - DNA, 17 bp, Homo sapiens
catgtgtcacttgtgct

SEQ ID NO: 4035451 - DNA, 14 bp, Homo sapiens
catgtgtcccctca

SEQ ID NO: 4035452 - DNA, 16 bp, Homo sapiens
catgtgtcccctcact

SEQ ID NO: 4035453 - DNA, 15 bp, Homo sapiens
catgtgtcctggttc

SEQ ID NO: 4035454 - DNA, 18 bp, Homo sapiens
catgtgtttattcatcca

SEQ ID NO: 4035455 - DNA, 20 bp, Homo sapiens
catgtgtttattcatccagc

SEQ ID NO: 4035456 - DNA, 22 bp, Homo sapiens
catgtgtttattcatccagcag

SEQ ID NO: 4035457 - DNA, 21 bp, Homo sapiens
catgttacataagataaatgt

SEQ ID NO: 4035458 - DNA, 21 bp, Homo sapiens
catgttcccacttcaaaacaa

SEQ ID NO: 4035459 - DNA, 20 bp, Homo sapiens
catgttctatttttgactgt

SEQ ID NO: 4035460 - DNA, 17 bp, Homo sapiens
catgttgcccctttctc

SEQ ID NO: 4035461 - DNA, 22 bp, Homo sapiens
catgttgcccctttctcttttc

SEQ ID NO: 4035462 - DNA, 15 bp, Homo sapiens
catgtttatttttct

SEQ ID NO: 4035463 - DNA, 18 bp, Homo sapiens
catgtttatttttcttgt

SEQ ID NO: 4035464 - DNA, 12 bp, Homo sapiens
catgtttctgcc

SEQ ID NO: 4035465 - DNA, 21 bp, Homo sapiens
catgttttctgaaaatataac

SEQ ID NO: 4035466 - DNA, 23 bp, Homo sapiens
cattaaaaaaatgtgcctagttt

SEQ ID NO: 4035467 - DNA, 21 bp, Homo sapiens
cattaaaaaatgaaatatttt

SEQ ID NO: 4035468 - DNA, 11 bp, Homo sapiens
cattaaaattg

SEQ ID NO: 4035469 - DNA, 15 bp, Homo sapiens
cattaaacttgaagc

SEQ ID NO: 4035470 - DNA, 17 bp, Homo sapiens
cattaaacttgaagcag

SEQ ID NO: 4035471 - DNA, 17 bp, Homo sapiens
cattaaagtctgaatca

SEQ ID NO: 4035472 - DNA, 19 bp, Homo sapiens
cattaaatgcaataatttt

SEQ ID NO: 4035473 - DNA, 20 bp, Homo sapiens
cattaaatgcaataatttta

SEQ ID NO: 4035474 - DNA, 15 bp, Homo sapiens
cattaacaaataaaa

SEQ ID NO: 4035475 - DNA, 21 bp, Homo sapiens
cattaacagttttccatgaaa

SEQ ID NO: 4035476 - DNA, 16 bp, Homo sapiens
cattaactaatctatt

SEQ ID NO: 4035477 - DNA, 17 bp, Homo sapiens
cattaacttagcatgtg

SEQ ID NO: 4035478 - DNA, 20 bp, Homo sapiens
cattaaggtatttcgaaact

SEQ ID NO: 4035479 - DNA, 23 bp, Homo sapiens
cattaaggtatttcgaaactgcc

SEQ ID NO: 4035480 - DNA, 17 bp, Homo sapiens
cattaagtcatgtgtga

SEQ ID NO: 4035481 - DNA, 20 bp, Homo sapiens
cattaagtcatgtgtgaaca

SEQ ID NO: 4035482 - DNA, 17 bp, Homo sapiens
cattaatagcagccttt

SEQ ID NO: 4035483 - DNA, 18 bp, Homo sapiens
cattaatagcagcctttc

SEQ ID NO: 4035484 - DNA, 21 bp, Homo sapiens
cattaatgttaattcagcact

SEQ ID NO: 4035485 - DNA, 20 bp, Homo sapiens
cattacacgatcacctgcat

SEQ ID NO: 4035486 - DNA, 21 bp, Homo sapiens
cattacagagaggagaaacac

SEQ ID NO: 4035487 - DNA, 15 bp, Homo sapiens
cattacagttcataa

SEQ ID NO: 4035488 - DNA, 12 bp, Homo sapiens
cattaccactca

SEQ ID NO: 4035489 - DNA, 18 bp, Homo sapiens
cattacccacccgacctg

SEQ ID NO: 4035490 - DNA, 23 bp, Homo sapiens
cattacctccatccatccttcca

SEQ ID NO: 4035491 - DNA, 20 bp, Homo sapiens
cattaccttactgtggagga

SEQ ID NO: 4035492 - DNA, 17 bp, Homo sapiens
cattacgtgagccaggt

SEQ ID NO: 4035493 - DNA, 23 bp, Homo sapiens
cattactgtacagggttatctgc

SEQ ID NO: 4035494 - DNA, 14 bp, Homo sapiens
cattactgtccttt

SEQ ID NO: 4035495 - DNA, 23 bp, Homo sapiens
cattacttgattaagattttaca

SEQ ID NO: 4035496 - DNA, 19 bp, Homo sapiens
cattagaattatttaaaca

SEQ ID NO: 4035497 - DNA, 15 bp, Homo sapiens
cattagactcctcct

SEQ ID NO: 4035498 - DNA, 17 bp, Homo sapiens
cattagcagtttgcttt

SEQ ID NO: 4035499 - DNA, 18 bp, Homo sapiens
cattagcagtttgctttg

SEQ ID NO: 4035500 - DNA, 14 bp, Homo sapiens
cattagtaaatgtc

SEQ ID NO: 4035501 - DNA, 18 bp, Homo sapiens
cattagtaaatgtctttg

SEQ ID NO: 4035502 - DNA, 14 bp, Homo sapiens
cattatccctgaat

SEQ ID NO: 4035503 - DNA, 21 bp, Homo sapiens
cattatcgagcagcattttat

SEQ ID NO: 4035504 - DNA, 17 bp, Homo sapiens
cattatcgggagcagtg

SEQ ID NO: 4035505 - DNA, 20 bp, Homo sapiens
cattatcgggagcagtgtct

SEQ ID NO: 4035506 - DNA, 21 bp, Homo sapiens
cattatcgggagcagtgtctt

SEQ ID NO: 4035507 - DNA, 23 bp, Homo sapiens
cattatcgggagcagtgtcttcc

SEQ ID NO: 4035508 - DNA, 16 bp, Homo sapiens
cattatcttatgaata

SEQ ID NO: 4035509 - DNA, 18 bp, Homo sapiens
cattatgccacttccttt

SEQ ID NO: 4035510 - DNA, 21 bp, Homo sapiens
cattatgggttaggcattaat

SEQ ID NO: 4035511 - DNA, 14 bp, Homo sapiens
cattatgtatctta

SEQ ID NO: 4035512 - DNA, 16 bp, Homo sapiens
cattatgtatcttagt

SEQ ID NO: 4035513 - DNA, 13 bp, Homo sapiens
cattattcattta

SEQ ID NO: 4035514 - DNA, 24 bp, Homo sapiens
cattattctctgctatatataaaa

SEQ ID NO: 4035515 - DNA, 12 bp, Homo sapiens
cattattctctt

SEQ ID NO: 4035516 - DNA, 23 bp, Homo sapiens
cattattggaattaacctggtgc

SEQ ID NO: 4035517 - DNA, 17 bp, Homo sapiens
catatttacttcttata

SEQ ID NO: 4035518 - DNA, 14 bp, Homo sapiens
catatttattttct

SEQ ID NO: 4035519 - DNA, 13 bp, Homo sapiens
catatttggaaga

SEQ ID NO: 4035520 - DNA, 17 bp, Homo sapiens
catattttagctgcacg

SEQ ID NO: 4035521 - DNA, 18 bp, Homo sapiens
catcaaaaactttggagt

SEQ ID NO: 4035522 - DNA, 23 bp, Homo sapiens
catcaaagaggctgaggctggca

SEQ ID NO: 4035523 - DNA, 22 bp, Homo sapiens
catcaactcccaacttcttcct

SEQ ID NO: 4035524 - DNA, 21 bp, Homo sapiens
catcaagaggtgggagggccc

SEQ ID NO: 4035525 - DNA, 20 bp, Homo sapiens
catcaagcaggaattatgtc

SEQ ID NO: 4035526 - DNA, 11 bp, Homo sapiens
catcaataaat

SEQ ID NO: 4035527 - DNA, 14 bp, Homo sapiens
catcaataaatgct

SEQ ID NO: 4035528 - DNA, 15 bp, Homo sapiens
catcaatgttcattg

SEQ ID NO: 4035529 - DNA, 15 bp, Homo sapiens
catcacaatacagat

SEQ ID NO: 4035530 - DNA, 14 bp, Homo sapiens
catcacactgggtg

SEQ ID NO: 4035531 - DNA, 12 bp, Homo sapiens
catcacagcagc

SEQ ID NO: 4035532 - DNA, 13 bp, Homo sapiens
catcacagcagcc

SEQ ID NO: 4035533 - DNA, 19 bp, Homo sapiens
catcacagcagcctccaac

SEQ ID NO: 4035534 - DNA, 22 bp, Homo sapiens
catcacaggacacggggcagtg

SEQ ID NO: 4035535 - DNA, 22 bp, Homo sapiens
catcacagggttgggcccagat

SEQ ID NO: 4035536 - DNA, 13 bp, Homo sapiens
catcaccctttgc

SEQ ID NO: 4035537 - DNA, 22 bp, Homo sapiens
catcaccgacgcgtctcctgtt

SEQ ID NO: 4035538 - DNA, 21 bp, Homo sapiens
catcactaaaccgataatgca

SEQ ID NO: 4035539 - DNA, 15 bp, Homo sapiens
catcactagaagaaa

SEQ ID NO: 4035540 - DNA, 17 bp, Homo sapiens
catcactagaagaaaag

SEQ ID NO: 4035541 - DNA, 18 bp, Homo sapiens
catcactagaagaaaagc

SEQ ID NO: 4035542 - DNA, 23 bp, Homo sapiens
catcactagaagaaaagcccatt

SEQ ID NO: 4035543 - DNA, 14 bp, Homo sapiens
catcacttccctac

SEQ ID NO: 4035544 - DNA, 12 bp, Homo sapiens
catcagacctgt

SEQ ID NO: 4035545 - DNA, 20 bp, Homo sapiens
catcagacctgtcttccaag

SEQ ID NO: 4035546 - DNA, 23 bp, Homo sapiens
catcagataagacatatctctaa

SEQ ID NO: 4035547 - DNA, 15 bp, Homo sapiens
catcagcagcagggt

SEQ ID NO: 4035548 - DNA, 20 bp, Homo sapiens
catcagcccaatccctgatc

SEQ ID NO: 4035549 - DNA, 11 bp, Homo sapiens
catcagctccc

SEQ ID NO: 4035550 - DNA, 14 bp, Homo sapiens
catcagctcccttt

SEQ ID NO: 4035551 - DNA, 19 bp, Homo sapiens
catcagctgtaagaagaga

SEQ ID NO: 4035552 - DNA, 18 bp, Homo sapiens
catcagggacaggatgac

SEQ ID NO: 4035553 - DNA, 16 bp, Homo sapiens
catcagggatctcaga

SEQ ID NO: 4035554 - DNA, 20 bp, Homo sapiens
catcagggatctcagaggct

SEQ ID NO: 4035555 - DNA, 15 bp, Homo sapiens
catcagggcctgggg

SEQ ID NO: 4035556 - DNA, 16 bp, Homo sapiens
catcagggcctggggc

SEQ ID NO: 4035557 - DNA, 21 bp, Homo sapiens
catcagggcctggggcctgag

SEQ ID NO: 4035558 - DNA, 13 bp, Homo sapiens
catcagtccccct

SEQ ID NO: 4035559 - DNA, 12 bp, Homo sapiens
catcagtgccaa

SEQ ID NO: 4035560 - DNA, 17 bp, Homo sapiens
catcagttcccccagta

SEQ ID NO: 4035561 - DNA, 18 bp, Homo sapiens
catcagttcccccagtac

SEQ ID NO: 4035562 - DNA, 12 bp, Homo sapiens
catcataaaata

SEQ ID NO: 4035563 - DNA, 15 bp, Homo sapiens
catcatctctgaagg

SEQ ID NO: 4035564 - DNA, 20 bp, Homo sapiens
catcatgcggtgggtgctgc

SEQ ID NO: 4035565 - DNA, 23 bp, Homo sapiens
catcatggtggatatggtgcaga

SEQ ID NO: 4035566 - DNA, 20 bp, Homo sapiens
catcattacccttccctgca

SEQ ID NO: 4035567 - DNA, 20 bp, Homo sapiens
catcattttccatatcctgg

SEQ ID NO: 4035568 - DNA, 22 bp, Homo sapiens
catcattttgcattcaaattaa

SEQ ID NO: 4035569 - DNA, 15 bp, Homo sapiens
catccaaagcagaca

SEQ ID NO: 4035570 - DNA, 16 bp, Homo sapiens
catccaaagcagacag

SEQ ID NO: 4035571 - DNA, 18 bp, Homo sapiens
catccaaagcagacagct

SEQ ID NO: 4035572 - DNA, 18 bp, Homo sapiens
catccaaataagaaacct

SEQ ID NO: 4035573 - DNA, 13 bp, Homo sapiens
catccaacaagaa

SEQ ID NO: 4035574 - DNA, 16 bp, Homo sapiens
catccaacaagaagaa

SEQ ID NO: 4035575 - DNA, 23 bp, Homo sapiens
catccaacaagaagaaatatgaa

SEQ ID NO: 4035576 - DNA, 17 bp, Homo sapiens
catccaatcctcactgg

SEQ ID NO: 4035577 - DNA, 21 bp, Homo sapiens
catccaatcctcactgggtgg

SEQ ID NO: 4035578 - DNA, 14 bp, Homo sapiens
catccacagtctcc

SEQ ID NO: 4035579 - DNA, 15 bp, Homo sapiens
catccaccttggctc

SEQ ID NO: 4035580 - DNA, 15 bp, Homo sapiens
catccactctaccct

SEQ ID NO: 4035581 - DNA, 22 bp, Homo sapiens
catccactctaccctcccaccc

SEQ ID NO: 4035582 - DNA, 15 bp, Homo sapiens
catccagacctggct

SEQ ID NO: 4035583 - DNA, 16 bp, Homo sapiens
catccagacctggctc

SEQ ID NO: 4035584 - DNA, 13 bp, Homo sapiens
catccagcaagaa

SEQ ID NO: 4035585 - DNA, 14 bp, Homo sapiens
catccagcagtgtt

SEQ ID NO: 4035586 - DNA, 14 bp, Homo sapiens
catccagtctattc

SEQ ID NO: 4035587 - DNA, 14 bp, Homo sapiens
catccagtttgttc

SEQ ID NO: 4035588 - DNA, 15 bp, Homo sapiens
catccatcagctccc

SEQ ID NO: 4035589 - DNA, 16 bp, Homo sapiens
catccatcagctccct

SEQ ID NO: 4035590 - DNA, 20 bp, Homo sapiens
catccatccctccattcatc

SEQ ID NO: 4035591 - DNA, 17 bp, Homo sapiens
catccattaggccagca

SEQ ID NO: 4035592 - DNA, 20 bp, Homo sapiens
catcccagcacctgcctcct

SEQ ID NO: 4035593 - DNA, 16 bp, Homo sapiens
catcccagcctgtggt

SEQ ID NO: 4035594 - DNA, 19 bp, Homo sapiens
catcccaggcttcaccctg

SEQ ID NO: 4035595 - DNA, 12 bp, Homo sapiens
catccccaccag

SEQ ID NO: 4035596 - DNA, 13 bp, Homo sapiens
catccccaccagc

SEQ ID NO: 4035597 - DNA, 14 bp, Homo sapiens
catccccaccagct

SEQ ID NO: 4035598 - DNA, 17 bp, Homo sapiens
catccccaccagctcgt

SEQ ID NO: 4035599 - DNA, 11 bp, Homo sapiens
catccccaggg

SEQ ID NO: 4035600 - DNA, 12 bp, Homo sapiens
catccccagggg

SEQ ID NO: 4035601 - DNA, 21 bp, Homo sapiens
catccccaggggtcccagcca

SEQ ID NO: 4035602 - DNA, 14 bp, Homo sapiens
catcccctcccatc

SEQ ID NO: 4035603 - DNA, 14 bp, Homo sapiens
catcccgtgttctc

SEQ ID NO: 4035604 - DNA, 14 bp, Homo sapiens
catccctccattca

SEQ ID NO: 4035605 - DNA, 21 bp, Homo sapiens
catccctgactggccaaaccc

SEQ ID NO: 4035606 - DNA, 23 bp, Homo sapiens
catccctgagacagggagggaag

SEQ ID NO: 4035607 - DNA, 19 bp, Homo sapiens
catccctgatggcagaact

SEQ ID NO: 4035608 - DNA, 13 bp, Homo sapiens
catccctggagca

SEQ ID NO: 4035609 - DNA, 13 bp, Homo sapiens
catccctgggccc

SEQ ID NO: 4035610 - DNA, 12 bp, Homo sapiens
catccctgtcct

SEQ ID NO: 4035611 - DNA, 13 bp, Homo sapiens
catccctgtcctc

SEQ ID NO: 4035612 - DNA, 16 bp, Homo sapiens
catccctgtcctcatg

SEQ ID NO: 4035613 - DNA, 13 bp, Homo sapiens
catcccttcccac

SEQ ID NO: 4035614 - DNA, 15 bp, Homo sapiens
catcccttctcttcc

SEQ ID NO: 4035615 - DNA, 17 bp, Homo sapiens
catccctttcccttggt

SEQ ID NO: 4035616 - DNA, 21 bp, Homo sapiens
catcctcaaacgacagaggag

SEQ ID NO: 4035617 - DNA, 16 bp, Homo sapiens
catcctcatccctgac

SEQ ID NO: 4035618 - DNA, 11 bp, Homo sapiens
catcctccctc

SEQ ID NO: 4035619 - DNA, 13 bp, Homo sapiens
catcctccctcca

SEQ ID NO: 4035620 - DNA, 16 bp, Homo sapiens
catcctccgtccagcc

SEQ ID NO: 4035621 - DNA, 18 bp, Homo sapiens
cataatgcttaatttcta

SEQ ID NO: 4035622 - DNA, 19 bp, Homo sapiens
cataatgcttaatttctaa

SEQ ID NO: 4035623 - DNA, 15 bp, Homo sapiens
cataatgttgcttct

SEQ ID NO: 4035624 - DNA, 14 bp, Homo sapiens
cataattatgacag

SEQ ID NO: 4035625 - DNA, 18 bp, Homo sapiens
cataattcctacagcact

SEQ ID NO: 4035626 - DNA, 17 bp, Homo sapiens
catacaaaataaatggt

SEQ ID NO: 4035627 - DNA, 22 bp, Homo sapiens
catacaggttaacctgcagaaa

SEQ ID NO: 4035628 - DNA, 22 bp, Homo sapiens
cataccagctcgcacccccctg

SEQ ID NO: 4035629 - DNA, 15 bp, Homo sapiens
cataccccactgggc

SEQ ID NO: 4035630 - DNA, 16 bp, Homo sapiens
cataccccactgggca

SEQ ID NO: 4035631 - DNA, 17 bp, Homo sapiens
cataccccactgggcac

SEQ ID NO: 4035632 - DNA, 14 bp, Homo sapiens
cataccttttctct

SEQ ID NO: 4035633 - DNA, 15 bp, Homo sapiens
catactcagcctgct

SEQ ID NO: 4035634 - DNA, 16 bp, Homo sapiens
catactcctgggctca

SEQ ID NO: 4035635 - DNA, 16 bp, Homo sapiens
catactctctgcctgg

SEQ ID NO: 4035636 - DNA, 19 bp, Homo sapiens
catactgagccaagtataa

SEQ ID NO: 4035637 - DNA, 19 bp, Homo sapiens
catactgagggaccaactg

SEQ ID NO: 4035638 - DNA, 20 bp, Homo sapiens
catactgagggaccaactgg

SEQ ID NO: 4035639 - DNA, 14 bp, Homo sapiens
catacttgaagggc

SEQ ID NO: 4035640 - DNA, 21 bp, Homo sapiens
catacttgaagggccagagcc

SEQ ID NO: 4035641 - DNA, 22 bp, Homo sapiens
catacttgaagggccagagcca

SEQ ID NO: 4035642 - DNA, 23 bp, Homo sapiens
catacttgaagggccagagccag

SEQ ID NO: 4035643 - DNA, 14 bp, Homo sapiens
catactttcatcct

SEQ ID NO: 4035644 - DNA, 22 bp, Homo sapiens
catactttcatcctgactctgc

SEQ ID NO: 4035645 - DNA, 16 bp, Homo sapiens
catacttttggctcct

SEQ ID NO: 4035646 - DNA, 19 bp, Homo sapiens
catagaaaacttgacatgt

SEQ ID NO: 4035647 - DNA, 24 bp, Homo sapiens
catagaaaacttgacatgtagctt

SEQ ID NO: 4035648 - DNA, 20 bp, Homo sapiens
catagaaactgtctagcact

SEQ ID NO: 4035649 - DNA, 16 bp, Homo sapiens
catagagctctatttc

SEQ ID NO: 4035650 - DNA, 15 bp, Homo sapiens
catagaggcttctcc

SEQ ID NO: 4035651 - DNA, 20 bp, Homo sapiens
catagaggcttctccgccag

SEQ ID NO: 4035652 - DNA, 22 bp, Homo sapiens
catagaggcttctccgccagcc

SEQ ID NO: 4035653 - DNA, 23 bp, Homo sapiens
catagaggcttctccgccagcct

SEQ ID NO: 4035654 - DNA, 16 bp, Homo sapiens
catagcaacaggaaaa

SEQ ID NO: 4035655 - DNA, 21 bp, Homo sapiens
catagcatagctagagattgg

SEQ ID NO: 4035656 - DNA, 18 bp, Homo sapiens
catagcctaatccctggg

SEQ ID NO: 4035657 - DNA, 19 bp, Homo sapiens
catagcctaatccctgggc

SEQ ID NO: 4035658 - DNA, 18 bp, Homo sapiens
catagctcactgcagcct

SEQ ID NO: 4035659 - DNA, 16 bp, Homo sapiens
catagctccttggagc

SEQ ID NO: 4035660 - DNA, 13 bp, Homo sapiens
catagctctattt

SEQ ID NO: 4035661 - DNA, 23 bp, Homo sapiens
cataggaaaagtacatttaatac

SEQ ID NO: 4035662 - DNA, 22 bp, Homo sapiens
cataggcccaggatatttctga

SEQ ID NO: 4035663 - DNA, 19 bp, Homo sapiens
cataggctcttaagcagca

SEQ ID NO: 4035664 - DNA, 15 bp, Homo sapiens
catagggtctcttca

SEQ ID NO: 4035665 - DNA, 20 bp, Homo sapiens
cataggtaagctgtgccttc

SEQ ID NO: 4035666 - DNA, 14 bp, Homo sapiens
cataggtttctctc

SEQ ID NO: 4035667 - DNA, 18 bp, Homo sapiens
cataggtttctctccctc

SEQ ID NO: 4035668 - DNA, 21 bp, Homo sapiens
catagtactctttgtagcaaa

SEQ ID NO: 4035669 - DNA, 20 bp, Homo sapiens
catagtatactgatttaatt

SEQ ID NO: 4035670 - DNA, 22 bp, Homo sapiens
catagtcgggatgtcagcagac

SEQ ID NO: 4035671 - DNA, 23 bp, Homo sapiens
catagtgaaataaattctgattc

SEQ ID NO: 4035672 - DNA, 22 bp, Homo sapiens
catagtgatggttcccctgttc

SEQ ID NO: 4035673 - DNA, 18 bp, Homo sapiens
catagttatttttctctt

SEQ ID NO: 4035674 - DNA, 12 bp, Homo sapiens
catagttcagaa

SEQ ID NO: 4035675 - DNA, 13 bp, Homo sapiens
catagttcagaat

SEQ ID NO: 4035676 - DNA, 16 bp, Homo sapiens
catagttctttttagt

SEQ ID NO: 4035677 - DNA, 20 bp, Homo sapiens
catagttggtaatgcttgga

SEQ ID NO: 4035678 - DNA, 22 bp, Homo sapiens
catagtttattattattaaagt

SEQ ID NO: 4035679 - DNA, 17 bp, Homo sapiens
catataatgttgttatt

SEQ ID NO: 4035680 - DNA, 14 bp, Homo sapiens
catatacagaaaaa

SEQ ID NO: 4035681 - DNA, 23 bp, Homo sapiens
catatactgattctgtgtatctt

SEQ ID NO: 4035682 - DNA, 14 bp, Homo sapiens
catatagagatgaa

SEQ ID NO: 4035683 - DNA, 20 bp, Homo sapiens
catatagagatgaagtttgt

SEQ ID NO: 4035684 - DNA, 19 bp, Homo sapiens
catatagtaaacactcaat

SEQ ID NO: 4035685 - DNA, 16 bp, Homo sapiens
catatatacaggcata

SEQ ID NO: 4035686 - DNA, 21 bp, Homo sapiens
catatatgtgtccatttcctt

SEQ ID NO: 4035687 - DNA, 23 bp, Homo sapiens
catatcaattggcagtgactttg

SEQ ID NO: 4035688 - DNA, 13 bp, Homo sapiens
catatcagtgacc

SEQ ID NO: 4035689 - DNA, 13 bp, Homo sapiens
catatcagttgag

SEQ ID NO: 4035690 - DNA, 17 bp, Homo sapiens
catatccttctggctgt

SEQ ID NO: 4035691 - DNA, 21 bp, Homo sapiens
catatctccatggccctgtcc

SEQ ID NO: 4035692 - DNA, 19 bp, Homo sapiens
catatcttctatatctgaa

SEQ ID NO: 4035693 - DNA, 16 bp, Homo sapiens
catatctttattaatc

SEQ ID NO: 4035694 - DNA, 17 bp, Homo sapiens
catatgaattgtacaga

SEQ ID NO: 4035695 - DNA, 22 bp, Homo sapiens
catatgactcacatgatgcata

SEQ ID NO: 4035696 - DNA, 13 bp, Homo sapiens
catatgatctgtt

SEQ ID NO: 4035697 - DNA, 20 bp, Homo sapiens
catatgggatattcccaagc

SEQ ID NO: 4035698 - DNA, 22 bp, Homo sapiens
catatgggtgggattttgcaaa

SEQ ID NO: 4035699 - DNA, 13 bp, Homo sapiens
catatgtaaacat

SEQ ID NO: 4035700 - DNA, 21 bp, Homo sapiens
catatgtcactagaatggata

SEQ ID NO: 4035701 - DNA, 13 bp, Homo sapiens
catatgttaagca

SEQ ID NO: 4035702 - DNA, 18 bp, Homo sapiens
catatgttaagcagctaa

SEQ ID NO: 4035703 - DNA, 15 bp, Homo sapiens
catatgttacactaa

SEQ ID NO: 4035704 - DNA, 14 bp, Homo sapiens
catatgtttggtaa

SEQ ID NO: 4035705 - DNA, 15 bp, Homo sapiens
catattaatgcgatt

SEQ ID NO: 4035706 - DNA, 21 bp, Homo sapiens
catattaatgcgatttcttcc

SEQ ID NO: 4035707 - DNA, 15 bp, Homo sapiens
catattacctggatt

SEQ ID NO: 4035708 - DNA, 18 bp, Homo sapiens
catattactgttgcattt

SEQ ID NO: 4035709 - DNA, 21 bp, Homo sapiens
catattactgttgcatttact

SEQ ID NO: 4035710 - DNA, 14 bp, Homo sapiens
catattaggaaaat

SEQ ID NO: 4035711 - DNA, 18 bp, Homo sapiens
catattagtattaatact

SEQ ID NO: 4035712 - DNA, 17 bp, Homo sapiens
catattccatatttatt

SEQ ID NO: 4035713 - DNA, 20 bp, Homo sapiens
catattctattgtattattt

SEQ ID NO: 4035714 - DNA, 15 bp, Homo sapiens
catattgatgaaaag

SEQ ID NO: 4035715 - DNA, 16 bp, Homo sapiens
catattgatgaaaaga

SEQ ID NO: 4035716 - DNA, 20 bp, Homo sapiens
catattgatgaaaagattta

SEQ ID NO: 4035717 - DNA, 21 bp, Homo sapiens
catattgctgagagaaatatg

SEQ ID NO: 4035718 - DNA, 23 bp, Homo sapiens
catattgctgagagaaatatgga

SEQ ID NO: 4035719 - DNA, 19 bp, Homo sapiens
catattgctttttctaatg

SEQ ID NO: 4035720 - DNA, 15 bp, Homo sapiens
catattgtttgatct

SEQ ID NO: 4035721 - DNA, 14 bp, Homo sapiens
catatttaaagaca

SEQ ID NO: 4035722 - DNA, 19 bp, Homo sapiens
catatttacattctagttc

SEQ ID NO: 4035723 - DNA, 19 bp, Homo sapiens
catcctccgtccagccgcc

SEQ ID NO: 4035724 - DNA, 15 bp, Homo sapiens
catcctcctccttcc

SEQ ID NO: 4035725 - DNA, 18 bp, Homo sapiens
catcctcctccttcctag

SEQ ID NO: 4035726 - DNA, 16 bp, Homo sapiens
catcctcctggaacct

SEQ ID NO: 4035727 - DNA, 17 bp, Homo sapiens
catcctctaaagcagag

SEQ ID NO: 4035728 - DNA, 20 bp, Homo sapiens
catcctctaaagcagaggca

SEQ ID NO: 4035729 - DNA, 22 bp, Homo sapiens
catcctgactctgccccctgct

SEQ ID NO: 4035730 - DNA, 15 bp, Homo sapiens
catcctgccagcccc

SEQ ID NO: 4035731 - DNA, 11 bp, Homo sapiens
catcctggctg

SEQ ID NO: 4035732 - DNA, 15 bp, Homo sapiens
catcctgtataagca

SEQ ID NO: 4035733 - DNA, 23 bp, Homo sapiens
catcctgtgccactaaactacat

SEQ ID NO: 4035734 - DNA, 21 bp, Homo sapiens
catccttcaagaactctgggc

SEQ ID NO: 4035735 - DNA, 20 bp, Homo sapiens
catccttcaccagagcccat

SEQ ID NO: 4035736 - DNA, 13 bp, Homo sapiens
catccttcccttt

SEQ ID NO: 4035737 - DNA, 18 bp, Homo sapiens
catccttccgccaatctg

SEQ ID NO: 4035738 - DNA, 21 bp, Homo sapiens
catccttccgccaatctggcc

SEQ ID NO: 4035739 - DNA, 19 bp, Homo sapiens
catccttggtctttgtatc

SEQ ID NO: 4035740 - DNA, 17 bp, Homo sapiens
catcctttcacttcttt

SEQ ID NO: 4035741 - DNA, 20 bp, Homo sapiens
catcctttcacttctttccc

SEQ ID NO: 4035742 - DNA, 12 bp, Homo sapiens
catcgcaggagt

SEQ ID NO: 4035743 - DNA, 22 bp, Homo sapiens
catcggaggctgggcccctggg

SEQ ID NO: 4035744 - DNA, 20 bp, Homo sapiens
catcgggagcacccagagca

SEQ ID NO: 4035745 - DNA, 17 bp, Homo sapiens
catcggtaggcaaagga

SEQ ID NO: 4035746 - DNA, 22 bp, Homo sapiens
catcggtgaaactaacagataa

SEQ ID NO: 4035747 - DNA, 20 bp, Homo sapiens
catcgtgaaaccctgtctct

SEQ ID NO: 4035748 - DNA, 18 bp, Homo sapiens
catctaatgcttgtttat

SEQ ID NO: 4035749 - DNA, 19 bp, Homo sapiens
catctacaatcagttgact

SEQ ID NO: 4035750 - DNA, 15 bp, Homo sapiens
catctacacagcctg

SEQ ID NO: 4035751 - DNA, 16 bp, Homo sapiens
catctacacagcctgg

SEQ ID NO: 4035752 - DNA, 17 bp, Homo sapiens
catctacacagcctgga

SEQ ID NO: 4035753 - DNA, 13 bp, Homo sapiens
catctagccagcc

SEQ ID NO: 4035754 - DNA, 17 bp, Homo sapiens
catctagccagcccctc

SEQ ID NO: 4035755 - DNA, 21 bp, Homo sapiens
catctagccagcccctcttcc

SEQ ID NO: 4035756 - DNA, 18 bp, Homo sapiens
catctaggtaatttttac

SEQ ID NO: 4035757 - DNA, 18 bp, Homo sapiens
catctagtacttgaaaaa

SEQ ID NO: 4035758 - DNA, 19 bp, Homo sapiens
catctatcgagtttgcaat

SEQ ID NO: 4035759 - DNA, 20 bp, Homo sapiens
catctatcgagtttgcaatg

SEQ ID NO: 4035760 - DNA, 15 bp, Homo sapiens
catctatctcaatcc

SEQ ID NO: 4035761 - DNA, 16 bp, Homo sapiens
catctattttggattg

SEQ ID NO: 4035762 - DNA, 12 bp, Homo sapiens
catctcacctcc

SEQ ID NO: 4035763 - DNA, 19 bp, Homo sapiens
catctcagcctcctgagcc

SEQ ID NO: 4035764 - DNA, 21 bp, Homo sapiens
catctcagcctcctgagcctg

SEQ ID NO: 4035765 - DNA, 22 bp, Homo sapiens
catctcagcctcctgagcctgt

SEQ ID NO: 4035766 - DNA, 23 bp, Homo sapiens
catctcaggagatggagggcttg

SEQ ID NO: 4035767 - DNA, 18 bp, Homo sapiens
catctcatgagtgtgccc

SEQ ID NO: 4035768 - DNA, 19 bp, Homo sapiens
catctcatgagtgtgcccc

SEQ ID NO: 4035769 - DNA, 22 bp, Homo sapiens
catctcattcaaaccccaccct

SEQ ID NO: 4035770 - DNA, 16 bp, Homo sapiens
catctccagggagcaa

SEQ ID NO: 4035771 - DNA, 20 bp, Homo sapiens
catctccagggagcaagaca

SEQ ID NO: 4035772 - DNA, 14 bp, Homo sapiens
catctccatcagct

SEQ ID NO: 4035773 - DNA, 13 bp, Homo sapiens
catctccctgcct

SEQ ID NO: 4035774 - DNA, 16 bp, Homo sapiens
catctccctgcctggc

SEQ ID NO: 4035775 - DNA, 18 bp, Homo sapiens
catctccctgcctggccc

SEQ ID NO: 4035776 - DNA, 13 bp, Homo sapiens
catctcctgtgca

SEQ ID NO: 4035777 - DNA, 15 bp, Homo sapiens
catctcctgtgcatg

SEQ ID NO: 4035778 - DNA, 20 bp, Homo sapiens
catctcctgtgcatgggtga

SEQ ID NO: 4035779 - DNA, 22 bp, Homo sapiens
catctcgggagtcctctagcag

SEQ ID NO: 4035780 - DNA, 13 bp, Homo sapiens
catctctccccaa

SEQ ID NO: 4035781 - DNA, 12 bp, Homo sapiens
catctctccctc

SEQ ID NO: 4035782 - DNA, 20 bp, Homo sapiens
catctctccctcccctgcca

SEQ ID NO: 4035783 - DNA, 15 bp, Homo sapiens
catctctctgcccaa

SEQ ID NO: 4035784 - DNA, 14 bp, Homo sapiens
catctctctggggc

SEQ ID NO: 4035785 - DNA, 11 bp, Homo sapiens
catctctgcac

SEQ ID NO: 4035786 - DNA, 18 bp, Homo sapiens
catctctgtactttgctt

SEQ ID NO: 4035787 - DNA, 20 bp, Homo sapiens
catctcttaggtgagacagt

SEQ ID NO: 4035788 - DNA, 19 bp, Homo sapiens
catctgaaacccacagatg

SEQ ID NO: 4035789 - DNA, 13 bp, Homo sapiens
catctgagaggct

SEQ ID NO: 4035790 - DNA, 21 bp, Homo sapiens
catctgagaggctctccgtgc

SEQ ID NO: 4035791 - DNA, 21 bp, Homo sapiens
catctgatccccatgcctagc

SEQ ID NO: 4035792 - DNA, 13 bp, Homo sapiens
catctgattaaaa

SEQ ID NO: 4035793 - DNA, 16 bp, Homo sapiens
catctgcaccccttct

SEQ ID NO: 4035794 - DNA, 17 bp, Homo sapiens
catctgcaccccttctc

SEQ ID NO: 4035795 - DNA, 19 bp, Homo sapiens
catctgcattttcacccca

SEQ ID NO: 4035796 - DNA, 12 bp, Homo sapiens
catctgccagac

SEQ ID NO: 4035797 - DNA, 16 bp, Homo sapiens
catctgcgtgacaata

SEQ ID NO: 4035798 - DNA, 16 bp, Homo sapiens
catctggaatctggag

SEQ ID NO: 4035799 - DNA, 21 bp, Homo sapiens
catctggagggttctaagtgg

SEQ ID NO: 4035800 - DNA, 22 bp, Homo sapiens
catctggataggagcctgctgg

SEQ ID NO: 4035801 - DNA, 16 bp, Homo sapiens
catctggctgtctaga

SEQ ID NO: 4035802 - DNA, 17 bp, Homo sapiens
catctggctgtctagaa

SEQ ID NO: 4035803 - DNA, 18 bp, Homo sapiens
catctggctgtctagaat

SEQ ID NO: 4035804 - DNA, 20 bp, Homo sapiens
catctggctgtctagaatgt

SEQ ID NO: 4035805 - DNA, 23 bp, Homo sapiens
catctggctgtttagcagaactc

SEQ ID NO: 4035806 - DNA, 21 bp, Homo sapiens
catctggggcccatactggtt

SEQ ID NO: 4035807 - DNA, 19 bp, Homo sapiens
catctggggttggcaacag

SEQ ID NO: 4035808 - DNA, 22 bp, Homo sapiens
catctggggttggcaacaggac

SEQ ID NO: 4035809 - DNA, 19 bp, Homo sapiens
catctgtataccctctgtt

SEQ ID NO: 4035810 - DNA, 18 bp, Homo sapiens
catctgtccatggccttt

SEQ ID NO: 4035811 - DNA, 15 bp, Homo sapiens
catctgttagggcct

SEQ ID NO: 4035812 - DNA, 16 bp, Homo sapiens
catctgttagggcctt

SEQ ID NO: 4035813 - DNA, 19 bp, Homo sapiens
catcttacttgagccttta

SEQ ID NO: 4035814 - DNA, 17 bp, Homo sapiens
catcttagacctccaca

SEQ ID NO: 4035815 - DNA, 20 bp, Homo sapiens
catcttattttcatgtatat

SEQ ID NO: 4035816 - DNA, 22 bp, Homo sapiens
catcttccaagggtactaagga

SEQ ID NO: 4035817 - DNA, 17 bp, Homo sapiens
catcttctgccttagtc

SEQ ID NO: 4035818 - DNA, 13 bp, Homo sapiens
catcttcttccca

SEQ ID NO: 4035819 - DNA, 22 bp, Homo sapiens
catcttgacagagcctgcccca

SEQ ID NO: 4035820 - DNA, 21 bp, Homo sapiens
catctttccatccattacctc

SEQ ID NO: 4035821 - DNA, 22 bp, Homo sapiens
catctttgccttgggctgctcc

SEQ ID NO: 4035822 - DNA, 23 bp, Homo sapiens
catctttgccttgggctgctcct

SEQ ID NO: 4035823 - DNA, 20 bp, Homo sapiens
catctttgttacttccttat

SEQ ID NO: 4035824 - DNA, 12 bp, Homo sapiens
catgaaaaagca

SEQ ID NO: 4035825 - DNA, 13 bp, Homo sapiens
catgaaaaagcag

SEQ ID NO: 4035826 - DNA, 19 bp, Homo sapiens
catgaaaaagcagctacca

SEQ ID NO: 4035827 - DNA, 17 bp, Homo sapiens
catgaaaacgttttatt

SEQ ID NO: 4035828 - DNA, 19 bp, Homo sapiens
catgaaaacgttttattgt

SEQ ID NO: 4035829 - DNA, 14 bp, Homo sapiens
catgaaaatgacat

SEQ ID NO: 4035830 - DNA, 13 bp, Homo sapiens
catgaaatatgca

SEQ ID NO: 4035831 - DNA, 14 bp, Homo sapiens
catgaaatatgcat

SEQ ID NO: 4035832 - DNA, 19 bp, Homo sapiens
catgaaattcttcctaatg

SEQ ID NO: 4035833 - DNA, 14 bp, Homo sapiens
catgaaatttttaa

SEQ ID NO: 4035834 - DNA, 17 bp, Homo sapiens
catgaacgttattatat

SEQ ID NO: 4035835 - DNA, 15 bp, Homo sapiens
catgaagaatagaaa

SEQ ID NO: 4035836 - DNA, 14 bp, Homo sapiens
catgaagacaggat

SEQ ID NO: 4035837 - DNA, 13 bp, Homo sapiens
catgaagaccaca

SEQ ID NO: 4035838 - DNA, 16 bp, Homo sapiens
catgaagctaataaaa

SEQ ID NO: 4035839 - DNA, 14 bp, Homo sapiens
catgaaggagtgaa

SEQ ID NO: 4035840 - DNA, 16 bp, Homo sapiens
catgaagtaaattatg

SEQ ID NO: 4035841 - DNA, 22 bp, Homo sapiens
catgaatggtatggaactctct

SEQ ID NO: 4035842 - DNA, 13 bp, Homo sapiens
catgaatgtatca

SEQ ID NO: 4035843 - DNA, 12 bp, Homo sapiens
catgaattccct

SEQ ID NO: 4035844 - DNA, 19 bp, Homo sapiens
catgacaactttgccagct

SEQ ID NO: 4035845 - DNA, 21 bp, Homo sapiens
catgacaactttgccagcttt

SEQ ID NO: 4035846 - DNA, 13 bp, Homo sapiens
catgacagaggct

SEQ ID NO: 4035847 - DNA, 22 bp, Homo sapiens
catgacagaggctgcacccctg

SEQ ID NO: 4035848 - DNA, 18 bp, Homo sapiens
catgacagcctgcagcag

SEQ ID NO: 4035849 - DNA, 18 bp, Homo sapiens
catgaccatactgaggga

SEQ ID NO: 4035850 - DNA, 21 bp, Homo sapiens
catgacccctcgtccaccccc

SEQ ID NO: 4035851 - DNA, 14 bp, Homo sapiens
catgacctgtgacc

SEQ ID NO: 4035852 - DNA, 16 bp, Homo sapiens
catgacctgtgaccag

SEQ ID NO: 4035853 - DNA, 23 bp, Homo sapiens
catgactgcacccagctccaggg

SEQ ID NO: 4035854 - DNA, 13 bp, Homo sapiens
catgactgggcct

SEQ ID NO: 4035855 - DNA, 17 bp, Homo sapiens
catgactgggcctccct

SEQ ID NO: 4035856 - DNA, 19 bp, Homo sapiens
catgactgtgaccaccttc

SEQ ID NO: 4035857 - DNA, 20 bp, Homo sapiens
catgactgtgaccaccttct

SEQ ID NO: 4035858 - DNA, 14 bp, Homo sapiens
catgacttgtgtgt

SEQ ID NO: 4035859 - DNA, 13 bp, Homo sapiens
catgagaaagaat

SEQ ID NO: 4035860 - DNA, 16 bp, Homo sapiens
catgagaacaaacaga

SEQ ID NO: 4035861 - DNA, 23 bp, Homo sapiens
catgagaccctggtgcctggctc

SEQ ID NO: 4035862 - DNA, 15 bp, Homo sapiens
catgagactttctgc

SEQ ID NO: 4035863 - DNA, 13 bp, Homo sapiens
catgagcctgccc

SEQ ID NO: 4035864 - DNA, 18 bp, Homo sapiens
catgagcctgctggaagc

SEQ ID NO: 4035865 - DNA, 23 bp, Homo sapiens
catgagctatttccattccagaa

SEQ ID NO: 4035866 - DNA, 22 bp, Homo sapiens
catgaggcaatgtcaggaacag

SEQ ID NO: 4035867 - DNA, 14 bp, Homo sapiens
catgaggccatctc

SEQ ID NO: 4035868 - DNA, 15 bp, Homo sapiens
catgaggccatctca

SEQ ID NO: 4035869 - DNA, 16 bp, Homo sapiens
catgaggccatctcag

SEQ ID NO: 4035870 - DNA, 20 bp, Homo sapiens
catgaggccatctcaggaga

SEQ ID NO: 4035871 - DNA, 17 bp, Homo sapiens
catgagggacagggtct

SEQ ID NO: 4035872 - DNA, 19 bp, Homo sapiens
catgagggacagggtcttt

SEQ ID NO: 4035873 - DNA, 13 bp, Homo sapiens
catgaggggagag

SEQ ID NO: 4035874 - DNA, 14 bp, Homo sapiens
catgaggggagagg

SEQ ID NO: 4035875 - DNA, 21 bp, Homo sapiens
catgagttggggtctggcagc

SEQ ID NO: 4035876 - DNA, 13 bp, Homo sapiens
catgataaatgat

SEQ ID NO: 4035877 - DNA, 21 bp, Homo sapiens
catgatccacactttgggctt

SEQ ID NO: 4035878 - DNA, 21 bp, Homo sapiens
catgatccctgtgttgtctct

SEQ ID NO: 4035879 - DNA, 12 bp, Homo sapiens
catgatctgtat

SEQ ID NO: 4035880 - DNA, 19 bp, Homo sapiens
catgatggcaacagatctg

SEQ ID NO: 4035881 - DNA, 12 bp, Homo sapiens
catgatgggaaa

SEQ ID NO: 4035882 - DNA, 17 bp, Homo sapiens
catgatgggaaaatatt

SEQ ID NO: 4035883 - DNA, 20 bp, Homo sapiens
catgatgggaaaatatttcc

SEQ ID NO: 4035884 - DNA, 20 bp, Homo sapiens
catgatgggaatagggagac

SEQ ID NO: 4035885 - DNA, 23 bp, Homo sapiens
catgatgggaatagggagacagg

SEQ ID NO: 4035886 - DNA, 14 bp, Homo sapiens
catgattctattta

SEQ ID NO: 4035887 - DNA, 12 bp, Homo sapiens
catgatttcctt

SEQ ID NO: 4035888 - DNA, 14 bp, Homo sapiens
catgatttccttga

SEQ ID NO: 4035889 - DNA, 18 bp, Homo sapiens
catgatttccttgaatgt

SEQ ID NO: 4035890 - DNA, 16 bp, Homo sapiens
catgcaaaaagaaatg

SEQ ID NO: 4035891 - DNA, 15 bp, Homo sapiens
catgcaactggagtt

SEQ ID NO: 4035892 - DNA, 22 bp, Homo sapiens
catgcacccctgagccagcagg

SEQ ID NO: 4035893 - DNA, 23 bp, Homo sapiens
catgcacccctgagccagcaggg

SEQ ID NO: 4035894 - DNA, 17 bp, Homo sapiens
catgcactgtgaaggac

SEQ ID NO: 4035895 - DNA, 18 bp, Homo sapiens
catgcactgtgaaggacc

SEQ ID NO: 4035896 - DNA, 20 bp, Homo sapiens
catgcactgtgaaggaccct

SEQ ID NO: 4035897 - DNA, 22 bp, Homo sapiens
catgcactgtgaaggacccttg

SEQ ID NO: 4035898 - DNA, 22 bp, Homo sapiens
catgcagcccatgcccacctgc

SEQ ID NO: 4035899 - DNA, 23 bp, Homo sapiens
catgcagcctaaagtacagcctg

SEQ ID NO: 4035900 - DNA, 23 bp, Homo sapiens
catgcagtctaaaatgcttcagt

SEQ ID NO: 4035901 - DNA, 15 bp, Homo sapiens
catgcataaatatgc

SEQ ID NO: 4035902 - DNA, 16 bp, Homo sapiens
catgcatgccctctct

SEQ ID NO: 4035903 - DNA, 11 bp, Homo sapiens
catgcattgtt

SEQ ID NO: 4035904 - DNA, 14 bp, Homo sapiens
catgcattgttggc

SEQ ID NO: 4035905 - DNA, 19 bp, Homo sapiens
catgcattttgcagcagtg

SEQ ID NO: 4035906 - DNA, 12 bp, Homo sapiens
catgccaaggcc

SEQ ID NO: 4035907 - DNA, 23 bp, Homo sapiens
catgccaaggcctccctcaggct

SEQ ID NO: 4035908 - DNA, 21 bp, Homo sapiens
catgccaccatggccagccaa

SEQ ID NO: 4035909 - DNA, 12 bp, Homo sapiens
catgccaccctc

SEQ ID NO: 4035910 - DNA, 13 bp, Homo sapiens
catgccaccctca

SEQ ID NO: 4035911 - DNA, 15 bp, Homo sapiens
catgccaccctcaca

SEQ ID NO: 4035912 - DNA, 19 bp, Homo sapiens
catgccacgttccacagtt

SEQ ID NO: 4035913 - DNA, 14 bp, Homo sapiens
catgccactgcctg

SEQ ID NO: 4035914 - DNA, 21 bp, Homo sapiens
catgccagattctgcctctct

SEQ ID NO: 4035915 - DNA, 13 bp, Homo sapiens
catgccaggaacc

SEQ ID NO: 4035916 - DNA, 13 bp, Homo sapiens
catgcccaccccc

SEQ ID NO: 4035917 - DNA, 16 bp, Homo sapiens
catgcccaccccctgc

SEQ ID NO: 4035918 - DNA, 17 bp, Homo sapiens
catgcccaccccctgcc

SEQ ID NO: 4035919 - DNA, 23 bp, Homo sapiens
catgcccaccccctgccctgcac

SEQ ID NO: 4035920 - DNA, 13 bp, Homo sapiens
catgcccacctgc

SEQ ID NO: 4035921 - DNA, 17 bp, Homo sapiens
catgcccacctgcccat

SEQ ID NO: 4035922 - DNA, 13 bp, Homo sapiens
catgcccactgct

SEQ ID NO: 4035923 - DNA, 13 bp, Homo sapiens
catgccccagtcg

SEQ ID NO: 4035924 - DNA, 14 bp, Homo sapiens
catgcccgccagtg

SEQ ID NO: 4035925 - DNA, 22 bp, Homo sapiens
catgccctctctgagtctggac

SEQ ID NO: 4035926 - DNA, 11 bp, Homo sapiens
catgcctgagg

SEQ ID NO: 4035927 - DNA, 12 bp, Homo sapiens
catgcctgcgcc

SEQ ID NO: 4035928 - DNA, 20 bp, Homo sapiens
catgcctgcgcctgctgcct

SEQ ID NO: 4035929 - DNA, 19 bp, Homo sapiens
catgcctttcatagtttat

SEQ ID NO: 4035930 - DNA, 13 bp, Homo sapiens
catgcctttgtaa

SEQ ID NO: 4035931 - DNA, 15 bp, Homo sapiens
catgcctttgtaagt

SEQ ID NO: 4035932 - DNA, 15 bp, Homo sapiens
catgcggtagccagc

SEQ ID NO: 4035933 - DNA, 16 bp, Homo sapiens
catgcggtagccagca

SEQ ID NO: 4035934 - DNA, 15 bp, Homo sapiens
catgctcaaccactg

SEQ ID NO: 4035935 - DNA, 17 bp, Homo sapiens
catgctcaaccactgtg

SEQ ID NO: 4035936 - DNA, 19 bp, Homo sapiens
catgctcaaccactgtggc

SEQ ID NO: 4035937 - DNA, 12 bp, Homo sapiens
catgctccaaat

SEQ ID NO: 4035938 - DNA, 15 bp, Homo sapiens
catgctccaaatata

SEQ ID NO: 4035939 - DNA, 18 bp, Homo sapiens
catgctcccctgtgccag

SEQ ID NO: 4035940 - DNA, 19 bp, Homo sapiens
catgctcccctgtgccagc

SEQ ID NO: 4035941 - DNA, 14 bp, Homo sapiens
catgctcctcacct

SEQ ID NO: 4035942 - DNA, 18 bp, Homo sapiens
catgctgaagggaccttg

SEQ ID NO: 4035943 - DNA, 13 bp, Homo sapiens
catgctgggattt

SEQ ID NO: 4035944 - DNA, 19 bp, Homo sapiens
catgctgggccactgggga

SEQ ID NO: 4035945 - DNA, 21 bp, Homo sapiens
catgctgggccactggggact

SEQ ID NO: 4035946 - DNA, 14 bp, Homo sapiens
catgcttcccagag

SEQ ID NO: 4035947 - DNA, 16 bp, Homo sapiens
catgcttcccagaggg

SEQ ID NO: 4035948 - DNA, 14 bp, Homo sapiens
catggaaaaatggt

SEQ ID NO: 4035949 - DNA, 12 bp, Homo sapiens
catggacactcc

SEQ ID NO: 4035950 - DNA, 18 bp, Homo sapiens
catggacactccagtgcc

SEQ ID NO: 4035951 - DNA, 19 bp, Homo sapiens
catggacactccagtgcca

SEQ ID NO: 4035952 - DNA, 14 bp, Homo sapiens
catggacaggctgg

SEQ ID NO: 4035953 - DNA, 24 bp, Homo sapiens
catggacgcaccggcctggctgca

SEQ ID NO: 4035954 - DNA, 14 bp, Homo sapiens
catggactgttgcc

SEQ ID NO: 4035955 - DNA, 15 bp, Homo sapiens
catggagactcctgc

SEQ ID NO: 4035956 - DNA, 19 bp, Homo sapiens
catggagactcctgccctg

SEQ ID NO: 4035957 - DNA, 21 bp, Homo sapiens
catggagactcctgccctgtt

SEQ ID NO: 4035958 - DNA, 13 bp, Homo sapiens
catggaggccctc

SEQ ID NO: 4035959 - DNA, 22 bp, Homo sapiens
catggagtagaggtactagaat

SEQ ID NO: 4035960 - DNA, 21 bp, Homo sapiens
catggagtgtgtattgttccc

SEQ ID NO: 4035961 - DNA, 21 bp, Homo sapiens
catggatttttacaagatcca

SEQ ID NO: 4035962 - DNA, 19 bp, Homo sapiens
catggcagctgtttctcat

SEQ ID NO: 4035963 - DNA, 20 bp, Homo sapiens
catggcagctgtttctcatg

SEQ ID NO: 4035964 - DNA, 15 bp, Homo sapiens
catggccaggtggcc

SEQ ID NO: 4035965 - DNA, 20 bp, Homo sapiens
catggccccatcccagttgg

SEQ ID NO: 4035966 - DNA, 18 bp, Homo sapiens
catggcccccaggggcag

SEQ ID NO: 4035967 - DNA, 20 bp, Homo sapiens
catggcccccaggggcagga

SEQ ID NO: 4035968 - DNA, 23 bp, Homo sapiens
catggcccccaggggcaggactg

SEQ ID NO: 4035969 - DNA, 12 bp, Homo sapiens
catggcccctct

SEQ ID NO: 4035970 - DNA, 14 bp, Homo sapiens
catggccctggggt

SEQ ID NO: 4035971 - DNA, 19 bp, Homo sapiens
catggccctgtcccaggcc

SEQ ID NO: 4035972 - DNA, 21 bp, Homo sapiens
catggcctattatattaaaat

SEQ ID NO: 4035973 - DNA, 21 bp, Homo sapiens
catggcgaaaacatctcctta

SEQ ID NO: 4035974 - DNA, 18 bp, Homo sapiens
catggctaatttaacacc

SEQ ID NO: 4035975 - DNA, 18 bp, Homo sapiens
catggctagcctttcttg

SEQ ID NO: 4035976 - DNA, 15 bp, Homo sapiens
catggctcagagctt

SEQ ID NO: 4035977 - DNA, 17 bp, Homo sapiens
catggctccagaaatgt

SEQ ID NO: 4035978 - DNA, 22 bp, Homo sapiens
catggcttctgaacctgtcttt

SEQ ID NO: 4035979 - DNA, 20 bp, Homo sapiens
catgggagccagctgctttt

SEQ ID NO: 4035980 - DNA, 13 bp, Homo sapiens
catgggcagccca

SEQ ID NO: 4035981 - DNA, 23 bp, Homo sapiens
catgggcataggtaagctgtgcc

SEQ ID NO: 4035982 - DNA, 13 bp, Homo sapiens
catgggcctggcc

SEQ ID NO: 4035983 - DNA, 23 bp, Homo sapiens
catgggcctggccacctctctcc

SEQ ID NO: 4035984 - DNA, 24 bp, Homo sapiens
catgggcctggccacctctctcct

SEQ ID NO: 4035985 - DNA, 15 bp, Homo sapiens
catgggctcctgccc

SEQ ID NO: 4035986 - DNA, 15 bp, Homo sapiens
catgggcttcactgt

SEQ ID NO: 4035987 - DNA, 17 bp, Homo sapiens
catgggcttcactgtat

SEQ ID NO: 4035988 - DNA, 23 bp, Homo sapiens
catgggcttcactgtataaatag

SEQ ID NO: 4035989 - DNA, 19 bp, Homo sapiens
catggggatcaattttcat

SEQ ID NO: 4035990 - DNA, 20 bp, Homo sapiens
catggggccctcccagaacc

SEQ ID NO: 4035991 - DNA, 17 bp, Homo sapiens
catgggggcacttgagt

SEQ ID NO: 4035992 - DNA, 21 bp, Homo sapiens
catggggtggggtagggctga

SEQ ID NO: 4035993 - DNA, 14 bp, Homo sapiens
catgggtccagggc

SEQ ID NO: 4035994 - DNA, 21 bp, Homo sapiens
catgggtccagggcctgacac

SEQ ID NO: 4035995 - DNA, 21 bp, Homo sapiens
catgggtcctagcccttccct

SEQ ID NO: 4035996 - DNA, 22 bp, Homo sapiens
catgggtcctagcccttccctg

SEQ ID NO: 4035997 - DNA, 22 bp, Homo sapiens
catgggtgaagggagagccagc

SEQ ID NO: 4035998 - DNA, 16 bp, Homo sapiens
catggtcaaccctcag

SEQ ID NO: 4035999 - DNA, 20 bp, Homo sapiens
catggtgagaccctgtctct

SEQ ID NO: 4036000 - DNA, 16 bp, Homo sapiens
catggtgcctgagagg

SEQ ID NO: 4036001 - DNA, 18 bp, Homo sapiens
catggtgcctgagaggca

SEQ ID NO: 4036002 - DNA, 14 bp, Homo sapiens
catggtgctagtgg

SEQ ID NO: 4036003 - DNA, 16 bp, Homo sapiens
catggtggacccagcg

SEQ ID NO: 4036004 - DNA, 19 bp, Homo sapiens
catggtggctcatgcctgt

SEQ ID NO: 4036005 - DNA, 16 bp, Homo sapiens
catggtgtaataagac

SEQ ID NO: 4036006 - DNA, 21 bp, Homo sapiens
catggtgtaataagacataac

SEQ ID NO: 4036007 - DNA, 14 bp, Homo sapiens
catgtaaaagagtc

SEQ ID NO: 4036008 - DNA, 21 bp, Homo sapiens
catgtaaactatttgtggcaa

SEQ ID NO: 4036009 - DNA, 16 bp, Homo sapiens
catgtaaagaaatgtc

SEQ ID NO: 4036010 - DNA, 22 bp, Homo sapiens
catgtaaccggcatgtttccag

SEQ ID NO: 4036011 - DNA, 22 bp, Homo sapiens
catgtaataaaaagtatatgtt

SEQ ID NO: 4036012 - DNA, 14 bp, Homo sapiens
catgtaatcctcaa

SEQ ID NO: 4036013 - DNA, 15 bp, Homo sapiens
catgtacatgaagaa

SEQ ID NO: 4036014 - DNA, 19 bp, Homo sapiens
catgtactgagccttgtaa

SEQ ID NO: 4036015 - DNA, 23 bp, Homo sapiens
catgtactgagccttgtaattct

SEQ ID NO: 4036016 - DNA, 13 bp, Homo sapiens
catgtacttgttt

SEQ ID NO: 4036017 - DNA, 21 bp, Homo sapiens
catgtacttgtttgcaagcag

SEQ ID NO: 4036018 - DNA, 13 bp, Homo sapiens
catgtagagaaaa

SEQ ID NO: 4036019 - DNA, 15 bp, Homo sapiens
catgtagcttcttct

SEQ ID NO: 4036020 - DNA, 19 bp, Homo sapiens
catgtagcttcttctgaaa

SEQ ID NO: 4036021 - DNA, 14 bp, Homo sapiens
catgtataaatgtg

SEQ ID NO: 4036022 - DNA, 21 bp, Homo sapiens
catgtatcccaactcctataa

SEQ ID NO: 4036023 - DNA, 22 bp, Homo sapiens
catgtatggaatcccactgtat

SEQ ID NO: 4036024 - DNA, 13 bp, Homo sapiens
catgtatgttatg

SEQ ID NO: 4036025 - DNA, 13 bp, Homo sapiens
catgtattcatcc

SEQ ID NO: 4036026 - DNA, 16 bp, Homo sapiens
catgtattcatccaga

SEQ ID NO: 4036027 - DNA, 17 bp, Homo sapiens
catgtattcatccagag

SEQ ID NO: 4036028 - DNA, 18 bp, Homo sapiens
catgtattcatccagagt

SEQ ID NO: 4036029 - DNA, 23 bp, Homo sapiens
catgtattcatccagagttctta

SEQ ID NO: 4036030 - DNA, 15 bp, Homo sapiens
catgtatttatctct

SEQ ID NO: 4036031 - DNA, 23 bp, Homo sapiens
catgtatttatctctatttaata

SEQ ID NO: 4036032 - DNA, 17 bp, Homo sapiens
cagtcgcctgcctgcag

SEQ ID NO: 4036033 - DNA, 23 bp, Homo sapiens
cagtcgcctttcagcaggcagcc

SEQ ID NO: 4036034 - DNA, 14 bp, Homo sapiens
cagtcggccccatc

SEQ ID NO: 4036035 - DNA, 23 bp, Homo sapiens
cagtcgtaaaagagataataaga

SEQ ID NO: 4036036 - DNA, 21 bp, Homo sapiens
cagtcgtggttgggaacacag

SEQ ID NO: 4036037 - DNA, 23 bp, Homo sapiens
cagtctcaaaaatacaaaataaa

SEQ ID NO: 4036038 - DNA, 21 bp, Homo sapiens
cagtctcaagaggcagagttc

SEQ ID NO: 4036039 - DNA, 21 bp, Homo sapiens
cagtctcccaggccccctgca

SEQ ID NO: 4036040 - DNA, 11 bp, Homo sapiens
cagtctccctt

SEQ ID NO: 4036041 - DNA, 18 bp, Homo sapiens
cagtctccctttcccttc

SEQ ID NO: 4036042 - DNA, 18 bp, Homo sapiens
cagtcttatgcttccaga

SEQ ID NO: 4036043 - DNA, 20 bp, Homo sapiens
cagtcttatgcttccagaaa

SEQ ID NO: 4036044 - DNA, 19 bp, Homo sapiens
cagtcttcacttgcactgg

SEQ ID NO: 4036045 - DNA, 21 bp, Homo sapiens
cagtcttcacttgcactgggg

SEQ ID NO: 4036046 - DNA, 22 bp, Homo sapiens
cagtcttcacttgcactggggg

SEQ ID NO: 4036047 - DNA, 15 bp, Homo sapiens
cagtcttgaatttct

SEQ ID NO: 4036048 - DNA, 17 bp, Homo sapiens
cagtcttggtggttcta

SEQ ID NO: 4036049 - DNA, 16 bp, Homo sapiens
cagtgaactcctgcca

SEQ ID NO: 4036050 - DNA, 17 bp, Homo sapiens
cagtgaactcctgccag

SEQ ID NO: 4036051 - DNA, 21 bp, Homo sapiens
cagtgaactcctgccaggcac

SEQ ID NO: 4036052 - DNA, 12 bp, Homo sapiens
cagtgaagcctc

SEQ ID NO: 4036053 - DNA, 15 bp, Homo sapiens
cagtgacagacaggc

SEQ ID NO: 4036054 - DNA, 21 bp, Homo sapiens
cagtgacctttgacctcggtg

SEQ ID NO: 4036055 - DNA, 13 bp, Homo sapiens
cagtgaccttttc

SEQ ID NO: 4036056 - DNA, 14 bp, Homo sapiens
cagtgactgaaacc

SEQ ID NO: 4036057 - DNA, 21 bp, Homo sapiens
cagtgagaaaaagctcctgtc

SEQ ID NO: 4036058 - DNA, 16 bp, Homo sapiens
cagtgagcctcctgtg

SEQ ID NO: 4036059 - DNA, 19 bp, Homo sapiens
cagtgagcctcctgtgcct

SEQ ID NO: 4036060 - DNA, 14 bp, Homo sapiens
cagtgagctggaga

SEQ ID NO: 4036061 - DNA, 21 bp, Homo sapiens
cagtgagggagggctgtcatc

SEQ ID NO: 4036062 - DNA, 16 bp, Homo sapiens
cagtgagggtcttctt

SEQ ID NO: 4036063 - DNA, 20 bp, Homo sapiens
cagtgagtaatcaatacaga

SEQ ID NO: 4036064 - DNA, 18 bp, Homo sapiens
cagtgagttacagcgaga

SEQ ID NO: 4036065 - DNA, 18 bp, Homo sapiens
cagtgataatgccccaag

SEQ ID NO: 4036066 - DNA, 19 bp, Homo sapiens
cagtgataatgccccaagg

SEQ ID NO: 4036067 - DNA, 20 bp, Homo sapiens
cagtgataatgccccaagga

SEQ ID NO: 4036068 - DNA, 19 bp, Homo sapiens
cagtgataggcccaaggtc

SEQ ID NO: 4036069 - DNA, 20 bp, Homo sapiens
cagtgatatggcagaagaca

SEQ ID NO: 4036070 - DNA, 23 bp, Homo sapiens
cagtgatatggcagaagacacca

SEQ ID NO: 4036071 - DNA, 17 bp, Homo sapiens
cagtgatctcagggcag

SEQ ID NO: 4036072 - DNA, 15 bp, Homo sapiens
cagtgatctccatat

SEQ ID NO: 4036073 - DNA, 22 bp, Homo sapiens
cagtgcaatggtataaatttca

SEQ ID NO: 4036074 - DNA, 12 bp, Homo sapiens
cagtgcagacag

SEQ ID NO: 4036075 - DNA, 12 bp, Homo sapiens
cagtgcatctca

SEQ ID NO: 4036076 - DNA, 19 bp, Homo sapiens
cagtgccaaatgctggggc

SEQ ID NO: 4036077 - DNA, 20 bp, Homo sapiens
cagtgccaaatgctggggca

SEQ ID NO: 4036078 - DNA, 17 bp, Homo sapiens
cagtgccaactcctcac

SEQ ID NO: 4036079 - DNA, 15 bp, Homo sapiens
cagtgccagcaatga

SEQ ID NO: 4036080 - DNA, 14 bp, Homo sapiens
cagtgccccaggga

SEQ ID NO: 4036081 - DNA, 16 bp, Homo sapiens
cagtgccccagggagt

SEQ ID NO: 4036082 - DNA, 21 bp, Homo sapiens
cagtgccccagggagtccagg

SEQ ID NO: 4036083 - DNA, 23 bp, Homo sapiens
cagtgccccagggagtccagggt

SEQ ID NO: 4036084 - DNA, 20 bp, Homo sapiens
cagtgcccccactgaccaga

SEQ ID NO: 4036085 - DNA, 21 bp, Homo sapiens
cagtgcctggatcccctctgt

SEQ ID NO: 4036086 - DNA, 17 bp, Homo sapiens
cagtgccttccataatt

SEQ ID NO: 4036087 - DNA, 11 bp, Homo sapiens
cagtgccttct

SEQ ID NO: 4036088 - DNA, 21 bp, Homo sapiens
cagtgccttgctcggcgccca

SEQ ID NO: 4036089 - DNA, 17 bp, Homo sapiens
cagtgccttttggaact

SEQ ID NO: 4036090 - DNA, 16 bp, Homo sapiens
cagtgcgggtgcagac

SEQ ID NO: 4036091 - DNA, 15 bp, Homo sapiens
cagtgctaaagcctg

SEQ ID NO: 4036092 - DNA, 17 bp, Homo sapiens
cagtgctcaccagccct

SEQ ID NO: 4036093 - DNA, 21 bp, Homo sapiens
cagtgctcaccagccctgcag

SEQ ID NO: 4036094 - DNA, 15 bp, Homo sapiens
cagtgctctctccac

SEQ ID NO: 4036095 - DNA, 16 bp, Homo sapiens
cagtgctctgcctcag

SEQ ID NO: 4036096 - DNA, 23 bp, Homo sapiens
cagtgctgaccagacagcctccc

SEQ ID NO: 4036097 - DNA, 15 bp, Homo sapiens
cagtgctgggaccag

SEQ ID NO: 4036098 - DNA, 17 bp, Homo sapiens
cagtgctgggaccagag

SEQ ID NO: 4036099 - DNA, 19 bp, Homo sapiens
cagtgctgggaccagagcc

SEQ ID NO: 4036100 - DNA, 22 bp, Homo sapiens
cagtgctgggaccagagccaga

SEQ ID NO: 4036101 - DNA, 19 bp, Homo sapiens
cagtggactcagcagtgac

SEQ ID NO: 4036102 - DNA, 13 bp, Homo sapiens
cagtggagcccag

SEQ ID NO: 4036103 - DNA, 15 bp, Homo sapiens
cagtggaggaagagg

SEQ ID NO: 4036104 - DNA, 18 bp, Homo sapiens
cagtggagtaatttatgc

SEQ ID NO: 4036105 - DNA, 22 bp, Homo sapiens
cagtggagtaatttatgcctta

SEQ ID NO: 4036106 - DNA, 15 bp, Homo sapiens
cagtggatcccctgc

SEQ ID NO: 4036107 - DNA, 17 bp, Homo sapiens
cagtggattgtttatac

SEQ ID NO: 4036108 - DNA, 14 bp, Homo sapiens
cagtggccactcag

SEQ ID NO: 4036109 - DNA, 19 bp, Homo sapiens
cagtggcgttgttgcatgt

SEQ ID NO: 4036110 - DNA, 19 bp, Homo sapiens
cagtggcttcccagctctg

SEQ ID NO: 4036111 - DNA, 18 bp, Homo sapiens
cagtgggaccacatgcca

SEQ ID NO: 4036112 - DNA, 15 bp, Homo sapiens
cagtgggcatcagca

SEQ ID NO: 4036113 - DNA, 22 bp, Homo sapiens
cagtgggcgttgggagcctagc

SEQ ID NO: 4036114 - DNA, 17 bp, Homo sapiens
cagtggggaactgaggg

SEQ ID NO: 4036115 - DNA, 15 bp, Homo sapiens
cagtggggcctgtgg

SEQ ID NO: 4036116 - DNA, 19 bp, Homo sapiens
cagtgtacatagtgtaatg

SEQ ID NO: 4036117 - DNA, 23 bp, Homo sapiens
cagtgtacatggaataacatgta

SEQ ID NO: 4036118 - DNA, 16 bp, Homo sapiens
cagtgtagttaattta

SEQ ID NO: 4036119 - DNA, 20 bp, Homo sapiens
cagtgtatcaggtcagggac

SEQ ID NO: 4036120 - DNA, 12 bp, Homo sapiens
cagtgtcacctc

SEQ ID NO: 4036121 - DNA, 16 bp, Homo sapiens
cagtgtcccaggcagc

SEQ ID NO: 4036122 - DNA, 19 bp, Homo sapiens
cagtgtcccctccactgtc

SEQ ID NO: 4036123 - DNA, 20 bp, Homo sapiens
cagtgtcccctccactgtca

SEQ ID NO: 4036124 - DNA, 19 bp, Homo sapiens
cagtgtcctcttgctcaaa

SEQ ID NO: 4036125 - DNA, 20 bp, Homo sapiens
cagtgtccttagaacatttt

SEQ ID NO: 4036126 - DNA, 19 bp, Homo sapiens
cagtgtctataaaagaaac

SEQ ID NO: 4036127 - DNA, 13 bp, Homo sapiens
cagtgtctggctt

SEQ ID NO: 4036128 - DNA, 14 bp, Homo sapiens
cagtgtctggcttt

SEQ ID NO: 4036129 - DNA, 20 bp, Homo sapiens
cagtgtcttccataatgtat

SEQ ID NO: 4036130 - DNA, 19 bp, Homo sapiens
cagtgtgaatagcctggcc

SEQ ID NO: 4036131 - DNA, 18 bp, Homo sapiens
cagtgtgcacgagtggga

SEQ ID NO: 4036132 - DNA, 21 bp, Homo sapiens
cagtgtgcacgagtgggaagg

SEQ ID NO: 4036133 - DNA, 14 bp, Homo sapiens
cagtgtggagaccc

SEQ ID NO: 4036134 - DNA, 16 bp, Homo sapiens
cagtgtggggcagccg

SEQ ID NO: 4036135 - DNA, 18 bp, Homo sapiens
cagtgtggggcagccgtc

SEQ ID NO: 4036136 - DNA, 17 bp, Homo sapiens
cagtgttacctgtgtgc

SEQ ID NO: 4036137 - DNA, 19 bp, Homo sapiens
cagtgttacctgtgtgctt

SEQ ID NO: 4036138 - DNA, 14 bp, Homo sapiens
cagtgttccccatc

SEQ ID NO: 4036139 - DNA, 21 bp, Homo sapiens
cagtgttgtttgtaaataaga

SEQ ID NO: 4036140 - DNA, 14 bp, Homo sapiens
cagtgtttctgggg

SEQ ID NO: 4036141 - DNA, 17 bp, Homo sapiens
cagtgttttaaattctg

SEQ ID NO: 4036142 - DNA, 22 bp, Homo sapiens
cagtgttttctgggataagtaa

SEQ ID NO: 4036143 - DNA, 14 bp, Homo sapiens
cagttaaaatgtga

SEQ ID NO: 4036144 - DNA, 19 bp, Homo sapiens
cagttaactttaagactga

SEQ ID NO: 4036145 - DNA, 22 bp, Homo sapiens
cagttaactttcagaagagatg

SEQ ID NO: 4036146 - DNA, 22 bp, Homo sapiens
cagttaattactcagcagaatg

SEQ ID NO: 4036147 - DNA, 19 bp, Homo sapiens
cagttagggttgagttact

SEQ ID NO: 4036148 - DNA, 19 bp, Homo sapiens
cagttagttgtgaaagaaa

SEQ ID NO: 4036149 - DNA, 21 bp, Homo sapiens
cagttattcattctgtgatca

SEQ ID NO: 4036150 - DNA, 17 bp, Homo sapiens
cagttattgtccctggc

SEQ ID NO: 4036151 - DNA, 23 bp, Homo sapiens
cagttattgtccctggcttcctt

SEQ ID NO: 4036152 - DNA, 12 bp, Homo sapiens
cagttattttgg

SEQ ID NO: 4036153 - DNA, 17 bp, Homo sapiens
cagttattttggatata

SEQ ID NO: 4036154 - DNA, 22 bp, Homo sapiens
cagttattttggatatattatt

SEQ ID NO: 4036155 - DNA, 17 bp, Homo sapiens
cagttcaacctggtggc

SEQ ID NO: 4036156 - DNA, 21 bp, Homo sapiens
cagttcaacctggtggcacca

SEQ ID NO: 4036157 - DNA, 16 bp, Homo sapiens
cagttcatgtttgctt

SEQ ID NO: 4036158 - DNA, 23 bp, Homo sapiens
cagttccaatcagtagcttaaga

SEQ ID NO: 4036159 - DNA, 17 bp, Homo sapiens
cagttcccccaacctca

SEQ ID NO: 4036160 - DNA, 15 bp, Homo sapiens
cagttcccccagtac

SEQ ID NO: 4036161 - DNA, 14 bp, Homo sapiens
cagttcccttggcc

SEQ ID NO: 4036162 - DNA, 17 bp, Homo sapiens
cagttcccttggcctca

SEQ ID NO: 4036163 - DNA, 19 bp, Homo sapiens
cagttcccttggcctcaga

SEQ ID NO: 4036164 - DNA, 20 bp, Homo sapiens
cagttcccttggcctcagaa

SEQ ID NO: 4036165 - DNA, 18 bp, Homo sapiens
cagttctctcccttcctc

SEQ ID NO: 4036166 - DNA, 16 bp, Homo sapiens
cagttcttggtgactg

SEQ ID NO: 4036167 - DNA, 19 bp, Homo sapiens
cagttcttggtgctctgtg

SEQ ID NO: 4036168 - DNA, 17 bp, Homo sapiens
cagttctttgggccaga

SEQ ID NO: 4036169 - DNA, 14 bp, Homo sapiens
cagttgacagcagg

SEQ ID NO: 4036170 - DNA, 18 bp, Homo sapiens
cagttgcccagcctcttt

SEQ ID NO: 4036171 - DNA, 12 bp, Homo sapiens
cagttgccctag

SEQ ID NO: 4036172 - DNA, 17 bp, Homo sapiens
cagttgccctagcccag

SEQ ID NO: 4036173 - DNA, 22 bp, Homo sapiens
cagttgccttttatcccaaagt

SEQ ID NO: 4036174 - DNA, 19 bp, Homo sapiens
cagttggactctcagggat

SEQ ID NO: 4036175 - DNA, 22 bp, Homo sapiens
cagttggcagaaaggatgtttt

SEQ ID NO: 4036176 - DNA, 15 bp, Homo sapiens
cagttggcagacagc

SEQ ID NO: 4036177 - DNA, 22 bp, Homo sapiens
cagttgggacccaaaacacagg

SEQ ID NO: 4036178 - DNA, 16 bp, Homo sapiens
cagttgggagcactgg

SEQ ID NO: 4036179 - DNA, 17 bp, Homo sapiens
cagttgggagcactgga

SEQ ID NO: 4036180 - DNA, 18 bp, Homo sapiens
cagttgggagcactggag

SEQ ID NO: 4036181 - DNA, 19 bp, Homo sapiens
cagttggggaagccaggtg

SEQ ID NO: 4036182 - DNA, 23 bp, Homo sapiens
cagttgtagggttacagagacct

SEQ ID NO: 4036183 - DNA, 13 bp, Homo sapiens
cagttgttctttt

SEQ ID NO: 4036184 - DNA, 22 bp, Homo sapiens
cagtttcaggtgtttagttgca

SEQ ID NO: 4036185 - DNA, 23 bp, Homo sapiens
cagtttcataaaaggagaaccag

SEQ ID NO: 4036186 - DNA, 14 bp, Homo sapiens
cagtttcctggaaa

SEQ ID NO: 4036187 - DNA, 22 bp, Homo sapiens
cagtttcttactgttttgtatc

SEQ ID NO: 4036188 - DNA, 16 bp, Homo sapiens
cagtttgaagcctgtg

SEQ ID NO: 4036189 - DNA, 22 bp, Homo sapiens
cagtttgccacccctgtccaga

SEQ ID NO: 4036190 - DNA, 21 bp, Homo sapiens
cagtttgccggatacaaactg

SEQ ID NO: 4036191 - DNA, 21 bp, Homo sapiens
cagtttgctttgtatgcactt

SEQ ID NO: 4036192 - DNA, 22 bp, Homo sapiens
cagtttggagagtcagatcttt

SEQ ID NO: 4036193 - DNA, 15 bp, Homo sapiens
cagtttgtgtgtctt

SEQ ID NO: 4036194 - DNA, 16 bp, Homo sapiens
cagttttaactagaat

SEQ ID NO: 4036195 - DNA, 15 bp, Homo sapiens
cagttttatcatttt

SEQ ID NO: 4036196 - DNA, 23 bp, Homo sapiens
cagttttcaagtcaaattaataa

SEQ ID NO: 4036197 - DNA, 15 bp, Homo sapiens
cagttttccatgaaa

SEQ ID NO: 4036198 - DNA, 19 bp, Homo sapiens
cagttttggtgtgtaactt

SEQ ID NO: 4036199 - DNA, 19 bp, Homo sapiens
cataaaaacattttaaaaa

SEQ ID NO: 4036200 - DNA, 23 bp, Homo sapiens
cataaaaagcaaaacaaaaatta

SEQ ID NO: 4036201 - DNA, 17 bp, Homo sapiens
cataaaaagcagaattt

SEQ ID NO: 4036202 - DNA, 22 bp, Homo sapiens
cataaaaagcagaattttaatg

SEQ ID NO: 4036203 - DNA, 19 bp, Homo sapiens
cataaaaaggacatcagca

SEQ ID NO: 4036204 - DNA, 20 bp, Homo sapiens
cataaaagggtcaaacctgt

SEQ ID NO: 4036205 - DNA, 19 bp, Homo sapiens
cataaaataaagtatatat

SEQ ID NO: 4036206 - DNA, 14 bp, Homo sapiens
cataaaatcaaaac

SEQ ID NO: 4036207 - DNA, 22 bp, Homo sapiens
cataaaatcaaaacaagtgaaa

SEQ ID NO: 4036208 - DNA, 12 bp, Homo sapiens
cataaagtactt

SEQ ID NO: 4036209 - DNA, 18 bp, Homo sapiens
cataaataaaactgaatc

SEQ ID NO: 4036210 - DNA, 16 bp, Homo sapiens
cataaatccagttcta

SEQ ID NO: 4036211 - DNA, 22 bp, Homo sapiens
cataacaccaatcccagggctg

SEQ ID NO: 4036212 - DNA, 15 bp, Homo sapiens
cataacgtttttcct

SEQ ID NO: 4036213 - DNA, 17 bp, Homo sapiens
cataactcctgtccctt

SEQ ID NO: 4036214 - DNA, 22 bp, Homo sapiens
cataactcctgtcccttttccc

SEQ ID NO: 4036215 - DNA, 18 bp, Homo sapiens
cataactctgtaaaaaca

SEQ ID NO: 4036216 - DNA, 14 bp, Homo sapiens
cataactgccttga

SEQ ID NO: 4036217 - DNA, 14 bp, Homo sapiens
cataacttcctgta

SEQ ID NO: 4036218 - DNA, 12 bp, Homo sapiens
cataagaatgaa

SEQ ID NO: 4036219 - DNA, 12 bp, Homo sapiens
cataagaatttt

SEQ ID NO: 4036220 - DNA, 21 bp, Homo sapiens
cataagaccataacagccaac

SEQ ID NO: 4036221 - DNA, 20 bp, Homo sapiens
cataagaccctaagcctcct

SEQ ID NO: 4036222 - DNA, 18 bp, Homo sapiens
cataagcttatgcttaaa

SEQ ID NO: 4036223 - DNA, 22 bp, Homo sapiens
cataaggaatgtagctggtttc

SEQ ID NO: 4036224 - DNA, 23 bp, Homo sapiens
cataaggacgtgtgtaaatatgt

SEQ ID NO: 4036225 - DNA, 14 bp, Homo sapiens
cataagttgcattt

SEQ ID NO: 4036226 - DNA, 21 bp, Homo sapiens
cataataaaaaattatgacaa

SEQ ID NO: 4036227 - DNA, 13 bp, Homo sapiens
cataataaagcaa

SEQ ID NO: 4036228 - DNA, 14 bp, Homo sapiens
cataataaagcaat

SEQ ID NO: 4036229 - DNA, 18 bp, Homo sapiens
cataataaatatctgtac

SEQ ID NO: 4036230 - DNA, 14 bp, Homo sapiens
cataataaatcaca

SEQ ID NO: 4036231 - DNA, 17 bp, Homo sapiens
cataataagctaaagag

SEQ ID NO: 4036232 - DNA, 17 bp, Homo sapiens
cataatgataaaataaa

SEQ ID NO: 4036233 - DNA, 19 bp, Homo sapiens
cataatgataaaataaata

SEQ ID NO: 4036234 - DNA, 18 bp, Homo sapiens
cataatgctaatttaaag

SEQ ID NO: 4036235 - DNA, 20 bp, Homo sapiens
cataatgctaatttaaagag

SEQ ID NO: 4036236 - DNA, 22 bp, Homo sapiens
caggtggggagtccagggctcc

SEQ ID NO: 4036237 - DNA, 21 bp, Homo sapiens
caggtgggggttgctgtataa

SEQ ID NO: 4036238 - DNA, 16 bp, Homo sapiens
caggtggtcctgagac

SEQ ID NO: 4036239 - DNA, 16 bp, Homo sapiens
caggtgtcatggactg

SEQ ID NO: 4036240 - DNA, 21 bp, Homo sapiens
caggtgtcatggactgttgcc

SEQ ID NO: 4036241 - DNA, 16 bp, Homo sapiens
caggtgtgagggcagt

SEQ ID NO: 4036242 - DNA, 20 bp, Homo sapiens
caggtgtgtccacctgggca

SEQ ID NO: 4036243 - DNA, 20 bp, Homo sapiens
caggtgttttaagactgaat

SEQ ID NO: 4036244 - DNA, 17 bp, Homo sapiens
caggttcccaagctcag

SEQ ID NO: 4036245 - DNA, 16 bp, Homo sapiens
caggttcccccagcaa

SEQ ID NO: 4036246 - DNA, 15 bp, Homo sapiens
caggttctattttct

SEQ ID NO: 4036247 - DNA, 22 bp, Homo sapiens
caggttgaagacctaaccaggg

SEQ ID NO: 4036248 - DNA, 11 bp, Homo sapiens
caggttgacag

SEQ ID NO: 4036249 - DNA, 16 bp, Homo sapiens
caggttgacaggaggt

SEQ ID NO: 4036250 - DNA, 22 bp, Homo sapiens
caggttggatgggagtgggcac

SEQ ID NO: 4036251 - DNA, 17 bp, Homo sapiens
caggtttgtcatcagat

SEQ ID NO: 4036252 - DNA, 13 bp, Homo sapiens
cagtaaacctgtc

SEQ ID NO: 4036253 - DNA, 20 bp, Homo sapiens
cagtaaatcttttacaactg

SEQ ID NO: 4036254 - DNA, 13 bp, Homo sapiens
cagtaacacaggc

SEQ ID NO: 4036255 - DNA, 21 bp, Homo sapiens
cagtaacgcgtcttcctgagt

SEQ ID NO: 4036256 - DNA, 9 bp, Homo sapiens
cagtaactg

SEQ ID NO: 4036257 - DNA, 18 bp, Homo sapiens
cagtaactgttttttaag

SEQ ID NO: 4036258 - DNA, 14 bp, Homo sapiens
cagtaagtttcccc

SEQ ID NO: 4036259 - DNA, 22 bp, Homo sapiens
cagtaagtttcccctctggctt

SEQ ID NO: 4036260 - DNA, 23 bp, Homo sapiens
cagtaagtttcccctctggcttg

SEQ ID NO: 4036261 - DNA, 20 bp, Homo sapiens
cagtaatatttatatattta

SEQ ID NO: 4036262 - DNA, 20 bp, Homo sapiens
cagtaatctaggtgtggctg

SEQ ID NO: 4036263 - DNA, 16 bp, Homo sapiens
cagtaatgactctctg

SEQ ID NO: 4036264 - DNA, 15 bp, Homo sapiens
cagtaccctctcagc

SEQ ID NO: 4036265 - DNA, 22 bp, Homo sapiens
cagtacctataaagtaaagcta

SEQ ID NO: 4036266 - DNA, 15 bp, Homo sapiens
cagtacctccaagca

SEQ ID NO: 4036267 - DNA, 23 bp, Homo sapiens
cagtacctgggtccccagccctt

SEQ ID NO: 4036268 - DNA, 13 bp, Homo sapiens
cagtaccttgctt

SEQ ID NO: 4036269 - DNA, 16 bp, Homo sapiens
cagtacctttgtcaca

SEQ ID NO: 4036270 - DNA, 19 bp, Homo sapiens
cagtagaaataatatgcat

SEQ ID NO: 4036271 - DNA, 14 bp, Homo sapiens
cagtagaactgtct

SEQ ID NO: 4036272 - DNA, 23 bp, Homo sapiens
cagtagaggctatggacagggca

SEQ ID NO: 4036273 - DNA, 15 bp, Homo sapiens
cagtagagtcatctc

SEQ ID NO: 4036274 - DNA, 16 bp, Homo sapiens
cagtagagtcatctcc

SEQ ID NO: 4036275 - DNA, 17 bp, Homo sapiens
cagtagatgtgcttctg

SEQ ID NO: 4036276 - DNA, 15 bp, Homo sapiens
cagtagattgcagaa

SEQ ID NO: 4036277 - DNA, 16 bp, Homo sapiens
cagtagattgcagaaa

SEQ ID NO: 4036278 - DNA, 18 bp, Homo sapiens
cagtagcttaagaaaaaa

SEQ ID NO: 4036279 - DNA, 19 bp, Homo sapiens
cagtaggggcttataataa

SEQ ID NO: 4036280 - DNA, 22 bp, Homo sapiens
cagtaggggcttataataaagg

SEQ ID NO: 4036281 - DNA, 22 bp, Homo sapiens
cagtaggtgacactatagttta

SEQ ID NO: 4036282 - DNA, 22 bp, Homo sapiens
cagtagtagcctccaggtttcc

SEQ ID NO: 4036283 - DNA, 15 bp, Homo sapiens
cagtatatttatagt

SEQ ID NO: 4036284 - DNA, 13 bp, Homo sapiens
cagtatcatctcc

SEQ ID NO: 4036285 - DNA, 19 bp, Homo sapiens
cagtatcatgccctgtgca

SEQ ID NO: 4036286 - DNA, 20 bp, Homo sapiens
cagtatgagtcaatgtgcag

SEQ ID NO: 4036287 - DNA, 21 bp, Homo sapiens
cagtatgagtcaatgtgcagt

SEQ ID NO: 4036288 - DNA, 15 bp, Homo sapiens
cagtatgatttataa

SEQ ID NO: 4036289 - DNA, 15 bp, Homo sapiens
cagtatgtattcttt

SEQ ID NO: 4036290 - DNA, 13 bp, Homo sapiens
cagtattatctgt

SEQ ID NO: 4036291 - DNA, 14 bp, Homo sapiens
cagtattatctgtg

SEQ ID NO: 4036292 - DNA, 16 bp, Homo sapiens
cagtattatctgtgtt

SEQ ID NO: 4036293 - DNA, 19 bp, Homo sapiens
cagtattatgcatatataa

SEQ ID NO: 4036294 - DNA, 14 bp, Homo sapiens
cagtattctcagag

SEQ ID NO: 4036295 - DNA, 13 bp, Homo sapiens
cagtattgctgat

SEQ ID NO: 4036296 - DNA, 23 bp, Homo sapiens
cagtattgctgattttaaaggca

SEQ ID NO: 4036297 - DNA, 11 bp, Homo sapiens
cagtatttcag

SEQ ID NO: 4036298 - DNA, 15 bp, Homo sapiens
cagtatttcatttct

SEQ ID NO: 4036299 - DNA, 18 bp, Homo sapiens
cagtattttgtgtcctcc

SEQ ID NO: 4036300 - DNA, 19 bp, Homo sapiens
cagtcaaaacagagatgtg

SEQ ID NO: 4036301 - DNA, 15 bp, Homo sapiens
cagtcaatattttta

SEQ ID NO: 4036302 - DNA, 20 bp, Homo sapiens
cagtcacactgttactccac

SEQ ID NO: 4036303 - DNA, 22 bp, Homo sapiens
cagtcacactgttactccacag

SEQ ID NO: 4036304 - DNA, 12 bp, Homo sapiens
cagtcacagcca

SEQ ID NO: 4036305 - DNA, 16 bp, Homo sapiens
cagtcacagccacccc

SEQ ID NO: 4036306 - DNA, 12 bp, Homo sapiens
cagtcacctccc

SEQ ID NO: 4036307 - DNA, 14 bp, Homo sapiens
cagtcacctcccca

SEQ ID NO: 4036308 - DNA, 23 bp, Homo sapiens
cagtcactggaggttgaagccaa

SEQ ID NO: 4036309 - DNA, 16 bp, Homo sapiens
cagtcagaaaacttta

SEQ ID NO: 4036310 - DNA, 15 bp, Homo sapiens
cagtcagagtccagt

SEQ ID NO: 4036311 - DNA, 21 bp, Homo sapiens
cagtcagcatgcttcccagag

SEQ ID NO: 4036312 - DNA, 22 bp, Homo sapiens
cagtcagcatgcttcccagagg

SEQ ID NO: 4036313 - DNA, 23 bp, Homo sapiens
cagtcagcatgcttcccagaggg

SEQ ID NO: 4036314 - DNA, 18 bp, Homo sapiens
cagtcaggctctctgggc

SEQ ID NO: 4036315 - DNA, 15 bp, Homo sapiens
cagtcataactaaat

SEQ ID NO: 4036316 - DNA, 14 bp, Homo sapiens
cagtcatcatcagg

SEQ ID NO: 4036317 - DNA, 22 bp, Homo sapiens
cagtcatcgagtggcccaacag

SEQ ID NO: 4036318 - DNA, 16 bp, Homo sapiens
cagtcatgcataaata

SEQ ID NO: 4036319 - DNA, 20 bp, Homo sapiens
cagtcatgcataaatatgca

SEQ ID NO: 4036320 - DNA, 12 bp, Homo sapiens
cagtcatttaaa

SEQ ID NO: 4036321 - DNA, 18 bp, Homo sapiens
cagtccaaatgtcctcca

SEQ ID NO: 4036322 - DNA, 15 bp, Homo sapiens
cagtccagaagaatt

SEQ ID NO: 4036323 - DNA, 12 bp, Homo sapiens
cagtccagaccc

SEQ ID NO: 4036324 - DNA, 18 bp, Homo sapiens
cagtccatttatatatga

SEQ ID NO: 4036325 - DNA, 13 bp, Homo sapiens
cagtccccacccc

SEQ ID NO: 4036326 - DNA, 15 bp, Homo sapiens
cagtccccagaactc

SEQ ID NO: 4036327 - DNA, 20 bp, Homo sapiens
cagtccccagaactctgcct

SEQ ID NO: 4036328 - DNA, 19 bp, Homo sapiens
cagtccccatttctgcctc

SEQ ID NO: 4036329 - DNA, 20 bp, Homo sapiens
cagtccccccaccctcattc

SEQ ID NO: 4036330 - DNA, 14 bp, Homo sapiens
cagtccccctgtgc

SEQ ID NO: 4036331 - DNA, 22 bp, Homo sapiens
cagtccccttcccgtgacctgg

SEQ ID NO: 4036332 - DNA, 23 bp, Homo sapiens
cagtcctccactcgacccagaat

SEQ ID NO: 4036333 - DNA, 18 bp, Homo sapiens
cagtcctccagaccacca

SEQ ID NO: 4036334 - DNA, 15 bp, Homo sapiens
cagtcctcctgggag

SEQ ID NO: 4036335 - DNA, 16 bp, Homo sapiens
cagtcctcttattcct

SEQ ID NO: 4036336 - DNA, 14 bp, Homo sapiens
cagtcctgcctggc

SEQ ID NO: 4036337 - DNA, 21 bp, Homo sapiens
cagtcctgcctggccaggcag

SEQ ID NO: 4036338 - DNA, 16 bp, Homo sapiens
cagtcgcctgcctgca

SEQ ID NO: 4036339 - DNA, 20 bp, Homo sapiens
caggctgaccacagcacagc

SEQ ID NO: 4036340 - DNA, 22 bp, Homo sapiens
caggctgaccacagcacagcca

SEQ ID NO: 4036341 - DNA, 22 bp, Homo sapiens
caggctgagtccagagcttgtg

SEQ ID NO: 4036342 - DNA, 12 bp, Homo sapiens
caggctgctaac

SEQ ID NO: 4036343 - DNA, 19 bp, Homo sapiens
caggctgctaacctggaaa

SEQ ID NO: 4036344 - DNA, 14 bp, Homo sapiens
caggctggacgtgg

SEQ ID NO: 4036345 - DNA, 18 bp, Homo sapiens
caggctggagtgcagtgg

SEQ ID NO: 4036346 - DNA, 17 bp, Homo sapiens
caggctggctccagatg

SEQ ID NO: 4036347 - DNA, 18 bp, Homo sapiens
caggctggctccagatgc

SEQ ID NO: 4036348 - DNA, 10 bp, Homo sapiens
caggctgggc

SEQ ID NO: 4036349 - DNA, 12 bp, Homo sapiens
caggctgggcag

SEQ ID NO: 4036350 - DNA, 20 bp, Homo sapiens
caggctgggcagccccagag

SEQ ID NO: 4036351 - DNA, 21 bp, Homo sapiens
caggctgggcagccccagaga

SEQ ID NO: 4036352 - DNA, 22 bp, Homo sapiens
caggctgggcagccccagagag

SEQ ID NO: 4036353 - DNA, 12 bp, Homo sapiens
caggctgggcca

SEQ ID NO: 4036354 - DNA, 13 bp, Homo sapiens
caggctgggccat

SEQ ID NO: 4036355 - DNA, 17 bp, Homo sapiens
caggctgggccatgtcc

SEQ ID NO: 4036356 - DNA, 23 bp, Homo sapiens
caggctgggccatgtccaaagag

SEQ ID NO: 4036357 - DNA, 14 bp, Homo sapiens
caggctgttccatg

SEQ ID NO: 4036358 - DNA, 16 bp, Homo sapiens
caggcttcacagtctg

SEQ ID NO: 4036359 - DNA, 22 bp, Homo sapiens
caggcttcaccctgaatggttc

SEQ ID NO: 4036360 - DNA, 19 bp, Homo sapiens
caggctttgtacagagtgc

SEQ ID NO: 4036361 - DNA, 17 bp, Homo sapiens
cagggaaaattgcccca

SEQ ID NO: 4036362 - DNA, 16 bp, Homo sapiens
cagggaagagaaagtg

SEQ ID NO: 4036363 - DNA, 15 bp, Homo sapiens
cagggaagagcagaa

SEQ ID NO: 4036364 - DNA, 17 bp, Homo sapiens
cagggaagctggccgag

SEQ ID NO: 4036365 - DNA, 22 bp, Homo sapiens
cagggaaggtggccacagcaag

SEQ ID NO: 4036366 - DNA, 16 bp, Homo sapiens
cagggaatttctatct

SEQ ID NO: 4036367 - DNA, 15 bp, Homo sapiens
cagggacagagccat

SEQ ID NO: 4036368 - DNA, 17 bp, Homo sapiens
cagggacagagccatgc

SEQ ID NO: 4036369 - DNA, 16 bp, Homo sapiens
cagggacagaggcccc

SEQ ID NO: 4036370 - DNA, 23 bp, Homo sapiens
cagggacagaggccccagcctcc

SEQ ID NO: 4036371 - DNA, 22 bp, Homo sapiens
cagggaccacaccctgtactgt

SEQ ID NO: 4036372 - DNA, 20 bp, Homo sapiens
cagggaccggtgctgcagga

SEQ ID NO: 4036373 - DNA, 18 bp, Homo sapiens
cagggaccgtccagggga

SEQ ID NO: 4036374 - DNA, 16 bp, Homo sapiens
cagggacttggacagg

SEQ ID NO: 4036375 - DNA, 12 bp, Homo sapiens
cagggagaagct

SEQ ID NO: 4036376 - DNA, 16 bp, Homo sapiens
cagggagcaagacaga

SEQ ID NO: 4036377 - DNA, 14 bp, Homo sapiens
cagggagcagggaa

SEQ ID NO: 4036378 - DNA, 21 bp, Homo sapiens
cagggagcagggaaggcctga

SEQ ID NO: 4036379 - DNA, 23 bp, Homo sapiens
cagggagcatttaatggcagcta

SEQ ID NO: 4036380 - DNA, 17 bp, Homo sapiens
cagggagcggccggcca

SEQ ID NO: 4036381 - DNA, 19 bp, Homo sapiens
cagggagcggccggccagc

SEQ ID NO: 4036382 - DNA, 21 bp, Homo sapiens
cagggagcggccggccagccc

SEQ ID NO: 4036383 - DNA, 16 bp, Homo sapiens
cagggagctctgggga

SEQ ID NO: 4036384 - DNA, 18 bp, Homo sapiens
cagggagggaagtgtgag

SEQ ID NO: 4036385 - DNA, 13 bp, Homo sapiens
cagggaggggagg

SEQ ID NO: 4036386 - DNA, 14 bp, Homo sapiens
cagggaggggaggc

SEQ ID NO: 4036387 - DNA, 15 bp, Homo sapiens
cagggatgctgggct

SEQ ID NO: 4036388 - DNA, 17 bp, Homo sapiens
cagggatgggggatggg

SEQ ID NO: 4036389 - DNA, 22 bp, Homo sapiens
cagggatgggggatgggccagg

SEQ ID NO: 4036390 - DNA, 18 bp, Homo sapiens
cagggattaacctctgca

SEQ ID NO: 4036391 - DNA, 20 bp, Homo sapiens
cagggattaacctctgcact

SEQ ID NO: 4036392 - DNA, 15 bp, Homo sapiens
cagggcaacaagccc

SEQ ID NO: 4036393 - DNA, 20 bp, Homo sapiens
cagggcaagggttaaggcct

SEQ ID NO: 4036394 - DNA, 17 bp, Homo sapiens
cagggcaatcaatgttc

SEQ ID NO: 4036395 - DNA, 18 bp, Homo sapiens
cagggcaatgatgaatga

SEQ ID NO: 4036396 - DNA, 18 bp, Homo sapiens
cagggcaccagaggccga

SEQ ID NO: 4036397 - DNA, 22 bp, Homo sapiens
cagggcaccctgtggccctggc

SEQ ID NO: 4036398 - DNA, 18 bp, Homo sapiens
cagggcacgcaggaccag

SEQ ID NO: 4036399 - DNA, 14 bp, Homo sapiens
cagggcagacagcc

SEQ ID NO: 4036400 - DNA, 18 bp, Homo sapiens
cagggcagagcaggaagg

SEQ ID NO: 4036401 - DNA, 15 bp, Homo sapiens
cagggcagcgccagg

SEQ ID NO: 4036402 - DNA, 17 bp, Homo sapiens
cagggcagcgccaggct

SEQ ID NO: 4036403 - DNA, 21 bp, Homo sapiens
cagggcagtcattggctgtct

SEQ ID NO: 4036404 - DNA, 15 bp, Homo sapiens
cagggcatgccacgt

SEQ ID NO: 4036405 - DNA, 16 bp, Homo sapiens
cagggcatgtgtatgt

SEQ ID NO: 4036406 - DNA, 16 bp, Homo sapiens
cagggcattcgggcca

SEQ ID NO: 4036407 - DNA, 16 bp, Homo sapiens
cagggccacgctccag

SEQ ID NO: 4036408 - DNA, 23 bp, Homo sapiens
cagggccacgctccagctgcccc

SEQ ID NO: 4036409 - DNA, 15 bp, Homo sapiens
cagggccaggcccag

SEQ ID NO: 4036410 - DNA, 15 bp, Homo sapiens
cagggccagtggggc

SEQ ID NO: 4036411 - DNA, 13 bp, Homo sapiens
cagggcccacccc

SEQ ID NO: 4036412 - DNA, 14 bp, Homo sapiens
cagggcccacccca

SEQ ID NO: 4036413 - DNA, 15 bp, Homo sapiens
cagggcccaccccag

SEQ ID NO: 4036414 - DNA, 13 bp, Homo sapiens
cagggcccagagc

SEQ ID NO: 4036415 - DNA, 15 bp, Homo sapiens
cagggcccccatctc

SEQ ID NO: 4036416 - DNA, 22 bp, Homo sapiens
cagggccccccaaatcccaggg

SEQ ID NO: 4036417 - DNA, 13 bp, Homo sapiens
cagggcctccagg

SEQ ID NO: 4036418 - DNA, 19 bp, Homo sapiens
cagggcctccagggcccag

SEQ ID NO: 4036419 - DNA, 17 bp, Homo sapiens
cagggcctgacaccccc

SEQ ID NO: 4036420 - DNA, 18 bp, Homo sapiens
cagggcctggagccccat

SEQ ID NO: 4036421 - DNA, 21 bp, Homo sapiens
cagggcctggcaggccagtgt

SEQ ID NO: 4036422 - DNA, 17 bp, Homo sapiens
cagggcctggggcctga

SEQ ID NO: 4036423 - DNA, 19 bp, Homo sapiens
cagggcctggggcctgaga

SEQ ID NO: 4036424 - DNA, 21 bp, Homo sapiens
cagggcctggggcctgagaga

SEQ ID NO: 4036425 - DNA, 23 bp, Homo sapiens
cagggcctggggcctgagagaat

SEQ ID NO: 4036426 - DNA, 23 bp, Homo sapiens
cagggcgctcagacggcggccag

SEQ ID NO: 4036427 - DNA, 17 bp, Homo sapiens
cagggcgggcagagggc

SEQ ID NO: 4036428 - DNA, 19 bp, Homo sapiens
cagggcgggcagagggctg

SEQ ID NO: 4036429 - DNA, 15 bp, Homo sapiens
cagggctagtgactt

SEQ ID NO: 4036430 - DNA, 14 bp, Homo sapiens
cagggctcccaggg

SEQ ID NO: 4036431 - DNA, 21 bp, Homo sapiens
cagggctcccaggggtctccc

SEQ ID NO: 4036432 - DNA, 17 bp, Homo sapiens
cagggctgccctgagaa

SEQ ID NO: 4036433 - DNA, 22 bp, Homo sapiens
cagggctgccctgagaagctgc

SEQ ID NO: 4036434 - DNA, 12 bp, Homo sapiens
cagggctggctc

SEQ ID NO: 4036435 - DNA, 10 bp, Homo sapiens
cagggctggg

SEQ ID NO: 4036436 - DNA, 14 bp, Homo sapiens
cagggctggtttgt

SEQ ID NO: 4036437 - DNA, 23 bp, Homo sapiens
cagggctggtttgttctgacttt

SEQ ID NO: 4036438 - DNA, 16 bp, Homo sapiens
caggggaaaatgaagg

SEQ ID NO: 4036439 - DNA, 14 bp, Homo sapiens
caggggaacctgcc

SEQ ID NO: 4036440 - DNA, 15 bp, Homo sapiens
caggggaacctgcca

SEQ ID NO: 4036441 - DNA, 17 bp, Homo sapiens
caggggaaggccctgag

SEQ ID NO: 4036442 - DNA, 19 bp, Homo sapiens
cagacccctgcctggactt

SEQ ID NO: 4036443 - DNA, 15 bp, Homo sapiens
cagacccctggcttt

SEQ ID NO: 4036444 - DNA, 16 bp, Homo sapiens
cagacccctggctttt

SEQ ID NO: 4036445 - DNA, 23 bp, Homo sapiens
cagacccctggcttttcactgct

SEQ ID NO: 4036446 - DNA, 16 bp, Homo sapiens
cagacctagcaggctg

SEQ ID NO: 4036447 - DNA, 21 bp, Homo sapiens
cagacctagcaggctgttcca

SEQ ID NO: 4036448 - DNA, 16 bp, Homo sapiens
cagacctcaagccatc

SEQ ID NO: 4036449 - DNA, 13 bp, Homo sapiens
cagacctgatcct

SEQ ID NO: 4036450 - DNA, 14 bp, Homo sapiens
cagacctgatcctg

SEQ ID NO: 4036451 - DNA, 22 bp, Homo sapiens
cagacctgatcctggaggccca

SEQ ID NO: 4036452 - DNA, 13 bp, Homo sapiens
cagacctggaaga

SEQ ID NO: 4036453 - DNA, 20 bp, Homo sapiens
cagacctgttagcagacagg

SEQ ID NO: 4036454 - DNA, 13 bp, Homo sapiens
cagacggcggcca

SEQ ID NO: 4036455 - DNA, 15 bp, Homo sapiens
cagacggcggccagg

SEQ ID NO: 4036456 - DNA, 13 bp, Homo sapiens
cagacgggcacag

SEQ ID NO: 4036457 - DNA, 15 bp, Homo sapiens
cagacgttgcctgag

SEQ ID NO: 4036458 - DNA, 14 bp, Homo sapiens
cagactacacagga

SEQ ID NO: 4036459 - DNA, 15 bp, Homo sapiens
cagactactattttc

SEQ ID NO: 4036460 - DNA, 18 bp, Homo sapiens
cagactcaagtacccatt

SEQ ID NO: 4036461 - DNA, 20 bp, Homo sapiens
cagactcaagtacccattct

SEQ ID NO: 4036462 - DNA, 14 bp, Homo sapiens
cagactcagacatt

SEQ ID NO: 4036463 - DNA, 17 bp, Homo sapiens
cagactcagtttgtcag

SEQ ID NO: 4036464 - DNA, 18 bp, Homo sapiens
cagactcagtttgtcaga

SEQ ID NO: 4036465 - DNA, 16 bp, Homo sapiens
cagactccatctcttc

SEQ ID NO: 4036466 - DNA, 17 bp, Homo sapiens
cagactccatctcttct

SEQ ID NO: 4036467 - DNA, 19 bp, Homo sapiens
cagactccatctcttctgc

SEQ ID NO: 4036468 - DNA, 14 bp, Homo sapiens
cagactcccattcc

SEQ ID NO: 4036469 - DNA, 17 bp, Homo sapiens
cagactcccattcctga

SEQ ID NO: 4036470 - DNA, 21 bp, Homo sapiens
cagactccgccctcctcgggc

SEQ ID NO: 4036471 - DNA, 21 bp, Homo sapiens
cagactggggcatcctgtgcc

SEQ ID NO: 4036472 - DNA, 15 bp, Homo sapiens
cagactgttgagtta

SEQ ID NO: 4036473 - DNA, 13 bp, Homo sapiens
cagacttctccag

SEQ ID NO: 4036474 - DNA, 17 bp, Homo sapiens
cagacttgcccaggtca

SEQ ID NO: 4036475 - DNA, 19 bp, Homo sapiens
cagagaaaggggagcccac

SEQ ID NO: 4036476 - DNA, 16 bp, Homo sapiens
cagagaagctggactt

SEQ ID NO: 4036477 - DNA, 22 bp, Homo sapiens
cagagaagctggacttctgtgg

SEQ ID NO: 4036478 - DNA, 14 bp, Homo sapiens
cagagaaggaaaag

SEQ ID NO: 4036479 - DNA, 15 bp, Homo sapiens
cagagaaggaaaaga

SEQ ID NO: 4036480 - DNA, 20 bp, Homo sapiens
cagagaagttctcaaagtta

SEQ ID NO: 4036481 - DNA, 22 bp, Homo sapiens
cagagaagttctcaaagttaat

SEQ ID NO: 4036482 - DNA, 23 bp, Homo sapiens
cagagaagttctcaaagttaatt

SEQ ID NO: 4036483 - DNA, 19 bp, Homo sapiens
cagagaatcatacttagca

SEQ ID NO: 4036484 - DNA, 14 bp, Homo sapiens
cagagacagctgat

SEQ ID NO: 4036485 - DNA, 17 bp, Homo sapiens
cagagacatacttgaag

SEQ ID NO: 4036486 - DNA, 23 bp, Homo sapiens
cagagacatacttgaagggccag

SEQ ID NO: 4036487 - DNA, 13 bp, Homo sapiens
cagagacgcagga

SEQ ID NO: 4036488 - DNA, 17 bp, Homo sapiens
cagagacgcaggaatgg

SEQ ID NO: 4036489 - DNA, 19 bp, Homo sapiens
cagagacgcccagccccat

SEQ ID NO: 4036490 - DNA, 15 bp, Homo sapiens
cagagactgcaagct

SEQ ID NO: 4036491 - DNA, 21 bp, Homo sapiens
cagagactgtccctgaaacct

SEQ ID NO: 4036492 - DNA, 14 bp, Homo sapiens
cagagagaagcctg

SEQ ID NO: 4036493 - DNA, 18 bp, Homo sapiens
cagagagacagacttgag

SEQ ID NO: 4036494 - DNA, 20 bp, Homo sapiens
cagagagcaactctgagatc

SEQ ID NO: 4036495 - DNA, 14 bp, Homo sapiens
cagagagcagctcc

SEQ ID NO: 4036496 - DNA, 21 bp, Homo sapiens
cagagagcagctccctttctc

SEQ ID NO: 4036497 - DNA, 12 bp, Homo sapiens
cagagagcatta

SEQ ID NO: 4036498 - DNA, 19 bp, Homo sapiens
cagagagccattttgtgaa

SEQ ID NO: 4036499 - DNA, 20 bp, Homo sapiens
cagagagccattttgtgaat

SEQ ID NO: 4036500 - DNA, 23 bp, Homo sapiens
cagagagccattttgtgaatgga

SEQ ID NO: 4036501 - DNA, 16 bp, Homo sapiens
cagagaggagaaacac

SEQ ID NO: 4036502 - DNA, 12 bp, Homo sapiens
cagagagggcag

SEQ ID NO: 4036503 - DNA, 23 bp, Homo sapiens
cagagaggtggagaactgggatt

SEQ ID NO: 4036504 - DNA, 13 bp, Homo sapiens
cagagagtggctc

SEQ ID NO: 4036505 - DNA, 19 bp, Homo sapiens
cagagatccaaaagaagcc

SEQ ID NO: 4036506 - DNA, 20 bp, Homo sapiens
cagagatccaaaagaagccc

SEQ ID NO: 4036507 - DNA, 19 bp, Homo sapiens
cagagatttatataaatgt

SEQ ID NO: 4036508 - DNA, 17 bp, Homo sapiens
cagagcaaccagaagga

SEQ ID NO: 4036509 - DNA, 15 bp, Homo sapiens
cagagcaacctctca

SEQ ID NO: 4036510 - DNA, 22 bp, Homo sapiens
cagagcaacgaccagggccgag

SEQ ID NO: 4036511 - DNA, 22 bp, Homo sapiens
cagagcactttgcaactccctg

SEQ ID NO: 4036512 - DNA, 19 bp, Homo sapiens
cagagcagatgcagagagc

SEQ ID NO: 4036513 - DNA, 21 bp, Homo sapiens
cagagcagatgcagagagcca

SEQ ID NO: 4036514 - DNA, 14 bp, Homo sapiens
cagagcagctcccc

SEQ ID NO: 4036515 - DNA, 18 bp, Homo sapiens
cagagcagctccccagga

SEQ ID NO: 4036516 - DNA, 21 bp, Homo sapiens
cagagcagctccccaggagct

SEQ ID NO: 4036517 - DNA, 14 bp, Homo sapiens
cagagcatacaaca

SEQ ID NO: 4036518 - DNA, 16 bp, Homo sapiens
cagagcatacaacaga

SEQ ID NO: 4036519 - DNA, 20 bp, Homo sapiens
cagagcatacaacagagggg

SEQ ID NO: 4036520 - DNA, 15 bp, Homo sapiens
cagagcatctggctg

SEQ ID NO: 4036521 - DNA, 23 bp, Homo sapiens
cagagcatctggctgtttagcag

SEQ ID NO: 4036522 - DNA, 22 bp, Homo sapiens
cagagcattacgtgagccaggt

SEQ ID NO: 4036523 - DNA, 19 bp, Homo sapiens
cagagcattccagtcaggc

SEQ ID NO: 4036524 - DNA, 21 bp, Homo sapiens
cagagccaagtcctccctctc

SEQ ID NO: 4036525 - DNA, 22 bp, Homo sapiens
cagagccacccctaaagagata

SEQ ID NO: 4036526 - DNA, 22 bp, Homo sapiens
cagagccagatgcaggacagga

SEQ ID NO: 4036527 - DNA, 23 bp, Homo sapiens
cagagccaggggggtgaggagct

SEQ ID NO: 4036528 - DNA, 15 bp, Homo sapiens
cagagcccatgctca

SEQ ID NO: 4036529 - DNA, 15 bp, Homo sapiens
cagagccccccacaa

SEQ ID NO: 4036530 - DNA, 10 bp, Homo sapiens
cagagccctg

SEQ ID NO: 4036531 - DNA, 14 bp, Homo sapiens
cagagccctggctg

SEQ ID NO: 4036532 - DNA, 16 bp, Homo sapiens
cagagccctggctggg

SEQ ID NO: 4036533 - DNA, 19 bp, Homo sapiens
cagagccctggctgggttc

SEQ ID NO: 4036534 - DNA, 14 bp, Homo sapiens
cagagcctgcccca

SEQ ID NO: 4036535 - DNA, 15 bp, Homo sapiens
cagagcctgccccag

SEQ ID NO: 4036536 - DNA, 15 bp, Homo sapiens
cagagcctggcccca

SEQ ID NO: 4036537 - DNA, 16 bp, Homo sapiens
cagagcctggccccag

SEQ ID NO: 4036538 - DNA, 15 bp, Homo sapiens
cagagccttctcaga

SEQ ID NO: 4036539 - DNA, 18 bp, Homo sapiens
cagagcctttggatgacc

SEQ ID NO: 4036540 - DNA, 19 bp, Homo sapiens
cagagcctttggatgacca

SEQ ID NO: 4036541 - DNA, 16 bp, Homo sapiens
cagagcgccaggaagc

SEQ ID NO: 4036542 - DNA, 19 bp, Homo sapiens
cagagcgccaggaagccag

SEQ ID NO: 4036543 - DNA, 17 bp, Homo sapiens
cagagcgtccttccccc

SEQ ID NO: 4036544 - DNA, 12 bp, Homo sapiens
cagagctgaaga

SEQ ID NO: 4036545 - DNA, 19 bp, Homo sapiens
cagaacatcgatatgtata

SEQ ID NO: 4036546 - DNA, 15 bp, Homo sapiens
cagaacctcttcccc

SEQ ID NO: 4036547 - DNA, 16 bp, Homo sapiens
cagaacctcttcccca

SEQ ID NO: 4036548 - DNA, 13 bp, Homo sapiens
cagaacctgagct

SEQ ID NO: 4036549 - DNA, 18 bp, Homo sapiens
cagaactaaatgttctat

SEQ ID NO: 4036550 - DNA, 15 bp, Homo sapiens
cagaactcactgggg

SEQ ID NO: 4036551 - DNA, 14 bp, Homo sapiens
cagaactctgtgtc

SEQ ID NO: 4036552 - DNA, 15 bp, Homo sapiens
cagaactcttcctcc

SEQ ID NO: 4036553 - DNA, 16 bp, Homo sapiens
cagaactcttcctcca

SEQ ID NO: 4036554 - DNA, 18 bp, Homo sapiens
cagaactgcccccactgt

SEQ ID NO: 4036555 - DNA, 13 bp, Homo sapiens
cagaacttcagaa

SEQ ID NO: 4036556 - DNA, 18 bp, Homo sapiens
cagaacttgaagcctgct

SEQ ID NO: 4036557 - DNA, 15 bp, Homo sapiens
cagaacttgaatgtg

SEQ ID NO: 4036558 - DNA, 17 bp, Homo sapiens
cagaacttgctgctgtc

SEQ ID NO: 4036559 - DNA, 21 bp, Homo sapiens
cagaagaagagaagctgctga

SEQ ID NO: 4036560 - DNA, 23 bp, Homo sapiens
cagaagaagagaagctgctgacc

SEQ ID NO: 4036561 - DNA, 12 bp, Homo sapiens
cagaagaatatt

SEQ ID NO: 4036562 - DNA, 17 bp, Homo sapiens
cagaagacaccagagca

SEQ ID NO: 4036563 - DNA, 18 bp, Homo sapiens
cagaagacaccagagcag

SEQ ID NO: 4036564 - DNA, 19 bp, Homo sapiens
cagaagacaccagagcaga

SEQ ID NO: 4036565 - DNA, 21 bp, Homo sapiens
cagaagagatgggcttgtttt

SEQ ID NO: 4036566 - DNA, 22 bp, Homo sapiens
cagaagataacttgagcaccgt

SEQ ID NO: 4036567 - DNA, 15 bp, Homo sapiens
cagaagatcccctca

SEQ ID NO: 4036568 - DNA, 23 bp, Homo sapiens
cagaagatcccctcaggactgca

SEQ ID NO: 4036569 - DNA, 17 bp, Homo sapiens
cagaagatgccagcttc

SEQ ID NO: 4036570 - DNA, 19 bp, Homo sapiens
cagaagatgccagcttctc

SEQ ID NO: 4036571 - DNA, 16 bp, Homo sapiens
cagaagcaagccagac

SEQ ID NO: 4036572 - DNA, 18 bp, Homo sapiens
cagaagccacccaaagca

SEQ ID NO: 4036573 - DNA, 19 bp, Homo sapiens
cagaagcctccaagcacag

SEQ ID NO: 4036574 - DNA, 21 bp, Homo sapiens
cagaagcctccaagcctgcct

SEQ ID NO: 4036575 - DNA, 15 bp, Homo sapiens
cagaagcctctggct

SEQ ID NO: 4036576 - DNA, 18 bp, Homo sapiens
cagaagcctgatgctgac

SEQ ID NO: 4036577 - DNA, 22 bp, Homo sapiens
cagaagcctggactctgcccca

SEQ ID NO: 4036578 - DNA, 20 bp, Homo sapiens
cagaagctcttactctttcc

SEQ ID NO: 4036579 - DNA, 21 bp, Homo sapiens
cagaagctcttactctttcct

SEQ ID NO: 4036580 - DNA, 14 bp, Homo sapiens
cagaaggaatctgt

SEQ ID NO: 4036581 - DNA, 16 bp, Homo sapiens
cagaaggatccaagac

SEQ ID NO: 4036582 - DNA, 17 bp, Homo sapiens
cagaaggatgaatgagg

SEQ ID NO: 4036583 - DNA, 15 bp, Homo sapiens
cagaaggctcctgcc

SEQ ID NO: 4036584 - DNA, 16 bp, Homo sapiens
cagaaggctcctgccc

SEQ ID NO: 4036585 - DNA, 18 bp, Homo sapiens
cagaagggaattgctcag

SEQ ID NO: 4036586 - DNA, 15 bp, Homo sapiens
cagaagggagaagga

SEQ ID NO: 4036587 - DNA, 20 bp, Homo sapiens
cagaagggagctggctccag

SEQ ID NO: 4036588 - DNA, 18 bp, Homo sapiens
cagaagtcatgaagccca

SEQ ID NO: 4036589 - DNA, 13 bp, Homo sapiens
cagaagtggagct

SEQ ID NO: 4036590 - DNA, 14 bp, Homo sapiens
cagaagtggagctg

SEQ ID NO: 4036591 - DNA, 16 bp, Homo sapiens
cagaataaattaatat

SEQ ID NO: 4036592 - DNA, 18 bp, Homo sapiens
cagaataatggaaacatt

SEQ ID NO: 4036593 - DNA, 16 bp, Homo sapiens
cagaatcatggagaaa

SEQ ID NO: 4036594 - DNA, 16 bp, Homo sapiens
cagaatcttgactttc

SEQ ID NO: 4036595 - DNA, 21 bp, Homo sapiens
cagaatcttgactttctgatt

SEQ ID NO: 4036596 - DNA, 11 bp, Homo sapiens
cagaatgctgt

SEQ ID NO: 4036597 - DNA, 14 bp, Homo sapiens
cagaattaaacttt

SEQ ID NO: 4036598 - DNA, 19 bp, Homo sapiens
cagaattaaacttttaatt

SEQ ID NO: 4036599 - DNA, 21 bp, Homo sapiens
cagaattagatggcttatttt

SEQ ID NO: 4036600 - DNA, 22 bp, Homo sapiens
cagaattagatggcttattttt

SEQ ID NO: 4036601 - DNA, 13 bp, Homo sapiens
cagaattttaatg

SEQ ID NO: 4036602 - DNA, 21 bp, Homo sapiens
cagaattttaggaacttcaga

SEQ ID NO: 4036603 - DNA, 23 bp, Homo sapiens
cagaattttaggaacttcagaga

SEQ ID NO: 4036604 - DNA, 12 bp, Homo sapiens
cagacaaaacaa

SEQ ID NO: 4036605 - DNA, 16 bp, Homo sapiens
cagacaaaacaatccc

SEQ ID NO: 4036606 - DNA, 19 bp, Homo sapiens
cagacaaaacaatccccat

SEQ ID NO: 4036607 - DNA, 15 bp, Homo sapiens
cagacaagctgttga

SEQ ID NO: 4036608 - DNA, 20 bp, Homo sapiens
cagacaagtgttttggaaag

SEQ ID NO: 4036609 - DNA, 22 bp, Homo sapiens
cagacaatatgtgagtgccttt

SEQ ID NO: 4036610 - DNA, 15 bp, Homo sapiens
cagacaatcttctgt

SEQ ID NO: 4036611 - DNA, 12 bp, Homo sapiens
cagacacacaca

SEQ ID NO: 4036612 - DNA, 21 bp, Homo sapiens
cagacacacacacgcacgcac

SEQ ID NO: 4036613 - DNA, 22 bp, Homo sapiens
cagacacacatgggcagcccaa

SEQ ID NO: 4036614 - DNA, 15 bp, Homo sapiens
cagacacaggccctc

SEQ ID NO: 4036615 - DNA, 14 bp, Homo sapiens
cagacacccaggac

SEQ ID NO: 4036616 - DNA, 14 bp, Homo sapiens
cagacaccctcaac

SEQ ID NO: 4036617 - DNA, 19 bp, Homo sapiens
cagacacgccttcccctca

SEQ ID NO: 4036618 - DNA, 21 bp, Homo sapiens
cagacactaagttatagtata

SEQ ID NO: 4036619 - DNA, 13 bp, Homo sapiens
cagacactacccc

SEQ ID NO: 4036620 - DNA, 17 bp, Homo sapiens
cagacagaagtctcctc

SEQ ID NO: 4036621 - DNA, 14 bp, Homo sapiens
cagacagacacaca

SEQ ID NO: 4036622 - DNA, 15 bp, Homo sapiens
cagacagacacacac

SEQ ID NO: 4036623 - DNA, 19 bp, Homo sapiens
cagacagacatctctgcac

SEQ ID NO: 4036624 - DNA, 15 bp, Homo sapiens
cagacagcaggcagc

SEQ ID NO: 4036625 - DNA, 17 bp, Homo sapiens
cagacagcaggcagcgc

SEQ ID NO: 4036626 - DNA, 12 bp, Homo sapiens
cagacaggagga

SEQ ID NO: 4036627 - DNA, 18 bp, Homo sapiens
cagacaggcaaataaaag

SEQ ID NO: 4036628 - DNA, 18 bp, Homo sapiens
cagacaggctcttagcag

SEQ ID NO: 4036629 - DNA, 20 bp, Homo sapiens
cagacaggctcttagcagct

SEQ ID NO: 4036630 - DNA, 22 bp, Homo sapiens
cagacagggtgggcttcctgcc

SEQ ID NO: 4036631 - DNA, 17 bp, Homo sapiens
cagacatccaaactaaa

SEQ ID NO: 4036632 - DNA, 18 bp, Homo sapiens
cagaccaactctctcctg

SEQ ID NO: 4036633 - DNA, 23 bp, Homo sapiens
cagaccaccagccgccccagccc

SEQ ID NO: 4036634 - DNA, 22 bp, Homo sapiens
cagaccaccccgcctgccctca

SEQ ID NO: 4036635 - DNA, 17 bp, Homo sapiens
cagaccacctgcttctg

SEQ ID NO: 4036636 - DNA, 13 bp, Homo sapiens
cagaccacggctc

SEQ ID NO: 4036637 - DNA, 17 bp, Homo sapiens
cagaccacttgccacgc

SEQ ID NO: 4036638 - DNA, 19 bp, Homo sapiens
cagaccacttgccacgctg

SEQ ID NO: 4036639 - DNA, 18 bp, Homo sapiens
cagaccagagctgtctga

SEQ ID NO: 4036640 - DNA, 20 bp, Homo sapiens
cagaccagtgaccccagaaa

SEQ ID NO: 4036641 - DNA, 20 bp, Homo sapiens
cagaccatattacctggatt

SEQ ID NO: 4036642 - DNA, 19 bp, Homo sapiens
cagacccaggacccccgag

SEQ ID NO: 4036643 - DNA, 13 bp, Homo sapiens
cagaccccaggct

SEQ ID NO: 4036644 - DNA, 13 bp, Homo sapiens
cagacccctctgg

SEQ ID NO: 4036645 - DNA, 16 bp, Homo sapiens
cagacccctctggcca

SEQ ID NO: 4036646 - DNA, 18 bp, Homo sapiens
cagacccctctggccagg

SEQ ID NO: 4036647 - DNA, 11 bp, Homo sapiens
cagacccctgc

SEQ ID NO: 4036648 - DNA, 19 bp, Homo sapiens
cactgtgacccccagctcc

SEQ ID NO: 4036649 - DNA, 19 bp, Homo sapiens
cactgtgatcaatattttt

SEQ ID NO: 4036650 - DNA, 21 bp, Homo sapiens
cactgtgatcaatatttttat

SEQ ID NO: 4036651 - DNA, 13 bp, Homo sapiens
cactgtgcactgc

SEQ ID NO: 4036652 - DNA, 14 bp, Homo sapiens
cactgtgcactgcc

SEQ ID NO: 4036653 - DNA, 19 bp, Homo sapiens
cactgtggcgttctgctgc

SEQ ID NO: 4036654 - DNA, 13 bp, Homo sapiens
cactgtggtggca

SEQ ID NO: 4036655 - DNA, 15 bp, Homo sapiens
cactgtgtatttaac

SEQ ID NO: 4036656 - DNA, 22 bp, Homo sapiens
cactgttagctttttaaaacat

SEQ ID NO: 4036657 - DNA, 14 bp, Homo sapiens
cactgttccctctg

SEQ ID NO: 4036658 - DNA, 17 bp, Homo sapiens
cactgttccctctgctc

SEQ ID NO: 4036659 - DNA, 20 bp, Homo sapiens
cactgttccctctgctcctg

SEQ ID NO: 4036660 - DNA, 13 bp, Homo sapiens
cactgttgaattt

SEQ ID NO: 4036661 - DNA, 17 bp, Homo sapiens
cactgttgaattttctc

SEQ ID NO: 4036662 - DNA, 18 bp, Homo sapiens
cactgtttctctgctgtt

SEQ ID NO: 4036663 - DNA, 14 bp, Homo sapiens
cacttaaaaaatgt

SEQ ID NO: 4036664 - DNA, 13 bp, Homo sapiens
cacttaagactgt

SEQ ID NO: 4036665 - DNA, 18 bp, Homo sapiens
cacttacctagatttaca

SEQ ID NO: 4036666 - DNA, 20 bp, Homo sapiens
cacttagaaattgcatttcc

SEQ ID NO: 4036667 - DNA, 24 bp, Homo sapiens
cacttagaaattgcatttcctgac

SEQ ID NO: 4036668 - DNA, 21 bp, Homo sapiens
cacttagcaggcaccgccacg

SEQ ID NO: 4036669 - DNA, 16 bp, Homo sapiens
cacttagtaggtcctc

SEQ ID NO: 4036670 - DNA, 19 bp, Homo sapiens
cacttatttcactatcttc

SEQ ID NO: 4036671 - DNA, 17 bp, Homo sapiens
cacttcacgcccttggc

SEQ ID NO: 4036672 - DNA, 19 bp, Homo sapiens
cacttcacgcccttggcca

SEQ ID NO: 4036673 - DNA, 20 bp, Homo sapiens
cacttcacgcccttggccat

SEQ ID NO: 4036674 - DNA, 21 bp, Homo sapiens
cacttcactgcgaagaccctc

SEQ ID NO: 4036675 - DNA, 15 bp, Homo sapiens
cacttcagagagctg

SEQ ID NO: 4036676 - DNA, 12 bp, Homo sapiens
cacttccagggg

SEQ ID NO: 4036677 - DNA, 13 bp, Homo sapiens
cacttccagggtt

SEQ ID NO: 4036678 - DNA, 19 bp, Homo sapiens
cacttcctgctacaggagg

SEQ ID NO: 4036679 - DNA, 21 bp, Homo sapiens
cacttcggccaggtcacacga

SEQ ID NO: 4036680 - DNA, 20 bp, Homo sapiens
cacttctgtgagacccccac

SEQ ID NO: 4036681 - DNA, 21 bp, Homo sapiens
cacttctgtgagacccccaca

SEQ ID NO: 4036682 - DNA, 22 bp, Homo sapiens
cacttctgtgagacccccacac

SEQ ID NO: 4036683 - DNA, 16 bp, Homo sapiens
cacttcttcctttctc

SEQ ID NO: 4036684 - DNA, 19 bp, Homo sapiens
cacttcttcctttctcttt

SEQ ID NO: 4036685 - DNA, 12 bp, Homo sapiens
cacttcttctgt

SEQ ID NO: 4036686 - DNA, 15 bp, Homo sapiens
cacttcttctgtcca

SEQ ID NO: 4036687 - DNA, 18 bp, Homo sapiens
cacttcttgttccccact

SEQ ID NO: 4036688 - DNA, 17 bp, Homo sapiens
cacttctttcccttcct

SEQ ID NO: 4036689 - DNA, 19 bp, Homo sapiens
cacttctttcccttcctcc

SEQ ID NO: 4036690 - DNA, 15 bp, Homo sapiens
cacttgaaagatttt

SEQ ID NO: 4036691 - DNA, 19 bp, Homo sapiens
cacttgaaagattttattg

SEQ ID NO: 4036692 - DNA, 16 bp, Homo sapiens
cacttgaatcagtttt

SEQ ID NO: 4036693 - DNA, 13 bp, Homo sapiens
cacttgagagaaa

SEQ ID NO: 4036694 - DNA, 13 bp, Homo sapiens
cacttgctggggc

SEQ ID NO: 4036695 - DNA, 15 bp, Homo sapiens
cacttgtccagctga

SEQ ID NO: 4036696 - DNA, 21 bp, Homo sapiens
cacttgtcggctccagtcccc

SEQ ID NO: 4036697 - DNA, 19 bp, Homo sapiens
cacttgtgattataaaatt

SEQ ID NO: 4036698 - DNA, 15 bp, Homo sapiens
cacttgtgctttgct

SEQ ID NO: 4036699 - DNA, 20 bp, Homo sapiens
cacttgtgctttgctcttgt

SEQ ID NO: 4036700 - DNA, 23 bp, Homo sapiens
cacttgtgtgtgggctgtgagtg

SEQ ID NO: 4036701 - DNA, 15 bp, Homo sapiens
cactttagggctgta

SEQ ID NO: 4036702 - DNA, 18 bp, Homo sapiens
cactttataagtcattgt

SEQ ID NO: 4036703 - DNA, 20 bp, Homo sapiens
cactttataagtcattgtat

SEQ ID NO: 4036704 - DNA, 18 bp, Homo sapiens
cactttccacttcttcct

SEQ ID NO: 4036705 - DNA, 19 bp, Homo sapiens
cactttgctctcaattaaa

SEQ ID NO: 4036706 - DNA, 12 bp, Homo sapiens
cactttgggagg

SEQ ID NO: 4036707 - DNA, 21 bp, Homo sapiens
cactttgttgcaagatgtgaa

SEQ ID NO: 4036708 - DNA, 23 bp, Homo sapiens
cactttgttgcaagatgtgaatt

SEQ ID NO: 4036709 - DNA, 17 bp, Homo sapiens
cacttttgttattccat

SEQ ID NO: 4036710 - DNA, 18 bp, Homo sapiens
cacttttgttattccatc

SEQ ID NO: 4036711 - DNA, 14 bp, Homo sapiens
cacttttgttctgc

SEQ ID NO: 4036712 - DNA, 16 bp, Homo sapiens
cactttttcgtgtgga

SEQ ID NO: 4036713 - DNA, 12 bp, Homo sapiens
cagaaaaaaggt

SEQ ID NO: 4036714 - DNA, 22 bp, Homo sapiens
cagaaaaaaggttctttgtgta

SEQ ID NO: 4036715 - DNA, 16 bp, Homo sapiens
cagaaaaactctggga

SEQ ID NO: 4036716 - DNA, 12 bp, Homo sapiens
cagaaaaagaaa

SEQ ID NO: 4036717 - DNA, 13 bp, Homo sapiens
cagaaaaagaaaa

SEQ ID NO: 4036718 - DNA, 15 bp, Homo sapiens
cagaaaaaggcagtg

SEQ ID NO: 4036719 - DNA, 13 bp, Homo sapiens
cagaaaagtgcct

SEQ ID NO: 4036720 - DNA, 15 bp, Homo sapiens
cagaaaagtgcctga

SEQ ID NO: 4036721 - DNA, 23 bp, Homo sapiens
cagaaaatgttgagaatcccaaa

SEQ ID NO: 4036722 - DNA, 14 bp, Homo sapiens
cagaaaattctgtg

SEQ ID NO: 4036723 - DNA, 17 bp, Homo sapiens
cagaaaattctgtgcct

SEQ ID NO: 4036724 - DNA, 18 bp, Homo sapiens
cagaaacacccacaggca

SEQ ID NO: 4036725 - DNA, 18 bp, Homo sapiens
cagaaacagccattgcgg

SEQ ID NO: 4036726 - DNA, 14 bp, Homo sapiens
cagaaacagtggga

SEQ ID NO: 4036727 - DNA, 15 bp, Homo sapiens
cagaaaccagttatg

SEQ ID NO: 4036728 - DNA, 12 bp, Homo sapiens
cagaaactagaa

SEQ ID NO: 4036729 - DNA, 23 bp, Homo sapiens
cagaaactcctgtttctccttag

SEQ ID NO: 4036730 - DNA, 16 bp, Homo sapiens
cagaaacttgttcttc

SEQ ID NO: 4036731 - DNA, 21 bp, Homo sapiens
cagaaagatggatgtgctttg

SEQ ID NO: 4036732 - DNA, 19 bp, Homo sapiens
cagaaagcctgggtgacat

SEQ ID NO: 4036733 - DNA, 22 bp, Homo sapiens
cagaaagcctgggtgacatttg

SEQ ID NO: 4036734 - DNA, 20 bp, Homo sapiens
cagaaaggaaaacctgaaga

SEQ ID NO: 4036735 - DNA, 20 bp, Homo sapiens
cagaaaggactcctcctttt

SEQ ID NO: 4036736 - DNA, 12 bp, Homo sapiens
cagaaaggagac

SEQ ID NO: 4036737 - DNA, 16 bp, Homo sapiens
cagaaaggatatttaa

SEQ ID NO: 4036738 - DNA, 20 bp, Homo sapiens
cagaaaggatatttaagaaa

SEQ ID NO: 4036739 - DNA, 16 bp, Homo sapiens
cagaaagtgcctgaca

SEQ ID NO: 4036740 - DNA, 15 bp, Homo sapiens
cagaaatatgtggtt

SEQ ID NO: 4036741 - DNA, 15 bp, Homo sapiens
cagaaatcagaggag

SEQ ID NO: 4036742 - DNA, 19 bp, Homo sapiens
cagaaatcaggtgttttaa

SEQ ID NO: 4036743 - DNA, 16 bp, Homo sapiens
cagaaatgtccctttc

SEQ ID NO: 4036744 - DNA, 21 bp, Homo sapiens
cagaaattggaacagaatgtt

SEQ ID NO: 4036745 - DNA, 14 bp, Homo sapiens
cagaacagcagagg

SEQ ID NO: 4036746 - DNA, 21 bp, Homo sapiens
cagaacagcagaggttctttt

SEQ ID NO: 4036747 - DNA, 13 bp, Homo sapiens
cagaacagcttca

SEQ ID NO: 4036748 - DNA, 17 bp, Homo sapiens
cagaacagcttcaggtt

SEQ ID NO: 4036749 - DNA, 12 bp, Homo sapiens
cagaacagggtc

SEQ ID NO: 4036750 - DNA, 16 bp, Homo sapiens
cagaacatatgttgca

SEQ ID NO: 4036751 - DNA, 17 bp, Homo sapiens
cactcttcctgcaagga

SEQ ID NO: 4036752 - DNA, 15 bp, Homo sapiens
cactcttgatctctc

SEQ ID NO: 4036753 - DNA, 16 bp, Homo sapiens
cactcttgatctctct

SEQ ID NO: 4036754 - DNA, 14 bp, Homo sapiens
cactgaaaaacaac

SEQ ID NO: 4036755 - DNA, 19 bp, Homo sapiens
cactgaaaacttagccaga

SEQ ID NO: 4036756 - DNA, 17 bp, Homo sapiens
cactgaaagttttgtaa

SEQ ID NO: 4036757 - DNA, 18 bp, Homo sapiens
cactgaaagttttgtaaa

SEQ ID NO: 4036758 - DNA, 23 bp, Homo sapiens
cactgaaagttttgtaaaagaaa

SEQ ID NO: 4036759 - DNA, 16 bp, Homo sapiens
cactgaaatgtttgga

SEQ ID NO: 4036760 - DNA, 21 bp, Homo sapiens
cactgaactctacgccactcc

SEQ ID NO: 4036761 - DNA, 20 bp, Homo sapiens
cactgaaggacctgagctgg

SEQ ID NO: 4036762 - DNA, 17 bp, Homo sapiens
cactgaagtcagttctc

SEQ ID NO: 4036763 - DNA, 19 bp, Homo sapiens
cactgaagttaacagagac

SEQ ID NO: 4036764 - DNA, 22 bp, Homo sapiens
cactgaagttaacagagacaga

SEQ ID NO: 4036765 - DNA, 14 bp, Homo sapiens
cactgaatatttat

SEQ ID NO: 4036766 - DNA, 14 bp, Homo sapiens
cactgaatttataa

SEQ ID NO: 4036767 - DNA, 13 bp, Homo sapiens
cactgacagcctc

SEQ ID NO: 4036768 - DNA, 17 bp, Homo sapiens
cactgaccatccactct

SEQ ID NO: 4036769 - DNA, 21 bp, Homo sapiens
cactgacccactcggatggac

SEQ ID NO: 4036770 - DNA, 20 bp, Homo sapiens
cactgagagggcaaggaagt

SEQ ID NO: 4036771 - DNA, 20 bp, Homo sapiens
cactgagcaagatcttgtct

SEQ ID NO: 4036772 - DNA, 18 bp, Homo sapiens
cactgaggcagccttggg

SEQ ID NO: 4036773 - DNA, 20 bp, Homo sapiens
cactgaggcagccttgggga

SEQ ID NO: 4036774 - DNA, 10 bp, Homo sapiens
cactgagggc

SEQ ID NO: 4036775 - DNA, 22 bp, Homo sapiens
cactgagtaccaggggctgggc

SEQ ID NO: 4036776 - DNA, 16 bp, Homo sapiens
cactgatatatttaaa

SEQ ID NO: 4036777 - DNA, 22 bp, Homo sapiens
cactgatctctactaccacaag

SEQ ID NO: 4036778 - DNA, 24 bp, Homo sapiens
cactgatctctactaccacaagga

SEQ ID NO: 4036779 - DNA, 18 bp, Homo sapiens
cactgatttcacaacaga

SEQ ID NO: 4036780 - DNA, 19 bp, Homo sapiens
cactgatttcacaacagat

SEQ ID NO: 4036781 - DNA, 18 bp, Homo sapiens
cactgcacagtgcatctc

SEQ ID NO: 4036782 - DNA, 21 bp, Homo sapiens
cactgcacagtgcatctcagc

SEQ ID NO: 4036783 - DNA, 15 bp, Homo sapiens
cactgcaccgcctca

SEQ ID NO: 4036784 - DNA, 16 bp, Homo sapiens
cactgcactccagcct

SEQ ID NO: 4036785 - DNA, 17 bp, Homo sapiens
cactgcagcccctgaga

SEQ ID NO: 4036786 - DNA, 16 bp, Homo sapiens
cactgcagtttcctgg

SEQ ID NO: 4036787 - DNA, 17 bp, Homo sapiens
cactgcagtttcctgga

SEQ ID NO: 4036788 - DNA, 18 bp, Homo sapiens
cactgcattattctcttt

SEQ ID NO: 4036789 - DNA, 16 bp, Homo sapiens
cactgcccgagctggt

SEQ ID NO: 4036790 - DNA, 20 bp, Homo sapiens
cactgcccttttcaggaagc

SEQ ID NO: 4036791 - DNA, 14 bp, Homo sapiens
cactgcctgcacct

SEQ ID NO: 4036792 - DNA, 16 bp, Homo sapiens
cactgcctgcaccttt

SEQ ID NO: 4036793 - DNA, 22 bp, Homo sapiens
cactgccttcgatacaccgggc

SEQ ID NO: 4036794 - DNA, 21 bp, Homo sapiens
cactgccttctcctctctggg

SEQ ID NO: 4036795 - DNA, 20 bp, Homo sapiens
cactgcgaagaccctcttgc

SEQ ID NO: 4036796 - DNA, 22 bp, Homo sapiens
cactgcgaagaccctcttgccc

SEQ ID NO: 4036797 - DNA, 22 bp, Homo sapiens
cactgcgttttcctagctgtgt

SEQ ID NO: 4036798 - DNA, 22 bp, Homo sapiens
cactgctccatttataacccca

SEQ ID NO: 4036799 - DNA, 18 bp, Homo sapiens
cactgctccctaccccag

SEQ ID NO: 4036800 - DNA, 22 bp, Homo sapiens
cactgctccctaccccagggcc

SEQ ID NO: 4036801 - DNA, 22 bp, Homo sapiens
cactgctcgaaatggcccctgt

SEQ ID NO: 4036802 - DNA, 17 bp, Homo sapiens
cactgctcttaagaaac

SEQ ID NO: 4036803 - DNA, 14 bp, Homo sapiens
cactgctggctgcc

SEQ ID NO: 4036804 - DNA, 16 bp, Homo sapiens
cactgctggctgcctt

SEQ ID NO: 4036805 - DNA, 21 bp, Homo sapiens
cactgctggctgccttagaac

SEQ ID NO: 4036806 - DNA, 16 bp, Homo sapiens
cactgctggtgccagg

SEQ ID NO: 4036807 - DNA, 10 bp, Homo sapiens
cactgctgta

SEQ ID NO: 4036808 - DNA, 14 bp, Homo sapiens
cactgctgtaccca

SEQ ID NO: 4036809 - DNA, 15 bp, Homo sapiens
cactggaaaggggag

SEQ ID NO: 4036810 - DNA, 18 bp, Homo sapiens
cactggaaaggggagagc

SEQ ID NO: 4036811 - DNA, 23 bp, Homo sapiens
cactggaaaggggagagcctgct

SEQ ID NO: 4036812 - DNA, 21 bp, Homo sapiens
cactggaggttgaagccaagt

SEQ ID NO: 4036813 - DNA, 20 bp, Homo sapiens
cactggagtgcagggaggag

SEQ ID NO: 4036814 - DNA, 23 bp, Homo sapiens
cactggagtgcagggaggagagg

SEQ ID NO: 4036815 - DNA, 24 bp, Homo sapiens
cactggcccctcaaatcgtccagc

SEQ ID NO: 4036816 - DNA, 13 bp, Homo sapiens
cactggctggctc

SEQ ID NO: 4036817 - DNA, 20 bp, Homo sapiens
cactgggatgagccgctgtg

SEQ ID NO: 4036818 - DNA, 19 bp, Homo sapiens
cactgggcacacgcacaaa

SEQ ID NO: 4036819 - DNA, 15 bp, Homo sapiens
cactgggccacggag

SEQ ID NO: 4036820 - DNA, 19 bp, Homo sapiens
cactgggccagccctgcag

SEQ ID NO: 4036821 - DNA, 21 bp, Homo sapiens
cactgggccagccctgcagcc

SEQ ID NO: 4036822 - DNA, 22 bp, Homo sapiens
cactggggagcccgtctcagtg

SEQ ID NO: 4036823 - DNA, 23 bp, Homo sapiens
cactgggggaacagatgctaata

SEQ ID NO: 4036824 - DNA, 21 bp, Homo sapiens
cactgggtggggtgaggacca

SEQ ID NO: 4036825 - DNA, 20 bp, Homo sapiens
cactgggtggtggcctggtc

SEQ ID NO: 4036826 - DNA, 22 bp, Homo sapiens
cactgggtggtggcctggtccc

SEQ ID NO: 4036827 - DNA, 17 bp, Homo sapiens
cactggtaacatgtgac

SEQ ID NO: 4036828 - DNA, 22 bp, Homo sapiens
cactggtacttagagtttctgt

SEQ ID NO: 4036829 - DNA, 18 bp, Homo sapiens
cactggtaggttgggaca

SEQ ID NO: 4036830 - DNA, 19 bp, Homo sapiens
cactggtaggttgggacac

SEQ ID NO: 4036831 - DNA, 14 bp, Homo sapiens
cactggtctgctgt

SEQ ID NO: 4036832 - DNA, 17 bp, Homo sapiens
cactggtgaactgagct

SEQ ID NO: 4036833 - DNA, 22 bp, Homo sapiens
cactggtgccaaaaccaggcct

SEQ ID NO: 4036834 - DNA, 19 bp, Homo sapiens
cactggtgtgacctgaggg

SEQ ID NO: 4036835 - DNA, 13 bp, Homo sapiens
cactgtaaaatga

SEQ ID NO: 4036836 - DNA, 16 bp, Homo sapiens
cactgtaaaatgaaat

SEQ ID NO: 4036837 - DNA, 15 bp, Homo sapiens
cactgtaattaaaac

SEQ ID NO: 4036838 - DNA, 14 bp, Homo sapiens
cactgtataaatag

SEQ ID NO: 4036839 - DNA, 18 bp, Homo sapiens
cactgtataaataggaga

SEQ ID NO: 4036840 - DNA, 19 bp, Homo sapiens
cactgtataaataggagag

SEQ ID NO: 4036841 - DNA, 23 bp, Homo sapiens
cactgtataaataggagaggatg

SEQ ID NO: 4036842 - DNA, 15 bp, Homo sapiens
cactgtatgatttat

SEQ ID NO: 4036843 - DNA, 22 bp, Homo sapiens
cactgtatgatttataaacaga

SEQ ID NO: 4036844 - DNA, 13 bp, Homo sapiens
cactgtcactttg

SEQ ID NO: 4036845 - DNA, 17 bp, Homo sapiens
cactgtcactttgctct

SEQ ID NO: 4036846 - DNA, 20 bp, Homo sapiens
cactgtcactttgctctggg

SEQ ID NO: 4036847 - DNA, 16 bp, Homo sapiens
cactgtcatgcttcat

SEQ ID NO: 4036848 - DNA, 18 bp, Homo sapiens
cactgtccctctttggca

SEQ ID NO: 4036849 - DNA, 17 bp, Homo sapiens
cactgtcccttgcctca

SEQ ID NO: 4036850 - DNA, 15 bp, Homo sapiens
cactgtcctgggcct

SEQ ID NO: 4036851 - DNA, 18 bp, Homo sapiens
cactgtctgtctggtcca

SEQ ID NO: 4036852 - DNA, 19 bp, Homo sapiens
cactgtctttaattctgta

SEQ ID NO: 4036853 - DNA, 17 bp, Homo sapiens
atatatgaaaactatac

SEQ ID NO: 4036854 - DNA, 20 bp, Homo sapiens
atatatgaaaactatacaac

SEQ ID NO: 4036855 - DNA, 18 bp, Homo sapiens
atatatgaccagaagcct

SEQ ID NO: 4036856 - DNA, 15 bp, Homo sapiens
atatatgcactatgt

SEQ ID NO: 4036857 - DNA, 19 bp, Homo sapiens
atatatgcactatgtatat

SEQ ID NO: 4036858 - DNA, 13 bp, Homo sapiens
atatattattgta

SEQ ID NO: 4036859 - DNA, 19 bp, Homo sapiens
atatattattgtaagttgt

SEQ ID NO: 4036860 - DNA, 18 bp, Homo sapiens
atatattgaacttttgta

SEQ ID NO: 4036861 - DNA, 22 bp, Homo sapiens
atatattgaacttttgtactga

SEQ ID NO: 4036862 - DNA, 14 bp, Homo sapiens
atatattgaattaa

SEQ ID NO: 4036863 - DNA, 13 bp, Homo sapiens
atatatttaagcc

SEQ ID NO: 4036864 - DNA, 13 bp, Homo sapiens
atatatttataac

SEQ ID NO: 4036865 - DNA, 16 bp, Homo sapiens
atatatttataactca

SEQ ID NO: 4036866 - DNA, 14 bp, Homo sapiens
atatatttatttaa

SEQ ID NO: 4036867 - DNA, 22 bp, Homo sapiens
atatatttcacgtgttccctct

SEQ ID NO: 4036868 - DNA, 17 bp, Homo sapiens
atatatttcacttttgt

SEQ ID NO: 4036869 - DNA, 21 bp, Homo sapiens
atatatttttcacagtttttc

SEQ ID NO: 4036870 - DNA, 20 bp, Homo sapiens
atatatttttggttgtcaat

SEQ ID NO: 4036871 - DNA, 14 bp, Homo sapiens
atatcaaaagacac

SEQ ID NO: 4036872 - DNA, 16 bp, Homo sapiens
atatcaaaagacacag

SEQ ID NO: 4036873 - DNA, 21 bp, Homo sapiens
atatcaatcaagccatgtata

SEQ ID NO: 4036874 - DNA, 14 bp, Homo sapiens
atatcacagtatta

SEQ ID NO: 4036875 - DNA, 15 bp, Homo sapiens
atatcacagtattat

SEQ ID NO: 4036876 - DNA, 14 bp, Homo sapiens
atatcagcctgagt

SEQ ID NO: 4036877 - DNA, 22 bp, Homo sapiens
atatcagcctgagtctcctgtg

SEQ ID NO: 4036878 - DNA, 13 bp, Homo sapiens
atatcagtttgct

SEQ ID NO: 4036879 - DNA, 14 bp, Homo sapiens
atatcatatgtata

SEQ ID NO: 4036880 - DNA, 19 bp, Homo sapiens
atatcatgctaaaattcta

SEQ ID NO: 4036881 - DNA, 23 bp, Homo sapiens
atatcatgctaaaattctataga

SEQ ID NO: 4036882 - DNA, 21 bp, Homo sapiens
atatcatgtaaagaaatgtct

SEQ ID NO: 4036883 - DNA, 22 bp, Homo sapiens
atatcatgtaaagaaatgtctt

SEQ ID NO: 4036884 - DNA, 20 bp, Homo sapiens
atatcattctacagaataat

SEQ ID NO: 4036885 - DNA, 21 bp, Homo sapiens
atatcatttattttttacatt

SEQ ID NO: 4036886 - DNA, 12 bp, Homo sapiens
atatccatcttt

SEQ ID NO: 4036887 - DNA, 20 bp, Homo sapiens
cagagctgggaggcatggcc

SEQ ID NO: 4036888 - DNA, 17 bp, Homo sapiens
cagagctgggtggggac

SEQ ID NO: 4036889 - DNA, 12 bp, Homo sapiens
cagagctgtgga

SEQ ID NO: 4036890 - DNA, 15 bp, Homo sapiens
cagagcttgaagatt

SEQ ID NO: 4036891 - DNA, 23 bp, Homo sapiens
cagagcttgtgctcctcttgatt

SEQ ID NO: 4036892 - DNA, 18 bp, Homo sapiens
cagaggaaagggctggct

SEQ ID NO: 4036893 - DNA, 17 bp, Homo sapiens
cagaggaacccccacca

SEQ ID NO: 4036894 - DNA, 18 bp, Homo sapiens
cagaggaacccccaccag

SEQ ID NO: 4036895 - DNA, 17 bp, Homo sapiens
cagaggaactgtccaga

SEQ ID NO: 4036896 - DNA, 20 bp, Homo sapiens
cagaggaactgtccagagag

SEQ ID NO: 4036897 - DNA, 17 bp, Homo sapiens
cagaggaatttatacct

SEQ ID NO: 4036898 - DNA, 20 bp, Homo sapiens
cagaggagcttttctggaat

SEQ ID NO: 4036899 - DNA, 15 bp, Homo sapiens
cagaggagggcagag

SEQ ID NO: 4036900 - DNA, 16 bp, Homo sapiens
cagaggagtgcagcct

SEQ ID NO: 4036901 - DNA, 19 bp, Homo sapiens
cagaggcagcttcaagtgc

SEQ ID NO: 4036902 - DNA, 21 bp, Homo sapiens
cagaggcagcttcaagtgcct

SEQ ID NO: 4036903 - DNA, 11 bp, Homo sapiens
cagaggcaggc

SEQ ID NO: 4036904 - DNA, 13 bp, Homo sapiens
cagaggcaggctg

SEQ ID NO: 4036905 - DNA, 14 bp, Homo sapiens
cagaggcaggctgg

SEQ ID NO: 4036906 - DNA, 21 bp, Homo sapiens
cagaggcaggctgggacggac

SEQ ID NO: 4036907 - DNA, 21 bp, Homo sapiens
cagaggccgaaggtgcctcag

SEQ ID NO: 4036908 - DNA, 14 bp, Homo sapiens
cagaggcctgcccg

SEQ ID NO: 4036909 - DNA, 17 bp, Homo sapiens
cagaggcctgctgccag

SEQ ID NO: 4036910 - DNA, 22 bp, Homo sapiens
cagaggctgcacccctgggcca

SEQ ID NO: 4036911 - DNA, 12 bp, Homo sapiens
cagagggagcag

SEQ ID NO: 4036912 - DNA, 14 bp, Homo sapiens
cagagggagcaggc

SEQ ID NO: 4036913 - DNA, 17 bp, Homo sapiens
cagagggagctggaacc

SEQ ID NO: 4036914 - DNA, 13 bp, Homo sapiens
cagagggctggag

SEQ ID NO: 4036915 - DNA, 15 bp, Homo sapiens
cagagggctggaggc

SEQ ID NO: 4036916 - DNA, 17 bp, Homo sapiens
cagagggctggaggccc

SEQ ID NO: 4036917 - DNA, 18 bp, Homo sapiens
cagagggctggaggccca

SEQ ID NO: 4036918 - DNA, 21 bp, Homo sapiens
cagagggctggaggcccaggc

SEQ ID NO: 4036919 - DNA, 19 bp, Homo sapiens
cagagggtgtggctttcca

SEQ ID NO: 4036920 - DNA, 20 bp, Homo sapiens
cagagggtgtggctttccag

SEQ ID NO: 4036921 - DNA, 15 bp, Homo sapiens
cagaggtaacagaac

SEQ ID NO: 4036922 - DNA, 16 bp, Homo sapiens
cagaggtaacagaaca

SEQ ID NO: 4036923 - DNA, 19 bp, Homo sapiens
cagaggtcagactaagaaa

SEQ ID NO: 4036924 - DNA, 13 bp, Homo sapiens
cagaggtctccca

SEQ ID NO: 4036925 - DNA, 17 bp, Homo sapiens
cagaggtggccagagct

SEQ ID NO: 4036926 - DNA, 19 bp, Homo sapiens
cagaggtgggatcctccct

SEQ ID NO: 4036927 - DNA, 19 bp, Homo sapiens
cagaggtgtacactaacat

SEQ ID NO: 4036928 - DNA, 20 bp, Homo sapiens
cagaggtgtacactaacatt

SEQ ID NO: 4036929 - DNA, 17 bp, Homo sapiens
cagagtaaattgctctg

SEQ ID NO: 4036930 - DNA, 22 bp, Homo sapiens
cagagtacgtcctgcctggcac

SEQ ID NO: 4036931 - DNA, 24 bp, Homo sapiens
cagagtacgtcctgcctggcactt

SEQ ID NO: 4036932 - DNA, 13 bp, Homo sapiens
cagagtagaaata

SEQ ID NO: 4036933 - DNA, 20 bp, Homo sapiens
cagagtatttgaaaaatgta

SEQ ID NO: 4036934 - DNA, 22 bp, Homo sapiens
cagagtcaccttttctgtggct

SEQ ID NO: 4036935 - DNA, 21 bp, Homo sapiens
cagagtcatttatgagcagaa

SEQ ID NO: 4036936 - DNA, 13 bp, Homo sapiens
cagagtccagtgc

SEQ ID NO: 4036937 - DNA, 21 bp, Homo sapiens
cagagtccatttcccacatct

SEQ ID NO: 4036938 - DNA, 16 bp, Homo sapiens
cagagtctgggcctct

SEQ ID NO: 4036939 - DNA, 19 bp, Homo sapiens
cagagtctgggcctctgac

SEQ ID NO: 4036940 - DNA, 15 bp, Homo sapiens
cagagtgagccagtg

SEQ ID NO: 4036941 - DNA, 17 bp, Homo sapiens
cagagtgcacagctgtc

SEQ ID NO: 4036942 - DNA, 23 bp, Homo sapiens
cagagtgctgaggccagggctga

SEQ ID NO: 4036943 - DNA, 19 bp, Homo sapiens
cagagtggcctccctgctg

SEQ ID NO: 4036944 - DNA, 18 bp, Homo sapiens
cagagtggcctggccagg

SEQ ID NO: 4036945 - DNA, 22 bp, Homo sapiens
cagagtggcctggccaggagct

SEQ ID NO: 4036946 - DNA, 12 bp, Homo sapiens
cagagtggctgc

SEQ ID NO: 4036947 - DNA, 15 bp, Homo sapiens
cagagtggtctttct

SEQ ID NO: 4036948 - DNA, 23 bp, Homo sapiens
cagagttcacaggaggccagtgg

SEQ ID NO: 4036949 - DNA, 14 bp, Homo sapiens
cagagttcactata

SEQ ID NO: 4036950 - DNA, 20 bp, Homo sapiens
cagagttcactataaatggt

SEQ ID NO: 4036951 - DNA, 23 bp, Homo sapiens
cagagtttagaggaaaaaaatga

SEQ ID NO: 4036952 - DNA, 22 bp, Homo sapiens
cagagtttgccttcctttctcc

SEQ ID NO: 4036953 - DNA, 13 bp, Homo sapiens
cagataaatagaa

SEQ ID NO: 4036954 - DNA, 17 bp, Homo sapiens
cagataaatagaactat

SEQ ID NO: 4036955 - DNA, 22 bp, Homo sapiens
cagataagcaagagagatgttt

SEQ ID NO: 4036956 - DNA, 15 bp, Homo sapiens
cagataatccctgta

SEQ ID NO: 4036957 - DNA, 22 bp, Homo sapiens
cagatactactgaccagacaag

SEQ ID NO: 4036958 - DNA, 13 bp, Homo sapiens
cagatagagctgg

SEQ ID NO: 4036959 - DNA, 17 bp, Homo sapiens
cagatagagctgggtgg

SEQ ID NO: 4036960 - DNA, 14 bp, Homo sapiens
cagatatcaaaatt

SEQ ID NO: 4036961 - DNA, 24 bp, Homo sapiens
cagatatcaaaattctagctgtat

SEQ ID NO: 4036962 - DNA, 12 bp, Homo sapiens
cagatatttata

SEQ ID NO: 4036963 - DNA, 18 bp, Homo sapiens
cagatatttccatttctt

SEQ ID NO: 4036964 - DNA, 22 bp, Homo sapiens
cagatcaaagtatgtatgtttt

SEQ ID NO: 4036965 - DNA, 17 bp, Homo sapiens
cagatcagtcagagccc

SEQ ID NO: 4036966 - DNA, 16 bp, Homo sapiens
cagatcagtgtaccat

SEQ ID NO: 4036967 - DNA, 12 bp, Homo sapiens
cagatccagcct

SEQ ID NO: 4036968 - DNA, 18 bp, Homo sapiens
cagatccccactgtccta

SEQ ID NO: 4036969 - DNA, 13 bp, Homo sapiens
cagatcctttttc

SEQ ID NO: 4036970 - DNA, 17 bp, Homo sapiens
cagatcctttttccatc

SEQ ID NO: 4036971 - DNA, 19 bp, Homo sapiens
cagatcctttttccatcat

SEQ ID NO: 4036972 - DNA, 14 bp, Homo sapiens
cagatctggaacct

SEQ ID NO: 4036973 - DNA, 18 bp, Homo sapiens
cagatctggaacctcagc

SEQ ID NO: 4036974 - DNA, 21 bp, Homo sapiens
cagatctggaacctcagcctg

SEQ ID NO: 4036975 - DNA, 22 bp, Homo sapiens
cagatctggaacctcagcctgg

SEQ ID NO: 4036976 - DNA, 17 bp, Homo sapiens
cagatctggtcccttgc

SEQ ID NO: 4036977 - DNA, 12 bp, Homo sapiens
cagatctgtgcc

SEQ ID NO: 4036978 - DNA, 21 bp, Homo sapiens
cagatctgtgccccatgcctg

SEQ ID NO: 4036979 - DNA, 15 bp, Homo sapiens
cagatgaaaatttga

SEQ ID NO: 4036980 - DNA, 21 bp, Homo sapiens
cagatgaaatgttctgttcac

SEQ ID NO: 4036981 - DNA, 22 bp, Homo sapiens
cagatgaaatgttctgttcacc

SEQ ID NO: 4036982 - DNA, 22 bp, Homo sapiens
cagatgaactctttctggcctg

SEQ ID NO: 4036983 - DNA, 17 bp, Homo sapiens
cagatgaatgccgtgga

SEQ ID NO: 4036984 - DNA, 23 bp, Homo sapiens
cagatgaatgtatttatttggga

SEQ ID NO: 4036985 - DNA, 16 bp, Homo sapiens
cagatgacccctgccc

SEQ ID NO: 4036986 - DNA, 17 bp, Homo sapiens
cagatgacccctgccca

SEQ ID NO: 4036987 - DNA, 23 bp, Homo sapiens
cagatgacccctgcccagatcag

SEQ ID NO: 4036988 - DNA, 16 bp, Homo sapiens
cagatgagcaaggaca

SEQ ID NO: 4036989 - DNA, 18 bp, Homo sapiens
cagatgagcaaggacatt

SEQ ID NO: 4036990 - DNA, 23 bp, Homo sapiens
cagatgagcagtcacactgttac

SEQ ID NO: 4036991 - DNA, 19 bp, Homo sapiens
cagatgatgagaatttcta

SEQ ID NO: 4036992 - DNA, 12 bp, Homo sapiens
cagatgcagctc

SEQ ID NO: 4036993 - DNA, 17 bp, Homo sapiens
cagatgcagctcttcct

SEQ ID NO: 4036994 - DNA, 14 bp, Homo sapiens
cagatgcaggacag

SEQ ID NO: 4036995 - DNA, 17 bp, Homo sapiens
cagatgcaggacaggag

SEQ ID NO: 4036996 - DNA, 14 bp, Homo sapiens
cagatgcagggcag

SEQ ID NO: 4036997 - DNA, 17 bp, Homo sapiens
cagatgcagggcagtca

SEQ ID NO: 4036998 - DNA, 16 bp, Homo sapiens
cagatgccccagagct

SEQ ID NO: 4036999 - DNA, 21 bp, Homo sapiens
cagatgctaaaatccctggat

SEQ ID NO: 4037000 - DNA, 16 bp, Homo sapiens
cagatgctaataaact

SEQ ID NO: 4037001 - DNA, 18 bp, Homo sapiens
cagatgctaataaactgt

SEQ ID NO: 4037002 - DNA, 13 bp, Homo sapiens
cagatgctctgag

SEQ ID NO: 4037003 - DNA, 18 bp, Homo sapiens
cagatggaaatattttga

SEQ ID NO: 4037004 - DNA, 16 bp, Homo sapiens
cagatggaatgctgtg

SEQ ID NO: 4037005 - DNA, 19 bp, Homo sapiens
cagatggaatgctgtgtta

SEQ ID NO: 4037006 - DNA, 21 bp, Homo sapiens
cagatggaatgctgtgttaaa

SEQ ID NO: 4037007 - DNA, 16 bp, Homo sapiens
cagatggactgggagg

SEQ ID NO: 4037008 - DNA, 14 bp, Homo sapiens
cagatggagcccat

SEQ ID NO: 4037009 - DNA, 22 bp, Homo sapiens
cagatggatttgcctgtgccac

SEQ ID NO: 4037010 - DNA, 13 bp, Homo sapiens
cagatggcccgga

SEQ ID NO: 4037011 - DNA, 16 bp, Homo sapiens
cagatggtgaagcatt

SEQ ID NO: 4037012 - DNA, 13 bp, Homo sapiens
cagatgtctctgg

SEQ ID NO: 4037013 - DNA, 14 bp, Homo sapiens
cagatgtctctggg

SEQ ID NO: 4037014 - DNA, 14 bp, Homo sapiens
cagatgtcttccct

SEQ ID NO: 4037015 - DNA, 18 bp, Homo sapiens
cagatgtgtcccccccag

SEQ ID NO: 4037016 - DNA, 14 bp, Homo sapiens
cagatgtttccaga

SEQ ID NO: 4037017 - DNA, 16 bp, Homo sapiens
cagatgtttgcctcat

SEQ ID NO: 4037018 - DNA, 16 bp, Homo sapiens
cagattagatgtgcca

SEQ ID NO: 4037019 - DNA, 19 bp, Homo sapiens
cagattattggctgctttg

SEQ ID NO: 4037020 - DNA, 15 bp, Homo sapiens
cagattctgcctctc

SEQ ID NO: 4037021 - DNA, 12 bp, Homo sapiens
cagattgaaaag

SEQ ID NO: 4037022 - DNA, 13 bp, Homo sapiens
cagattgcctcct

SEQ ID NO: 4037023 - DNA, 13 bp, Homo sapiens
cagatttctggtt

SEQ ID NO: 4037024 - DNA, 14 bp, Homo sapiens
cagatttgatattt

SEQ ID NO: 4037025 - DNA, 18 bp, Homo sapiens
cagattttacaaaagatg

SEQ ID NO: 4037026 - DNA, 19 bp, Homo sapiens
cagattttgctgtatattt

SEQ ID NO: 4037027 - DNA, 23 bp, Homo sapiens
cagattttgctgtatatttgtga

SEQ ID NO: 4037028 - DNA, 21 bp, Homo sapiens
cagcaaacactccaccctcca

SEQ ID NO: 4037029 - DNA, 12 bp, Homo sapiens
cagcaaaccatt

SEQ ID NO: 4037030 - DNA, 21 bp, Homo sapiens
cagcaaaccatttttaaagta

SEQ ID NO: 4037031 - DNA, 24 bp, Homo sapiens
cagcaaaccatttttaaagtagaa

SEQ ID NO: 4037032 - DNA, 16 bp, Homo sapiens
cagcaaaccggggcct

SEQ ID NO: 4037033 - DNA, 21 bp, Homo sapiens
cagcaacacaagctggaagca

SEQ ID NO: 4037034 - DNA, 16 bp, Homo sapiens
cagcaaccccaggctg

SEQ ID NO: 4037035 - DNA, 17 bp, Homo sapiens
cagcaactgaagacaat

SEQ ID NO: 4037036 - DNA, 22 bp, Homo sapiens
cagcaacttgtctttttctgga

SEQ ID NO: 4037037 - DNA, 12 bp, Homo sapiens
cagcaagaaata

SEQ ID NO: 4037038 - DNA, 14 bp, Homo sapiens
cagcaagcgggagc

SEQ ID NO: 4037039 - DNA, 13 bp, Homo sapiens
cagcaaggcaggt

SEQ ID NO: 4037040 - DNA, 22 bp, Homo sapiens
cagcaaggcaggttggatggga

SEQ ID NO: 4037041 - DNA, 16 bp, Homo sapiens
cagcaaggccctgctg

SEQ ID NO: 4037042 - DNA, 13 bp, Homo sapiens
cagcaataagaaa

SEQ ID NO: 4037043 - DNA, 14 bp, Homo sapiens
cagcaataagaaat

SEQ ID NO: 4037044 - DNA, 18 bp, Homo sapiens
cagcaataagaaatgaac

SEQ ID NO: 4037045 - DNA, 19 bp, Homo sapiens
cagcaataagaaatgaaca

SEQ ID NO: 4037046 - DNA, 23 bp, Homo sapiens
cagcaataagaaatgaacaaaag

SEQ ID NO: 4037047 - DNA, 19 bp, Homo sapiens
cagcaatgccatttcagtg

SEQ ID NO: 4037048 - DNA, 16 bp, Homo sapiens
cagcaatttaaatgtt

SEQ ID NO: 4037049 - DNA, 23 bp, Homo sapiens
cagcaatttctaatttttaagaa

SEQ ID NO: 4037050 - DNA, 14 bp, Homo sapiens
cagcacacagggca

SEQ ID NO: 4037051 - DNA, 22 bp, Homo sapiens
cagcacagcttagatttcatag

SEQ ID NO: 4037052 - DNA, 22 bp, Homo sapiens
cagcacagggggattctgagca

SEQ ID NO: 4037053 - DNA, 15 bp, Homo sapiens
cagcaccaaccacag

SEQ ID NO: 4037054 - DNA, 21 bp, Homo sapiens
cagcaccaccctagtcccttc

SEQ ID NO: 4037055 - DNA, 22 bp, Homo sapiens
cagcaccaccctagtcccttcc

SEQ ID NO: 4037056 - DNA, 17 bp, Homo sapiens
cagcaccaccctccttc

SEQ ID NO: 4037057 - DNA, 19 bp, Homo sapiens
cagcacccccacccacctc

SEQ ID NO: 4037058 - DNA, 18 bp, Homo sapiens
cagcaccctcccccgcag

SEQ ID NO: 4037059 - DNA, 16 bp, Homo sapiens
cagcaccctctcctgg

SEQ ID NO: 4037060 - DNA, 14 bp, Homo sapiens
cagcacctccaggc

SEQ ID NO: 4037061 - DNA, 10 bp, Homo sapiens
cagcactaac

SEQ ID NO: 4037062 - DNA, 16 bp, Homo sapiens
cagcactaaggccgtg

SEQ ID NO: 4037063 - DNA, 17 bp, Homo sapiens
cagcactccgcatcacc

SEQ ID NO: 4037064 - DNA, 22 bp, Homo sapiens
cagcactggtgaactgagctgg

SEQ ID NO: 4037065 - DNA, 20 bp, Homo sapiens
cagcactgtcccttgcctca

SEQ ID NO: 4037066 - DNA, 23 bp, Homo sapiens
cagcactgtctcagtttcacttt

SEQ ID NO: 4037067 - DNA, 12 bp, Homo sapiens
cagcactgtgaa

SEQ ID NO: 4037068 - DNA, 13 bp, Homo sapiens
cagcacttattta

SEQ ID NO: 4037069 - DNA, 15 bp, Homo sapiens
cagcacttgtccagc

SEQ ID NO: 4037070 - DNA, 17 bp, Homo sapiens
cagcacttgtccagctg

SEQ ID NO: 4037071 - DNA, 18 bp, Homo sapiens
cagcacttgtccagctga

SEQ ID NO: 4037072 - DNA, 19 bp, Homo sapiens
cagcacttgtccagctgag

SEQ ID NO: 4037073 - DNA, 16 bp, Homo sapiens
cagcactttgggaggc

SEQ ID NO: 4037074 - DNA, 18 bp, Homo sapiens
cagcactttgggaggccg

SEQ ID NO: 4037075 - DNA, 22 bp, Homo sapiens
cagcactttgggaggcctaggc

SEQ ID NO: 4037076 - DNA, 17 bp, Homo sapiens
cagcactttgggaggct

SEQ ID NO: 4037077 - DNA, 15 bp, Homo sapiens
cagcagaagacaaaa

SEQ ID NO: 4037078 - DNA, 15 bp, Homo sapiens
cagcagacacacatg

SEQ ID NO: 4037079 - DNA, 19 bp, Homo sapiens
cagcagactttctctgtgt

SEQ ID NO: 4037080 - DNA, 24 bp, Homo sapiens
cagcagataacaatgcagcaaggc

SEQ ID NO: 4037081 - DNA, 15 bp, Homo sapiens
cagcagcagcccaag

SEQ ID NO: 4037082 - DNA, 13 bp, Homo sapiens
cagcagcccaagc

SEQ ID NO: 4037083 - DNA, 13 bp, Homo sapiens
cagcagcccccca

SEQ ID NO: 4037084 - DNA, 14 bp, Homo sapiens
cagcagccccccag

SEQ ID NO: 4037085 - DNA, 18 bp, Homo sapiens
cagcagccccccagcact

SEQ ID NO: 4037086 - DNA, 21 bp, Homo sapiens
cagcagccccccagcactaag

SEQ ID NO: 4037087 - DNA, 16 bp, Homo sapiens
cagcagccctaaggat

SEQ ID NO: 4037088 - DNA, 23 bp, Homo sapiens
cagcagccctaaggatctctcag

SEQ ID NO: 4037089 - DNA, 16 bp, Homo sapiens
cagcagccctcaacag

SEQ ID NO: 4037090 - DNA, 22 bp, Homo sapiens
cagcagccgccttaagctgatc

SEQ ID NO: 4037091 - DNA, 20 bp, Homo sapiens
cagcagcctggggctggcct

SEQ ID NO: 4037092 - DNA, 12 bp, Homo sapiens
cagcagcttcac

SEQ ID NO: 4037093 - DNA, 16 bp, Homo sapiens
caggggacacccagaa

SEQ ID NO: 4037094 - DNA, 15 bp, Homo sapiens
caggggactcagccc

SEQ ID NO: 4037095 - DNA, 23 bp, Homo sapiens
caggggactcagccctgaggtga

SEQ ID NO: 4037096 - DNA, 16 bp, Homo sapiens
caggggagacaggagc

SEQ ID NO: 4037097 - DNA, 23 bp, Homo sapiens
caggggatacaggcccctgggtt

SEQ ID NO: 4037098 - DNA, 14 bp, Homo sapiens
caggggccagagga

SEQ ID NO: 4037099 - DNA, 21 bp, Homo sapiens
caggggcccaaggcggcccct

SEQ ID NO: 4037100 - DNA, 22 bp, Homo sapiens
caggggcccaaggcggcccctc

SEQ ID NO: 4037101 - DNA, 19 bp, Homo sapiens
caggggccctgcagctctc

SEQ ID NO: 4037102 - DNA, 20 bp, Homo sapiens
caggggctgggctccctgat

SEQ ID NO: 4037103 - DNA, 20 bp, Homo sapiens
caggggctggtgggacagtg

SEQ ID NO: 4037104 - DNA, 16 bp, Homo sapiens
cagggggagaatgggt

SEQ ID NO: 4037105 - DNA, 19 bp, Homo sapiens
cagggggattctgagcagt

SEQ ID NO: 4037106 - DNA, 12 bp, Homo sapiens
cagggggccccg

SEQ ID NO: 4037107 - DNA, 22 bp, Homo sapiens
cagggggccccgccagggctgg

SEQ ID NO: 4037108 - DNA, 18 bp, Homo sapiens
caggggggtgaggagctg

SEQ ID NO: 4037109 - DNA, 19 bp, Homo sapiens
caggggggttgtgaggcct

SEQ ID NO: 4037110 - DNA, 22 bp, Homo sapiens
cagggggtgaagaaccctctgt

SEQ ID NO: 4037111 - DNA, 22 bp, Homo sapiens
caggggtaggggtagggagcct

SEQ ID NO: 4037112 - DNA, 23 bp, Homo sapiens
caggggtaggggtagggagcctc

SEQ ID NO: 4037113 - DNA, 14 bp, Homo sapiens
caggggtcccccct

SEQ ID NO: 4037114 - DNA, 14 bp, Homo sapiens
caggggtctccctg

SEQ ID NO: 4037115 - DNA, 17 bp, Homo sapiens
caggggtctccctggag

SEQ ID NO: 4037116 - DNA, 14 bp, Homo sapiens
caggggtctgtctg

SEQ ID NO: 4037117 - DNA, 22 bp, Homo sapiens
caggggtggggggtgcaggtgg

SEQ ID NO: 4037118 - DNA, 17 bp, Homo sapiens
caggggttcgagaccag

SEQ ID NO: 4037119 - DNA, 21 bp, Homo sapiens
cagggtaccctttggggagca

SEQ ID NO: 4037120 - DNA, 19 bp, Homo sapiens
cagggtacctcaagcccca

SEQ ID NO: 4037121 - DNA, 13 bp, Homo sapiens
cagggtaggaaag

SEQ ID NO: 4037122 - DNA, 17 bp, Homo sapiens
cagggtcaaagacagaa

SEQ ID NO: 4037123 - DNA, 21 bp, Homo sapiens
cagggtcccatttctcactga

SEQ ID NO: 4037124 - DNA, 20 bp, Homo sapiens
cagggtcctcttctgggcct

SEQ ID NO: 4037125 - DNA, 16 bp, Homo sapiens
cagggtctctccctca

SEQ ID NO: 4037126 - DNA, 14 bp, Homo sapiens
cagggtctgctctt

SEQ ID NO: 4037127 - DNA, 15 bp, Homo sapiens
cagggtcttgctctg

SEQ ID NO: 4037128 - DNA, 15 bp, Homo sapiens
cagggtgagagctgc

SEQ ID NO: 4037129 - DNA, 20 bp, Homo sapiens
cagggtgcagtatcatgccc

SEQ ID NO: 4037130 - DNA, 17 bp, Homo sapiens
cagggtgggcagcctat

SEQ ID NO: 4037131 - DNA, 16 bp, Homo sapiens
cagggtgggcttcctg

SEQ ID NO: 4037132 - DNA, 19 bp, Homo sapiens
cagggtgggcttcctgccc

SEQ ID NO: 4037133 - DNA, 20 bp, Homo sapiens
cagggtgggcttcctgccct

SEQ ID NO: 4037134 - DNA, 11 bp, Homo sapiens
cagggtggggg

SEQ ID NO: 4037135 - DNA, 13 bp, Homo sapiens
cagggtggggggt

SEQ ID NO: 4037136 - DNA, 16 bp, Homo sapiens
cagggtggggggtgac

SEQ ID NO: 4037137 - DNA, 14 bp, Homo sapiens
cagggttaaactgc

SEQ ID NO: 4037138 - DNA, 22 bp, Homo sapiens
cagggttaaactgcaggagcag

SEQ ID NO: 4037139 - DNA, 14 bp, Homo sapiens
cagggttcatctgt

SEQ ID NO: 4037140 - DNA, 14 bp, Homo sapiens
cagggttgggccca

SEQ ID NO: 4037141 - DNA, 15 bp, Homo sapiens
cagggttgggcccag

SEQ ID NO: 4037142 - DNA, 21 bp, Homo sapiens
cagggttgggcccagatctgg

SEQ ID NO: 4037143 - DNA, 16 bp, Homo sapiens
cagggtttaatagact

SEQ ID NO: 4037144 - DNA, 19 bp, Homo sapiens
cagggtttacccagtggga

SEQ ID NO: 4037145 - DNA, 22 bp, Homo sapiens
cagggtttacccagtgggacag

SEQ ID NO: 4037146 - DNA, 19 bp, Homo sapiens
cagggtttcaccatgttgc

SEQ ID NO: 4037147 - DNA, 19 bp, Homo sapiens
cagggtttctctgcagatg

SEQ ID NO: 4037148 - DNA, 22 bp, Homo sapiens
cagggtttctctgcagatgtgc

SEQ ID NO: 4037149 - DNA, 21 bp, Homo sapiens
cagggttttggggtcctgggc

SEQ ID NO: 4037150 - DNA, 19 bp, Homo sapiens
cagggtttttacctgtcac

SEQ ID NO: 4037151 - DNA, 23 bp, Homo sapiens
caggtaatgagggactggaacca

SEQ ID NO: 4037152 - DNA, 20 bp, Homo sapiens
caggtaccacccttcagacc

SEQ ID NO: 4037153 - DNA, 21 bp, Homo sapiens
caggtaccacccttcagaccc

SEQ ID NO: 4037154 - DNA, 13 bp, Homo sapiens
caggtaccagctg

SEQ ID NO: 4037155 - DNA, 15 bp, Homo sapiens
caggtaccagctgcg

SEQ ID NO: 4037156 - DNA, 17 bp, Homo sapiens
caggtaccagctgcgct

SEQ ID NO: 4037157 - DNA, 19 bp, Homo sapiens
caggtagaacgccagggac

SEQ ID NO: 4037158 - DNA, 18 bp, Homo sapiens
caggtagttgcaattgaa

SEQ ID NO: 4037159 - DNA, 23 bp, Homo sapiens
caggtagttgcaattgaattaaa

SEQ ID NO: 4037160 - DNA, 15 bp, Homo sapiens
caggtatctccagga

SEQ ID NO: 4037161 - DNA, 18 bp, Homo sapiens
caggtatctccaggattg

SEQ ID NO: 4037162 - DNA, 14 bp, Homo sapiens
caggtatggctctg

SEQ ID NO: 4037163 - DNA, 20 bp, Homo sapiens
caggtattttgtttctttta

SEQ ID NO: 4037164 - DNA, 18 bp, Homo sapiens
caggtcccacgtctggcc

SEQ ID NO: 4037165 - DNA, 13 bp, Homo sapiens
caggtcctgccca

SEQ ID NO: 4037166 - DNA, 23 bp, Homo sapiens
caggtcctgcccatgtgtcccct

SEQ ID NO: 4037167 - DNA, 13 bp, Homo sapiens
caggtcctgctca

SEQ ID NO: 4037168 - DNA, 12 bp, Homo sapiens
caggtctcccac

SEQ ID NO: 4037169 - DNA, 13 bp, Homo sapiens
caggtctcccacg

SEQ ID NO: 4037170 - DNA, 19 bp, Homo sapiens
caggtctcccacgtgggag

SEQ ID NO: 4037171 - DNA, 20 bp, Homo sapiens
caggtcttcatcgaatctac

SEQ ID NO: 4037172 - DNA, 23 bp, Homo sapiens
caggtcttgactcatggcagctg

SEQ ID NO: 4037173 - DNA, 23 bp, Homo sapiens
caggtgaaggaggctccaggcag

SEQ ID NO: 4037174 - DNA, 12 bp, Homo sapiens
caggtgacatgt

SEQ ID NO: 4037175 - DNA, 16 bp, Homo sapiens
caggtgacatgtgaaa

SEQ ID NO: 4037176 - DNA, 21 bp, Homo sapiens
caggtgacatgtgaaaccttt

SEQ ID NO: 4037177 - DNA, 22 bp, Homo sapiens
caggtgagaaactgtttgaaaa

SEQ ID NO: 4037178 - DNA, 18 bp, Homo sapiens
caggtgagctctgaccct

SEQ ID NO: 4037179 - DNA, 21 bp, Homo sapiens
caggtgcatgcatgccctctc

SEQ ID NO: 4037180 - DNA, 18 bp, Homo sapiens
caggtgccagcctgaggc

SEQ ID NO: 4037181 - DNA, 23 bp, Homo sapiens
caggtgccagcctgaggcagcca

SEQ ID NO: 4037182 - DNA, 16 bp, Homo sapiens
caggtgccagggccca

SEQ ID NO: 4037183 - DNA, 21 bp, Homo sapiens
caggtgctcaataaacacttg

SEQ ID NO: 4037184 - DNA, 22 bp, Homo sapiens
caggtgctcaataaacacttgt

SEQ ID NO: 4037185 - DNA, 13 bp, Homo sapiens
caggtgctgtcca

SEQ ID NO: 4037186 - DNA, 16 bp, Homo sapiens
caggtggaaggcagac

SEQ ID NO: 4037187 - DNA, 19 bp, Homo sapiens
caggtggaaggcagacagc

SEQ ID NO: 4037188 - DNA, 16 bp, Homo sapiens
caggtggatgaggaga

SEQ ID NO: 4037189 - DNA, 20 bp, Homo sapiens
caggtggcaggaccaggact

SEQ ID NO: 4037190 - DNA, 15 bp, Homo sapiens
caggtggccactcca

SEQ ID NO: 4037191 - DNA, 19 bp, Homo sapiens
caggtggccactccagacc

SEQ ID NO: 4037192 - DNA, 12 bp, Homo sapiens
caggtgggcact

SEQ ID NO: 4037193 - DNA, 12 bp, Homo sapiens
caggtgggctgg

SEQ ID NO: 4037194 - DNA, 20 bp, Homo sapiens
caggtggggactgggcacag

SEQ ID NO: 4037195 - DNA, 17 bp, Homo sapiens
caggcacacagcagccc

SEQ ID NO: 4037196 - DNA, 14 bp, Homo sapiens
caggcacacagcta

SEQ ID NO: 4037197 - DNA, 20 bp, Homo sapiens
caggcacacagctactctcc

SEQ ID NO: 4037198 - DNA, 13 bp, Homo sapiens
caggcacagctga

SEQ ID NO: 4037199 - DNA, 17 bp, Homo sapiens
caggcacagggcccgca

SEQ ID NO: 4037200 - DNA, 23 bp, Homo sapiens
caggcacagggcccgcagtgctg

SEQ ID NO: 4037201 - DNA, 21 bp, Homo sapiens
caggcaccccctggagagaag

SEQ ID NO: 4037202 - DNA, 14 bp, Homo sapiens
caggcaccctcagg

SEQ ID NO: 4037203 - DNA, 20 bp, Homo sapiens
caggcaccctcagggagcct

SEQ ID NO: 4037204 - DNA, 16 bp, Homo sapiens
caggcaccgagaatgt

SEQ ID NO: 4037205 - DNA, 17 bp, Homo sapiens
caggcaccgagaatgtt

SEQ ID NO: 4037206 - DNA, 14 bp, Homo sapiens
caggcacggtttgg

SEQ ID NO: 4037207 - DNA, 18 bp, Homo sapiens
caggcactgccttctcct

SEQ ID NO: 4037208 - DNA, 17 bp, Homo sapiens
caggcagagctggagcc

SEQ ID NO: 4037209 - DNA, 14 bp, Homo sapiens
caggcagatccagg

SEQ ID NO: 4037210 - DNA, 17 bp, Homo sapiens
caggcagatccaggact

SEQ ID NO: 4037211 - DNA, 18 bp, Homo sapiens
caggcagatccaggacta

SEQ ID NO: 4037212 - DNA, 22 bp, Homo sapiens
caggcagatctgtgccccatgc

SEQ ID NO: 4037213 - DNA, 16 bp, Homo sapiens
caggcagcccagcagt

SEQ ID NO: 4037214 - DNA, 20 bp, Homo sapiens
caggcagcccagcagtgtgg

SEQ ID NO: 4037215 - DNA, 19 bp, Homo sapiens
caggcagcgccaagtgcgt

SEQ ID NO: 4037216 - DNA, 20 bp, Homo sapiens
caggcagcgccaagtgcgtg

SEQ ID NO: 4037217 - DNA, 15 bp, Homo sapiens
caggcagctggatga

SEQ ID NO: 4037218 - DNA, 20 bp, Homo sapiens
caggcaggggccctgcagct

SEQ ID NO: 4037219 - DNA, 22 bp, Homo sapiens
caggcaggggtgggggtggagg

SEQ ID NO: 4037220 - DNA, 14 bp, Homo sapiens
caggcatagaggct

SEQ ID NO: 4037221 - DNA, 18 bp, Homo sapiens
caggcataggcctgggtg

SEQ ID NO: 4037222 - DNA, 17 bp, Homo sapiens
caggcatctacacagcc

SEQ ID NO: 4037223 - DNA, 21 bp, Homo sapiens
caggcatctacacagcctgga

SEQ ID NO: 4037224 - DNA, 15 bp, Homo sapiens
caggcatggctcaga

SEQ ID NO: 4037225 - DNA, 17 bp, Homo sapiens
caggcatggctcagagc

SEQ ID NO: 4037226 - DNA, 21 bp, Homo sapiens
caggcatttgactgaagatgc

SEQ ID NO: 4037227 - DNA, 16 bp, Homo sapiens
caggccaacagcacct

SEQ ID NO: 4037228 - DNA, 15 bp, Homo sapiens
caggccaccaggatg

SEQ ID NO: 4037229 - DNA, 16 bp, Homo sapiens
caggccaccaggatgg

SEQ ID NO: 4037230 - DNA, 17 bp, Homo sapiens
caggccaccctgtgcag

SEQ ID NO: 4037231 - DNA, 20 bp, Homo sapiens
caggccagagggcagtggcc

SEQ ID NO: 4037232 - DNA, 12 bp, Homo sapiens
caggccagccca

SEQ ID NO: 4037233 - DNA, 14 bp, Homo sapiens
caggccagcccagc

SEQ ID NO: 4037234 - DNA, 19 bp, Homo sapiens
caggccagcccagccaggc

SEQ ID NO: 4037235 - DNA, 13 bp, Homo sapiens
caggccagcctcc

SEQ ID NO: 4037236 - DNA, 19 bp, Homo sapiens
caggccagtgtctgggttt

SEQ ID NO: 4037237 - DNA, 16 bp, Homo sapiens
caggccatgtgagcca

SEQ ID NO: 4037238 - DNA, 17 bp, Homo sapiens
caggccatgtgagccac

SEQ ID NO: 4037239 - DNA, 16 bp, Homo sapiens
caggcccaaggctccc

SEQ ID NO: 4037240 - DNA, 13 bp, Homo sapiens
caggcccagcgcg

SEQ ID NO: 4037241 - DNA, 14 bp, Homo sapiens
caggcccagcgcgg

SEQ ID NO: 4037242 - DNA, 18 bp, Homo sapiens
caggcccaggcctcacca

SEQ ID NO: 4037243 - DNA, 14 bp, Homo sapiens
caggcccccctgtc

SEQ ID NO: 4037244 - DNA, 14 bp, Homo sapiens
caggcccctgggtt

SEQ ID NO: 4037245 - DNA, 16 bp, Homo sapiens
caggcccggcagggcg

SEQ ID NO: 4037246 - DNA, 19 bp, Homo sapiens
caggccctgactcctctgg

SEQ ID NO: 4037247 - DNA, 22 bp, Homo sapiens
caggccctgactcctctggctt

SEQ ID NO: 4037248 - DNA, 13 bp, Homo sapiens
caggccctgctcc

SEQ ID NO: 4037249 - DNA, 20 bp, Homo sapiens
caggccctgctcctgcagca

SEQ ID NO: 4037250 - DNA, 16 bp, Homo sapiens
caggcccttcctctcc

SEQ ID NO: 4037251 - DNA, 20 bp, Homo sapiens
caggcccttcctctccactg

SEQ ID NO: 4037252 - DNA, 21 bp, Homo sapiens
caggcccttcctctccactgc

SEQ ID NO: 4037253 - DNA, 20 bp, Homo sapiens
caggccctttgaagcctcag

SEQ ID NO: 4037254 - DNA, 22 bp, Homo sapiens
caggccctttgaagcctcagct

SEQ ID NO: 4037255 - DNA, 14 bp, Homo sapiens
caggccggaaccac

SEQ ID NO: 4037256 - DNA, 16 bp, Homo sapiens
caggccggaaccacag

SEQ ID NO: 4037257 - DNA, 21 bp, Homo sapiens
caggccggaaccacagggcca

SEQ ID NO: 4037258 - DNA, 22 bp, Homo sapiens
caggccggaaccacagggccag

SEQ ID NO: 4037259 - DNA, 16 bp, Homo sapiens
caggccggcccagatg

SEQ ID NO: 4037260 - DNA, 14 bp, Homo sapiens
caggccgggcagag

SEQ ID NO: 4037261 - DNA, 19 bp, Homo sapiens
caggccgggcttgggccct

SEQ ID NO: 4037262 - DNA, 22 bp, Homo sapiens
caggcctacagccacatcccca

SEQ ID NO: 4037263 - DNA, 15 bp, Homo sapiens
caggcctccctctct

SEQ ID NO: 4037264 - DNA, 18 bp, Homo sapiens
caggcctccctctctctt

SEQ ID NO: 4037265 - DNA, 19 bp, Homo sapiens
caggcctccctctctcttc

SEQ ID NO: 4037266 - DNA, 23 bp, Homo sapiens
caggcctccctctctcttctgct

SEQ ID NO: 4037267 - DNA, 13 bp, Homo sapiens
caggcctccctgc

SEQ ID NO: 4037268 - DNA, 23 bp, Homo sapiens
caggcctctgctgccgcccttcc

SEQ ID NO: 4037269 - DNA, 12 bp, Homo sapiens
caggcctctgtg

SEQ ID NO: 4037270 - DNA, 13 bp, Homo sapiens
caggcctctgtgt

SEQ ID NO: 4037271 - DNA, 22 bp, Homo sapiens
caggcctctgtgtccttccctg

SEQ ID NO: 4037272 - DNA, 20 bp, Homo sapiens
caggcctgaaagaggctgag

SEQ ID NO: 4037273 - DNA, 23 bp, Homo sapiens
caggcctgaaagaggctgaggcc

SEQ ID NO: 4037274 - DNA, 12 bp, Homo sapiens
caggcctgcctc

SEQ ID NO: 4037275 - DNA, 16 bp, Homo sapiens
caggcctgggtctgtg

SEQ ID NO: 4037276 - DNA, 19 bp, Homo sapiens
caggcctgggtctgtgtct

SEQ ID NO: 4037277 - DNA, 20 bp, Homo sapiens
caggcctgggtctgtgtctc

SEQ ID NO: 4037278 - DNA, 23 bp, Homo sapiens
caggccttgtcctacgtccaagg

SEQ ID NO: 4037279 - DNA, 20 bp, Homo sapiens
caggcgagagaggagccaga

SEQ ID NO: 4037280 - DNA, 20 bp, Homo sapiens
caggcgatccacctgtctca

SEQ ID NO: 4037281 - DNA, 23 bp, Homo sapiens
caggcgatggggcaagacagaaa

SEQ ID NO: 4037282 - DNA, 15 bp, Homo sapiens
caggcgccccttccc

SEQ ID NO: 4037283 - DNA, 17 bp, Homo sapiens
caggcgccccttccccc

SEQ ID NO: 4037284 - DNA, 20 bp, Homo sapiens
caggcgctagcacagctccc

SEQ ID NO: 4037285 - DNA, 16 bp, Homo sapiens
caggcgggaggaggtg

SEQ ID NO: 4037286 - DNA, 16 bp, Homo sapiens
caggcggggtgctgtg

SEQ ID NO: 4037287 - DNA, 18 bp, Homo sapiens
caggcggggtgctgtggt

SEQ ID NO: 4037288 - DNA, 23 bp, Homo sapiens
caggcggtccccatccccaccag

SEQ ID NO: 4037289 - DNA, 23 bp, Homo sapiens
caggctaatgttggcagatgcag

SEQ ID NO: 4037290 - DNA, 14 bp, Homo sapiens
caggctcactgcca

SEQ ID NO: 4037291 - DNA, 21 bp, Homo sapiens
caggctcactgccaggccagc

SEQ ID NO: 4037292 - DNA, 22 bp, Homo sapiens
caggctcactgccaggccagcc

SEQ ID NO: 4037293 - DNA, 13 bp, Homo sapiens
caggctctgctgg

SEQ ID NO: 4037294 - DNA, 14 bp, Homo sapiens
caggctctgctggt

SEQ ID NO: 4037295 - DNA, 13 bp, Homo sapiens
caggctctgtgga

SEQ ID NO: 4037296 - DNA, 15 bp, Homo sapiens
caggctcttagcagc

SEQ ID NO: 4037297 - DNA, 15 bp, Homo sapiens
caggctcttctcctt

SEQ ID NO: 4037298 - DNA, 21 bp, Homo sapiens
caggaagggggtccacccagc

SEQ ID NO: 4037299 - DNA, 20 bp, Homo sapiens
caggaagtcagtcacgtttc

SEQ ID NO: 4037300 - DNA, 21 bp, Homo sapiens
caggaagtccttatctagctg

SEQ ID NO: 4037301 - DNA, 12 bp, Homo sapiens
caggaataaggc

SEQ ID NO: 4037302 - DNA, 17 bp, Homo sapiens
caggaatatatgtgtgc

SEQ ID NO: 4037303 - DNA, 16 bp, Homo sapiens
caggaatcaagagctg

SEQ ID NO: 4037304 - DNA, 16 bp, Homo sapiens
caggaatttcccagga

SEQ ID NO: 4037305 - DNA, 13 bp, Homo sapiens
caggacagagttc

SEQ ID NO: 4037306 - DNA, 19 bp, Homo sapiens
caggacagcatcccttccc

SEQ ID NO: 4037307 - DNA, 20 bp, Homo sapiens
caggacatgcggtagccagc

SEQ ID NO: 4037308 - DNA, 16 bp, Homo sapiens
caggacattaaaaatg

SEQ ID NO: 4037309 - DNA, 20 bp, Homo sapiens
caggaccagccagcagcagc

SEQ ID NO: 4037310 - DNA, 12 bp, Homo sapiens
caggaccagctc

SEQ ID NO: 4037311 - DNA, 20 bp, Homo sapiens
caggaccagctcaggacaga

SEQ ID NO: 4037312 - DNA, 14 bp, Homo sapiens
caggaccaggacta

SEQ ID NO: 4037313 - DNA, 13 bp, Homo sapiens
caggaccctgaag

SEQ ID NO: 4037314 - DNA, 18 bp, Homo sapiens
caggaccctgaaggggcc

SEQ ID NO: 4037315 - DNA, 22 bp, Homo sapiens
caggacctctgtaggcagcaga

SEQ ID NO: 4037316 - DNA, 17 bp, Homo sapiens
caggacctggctgccat

SEQ ID NO: 4037317 - DNA, 18 bp, Homo sapiens
caggacctggctgccata

SEQ ID NO: 4037318 - DNA, 15 bp, Homo sapiens
caggacggctcctca

SEQ ID NO: 4037319 - DNA, 17 bp, Homo sapiens
caggacggctcctcaga

SEQ ID NO: 4037320 - DNA, 19 bp, Homo sapiens
caggacggctcctcagagc

SEQ ID NO: 4037321 - DNA, 17 bp, Homo sapiens
caggacgtctggggtgt

SEQ ID NO: 4037322 - DNA, 19 bp, Homo sapiens
caggactccaggcccaagg

SEQ ID NO: 4037323 - DNA, 21 bp, Homo sapiens
caggactccaggcccaaggct

SEQ ID NO: 4037324 - DNA, 13 bp, Homo sapiens
caggactccctcc

SEQ ID NO: 4037325 - DNA, 16 bp, Homo sapiens
caggactccctcctca

SEQ ID NO: 4037326 - DNA, 19 bp, Homo sapiens
caggacttaacggctccag

SEQ ID NO: 4037327 - DNA, 20 bp, Homo sapiens
caggacttggtctgatttca

SEQ ID NO: 4037328 - DNA, 23 bp, Homo sapiens
caggacttggtctgatttcagga

SEQ ID NO: 4037329 - DNA, 20 bp, Homo sapiens
caggagaccacggggagcaa

SEQ ID NO: 4037330 - DNA, 19 bp, Homo sapiens
caggagagactgagcagcc

SEQ ID NO: 4037331 - DNA, 22 bp, Homo sapiens
caggagatcgagaccatcctgg

SEQ ID NO: 4037332 - DNA, 14 bp, Homo sapiens
caggagatggaggg

SEQ ID NO: 4037333 - DNA, 14 bp, Homo sapiens
caggagcaatggga

SEQ ID NO: 4037334 - DNA, 15 bp, Homo sapiens
caggagcaatgggac

SEQ ID NO: 4037335 - DNA, 22 bp, Homo sapiens
caggagcaatgggactggagtc

SEQ ID NO: 4037336 - DNA, 15 bp, Homo sapiens
caggagcagtttgcc

SEQ ID NO: 4037337 - DNA, 14 bp, Homo sapiens
caggagccccgcca

SEQ ID NO: 4037338 - DNA, 13 bp, Homo sapiens
caggagcctagcg

SEQ ID NO: 4037339 - DNA, 13 bp, Homo sapiens
caggagctcaggt

SEQ ID NO: 4037340 - DNA, 19 bp, Homo sapiens
caggagctgtcaccaagga

SEQ ID NO: 4037341 - DNA, 22 bp, Homo sapiens
caggagctgtcaccaaggaaac

SEQ ID NO: 4037342 - DNA, 20 bp, Homo sapiens
caggagcttgggcagtgccc

SEQ ID NO: 4037343 - DNA, 23 bp, Homo sapiens
caggaggattgcttgagcccagg

SEQ ID NO: 4037344 - DNA, 14 bp, Homo sapiens
caggaggccaataa

SEQ ID NO: 4037345 - DNA, 16 bp, Homo sapiens
caggaggccagtgggc

SEQ ID NO: 4037346 - DNA, 20 bp, Homo sapiens
caggaggcggcccggccagc

SEQ ID NO: 4037347 - DNA, 18 bp, Homo sapiens
caggaggctgaggcagga

SEQ ID NO: 4037348 - DNA, 21 bp, Homo sapiens
caggaggctgggacgctctgc

SEQ ID NO: 4037349 - DNA, 18 bp, Homo sapiens
caggagggaccaccctcc

SEQ ID NO: 4037350 - DNA, 15 bp, Homo sapiens
caggagggagcagag

SEQ ID NO: 4037351 - DNA, 11 bp, Homo sapiens
caggagggagg

SEQ ID NO: 4037352 - DNA, 19 bp, Homo sapiens
caggagggaggtttgtgag

SEQ ID NO: 4037353 - DNA, 22 bp, Homo sapiens
caggagggattggccgcttggc

SEQ ID NO: 4037354 - DNA, 19 bp, Homo sapiens
caggagggcaagggccatg

SEQ ID NO: 4037355 - DNA, 12 bp, Homo sapiens
caggagggccct

SEQ ID NO: 4037356 - DNA, 17 bp, Homo sapiens
caggaggggaactgagt

SEQ ID NO: 4037357 - DNA, 19 bp, Homo sapiens
caggaggggaactgagtca

SEQ ID NO: 4037358 - DNA, 24 bp, Homo sapiens
caggaggggaactgagtcacgctg

SEQ ID NO: 4037359 - DNA, 18 bp, Homo sapiens
caggaggggtctcatgtc

SEQ ID NO: 4037360 - DNA, 18 bp, Homo sapiens
caggaggtggctatggcc

SEQ ID NO: 4037361 - DNA, 22 bp, Homo sapiens
caggaggtggctatggccaccc

SEQ ID NO: 4037362 - DNA, 23 bp, Homo sapiens
caggagtagtgaagactccagaa

SEQ ID NO: 4037363 - DNA, 16 bp, Homo sapiens
caggagtcagtgtctg

SEQ ID NO: 4037364 - DNA, 18 bp, Homo sapiens
caggagtcagtgtctggc

SEQ ID NO: 4037365 - DNA, 20 bp, Homo sapiens
caggagtcagtgtctggctt

SEQ ID NO: 4037366 - DNA, 18 bp, Homo sapiens
caggagtcccaaggaaag

SEQ ID NO: 4037367 - DNA, 21 bp, Homo sapiens
caggagtcccaaggaaagccc

SEQ ID NO: 4037368 - DNA, 24 bp, Homo sapiens
caggagtcccaaggaaagccccag

SEQ ID NO: 4037369 - DNA, 17 bp, Homo sapiens
caggagtctctgccacc

SEQ ID NO: 4037370 - DNA, 20 bp, Homo sapiens
caggagtctctgccacccac

SEQ ID NO: 4037371 - DNA, 21 bp, Homo sapiens
caggagtctctgccacccact

SEQ ID NO: 4037372 - DNA, 22 bp, Homo sapiens
caggagtgtcctgcccatgccc

SEQ ID NO: 4037373 - DNA, 18 bp, Homo sapiens
caggagttcgaggctgca

SEQ ID NO: 4037374 - DNA, 22 bp, Homo sapiens
caggagttggaatgttgtagtt

SEQ ID NO: 4037375 - DNA, 17 bp, Homo sapiens
caggataaggagactga

SEQ ID NO: 4037376 - DNA, 22 bp, Homo sapiens
caggataaggagactgaggctt

SEQ ID NO: 4037377 - DNA, 17 bp, Homo sapiens
caggatactctgtcaga

SEQ ID NO: 4037378 - DNA, 18 bp, Homo sapiens
caggatactctgtcagat

SEQ ID NO: 4037379 - DNA, 20 bp, Homo sapiens
caggatactctgtcagatgg

SEQ ID NO: 4037380 - DNA, 22 bp, Homo sapiens
caggatatccttatcagagcta

SEQ ID NO: 4037381 - DNA, 17 bp, Homo sapiens
caggatcagttaactat

SEQ ID NO: 4037382 - DNA, 20 bp, Homo sapiens
caggatcctattctcaccag

SEQ ID NO: 4037383 - DNA, 21 bp, Homo sapiens
caggatcctattctcaccagg

SEQ ID NO: 4037384 - DNA, 16 bp, Homo sapiens
caggatgaacccagga

SEQ ID NO: 4037385 - DNA, 23 bp, Homo sapiens
caggatgctaacatctaaaaata

SEQ ID NO: 4037386 - DNA, 13 bp, Homo sapiens
caggatgctggcc

SEQ ID NO: 4037387 - DNA, 17 bp, Homo sapiens
caggatggactcttctc

SEQ ID NO: 4037388 - DNA, 15 bp, Homo sapiens
caggatggcctttcc

SEQ ID NO: 4037389 - DNA, 16 bp, Homo sapiens
caggatggcctttcct

SEQ ID NO: 4037390 - DNA, 17 bp, Homo sapiens
caggatggcctttcctt

SEQ ID NO: 4037391 - DNA, 21 bp, Homo sapiens
caggatggcctttccttccct

SEQ ID NO: 4037392 - DNA, 22 bp, Homo sapiens
caggatggtctcgatctcctga

SEQ ID NO: 4037393 - DNA, 22 bp, Homo sapiens
caggatgtagttctgccaggca

SEQ ID NO: 4037394 - DNA, 22 bp, Homo sapiens
caggattctcaccagctgtgtc

SEQ ID NO: 4037395 - DNA, 18 bp, Homo sapiens
caggcaaaaaagggacag

SEQ ID NO: 4037396 - DNA, 22 bp, Homo sapiens
caggcaacgcacaaaacagaaa

SEQ ID NO: 4037397 - DNA, 21 bp, Homo sapiens
caggcaaggggaatctggagg

SEQ ID NO: 4037398 - DNA, 12 bp, Homo sapiens
caggcacacagc

SEQ ID NO: 4037399 - DNA, 16 bp, Homo sapiens
caggcacacagcagcc

SEQ ID NO: 4037400 - DNA, 21 bp, Homo sapiens
cagcctggcacagggcagtgg

SEQ ID NO: 4037401 - DNA, 10 bp, Homo sapiens
cagcctggcc

SEQ ID NO: 4037402 - DNA, 18 bp, Homo sapiens
cagcctggccagacacag

SEQ ID NO: 4037403 - DNA, 14 bp, Homo sapiens
cagcctggcctgcc

SEQ ID NO: 4037404 - DNA, 15 bp, Homo sapiens
cagcctggcctgccc

SEQ ID NO: 4037405 - DNA, 23 bp, Homo sapiens
cagcctggcctgcccgtgccctg

SEQ ID NO: 4037406 - DNA, 18 bp, Homo sapiens
cagcctgggagcccagag

SEQ ID NO: 4037407 - DNA, 20 bp, Homo sapiens
cagcctgggagcccagaggg

SEQ ID NO: 4037408 - DNA, 21 bp, Homo sapiens
cagcctgggataggggcagag

SEQ ID NO: 4037409 - DNA, 20 bp, Homo sapiens
cagcctgggcagccaggctg

SEQ ID NO: 4037410 - DNA, 15 bp, Homo sapiens
cagcctgggggccag

SEQ ID NO: 4037411 - DNA, 18 bp, Homo sapiens
cagcctgggggccagtgg

SEQ ID NO: 4037412 - DNA, 19 bp, Homo sapiens
cagcctgggggccagtggg

SEQ ID NO: 4037413 - DNA, 15 bp, Homo sapiens
cagcctggggtctgg

SEQ ID NO: 4037414 - DNA, 14 bp, Homo sapiens
cagcctggtcgcct

SEQ ID NO: 4037415 - DNA, 21 bp, Homo sapiens
cagcctgtcccatggacactc

SEQ ID NO: 4037416 - DNA, 12 bp, Homo sapiens
cagcctgtggca

SEQ ID NO: 4037417 - DNA, 21 bp, Homo sapiens
cagcctgtggcatctttgcct

SEQ ID NO: 4037418 - DNA, 14 bp, Homo sapiens
cagccttagctgcc

SEQ ID NO: 4037419 - DNA, 18 bp, Homo sapiens
cagccttagctgccagtg

SEQ ID NO: 4037420 - DNA, 16 bp, Homo sapiens
cagccttgagccctgg

SEQ ID NO: 4037421 - DNA, 19 bp, Homo sapiens
cagccttgagccctggctg

SEQ ID NO: 4037422 - DNA, 16 bp, Homo sapiens
cagccttgccagagat

SEQ ID NO: 4037423 - DNA, 15 bp, Homo sapiens
cagccttggtgccac

SEQ ID NO: 4037424 - DNA, 16 bp, Homo sapiens
cagccttggtgccacc

SEQ ID NO: 4037425 - DNA, 20 bp, Homo sapiens
cagccttgtaaataaccaca

SEQ ID NO: 4037426 - DNA, 19 bp, Homo sapiens
cagcgaagtagcttgctcc

SEQ ID NO: 4037427 - DNA, 17 bp, Homo sapiens
cagcgaccgccccctcc

SEQ ID NO: 4037428 - DNA, 18 bp, Homo sapiens
cagcgaccgccccctcct

SEQ ID NO: 4037429 - DNA, 18 bp, Homo sapiens
cagcgaccttcctcatcc

SEQ ID NO: 4037430 - DNA, 13 bp, Homo sapiens
cagcgagaggcag

SEQ ID NO: 4037431 - DNA, 24 bp, Homo sapiens
cagcgccaagtaaacagggtacct

SEQ ID NO: 4037432 - DNA, 24 bp, Homo sapiens
cagcgccaagtgcgtgccgtgtga

SEQ ID NO: 4037433 - DNA, 21 bp, Homo sapiens
cagcggagtctgtcctgtgac

SEQ ID NO: 4037434 - DNA, 21 bp, Homo sapiens
cagcggctcccctctgcttct

SEQ ID NO: 4037435 - DNA, 22 bp, Homo sapiens
cagcggctcccctctgcttctc

SEQ ID NO: 4037436 - DNA, 19 bp, Homo sapiens
cagcgggagacctgtgcta

SEQ ID NO: 4037437 - DNA, 17 bp, Homo sapiens
cagcgggcacagggcac

SEQ ID NO: 4037438 - DNA, 14 bp, Homo sapiens
cagcgggcagatgg

SEQ ID NO: 4037439 - DNA, 16 bp, Homo sapiens
cagcgggcagatgggc

SEQ ID NO: 4037440 - DNA, 13 bp, Homo sapiens
cagcgggccaggc

SEQ ID NO: 4037441 - DNA, 14 bp, Homo sapiens
cagcgggccaggcc

SEQ ID NO: 4037442 - DNA, 16 bp, Homo sapiens
cagcgggccaggcccg

SEQ ID NO: 4037443 - DNA, 21 bp, Homo sapiens
cagcgggctaacgggaggctg

SEQ ID NO: 4037444 - DNA, 14 bp, Homo sapiens
cagcggggctgctc

SEQ ID NO: 4037445 - DNA, 17 bp, Homo sapiens
cagcggggctgctcacc

SEQ ID NO: 4037446 - DNA, 21 bp, Homo sapiens
cagcgtcagctgctccctggc

SEQ ID NO: 4037447 - DNA, 14 bp, Homo sapiens
cagcgtccctggcg

SEQ ID NO: 4037448 - DNA, 17 bp, Homo sapiens
cagcgtggcttttccta

SEQ ID NO: 4037449 - DNA, 18 bp, Homo sapiens
cagctaaagcccaacctc

SEQ ID NO: 4037450 - DNA, 22 bp, Homo sapiens
cagctaaagcccaacctcctga

SEQ ID NO: 4037451 - DNA, 18 bp, Homo sapiens
cagctaaattttctgaaa

SEQ ID NO: 4037452 - DNA, 23 bp, Homo sapiens
cagctaagaaaagattttaatca

SEQ ID NO: 4037453 - DNA, 23 bp, Homo sapiens
cagctaagaacctggaacttggg

SEQ ID NO: 4037454 - DNA, 18 bp, Homo sapiens
cagctaagggaagacatt

SEQ ID NO: 4037455 - DNA, 12 bp, Homo sapiens
cagctaatctgt

SEQ ID NO: 4037456 - DNA, 21 bp, Homo sapiens
cagctaatctgtagggctgga

SEQ ID NO: 4037457 - DNA, 22 bp, Homo sapiens
cagctaccccttctttgcaggg

SEQ ID NO: 4037458 - DNA, 17 bp, Homo sapiens
cagctactaatgatgtt

SEQ ID NO: 4037459 - DNA, 15 bp, Homo sapiens
cagctactctcccca

SEQ ID NO: 4037460 - DNA, 17 bp, Homo sapiens
cagctacttcctcctcc

SEQ ID NO: 4037461 - DNA, 18 bp, Homo sapiens
cagctacttgggaggctg

SEQ ID NO: 4037462 - DNA, 19 bp, Homo sapiens
cagctacttgggaggctga

SEQ ID NO: 4037463 - DNA, 19 bp, Homo sapiens
cagctacttggtttgtgtt

SEQ ID NO: 4037464 - DNA, 21 bp, Homo sapiens
cagctagtgaagaccagagca

SEQ ID NO: 4037465 - DNA, 22 bp, Homo sapiens
cagctagtgaagaccagagcag

SEQ ID NO: 4037466 - DNA, 24 bp, Homo sapiens
cagctatcgaacttcacaactagg

SEQ ID NO: 4037467 - DNA, 22 bp, Homo sapiens
cagctatgggagccccagggtc

SEQ ID NO: 4037468 - DNA, 23 bp, Homo sapiens
cagctatgggagccccagggtct

SEQ ID NO: 4037469 - DNA, 20 bp, Homo sapiens
cagctcaatggactggaagg

SEQ ID NO: 4037470 - DNA, 17 bp, Homo sapiens
cagctcacccctgggca

SEQ ID NO: 4037471 - DNA, 17 bp, Homo sapiens
cagctcagcgccagcct

SEQ ID NO: 4037472 - DNA, 19 bp, Homo sapiens
cagctcaggacagatgcca

SEQ ID NO: 4037473 - DNA, 12 bp, Homo sapiens
cagctcagtccc

SEQ ID NO: 4037474 - DNA, 18 bp, Homo sapiens
cagctcagtcccatcaga

SEQ ID NO: 4037475 - DNA, 16 bp, Homo sapiens
cagctcatctccaagg

SEQ ID NO: 4037476 - DNA, 14 bp, Homo sapiens
cagctcattaaact

SEQ ID NO: 4037477 - DNA, 16 bp, Homo sapiens
cagctcattaaacttt

SEQ ID NO: 4037478 - DNA, 15 bp, Homo sapiens
cagctccaccctggc

SEQ ID NO: 4037479 - DNA, 13 bp, Homo sapiens
cagctccccagga

SEQ ID NO: 4037480 - DNA, 14 bp, Homo sapiens
cagctccccaggag

SEQ ID NO: 4037481 - DNA, 19 bp, Homo sapiens
cagctccccaggagctcag

SEQ ID NO: 4037482 - DNA, 20 bp, Homo sapiens
cagctccccaggagctcagg

SEQ ID NO: 4037483 - DNA, 19 bp, Homo sapiens
cagctcccccaggctgttc

SEQ ID NO: 4037484 - DNA, 14 bp, Homo sapiens
cagctccctagact

SEQ ID NO: 4037485 - DNA, 23 bp, Homo sapiens
cagctccctagactgcatcccgt

SEQ ID NO: 4037486 - DNA, 18 bp, Homo sapiens
cagctccctaggagacca

SEQ ID NO: 4037487 - DNA, 18 bp, Homo sapiens
cagctccctttctcagga

SEQ ID NO: 4037488 - DNA, 22 bp, Homo sapiens
cagctcctacctctgtgccagg

SEQ ID NO: 4037489 - DNA, 16 bp, Homo sapiens
cagctccttttccaga

SEQ ID NO: 4037490 - DNA, 20 bp, Homo sapiens
cagctccttttccagagcat

SEQ ID NO: 4037491 - DNA, 22 bp, Homo sapiens
cagctcgctggatggcggaagc

SEQ ID NO: 4037492 - DNA, 20 bp, Homo sapiens
cagctcgtttttcagcaccc

SEQ ID NO: 4037493 - DNA, 21 bp, Homo sapiens
cagctcgtttttcagcacccc

SEQ ID NO: 4037494 - DNA, 15 bp, Homo sapiens
cagctctctgccctg

SEQ ID NO: 4037495 - DNA, 17 bp, Homo sapiens
cagctctctgccctgtg

SEQ ID NO: 4037496 - DNA, 16 bp, Homo sapiens
cagctctgctatgagt

SEQ ID NO: 4037497 - DNA, 17 bp, Homo sapiens
cagctctggacagcccc

SEQ ID NO: 4037498 - DNA, 18 bp, Homo sapiens
cagctctggacagcccca

SEQ ID NO: 4037499 - DNA, 23 bp, Homo sapiens
cagctctggacagccccaccctg

SEQ ID NO: 4037500 - DNA, 14 bp, Homo sapiens
cagctctggcatgg

SEQ ID NO: 4037501 - DNA, 18 bp, Homo sapiens
cagctctggcatggctag

SEQ ID NO: 4037502 - DNA, 15 bp, Homo sapiens
cagctctgggagagg

SEQ ID NO: 4037503 - DNA, 16 bp, Homo sapiens
cagctcttggcccctg

SEQ ID NO: 4037504 - DNA, 22 bp, Homo sapiens
cagctcttggcccctgtgtgag

SEQ ID NO: 4037505 - DNA, 22 bp, Homo sapiens
cagctctttgaaatagtctgtg

SEQ ID NO: 4037506 - DNA, 14 bp, Homo sapiens
cagctgacccggcc

SEQ ID NO: 4037507 - DNA, 21 bp, Homo sapiens
cagctgacccggcctctctgc

SEQ ID NO: 4037508 - DNA, 15 bp, Homo sapiens
cagctgactgtggcc

SEQ ID NO: 4037509 - DNA, 11 bp, Homo sapiens
cagctgagccc

SEQ ID NO: 4037510 - DNA, 12 bp, Homo sapiens
cagctgagccct

SEQ ID NO: 4037511 - DNA, 16 bp, Homo sapiens
cagctgagcgccagga

SEQ ID NO: 4037512 - DNA, 22 bp, Homo sapiens
cagctgaggacacaccccacac

SEQ ID NO: 4037513 - DNA, 12 bp, Homo sapiens
cagctgaggctg

SEQ ID NO: 4037514 - DNA, 21 bp, Homo sapiens
cagctgaggctgggggagagc

SEQ ID NO: 4037515 - DNA, 23 bp, Homo sapiens
cagctgaggctgggggagagccg

SEQ ID NO: 4037516 - DNA, 14 bp, Homo sapiens
cagctgagttatga

SEQ ID NO: 4037517 - DNA, 18 bp, Homo sapiens
cagctgagttatgatgta

SEQ ID NO: 4037518 - DNA, 20 bp, Homo sapiens
cagctgatacttcatttaaa

SEQ ID NO: 4037519 - DNA, 14 bp, Homo sapiens
cagctgatgagtta

SEQ ID NO: 4037520 - DNA, 18 bp, Homo sapiens
cagctgcaagccagggat

SEQ ID NO: 4037521 - DNA, 12 bp, Homo sapiens
cagctgcactga

SEQ ID NO: 4037522 - DNA, 14 bp, Homo sapiens
cagctgccctagct

SEQ ID NO: 4037523 - DNA, 15 bp, Homo sapiens
cagctgccctagctg

SEQ ID NO: 4037524 - DNA, 20 bp, Homo sapiens
cagctgccctagctgacccc

SEQ ID NO: 4037525 - DNA, 14 bp, Homo sapiens
cagctgcctgggcc

SEQ ID NO: 4037526 - DNA, 15 bp, Homo sapiens
cagctgcgcgggctt

SEQ ID NO: 4037527 - DNA, 17 bp, Homo sapiens
cagctgctactactcct

SEQ ID NO: 4037528 - DNA, 16 bp, Homo sapiens
cagctgctatccccat

SEQ ID NO: 4037529 - DNA, 18 bp, Homo sapiens
cagctgctccctggcatt

SEQ ID NO: 4037530 - DNA, 14 bp, Homo sapiens
cagctgctgttctc

SEQ ID NO: 4037531 - DNA, 15 bp, Homo sapiens
cagctggactctgca

SEQ ID NO: 4037532 - DNA, 18 bp, Homo sapiens
cagctggactctgcatcc

SEQ ID NO: 4037533 - DNA, 22 bp, Homo sapiens
cagctggctctgacaagatggt

SEQ ID NO: 4037534 - DNA, 14 bp, Homo sapiens
cagctggctttgca

SEQ ID NO: 4037535 - DNA, 14 bp, Homo sapiens
cagctgggcaaagc

SEQ ID NO: 4037536 - DNA, 16 bp, Homo sapiens
cagctgggcaaagcca

SEQ ID NO: 4037537 - DNA, 17 bp, Homo sapiens
cagctgggcaaagccac

SEQ ID NO: 4037538 - DNA, 15 bp, Homo sapiens
cagctgggctctgca

SEQ ID NO: 4037539 - DNA, 17 bp, Homo sapiens
cagctggggccagaggc

SEQ ID NO: 4037540 - DNA, 20 bp, Homo sapiens
cagctgggtcaggcagggtg

SEQ ID NO: 4037541 - DNA, 17 bp, Homo sapiens
cagctggttactcaggg

SEQ ID NO: 4037542 - DNA, 12 bp, Homo sapiens
cagctgtctcta

SEQ ID NO: 4037543 - DNA, 14 bp, Homo sapiens
cagctgttgtctct

SEQ ID NO: 4037544 - DNA, 17 bp, Homo sapiens
cagctgtttctcatgaa

SEQ ID NO: 4037545 - DNA, 15 bp, Homo sapiens
cagcttagatttcat

SEQ ID NO: 4037546 - DNA, 17 bp, Homo sapiens
cagcttagatttcatag

SEQ ID NO: 4037547 - DNA, 19 bp, Homo sapiens
cagcttatctcttttatat

SEQ ID NO: 4037548 - DNA, 17 bp, Homo sapiens
cagcttcaagtgccttt

SEQ ID NO: 4037549 - DNA, 16 bp, Homo sapiens
cagcttcaggcaccag

SEQ ID NO: 4037550 - DNA, 14 bp, Homo sapiens
cagcttcaggttat

SEQ ID NO: 4037551 - DNA, 19 bp, Homo sapiens
cagcttcatgcctttgtaa

SEQ ID NO: 4037552 - DNA, 21 bp, Homo sapiens
cagcttcatgcctttgtaagt

SEQ ID NO: 4037553 - DNA, 20 bp, Homo sapiens
cagcttcctcacacccctgt

SEQ ID NO: 4037554 - DNA, 20 bp, Homo sapiens
cagcttcctttcctgtgtgt

SEQ ID NO: 4037555 - DNA, 17 bp, Homo sapiens
cagcttctctctccagg

SEQ ID NO: 4037556 - DNA, 21 bp, Homo sapiens
cagcttgagccgggcccctgg

SEQ ID NO: 4037557 - DNA, 22 bp, Homo sapiens
cagcttgagccgggcccctggg

SEQ ID NO: 4037558 - DNA, 19 bp, Homo sapiens
cagcttgtatgcaatggat

SEQ ID NO: 4037559 - DNA, 23 bp, Homo sapiens
cagcttgtatgcaatggattttc

SEQ ID NO: 4037560 - DNA, 16 bp, Homo sapiens
cagcttgttctgggct

SEQ ID NO: 4037561 - DNA, 17 bp, Homo sapiens
cagctttaaaaagaaaa

SEQ ID NO: 4037562 - DNA, 15 bp, Homo sapiens
cagctttaaacaaat

SEQ ID NO: 4037563 - DNA, 17 bp, Homo sapiens
cagctttaaactcaggg

SEQ ID NO: 4037564 - DNA, 13 bp, Homo sapiens
cagctttatgttc

SEQ ID NO: 4037565 - DNA, 19 bp, Homo sapiens
cagctttcagggccatggt

SEQ ID NO: 4037566 - DNA, 17 bp, Homo sapiens
cagctttcatgattagc

SEQ ID NO: 4037567 - DNA, 21 bp, Homo sapiens
cagctttcttgctcccttcag

SEQ ID NO: 4037568 - DNA, 23 bp, Homo sapiens
cagctttgactttatctcctgct

SEQ ID NO: 4037569 - DNA, 20 bp, Homo sapiens
cagctttgatccctgacatc

SEQ ID NO: 4037570 - DNA, 20 bp, Homo sapiens
cagcttttcattgctgtgac

SEQ ID NO: 4037571 - DNA, 19 bp, Homo sapiens
cagctttttaaagtgggtt

SEQ ID NO: 4037572 - DNA, 21 bp, Homo sapiens
caggaaaaacaaaacaaagaa

SEQ ID NO: 4037573 - DNA, 16 bp, Homo sapiens
caggaaaacacccagg

SEQ ID NO: 4037574 - DNA, 22 bp, Homo sapiens
caggaaactccacatctgcctt

SEQ ID NO: 4037575 - DNA, 17 bp, Homo sapiens
caggaaagccctccccc

SEQ ID NO: 4037576 - DNA, 19 bp, Homo sapiens
caggaaagccctccccctt

SEQ ID NO: 4037577 - DNA, 20 bp, Homo sapiens
caggaaagccctcccccttc

SEQ ID NO: 4037578 - DNA, 21 bp, Homo sapiens
caggaaagtggcacctgtctg

SEQ ID NO: 4037579 - DNA, 17 bp, Homo sapiens
caggaaatatatatgtg

SEQ ID NO: 4037580 - DNA, 13 bp, Homo sapiens
caggaacagaagg

SEQ ID NO: 4037581 - DNA, 15 bp, Homo sapiens
caggaacagaaggat

SEQ ID NO: 4037582 - DNA, 17 bp, Homo sapiens
caggaacagtggctggg

SEQ ID NO: 4037583 - DNA, 20 bp, Homo sapiens
caggaacagtggctgggtgg

SEQ ID NO: 4037584 - DNA, 23 bp, Homo sapiens
caggaaccatagttgacagttcc

SEQ ID NO: 4037585 - DNA, 21 bp, Homo sapiens
caggaacctgtcctaaggaac

SEQ ID NO: 4037586 - DNA, 17 bp, Homo sapiens
caggaactcccagcaac

SEQ ID NO: 4037587 - DNA, 23 bp, Homo sapiens
caggaactggggctttgccttgc

SEQ ID NO: 4037588 - DNA, 15 bp, Homo sapiens
caggaagcaccccat

SEQ ID NO: 4037589 - DNA, 17 bp, Homo sapiens
caggaagcaccccatgc

SEQ ID NO: 4037590 - DNA, 15 bp, Homo sapiens
caggaagccagagcc

SEQ ID NO: 4037591 - DNA, 16 bp, Homo sapiens
caggaagccagagccc

SEQ ID NO: 4037592 - DNA, 12 bp, Homo sapiens
caggaagccagg

SEQ ID NO: 4037593 - DNA, 15 bp, Homo sapiens
caggaagccaggctg

SEQ ID NO: 4037594 - DNA, 18 bp, Homo sapiens
caggaagccaggctgagt

SEQ ID NO: 4037595 - DNA, 19 bp, Homo sapiens
caggaagccaggctgagtg

SEQ ID NO: 4037596 - DNA, 21 bp, Homo sapiens
caggaagcctgcagtcctgga

SEQ ID NO: 4037597 - DNA, 13 bp, Homo sapiens
caggaagctctct

SEQ ID NO: 4037598 - DNA, 14 bp, Homo sapiens
caggaagctggcag

SEQ ID NO: 4037599 - DNA, 12 bp, Homo sapiens
caggaaggagag

SEQ ID NO: 4037600 - DNA, 13 bp, Homo sapiens
caggaaggagagc

SEQ ID NO: 4037601 - DNA, 14 bp, Homo sapiens
caggaaggagagcc

SEQ ID NO: 4037602 - DNA, 17 bp, Homo sapiens
caggaaggagagcctgc

SEQ ID NO: 4037603 - DNA, 16 bp, Homo sapiens
caggaaggaggggaga

SEQ ID NO: 4037604 - DNA, 21 bp, Homo sapiens
caggaagggcaggaaggagag

SEQ ID NO: 4037605 - DNA, 19 bp, Homo sapiens
cagcccagagccacctgga

SEQ ID NO: 4037606 - DNA, 15 bp, Homo sapiens
cagcccagagcctgg

SEQ ID NO: 4037607 - DNA, 18 bp, Homo sapiens
cagcccagagcctggctg

SEQ ID NO: 4037608 - DNA, 19 bp, Homo sapiens
cagcccagattcccctgtg

SEQ ID NO: 4037609 - DNA, 13 bp, Homo sapiens
cagcccagccagg

SEQ ID NO: 4037610 - DNA, 23 bp, Homo sapiens
cagcccagcttggccctttcctt

SEQ ID NO: 4037611 - DNA, 11 bp, Homo sapiens
cagcccatcca

SEQ ID NO: 4037612 - DNA, 16 bp, Homo sapiens
cagcccatctgcctgt

SEQ ID NO: 4037613 - DNA, 15 bp, Homo sapiens
cagcccatgcccacc

SEQ ID NO: 4037614 - DNA, 16 bp, Homo sapiens
cagcccatgcccacct

SEQ ID NO: 4037615 - DNA, 15 bp, Homo sapiens
cagccccacacagct

SEQ ID NO: 4037616 - DNA, 12 bp, Homo sapiens
cagccccaccca

SEQ ID NO: 4037617 - DNA, 14 bp, Homo sapiens
cagccccacccagg

SEQ ID NO: 4037618 - DNA, 16 bp, Homo sapiens
cagccccacccaggag

SEQ ID NO: 4037619 - DNA, 17 bp, Homo sapiens
cagccccaccctgtttt

SEQ ID NO: 4037620 - DNA, 13 bp, Homo sapiens
cagccccatcaga

SEQ ID NO: 4037621 - DNA, 12 bp, Homo sapiens
cagccccatccc

SEQ ID NO: 4037622 - DNA, 15 bp, Homo sapiens
cagccccatccctgt

SEQ ID NO: 4037623 - DNA, 15 bp, Homo sapiens
cagcccccagcccct

SEQ ID NO: 4037624 - DNA, 11 bp, Homo sapiens
cagccccctcc

SEQ ID NO: 4037625 - DNA, 16 bp, Homo sapiens
cagccccgagctgtcc

SEQ ID NO: 4037626 - DNA, 17 bp, Homo sapiens
cagccccgagctgtccc

SEQ ID NO: 4037627 - DNA, 19 bp, Homo sapiens
cagccccggcaagccacag

SEQ ID NO: 4037628 - DNA, 18 bp, Homo sapiens
cagccccggtggctgggc

SEQ ID NO: 4037629 - DNA, 15 bp, Homo sapiens
cagccccgtctgccc

SEQ ID NO: 4037630 - DNA, 11 bp, Homo sapiens
cagcccctccc

SEQ ID NO: 4037631 - DNA, 18 bp, Homo sapiens
cagcccctccctcctctg

SEQ ID NO: 4037632 - DNA, 21 bp, Homo sapiens
cagcccctccctcctctgaga

SEQ ID NO: 4037633 - DNA, 21 bp, Homo sapiens
cagcccctggccccaggacct

SEQ ID NO: 4037634 - DNA, 17 bp, Homo sapiens
cagcccctggggcccag

SEQ ID NO: 4037635 - DNA, 22 bp, Homo sapiens
cagcccctggggcccagcccct

SEQ ID NO: 4037636 - DNA, 14 bp, Homo sapiens
cagcccctgtccca

SEQ ID NO: 4037637 - DNA, 20 bp, Homo sapiens
cagccccttctcccagcaca

SEQ ID NO: 4037638 - DNA, 17 bp, Homo sapiens
cagccccttgagaaacc

SEQ ID NO: 4037639 - DNA, 18 bp, Homo sapiens
cagccccttgagaaacct

SEQ ID NO: 4037640 - DNA, 19 bp, Homo sapiens
cagcccgacaatgtcgagt

SEQ ID NO: 4037641 - DNA, 14 bp, Homo sapiens
cagcccggcctgct

SEQ ID NO: 4037642 - DNA, 20 bp, Homo sapiens
cagcccggcctgctcccagc

SEQ ID NO: 4037643 - DNA, 17 bp, Homo sapiens
cagccctaaggatctct

SEQ ID NO: 4037644 - DNA, 22 bp, Homo sapiens
cagccctaaggatctctcagga

SEQ ID NO: 4037645 - DNA, 12 bp, Homo sapiens
cagccctagagc

SEQ ID NO: 4037646 - DNA, 20 bp, Homo sapiens
cagccctagagcctgcctgg

SEQ ID NO: 4037647 - DNA, 21 bp, Homo sapiens
cagccctagagcctgcctgga

SEQ ID NO: 4037648 - DNA, 20 bp, Homo sapiens
cagccctcaacaggcccagg

SEQ ID NO: 4037649 - DNA, 18 bp, Homo sapiens
cagccctcagttccttca

SEQ ID NO: 4037650 - DNA, 20 bp, Homo sapiens
cagccctccccatggagcca

SEQ ID NO: 4037651 - DNA, 15 bp, Homo sapiens
cagccctgcagccca

SEQ ID NO: 4037652 - DNA, 23 bp, Homo sapiens
cagccctgcagcccaaaacccag

SEQ ID NO: 4037653 - DNA, 13 bp, Homo sapiens
cagccctgctttg

SEQ ID NO: 4037654 - DNA, 19 bp, Homo sapiens
cagccctgctttgggctgc

SEQ ID NO: 4037655 - DNA, 20 bp, Homo sapiens
cagccctgctttgggctgcc

SEQ ID NO: 4037656 - DNA, 23 bp, Homo sapiens
cagccctgctttgggctgccctg

SEQ ID NO: 4037657 - DNA, 12 bp, Homo sapiens
cagccctggctc

SEQ ID NO: 4037658 - DNA, 18 bp, Homo sapiens
cagccctgtcacgccggg

SEQ ID NO: 4037659 - DNA, 13 bp, Homo sapiens
cagcccttcctct

SEQ ID NO: 4037660 - DNA, 17 bp, Homo sapiens
cagcccttcctctgctc

SEQ ID NO: 4037661 - DNA, 23 bp, Homo sapiens
cagcccttcctctgctccccctt

SEQ ID NO: 4037662 - DNA, 19 bp, Homo sapiens
cagccgagccgggcctggg

SEQ ID NO: 4037663 - DNA, 17 bp, Homo sapiens
cagccgccattgccacc

SEQ ID NO: 4037664 - DNA, 23 bp, Homo sapiens
cagccgccattgccaccaggaga

SEQ ID NO: 4037665 - DNA, 14 bp, Homo sapiens
cagccgccctgggc

SEQ ID NO: 4037666 - DNA, 16 bp, Homo sapiens
cagccgccctgggctg

SEQ ID NO: 4037667 - DNA, 18 bp, Homo sapiens
cagccgccttaagctgat

SEQ ID NO: 4037668 - DNA, 19 bp, Homo sapiens
cagccgccttaagctgatc

SEQ ID NO: 4037669 - DNA, 13 bp, Homo sapiens
cagccggcacagg

SEQ ID NO: 4037670 - DNA, 23 bp, Homo sapiens
cagccggcacagggtctgctctt

SEQ ID NO: 4037671 - DNA, 17 bp, Homo sapiens
cagccgtgatgctcagg

SEQ ID NO: 4037672 - DNA, 9 bp, Homo sapiens
cagccgtgc

SEQ ID NO: 4037673 - DNA, 20 bp, Homo sapiens
cagccgtgccttcagctcta

SEQ ID NO: 4037674 - DNA, 23 bp, Homo sapiens
cagccgtggtccaaccaggagct

SEQ ID NO: 4037675 - DNA, 15 bp, Homo sapiens
cagcctaccatgaga

SEQ ID NO: 4037676 - DNA, 21 bp, Homo sapiens
cagcctagggctgagctgggg

SEQ ID NO: 4037677 - DNA, 13 bp, Homo sapiens
cagcctcagagga

SEQ ID NO: 4037678 - DNA, 17 bp, Homo sapiens
cagcctcagaggagctc

SEQ ID NO: 4037679 - DNA, 21 bp, Homo sapiens
cagcctcagaggagctctacc

SEQ ID NO: 4037680 - DNA, 14 bp, Homo sapiens
cagcctcagagtgg

SEQ ID NO: 4037681 - DNA, 19 bp, Homo sapiens
cagcctcatactcctgggc

SEQ ID NO: 4037682 - DNA, 20 bp, Homo sapiens
cagcctcatactcctgggct

SEQ ID NO: 4037683 - DNA, 14 bp, Homo sapiens
cagcctccagggcc

SEQ ID NO: 4037684 - DNA, 19 bp, Homo sapiens
cagcctcccacccccatct

SEQ ID NO: 4037685 - DNA, 23 bp, Homo sapiens
cagcctccccctgtcccctctat

SEQ ID NO: 4037686 - DNA, 19 bp, Homo sapiens
cagcctcccgagtagctgg

SEQ ID NO: 4037687 - DNA, 14 bp, Homo sapiens
cagcctccctgaag

SEQ ID NO: 4037688 - DNA, 17 bp, Homo sapiens
cagcctccgagagggag

SEQ ID NO: 4037689 - DNA, 20 bp, Homo sapiens
cagcctcctgagcctgtggg

SEQ ID NO: 4037690 - DNA, 21 bp, Homo sapiens
cagcctcctgagcctgtgggt

SEQ ID NO: 4037691 - DNA, 22 bp, Homo sapiens
cagcctcgcaggcctccctgcc

SEQ ID NO: 4037692 - DNA, 16 bp, Homo sapiens
cagcctcgcctgtcac

SEQ ID NO: 4037693 - DNA, 17 bp, Homo sapiens
cagcctcgcctgtcacc

SEQ ID NO: 4037694 - DNA, 23 bp, Homo sapiens
cagcctcgttggaagaggaacag

SEQ ID NO: 4037695 - DNA, 19 bp, Homo sapiens
cagcctctggacagccagt

SEQ ID NO: 4037696 - DNA, 13 bp, Homo sapiens
cagcctctggcat

SEQ ID NO: 4037697 - DNA, 13 bp, Homo sapiens
cagcctctgggcc

SEQ ID NO: 4037698 - DNA, 21 bp, Homo sapiens
cagcctctgggcccacatccg

SEQ ID NO: 4037699 - DNA, 18 bp, Homo sapiens
cagcctctttcccttcca

SEQ ID NO: 4037700 - DNA, 17 bp, Homo sapiens
cagcctgaacagaagct

SEQ ID NO: 4037701 - DNA, 15 bp, Homo sapiens
cagcctgagtctcct

SEQ ID NO: 4037702 - DNA, 17 bp, Homo sapiens
cagcctgagtctcctgt

SEQ ID NO: 4037703 - DNA, 18 bp, Homo sapiens
cagcctgagtctcctgtg

SEQ ID NO: 4037704 - DNA, 22 bp, Homo sapiens
cagcctgagtctcctgtgccca

SEQ ID NO: 4037705 - DNA, 11 bp, Homo sapiens
cagcctgctga

SEQ ID NO: 4037706 - DNA, 16 bp, Homo sapiens
cagcctggactttggt

SEQ ID NO: 4037707 - DNA, 10 bp, Homo sapiens
cagcctggca

SEQ ID NO: 4037708 - DNA, 15 bp, Homo sapiens
cagcaggaagccagg

SEQ ID NO: 4037709 - DNA, 20 bp, Homo sapiens
cagcaggaagccaggctgag

SEQ ID NO: 4037710 - DNA, 20 bp, Homo sapiens
cagcaggagagactgagcag

SEQ ID NO: 4037711 - DNA, 23 bp, Homo sapiens
cagcaggagagactgagcagccg

SEQ ID NO: 4037712 - DNA, 16 bp, Homo sapiens
cagcaggagtggtgca

SEQ ID NO: 4037713 - DNA, 12 bp, Homo sapiens
cagcaggcagcc

SEQ ID NO: 4037714 - DNA, 19 bp, Homo sapiens
cagcaggcagccttggcgg

SEQ ID NO: 4037715 - DNA, 13 bp, Homo sapiens
cagcaggcagcgc

SEQ ID NO: 4037716 - DNA, 15 bp, Homo sapiens
cagcaggcagcgcca

SEQ ID NO: 4037717 - DNA, 14 bp, Homo sapiens
cagcagggcctcaa

SEQ ID NO: 4037718 - DNA, 17 bp, Homo sapiens
cagcagggcctcaaagt

SEQ ID NO: 4037719 - DNA, 23 bp, Homo sapiens
cagcagggggagaaacccttcac

SEQ ID NO: 4037720 - DNA, 19 bp, Homo sapiens
cagcagtacctataaagta

SEQ ID NO: 4037721 - DNA, 19 bp, Homo sapiens
cagcagtcttatgcttcca

SEQ ID NO: 4037722 - DNA, 21 bp, Homo sapiens
cagcagtcttatgcttccaga

SEQ ID NO: 4037723 - DNA, 16 bp, Homo sapiens
cagcagtgagagcaga

SEQ ID NO: 4037724 - DNA, 19 bp, Homo sapiens
cagcagtgagtctcttcag

SEQ ID NO: 4037725 - DNA, 16 bp, Homo sapiens
cagcagtgtcatcaga

SEQ ID NO: 4037726 - DNA, 20 bp, Homo sapiens
cagcagtgtgaatagcctgg

SEQ ID NO: 4037727 - DNA, 13 bp, Homo sapiens
cagcagtgttccc

SEQ ID NO: 4037728 - DNA, 19 bp, Homo sapiens
cagcagtgttccccatctg

SEQ ID NO: 4037729 - DNA, 21 bp, Homo sapiens
cagcagtgttccccatctggg

SEQ ID NO: 4037730 - DNA, 23 bp, Homo sapiens
cagcagtgttccccatctgggtc

SEQ ID NO: 4037731 - DNA, 21 bp, Homo sapiens
cagcagtgttctcacagtgtg

SEQ ID NO: 4037732 - DNA, 14 bp, Homo sapiens
cagcagtgttgctc

SEQ ID NO: 4037733 - DNA, 19 bp, Homo sapiens
cagcagtgttgctcagctc

SEQ ID NO: 4037734 - DNA, 20 bp, Homo sapiens
cagcagttttcaagtcaaat

SEQ ID NO: 4037735 - DNA, 18 bp, Homo sapiens
cagcatatttatagcaat

SEQ ID NO: 4037736 - DNA, 17 bp, Homo sapiens
cagcatcactaaaccga

SEQ ID NO: 4037737 - DNA, 19 bp, Homo sapiens
cagcatcactaaaccgata

SEQ ID NO: 4037738 - DNA, 19 bp, Homo sapiens
cagcatcactccccaagga

SEQ ID NO: 4037739 - DNA, 20 bp, Homo sapiens
cagcatcactccccaaggaa

SEQ ID NO: 4037740 - DNA, 17 bp, Homo sapiens
cagcatccaccttggct

SEQ ID NO: 4037741 - DNA, 15 bp, Homo sapiens
cagcatccctggagc

SEQ ID NO: 4037742 - DNA, 21 bp, Homo sapiens
cagcatcccttcccacatgcc

SEQ ID NO: 4037743 - DNA, 23 bp, Homo sapiens
cagcatcccttcccacatgcctg

SEQ ID NO: 4037744 - DNA, 21 bp, Homo sapiens
cagcatcggacaagaccccca

SEQ ID NO: 4037745 - DNA, 15 bp, Homo sapiens
cagcatcgggagcac

SEQ ID NO: 4037746 - DNA, 18 bp, Homo sapiens
cagcatcgggagcaccca

SEQ ID NO: 4037747 - DNA, 14 bp, Homo sapiens
cagcatctggaaga

SEQ ID NO: 4037748 - DNA, 24 bp, Homo sapiens
cagcatctggaagagctaggcagg

SEQ ID NO: 4037749 - DNA, 23 bp, Homo sapiens
cagcatctggctgtctagaatgt

SEQ ID NO: 4037750 - DNA, 21 bp, Homo sapiens
cagcatgacctgtgaccagca

SEQ ID NO: 4037751 - DNA, 23 bp, Homo sapiens
cagcatgacctgtgaccagcact

SEQ ID NO: 4037752 - DNA, 20 bp, Homo sapiens
cagcatgagactttctgctg

SEQ ID NO: 4037753 - DNA, 15 bp, Homo sapiens
cagcatgaggacaga

SEQ ID NO: 4037754 - DNA, 22 bp, Homo sapiens
cagcatgaggacagaccacaga

SEQ ID NO: 4037755 - DNA, 15 bp, Homo sapiens
cagcatgccccttgg

SEQ ID NO: 4037756 - DNA, 20 bp, Homo sapiens
cagcatgccccttggctgga

SEQ ID NO: 4037757 - DNA, 14 bp, Homo sapiens
cagcatgcttccca

SEQ ID NO: 4037758 - DNA, 18 bp, Homo sapiens
cagcatgcttcccagagg

SEQ ID NO: 4037759 - DNA, 21 bp, Homo sapiens
cagcatgcttcccagagggag

SEQ ID NO: 4037760 - DNA, 14 bp, Homo sapiens
cagcatggaaaaat

SEQ ID NO: 4037761 - DNA, 15 bp, Homo sapiens
cagcatggaaaaatg

SEQ ID NO: 4037762 - DNA, 16 bp, Homo sapiens
cagcatggaaaaatgg

SEQ ID NO: 4037763 - DNA, 15 bp, Homo sapiens
cagcatggcatagcc

SEQ ID NO: 4037764 - DNA, 21 bp, Homo sapiens
cagcatgtacggattttcagt

SEQ ID NO: 4037765 - DNA, 19 bp, Homo sapiens
cagcattctggaggggaga

SEQ ID NO: 4037766 - DNA, 16 bp, Homo sapiens
cagcattgctttctga

SEQ ID NO: 4037767 - DNA, 16 bp, Homo sapiens
cagcatttccttccag

SEQ ID NO: 4037768 - DNA, 20 bp, Homo sapiens
cagcatttccttccagccca

SEQ ID NO: 4037769 - DNA, 22 bp, Homo sapiens
cagcattttcatatccaagatc

SEQ ID NO: 4037770 - DNA, 15 bp, Homo sapiens
cagccaaaccctgtc

SEQ ID NO: 4037771 - DNA, 22 bp, Homo sapiens
cagccaaatgtaattgaataaa

SEQ ID NO: 4037772 - DNA, 18 bp, Homo sapiens
cagccaacaggtggcagg

SEQ ID NO: 4037773 - DNA, 22 bp, Homo sapiens
cagccaacaggtggcaggacca

SEQ ID NO: 4037774 - DNA, 14 bp, Homo sapiens
cagccaactagccc

SEQ ID NO: 4037775 - DNA, 17 bp, Homo sapiens
cagccaagacaaggagg

SEQ ID NO: 4037776 - DNA, 20 bp, Homo sapiens
cagccaagattttcctcttg

SEQ ID NO: 4037777 - DNA, 23 bp, Homo sapiens
cagccaagattttcctcttgtga

SEQ ID NO: 4037778 - DNA, 20 bp, Homo sapiens
cagccaagtgccaaatgctc

SEQ ID NO: 4037779 - DNA, 17 bp, Homo sapiens
cagccacatccccaagc

SEQ ID NO: 4037780 - DNA, 22 bp, Homo sapiens
cagccaccccgggctctctgct

SEQ ID NO: 4037781 - DNA, 16 bp, Homo sapiens
cagccagagctgggtg

SEQ ID NO: 4037782 - DNA, 17 bp, Homo sapiens
cagccagcagcagccca

SEQ ID NO: 4037783 - DNA, 14 bp, Homo sapiens
cagccagccgccct

SEQ ID NO: 4037784 - DNA, 17 bp, Homo sapiens
cagccagccgccctggg

SEQ ID NO: 4037785 - DNA, 13 bp, Homo sapiens
cagccaggagcag

SEQ ID NO: 4037786 - DNA, 23 bp, Homo sapiens
cagccaggccaacagcacctccc

SEQ ID NO: 4037787 - DNA, 12 bp, Homo sapiens
cagccaggctgc

SEQ ID NO: 4037788 - DNA, 15 bp, Homo sapiens
cagccagggccaggg

SEQ ID NO: 4037789 - DNA, 16 bp, Homo sapiens
cagccagtgacctttg

SEQ ID NO: 4037790 - DNA, 23 bp, Homo sapiens
cagccatacttatctctctgtgc

SEQ ID NO: 4037791 - DNA, 20 bp, Homo sapiens
cagccataggccctttcagt

SEQ ID NO: 4037792 - DNA, 15 bp, Homo sapiens
cagccatcctccctc

SEQ ID NO: 4037793 - DNA, 23 bp, Homo sapiens
cagccatcctccctccacctcaa

SEQ ID NO: 4037794 - DNA, 19 bp, Homo sapiens
cagccatctcatgagggga

SEQ ID NO: 4037795 - DNA, 21 bp, Homo sapiens
cagccattgcggccccaggag

SEQ ID NO: 4037796 - DNA, 22 bp, Homo sapiens
cagccattgcggccccaggagg

SEQ ID NO: 4037797 - DNA, 23 bp, Homo sapiens
cagccattgcggccccaggaggg

SEQ ID NO: 4037798 - DNA, 22 bp, Homo sapiens
cagccattggctatttaaaact

SEQ ID NO: 4037799 - DNA, 18 bp, Homo sapiens
cagcccaaaacccagggc

SEQ ID NO: 4037800 - DNA, 19 bp, Homo sapiens
cagcccaaaacccagggca

SEQ ID NO: 4037801 - DNA, 20 bp, Homo sapiens
cagcccaaaacccagggcaa

SEQ ID NO: 4037802 - DNA, 16 bp, Homo sapiens
cagcccaaagctgcag

SEQ ID NO: 4037803 - DNA, 16 bp, Homo sapiens
cagcccaatccctgat

SEQ ID NO: 4037804 - DNA, 22 bp, Homo sapiens
cagcccaccagacgtcaggccc

SEQ ID NO: 4037805 - DNA, 21 bp, Homo sapiens
cagcccaccctgctcctcctg

SEQ ID NO: 4037806 - DNA, 16 bp, Homo sapiens
cagcccactgagaagt

SEQ ID NO: 4037807 - DNA, 14 bp, Homo sapiens
cagcccactgcacc

SEQ ID NO: 4037808 - DNA, 12 bp, Homo sapiens
cagcccagagac

SEQ ID NO: 4037809 - DNA, 11 bp, Homo sapiens
cagcccagagc

SEQ ID NO: 4037810 - DNA, 13 bp, Homo sapiens
accttatatttac

SEQ ID NO: 4037811 - DNA, 19 bp, Homo sapiens
accttatcactgcattatt

SEQ ID NO: 4037812 - DNA, 11 bp, Homo sapiens
accttatctgt

SEQ ID NO: 4037813 - DNA, 18 bp, Homo sapiens
accttattgtacctctct

SEQ ID NO: 4037814 - DNA, 22 bp, Homo sapiens
accttattgtacctctcttata

SEQ ID NO: 4037815 - DNA, 19 bp, Homo sapiens
accttcagtttttgtgttt

SEQ ID NO: 4037816 - DNA, 21 bp, Homo sapiens
accttcccaaacgcctcccct

SEQ ID NO: 4037817 - DNA, 22 bp, Homo sapiens
accttcccaaacgcctcccctg

SEQ ID NO: 4037818 - DNA, 12 bp, Homo sapiens
accttcctcact

SEQ ID NO: 4037819 - DNA, 15 bp, Homo sapiens
accttccttcctgtt

SEQ ID NO: 4037820 - DNA, 14 bp, Homo sapiens
accttctccaaatg

SEQ ID NO: 4037821 - DNA, 15 bp, Homo sapiens
accttctgtccccag

SEQ ID NO: 4037822 - DNA, 20 bp, Homo sapiens
accttctgtccccagccctg

SEQ ID NO: 4037823 - DNA, 21 bp, Homo sapiens
accttctgtccccagccctgt

SEQ ID NO: 4037824 - DNA, 15 bp, Homo sapiens
accttctgtggctca

SEQ ID NO: 4037825 - DNA, 16 bp, Homo sapiens
accttctgtggctcac

SEQ ID NO: 4037826 - DNA, 20 bp, Homo sapiens
accttgaataaggcccactg

SEQ ID NO: 4037827 - DNA, 22 bp, Homo sapiens
accttgaataaggcccactgta

SEQ ID NO: 4037828 - DNA, 17 bp, Homo sapiens
accttgaatgctgccag

SEQ ID NO: 4037829 - DNA, 11 bp, Homo sapiens
accttgaggtc

SEQ ID NO: 4037830 - DNA, 22 bp, Homo sapiens
accttgaggtcttttgacatgt

SEQ ID NO: 4037831 - DNA, 15 bp, Homo sapiens
accttgcaacttcat

SEQ ID NO: 4037832 - DNA, 20 bp, Homo sapiens
accttgctctcctcatctcc

SEQ ID NO: 4037833 - DNA, 17 bp, Homo sapiens
accttgctgtcctgatc

SEQ ID NO: 4037834 - DNA, 14 bp, Homo sapiens
accttggcaccaga

SEQ ID NO: 4037835 - DNA, 14 bp, Homo sapiens
accttgggctgggg

SEQ ID NO: 4037836 - DNA, 16 bp, Homo sapiens
accttgttcctgccct

SEQ ID NO: 4037837 - DNA, 19 bp, Homo sapiens
acctttaacacagacccct

SEQ ID NO: 4037838 - DNA, 22 bp, Homo sapiens
acctttaatcaggtcctgctca

SEQ ID NO: 4037839 - DNA, 23 bp, Homo sapiens
acctttgcacaggatgctggcct

SEQ ID NO: 4037840 - DNA, 16 bp, Homo sapiens
acctttgttttttgtt

SEQ ID NO: 4037841 - DNA, 15 bp, Homo sapiens
accttttatgtagca

SEQ ID NO: 4037842 - DNA, 15 bp, Homo sapiens
accttttatgtagta

SEQ ID NO: 4037843 - DNA, 20 bp, Homo sapiens
accttttatgtagtaattga

SEQ ID NO: 4037844 - DNA, 16 bp, Homo sapiens
accttttttaagattt

SEQ ID NO: 4037845 - DNA, 12 bp, Homo sapiens
acgacagaggag

SEQ ID NO: 4037846 - DNA, 16 bp, Homo sapiens
acgaccggggccagca

SEQ ID NO: 4037847 - DNA, 21 bp, Homo sapiens
acgaccggggccagcaccact

SEQ ID NO: 4037848 - DNA, 20 bp, Homo sapiens
acgagaccctacaggagagg

SEQ ID NO: 4037849 - DNA, 19 bp, Homo sapiens
acgagatcaagagatcaag

SEQ ID NO: 4037850 - DNA, 16 bp, Homo sapiens
acgataaaattacaaa

SEQ ID NO: 4037851 - DNA, 13 bp, Homo sapiens
acgatcaggagga

SEQ ID NO: 4037852 - DNA, 15 bp, Homo sapiens
acgcacaaacacaca

SEQ ID NO: 4037853 - DNA, 20 bp, Homo sapiens
acgcacaaacacacacacta

SEQ ID NO: 4037854 - DNA, 13 bp, Homo sapiens
acgcacacacaca

SEQ ID NO: 4037855 - DNA, 14 bp, Homo sapiens
acgcacacacacaa

SEQ ID NO: 4037856 - DNA, 16 bp, Homo sapiens
acgcacacagctgagc

SEQ ID NO: 4037857 - DNA, 19 bp, Homo sapiens
acgcaccggcctggctgca

SEQ ID NO: 4037858 - DNA, 16 bp, Homo sapiens
acgcacctgcctcagg

SEQ ID NO: 4037859 - DNA, 17 bp, Homo sapiens
acgcacctgcctcagga

SEQ ID NO: 4037860 - DNA, 13 bp, Homo sapiens
acgcacgcacaca

SEQ ID NO: 4037861 - DNA, 16 bp, Homo sapiens
acgcactccatgagca

SEQ ID NO: 4037862 - DNA, 23 bp, Homo sapiens
acgcagccctagagcctgcctgg

SEQ ID NO: 4037863 - DNA, 22 bp, Homo sapiens
acgcagccctgctttgggctgc

SEQ ID NO: 4037864 - DNA, 16 bp, Homo sapiens
acgcaggaactcccag

SEQ ID NO: 4037865 - DNA, 12 bp, Homo sapiens
acgcaggaatgg

SEQ ID NO: 4037866 - DNA, 14 bp, Homo sapiens
acgcaggaccagtt

SEQ ID NO: 4037867 - DNA, 17 bp, Homo sapiens
acgccagggaccccaga

SEQ ID NO: 4037868 - DNA, 18 bp, Homo sapiens
acgccagggaccccagaa

SEQ ID NO: 4037869 - DNA, 15 bp, Homo sapiens
acgccattggttgga

SEQ ID NO: 4037870 - DNA, 22 bp, Homo sapiens
acgcccctccaaacctccagcc

SEQ ID NO: 4037871 - DNA, 21 bp, Homo sapiens
acgccctgttcacgctcaccc

SEQ ID NO: 4037872 - DNA, 22 bp, Homo sapiens
acgccgcaggtgtttggcaccc

SEQ ID NO: 4037873 - DNA, 22 bp, Homo sapiens
acgccggggacagaggcctgcc

SEQ ID NO: 4037874 - DNA, 19 bp, Homo sapiens
acgccgtcccaccagcttc

SEQ ID NO: 4037875 - DNA, 21 bp, Homo sapiens
acgccgtcccaccagcttcac

SEQ ID NO: 4037876 - DNA, 22 bp, Homo sapiens
acgcctcactgaaacatggctg

SEQ ID NO: 4037877 - DNA, 16 bp, Homo sapiens
acgcctcctggccaga

SEQ ID NO: 4037878 - DNA, 14 bp, Homo sapiens
acgcctgcaggaga

SEQ ID NO: 4037879 - DNA, 22 bp, Homo sapiens
acgcctgcaggagagagcagca

SEQ ID NO: 4037880 - DNA, 14 bp, Homo sapiens
acgcctgctggccg

SEQ ID NO: 4037881 - DNA, 16 bp, Homo sapiens
acgcctgtaatcccag

SEQ ID NO: 4037882 - DNA, 17 bp, Homo sapiens
acgccttcccctcagcc

SEQ ID NO: 4037883 - DNA, 22 bp, Homo sapiens
acgcctttaaaggtttttaaat

SEQ ID NO: 4037884 - DNA, 13 bp, Homo sapiens
acgcggttttttc

SEQ ID NO: 4037885 - DNA, 20 bp, Homo sapiens
acgcgtatctaggctttggt

SEQ ID NO: 4037886 - DNA, 13 bp, Homo sapiens
acgcgtcttcctg

SEQ ID NO: 4037887 - DNA, 16 bp, Homo sapiens
acgctaaagagccctt

SEQ ID NO: 4037888 - DNA, 20 bp, Homo sapiens
acgctaaagagcccttgcct

SEQ ID NO: 4037889 - DNA, 19 bp, Homo sapiens
acgctcacccagtcacctc

SEQ ID NO: 4037890 - DNA, 11 bp, Homo sapiens
acgctccagct

SEQ ID NO: 4037891 - DNA, 13 bp, Homo sapiens
acgctcctttgtg

SEQ ID NO: 4037892 - DNA, 21 bp, Homo sapiens
acgctcgcgggcagcgggcca

SEQ ID NO: 4037893 - DNA, 15 bp, Homo sapiens
acgctgcatgagaca

SEQ ID NO: 4037894 - DNA, 16 bp, Homo sapiens
acgctggggctctctg

SEQ ID NO: 4037895 - DNA, 20 bp, Homo sapiens
acgcttaacctttccgctgt

SEQ ID NO: 4037896 - DNA, 13 bp, Homo sapiens
acgcttctgaatg

SEQ ID NO: 4037897 - DNA, 22 bp, Homo sapiens
acgcttctgaatgctgctactt

SEQ ID NO: 4037898 - DNA, 12 bp, Homo sapiens
acgctttgattc

SEQ ID NO: 4037899 - DNA, 22 bp, Homo sapiens
acgctttgctgctaccgccctg

SEQ ID NO: 4037900 - DNA, 16 bp, Homo sapiens
acgcttttaattctca

SEQ ID NO: 4037901 - DNA, 21 bp, Homo sapiens
acggaaagtttttagaatgtt

SEQ ID NO: 4037902 - DNA, 17 bp, Homo sapiens
acggaacgttggacttt

SEQ ID NO: 4037903 - DNA, 24 bp, Homo sapiens
acggactcccgggccacgccccag

SEQ ID NO: 4037904 - DNA, 14 bp, Homo sapiens
acggagagaaaaaa

SEQ ID NO: 4037905 - DNA, 15 bp, Homo sapiens
acggagcccagccct

SEQ ID NO: 4037906 - DNA, 20 bp, Homo sapiens
acggagcccagccctcccca

SEQ ID NO: 4037907 - DNA, 21 bp, Homo sapiens
acggagtctcactctgtcacc

SEQ ID NO: 4037908 - DNA, 16 bp, Homo sapiens
acggatgattggatta

SEQ ID NO: 4037909 - DNA, 20 bp, Homo sapiens
acggcaggctcactgccagg

SEQ ID NO: 4037910 - DNA, 21 bp, Homo sapiens
acggcattagcttcctgcccc

SEQ ID NO: 4037911 - DNA, 18 bp, Homo sapiens
acggccacatcaaagagg

SEQ ID NO: 4037912 - DNA, 19 bp, Homo sapiens
actcatattacaaaaacaa

SEQ ID NO: 4037913 - DNA, 20 bp, Homo sapiens
actcatcaatcaaataagta

SEQ ID NO: 4037914 - DNA, 17 bp, Homo sapiens
actcatcataaaataaa

SEQ ID NO: 4037915 - DNA, 18 bp, Homo sapiens
actcatcttagtgcctga

SEQ ID NO: 4037916 - DNA, 21 bp, Homo sapiens
actcatggcagctgtttctca

SEQ ID NO: 4037917 - DNA, 18 bp, Homo sapiens
actcattgctgagcctct

SEQ ID NO: 4037918 - DNA, 22 bp, Homo sapiens
actcatttgttaaaattatcaa

SEQ ID NO: 4037919 - DNA, 15 bp, Homo sapiens
actcatttttgccat

SEQ ID NO: 4037920 - DNA, 21 bp, Homo sapiens
actcatttttgccatacatca

SEQ ID NO: 4037921 - DNA, 19 bp, Homo sapiens
actccaacagaagaactgt

SEQ ID NO: 4037922 - DNA, 13 bp, Homo sapiens
actccacaaatga

SEQ ID NO: 4037923 - DNA, 14 bp, Homo sapiens
actccacaaatgat

SEQ ID NO: 4037924 - DNA, 13 bp, Homo sapiens
actccacatctgc

SEQ ID NO: 4037925 - DNA, 17 bp, Homo sapiens
actccaccgaccaactg

SEQ ID NO: 4037926 - DNA, 19 bp, Homo sapiens
actccaccgaccaactgcc

SEQ ID NO: 4037927 - DNA, 20 bp, Homo sapiens
actccagaaatgtccctttc

SEQ ID NO: 4037928 - DNA, 23 bp, Homo sapiens
actccagaaatgtccctttcttc

SEQ ID NO: 4037929 - DNA, 21 bp, Homo sapiens
actccagacccctggcttttc

SEQ ID NO: 4037930 - DNA, 14 bp, Homo sapiens
actccagatagaga

SEQ ID NO: 4037931 - DNA, 18 bp, Homo sapiens
actccagcctgggcaaca

SEQ ID NO: 4037932 - DNA, 14 bp, Homo sapiens
actccaggaaagag

SEQ ID NO: 4037933 - DNA, 18 bp, Homo sapiens
actccaggaaagagcagt

SEQ ID NO: 4037934 - DNA, 16 bp, Homo sapiens
actccaggcccaaggc

SEQ ID NO: 4037935 - DNA, 17 bp, Homo sapiens
actccaggcccaaggct

SEQ ID NO: 4037936 - DNA, 19 bp, Homo sapiens
actccaggcccaaggctcc

SEQ ID NO: 4037937 - DNA, 21 bp, Homo sapiens
actccaggcccaaggctcccg

SEQ ID NO: 4037938 - DNA, 15 bp, Homo sapiens
actccatctcctgct

SEQ ID NO: 4037939 - DNA, 17 bp, Homo sapiens
actccatctcctgctca

SEQ ID NO: 4037940 - DNA, 20 bp, Homo sapiens
actccatctcctgctcacca

SEQ ID NO: 4037941 - DNA, 17 bp, Homo sapiens
actccatgagcacccca

SEQ ID NO: 4037942 - DNA, 16 bp, Homo sapiens
actcccaaccctggct

SEQ ID NO: 4037943 - DNA, 19 bp, Homo sapiens
actcccaaggttggagccc

SEQ ID NO: 4037944 - DNA, 15 bp, Homo sapiens
actcccacctcaccc

SEQ ID NO: 4037945 - DNA, 16 bp, Homo sapiens
actcccattcctgaag

SEQ ID NO: 4037946 - DNA, 17 bp, Homo sapiens
actcccccgtttctcct

SEQ ID NO: 4037947 - DNA, 17 bp, Homo sapiens
actccccgaagtctttt

SEQ ID NO: 4037948 - DNA, 14 bp, Homo sapiens
actcccgcctcagg

SEQ ID NO: 4037949 - DNA, 19 bp, Homo sapiens
actcccggagcctgtgcag

SEQ ID NO: 4037950 - DNA, 19 bp, Homo sapiens
actcccgggccacgcccca

SEQ ID NO: 4037951 - DNA, 14 bp, Homo sapiens
actccctatctcct

SEQ ID NO: 4037952 - DNA, 20 bp, Homo sapiens
actccctatctccttcccac

SEQ ID NO: 4037953 - DNA, 13 bp, Homo sapiens
actccctcctcac

SEQ ID NO: 4037954 - DNA, 19 bp, Homo sapiens
actccctcctcacctctgg

SEQ ID NO: 4037955 - DNA, 23 bp, Homo sapiens
actccctctgccttcaggcttct

SEQ ID NO: 4037956 - DNA, 16 bp, Homo sapiens
actccctgctccacga

SEQ ID NO: 4037957 - DNA, 15 bp, Homo sapiens
actccctgcttgcag

SEQ ID NO: 4037958 - DNA, 18 bp, Homo sapiens
actccctggctctcagaa

SEQ ID NO: 4037959 - DNA, 22 bp, Homo sapiens
actccctgtgggggtggccatc

SEQ ID NO: 4037960 - DNA, 19 bp, Homo sapiens
actcccttggtggcaagag

SEQ ID NO: 4037961 - DNA, 21 bp, Homo sapiens
actcccttggtggcaagagcc

SEQ ID NO: 4037962 - DNA, 22 bp, Homo sapiens
actcccttggtggcaagagccc

SEQ ID NO: 4037963 - DNA, 15 bp, Homo sapiens
actccgcatcacctc

SEQ ID NO: 4037964 - DNA, 17 bp, Homo sapiens
actccgcatcacctcac

SEQ ID NO: 4037965 - DNA, 21 bp, Homo sapiens
actcctaattttaaataattt

SEQ ID NO: 4037966 - DNA, 14 bp, Homo sapiens
actcctacctggta

SEQ ID NO: 4037967 - DNA, 21 bp, Homo sapiens
actcctagagaacgcagccct

SEQ ID NO: 4037968 - DNA, 15 bp, Homo sapiens
actcctaggagagcc

SEQ ID NO: 4037969 - DNA, 16 bp, Homo sapiens
actcctaggagagcca

SEQ ID NO: 4037970 - DNA, 20 bp, Homo sapiens
actcctcaaaagcaaatgag

SEQ ID NO: 4037971 - DNA, 12 bp, Homo sapiens
actcctcccagg

SEQ ID NO: 4037972 - DNA, 18 bp, Homo sapiens
actcctctggctttccca

SEQ ID NO: 4037973 - DNA, 18 bp, Homo sapiens
actcctgactcctacctg

SEQ ID NO: 4037974 - DNA, 13 bp, Homo sapiens
actcctgcaaaat

SEQ ID NO: 4037975 - DNA, 15 bp, Homo sapiens
actcctgcaaaattt

SEQ ID NO: 4037976 - DNA, 13 bp, Homo sapiens
actcctggccttt

SEQ ID NO: 4037977 - DNA, 16 bp, Homo sapiens
actcctgtacactgaa

SEQ ID NO: 4037978 - DNA, 23 bp, Homo sapiens
actccttccagtgtccttagaac

SEQ ID NO: 4037979 - DNA, 13 bp, Homo sapiens
actccttcctggc

SEQ ID NO: 4037980 - DNA, 16 bp, Homo sapiens
actccttcctggcctg

SEQ ID NO: 4037981 - DNA, 14 bp, Homo sapiens
actccttgcttcct

SEQ ID NO: 4037982 - DNA, 16 bp, Homo sapiens
actccttgcttcctga

SEQ ID NO: 4037983 - DNA, 18 bp, Homo sapiens
actcgcacctgtgctgga

SEQ ID NO: 4037984 - DNA, 15 bp, Homo sapiens
actcgccatctcctg

SEQ ID NO: 4037985 - DNA, 16 bp, Homo sapiens
actcggcaccctgcaa

SEQ ID NO: 4037986 - DNA, 16 bp, Homo sapiens
actctaaaaaacattt

SEQ ID NO: 4037987 - DNA, 12 bp, Homo sapiens
actctaaaaact

SEQ ID NO: 4037988 - DNA, 21 bp, Homo sapiens
actctaaactgcaaacagaaa

SEQ ID NO: 4037989 - DNA, 23 bp, Homo sapiens
actctaaactgcaaacagaaatc

SEQ ID NO: 4037990 - DNA, 22 bp, Homo sapiens
actctaaatgcagttttaagaa

SEQ ID NO: 4037991 - DNA, 17 bp, Homo sapiens
actctaagctcagtgct

SEQ ID NO: 4037992 - DNA, 21 bp, Homo sapiens
actctaattcccattttgcaa

SEQ ID NO: 4037993 - DNA, 14 bp, Homo sapiens
actctacccctgct

SEQ ID NO: 4037994 - DNA, 19 bp, Homo sapiens
actctacccctgctcccat

SEQ ID NO: 4037995 - DNA, 23 bp, Homo sapiens
actctacccctgctcccattcct

SEQ ID NO: 4037996 - DNA, 13 bp, Homo sapiens
actctaccctccc

SEQ ID NO: 4037997 - DNA, 19 bp, Homo sapiens
actctaccctcccaccccc

SEQ ID NO: 4037998 - DNA, 21 bp, Homo sapiens
actctacttagcatgtcccta

SEQ ID NO: 4037999 - DNA, 17 bp, Homo sapiens
actctagacaagatatt

SEQ ID NO: 4038000 - DNA, 19 bp, Homo sapiens
actctagacaagatattgt

SEQ ID NO: 4038001 - DNA, 21 bp, Homo sapiens
actctagacaagatattgtac

SEQ ID NO: 4038002 - DNA, 22 bp, Homo sapiens
actctagatgaagttttacatt

SEQ ID NO: 4038003 - DNA, 15 bp, Homo sapiens
actctatagactcta

SEQ ID NO: 4038004 - DNA, 20 bp, Homo sapiens
actctatagtaggcatgtta

SEQ ID NO: 4038005 - DNA, 16 bp, Homo sapiens
actctcacatgtggca

SEQ ID NO: 4038006 - DNA, 19 bp, Homo sapiens
actctcacccataaacagt

SEQ ID NO: 4038007 - DNA, 11 bp, Homo sapiens
actctcaggga

SEQ ID NO: 4038008 - DNA, 22 bp, Homo sapiens
actctcagtgcttcttactatt

SEQ ID NO: 4038009 - DNA, 13 bp, Homo sapiens
actctccatatcc

SEQ ID NO: 4038010 - DNA, 15 bp, Homo sapiens
actctccccacacta

SEQ ID NO: 4038011 - DNA, 21 bp, Homo sapiens
actctccccacgagggctggc

SEQ ID NO: 4038012 - DNA, 23 bp, Homo sapiens
actctctaaatcttccttgtgag

SEQ ID NO: 4038013 - DNA, 20 bp, Homo sapiens
actctctccaccctatatgt

SEQ ID NO: 4038014 - DNA, 18 bp, Homo sapiens
actgatgctgagattctt

SEQ ID NO: 4038015 - DNA, 12 bp, Homo sapiens
actgatgctgcc

SEQ ID NO: 4038016 - DNA, 15 bp, Homo sapiens
actgatgctgttctc

SEQ ID NO: 4038017 - DNA, 17 bp, Homo sapiens
actgatggccaggcaag

SEQ ID NO: 4038018 - DNA, 20 bp, Homo sapiens
actgattatgtcttttatat

SEQ ID NO: 4038019 - DNA, 21 bp, Homo sapiens
actgattctgtgtatcttttt

SEQ ID NO: 4038020 - DNA, 13 bp, Homo sapiens
actgattgtttca

SEQ ID NO: 4038021 - DNA, 17 bp, Homo sapiens
actgatttcacaacaga

SEQ ID NO: 4038022 - DNA, 13 bp, Homo sapiens
actgatttccttt

SEQ ID NO: 4038023 - DNA, 19 bp, Homo sapiens
actgatttcttcagaatta

SEQ ID NO: 4038024 - DNA, 22 bp, Homo sapiens
actgattttgttatttttatat

SEQ ID NO: 4038025 - DNA, 14 bp, Homo sapiens
actgcaaacagaaa

SEQ ID NO: 4038026 - DNA, 15 bp, Homo sapiens
actgcaaaggcgcag

SEQ ID NO: 4038027 - DNA, 16 bp, Homo sapiens
actgcaaattttaact

SEQ ID NO: 4038028 - DNA, 16 bp, Homo sapiens
actgcaacctctgcct

SEQ ID NO: 4038029 - DNA, 17 bp, Homo sapiens
actgcaacctctgcctc

SEQ ID NO: 4038030 - DNA, 13 bp, Homo sapiens
actgcaagctgct

SEQ ID NO: 4038031 - DNA, 17 bp, Homo sapiens
actgcaataacttctga

SEQ ID NO: 4038032 - DNA, 22 bp, Homo sapiens
actgcacagcggcccctgcatc

SEQ ID NO: 4038033 - DNA, 16 bp, Homo sapiens
actgcacagtgcatct

SEQ ID NO: 4038034 - DNA, 14 bp, Homo sapiens
actgcacccagctc

SEQ ID NO: 4038035 - DNA, 18 bp, Homo sapiens
actgcacccagctccagg

SEQ ID NO: 4038036 - DNA, 17 bp, Homo sapiens
actgcactccagcctgg

SEQ ID NO: 4038037 - DNA, 20 bp, Homo sapiens
actgcactccagcctgggca

SEQ ID NO: 4038038 - DNA, 19 bp, Homo sapiens
actgcactccagcctgggg

SEQ ID NO: 4038039 - DNA, 20 bp, Homo sapiens
actgcactccagcctggggg

SEQ ID NO: 4038040 - DNA, 20 bp, Homo sapiens
actgcagagtaaattgctct

SEQ ID NO: 4038041 - DNA, 23 bp, Homo sapiens
actgcagcctcatactcctgggc

SEQ ID NO: 4038042 - DNA, 19 bp, Homo sapiens
actgcaggagcagtttgcc

SEQ ID NO: 4038043 - DNA, 14 bp, Homo sapiens
actgcagtttcctg

SEQ ID NO: 4038044 - DNA, 16 bp, Homo sapiens
actgcagtttcctgga

SEQ ID NO: 4038045 - DNA, 16 bp, Homo sapiens
actgcatatgaaagga

SEQ ID NO: 4038046 - DNA, 17 bp, Homo sapiens
actgcatggacctaaca

SEQ ID NO: 4038047 - DNA, 15 bp, Homo sapiens
actgccaggccagcc

SEQ ID NO: 4038048 - DNA, 18 bp, Homo sapiens
actgccaggctgcctcct

SEQ ID NO: 4038049 - DNA, 21 bp, Homo sapiens
actgccaggctgcctcctgcc

SEQ ID NO: 4038050 - DNA, 19 bp, Homo sapiens
actgcccatggacaggctg

SEQ ID NO: 4038051 - DNA, 20 bp, Homo sapiens
actgccccacggagacagag

SEQ ID NO: 4038052 - DNA, 22 bp, Homo sapiens
actgccctaagcccccagggcc

SEQ ID NO: 4038053 - DNA, 23 bp, Homo sapiens
actgccctgttcatgtgcctctg

SEQ ID NO: 4038054 - DNA, 17 bp, Homo sapiens
actgcccttttcaggaa

SEQ ID NO: 4038055 - DNA, 17 bp, Homo sapiens
actgcctcccatccttc

SEQ ID NO: 4038056 - DNA, 19 bp, Homo sapiens
actgcctcgaaacacagaa

SEQ ID NO: 4038057 - DNA, 19 bp, Homo sapiens
actgccttctcctctctgg

SEQ ID NO: 4038058 - DNA, 21 bp, Homo sapiens
actgccttctcctctctgggc

SEQ ID NO: 4038059 - DNA, 23 bp, Homo sapiens
actgccttctcctctctgggcct

SEQ ID NO: 4038060 - DNA, 21 bp, Homo sapiens
actgccttgaacctgtgagta

SEQ ID NO: 4038061 - DNA, 18 bp, Homo sapiens
actgcgatcttcagagca

SEQ ID NO: 4038062 - DNA, 15 bp, Homo sapiens
actgctaaatcctca

SEQ ID NO: 4038063 - DNA, 23 bp, Homo sapiens
actgctacaaatactcttaggaa

SEQ ID NO: 4038064 - DNA, 14 bp, Homo sapiens
actgctacagcaat

SEQ ID NO: 4038065 - DNA, 22 bp, Homo sapiens
actgctcagaacttgctgctgt

SEQ ID NO: 4038066 - DNA, 19 bp, Homo sapiens
actgctcccatcattcctt

SEQ ID NO: 4038067 - DNA, 19 bp, Homo sapiens
actgctccccagccctggc

SEQ ID NO: 4038068 - DNA, 12 bp, Homo sapiens
actgctggctgc

SEQ ID NO: 4038069 - DNA, 16 bp, Homo sapiens
actgctgtacccagat

SEQ ID NO: 4038070 - DNA, 19 bp, Homo sapiens
actgctgtacccagatgcc

SEQ ID NO: 4038071 - DNA, 23 bp, Homo sapiens
actgctgtgaaccctggggcctg

SEQ ID NO: 4038072 - DNA, 21 bp, Homo sapiens
actgcttgaccgtactctcac

SEQ ID NO: 4038073 - DNA, 16 bp, Homo sapiens
actgcttgatgaagca

SEQ ID NO: 4038074 - DNA, 18 bp, Homo sapiens
actgcttgatgaagcaag

SEQ ID NO: 4038075 - DNA, 13 bp, Homo sapiens
actgctttcaagt

SEQ ID NO: 4038076 - DNA, 23 bp, Homo sapiens
actgctttgggatttaatttcca

SEQ ID NO: 4038077 - DNA, 15 bp, Homo sapiens
actggaaaggggaga

SEQ ID NO: 4038078 - DNA, 20 bp, Homo sapiens
actggaaaggggagagcctg

SEQ ID NO: 4038079 - DNA, 22 bp, Homo sapiens
actggaaaggggagagcctgct

SEQ ID NO: 4038080 - DNA, 19 bp, Homo sapiens
actggaagctaatttgcat

SEQ ID NO: 4038081 - DNA, 21 bp, Homo sapiens
actggaaggaacatggagctg

SEQ ID NO: 4038082 - DNA, 17 bp, Homo sapiens
actggaagttttgcatt

SEQ ID NO: 4038083 - DNA, 16 bp, Homo sapiens
actggaataatttgta

SEQ ID NO: 4038084 - DNA, 18 bp, Homo sapiens
actggaattcttctgcaa

SEQ ID NO: 4038085 - DNA, 18 bp, Homo sapiens
actggacataacattttc

SEQ ID NO: 4038086 - DNA, 20 bp, Homo sapiens
actggacgctgtcctgagat

SEQ ID NO: 4038087 - DNA, 15 bp, Homo sapiens
actggagctcatctg

SEQ ID NO: 4038088 - DNA, 12 bp, Homo sapiens
actggaggaggc

SEQ ID NO: 4038089 - DNA, 16 bp, Homo sapiens
actggaggaggcctgt

SEQ ID NO: 4038090 - DNA, 18 bp, Homo sapiens
actggaggcccctggagc

SEQ ID NO: 4038091 - DNA, 23 bp, Homo sapiens
actggaggtcacattcaggaaga

SEQ ID NO: 4038092 - DNA, 14 bp, Homo sapiens
actggaggtgggca

SEQ ID NO: 4038093 - DNA, 17 bp, Homo sapiens
actggaggttgaagcca

SEQ ID NO: 4038094 - DNA, 18 bp, Homo sapiens
actggaggttgaagccaa

SEQ ID NO: 4038095 - DNA, 17 bp, Homo sapiens
actggagtcagatgagc

SEQ ID NO: 4038096 - DNA, 13 bp, Homo sapiens
actggagtctgga

SEQ ID NO: 4038097 - DNA, 15 bp, Homo sapiens
actggagttacatta

SEQ ID NO: 4038098 - DNA, 17 bp, Homo sapiens
actggagttacattaat

SEQ ID NO: 4038099 - DNA, 23 bp, Homo sapiens
actggagttccttatccctctct

SEQ ID NO: 4038100 - DNA, 11 bp, Homo sapiens
actggatgaaa

SEQ ID NO: 4038101 - DNA, 15 bp, Homo sapiens
actggatggaaagac

SEQ ID NO: 4038102 - DNA, 13 bp, Homo sapiens
actggattggcca

SEQ ID NO: 4038103 - DNA, 23 bp, Homo sapiens
actggattggccaaacatcagac

SEQ ID NO: 4038104 - DNA, 14 bp, Homo sapiens
actggcagcatctt

SEQ ID NO: 4038105 - DNA, 22 bp, Homo sapiens
actggcaggagggtgaggaggt

SEQ ID NO: 4038106 - DNA, 21 bp, Homo sapiens
actggcaggggagacaggagc

SEQ ID NO: 4038107 - DNA, 18 bp, Homo sapiens
actggcctgacttggggg

SEQ ID NO: 4038108 - DNA, 12 bp, Homo sapiens
actggctggctc

SEQ ID NO: 4038109 - DNA, 13 bp, Homo sapiens
actggctggctcc

SEQ ID NO: 4038110 - DNA, 19 bp, Homo sapiens
actgggaagataggctctg

SEQ ID NO: 4038111 - DNA, 16 bp, Homo sapiens
actgggagaatcacta

SEQ ID NO: 4038112 - DNA, 13 bp, Homo sapiens
actgggaggaggg

SEQ ID NO: 4038113 - DNA, 19 bp, Homo sapiens
actgggaggagggggaggg

SEQ ID NO: 4038114 - DNA, 14 bp, Homo sapiens
actgggaggcaggg

SEQ ID NO: 4038115 - DNA, 14 bp, Homo sapiens
actgggagtcagag

SEQ ID NO: 4038116 - DNA, 19 bp, Homo sapiens
atcgccagaggtgcttcac

SEQ ID NO: 4038117 - DNA, 18 bp, Homo sapiens
atcgccctggcaggcagg

SEQ ID NO: 4038118 - DNA, 14 bp, Homo sapiens
atcggaagcagtgc

SEQ ID NO: 4038119 - DNA, 16 bp, Homo sapiens
atcggagcctcctctc

SEQ ID NO: 4038120 - DNA, 17 bp, Homo sapiens
atcggagcgaagcagag

SEQ ID NO: 4038121 - DNA, 22 bp, Homo sapiens
atcggaggctgggcccctggga

SEQ ID NO: 4038122 - DNA, 21 bp, Homo sapiens
atcgggaacagtgtttcccat

SEQ ID NO: 4038123 - DNA, 18 bp, Homo sapiens
atcggtgaaactaacaga

SEQ ID NO: 4038124 - DNA, 15 bp, Homo sapiens
atcgtaaccagccag

SEQ ID NO: 4038125 - DNA, 19 bp, Homo sapiens
atcgtccagcgaccttcct

SEQ ID NO: 4038126 - DNA, 12 bp, Homo sapiens
atcgtgctaaat

SEQ ID NO: 4038127 - DNA, 15 bp, Homo sapiens
atcgtgctaaatttt

SEQ ID NO: 4038128 - DNA, 14 bp, Homo sapiens
atcgtgctactgca

SEQ ID NO: 4038129 - DNA, 21 bp, Homo sapiens
atcgtgtattgagatttctta

SEQ ID NO: 4038130 - DNA, 15 bp, Homo sapiens
atcgttattataaat

SEQ ID NO: 4038131 - DNA, 17 bp, Homo sapiens
atcgttattataaatgt

SEQ ID NO: 4038132 - DNA, 13 bp, Homo sapiens
atctaaaacaaaa

SEQ ID NO: 4038133 - DNA, 21 bp, Homo sapiens
atctaaaacaaaatctgaact

SEQ ID NO: 4038134 - DNA, 18 bp, Homo sapiens
atctaaaagctctgttcc

SEQ ID NO: 4038135 - DNA, 15 bp, Homo sapiens
atctaaagtgtgttg

SEQ ID NO: 4038136 - DNA, 16 bp, Homo sapiens
atctaaatctatttat

SEQ ID NO: 4038137 - DNA, 14 bp, Homo sapiens
atctaaatgatgag

SEQ ID NO: 4038138 - DNA, 15 bp, Homo sapiens
atctaaatgttgaaa

SEQ ID NO: 4038139 - DNA, 15 bp, Homo sapiens
atctaagtgatataa

SEQ ID NO: 4038140 - DNA, 23 bp, Homo sapiens
atctaatatggccacagtagtct

SEQ ID NO: 4038141 - DNA, 17 bp, Homo sapiens
atctaatgcttgtttat

SEQ ID NO: 4038142 - DNA, 17 bp, Homo sapiens
atctacaagccaaaagt

SEQ ID NO: 4038143 - DNA, 20 bp, Homo sapiens
atctacaatcagttgacttt

SEQ ID NO: 4038144 - DNA, 16 bp, Homo sapiens
atctactcagaaattt

SEQ ID NO: 4038145 - DNA, 17 bp, Homo sapiens
atctagacaatatacaa

SEQ ID NO: 4038146 - DNA, 15 bp, Homo sapiens
atctagcaatcacaa

SEQ ID NO: 4038147 - DNA, 16 bp, Homo sapiens
atctaggtaattttta

SEQ ID NO: 4038148 - DNA, 18 bp, Homo sapiens
atctaggtggagttgaaa

SEQ ID NO: 4038149 - DNA, 21 bp, Homo sapiens
atctaggtggagttgaaagag

SEQ ID NO: 4038150 - DNA, 17 bp, Homo sapiens
atctaggtgtggctgtg

SEQ ID NO: 4038151 - DNA, 21 bp, Homo sapiens
atctaggtgtggctgtgaagg

SEQ ID NO: 4038152 - DNA, 13 bp, Homo sapiens
atctagtgcagct

SEQ ID NO: 4038153 - DNA, 19 bp, Homo sapiens
atctagtgcagctgatttt

SEQ ID NO: 4038154 - DNA, 21 bp, Homo sapiens
atctagtgcagctgattttaa

SEQ ID NO: 4038155 - DNA, 22 bp, Homo sapiens
atctagtgcagctgattttaac

SEQ ID NO: 4038156 - DNA, 13 bp, Homo sapiens
atctatccctgcg

SEQ ID NO: 4038157 - DNA, 19 bp, Homo sapiens
atctatctcatctatctca

SEQ ID NO: 4038158 - DNA, 13 bp, Homo sapiens
atctatcttccaa

SEQ ID NO: 4038159 - DNA, 13 bp, Homo sapiens
atctatgatataa

SEQ ID NO: 4038160 - DNA, 14 bp, Homo sapiens
atctattaatatat

SEQ ID NO: 4038161 - DNA, 13 bp, Homo sapiens
atctattctgtgt

SEQ ID NO: 4038162 - DNA, 17 bp, Homo sapiens
atctattgggttcatta

SEQ ID NO: 4038163 - DNA, 19 bp, Homo sapiens
atctattgggttcattatt

SEQ ID NO: 4038164 - DNA, 15 bp, Homo sapiens
atctatttattaata

SEQ ID NO: 4038165 - DNA, 19 bp, Homo sapiens
atctatttcatgtttttga

SEQ ID NO: 4038166 - DNA, 14 bp, Homo sapiens
atctattttggatt

SEQ ID NO: 4038167 - DNA, 22 bp, Homo sapiens
atctattttggattgtatattg

SEQ ID NO: 4038168 - DNA, 14 bp, Homo sapiens
atctcaaataacta

SEQ ID NO: 4038169 - DNA, 23 bp, Homo sapiens
atctcaaataactaaaaggtatg

SEQ ID NO: 4038170 - DNA, 15 bp, Homo sapiens
atctcagaaagtgcc

SEQ ID NO: 4038171 - DNA, 18 bp, Homo sapiens
atctcagcctcctgagcc

SEQ ID NO: 4038172 - DNA, 24 bp, Homo sapiens
atctcagcctcctgagcctgtggg

SEQ ID NO: 4038173 - DNA, 16 bp, Homo sapiens
atctcaggggccagag

SEQ ID NO: 4038174 - DNA, 23 bp, Homo sapiens
atctcaggggccagaggaactgt

SEQ ID NO: 4038175 - DNA, 16 bp, Homo sapiens
atctcagtcatgcata

SEQ ID NO: 4038176 - DNA, 20 bp, Homo sapiens
atctcatttaatttgttata

SEQ ID NO: 4038177 - DNA, 12 bp, Homo sapiens
atctccaaggac

SEQ ID NO: 4038178 - DNA, 19 bp, Homo sapiens
atctccatcatatgcctga

SEQ ID NO: 4038179 - DNA, 20 bp, Homo sapiens
atctccatcatatgcctgac

SEQ ID NO: 4038180 - DNA, 21 bp, Homo sapiens
atctccatggccctgtcccag

SEQ ID NO: 4038181 - DNA, 22 bp, Homo sapiens
atctccatggccctgtcccagg

SEQ ID NO: 4038182 - DNA, 20 bp, Homo sapiens
atctcccaagctatctaaag

SEQ ID NO: 4038183 - DNA, 13 bp, Homo sapiens
atctccccactct

SEQ ID NO: 4038184 - DNA, 17 bp, Homo sapiens
atctccctgcctggccc

SEQ ID NO: 4038185 - DNA, 17 bp, Homo sapiens
atctccgttccatctgg

SEQ ID NO: 4038186 - DNA, 11 bp, Homo sapiens
atctcctcccg

SEQ ID NO: 4038187 - DNA, 11 bp, Homo sapiens
atctcctgctc

SEQ ID NO: 4038188 - DNA, 15 bp, Homo sapiens
atctcctgctcacca

SEQ ID NO: 4038189 - DNA, 22 bp, Homo sapiens
atctcctgctcaccacctgcct

SEQ ID NO: 4038190 - DNA, 23 bp, Homo sapiens
atctcctgctcaccacctgcctc

SEQ ID NO: 4038191 - DNA, 15 bp, Homo sapiens
atctcctgtgcatgg

SEQ ID NO: 4038192 - DNA, 13 bp, Homo sapiens
atctccttcccac

SEQ ID NO: 4038193 - DNA, 20 bp, Homo sapiens
atctccttcccacccctaca

SEQ ID NO: 4038194 - DNA, 19 bp, Homo sapiens
atctcggctcactgcaacc

SEQ ID NO: 4038195 - DNA, 14 bp, Homo sapiens
atctcgtgggagag

SEQ ID NO: 4038196 - DNA, 15 bp, Homo sapiens
atctcgttcccaaag

SEQ ID NO: 4038197 - DNA, 22 bp, Homo sapiens
atctcgtttttcttcttaagac

SEQ ID NO: 4038198 - DNA, 21 bp, Homo sapiens
atctctactaccacaaggaaa

SEQ ID NO: 4038199 - DNA, 15 bp, Homo sapiens
atctctagaatttta

SEQ ID NO: 4038200 - DNA, 21 bp, Homo sapiens
atctctagaattttaagtgct

SEQ ID NO: 4038201 - DNA, 17 bp, Homo sapiens
atctctattatatcttg

SEQ ID NO: 4038202 - DNA, 17 bp, Homo sapiens
atctctattccccaccc

SEQ ID NO: 4038203 - DNA, 15 bp, Homo sapiens
atctctcaaaacttg

SEQ ID NO: 4038204 - DNA, 14 bp, Homo sapiens
atctctcaaatctg

SEQ ID NO: 4038205 - DNA, 17 bp, Homo sapiens
atctctcaaatctgtta

SEQ ID NO: 4038206 - DNA, 14 bp, Homo sapiens
atctctcaggagca

SEQ ID NO: 4038207 - DNA, 16 bp, Homo sapiens
atctctcaggagcaca

SEQ ID NO: 4038208 - DNA, 21 bp, Homo sapiens
atctctcaggagcacaggcag

SEQ ID NO: 4038209 - DNA, 12 bp, Homo sapiens
atctctcatcct

SEQ ID NO: 4038210 - DNA, 14 bp, Homo sapiens
atctctccctcccc

SEQ ID NO: 4038211 - DNA, 17 bp, Homo sapiens
atctctctgcagctgcc

SEQ ID NO: 4038212 - DNA, 23 bp, Homo sapiens
atctctctgtgctgtggaagcaa

SEQ ID NO: 4038213 - DNA, 15 bp, Homo sapiens
atctctcttgtcctc

SEQ ID NO: 4038214 - DNA, 17 bp, Homo sapiens
atctctcttgtcctctt

SEQ ID NO: 4038215 - DNA, 19 bp, Homo sapiens
atctctcttgtcctcttct

SEQ ID NO: 4038216 - DNA, 12 bp, Homo sapiens
atctcttctgca

SEQ ID NO: 4038217 - DNA, 13 bp, Homo sapiens
atctcttctgcaa

SEQ ID NO: 4038218 - DNA, 15 bp, Homo sapiens
atctcttctgcaagc

SEQ ID NO: 4038219 - DNA, 20 bp, Homo sapiens
atctctttgtacaggaactg

SEQ ID NO: 4038220 - DNA, 19 bp, Homo sapiens
atctcttttatatttgtag

SEQ ID NO: 4038221 - DNA, 14 bp, Homo sapiens
atctgaaaactgga

SEQ ID NO: 4038222 - DNA, 20 bp, Homo sapiens
atctgaaaatgtatgtgtaa

SEQ ID NO: 4038223 - DNA, 14 bp, Homo sapiens
atctgaactctcaa

SEQ ID NO: 4038224 - DNA, 21 bp, Homo sapiens
atctgaagagctattatataa

SEQ ID NO: 4038225 - DNA, 22 bp, Homo sapiens
atctgaagagtatccttccttc

SEQ ID NO: 4038226 - DNA, 19 bp, Homo sapiens
atctgagctgcagcctggc

SEQ ID NO: 4038227 - DNA, 15 bp, Homo sapiens
atctgcacactccag

SEQ ID NO: 4038228 - DNA, 17 bp, Homo sapiens
atctgcaccccttctct

SEQ ID NO: 4038229 - DNA, 18 bp, Homo sapiens
atctgcactctaaactgc

SEQ ID NO: 4038230 - DNA, 21 bp, Homo sapiens
atctgcactctaaactgcaaa

SEQ ID NO: 4038231 - DNA, 19 bp, Homo sapiens
atctgcagtacagtcttat

SEQ ID NO: 4038232 - DNA, 15 bp, Homo sapiens
atctgccacaaaaac

SEQ ID NO: 4038233 - DNA, 19 bp, Homo sapiens
atctgccttaaaaccaaag

SEQ ID NO: 4038234 - DNA, 21 bp, Homo sapiens
atctgcgtgacaataaaacat

SEQ ID NO: 4038235 - DNA, 15 bp, Homo sapiens
atctgcgtgtgtgca

SEQ ID NO: 4038236 - DNA, 14 bp, Homo sapiens
atctgctaataaaa

SEQ ID NO: 4038237 - DNA, 13 bp, Homo sapiens
atctgctagaaag

SEQ ID NO: 4038238 - DNA, 14 bp, Homo sapiens
atctgctagaaagt

SEQ ID NO: 4038239 - DNA, 14 bp, Homo sapiens
atctgctcacttta

SEQ ID NO: 4038240 - DNA, 15 bp, Homo sapiens
atctggaacccagac

SEQ ID NO: 4038241 - DNA, 23 bp, Homo sapiens
atctggaacccagactcagacat

SEQ ID NO: 4038242 - DNA, 16 bp, Homo sapiens
atctggaacctcagcc

SEQ ID NO: 4038243 - DNA, 19 bp, Homo sapiens
atctggaacctcagcctgg

SEQ ID NO: 4038244 - DNA, 20 bp, Homo sapiens
atctggaacctcagcctggc

SEQ ID NO: 4038245 - DNA, 21 bp, Homo sapiens
atctggaagagctaggcaggg

SEQ ID NO: 4038246 - DNA, 21 bp, Homo sapiens
atctggaattggtttagccca

SEQ ID NO: 4038247 - DNA, 21 bp, Homo sapiens
atctggagaccagggagcctt

SEQ ID NO: 4038248 - DNA, 22 bp, Homo sapiens
atctggagaccagggagccttt

SEQ ID NO: 4038249 - DNA, 19 bp, Homo sapiens
atctggaggccttccagct

SEQ ID NO: 4038250 - DNA, 21 bp, Homo sapiens
atctggaggccttccagctgc

SEQ ID NO: 4038251 - DNA, 22 bp, Homo sapiens
atctggaggccttccagctgct

SEQ ID NO: 4038252 - DNA, 20 bp, Homo sapiens
atctggataggagcctgctg

SEQ ID NO: 4038253 - DNA, 22 bp, Homo sapiens
atctggataggagcctgctggt

SEQ ID NO: 4038254 - DNA, 20 bp, Homo sapiens
atctggccctcgacactcac

SEQ ID NO: 4038255 - DNA, 21 bp, Homo sapiens
atctggccctcgacactcacc

SEQ ID NO: 4038256 - DNA, 20 bp, Homo sapiens
atctggcctaaaatcttgga

SEQ ID NO: 4038257 - DNA, 20 bp, Homo sapiens
atctggctgtctagaatgtg

SEQ ID NO: 4038258 - DNA, 20 bp, Homo sapiens
atctggctgtttagcagaac

SEQ ID NO: 4038259 - DNA, 17 bp, Homo sapiens
atctgggcattttcctc

SEQ ID NO: 4038260 - DNA, 18 bp, Homo sapiens
atctgggcattttcctcc

SEQ ID NO: 4038261 - DNA, 23 bp, Homo sapiens
atctgggcattttcctcctctgc

SEQ ID NO: 4038262 - DNA, 21 bp, Homo sapiens
atctggggttggcaacaggac

SEQ ID NO: 4038263 - DNA, 17 bp, Homo sapiens
atctggtagatttttaa

SEQ ID NO: 4038264 - DNA, 15 bp, Homo sapiens
atctggtcaagttga

SEQ ID NO: 4038265 - DNA, 21 bp, Homo sapiens
atctggttgtgactctaagct

SEQ ID NO: 4038266 - DNA, 12 bp, Homo sapiens
atctgtataaat

SEQ ID NO: 4038267 - DNA, 13 bp, Homo sapiens
atctgtataaatg

SEQ ID NO: 4038268 - DNA, 17 bp, Homo sapiens
atctgtataaatgtcta

SEQ ID NO: 4038269 - DNA, 22 bp, Homo sapiens
atctgtataaatgtctattatt

SEQ ID NO: 4038270 - DNA, 17 bp, Homo sapiens
atctgtcacaccagcca

SEQ ID NO: 4038271 - DNA, 20 bp, Homo sapiens
atctgtcacacctgtgcctc

SEQ ID NO: 4038272 - DNA, 19 bp, Homo sapiens
atctgtccaaaggaggctg

SEQ ID NO: 4038273 - DNA, 14 bp, Homo sapiens
atctgtccaaggaa

SEQ ID NO: 4038274 - DNA, 20 bp, Homo sapiens
atctgtccatggcctttcta

SEQ ID NO: 4038275 - DNA, 21 bp, Homo sapiens
atctgtcctcagccttgccag

SEQ ID NO: 4038276 - DNA, 18 bp, Homo sapiens
atctgtctcccagttatg

SEQ ID NO: 4038277 - DNA, 21 bp, Homo sapiens
atctgtgatgacattccctgc

SEQ ID NO: 4038278 - DNA, 12 bp, Homo sapiens
atctgtgcaggg

SEQ ID NO: 4038279 - DNA, 20 bp, Homo sapiens
atctgtgcagggctggtttg

SEQ ID NO: 4038280 - DNA, 13 bp, Homo sapiens
atctgtgccccat

SEQ ID NO: 4038281 - DNA, 15 bp, Homo sapiens
atctgtgccccatgc

SEQ ID NO: 4038282 - DNA, 18 bp, Homo sapiens
atctgtgcgtgaaacaca

SEQ ID NO: 4038283 - DNA, 19 bp, Homo sapiens
atctgtgggcatggtcaaa

SEQ ID NO: 4038284 - DNA, 16 bp, Homo sapiens
atctgtggtcttcaaa

SEQ ID NO: 4038285 - DNA, 14 bp, Homo sapiens
atctgtttaaagca

SEQ ID NO: 4038286 - DNA, 18 bp, Homo sapiens
atctgttttgaaggcaaa

SEQ ID NO: 4038287 - DNA, 19 bp, Homo sapiens
atctgttttgaaggcaaaa

SEQ ID NO: 4038288 - DNA, 20 bp, Homo sapiens
atcttaaacataataaatca

SEQ ID NO: 4038289 - DNA, 17 bp, Homo sapiens
atcttaaatcagaataa

SEQ ID NO: 4038290 - DNA, 21 bp, Homo sapiens
atcttaagttctatgaagagt

SEQ ID NO: 4038291 - DNA, 16 bp, Homo sapiens
atcttaatatatttga

SEQ ID NO: 4038292 - DNA, 15 bp, Homo sapiens
atcttacaagatatt

SEQ ID NO: 4038293 - DNA, 18 bp, Homo sapiens
atcttagggtgaaccact

SEQ ID NO: 4038294 - DNA, 21 bp, Homo sapiens
atcttagtgcctgagagtatt

SEQ ID NO: 4038295 - DNA, 17 bp, Homo sapiens
atcttcaaactttcact

SEQ ID NO: 4038296 - DNA, 15 bp, Homo sapiens
atcttccatatttgg

SEQ ID NO: 4038297 - DNA, 22 bp, Homo sapiens
atcttcccataataaagcaatc

SEQ ID NO: 4038298 - DNA, 21 bp, Homo sapiens
atcttccctagagggttcctg

SEQ ID NO: 4038299 - DNA, 14 bp, Homo sapiens
atcttccctctccc

SEQ ID NO: 4038300 - DNA, 13 bp, Homo sapiens
atcttcctgtgtc

SEQ ID NO: 4038301 - DNA, 15 bp, Homo sapiens
atcttccttgtgagg

SEQ ID NO: 4038302 - DNA, 13 bp, Homo sapiens
atcttcttcaaat

SEQ ID NO: 4038303 - DNA, 21 bp, Homo sapiens
atcttgaaattaagaaggcaa

SEQ ID NO: 4038304 - DNA, 14 bp, Homo sapiens
atcttgaatgtggt

SEQ ID NO: 4038305 - DNA, 20 bp, Homo sapiens
atcttgaatgtggtctcagg

SEQ ID NO: 4038306 - DNA, 17 bp, Homo sapiens
atcttgacattcaaggc

SEQ ID NO: 4038307 - DNA, 16 bp, Homo sapiens
atcttgactttctgat

SEQ ID NO: 4038308 - DNA, 22 bp, Homo sapiens
atcttgagtataagaaatgcat

SEQ ID NO: 4038309 - DNA, 15 bp, Homo sapiens
atcttgccacatttc

SEQ ID NO: 4038310 - DNA, 20 bp, Homo sapiens
atcttgcctgtctggctcag

SEQ ID NO: 4038311 - DNA, 17 bp, Homo sapiens
atcttgctttgtgtatc

SEQ ID NO: 4038312 - DNA, 16 bp, Homo sapiens
atcttggactgacatt

SEQ ID NO: 4038313 - DNA, 19 bp, Homo sapiens
atcttggactgacatttag

SEQ ID NO: 4038314 - DNA, 17 bp, Homo sapiens
atcttggagaccctgca

SEQ ID NO: 4038315 - DNA, 13 bp, Homo sapiens
atcttggctatgt

SEQ ID NO: 4038316 - DNA, 21 bp, Homo sapiens
atcttggctatgtaattcttg

SEQ ID NO: 4038317 - DNA, 18 bp, Homo sapiens
atcttgtgtgattaactt

SEQ ID NO: 4038318 - DNA, 17 bp, Homo sapiens
atcttgttttaagcaaa

SEQ ID NO: 4038319 - DNA, 19 bp, Homo sapiens
atcttgttttaagcaaatg

SEQ ID NO: 4038320 - DNA, 20 bp, Homo sapiens
tcattcaatattgacatttg

SEQ ID NO: 4038321 - DNA, 16 bp, Homo sapiens
tcattcactagctttg

SEQ ID NO: 4038322 - DNA, 17 bp, Homo sapiens
tcattcagtattaaagg

SEQ ID NO: 4038323 - DNA, 21 bp, Homo sapiens
tcattccaacttcccagttca

SEQ ID NO: 4038324 - DNA, 11 bp, Homo sapiens
tcattccagag

SEQ ID NO: 4038325 - DNA, 20 bp, Homo sapiens
tcattccagtgctagaaaat

SEQ ID NO: 4038326 - DNA, 14 bp, Homo sapiens
tcattccattgcct

SEQ ID NO: 4038327 - DNA, 17 bp, Homo sapiens
tcattccctctcatctc

SEQ ID NO: 4038328 - DNA, 18 bp, Homo sapiens
tcattcctaacacagcat

SEQ ID NO: 4038329 - DNA, 14 bp, Homo sapiens
tcattcctgaaaga

SEQ ID NO: 4038330 - DNA, 20 bp, Homo sapiens
tcattcctgaaagaaacagt

SEQ ID NO: 4038331 - DNA, 17 bp, Homo sapiens
tcattccttcagatttg

SEQ ID NO: 4038332 - DNA, 21 bp, Homo sapiens
tcattcgggccccacctgcag

SEQ ID NO: 4038333 - DNA, 14 bp, Homo sapiens
tcattctacagaat

SEQ ID NO: 4038334 - DNA, 18 bp, Homo sapiens
tcattctcataattccta

SEQ ID NO: 4038335 - DNA, 21 bp, Homo sapiens
tcattctcataattcctacag

SEQ ID NO: 4038336 - DNA, 16 bp, Homo sapiens
tcattctcctgcctgt

SEQ ID NO: 4038337 - DNA, 19 bp, Homo sapiens
tcattctgcattgctagat

SEQ ID NO: 4038338 - DNA, 22 bp, Homo sapiens
tcattctgcattgctagataaa

SEQ ID NO: 4038339 - DNA, 18 bp, Homo sapiens
tcattgacctctcagggc

SEQ ID NO: 4038340 - DNA, 13 bp, Homo sapiens
tcattgactcttg

SEQ ID NO: 4038341 - DNA, 17 bp, Homo sapiens
tcattgctgagcctctg

SEQ ID NO: 4038342 - DNA, 12 bp, Homo sapiens
tcattgcttctt

SEQ ID NO: 4038343 - DNA, 13 bp, Homo sapiens
tcattgtaaccat

SEQ ID NO: 4038344 - DNA, 21 bp, Homo sapiens
tcattgtactacctgtgtata

SEQ ID NO: 4038345 - DNA, 15 bp, Homo sapiens
tcattgtccagagct

SEQ ID NO: 4038346 - DNA, 23 bp, Homo sapiens
tcatttaaaaaaaaaatttgttt

SEQ ID NO: 4038347 - DNA, 15 bp, Homo sapiens
tcatttaaaatgatt

SEQ ID NO: 4038348 - DNA, 19 bp, Homo sapiens
tcatttaagggaaagaaaa

SEQ ID NO: 4038349 - DNA, 23 bp, Homo sapiens
tcatttaagtttcaaacttacta

SEQ ID NO: 4038350 - DNA, 22 bp, Homo sapiens
tcatttagaacttgcagctgat

SEQ ID NO: 4038351 - DNA, 17 bp, Homo sapiens
tcatttagtgagttatt

SEQ ID NO: 4038352 - DNA, 16 bp, Homo sapiens
tcatttcattcctaac

SEQ ID NO: 4038353 - DNA, 17 bp, Homo sapiens
tcatttctcactgtgta

SEQ ID NO: 4038354 - DNA, 16 bp, Homo sapiens
tcatttcttcctcagc

SEQ ID NO: 4038355 - DNA, 18 bp, Homo sapiens
tcatttcttcctcagctg

SEQ ID NO: 4038356 - DNA, 20 bp, Homo sapiens
tcatttcttcctcagctggt

SEQ ID NO: 4038357 - DNA, 15 bp, Homo sapiens
tcatttggtctgcca

SEQ ID NO: 4038358 - DNA, 12 bp, Homo sapiens
tcatttgttgtg

SEQ ID NO: 4038359 - DNA, 15 bp, Homo sapiens
tcattttcatcactg

SEQ ID NO: 4038360 - DNA, 19 bp, Homo sapiens
tcattttccccccactctc

SEQ ID NO: 4038361 - DNA, 16 bp, Homo sapiens
tcattttcctgttcag

SEQ ID NO: 4038362 - DNA, 14 bp, Homo sapiens
tcattttctataac

SEQ ID NO: 4038363 - DNA, 17 bp, Homo sapiens
tcattttctgacatgca

SEQ ID NO: 4038364 - DNA, 19 bp, Homo sapiens
tcattttctgacatgcatt

SEQ ID NO: 4038365 - DNA, 14 bp, Homo sapiens
tcattttgcattca

SEQ ID NO: 4038366 - DNA, 22 bp, Homo sapiens
tcattttggtttatttttgtaa

SEQ ID NO: 4038367 - DNA, 18 bp, Homo sapiens
tcattttggttttgtgtt

SEQ ID NO: 4038368 - DNA, 12 bp, Homo sapiens
tcatttttaatt

SEQ ID NO: 4038369 - DNA, 13 bp, Homo sapiens
tcatttttatagc

SEQ ID NO: 4038370 - DNA, 16 bp, Homo sapiens
tcatttttatagcaac

SEQ ID NO: 4038371 - DNA, 21 bp, Homo sapiens
tcatttttatagcaacaacaa

SEQ ID NO: 4038372 - DNA, 20 bp, Homo sapiens
tccaaaaagattttcagaaa

SEQ ID NO: 4038373 - DNA, 22 bp, Homo sapiens
tccaaaaattattataagcatt

SEQ ID NO: 4038374 - DNA, 16 bp, Homo sapiens
tccaaaacttctcttg

SEQ ID NO: 4038375 - DNA, 14 bp, Homo sapiens
tccaaaagaagccc

SEQ ID NO: 4038376 - DNA, 21 bp, Homo sapiens
tccaaaagaagcccccagcta

SEQ ID NO: 4038377 - DNA, 19 bp, Homo sapiens
tccaaaataattttaagaa

SEQ ID NO: 4038378 - DNA, 18 bp, Homo sapiens
tccaaaatattttttgca

SEQ ID NO: 4038379 - DNA, 19 bp, Homo sapiens
tccaaacactgaggcagcc

SEQ ID NO: 4038380 - DNA, 19 bp, Homo sapiens
cttcattcaatattgacat

SEQ ID NO: 4038381 - DNA, 22 bp, Homo sapiens
cttcattcaatattgacatttg

SEQ ID NO: 4038382 - DNA, 13 bp, Homo sapiens
cttcattctcctt

SEQ ID NO: 4038383 - DNA, 20 bp, Homo sapiens
cttcattcttgaaagctgtg

SEQ ID NO: 4038384 - DNA, 17 bp, Homo sapiens
cttcattgtccctcttc

SEQ ID NO: 4038385 - DNA, 16 bp, Homo sapiens
cttcatttccaccagg

SEQ ID NO: 4038386 - DNA, 20 bp, Homo sapiens
cttcatttccaccaggccgt

SEQ ID NO: 4038387 - DNA, 21 bp, Homo sapiens
cttcattttattaatattttt

SEQ ID NO: 4038388 - DNA, 12 bp, Homo sapiens
cttcatttttaa

SEQ ID NO: 4038389 - DNA, 17 bp, Homo sapiens
cttccaaaaattattat

SEQ ID NO: 4038390 - DNA, 15 bp, Homo sapiens
cttccaaaattctta

SEQ ID NO: 4038391 - DNA, 21 bp, Homo sapiens
cttccaaagtaaaattgctgt

SEQ ID NO: 4038392 - DNA, 19 bp, Homo sapiens
cttccaaatgcaatttgat

SEQ ID NO: 4038393 - DNA, 16 bp, Homo sapiens
cttccaagcaaaggtg

SEQ ID NO: 4038394 - DNA, 14 bp, Homo sapiens
cttccaatcttgct

SEQ ID NO: 4038395 - DNA, 13 bp, Homo sapiens
cttccacctccct

SEQ ID NO: 4038396 - DNA, 15 bp, Homo sapiens
cttccacctgctctg

SEQ ID NO: 4038397 - DNA, 16 bp, Homo sapiens
cttccacctgctctgc

SEQ ID NO: 4038398 - DNA, 13 bp, Homo sapiens
cttccagaatgct

SEQ ID NO: 4038399 - DNA, 14 bp, Homo sapiens
cttccagcttcagg

SEQ ID NO: 4038400 - DNA, 17 bp, Homo sapiens
cttccagcttcaggcac

SEQ ID NO: 4038401 - DNA, 21 bp, Homo sapiens
cttccaggaaactccacatct

SEQ ID NO: 4038402 - DNA, 22 bp, Homo sapiens
cttccaggaaactccacatctg

SEQ ID NO: 4038403 - DNA, 11 bp, Homo sapiens
cttccaggcag

SEQ ID NO: 4038404 - DNA, 15 bp, Homo sapiens
cttccaggggaacct

SEQ ID NO: 4038405 - DNA, 20 bp, Homo sapiens
cttccaggtatctccaggat

SEQ ID NO: 4038406 - DNA, 19 bp, Homo sapiens
cttccaggtgttactgtaa

SEQ ID NO: 4038407 - DNA, 19 bp, Homo sapiens
cttccagtgtccttagaac

SEQ ID NO: 4038408 - DNA, 18 bp, Homo sapiens
cttccataggacatactg

SEQ ID NO: 4038409 - DNA, 15 bp, Homo sapiens
cttccatatttggaa

SEQ ID NO: 4038410 - DNA, 22 bp, Homo sapiens
cttccatccatctttccatcca

SEQ ID NO: 4038411 - DNA, 14 bp, Homo sapiens
cttccatccctacc

SEQ ID NO: 4038412 - DNA, 19 bp, Homo sapiens
cttccatccctacccccta

SEQ ID NO: 4038413 - DNA, 21 bp, Homo sapiens
cttccatgagaacagcagggt

SEQ ID NO: 4038414 - DNA, 17 bp, Homo sapiens
cttccatgattctattt

SEQ ID NO: 4038415 - DNA, 15 bp, Homo sapiens
cttccatgtgccttt

SEQ ID NO: 4038416 - DNA, 16 bp, Homo sapiens
cttcccaacagcctta

SEQ ID NO: 4038417 - DNA, 14 bp, Homo sapiens
cttcccacatgcct

SEQ ID NO: 4038418 - DNA, 23 bp, Homo sapiens
cttcccacccctacacacacact

SEQ ID NO: 4038419 - DNA, 15 bp, Homo sapiens
cttcccactggaggt

SEQ ID NO: 4038420 - DNA, 19 bp, Homo sapiens
cttcccagagggagcaggc

SEQ ID NO: 4038421 - DNA, 13 bp, Homo sapiens
cttcccataataa

SEQ ID NO: 4038422 - DNA, 18 bp, Homo sapiens
cttcccataataaagcaa

SEQ ID NO: 4038423 - DNA, 12 bp, Homo sapiens
cttcccatttct

SEQ ID NO: 4038424 - DNA, 14 bp, Homo sapiens
cttcccatttcttc

SEQ ID NO: 4038425 - DNA, 21 bp, Homo sapiens
ctgttgcaattaggattttga

SEQ ID NO: 4038426 - DNA, 22 bp, Homo sapiens
ctgttgcagatgaaatgttctg

SEQ ID NO: 4038427 - DNA, 23 bp, Homo sapiens
ctgttgcagatgaaatgttctgt

SEQ ID NO: 4038428 - DNA, 16 bp, Homo sapiens
ctgttgcatttacttt

SEQ ID NO: 4038429 - DNA, 17 bp, Homo sapiens
ctgttgcatttactttt

SEQ ID NO: 4038430 - DNA, 11 bp, Homo sapiens
ctgttgctcaa

SEQ ID NO: 4038431 - DNA, 21 bp, Homo sapiens
ctgttgctgtgtttaatttga

SEQ ID NO: 4038432 - DNA, 19 bp, Homo sapiens
ctgttgtacatttatgatt

SEQ ID NO: 4038433 - DNA, 15 bp, Homo sapiens
ctgttgtagaagaca

SEQ ID NO: 4038434 - DNA, 12 bp, Homo sapiens
ctgttgtcattg

SEQ ID NO: 4038435 - DNA, 15 bp, Homo sapiens
ctgttgtcattgctg

SEQ ID NO: 4038436 - DNA, 14 bp, Homo sapiens
ctgttgtctcttct

SEQ ID NO: 4038437 - DNA, 16 bp, Homo sapiens
ctgttgtgatcttgca

SEQ ID NO: 4038438 - DNA, 18 bp, Homo sapiens
ctgttgtgatcttgcatt

SEQ ID NO: 4038439 - DNA, 22 bp, Homo sapiens
ctgttgtgatcttgcattcatt

SEQ ID NO: 4038440 - DNA, 20 bp, Homo sapiens
ctgtttaagaaaagtatttt

SEQ ID NO: 4038441 - DNA, 21 bp, Homo sapiens
ctgtttaatatttaaacagca

SEQ ID NO: 4038442 - DNA, 21 bp, Homo sapiens
ctgtttagcagaactcattct

SEQ ID NO: 4038443 - DNA, 17 bp, Homo sapiens
ctgtttagcagcagcct

SEQ ID NO: 4038444 - DNA, 21 bp, Homo sapiens
ctgtttaggttcccctgtcaa

SEQ ID NO: 4038445 - DNA, 15 bp, Homo sapiens
ctgtttataatctga

SEQ ID NO: 4038446 - DNA, 21 bp, Homo sapiens
ctgtttatggccacatttaat

SEQ ID NO: 4038447 - DNA, 23 bp, Homo sapiens
ctgtttattcttccagaatgctg

SEQ ID NO: 4038448 - DNA, 17 bp, Homo sapiens
ctgtttcaacacagacc

SEQ ID NO: 4038449 - DNA, 12 bp, Homo sapiens
ctgtttctcatg

SEQ ID NO: 4038450 - DNA, 21 bp, Homo sapiens
ctgtttctctgccgctacctc

SEQ ID NO: 4038451 - DNA, 15 bp, Homo sapiens
ctgtttctgcagccc

SEQ ID NO: 4038452 - DNA, 17 bp, Homo sapiens
ctgtttctgcttgctct

SEQ ID NO: 4038453 - DNA, 15 bp, Homo sapiens
ctgtttcttcttgtg

SEQ ID NO: 4038454 - DNA, 19 bp, Homo sapiens
ctgtttgaaaacttcagaa

SEQ ID NO: 4038455 - DNA, 12 bp, Homo sapiens
ctgtttgattct

SEQ ID NO: 4038456 - DNA, 16 bp, Homo sapiens
ctgtttgtaaattatt

SEQ ID NO: 4038457 - DNA, 14 bp, Homo sapiens
ctgtttgtttcaag

SEQ ID NO: 4038458 - DNA, 16 bp, Homo sapiens
ctgttttcccccagca

SEQ ID NO: 4038459 - DNA, 21 bp, Homo sapiens
ctgttttctctcggctcccca

SEQ ID NO: 4038460 - DNA, 16 bp, Homo sapiens
ctgttttctgtttctt

SEQ ID NO: 4038461 - DNA, 18 bp, Homo sapiens
ctgttttctgtttgtaaa

SEQ ID NO: 4038462 - DNA, 14 bp, Homo sapiens
ctgttttgaaaagt

SEQ ID NO: 4038463 - DNA, 15 bp, Homo sapiens
ctgtttttaagctgt

SEQ ID NO: 4038464 - DNA, 16 bp, Homo sapiens
ctgtttttaagctgtt

SEQ ID NO: 4038465 - DNA, 18 bp, Homo sapiens
ctgtttttaagctgtttc

SEQ ID NO: 4038466 - DNA, 19 bp, Homo sapiens
ctgtttttaagctgtttcc

SEQ ID NO: 4038467 - DNA, 23 bp, Homo sapiens
ctgtttttctctaatgcttgatt

SEQ ID NO: 4038468 - DNA, 15 bp, Homo sapiens
ctgtttttctgggtg

SEQ ID NO: 4038469 - DNA, 21 bp, Homo sapiens
ctgtttttctgggtggcctcg

SEQ ID NO: 4038470 - DNA, 15 bp, Homo sapiens
ctgtttttttttcat

SEQ ID NO: 4038471 - DNA, 17 bp, Homo sapiens
cttaaaaaaatgacaga

SEQ ID NO: 4038472 - DNA, 18 bp, Homo sapiens
cttaaaaaacttgtaaat

SEQ ID NO: 4038473 - DNA, 13 bp, Homo sapiens
cttaaaaaatgtc

SEQ ID NO: 4038474 - DNA, 14 bp, Homo sapiens
cttaaaaaatgtcc

SEQ ID NO: 4038475 - DNA, 12 bp, Homo sapiens
cttaaaataagc

SEQ ID NO: 4038476 - DNA, 14 bp, Homo sapiens
cttaaaataagcag

SEQ ID NO: 4038477 - DNA, 15 bp, Homo sapiens
cttaaaataagcagg

SEQ ID NO: 4038478 - DNA, 13 bp, Homo sapiens
cttaaaatatttt

SEQ ID NO: 4038479 - DNA, 23 bp, Homo sapiens
atttgggaaggtttgtgttttct

SEQ ID NO: 4038480 - DNA, 14 bp, Homo sapiens
atttgggaagtgaa

SEQ ID NO: 4038481 - DNA, 18 bp, Homo sapiens
atttgggaagtgaagact

SEQ ID NO: 4038482 - DNA, 19 bp, Homo sapiens
atttgggagacatgtgaca

SEQ ID NO: 4038483 - DNA, 23 bp, Homo sapiens
atttgggcctgctccagacctga

SEQ ID NO: 4038484 - DNA, 23 bp, Homo sapiens
atttggggaaacctagagaagat

SEQ ID NO: 4038485 - DNA, 21 bp, Homo sapiens
atttggggcttgcatgccaaa

SEQ ID NO: 4038486 - DNA, 23 bp, Homo sapiens
atttggtacttttgagtgtgtgt

SEQ ID NO: 4038487 - DNA, 23 bp, Homo sapiens
atttggtcaagattttgaatgct

SEQ ID NO: 4038488 - DNA, 20 bp, Homo sapiens
atttggtccaaaaaaaggaa

SEQ ID NO: 4038489 - DNA, 20 bp, Homo sapiens
atttggtctgccagaatact

SEQ ID NO: 4038490 - DNA, 15 bp, Homo sapiens
atttggttctaatag

SEQ ID NO: 4038491 - DNA, 12 bp, Homo sapiens
atttgtaaatct

SEQ ID NO: 4038492 - DNA, 12 bp, Homo sapiens
atttgtaaatga

SEQ ID NO: 4038493 - DNA, 13 bp, Homo sapiens
atttgtaaatgat

SEQ ID NO: 4038494 - DNA, 16 bp, Homo sapiens
atttgtaaatgatttt

SEQ ID NO: 4038495 - DNA, 15 bp, Homo sapiens
atttgtaagtttcag

SEQ ID NO: 4038496 - DNA, 18 bp, Homo sapiens
atttgtaataaagtatat

SEQ ID NO: 4038497 - DNA, 23 bp, Homo sapiens
atttgtaattgcttacattttta

SEQ ID NO: 4038498 - DNA, 16 bp, Homo sapiens
atttgtaccatttcag

SEQ ID NO: 4038499 - DNA, 18 bp, Homo sapiens
atttgtagcactgagggt

SEQ ID NO: 4038500 - DNA, 22 bp, Homo sapiens
atttgtaggaaggtctcattct

SEQ ID NO: 4038501 - DNA, 22 bp, Homo sapiens
atttgtatattacacatttgta

SEQ ID NO: 4038502 - DNA, 14 bp, Homo sapiens
atttgtcaatgaca

SEQ ID NO: 4038503 - DNA, 16 bp, Homo sapiens
atttgtcacagaaatc

SEQ ID NO: 4038504 - DNA, 22 bp, Homo sapiens
atttgtcacagaaatcagagga

SEQ ID NO: 4038505 - DNA, 17 bp, Homo sapiens
atttgtcagtttggttg

SEQ ID NO: 4038506 - DNA, 20 bp, Homo sapiens
atttgtctctgtcacccttg

SEQ ID NO: 4038507 - DNA, 12 bp, Homo sapiens
atttgtgagact

SEQ ID NO: 4038508 - DNA, 17 bp, Homo sapiens
atttgtgatagcacttt

SEQ ID NO: 4038509 - DNA, 21 bp, Homo sapiens
atttgtgttttaatttaaaca

SEQ ID NO: 4038510 - DNA, 13 bp, Homo sapiens
atttgtgtttttc

SEQ ID NO: 4038511 - DNA, 14 bp, Homo sapiens
atttgttaaaatac

SEQ ID NO: 4038512 - DNA, 14 bp, Homo sapiens
atttgttaaaatta

SEQ ID NO: 4038513 - DNA, 14 bp, Homo sapiens
atttgttacagcca

SEQ ID NO: 4038514 - DNA, 12 bp, Homo sapiens
atttgttcaagt

SEQ ID NO: 4038515 - DNA, 16 bp, Homo sapiens
atttgtttaaagaata

SEQ ID NO: 4038516 - DNA, 19 bp, Homo sapiens
atttgtttaaagaataaag

SEQ ID NO: 4038517 - DNA, 20 bp, Homo sapiens
atttgtttaaagaataaagt

SEQ ID NO: 4038518 - DNA, 19 bp, Homo sapiens
atttgtttaattaaattta

SEQ ID NO: 4038519 - DNA, 18 bp, Homo sapiens
atttgtttgctgtacaga

SEQ ID NO: 4038520 - DNA, 21 bp, Homo sapiens
atttgttttgacggatgattg

SEQ ID NO: 4038521 - DNA, 19 bp, Homo sapiens
attttaaaaagatttgttt

SEQ ID NO: 4038522 - DNA, 18 bp, Homo sapiens
attttaaaaatacatatc

SEQ ID NO: 4038523 - DNA, 22 bp, Homo sapiens
attttaaaaatacatatcgctg

SEQ ID NO: 4038524 - DNA, 15 bp, Homo sapiens
attttaaaatattta

SEQ ID NO: 4038525 - DNA, 14 bp, Homo sapiens
attttaaaatgaga

SEQ ID NO: 4038526 - DNA, 21 bp, Homo sapiens
attttaaataaaagtgatcaa

SEQ ID NO: 4038527 - DNA, 13 bp, Homo sapiens
attttaacaaaag

SEQ ID NO: 4038528 - DNA, 18 bp, Homo sapiens
attttaacaaaagcaaga

SEQ ID NO: 4038529 - DNA, 14 bp, Homo sapiens
attttaacaataac

SEQ ID NO: 4038530 - DNA, 13 bp, Homo sapiens
attttaactcata

SEQ ID NO: 4038531 - DNA, 15 bp, Homo sapiens
attttaactttatca

SEQ ID NO: 4038532 - DNA, 19 bp, Homo sapiens
attttaactttatcacatt

SEQ ID NO: 4038533 - DNA, 14 bp, Homo sapiens
attttaagcactct

SEQ ID NO: 4038534 - DNA, 14 bp, Homo sapiens
attttaatcaagtt

SEQ ID NO: 4038535 - DNA, 17 bp, Homo sapiens
attttaatcctgtacca

SEQ ID NO: 4038536 - DNA, 21 bp, Homo sapiens
attttaatcctgtaccaaatc

SEQ ID NO: 4038537 - DNA, 22 bp, Homo sapiens
attttaatcctgtaccaaatct

SEQ ID NO: 4038538 - DNA, 21 bp, Homo sapiens
attttaatgtgaagacatttt

SEQ ID NO: 4038539 - DNA, 24 bp, Homo sapiens
attttaattcatcccaactgtctt

SEQ ID NO: 4038540 - DNA, 16 bp, Homo sapiens
attttacaaaagatgt

SEQ ID NO: 4038541 - DNA, 20 bp, Homo sapiens
attttacaataggtgcttat

SEQ ID NO: 4038542 - DNA, 13 bp, Homo sapiens
attttacacatta

SEQ ID NO: 4038543 - DNA, 23 bp, Homo sapiens
attttacagctcattaaactttt

SEQ ID NO: 4038544 - DNA, 12 bp, Homo sapiens
attttacattaa

SEQ ID NO: 4038545 - DNA, 22 bp, Homo sapiens
attttactccataaacagactg

SEQ ID NO: 4038546 - DNA, 13 bp, Homo sapiens
attttactttgta

SEQ ID NO: 4038547 - DNA, 14 bp, Homo sapiens
attttactttgtac

SEQ ID NO: 4038548 - DNA, 16 bp, Homo sapiens
attttacttttataat

SEQ ID NO: 4038549 - DNA, 21 bp, Homo sapiens
attttaggtgttgattttctg

SEQ ID NO: 4038550 - DNA, 14 bp, Homo sapiens
attttagtattcat

SEQ ID NO: 4038551 - DNA, 20 bp, Homo sapiens
attttagtattcattctgca

SEQ ID NO: 4038552 - DNA, 16 bp, Homo sapiens
attttagtccaaataa

SEQ ID NO: 4038553 - DNA, 20 bp, Homo sapiens
attttataaggacttcctga

SEQ ID NO: 4038554 - DNA, 18 bp, Homo sapiens
attttatagctcagttta

SEQ ID NO: 4038555 - DNA, 15 bp, Homo sapiens
attttatctgtgaat

SEQ ID NO: 4038556 - DNA, 23 bp, Homo sapiens
attttattgtataaaaagtttca

SEQ ID NO: 4038557 - DNA, 22 bp, Homo sapiens
attttatttacccctcccctat

SEQ ID NO: 4038558 - DNA, 13 bp, Homo sapiens
attttatttccat

SEQ ID NO: 4038559 - DNA, 23 bp, Homo sapiens
attttatttcctggacatcctct

SEQ ID NO: 4038560 - DNA, 22 bp, Homo sapiens
attttattttgtgctcatttaa

SEQ ID NO: 4038561 - DNA, 17 bp, Homo sapiens
attttatttttttctac

SEQ ID NO: 4038562 - DNA, 18 bp, Homo sapiens
attttcaacgcagccctg

SEQ ID NO: 4038563 - DNA, 12 bp, Homo sapiens
attttcaagtaa

SEQ ID NO: 4038564 - DNA, 16 bp, Homo sapiens
attttcaagtaattgt

SEQ ID NO: 4038565 - DNA, 18 bp, Homo sapiens
attttcacaaaatgtctc

SEQ ID NO: 4038566 - DNA, 15 bp, Homo sapiens
attttcaccccaccc

SEQ ID NO: 4038567 - DNA, 21 bp, Homo sapiens
attttcagtagggctacaaaa

SEQ ID NO: 4038568 - DNA, 15 bp, Homo sapiens
attttcatatccaag

SEQ ID NO: 4038569 - DNA, 14 bp, Homo sapiens
attttcatcactgg

SEQ ID NO: 4038570 - DNA, 11 bp, Homo sapiens
attttcatgtt

SEQ ID NO: 4038571 - DNA, 15 bp, Homo sapiens
attttcattaaactt

SEQ ID NO: 4038572 - DNA, 23 bp, Homo sapiens
atttaggaagttgacttatagta

SEQ ID NO: 4038573 - DNA, 20 bp, Homo sapiens
atttccaactcgaatctgtg

SEQ ID NO: 4038574 - DNA, 20 bp, Homo sapiens
atttccaccaggccgtgcct

SEQ ID NO: 4038575 - DNA, 14 bp, Homo sapiens
atttccagggatat

SEQ ID NO: 4038576 - DNA, 20 bp, Homo sapiens
atttccagtacctttgtcac

SEQ ID NO: 4038577 - DNA, 12 bp, Homo sapiens
atttccatatcc

SEQ ID NO: 4038578 - DNA, 15 bp, Homo sapiens
atttccattatttat

SEQ ID NO: 4038579 - DNA, 16 bp, Homo sapiens
atttccattccagaat

SEQ ID NO: 4038580 - DNA, 17 bp, Homo sapiens
atttccattccagaata

SEQ ID NO: 4038581 - DNA, 13 bp, Homo sapiens
atttccatttctt

SEQ ID NO: 4038582 - DNA, 17 bp, Homo sapiens
atttcccaattaggaag

SEQ ID NO: 4038583 - DNA, 18 bp, Homo sapiens
atttcccaattaggaagt

SEQ ID NO: 4038584 - DNA, 12 bp, Homo sapiens
atttcccaggac

SEQ ID NO: 4038585 - DNA, 16 bp, Homo sapiens
atttcccaggaccctg

SEQ ID NO: 4038586 - DNA, 19 bp, Homo sapiens
atttcccaggaccctgaag

SEQ ID NO: 4038587 - DNA, 13 bp, Homo sapiens
atttcccatctgc

SEQ ID NO: 4038588 - DNA, 15 bp, Homo sapiens
atttcccatctgcac

SEQ ID NO: 4038589 - DNA, 21 bp, Homo sapiens
atttccccaggggaaaatgaa

SEQ ID NO: 4038590 - DNA, 15 bp, Homo sapiens
atttccccaggtgtg

SEQ ID NO: 4038591 - DNA, 17 bp, Homo sapiens
atttccccctttcttcc

SEQ ID NO: 4038592 - DNA, 19 bp, Homo sapiens
atttccccctttcttcctc

SEQ ID NO: 4038593 - DNA, 20 bp, Homo sapiens
atttccctaaaatacattta

SEQ ID NO: 4038594 - DNA, 18 bp, Homo sapiens
atttcctatcacctattt

SEQ ID NO: 4038595 - DNA, 22 bp, Homo sapiens
atttcctcaacgttgctcccca

SEQ ID NO: 4038596 - DNA, 19 bp, Homo sapiens
atttccttcaatgtgcata

SEQ ID NO: 4038597 - DNA, 12 bp, Homo sapiens
atttccttccag

SEQ ID NO: 4038598 - DNA, 15 bp, Homo sapiens
atttccttccagccc

SEQ ID NO: 4038599 - DNA, 23 bp, Homo sapiens
atttccttgaatgtggcttgaga

SEQ ID NO: 4038600 - DNA, 10 bp, Homo sapiens
atttccttta

SEQ ID NO: 4038601 - DNA, 13 bp, Homo sapiens
atttcctttatac

SEQ ID NO: 4038602 - DNA, 16 bp, Homo sapiens
atttcctttatactgt

SEQ ID NO: 4038603 - DNA, 17 bp, Homo sapiens
atttcctttatactgtg

SEQ ID NO: 4038604 - DNA, 19 bp, Homo sapiens
atttcctttatactgtgaa

SEQ ID NO: 4038605 - DNA, 17 bp, Homo sapiens
atttcctttttgacact

SEQ ID NO: 4038606 - DNA, 18 bp, Homo sapiens
atttcctttttgacactg

SEQ ID NO: 4038607 - DNA, 19 bp, Homo sapiens
atttcctttttgacactga

SEQ ID NO: 4038608 - DNA, 21 bp, Homo sapiens
atttcgccgttgaagaggaag

SEQ ID NO: 4038609 - DNA, 14 bp, Homo sapiens
atttctaaaaaaca

SEQ ID NO: 4038610 - DNA, 14 bp, Homo sapiens
atttctaaaaagat

SEQ ID NO: 4038611 - DNA, 21 bp, Homo sapiens
atttctagtccaaaattacaa

SEQ ID NO: 4038612 - DNA, 12 bp, Homo sapiens
atttctatttat

SEQ ID NO: 4038613 - DNA, 16 bp, Homo sapiens
atttctatttatttac

SEQ ID NO: 4038614 - DNA, 17 bp, Homo sapiens
atttctatttatttact

SEQ ID NO: 4038615 - DNA, 20 bp, Homo sapiens
atttctcaaagatctgaatt

SEQ ID NO: 4038616 - DNA, 16 bp, Homo sapiens
atttctcactagtgtc

SEQ ID NO: 4038617 - DNA, 20 bp, Homo sapiens
atttctcataattttgcaaa

SEQ ID NO: 4038618 - DNA, 20 bp, Homo sapiens
atttctccagttgggactca

SEQ ID NO: 4038619 - DNA, 19 bp, Homo sapiens
atttctcctcccttccttt

SEQ ID NO: 4038620 - DNA, 18 bp, Homo sapiens
atttctcgggtgcatttg

SEQ ID NO: 4038621 - DNA, 19 bp, Homo sapiens
atttctctgatttgcaaaa

SEQ ID NO: 4038622 - DNA, 15 bp, Homo sapiens
atttctgatcagagg

SEQ ID NO: 4038623 - DNA, 22 bp, Homo sapiens
atttctgatcagaggtgtacac

SEQ ID NO: 4038624 - DNA, 11 bp, Homo sapiens
atttctgcctc

SEQ ID NO: 4038625 - DNA, 18 bp, Homo sapiens
atttctgctctggaataa

SEQ ID NO: 4038626 - DNA, 20 bp, Homo sapiens
atttctgggtcttttgctac

SEQ ID NO: 4038627 - DNA, 13 bp, Homo sapiens
atttctggttgat

SEQ ID NO: 4038628 - DNA, 15 bp, Homo sapiens
atttctggttgattt

SEQ ID NO: 4038629 - DNA, 13 bp, Homo sapiens
atttcttatgtga

SEQ ID NO: 4038630 - DNA, 14 bp, Homo sapiens
atttcttatgtgac

SEQ ID NO: 4038631 - DNA, 17 bp, Homo sapiens
atttcttatgtgacatt

SEQ ID NO: 4038632 - DNA, 21 bp, Homo sapiens
atttcttatgtgacattaaca

SEQ ID NO: 4038633 - DNA, 17 bp, Homo sapiens
atttcttcacttcaagc

SEQ ID NO: 4038634 - DNA, 14 bp, Homo sapiens
atttcttcagaatt

SEQ ID NO: 4038635 - DNA, 17 bp, Homo sapiens
atttcttcagtcagaaa

SEQ ID NO: 4038636 - DNA, 21 bp, Homo sapiens
atttcttcagtcagaaaactt

SEQ ID NO: 4038637 - DNA, 19 bp, Homo sapiens
atttcttccctgctttgca

SEQ ID NO: 4038638 - DNA, 14 bp, Homo sapiens
atttcttcctcagc

SEQ ID NO: 4038639 - DNA, 22 bp, Homo sapiens
atttcttctctttagtataatt

SEQ ID NO: 4038640 - DNA, 23 bp, Homo sapiens
atttcttggtattattctgtttt

SEQ ID NO: 4038641 - DNA, 13 bp, Homo sapiens
atttcttgtttgt

SEQ ID NO: 4038642 - DNA, 20 bp, Homo sapiens
atttctttaaaagaatgact

SEQ ID NO: 4038643 - DNA, 20 bp, Homo sapiens
atttctttgatctggacaga

SEQ ID NO: 4038644 - DNA, 21 bp, Homo sapiens
atttctttgttatcaaacttc

SEQ ID NO: 4038645 - DNA, 19 bp, Homo sapiens
atttcttttctttttacat

SEQ ID NO: 4038646 - DNA, 22 bp, Homo sapiens
atttctttttaattattttaaa

SEQ ID NO: 4038647 - DNA, 22 bp, Homo sapiens
atttgaacactggctaaagata

SEQ ID NO: 4038648 - DNA, 22 bp, Homo sapiens
atttgaagtgtacctgtgtaca

SEQ ID NO: 4038649 - DNA, 15 bp, Homo sapiens
atttgaatgaaaaca

SEQ ID NO: 4038650 - DNA, 18 bp, Homo sapiens
atttgaatgggtccattt

SEQ ID NO: 4038651 - DNA, 23 bp, Homo sapiens
atttgacaaaatttgttgaaatt

SEQ ID NO: 4038652 - DNA, 19 bp, Homo sapiens
atttgacttgcatgaagag

SEQ ID NO: 4038653 - DNA, 19 bp, Homo sapiens
atttgagtgttttaagata

SEQ ID NO: 4038654 - DNA, 16 bp, Homo sapiens
atttgatattatctac

SEQ ID NO: 4038655 - DNA, 16 bp, Homo sapiens
atttgatatttgcatt

SEQ ID NO: 4038656 - DNA, 23 bp, Homo sapiens
atttgatcgttccagttcccact

SEQ ID NO: 4038657 - DNA, 11 bp, Homo sapiens
atttgatgaaa

SEQ ID NO: 4038658 - DNA, 16 bp, Homo sapiens
atttgatgaaagctga

SEQ ID NO: 4038659 - DNA, 15 bp, Homo sapiens
atttgatgccaggac

SEQ ID NO: 4038660 - DNA, 20 bp, Homo sapiens
atttgattcattttcctgtt

SEQ ID NO: 4038661 - DNA, 20 bp, Homo sapiens
atttgcaaaatcacttagca

SEQ ID NO: 4038662 - DNA, 18 bp, Homo sapiens
atttgcatggattttgga

SEQ ID NO: 4038663 - DNA, 21 bp, Homo sapiens
atttgcatggctccagaaatg

SEQ ID NO: 4038664 - DNA, 18 bp, Homo sapiens
atttgcattaaattcaca

SEQ ID NO: 4038665 - DNA, 21 bp, Homo sapiens
atttgcattgaacacaaactg

SEQ ID NO: 4038666 - DNA, 18 bp, Homo sapiens
atttgccttctgaaatgt

SEQ ID NO: 4038667 - DNA, 17 bp, Homo sapiens
atttgctaagcatattt

SEQ ID NO: 4038668 - DNA, 14 bp, Homo sapiens
atttgcttcattgt

SEQ ID NO: 4038669 - DNA, 21 bp, Homo sapiens
tcataaaataaagtatatata

SEQ ID NO: 4038670 - DNA, 17 bp, Homo sapiens
tcataaagggttgaaaa

SEQ ID NO: 4038671 - DNA, 15 bp, Homo sapiens
tcataaagtacttga

SEQ ID NO: 4038672 - DNA, 12 bp, Homo sapiens
tcataaatgaag

SEQ ID NO: 4038673 - DNA, 22 bp, Homo sapiens
tcataagaatttttcagcactt

SEQ ID NO: 4038674 - DNA, 21 bp, Homo sapiens
tcataattaaaatttatctta

SEQ ID NO: 4038675 - DNA, 15 bp, Homo sapiens
tcatactcctgggct

SEQ ID NO: 4038676 - DNA, 18 bp, Homo sapiens
tcatagcaagcttttgct

SEQ ID NO: 4038677 - DNA, 14 bp, Homo sapiens
tcatagcattaact

SEQ ID NO: 4038678 - DNA, 19 bp, Homo sapiens
tcatagcattaactaatct

SEQ ID NO: 4038679 - DNA, 22 bp, Homo sapiens
tcatagctcactgcagcctcat

SEQ ID NO: 4038680 - DNA, 22 bp, Homo sapiens
tcatagggaaaggttttgtatt

SEQ ID NO: 4038681 - DNA, 18 bp, Homo sapiens
tcatagggtctcttcagg

SEQ ID NO: 4038682 - DNA, 18 bp, Homo sapiens
tcatagtaacttcttatg

SEQ ID NO: 4038683 - DNA, 21 bp, Homo sapiens
tcatagtaacttcttatggaa

SEQ ID NO: 4038684 - DNA, 22 bp, Homo sapiens
tcatagtactctttgtagcaaa

SEQ ID NO: 4038685 - DNA, 22 bp, Homo sapiens
tcatagtagtttttacagctgt

SEQ ID NO: 4038686 - DNA, 14 bp, Homo sapiens
tcatagtattggag

SEQ ID NO: 4038687 - DNA, 11 bp, Homo sapiens
tcatagtttat

SEQ ID NO: 4038688 - DNA, 12 bp, Homo sapiens
tcatagtttatt

SEQ ID NO: 4038689 - DNA, 18 bp, Homo sapiens
tcatataagattcatatt

SEQ ID NO: 4038690 - DNA, 13 bp, Homo sapiens
tcatatgttgctc

SEQ ID NO: 4038691 - DNA, 18 bp, Homo sapiens
tcatatgttgctcagtct

SEQ ID NO: 4038692 - DNA, 19 bp, Homo sapiens
tcatatgttgctcagtctc

SEQ ID NO: 4038693 - DNA, 21 bp, Homo sapiens
tcatattgatgaaaagattta

SEQ ID NO: 4038694 - DNA, 20 bp, Homo sapiens
tcatatttacttcttataca

SEQ ID NO: 4038695 - DNA, 16 bp, Homo sapiens
tcatcaacaaagaaat

SEQ ID NO: 4038696 - DNA, 21 bp, Homo sapiens
tcatcaagcaggaattatgtc

SEQ ID NO: 4038697 - DNA, 20 bp, Homo sapiens
tcatcaatatccctcttgta

SEQ ID NO: 4038698 - DNA, 22 bp, Homo sapiens
tcatcagatggaaatattttga

SEQ ID NO: 4038699 - DNA, 11 bp, Homo sapiens
tcatcaggatg

SEQ ID NO: 4038700 - DNA, 22 bp, Homo sapiens
tcatcaggatgaacccaggacg

SEQ ID NO: 4038701 - DNA, 21 bp, Homo sapiens
tcatcagggcctggggcctga

SEQ ID NO: 4038702 - DNA, 23 bp, Homo sapiens
tcatcagggcctggggcctgaga

SEQ ID NO: 4038703 - DNA, 14 bp, Homo sapiens
tcatcataaaataa

SEQ ID NO: 4038704 - DNA, 11 bp, Homo sapiens
tcatcatcagg

SEQ ID NO: 4038705 - DNA, 15 bp, Homo sapiens
tcatcatcagggcct

SEQ ID NO: 4038706 - DNA, 12 bp, Homo sapiens
tcatcattgttt

SEQ ID NO: 4038707 - DNA, 19 bp, Homo sapiens
tcatccaaaatattttttg

SEQ ID NO: 4038708 - DNA, 12 bp, Homo sapiens
ctagataaaagc

SEQ ID NO: 4038709 - DNA, 17 bp, Homo sapiens
ctagatgaagttttaca

SEQ ID NO: 4038710 - DNA, 17 bp, Homo sapiens
ctagatgcatcactggg

SEQ ID NO: 4038711 - DNA, 18 bp, Homo sapiens
ctagatgcatcactgggt

SEQ ID NO: 4038712 - DNA, 22 bp, Homo sapiens
ctagattaggtagactttgctt

SEQ ID NO: 4038713 - DNA, 16 bp, Homo sapiens
ctagcaagctggcctc

SEQ ID NO: 4038714 - DNA, 19 bp, Homo sapiens
ctagcaagtgagagagatg

SEQ ID NO: 4038715 - DNA, 18 bp, Homo sapiens
ctagcactcattttctat

SEQ ID NO: 4038716 - DNA, 19 bp, Homo sapiens
ctagcactcattttctata

SEQ ID NO: 4038717 - DNA, 13 bp, Homo sapiens
ctagcagagtgct

SEQ ID NO: 4038718 - DNA, 19 bp, Homo sapiens
ctagcagagtgctggcact

SEQ ID NO: 4038719 - DNA, 20 bp, Homo sapiens
ctagcagagtgctggcactt

SEQ ID NO: 4038720 - DNA, 22 bp, Homo sapiens
ctagcagagtgctggcacttag

SEQ ID NO: 4038721 - DNA, 19 bp, Homo sapiens
ctagcagcaccgttctgtg

SEQ ID NO: 4038722 - DNA, 20 bp, Homo sapiens
ctagcagcaccgttctgtgc

SEQ ID NO: 4038723 - DNA, 14 bp, Homo sapiens
ctagccaccagtgt

SEQ ID NO: 4038724 - DNA, 23 bp, Homo sapiens
ctagccaggaagtacttccacct

SEQ ID NO: 4038725 - DNA, 14 bp, Homo sapiens
ctagcccagactct

SEQ ID NO: 4038726 - DNA, 15 bp, Homo sapiens
ctagcccagactctg

SEQ ID NO: 4038727 - DNA, 13 bp, Homo sapiens
ctagcccttccct

SEQ ID NO: 4038728 - DNA, 15 bp, Homo sapiens
ctagcccttccctga

SEQ ID NO: 4038729 - DNA, 16 bp, Homo sapiens
ctagcccttccctgag

SEQ ID NO: 4038730 - DNA, 21 bp, Homo sapiens
ctagcctatttacctgcaggc

SEQ ID NO: 4038731 - DNA, 22 bp, Homo sapiens
ctagcctatttacctgcaggct

SEQ ID NO: 4038732 - DNA, 19 bp, Homo sapiens
ctagccttgaggagtgtga

SEQ ID NO: 4038733 - DNA, 14 bp, Homo sapiens
ctagccttgcttgt

SEQ ID NO: 4038734 - DNA, 22 bp, Homo sapiens
ctagccttggcctctttcctca

SEQ ID NO: 4038735 - DNA, 17 bp, Homo sapiens
ctagcgatctctcctgg

SEQ ID NO: 4038736 - DNA, 15 bp, Homo sapiens
ctagcggagcccagc

SEQ ID NO: 4038737 - DNA, 16 bp, Homo sapiens
ctagcggagcccagcc

SEQ ID NO: 4038738 - DNA, 22 bp, Homo sapiens
ctagcggagcccagcctgggag

SEQ ID NO: 4038739 - DNA, 19 bp, Homo sapiens
ctagcgtagtgcagcaggg

SEQ ID NO: 4038740 - DNA, 13 bp, Homo sapiens
ctagctaaataaa

SEQ ID NO: 4038741 - DNA, 15 bp, Homo sapiens
ctagctagaaatatg

SEQ ID NO: 4038742 - DNA, 16 bp, Homo sapiens
ctagctagaaatatga

SEQ ID NO: 4038743 - DNA, 17 bp, Homo sapiens
ctagctagaaatatgat

SEQ ID NO: 4038744 - DNA, 21 bp, Homo sapiens
ctagctcctgccacatggagc

SEQ ID NO: 4038745 - DNA, 22 bp, Homo sapiens
ctagctctcccagtgaactcct

SEQ ID NO: 4038746 - DNA, 16 bp, Homo sapiens
ctagctctctaggcct

SEQ ID NO: 4038747 - DNA, 18 bp, Homo sapiens
ctagctgttgagctgttt

SEQ ID NO: 4038748 - DNA, 13 bp, Homo sapiens
ctagcttctgctt

SEQ ID NO: 4038749 - DNA, 15 bp, Homo sapiens
ctagcttctgctttt

SEQ ID NO: 4038750 - DNA, 22 bp, Homo sapiens
ctagcttctgcttttctgccct

SEQ ID NO: 4038751 - DNA, 15 bp, Homo sapiens
ctagcttttaggaaa

SEQ ID NO: 4038752 - DNA, 14 bp, Homo sapiens
ctaggaaactcaca

SEQ ID NO: 4038753 - DNA, 23 bp, Homo sapiens
ctaggaagagcaggactccaggc

SEQ ID NO: 4038754 - DNA, 22 bp, Homo sapiens
ctaggaaggcacttctgcctga

SEQ ID NO: 4038755 - DNA, 22 bp, Homo sapiens
ctaggagagccaacctcggctt

SEQ ID NO: 4038756 - DNA, 20 bp, Homo sapiens
ctaggaggagctagtaggaa

SEQ ID NO: 4038757 - DNA, 13 bp, Homo sapiens
ctaggagggagac

SEQ ID NO: 4038758 - DNA, 22 bp, Homo sapiens
ctaggagggagacactggcccc

SEQ ID NO: 4038759 - DNA, 18 bp, Homo sapiens
ctaggatgcggaaatccc

SEQ ID NO: 4038760 - DNA, 22 bp, Homo sapiens
ctaggatgtcatgtctgcttgt

SEQ ID NO: 4038761 - DNA, 13 bp, Homo sapiens
ctaggatttcatg

SEQ ID NO: 4038762 - DNA, 14 bp, Homo sapiens
ctaggcaagcagga

SEQ ID NO: 4038763 - DNA, 17 bp, Homo sapiens
ctaggcaagcaggacct

SEQ ID NO: 4038764 - DNA, 18 bp, Homo sapiens
ctaggcaagcaggacctg

SEQ ID NO: 4038765 - DNA, 19 bp, Homo sapiens
ctaggcagggtgtctgccc

SEQ ID NO: 4038766 - DNA, 17 bp, Homo sapiens
ctaggcatctctgtact

SEQ ID NO: 4038767 - DNA, 13 bp, Homo sapiens
ctaggcccaggcc

SEQ ID NO: 4038768 - DNA, 18 bp, Homo sapiens
ctaggcgagtgccaggac

SEQ ID NO: 4038769 - DNA, 16 bp, Homo sapiens
actgggatgagccgct

SEQ ID NO: 4038770 - DNA, 22 bp, Homo sapiens
actgggattaagaaaccttgct

SEQ ID NO: 4038771 - DNA, 16 bp, Homo sapiens
actgggcacacgcaca

SEQ ID NO: 4038772 - DNA, 14 bp, Homo sapiens
actgggcacagctc

SEQ ID NO: 4038773 - DNA, 16 bp, Homo sapiens
actgggccacggagga

SEQ ID NO: 4038774 - DNA, 15 bp, Homo sapiens
actgggccagccctg

SEQ ID NO: 4038775 - DNA, 20 bp, Homo sapiens
actgggccttagtgggccag

SEQ ID NO: 4038776 - DNA, 13 bp, Homo sapiens
actgggctgggtt

SEQ ID NO: 4038777 - DNA, 16 bp, Homo sapiens
actgggctgggtttgc

SEQ ID NO: 4038778 - DNA, 18 bp, Homo sapiens
actgggctgggtttgctg

SEQ ID NO: 4038779 - DNA, 23 bp, Homo sapiens
actggggactttatttatttcta

SEQ ID NO: 4038780 - DNA, 21 bp, Homo sapiens
actggggagcccgtctcagtg

SEQ ID NO: 4038781 - DNA, 19 bp, Homo sapiens
actggggaggaatcctgga

SEQ ID NO: 4038782 - DNA, 15 bp, Homo sapiens
actggggagtctttg

SEQ ID NO: 4038783 - DNA, 17 bp, Homo sapiens
actggggatgtgggagg

SEQ ID NO: 4038784 - DNA, 18 bp, Homo sapiens
actggggatgtgggaggg

SEQ ID NO: 4038785 - DNA, 13 bp, Homo sapiens
actggggcctcca

SEQ ID NO: 4038786 - DNA, 22 bp, Homo sapiens
actggggctggggtgagagagg

SEQ ID NO: 4038787 - DNA, 19 bp, Homo sapiens
actggggctttgccttgca

SEQ ID NO: 4038788 - DNA, 21 bp, Homo sapiens
actggggtgggaggtcttgct

SEQ ID NO: 4038789 - DNA, 20 bp, Homo sapiens
actgggtggggtgaggacca

SEQ ID NO: 4038790 - DNA, 20 bp, Homo sapiens
actgggtgtcatttcattcc

SEQ ID NO: 4038791 - DNA, 22 bp, Homo sapiens
actgggtgtcatttcattccat

SEQ ID NO: 4038792 - DNA, 17 bp, Homo sapiens
actggtacttagagttt

SEQ ID NO: 4038793 - DNA, 17 bp, Homo sapiens
acttctaaatgcatatc

SEQ ID NO: 4038794 - DNA, 14 bp, Homo sapiens
acttctacctgccc

SEQ ID NO: 4038795 - DNA, 16 bp, Homo sapiens
acttctacctgccctc

SEQ ID NO: 4038796 - DNA, 17 bp, Homo sapiens
acttctacctgccctca

SEQ ID NO: 4038797 - DNA, 13 bp, Homo sapiens
acttctatatttt

SEQ ID NO: 4038798 - DNA, 16 bp, Homo sapiens
acttctatattttaat

SEQ ID NO: 4038799 - DNA, 17 bp, Homo sapiens
acttctatattttaata

SEQ ID NO: 4038800 - DNA, 19 bp, Homo sapiens
acttctatattttaataga

SEQ ID NO: 4038801 - DNA, 13 bp, Homo sapiens
acttctcttccag

SEQ ID NO: 4038802 - DNA, 16 bp, Homo sapiens
acttctggctcctcaa

SEQ ID NO: 4038803 - DNA, 21 bp, Homo sapiens
acttctgtgggcccctcaaca

SEQ ID NO: 4038804 - DNA, 22 bp, Homo sapiens
acttctgtgggcccctcaacag

SEQ ID NO: 4038805 - DNA, 23 bp, Homo sapiens
acttctgtgggcccctcaacagc

SEQ ID NO: 4038806 - DNA, 17 bp, Homo sapiens
acttcttatacatttga

SEQ ID NO: 4038807 - DNA, 16 bp, Homo sapiens
acttcttatggaattg

SEQ ID NO: 4038808 - DNA, 17 bp, Homo sapiens
acttcttatggaattga

SEQ ID NO: 4038809 - DNA, 21 bp, Homo sapiens
acttcttatggaattgatttg

SEQ ID NO: 4038810 - DNA, 13 bp, Homo sapiens
acttcttctctta

SEQ ID NO: 4038811 - DNA, 16 bp, Homo sapiens
acttcttctcttagat

SEQ ID NO: 4038812 - DNA, 18 bp, Homo sapiens
acttctttcccttcctcc

SEQ ID NO: 4038813 - DNA, 21 bp, Homo sapiens
acttcttttttcaaaagaaag

SEQ ID NO: 4038814 - DNA, 20 bp, Homo sapiens
acttgaaagcatccatgtgt

SEQ ID NO: 4038815 - DNA, 18 bp, Homo sapiens
acttgaaatctaggatta

SEQ ID NO: 4038816 - DNA, 23 bp, Homo sapiens
acttgaagaaacagagtggcctc

SEQ ID NO: 4038817 - DNA, 13 bp, Homo sapiens
acttgaagcagtc

SEQ ID NO: 4038818 - DNA, 14 bp, Homo sapiens
acttgaagcctgct

SEQ ID NO: 4038819 - DNA, 19 bp, Homo sapiens
acttgaagcctgctccttc

SEQ ID NO: 4038820 - DNA, 16 bp, Homo sapiens
acttgaatcaaagcag

SEQ ID NO: 4038821 - DNA, 16 bp, Homo sapiens
acttgaatgtgtcact

SEQ ID NO: 4038822 - DNA, 22 bp, Homo sapiens
acttgaatttggtctgtatagt

SEQ ID NO: 4038823 - DNA, 19 bp, Homo sapiens
acttgacatgtagcttctt

SEQ ID NO: 4038824 - DNA, 16 bp, Homo sapiens
acttgagtgtaatgtt

SEQ ID NO: 4038825 - DNA, 20 bp, Homo sapiens
agcaccccctgctccaccag

SEQ ID NO: 4038826 - DNA, 18 bp, Homo sapiens
agcaccctcccccgcagc

SEQ ID NO: 4038827 - DNA, 14 bp, Homo sapiens
agcaccctctcctg

SEQ ID NO: 4038828 - DNA, 16 bp, Homo sapiens
agcaccctctcctggg

SEQ ID NO: 4038829 - DNA, 13 bp, Homo sapiens
agcaccctctgga

SEQ ID NO: 4038830 - DNA, 21 bp, Homo sapiens
agcaccgcttttgttctcgca

SEQ ID NO: 4038831 - DNA, 20 bp, Homo sapiens
agcaccgtgtcaagctgctc

SEQ ID NO: 4038832 - DNA, 15 bp, Homo sapiens
agcaccgttctgtgc

SEQ ID NO: 4038833 - DNA, 21 bp, Homo sapiens
agcacctactatgtgctgggt

SEQ ID NO: 4038834 - DNA, 14 bp, Homo sapiens
agcacctccagcct

SEQ ID NO: 4038835 - DNA, 15 bp, Homo sapiens
agcacctccaggcct

SEQ ID NO: 4038836 - DNA, 18 bp, Homo sapiens
agcaccttcagggctgag

SEQ ID NO: 4038837 - DNA, 16 bp, Homo sapiens
agcaccttcctcactt

SEQ ID NO: 4038838 - DNA, 18 bp, Homo sapiens
agcaccttcctcacttcc

SEQ ID NO: 4038839 - DNA, 17 bp, Homo sapiens
agcacgaaatgttattt

SEQ ID NO: 4038840 - DNA, 18 bp, Homo sapiens
agcacgaaatgttatttt

SEQ ID NO: 4038841 - DNA, 17 bp, Homo sapiens
agcacggactcttactg

SEQ ID NO: 4038842 - DNA, 15 bp, Homo sapiens
agcacgtgcaaggac

SEQ ID NO: 4038843 - DNA, 15 bp, Homo sapiens
agcactactgggtgt

SEQ ID NO: 4038844 - DNA, 16 bp, Homo sapiens
agcactactgggtgtc

SEQ ID NO: 4038845 - DNA, 20 bp, Homo sapiens
agcactccgcatcacctcac

SEQ ID NO: 4038846 - DNA, 14 bp, Homo sapiens
agcactctctaaat

SEQ ID NO: 4038847 - DNA, 11 bp, Homo sapiens
agcactgagca

SEQ ID NO: 4038848 - DNA, 18 bp, Homo sapiens
agcactgatttcacaaca

SEQ ID NO: 4038849 - DNA, 20 bp, Homo sapiens
agcactggagtgcagggagg

SEQ ID NO: 4038850 - DNA, 23 bp, Homo sapiens
agcactggtgaactgagctgggc

SEQ ID NO: 4038851 - DNA, 22 bp, Homo sapiens
agcactgtgaagacccagcagg

SEQ ID NO: 4038852 - DNA, 18 bp, Homo sapiens
agcacttccaaaattctt

SEQ ID NO: 4038853 - DNA, 16 bp, Homo sapiens
agcacttccttgccag

SEQ ID NO: 4038854 - DNA, 19 bp, Homo sapiens
agcacttccttgccagtct

SEQ ID NO: 4038855 - DNA, 20 bp, Homo sapiens
agcacttccttgccagtctt

SEQ ID NO: 4038856 - DNA, 16 bp, Homo sapiens
agcacttgtccagctg

SEQ ID NO: 4038857 - DNA, 19 bp, Homo sapiens
agcactttgggaggccaag

SEQ ID NO: 4038858 - DNA, 17 bp, Homo sapiens
agcactttgggaggccg

SEQ ID NO: 4038859 - DNA, 15 bp, Homo sapiens
agcacttttgttatt

SEQ ID NO: 4038860 - DNA, 20 bp, Homo sapiens
agcacttttgttattccatc

SEQ ID NO: 4038861 - DNA, 13 bp, Homo sapiens
agcagaaagaaga

SEQ ID NO: 4038862 - DNA, 20 bp, Homo sapiens
agcagaaagaagagaagtga

SEQ ID NO: 4038863 - DNA, 20 bp, Homo sapiens
agcagaacagatcttttact

SEQ ID NO: 4038864 - DNA, 16 bp, Homo sapiens
agcagaactcattcta

SEQ ID NO: 4038865 - DNA, 13 bp, Homo sapiens
agcagaagacaaa

SEQ ID NO: 4038866 - DNA, 13 bp, Homo sapiens
agcagaattttaa

SEQ ID NO: 4038867 - DNA, 15 bp, Homo sapiens
agcagaattttaatg

SEQ ID NO: 4038868 - DNA, 17 bp, Homo sapiens
agcagaattttaatgtg

SEQ ID NO: 4038869 - DNA, 18 bp, Homo sapiens
agcagaattttaatgtga

SEQ ID NO: 4038870 - DNA, 16 bp, Homo sapiens
agcagacagaaactgg

SEQ ID NO: 4038871 - DNA, 15 bp, Homo sapiens
agcagagagagagga

SEQ ID NO: 4038872 - DNA, 16 bp, Homo sapiens
agcagaggcaggctgg

SEQ ID NO: 4038873 - DNA, 13 bp, Homo sapiens
agaagtccagagt

SEQ ID NO: 4038874 - DNA, 15 bp, Homo sapiens
agaagtgaagaatgc

SEQ ID NO: 4038875 - DNA, 18 bp, Homo sapiens
agaagtgagcagtgttgg

SEQ ID NO: 4038876 - DNA, 14 bp, Homo sapiens
agaagtgcatttct

SEQ ID NO: 4038877 - DNA, 15 bp, Homo sapiens
agaagtgcatttctg

SEQ ID NO: 4038878 - DNA, 24 bp, Homo sapiens
agaagtgcatttctgaatagaaat

SEQ ID NO: 4038879 - DNA, 12 bp, Homo sapiens
agaagtgccttc

SEQ ID NO: 4038880 - DNA, 14 bp, Homo sapiens
agaagtgctcttgg

SEQ ID NO: 4038881 - DNA, 17 bp, Homo sapiens
agaagtggactggagga

SEQ ID NO: 4038882 - DNA, 11 bp, Homo sapiens
agaagttactt

SEQ ID NO: 4038883 - DNA, 15 bp, Homo sapiens
agaagttactttgta

SEQ ID NO: 4038884 - DNA, 14 bp, Homo sapiens
agaagtttcccttc

SEQ ID NO: 4038885 - DNA, 18 bp, Homo sapiens
agaagtttcccttcctcc

SEQ ID NO: 4038886 - DNA, 22 bp, Homo sapiens
agaataatatgctgccaaattt

SEQ ID NO: 4038887 - DNA, 20 bp, Homo sapiens
agaataatccagtattgctg

SEQ ID NO: 4038888 - DNA, 13 bp, Homo sapiens
agaataatggaaa

SEQ ID NO: 4038889 - DNA, 14 bp, Homo sapiens
agaataatggaaac

SEQ ID NO: 4038890 - DNA, 18 bp, Homo sapiens
agaatacagaaagatgga

SEQ ID NO: 4038891 - DNA, 21 bp, Homo sapiens
agaatacagaaagatggatgt

SEQ ID NO: 4038892 - DNA, 17 bp, Homo sapiens
agaatactgggttctta

SEQ ID NO: 4038893 - DNA, 17 bp, Homo sapiens
agaatactttgcttcat

SEQ ID NO: 4038894 - DNA, 20 bp, Homo sapiens
agaatactttgcttcatagt

SEQ ID NO: 4038895 - DNA, 12 bp, Homo sapiens
agaatagaaaca

SEQ ID NO: 4038896 - DNA, 13 bp, Homo sapiens
agaatagaaacaa

SEQ ID NO: 4038897 - DNA, 13 bp, Homo sapiens
agaatagactgga

SEQ ID NO: 4038898 - DNA, 16 bp, Homo sapiens
agaatagatgctgact

SEQ ID NO: 4038899 - DNA, 19 bp, Homo sapiens
agaataggcattaacacaa

SEQ ID NO: 4038900 - DNA, 19 bp, Homo sapiens
agaatatagaagcatttga

SEQ ID NO: 4038901 - DNA, 13 bp, Homo sapiens
agaatatatttat

SEQ ID NO: 4038902 - DNA, 11 bp, Homo sapiens
agaatatctgg

SEQ ID NO: 4038903 - DNA, 13 bp, Homo sapiens
agaatatgtttcc

SEQ ID NO: 4038904 - DNA, 13 bp, Homo sapiens
agaatattcagga

SEQ ID NO: 4038905 - DNA, 15 bp, Homo sapiens
agaatatttaagaaa

SEQ ID NO: 4038906 - DNA, 24 bp, Homo sapiens
agaatatttaagaaaagcactttt

SEQ ID NO: 4038907 - DNA, 23 bp, Homo sapiens
agaatatttttatatttccttta

SEQ ID NO: 4038908 - DNA, 18 bp, Homo sapiens
agaatcagagtagaaata

SEQ ID NO: 4038909 - DNA, 21 bp, Homo sapiens
agaatcatgctgttgcattta

SEQ ID NO: 4038910 - DNA, 18 bp, Homo sapiens
agaatcatggagaaaatg

SEQ ID NO: 4038911 - DNA, 18 bp, Homo sapiens
agaatcatgtgaacccgg

SEQ ID NO: 4038912 - DNA, 14 bp, Homo sapiens
agaatccaaacttg

SEQ ID NO: 4038913 - DNA, 16 bp, Homo sapiens
agaatccaaacttgga

SEQ ID NO: 4038914 - DNA, 21 bp, Homo sapiens
agaatccaaacttggattttt

SEQ ID NO: 4038915 - DNA, 18 bp, Homo sapiens
agaatcccaaatttgatt

SEQ ID NO: 4038916 - DNA, 18 bp, Homo sapiens
agaatcccactttctata

SEQ ID NO: 4038917 - DNA, 17 bp, Homo sapiens
agaatctcaaataacta

SEQ ID NO: 4038918 - DNA, 17 bp, Homo sapiens
agaatcttaatgcttgt

SEQ ID NO: 4038919 - DNA, 16 bp, Homo sapiens
agaatcttgactttct

SEQ ID NO: 4038920 - DNA, 14 bp, Homo sapiens
agaatctttagaga

SEQ ID NO: 4038921 - DNA, 23 bp, Homo sapiens
agaatctttagagaagtatacat

SEQ ID NO: 4038922 - DNA, 15 bp, Homo sapiens
agaatgaaatgtatg

SEQ ID NO: 4038923 - DNA, 21 bp, Homo sapiens
agaatgaacccaagagcaagg

SEQ ID NO: 4038924 - DNA, 14 bp, Homo sapiens
agaatgattaatca

SEQ ID NO: 4038925 - DNA, 16 bp, Homo sapiens
agaatgcattccctga

SEQ ID NO: 4038926 - DNA, 16 bp, Homo sapiens
agaatgccatttctca

SEQ ID NO: 4038927 - DNA, 18 bp, Homo sapiens
agaatgctctttacttca

SEQ ID NO: 4038928 - DNA, 13 bp, Homo sapiens
agaatgctggttt

SEQ ID NO: 4038929 - DNA, 23 bp, Homo sapiens
agaatggataaaataatgctgca

SEQ ID NO: 4038930 - DNA, 19 bp, Homo sapiens
agaatggtgtgaacccggg

SEQ ID NO: 4038931 - DNA, 17 bp, Homo sapiens
agaatgtaaaagaactt

SEQ ID NO: 4038932 - DNA, 14 bp, Homo sapiens
agaatgtaagaaaa

SEQ ID NO: 4038933 - DNA, 15 bp, Homo sapiens
agaatgtaagaaaac

SEQ ID NO: 4038934 - DNA, 22 bp, Homo sapiens
agaatgtcagatttctggttga

SEQ ID NO: 4038935 - DNA, 16 bp, Homo sapiens
agaatgtggccactta

SEQ ID NO: 4038936 - DNA, 19 bp, Homo sapiens
agaccaaagcaaagaaaat

SEQ ID NO: 4038937 - DNA, 17 bp, Homo sapiens
agaccacagagctgtca

SEQ ID NO: 4038938 - DNA, 20 bp, Homo sapiens
agaccacagggttcaaaatg

SEQ ID NO: 4038939 - DNA, 13 bp, Homo sapiens
agaccacatcttt

SEQ ID NO: 4038940 - DNA, 20 bp, Homo sapiens
agaccaccagccgccccagc

SEQ ID NO: 4038941 - DNA, 23 bp, Homo sapiens
agaccaccagccgccccagcccc

SEQ ID NO: 4038942 - DNA, 14 bp, Homo sapiens
agaccaccccgcct

SEQ ID NO: 4038943 - DNA, 16 bp, Homo sapiens
agaccacctgcttctg

SEQ ID NO: 4038944 - DNA, 21 bp, Homo sapiens
agaccacctgcttctgaactc

SEQ ID NO: 4038945 - DNA, 22 bp, Homo sapiens
agaccacctgcttctgaactca

SEQ ID NO: 4038946 - DNA, 15 bp, Homo sapiens
agaccagagcagttt

SEQ ID NO: 4038947 - DNA, 18 bp, Homo sapiens
agaccagagcagtttcat

SEQ ID NO: 4038948 - DNA, 15 bp, Homo sapiens
agaccagccctgcag

SEQ ID NO: 4038949 - DNA, 20 bp, Homo sapiens
agaccagctcagaggcccag

SEQ ID NO: 4038950 - DNA, 15 bp, Homo sapiens
agaccaggctgtgtc

SEQ ID NO: 4038951 - DNA, 14 bp, Homo sapiens
agaccagtctggcc

SEQ ID NO: 4038952 - DNA, 23 bp, Homo sapiens
agaccagtgtatcaggtcaggga

SEQ ID NO: 4038953 - DNA, 19 bp, Homo sapiens
agaccatattacctggatt

SEQ ID NO: 4038954 - DNA, 22 bp, Homo sapiens
agacccaaagcggtccctgtcc

SEQ ID NO: 4038955 - DNA, 23 bp, Homo sapiens
agacccaagtcaaagatgcccca

SEQ ID NO: 4038956 - DNA, 13 bp, Homo sapiens
agacccaggtgga

SEQ ID NO: 4038957 - DNA, 13 bp, Homo sapiens
agacccccacacc

SEQ ID NO: 4038958 - DNA, 15 bp, Homo sapiens
agacccccacacctc

SEQ ID NO: 4038959 - DNA, 17 bp, Homo sapiens
agacccctctggccagg

SEQ ID NO: 4038960 - DNA, 18 bp, Homo sapiens
agacccctgcctggactt

SEQ ID NO: 4038961 - DNA, 21 bp, Homo sapiens
agacccctggcttttcactgc

SEQ ID NO: 4038962 - DNA, 12 bp, Homo sapiens
agaccctcgggc

SEQ ID NO: 4038963 - DNA, 19 bp, Homo sapiens
agaccctcgggccccatcc

SEQ ID NO: 4038964 - DNA, 19 bp, Homo sapiens
agaccctcttgcccatcct

SEQ ID NO: 4038965 - DNA, 21 bp, Homo sapiens
agaccctgaggccctgggctg

SEQ ID NO: 4038966 - DNA, 20 bp, Homo sapiens
agaccctgcaaacagaacag

SEQ ID NO: 4038967 - DNA, 16 bp, Homo sapiens
agaccctgccacagcc

SEQ ID NO: 4038968 - DNA, 17 bp, Homo sapiens
agaccctgccacagcca

SEQ ID NO: 4038969 - DNA, 20 bp, Homo sapiens
agaccctgccacagccagag

SEQ ID NO: 4038970 - DNA, 17 bp, Homo sapiens
agaccctgggtgggctc

SEQ ID NO: 4038971 - DNA, 19 bp, Homo sapiens
agacccttcttgcctgctg

SEQ ID NO: 4038972 - DNA, 20 bp, Homo sapiens
agacccttcttgcctgctgg

SEQ ID NO: 4038973 - DNA, 16 bp, Homo sapiens
agaccgagtgaaccta

SEQ ID NO: 4038974 - DNA, 12 bp, Homo sapiens
agacctaaccag

SEQ ID NO: 4038975 - DNA, 16 bp, Homo sapiens
agacctaaccagggcc

SEQ ID NO: 4038976 - DNA, 15 bp, Homo sapiens
agacctacattccct

SEQ ID NO: 4038977 - DNA, 20 bp, Homo sapiens
agacctacattccctctcct

SEQ ID NO: 4038978 - DNA, 23 bp, Homo sapiens
agacctacattccctctcctgcc

SEQ ID NO: 4038979 - DNA, 18 bp, Homo sapiens
agagacttaaaggacagg

SEQ ID NO: 4038980 - DNA, 14 bp, Homo sapiens
agagagaaaataaa

SEQ ID NO: 4038981 - DNA, 21 bp, Homo sapiens
agagagaaattctgttaaaat

SEQ ID NO: 4038982 - DNA, 10 bp, Homo sapiens
agagagagaa

SEQ ID NO: 4038983 - DNA, 14 bp, Homo sapiens
agagagagagaaaa

SEQ ID NO: 4038984 - DNA, 14 bp, Homo sapiens
agagagagagaaat

SEQ ID NO: 4038985 - DNA, 15 bp, Homo sapiens
agagagagagagaaa

SEQ ID NO: 4038986 - DNA, 15 bp, Homo sapiens
agagagagagagaga

SEQ ID NO: 4038987 - DNA, 22 bp, Homo sapiens
agagagaggaggcagccccctc

SEQ ID NO: 4038988 - DNA, 17 bp, Homo sapiens
agagagatgggagctcc

SEQ ID NO: 4038989 - DNA, 18 bp, Homo sapiens
agagagatgggagctcct

SEQ ID NO: 4038990 - DNA, 14 bp, Homo sapiens
agagagatgttttg

SEQ ID NO: 4038991 - DNA, 20 bp, Homo sapiens
agagagcagctccctttctc

SEQ ID NO: 4038992 - DNA, 23 bp, Homo sapiens
agagagcagctccctttctcagg

SEQ ID NO: 4038993 - DNA, 18 bp, Homo sapiens
agagagccattttgtgaa

SEQ ID NO: 4038994 - DNA, 18 bp, Homo sapiens
agagagcgagcgctaccc

SEQ ID NO: 4038995 - DNA, 23 bp, Homo sapiens
agagagctggtagttagtagcat

SEQ ID NO: 4038996 - DNA, 14 bp, Homo sapiens
agagaggagaaaca

SEQ ID NO: 4038997 - DNA, 14 bp, Homo sapiens
agagaggagccaga

SEQ ID NO: 4038998 - DNA, 19 bp, Homo sapiens
agagaggatgtgcaagcga

SEQ ID NO: 4038999 - DNA, 16 bp, Homo sapiens
agagaggctctggggc

SEQ ID NO: 4039000 - DNA, 22 bp, Homo sapiens
agagagggtgagtcctccagaa

SEQ ID NO: 4039001 - DNA, 23 bp, Homo sapiens
agagagggtgagtcctccagaac

SEQ ID NO: 4039002 - DNA, 16 bp, Homo sapiens
agagagtggctcctcc

SEQ ID NO: 4039003 - DNA, 13 bp, Homo sapiens
agagataataaga

SEQ ID NO: 4039004 - DNA, 15 bp, Homo sapiens
agagatatatctgaa

SEQ ID NO: 4039005 - DNA, 13 bp, Homo sapiens
agagatattttaa

SEQ ID NO: 4039006 - DNA, 18 bp, Homo sapiens
agagatccaaaagaagcc

SEQ ID NO: 4039007 - DNA, 15 bp, Homo sapiens
agagatcttcccata

SEQ ID NO: 4039008 - DNA, 21 bp, Homo sapiens
agagatgctgtaacttaaaat

SEQ ID NO: 4039009 - DNA, 15 bp, Homo sapiens
agagatgggagctcc

SEQ ID NO: 4039010 - DNA, 17 bp, Homo sapiens
agagatgggagctcctc

SEQ ID NO: 4039011 - DNA, 21 bp, Homo sapiens
agagatgggagctcctctcct

SEQ ID NO: 4039012 - DNA, 16 bp, Homo sapiens
agagatgtctcttata

SEQ ID NO: 4039013 - DNA, 15 bp, Homo sapiens
agagatgtgcaccca

SEQ ID NO: 4039014 - DNA, 20 bp, Homo sapiens
agagattctgtgatctttta

SEQ ID NO: 4039015 - DNA, 23 bp, Homo sapiens
agagattctgtgatcttttaaag

SEQ ID NO: 4039016 - DNA, 14 bp, Homo sapiens
agagattgtacatt

SEQ ID NO: 4039017 - DNA, 17 bp, Homo sapiens
agagattgtttttagag

SEQ ID NO: 4039018 - DNA, 18 bp, Homo sapiens
agagatttatataaatgt

SEQ ID NO: 4039019 - DNA, 14 bp, Homo sapiens
agagatttgtctaa

SEQ ID NO: 4039020 - DNA, 20 bp, Homo sapiens
agagcaaaattgatgtgttt

SEQ ID NO: 4039021 - DNA, 14 bp, Homo sapiens
agagcaactctgag

SEQ ID NO: 4039022 - DNA, 14 bp, Homo sapiens
agagcaagactctg

SEQ ID NO: 4039023 - DNA, 23 bp, Homo sapiens
agagcaagatcctgtctttaagg

SEQ ID NO: 4039024 - DNA, 15 bp, Homo sapiens
agagcaccccctgct

SEQ ID NO: 4039025 - DNA, 14 bp, Homo sapiens
agagcaccttcctc

SEQ ID NO: 4039026 - DNA, 20 bp, Homo sapiens
agagcaccttcctcacttcc

SEQ ID NO: 4039027 - DNA, 20 bp, Homo sapiens
agagcacctttgcacaggat

SEQ ID NO: 4039028 - DNA, 18 bp, Homo sapiens
agagcagagtctgggcct

SEQ ID NO: 4039029 - DNA, 18 bp, Homo sapiens
agagcagatgcagagagc

SEQ ID NO: 4039030 - DNA, 13 bp, Homo sapiens
agagcagcactcc

SEQ ID NO: 4039031 - DNA, 18 bp, Homo sapiens
agagcagcatttttaatt

SEQ ID NO: 4039032 - DNA, 22 bp, Homo sapiens
agagcagcatttttaattttca

SEQ ID NO: 4039033 - DNA, 13 bp, Homo sapiens
agagcagctcccc

SEQ ID NO: 4039034 - DNA, 14 bp, Homo sapiens
agagcagctcccca

SEQ ID NO: 4039035 - DNA, 20 bp, Homo sapiens
agagcagctccctttctcag

SEQ ID NO: 4039036 - DNA, 18 bp, Homo sapiens
agagcagctttaaactca

SEQ ID NO: 4039037 - DNA, 21 bp, Homo sapiens
agagcagctttaaactcaggg

SEQ ID NO: 4039038 - DNA, 22 bp, Homo sapiens
agagcaggaaggacaggaagct

SEQ ID NO: 4039039 - DNA, 20 bp, Homo sapiens
agagcaggactccaggccca

SEQ ID NO: 4039040 - DNA, 19 bp, Homo sapiens
agagcagtaccagcgctct

SEQ ID NO: 4039041 - DNA, 20 bp, Homo sapiens
agagcagtgaagactagaaa

SEQ ID NO: 4039042 - DNA, 16 bp, Homo sapiens
agagcagtttcatctg

SEQ ID NO: 4039043 - DNA, 16 bp, Homo sapiens
agagcatgtgtcagag

SEQ ID NO: 4039044 - DNA, 21 bp, Homo sapiens
agagcatgtgtcagagtgttg

SEQ ID NO: 4039045 - DNA, 20 bp, Homo sapiens
agagcattacgtgagccagg

SEQ ID NO: 4039046 - DNA, 21 bp, Homo sapiens
agagcattacgtgagccaggt

SEQ ID NO: 4039047 - DNA, 15 bp, Homo sapiens
agagcattagctggc

SEQ ID NO: 4039048 - DNA, 18 bp, Homo sapiens
agagcattccagtcaggc

SEQ ID NO: 4039049 - DNA, 19 bp, Homo sapiens
agagcattccagtcaggct

SEQ ID NO: 4039050 - DNA, 15 bp, Homo sapiens
agagccaacctcggc

SEQ ID NO: 4039051 - DNA, 13 bp, Homo sapiens
agagccacctgga

SEQ ID NO: 4039052 - DNA, 17 bp, Homo sapiens
agagccattttgtgaat

SEQ ID NO: 4039053 - DNA, 24 bp, Homo sapiens
agagcccagaggtaacagaacagc

SEQ ID NO: 4039054 - DNA, 12 bp, Homo sapiens
agagcccagctc

SEQ ID NO: 4039055 - DNA, 14 bp, Homo sapiens
agagcccatgctca

SEQ ID NO: 4039056 - DNA, 15 bp, Homo sapiens
agagcccctcctcca

SEQ ID NO: 4039057 - DNA, 22 bp, Homo sapiens
agagcccctcctccagcccctg

SEQ ID NO: 4039058 - DNA, 13 bp, Homo sapiens
agagccctggaca

SEQ ID NO: 4039059 - DNA, 16 bp, Homo sapiens
agagccgtggtccctg

SEQ ID NO: 4039060 - DNA, 12 bp, Homo sapiens
agagcctgcccc

SEQ ID NO: 4039061 - DNA, 13 bp, Homo sapiens
agagcctgcccca

SEQ ID NO: 4039062 - DNA, 15 bp, Homo sapiens
agagcctgcctggag

SEQ ID NO: 4039063 - DNA, 11 bp, Homo sapiens
agagcctgctg

SEQ ID NO: 4039064 - DNA, 15 bp, Homo sapiens
agagcctgctgcatg

SEQ ID NO: 4039065 - DNA, 12 bp, Homo sapiens
agagcctgctgg

SEQ ID NO: 4039066 - DNA, 13 bp, Homo sapiens
agagcctgctggc

SEQ ID NO: 4039067 - DNA, 24 bp, Homo sapiens
agagcctgctggcacccaccgtgg

SEQ ID NO: 4039068 - DNA, 15 bp, Homo sapiens
agagcctggagaagc

SEQ ID NO: 4039069 - DNA, 21 bp, Homo sapiens
agagccttctgatgtctctaa

SEQ ID NO: 4039070 - DNA, 19 bp, Homo sapiens
agagccttttatctgcaga

SEQ ID NO: 4039071 - DNA, 21 bp, Homo sapiens
agagccttttatctgcagaac

SEQ ID NO: 4039072 - DNA, 12 bp, Homo sapiens
agagcgaggctg

SEQ ID NO: 4039073 - DNA, 14 bp, Homo sapiens
agagcgccaggaag

SEQ ID NO: 4039074 - DNA, 20 bp, Homo sapiens
agagcgccaggaagccagag

SEQ ID NO: 4039075 - DNA, 23 bp, Homo sapiens
agagcgccaggaagccagagccc

SEQ ID NO: 4039076 - DNA, 14 bp, Homo sapiens
agagcgcccctccc

SEQ ID NO: 4039077 - DNA, 19 bp, Homo sapiens
agagcggaggctgtgtgcc

SEQ ID NO: 4039078 - DNA, 19 bp, Homo sapiens
agagctaaactccttcctg

SEQ ID NO: 4039079 - DNA, 20 bp, Homo sapiens
agagctaaactccttcctgg

SEQ ID NO: 4039080 - DNA, 18 bp, Homo sapiens
agagctaagggtgggtgc

SEQ ID NO: 4039081 - DNA, 22 bp, Homo sapiens
agagctaagggtgggtgctcag

SEQ ID NO: 4039082 - DNA, 14 bp, Homo sapiens
agagctaataaatc

SEQ ID NO: 4039083 - DNA, 16 bp, Homo sapiens
agagctctcaagtcaa

SEQ ID NO: 4039084 - DNA, 12 bp, Homo sapiens
agagctgagcca

SEQ ID NO: 4039085 - DNA, 14 bp, Homo sapiens
agagctgctctgga

SEQ ID NO: 4039086 - DNA, 16 bp, Homo sapiens
agagctgctctggaaa

SEQ ID NO: 4039087 - DNA, 22 bp, Homo sapiens
agagctgctctggaaaatgtga

SEQ ID NO: 4039088 - DNA, 12 bp, Homo sapiens
agagctgggagg

SEQ ID NO: 4039089 - DNA, 13 bp, Homo sapiens
agagctggtgccc

SEQ ID NO: 4039090 - DNA, 11 bp, Homo sapiens
agagctggtgt

SEQ ID NO: 4039091 - DNA, 15 bp, Homo sapiens
agagctggtgtctga

SEQ ID NO: 4039092 - DNA, 14 bp, Homo sapiens
agagctgtggagga

SEQ ID NO: 4039093 - DNA, 16 bp, Homo sapiens
agagcttgtaataaat

SEQ ID NO: 4039094 - DNA, 18 bp, Homo sapiens
agagcttgtaataaatac

SEQ ID NO: 4039095 - DNA, 22 bp, Homo sapiens
agagctttctgtccttttggca

SEQ ID NO: 4039096 - DNA, 15 bp, Homo sapiens
agagcttttaaaaat

SEQ ID NO: 4039097 - DNA, 16 bp, Homo sapiens
agaggaaaaaaatgac

SEQ ID NO: 4039098 - DNA, 19 bp, Homo sapiens
agaggaaaagtaaggtgca

SEQ ID NO: 4039099 - DNA, 21 bp, Homo sapiens
agaggaaaagtaaggtgcagt

SEQ ID NO: 4039100 - DNA, 22 bp, Homo sapiens
agaggaaaagtaaggtgcagtt

SEQ ID NO: 4039101 - DNA, 18 bp, Homo sapiens
agaggaaagggctggctc

SEQ ID NO: 4039102 - DNA, 16 bp, Homo sapiens
agaggaacccccacca

SEQ ID NO: 4039103 - DNA, 12 bp, Homo sapiens
agaggaactgtc

SEQ ID NO: 4039104 - DNA, 21 bp, Homo sapiens
agaggaactgtccagagagca

SEQ ID NO: 4039105 - DNA, 15 bp, Homo sapiens
agaggaagccagctg

SEQ ID NO: 4039106 - DNA, 15 bp, Homo sapiens
agaggaccggcggct

SEQ ID NO: 4039107 - DNA, 15 bp, Homo sapiens
agaggagccagacag

SEQ ID NO: 4039108 - DNA, 17 bp, Homo sapiens
agaggagccagacagac

SEQ ID NO: 4039109 - DNA, 21 bp, Homo sapiens
agaggagctctaccctgctcc

SEQ ID NO: 4039110 - DNA, 21 bp, Homo sapiens
agaggaggcagccccctccac

SEQ ID NO: 4039111 - DNA, 19 bp, Homo sapiens
agaggagtgattgaaccag

SEQ ID NO: 4039112 - DNA, 19 bp, Homo sapiens
agaggagtgcagccttctc

SEQ ID NO: 4039113 - DNA, 22 bp, Homo sapiens
agaggattaggttccatccttt

SEQ ID NO: 4039114 - DNA, 24 bp, Homo sapiens
agaggcaccactaaaagatcgcag

SEQ ID NO: 4039115 - DNA, 21 bp, Homo sapiens
agaggcagagaaagaagagac

SEQ ID NO: 4039116 - DNA, 20 bp, Homo sapiens
agaggcagagttctgtgaag

SEQ ID NO: 4039117 - DNA, 17 bp, Homo sapiens
agaggcagctatctgca

SEQ ID NO: 4039118 - DNA, 22 bp, Homo sapiens
agaggcagcttcaagtgccttt

SEQ ID NO: 4039119 - DNA, 15 bp, Homo sapiens
agaggcattgttagt

SEQ ID NO: 4039120 - DNA, 18 bp, Homo sapiens
agaggccaaaggctggtg

SEQ ID NO: 4039121 - DNA, 17 bp, Homo sapiens
agaggccagccccaccc

SEQ ID NO: 4039122 - DNA, 18 bp, Homo sapiens
agaggccagccccaccca

SEQ ID NO: 4039123 - DNA, 16 bp, Homo sapiens
agaggccccagcctcc

SEQ ID NO: 4039124 - DNA, 21 bp, Homo sapiens
agaggccgaaggtgcctcaga

SEQ ID NO: 4039125 - DNA, 23 bp, Homo sapiens
agaggcctgctgccagtgcagcc

SEQ ID NO: 4039126 - DNA, 12 bp, Homo sapiens
agaggcggcctc

SEQ ID NO: 4039127 - DNA, 19 bp, Homo sapiens
agaggctagcttctgcttt

SEQ ID NO: 4039128 - DNA, 15 bp, Homo sapiens
agaggctctggacag

SEQ ID NO: 4039129 - DNA, 22 bp, Homo sapiens
agaggctctggacagcagaagc

SEQ ID NO: 4039130 - DNA, 19 bp, Homo sapiens
agaggctctggggcagccc

SEQ ID NO: 4039131 - DNA, 13 bp, Homo sapiens
agaggctgaaaga

SEQ ID NO: 4039132 - DNA, 19 bp, Homo sapiens
agaggctgaggctggcaca

SEQ ID NO: 4039133 - DNA, 16 bp, Homo sapiens
agaggctgcacccctg

SEQ ID NO: 4039134 - DNA, 16 bp, Homo sapiens
agaggctgcccctctc

SEQ ID NO: 4039135 - DNA, 14 bp, Homo sapiens
agaggctggtgctg

SEQ ID NO: 4039136 - DNA, 15 bp, Homo sapiens
agaggctgtctgggg

SEQ ID NO: 4039137 - DNA, 16 bp, Homo sapiens
agaggcttctccgcca

SEQ ID NO: 4039138 - DNA, 16 bp, Homo sapiens
agatgggcttgttttc

SEQ ID NO: 4039139 - DNA, 19 bp, Homo sapiens
agatggggataaaatgact

SEQ ID NO: 4039140 - DNA, 17 bp, Homo sapiens
agatgggggcagggctg

SEQ ID NO: 4039141 - DNA, 21 bp, Homo sapiens
agatgggtctggctgagctga

SEQ ID NO: 4039142 - DNA, 17 bp, Homo sapiens
agatggtccatttgttc

SEQ ID NO: 4039143 - DNA, 14 bp, Homo sapiens
agatggtggcagta

SEQ ID NO: 4039144 - DNA, 21 bp, Homo sapiens
agatggtgtgggtgtcctgcc

SEQ ID NO: 4039145 - DNA, 16 bp, Homo sapiens
agatggtttcaattca

SEQ ID NO: 4039146 - DNA, 18 bp, Homo sapiens
agatggtttgagcctgag

SEQ ID NO: 4039147 - DNA, 12 bp, Homo sapiens
agatgtatcctt

SEQ ID NO: 4039148 - DNA, 17 bp, Homo sapiens
agatgtatccttccaat

SEQ ID NO: 4039149 - DNA, 14 bp, Homo sapiens
agatgtctctgggg

SEQ ID NO: 4039150 - DNA, 16 bp, Homo sapiens
agatgtcttccctggg

SEQ ID NO: 4039151 - DNA, 18 bp, Homo sapiens
agatgtcttccctgggct

SEQ ID NO: 4039152 - DNA, 22 bp, Homo sapiens
agatgtcttccctgggctgcca

SEQ ID NO: 4039153 - DNA, 11 bp, Homo sapiens
agatgtgaatt

SEQ ID NO: 4039154 - DNA, 16 bp, Homo sapiens
agatgtgaattattga

SEQ ID NO: 4039155 - DNA, 18 bp, Homo sapiens
agatgtgaattattgaca

SEQ ID NO: 4039156 - DNA, 22 bp, Homo sapiens
agatgtgaattattgacactga

SEQ ID NO: 4039157 - DNA, 15 bp, Homo sapiens
agatgtgagccaccg

SEQ ID NO: 4039158 - DNA, 20 bp, Homo sapiens
agatgtgagccaccgtgcct

SEQ ID NO: 4039159 - DNA, 23 bp, Homo sapiens
agatgtgagccaccgtgcctggc

SEQ ID NO: 4039160 - DNA, 18 bp, Homo sapiens
agatgtgcaatagaaata

SEQ ID NO: 4039161 - DNA, 21 bp, Homo sapiens
agatgtgcttctgaaccgcaa

SEQ ID NO: 4039162 - DNA, 16 bp, Homo sapiens
agatgtggatttggca

SEQ ID NO: 4039163 - DNA, 20 bp, Homo sapiens
agatgtgtcccccccaggcc

SEQ ID NO: 4039164 - DNA, 14 bp, Homo sapiens
agatgtttccagac

SEQ ID NO: 4039165 - DNA, 19 bp, Homo sapiens
agatgttttggtagattaa

SEQ ID NO: 4039166 - DNA, 23 bp, Homo sapiens
agattaaaattatatagctgctc

SEQ ID NO: 4039167 - DNA, 14 bp, Homo sapiens
agattaaacagatg

SEQ ID NO: 4039168 - DNA, 13 bp, Homo sapiens
agattaaatatag

SEQ ID NO: 4039169 - DNA, 18 bp, Homo sapiens
agattaatgtgtattaaa

SEQ ID NO: 4039170 - DNA, 18 bp, Homo sapiens
agattactttgctgcctt

SEQ ID NO: 4039171 - DNA, 13 bp, Homo sapiens
agattagaaaaat

SEQ ID NO: 4039172 - DNA, 17 bp, Homo sapiens
agattaggagaaacaca

SEQ ID NO: 4039173 - DNA, 18 bp, Homo sapiens
agattagttctttttgcc

SEQ ID NO: 4039174 - DNA, 17 bp, Homo sapiens
agattattggctgcttt

SEQ ID NO: 4039175 - DNA, 15 bp, Homo sapiens
agattcaggccagcc

SEQ ID NO: 4039176 - DNA, 13 bp, Homo sapiens
agattcatattta

SEQ ID NO: 4039177 - DNA, 19 bp, Homo sapiens
agattcatatttacttctt

SEQ ID NO: 4039178 - DNA, 22 bp, Homo sapiens
agattcatatttacttcttata

SEQ ID NO: 4039179 - DNA, 21 bp, Homo sapiens
agattcattatttttccactt

SEQ ID NO: 4039180 - DNA, 19 bp, Homo sapiens
agattccagagagtggctc

SEQ ID NO: 4039181 - DNA, 15 bp, Homo sapiens
agattctactttgaa

SEQ ID NO: 4039182 - DNA, 20 bp, Homo sapiens
agattctaggacctgtgtcc

SEQ ID NO: 4039183 - DNA, 16 bp, Homo sapiens
agattctccattacac

SEQ ID NO: 4039184 - DNA, 15 bp, Homo sapiens
agattctgcctctct

SEQ ID NO: 4039185 - DNA, 19 bp, Homo sapiens
agattctgcctctctggaa

SEQ ID NO: 4039186 - DNA, 18 bp, Homo sapiens
agattcttgaagaatgaa

SEQ ID NO: 4039187 - DNA, 15 bp, Homo sapiens
agattgacgacaagt

SEQ ID NO: 4039188 - DNA, 15 bp, Homo sapiens
aggagggtacagctg

SEQ ID NO: 4039189 - DNA, 19 bp, Homo sapiens
aggagggtacagctgggct

SEQ ID NO: 4039190 - DNA, 23 bp, Homo sapiens
aggagggttcctcttaggtcaga

SEQ ID NO: 4039191 - DNA, 14 bp, Homo sapiens
aggaggtgagggat

SEQ ID NO: 4039192 - DNA, 20 bp, Homo sapiens
aggaggtggaggctgcagtg

SEQ ID NO: 4039193 - DNA, 11 bp, Homo sapiens
aggagtaacaa

SEQ ID NO: 4039194 - DNA, 21 bp, Homo sapiens
aggagtcccactccaagccag

SEQ ID NO: 4039195 - DNA, 16 bp, Homo sapiens
aggagtctctgccacc

SEQ ID NO: 4039196 - DNA, 20 bp, Homo sapiens
aggagtctctgccacccact

SEQ ID NO: 4039197 - DNA, 22 bp, Homo sapiens
aggagtctctgccacccactca

SEQ ID NO: 4039198 - DNA, 21 bp, Homo sapiens
aggagtgaaacatcatagaaa

SEQ ID NO: 4039199 - DNA, 21 bp, Homo sapiens
aggagtgattgaaccagctca

SEQ ID NO: 4039200 - DNA, 20 bp, Homo sapiens
aggagtgcgtggcccaccag

SEQ ID NO: 4039201 - DNA, 20 bp, Homo sapiens
aggagtgtgtgacattccag

SEQ ID NO: 4039202 - DNA, 19 bp, Homo sapiens
aggagttcctaaccagcct

SEQ ID NO: 4039203 - DNA, 16 bp, Homo sapiens
aggagttcgaggctgc

SEQ ID NO: 4039204 - DNA, 19 bp, Homo sapiens
aggagtttcgaggtagagt

SEQ ID NO: 4039205 - DNA, 15 bp, Homo sapiens
aggagtttgagacca

SEQ ID NO: 4039206 - DNA, 12 bp, Homo sapiens
aggataaaataa

SEQ ID NO: 4039207 - DNA, 16 bp, Homo sapiens
aggataaggagactga

SEQ ID NO: 4039208 - DNA, 17 bp, Homo sapiens
aggataatgaaataatc

SEQ ID NO: 4039209 - DNA, 14 bp, Homo sapiens
aggatacatgtgcc

SEQ ID NO: 4039210 - DNA, 16 bp, Homo sapiens
aggatactctgtcaga

SEQ ID NO: 4039211 - DNA, 18 bp, Homo sapiens
aggatactgcctccccca

SEQ ID NO: 4039212 - DNA, 18 bp, Homo sapiens
aggatagatgctggccca

SEQ ID NO: 4039213 - DNA, 20 bp, Homo sapiens
aggatagatgctggcccagg

SEQ ID NO: 4039214 - DNA, 17 bp, Homo sapiens
aggatatccttatcaga

SEQ ID NO: 4039215 - DNA, 19 bp, Homo sapiens
aggatatccttatcagagc

SEQ ID NO: 4039216 - DNA, 21 bp, Homo sapiens
aggatattagttaatgagcca

SEQ ID NO: 4039217 - DNA, 17 bp, Homo sapiens
aggatatttaagaaaat

SEQ ID NO: 4039218 - DNA, 23 bp, Homo sapiens
aggatcagttaactattgcattt

SEQ ID NO: 4039219 - DNA, 15 bp, Homo sapiens
aggatcatggtgtaa

SEQ ID NO: 4039220 - DNA, 22 bp, Homo sapiens
aggatcatggtgtaataagaca

SEQ ID NO: 4039221 - DNA, 14 bp, Homo sapiens
aggatccagagagc

SEQ ID NO: 4039222 - DNA, 21 bp, Homo sapiens
aggatccagagagcagctccc

SEQ ID NO: 4039223 - DNA, 22 bp, Homo sapiens
aggatctctcaggagcacaggc

SEQ ID NO: 4039224 - DNA, 21 bp, Homo sapiens
aggatgaatgaggtcccaggc

SEQ ID NO: 4039225 - DNA, 22 bp, Homo sapiens
aggatgaatgaggtcccaggca

SEQ ID NO: 4039226 - DNA, 18 bp, Homo sapiens
aggatgaatgtatgtgca

SEQ ID NO: 4039227 - DNA, 13 bp, Homo sapiens
aggatgagagccc

SEQ ID NO: 4039228 - DNA, 14 bp, Homo sapiens
aggatgagagccca

SEQ ID NO: 4039229 - DNA, 15 bp, Homo sapiens
aggatgagagcccag

SEQ ID NO: 4039230 - DNA, 18 bp, Homo sapiens
aggatgagagcccagagg

SEQ ID NO: 4039231 - DNA, 23 bp, Homo sapiens
aggatgctaacatctaaaaatag

SEQ ID NO: 4039232 - DNA, 17 bp, Homo sapiens
aggatggaaactggact

SEQ ID NO: 4039233 - DNA, 17 bp, Homo sapiens
aggatggagccagctct

SEQ ID NO: 4039234 - DNA, 16 bp, Homo sapiens
aggatggcctttcctt

SEQ ID NO: 4039235 - DNA, 21 bp, Homo sapiens
aggatgggatgggttccagag

SEQ ID NO: 4039236 - DNA, 18 bp, Homo sapiens
aggatgtcacagggccaa

SEQ ID NO: 4039237 - DNA, 15 bp, Homo sapiens
aggatgtcatgtctg

SEQ ID NO: 4039238 - DNA, 22 bp, Homo sapiens
aggatgtccctgggccagggtc

SEQ ID NO: 4039239 - DNA, 18 bp, Homo sapiens
aggatgtgatatataagt

SEQ ID NO: 4039240 - DNA, 16 bp, Homo sapiens
aggatgtggaagagca

SEQ ID NO: 4039241 - DNA, 21 bp, Homo sapiens
aggatgtggagctactgatga

SEQ ID NO: 4039242 - DNA, 22 bp, Homo sapiens
aggatgttttgtcccatttcct

SEQ ID NO: 4039243 - DNA, 22 bp, Homo sapiens
aggattataaatgaaatttgca

SEQ ID NO: 4039244 - DNA, 19 bp, Homo sapiens
aggattatgggtcctgcaa

SEQ ID NO: 4039245 - DNA, 14 bp, Homo sapiens
aggattattggaaa

SEQ ID NO: 4039246 - DNA, 14 bp, Homo sapiens
aggattcagccgga

SEQ ID NO: 4039247 - DNA, 15 bp, Homo sapiens
aggattcaggggctg

SEQ ID NO: 4039248 - DNA, 19 bp, Homo sapiens
aggattgaacttctttgaa

SEQ ID NO: 4039249 - DNA, 14 bp, Homo sapiens
aggattgaagagca

SEQ ID NO: 4039250 - DNA, 14 bp, Homo sapiens
aggattgctatctg

SEQ ID NO: 4039251 - DNA, 19 bp, Homo sapiens
aggattgcttgagcccagg

SEQ ID NO: 4039252 - DNA, 20 bp, Homo sapiens
aggattgcttgagcccagga

SEQ ID NO: 4039253 - DNA, 19 bp, Homo sapiens
aggattgtaaaaaaaaatg

SEQ ID NO: 4039254 - DNA, 12 bp, Homo sapiens
aggatttaacag

SEQ ID NO: 4039255 - DNA, 20 bp, Homo sapiens
aggatttaacagtcatttaa

SEQ ID NO: 4039256 - DNA, 20 bp, Homo sapiens
aggatttcatgatttcattt

SEQ ID NO: 4039257 - DNA, 19 bp, Homo sapiens
aggattttaacaaaagcaa

SEQ ID NO: 4039258 - DNA, 14 bp, Homo sapiens
aggcaacttttaaa

SEQ ID NO: 4039259 - DNA, 15 bp, Homo sapiens
aggcaagaaaaggac

SEQ ID NO: 4039260 - DNA, 18 bp, Homo sapiens
aggcaaggctatgtgatt

SEQ ID NO: 4039261 - DNA, 15 bp, Homo sapiens
aggcaagtgggacca

SEQ ID NO: 4039262 - DNA, 20 bp, Homo sapiens
aggcaagttaagagaaactt

SEQ ID NO: 4039263 - DNA, 17 bp, Homo sapiens
aggcaataaaaatcata

SEQ ID NO: 4039264 - DNA, 22 bp, Homo sapiens
aggcaatgtcaggaacagaagg

SEQ ID NO: 4039265 - DNA, 23 bp, Homo sapiens
aggcaatgtcaggaacagaagga

SEQ ID NO: 4039266 - DNA, 22 bp, Homo sapiens
aggcacaaggttggttgctaag

SEQ ID NO: 4039267 - DNA, 14 bp, Homo sapiens
aggcacacacagcc

SEQ ID NO: 4039268 - DNA, 20 bp, Homo sapiens
aggcacacagcagcccccca

SEQ ID NO: 4039269 - DNA, 21 bp, Homo sapiens
aggcacacagcagccccccag

SEQ ID NO: 4039270 - DNA, 13 bp, Homo sapiens
acttttgttctgc

SEQ ID NO: 4039271 - DNA, 16 bp, Homo sapiens
acttttgttctgcttt

SEQ ID NO: 4039272 - DNA, 14 bp, Homo sapiens
actttttatttaat

SEQ ID NO: 4039273 - DNA, 22 bp, Homo sapiens
actttttatttaattaaatgta

SEQ ID NO: 4039274 - DNA, 16 bp, Homo sapiens
actttttcgtgtggat

SEQ ID NO: 4039275 - DNA, 23 bp, Homo sapiens
actttttgttctggtcctttttg

SEQ ID NO: 4039276 - DNA, 14 bp, Homo sapiens
actttttgtttctt

SEQ ID NO: 4039277 - DNA, 18 bp, Homo sapiens
acttttttttctctcttt

SEQ ID NO: 4039278 - DNA, 19 bp, Homo sapiens
acttttttttctctctttt

SEQ ID NO: 4039279 - DNA, 18 bp, Homo sapiens
agaaaaaaactataaata

SEQ ID NO: 4039280 - DNA, 17 bp, Homo sapiens
agaaaaaaatcttctcc

SEQ ID NO: 4039281 - DNA, 12 bp, Homo sapiens
agaaaaaagaag

SEQ ID NO: 4039282 - DNA, 18 bp, Homo sapiens
agaaaaaataacacacat

SEQ ID NO: 4039283 - DNA, 13 bp, Homo sapiens
agaaaaacagaca

SEQ ID NO: 4039284 - DNA, 13 bp, Homo sapiens
agaaaaagaaatg

SEQ ID NO: 4039285 - DNA, 12 bp, Homo sapiens
agaaaaagcaaa

SEQ ID NO: 4039286 - DNA, 14 bp, Homo sapiens
agaaaaaggcagtg

SEQ ID NO: 4039287 - DNA, 17 bp, Homo sapiens
agaaaaatatatactaa

SEQ ID NO: 4039288 - DNA, 16 bp, Homo sapiens
agaaaacagaaaacaa

SEQ ID NO: 4039289 - DNA, 16 bp, Homo sapiens
agaaaacccttttcta

SEQ ID NO: 4039290 - DNA, 19 bp, Homo sapiens
agaaaactttaaaaaatat

SEQ ID NO: 4039291 - DNA, 12 bp, Homo sapiens
agaaaagcacac

SEQ ID NO: 4039292 - DNA, 15 bp, Homo sapiens
agaaaagcacttttg

SEQ ID NO: 4039293 - DNA, 12 bp, Homo sapiens
agaaaagtattt

SEQ ID NO: 4039294 - DNA, 15 bp, Homo sapiens
agaaaagtattttga

SEQ ID NO: 4039295 - DNA, 14 bp, Homo sapiens
agaaaagtgcctga

SEQ ID NO: 4039296 - DNA, 14 bp, Homo sapiens
agaaaataaaacta

SEQ ID NO: 4039297 - DNA, 23 bp, Homo sapiens
agaaaatattatgtgtttccata

SEQ ID NO: 4039298 - DNA, 11 bp, Homo sapiens
agaaaatgaag

SEQ ID NO: 4039299 - DNA, 19 bp, Homo sapiens
agaaaatgacttatttctg

SEQ ID NO: 4039300 - DNA, 22 bp, Homo sapiens
agaaaatgcctcaattcacata

SEQ ID NO: 4039301 - DNA, 18 bp, Homo sapiens
agaaaatgttatttaaca

SEQ ID NO: 4039302 - DNA, 19 bp, Homo sapiens
agaaaatgttatttaacag

SEQ ID NO: 4039303 - DNA, 16 bp, Homo sapiens
agaaaatgttcttcca

SEQ ID NO: 4039304 - DNA, 16 bp, Homo sapiens
agaaaatgttgagaat

SEQ ID NO: 4039305 - DNA, 15 bp, Homo sapiens
agaaaattagactgt

SEQ ID NO: 4039306 - DNA, 13 bp, Homo sapiens
agaaaattcaatt

SEQ ID NO: 4039307 - DNA, 20 bp, Homo sapiens
agaaaatttttgtagtagcg

SEQ ID NO: 4039308 - DNA, 15 bp, Homo sapiens
agaaacaacagggga

SEQ ID NO: 4039309 - DNA, 14 bp, Homo sapiens
agaaacacaatatt

SEQ ID NO: 4039310 - DNA, 19 bp, Homo sapiens
agaaacacattcttattaa

SEQ ID NO: 4039311 - DNA, 22 bp, Homo sapiens
agaaacactgcaaattttaact

SEQ ID NO: 4039312 - DNA, 21 bp, Homo sapiens
agaaacagagtggcctccctg

SEQ ID NO: 4039313 - DNA, 19 bp, Homo sapiens
agaaacagtgggagccctg

SEQ ID NO: 4039314 - DNA, 20 bp, Homo sapiens
agaaacagttaactttcaga

SEQ ID NO: 4039315 - DNA, 22 bp, Homo sapiens
agaaacctgactcaattatttg

SEQ ID NO: 4039316 - DNA, 18 bp, Homo sapiens
agaaaccttattgtacct

SEQ ID NO: 4039317 - DNA, 20 bp, Homo sapiens
agaaaccttattgtacctct

SEQ ID NO: 4039318 - DNA, 14 bp, Homo sapiens
agaaaccttgctct

SEQ ID NO: 4039319 - DNA, 15 bp, Homo sapiens
agaaacgtcttctaa

SEQ ID NO: 4039320 - DNA, 13 bp, Homo sapiens
agaaactcctgtt

SEQ ID NO: 4039321 - DNA, 16 bp, Homo sapiens
agaaactcctgtttct

SEQ ID NO: 4039322 - DNA, 22 bp, Homo sapiens
agaaactgtctagcacttcctt

SEQ ID NO: 4039323 - DNA, 23 bp, Homo sapiens
agaaactgtctagcacttccttg

SEQ ID NO: 4039324 - DNA, 13 bp, Homo sapiens
agaaacttgtgaa

SEQ ID NO: 4039325 - DNA, 23 bp, Homo sapiens
agaaacttgttcttccaaagcag

SEQ ID NO: 4039326 - DNA, 13 bp, Homo sapiens
agaaactttgcct

SEQ ID NO: 4039327 - DNA, 16 bp, Homo sapiens
agaaagaaaatgaaga

SEQ ID NO: 4039328 - DNA, 13 bp, Homo sapiens
agaaagaagagac

SEQ ID NO: 4039329 - DNA, 17 bp, Homo sapiens
agaaagatcattgaaat

SEQ ID NO: 4039330 - DNA, 19 bp, Homo sapiens
agaaagatggatgtgcttt

SEQ ID NO: 4039331 - DNA, 18 bp, Homo sapiens
agaaagcctgggtgacat

SEQ ID NO: 4039332 - DNA, 20 bp, Homo sapiens
agaaagcctgggtgacattt

SEQ ID NO: 4039333 - DNA, 21 bp, Homo sapiens
agaaagcctgggtgacatttg

SEQ ID NO: 4039334 - DNA, 19 bp, Homo sapiens
agaaagcctgttcccctca

SEQ ID NO: 4039335 - DNA, 22 bp, Homo sapiens
agaaagctgtgaacaggctggg

SEQ ID NO: 4039336 - DNA, 18 bp, Homo sapiens
agaaaggatatttaagaa

SEQ ID NO: 4039337 - DNA, 17 bp, Homo sapiens
agaaaggggagcccact

SEQ ID NO: 4039338 - DNA, 23 bp, Homo sapiens
agaagcattccttctttgataat

SEQ ID NO: 4039339 - DNA, 18 bp, Homo sapiens
agaagccaagggaaaggg

SEQ ID NO: 4039340 - DNA, 18 bp, Homo sapiens
agaagccacgctgtcctc

SEQ ID NO: 4039341 - DNA, 13 bp, Homo sapiens
agaagccaggaat

SEQ ID NO: 4039342 - DNA, 22 bp, Homo sapiens
agaagccatatatgaccagaag

SEQ ID NO: 4039343 - DNA, 18 bp, Homo sapiens
agaagcccaatattataa

SEQ ID NO: 4039344 - DNA, 18 bp, Homo sapiens
agaagccgggaacagaca

SEQ ID NO: 4039345 - DNA, 22 bp, Homo sapiens
agaagccgggaacagacaacag

SEQ ID NO: 4039346 - DNA, 21 bp, Homo sapiens
agaagcctccaagcctgcctc

SEQ ID NO: 4039347 - DNA, 13 bp, Homo sapiens
agaagcctctggc

SEQ ID NO: 4039348 - DNA, 23 bp, Homo sapiens
agaagccttggaaccagccccat

SEQ ID NO: 4039349 - DNA, 14 bp, Homo sapiens
agaagcgagcactg

SEQ ID NO: 4039350 - DNA, 23 bp, Homo sapiens
agaagcgggacgagaccctacag

SEQ ID NO: 4039351 - DNA, 18 bp, Homo sapiens
agaagctcctctccccag

SEQ ID NO: 4039352 - DNA, 20 bp, Homo sapiens
agaagctcctctccccagcc

SEQ ID NO: 4039353 - DNA, 22 bp, Homo sapiens
agaagctcctctccccagccca

SEQ ID NO: 4039354 - DNA, 21 bp, Homo sapiens
agaagctgccaggtgagaaac

SEQ ID NO: 4039355 - DNA, 22 bp, Homo sapiens
agaagctgccaggtgagaaact

SEQ ID NO: 4039356 - DNA, 14 bp, Homo sapiens
agaagctgctgacc

SEQ ID NO: 4039357 - DNA, 17 bp, Homo sapiens
agaagctgtctaggtcc

SEQ ID NO: 4039358 - DNA, 16 bp, Homo sapiens
agaagctgttgtacat

SEQ ID NO: 4039359 - DNA, 22 bp, Homo sapiens
agaagctgttgtacatttatga

SEQ ID NO: 4039360 - DNA, 17 bp, Homo sapiens
agaaggaagtgaagagg

SEQ ID NO: 4039361 - DNA, 15 bp, Homo sapiens
agaaggcaaaaatgt

SEQ ID NO: 4039362 - DNA, 16 bp, Homo sapiens
agaaggcatgagaaag

SEQ ID NO: 4039363 - DNA, 23 bp, Homo sapiens
agaaggccttcatggccccagca

SEQ ID NO: 4039364 - DNA, 18 bp, Homo sapiens
agaagggaatcctcctcc

SEQ ID NO: 4039365 - DNA, 14 bp, Homo sapiens
agaagggagaagaa

SEQ ID NO: 4039366 - DNA, 16 bp, Homo sapiens
agaagggagaagaaag

SEQ ID NO: 4039367 - DNA, 13 bp, Homo sapiens
agaagggagaagg

SEQ ID NO: 4039368 - DNA, 14 bp, Homo sapiens
agaagggagaagga

SEQ ID NO: 4039369 - DNA, 20 bp, Homo sapiens
agaagggagacattgtttgg

SEQ ID NO: 4039370 - DNA, 23 bp, Homo sapiens
agaagggtggatgacagggcaga

SEQ ID NO: 4039371 - DNA, 15 bp, Homo sapiens
agaaggtggaccttt

SEQ ID NO: 4039372 - DNA, 21 bp, Homo sapiens
agaaggtggaccttttaaagt

SEQ ID NO: 4039373 - DNA, 22 bp, Homo sapiens
agaaggtggaccttttaaagtg

SEQ ID NO: 4039374 - DNA, 12 bp, Homo sapiens
agcagggaaggc

SEQ ID NO: 4039375 - DNA, 17 bp, Homo sapiens
agcagggaaggcctgac

SEQ ID NO: 4039376 - DNA, 19 bp, Homo sapiens
agcagggattaacctctgc

SEQ ID NO: 4039377 - DNA, 20 bp, Homo sapiens
agcagggattaacctctgca

SEQ ID NO: 4039378 - DNA, 13 bp, Homo sapiens
agcagggctgtgt

SEQ ID NO: 4039379 - DNA, 23 bp, Homo sapiens
agcagggggagaaacccttcaca

SEQ ID NO: 4039380 - DNA, 22 bp, Homo sapiens
agcaggggtccttggtgtgacc

SEQ ID NO: 4039381 - DNA, 23 bp, Homo sapiens
agcaggggtgactttgtctctcc

SEQ ID NO: 4039382 - DNA, 22 bp, Homo sapiens
agcagggtaccctttggggagc

SEQ ID NO: 4039383 - DNA, 18 bp, Homo sapiens
agcagggtagtctggttt

SEQ ID NO: 4039384 - DNA, 20 bp, Homo sapiens
agcaggtggtcctgagacct

SEQ ID NO: 4039385 - DNA, 21 bp, Homo sapiens
agcaggtggtcctgagacctg

SEQ ID NO: 4039386 - DNA, 21 bp, Homo sapiens
agcagtaaaagatgaagtttt

SEQ ID NO: 4039387 - DNA, 19 bp, Homo sapiens
agcagtaaatttgctagca

SEQ ID NO: 4039388 - DNA, 20 bp, Homo sapiens
agcagtcacactgttactcc

SEQ ID NO: 4039389 - DNA, 17 bp, Homo sapiens
agcagtcagagtccagt

SEQ ID NO: 4039390 - DNA, 20 bp, Homo sapiens
agcagtcccagtattctcag

SEQ ID NO: 4039391 - DNA, 23 bp, Homo sapiens
agcagtcccagtattctcagagc

SEQ ID NO: 4039392 - DNA, 17 bp, Homo sapiens
agcagtcgcctgcctgc

SEQ ID NO: 4039393 - DNA, 18 bp, Homo sapiens
agcagtctgataaactga

SEQ ID NO: 4039394 - DNA, 22 bp, Homo sapiens
agcagtcttatgcttccagaaa

SEQ ID NO: 4039395 - DNA, 23 bp, Homo sapiens
agcagtgccttccataattatga

SEQ ID NO: 4039396 - DNA, 11 bp, Homo sapiens
agcagtggctg

SEQ ID NO: 4039397 - DNA, 22 bp, Homo sapiens
agcagtgggtcatgatgctctt

SEQ ID NO: 4039398 - DNA, 19 bp, Homo sapiens
agcagtgtcatcagaagat

SEQ ID NO: 4039399 - DNA, 20 bp, Homo sapiens
agcagtgtcatcagaagata

SEQ ID NO: 4039400 - DNA, 20 bp, Homo sapiens
agcagtgtcttccataatgt

SEQ ID NO: 4039401 - DNA, 20 bp, Homo sapiens
agcagtgtgaatagcctggc

SEQ ID NO: 4039402 - DNA, 13 bp, Homo sapiens
agcagtgttctca

SEQ ID NO: 4039403 - DNA, 20 bp, Homo sapiens
agcagtgttgctcagctcct

SEQ ID NO: 4039404 - DNA, 15 bp, Homo sapiens
agcagtttgccaccc

SEQ ID NO: 4039405 - DNA, 17 bp, Homo sapiens
agcagttttcaagtcaa

SEQ ID NO: 4039406 - DNA, 18 bp, Homo sapiens
agcagttttcaagtcaaa

SEQ ID NO: 4039407 - DNA, 18 bp, Homo sapiens
agcataaataaaactgaa

SEQ ID NO: 4039408 - DNA, 13 bp, Homo sapiens
agcataaatgcaa

SEQ ID NO: 4039409 - DNA, 22 bp, Homo sapiens
agcatacatgcaaaaagaaatg

SEQ ID NO: 4039410 - DNA, 14 bp, Homo sapiens
agcatagatgtttt

SEQ ID NO: 4039411 - DNA, 18 bp, Homo sapiens
agcatagcttattattga

SEQ ID NO: 4039412 - DNA, 14 bp, Homo sapiens
agcatatagagatg

SEQ ID NO: 4039413 - DNA, 21 bp, Homo sapiens
agcatattttctctaggcttt

SEQ ID NO: 4039414 - DNA, 12 bp, Homo sapiens
agcatcactccc

SEQ ID NO: 4039415 - DNA, 18 bp, Homo sapiens
agcatcattttgcattca

SEQ ID NO: 4039416 - DNA, 18 bp, Homo sapiens
agcatccaccttggctct

SEQ ID NO: 4039417 - DNA, 20 bp, Homo sapiens
agctccccgcttctgcctgc

SEQ ID NO: 4039418 - DNA, 17 bp, Homo sapiens
agctccctagactgcat

SEQ ID NO: 4039419 - DNA, 15 bp, Homo sapiens
agctccctaggagac

SEQ ID NO: 4039420 - DNA, 20 bp, Homo sapiens
agctccctcaaagaggcagt

SEQ ID NO: 4039421 - DNA, 17 bp, Homo sapiens
agctccgcctcccgggt

SEQ ID NO: 4039422 - DNA, 16 bp, Homo sapiens
agctcctacctctgtg

SEQ ID NO: 4039423 - DNA, 23 bp, Homo sapiens
agctcctcaactcacctaatgtt

SEQ ID NO: 4039424 - DNA, 23 bp, Homo sapiens
agctcctctccccagcccagaga

SEQ ID NO: 4039425 - DNA, 13 bp, Homo sapiens
agctcctctcctg

SEQ ID NO: 4039426 - DNA, 14 bp, Homo sapiens
agctcctctcctgg

SEQ ID NO: 4039427 - DNA, 17 bp, Homo sapiens
agctcctctcctggagg

SEQ ID NO: 4039428 - DNA, 18 bp, Homo sapiens
agctcctctcctggagga

SEQ ID NO: 4039429 - DNA, 14 bp, Homo sapiens
agctcctgctgcgg

SEQ ID NO: 4039430 - DNA, 20 bp, Homo sapiens
agctcctggtcttgagatgt

SEQ ID NO: 4039431 - DNA, 14 bp, Homo sapiens
agctcgcacccccc

SEQ ID NO: 4039432 - DNA, 22 bp, Homo sapiens
agctcgcacccccctgttctaa

SEQ ID NO: 4039433 - DNA, 22 bp, Homo sapiens
agctctaataaaacagctgtct

SEQ ID NO: 4039434 - DNA, 17 bp, Homo sapiens
agctctaccctgctccc

SEQ ID NO: 4039435 - DNA, 19 bp, Homo sapiens
agctctaccctgctccctg

SEQ ID NO: 4039436 - DNA, 22 bp, Homo sapiens
agctctcatgctgcccctgcct

SEQ ID NO: 4039437 - DNA, 16 bp, Homo sapiens
agctctctgccctgtg

SEQ ID NO: 4039438 - DNA, 18 bp, Homo sapiens
agctctctgccctgtgta

SEQ ID NO: 4039439 - DNA, 19 bp, Homo sapiens
agctctctgccctgtgtac

SEQ ID NO: 4039440 - DNA, 18 bp, Homo sapiens
agctctctgggacctcct

SEQ ID NO: 4039441 - DNA, 13 bp, Homo sapiens
agctctgaccctt

SEQ ID NO: 4039442 - DNA, 19 bp, Homo sapiens
agctctgagacccttttct

SEQ ID NO: 4039443 - DNA, 23 bp, Homo sapiens
agctctgagacccttttctcagg

SEQ ID NO: 4039444 - DNA, 16 bp, Homo sapiens
agctctgcatctcctg

SEQ ID NO: 4039445 - DNA, 17 bp, Homo sapiens
agctctggacagcccca

SEQ ID NO: 4039446 - DNA, 13 bp, Homo sapiens
agctcttcaatag

SEQ ID NO: 4039447 - DNA, 15 bp, Homo sapiens
agctcttcacaccat

SEQ ID NO: 4039448 - DNA, 17 bp, Homo sapiens
agctcttcaggcctccc

SEQ ID NO: 4039449 - DNA, 12 bp, Homo sapiens
agctcttccctt

SEQ ID NO: 4039450 - DNA, 15 bp, Homo sapiens
agctcttggagctgt

SEQ ID NO: 4039451 - DNA, 20 bp, Homo sapiens
agctcttggcccctgtgtga

SEQ ID NO: 4039452 - DNA, 23 bp, Homo sapiens
agctcttggcccctgtgtgagtt

SEQ ID NO: 4039453 - DNA, 15 bp, Homo sapiens
aggccatggcagaat

SEQ ID NO: 4039454 - DNA, 19 bp, Homo sapiens
aggccatgtgagccaccgc

SEQ ID NO: 4039455 - DNA, 20 bp, Homo sapiens
aggccatgtgagccaccgct

SEQ ID NO: 4039456 - DNA, 17 bp, Homo sapiens
aggcccaaggtcccctc

SEQ ID NO: 4039457 - DNA, 12 bp, Homo sapiens
aggcccagcacc

SEQ ID NO: 4039458 - DNA, 17 bp, Homo sapiens
aggcccagcgcggccag

SEQ ID NO: 4039459 - DNA, 19 bp, Homo sapiens
aggcccagcgggcagatgg

SEQ ID NO: 4039460 - DNA, 17 bp, Homo sapiens
aggcccaggcctcacca

SEQ ID NO: 4039461 - DNA, 15 bp, Homo sapiens
aggcccaggctggga

SEQ ID NO: 4039462 - DNA, 20 bp, Homo sapiens
aggcccatgccaaggcctcc

SEQ ID NO: 4039463 - DNA, 12 bp, Homo sapiens
aggctctgctgg

SEQ ID NO: 4039464 - DNA, 16 bp, Homo sapiens
aggctctgcttctcca

SEQ ID NO: 4039465 - DNA, 12 bp, Homo sapiens
aggctctggaca

SEQ ID NO: 4039466 - DNA, 15 bp, Homo sapiens
aggctctggacagca

SEQ ID NO: 4039467 - DNA, 12 bp, Homo sapiens
aggctctggggc

SEQ ID NO: 4039468 - DNA, 14 bp, Homo sapiens
aggctctgtggagg

SEQ ID NO: 4039469 - DNA, 19 bp, Homo sapiens
aggctcttagcagcttcca

SEQ ID NO: 4039470 - DNA, 13 bp, Homo sapiens
aggctcttctcct

SEQ ID NO: 4039471 - DNA, 17 bp, Homo sapiens
aggctgaccacagcaca

SEQ ID NO: 4039472 - DNA, 13 bp, Homo sapiens
aggctgagacagg

SEQ ID NO: 4039473 - DNA, 11 bp, Homo sapiens
aggctgagcca

SEQ ID NO: 4039474 - DNA, 19 bp, Homo sapiens
aggctgaggcaggagaatg

SEQ ID NO: 4039475 - DNA, 15 bp, Homo sapiens
aggctgaggcctgga

SEQ ID NO: 4039476 - DNA, 16 bp, Homo sapiens
aggctgaggcctggac

SEQ ID NO: 4039477 - DNA, 16 bp, Homo sapiens
aggctgaggctggcac

SEQ ID NO: 4039478 - DNA, 21 bp, Homo sapiens
aggctgagggctgccagcagc

SEQ ID NO: 4039479 - DNA, 22 bp, Homo sapiens
aggctgagggctgccagcagcc

SEQ ID NO: 4039480 - DNA, 17 bp, Homo sapiens
aggctgagtccagagct

SEQ ID NO: 4039481 - DNA, 17 bp, Homo sapiens
aggctgccaaggccaga

SEQ ID NO: 4039482 - DNA, 15 bp, Homo sapiens
aggctgcccccggcc

SEQ ID NO: 4039483 - DNA, 18 bp, Homo sapiens
aggctgcctcctgccctt

SEQ ID NO: 4039484 - DNA, 22 bp, Homo sapiens
aggctgcttagaatccaaactt

SEQ ID NO: 4039485 - DNA, 17 bp, Homo sapiens
aggctggacatgctgac

SEQ ID NO: 4039486 - DNA, 18 bp, Homo sapiens
aggctggacatgctgact

SEQ ID NO: 4039487 - DNA, 12 bp, Homo sapiens
aggctggagaag

SEQ ID NO: 4039488 - DNA, 13 bp, Homo sapiens
aggctggagaagc

SEQ ID NO: 4039489 - DNA, 12 bp, Homo sapiens
aggctggagacc

SEQ ID NO: 4039490 - DNA, 15 bp, Homo sapiens
aggctggaggaaggg

SEQ ID NO: 4039491 - DNA, 20 bp, Homo sapiens
aggctggagtgcagtggcgt

SEQ ID NO: 4039492 - DNA, 14 bp, Homo sapiens
aggctggcacagga

SEQ ID NO: 4039493 - DNA, 18 bp, Homo sapiens
aggctggcacaggacatg

SEQ ID NO: 4039494 - DNA, 18 bp, Homo sapiens
aggctgggcagccccaga

SEQ ID NO: 4039495 - DNA, 20 bp, Homo sapiens
aggctgggcagccccagaga

SEQ ID NO: 4039496 - DNA, 10 bp, Homo sapiens
aggctgggcc

SEQ ID NO: 4039497 - DNA, 12 bp, Homo sapiens
aggctggggcgg

SEQ ID NO: 4039498 - DNA, 16 bp, Homo sapiens
aggctggggcggggcc

SEQ ID NO: 4039499 - DNA, 17 bp, Homo sapiens
aggctgggggagagccg

SEQ ID NO: 4039500 - DNA, 20 bp, Homo sapiens
aggctggtgctgtggccagg

SEQ ID NO: 4039501 - DNA, 15 bp, Homo sapiens
aggctgtcctgtaca

SEQ ID NO: 4039502 - DNA, 22 bp, Homo sapiens
aggctgtccttaacccacctct

SEQ ID NO: 4039503 - DNA, 12 bp, Homo sapiens
aggctgtctggg

SEQ ID NO: 4039504 - DNA, 16 bp, Homo sapiens
aggctgtctggggcct

SEQ ID NO: 4039505 - DNA, 14 bp, Homo sapiens
aggctgtgctccgc

SEQ ID NO: 4039506 - DNA, 19 bp, Homo sapiens
aggctgtgctccgccatgg

SEQ ID NO: 4039507 - DNA, 22 bp, Homo sapiens
aggctgttccatgttctatttt

SEQ ID NO: 4039508 - DNA, 20 bp, Homo sapiens
aggctgttcccatgtagccc

SEQ ID NO: 4039509 - DNA, 13 bp, Homo sapiens
aggctgttctcca

SEQ ID NO: 4039510 - DNA, 14 bp, Homo sapiens
aggctgttctccag

SEQ ID NO: 4039511 - DNA, 16 bp, Homo sapiens
aggctgttctccaggc

SEQ ID NO: 4039512 - DNA, 17 bp, Homo sapiens
aggctgttctccaggct

SEQ ID NO: 4039513 - DNA, 19 bp, Homo sapiens
aggctgttctccaggcttc

SEQ ID NO: 4039514 - DNA, 16 bp, Homo sapiens
aggcttaggcatgttc

SEQ ID NO: 4039515 - DNA, 14 bp, Homo sapiens
aggcttatatttgt

SEQ ID NO: 4039516 - DNA, 20 bp, Homo sapiens
aggcttccctgacttgcttt

SEQ ID NO: 4039517 - DNA, 21 bp, Homo sapiens
aggcttccctgacttgcttta

SEQ ID NO: 4039518 - DNA, 21 bp, Homo sapiens
aggcttcctgcaattttctaa

SEQ ID NO: 4039519 - DNA, 15 bp, Homo sapiens
aggcttctccgccag

SEQ ID NO: 4039520 - DNA, 20 bp, Homo sapiens
aggcttctccgccagcctcc

SEQ ID NO: 4039521 - DNA, 15 bp, Homo sapiens
aggcttcttcctaca

SEQ ID NO: 4039522 - DNA, 18 bp, Homo sapiens
aggcttgcataataagct

SEQ ID NO: 4039523 - DNA, 18 bp, Homo sapiens
aggctttagtgtatttat

SEQ ID NO: 4039524 - DNA, 19 bp, Homo sapiens
aggctttggatttgacatt

SEQ ID NO: 4039525 - DNA, 16 bp, Homo sapiens
aggctttgtgttgtaa

SEQ ID NO: 4039526 - DNA, 23 bp, Homo sapiens
agggaaaataaaaaaagaaaaaa

SEQ ID NO: 4039527 - DNA, 12 bp, Homo sapiens
agggaaagaaaa

SEQ ID NO: 4039528 - DNA, 19 bp, Homo sapiens
agggaaagatgtagaaaga

SEQ ID NO: 4039529 - DNA, 15 bp, Homo sapiens
agggaaaggggtgct

SEQ ID NO: 4039530 - DNA, 19 bp, Homo sapiens
agggaaaggttttgtattt

SEQ ID NO: 4039531 - DNA, 15 bp, Homo sapiens
agggaaatatcattt

SEQ ID NO: 4039532 - DNA, 16 bp, Homo sapiens
agggaactaggaaggc

SEQ ID NO: 4039533 - DNA, 23 bp, Homo sapiens
agggaagaaaactatcctgcggg

SEQ ID NO: 4039534 - DNA, 16 bp, Homo sapiens
agggaagacatttctt

SEQ ID NO: 4039535 - DNA, 14 bp, Homo sapiens
agggaagagtgcat

SEQ ID NO: 4039536 - DNA, 14 bp, Homo sapiens
agggaagctcttgg

SEQ ID NO: 4039537 - DNA, 21 bp, Homo sapiens
agggaaggggaggcagccggc

SEQ ID NO: 4039538 - DNA, 19 bp, Homo sapiens
agggaaggggggtcagaag

SEQ ID NO: 4039539 - DNA, 21 bp, Homo sapiens
agggaagtcacttcaccatca

SEQ ID NO: 4039540 - DNA, 13 bp, Homo sapiens
agggaagtgtgag

SEQ ID NO: 4039541 - DNA, 19 bp, Homo sapiens
agggacaagtggactcagg

SEQ ID NO: 4039542 - DNA, 16 bp, Homo sapiens
agggacagaggcccca

SEQ ID NO: 4039543 - DNA, 17 bp, Homo sapiens
agggacagaggccccag

SEQ ID NO: 4039544 - DNA, 21 bp, Homo sapiens
agggacagaggccccagcctc

SEQ ID NO: 4039545 - DNA, 22 bp, Homo sapiens
agggacagatgaatgccgtgga

SEQ ID NO: 4039546 - DNA, 17 bp, Homo sapiens
agggacatatcagtgac

SEQ ID NO: 4039547 - DNA, 17 bp, Homo sapiens
agggaccaactgggccc

SEQ ID NO: 4039548 - DNA, 20 bp, Homo sapiens
agggaccaccctccctgact

SEQ ID NO: 4039549 - DNA, 13 bp, Homo sapiens
agggaccatgtgt

SEQ ID NO: 4039550 - DNA, 22 bp, Homo sapiens
agggaccggtgctgcaggagtg

SEQ ID NO: 4039551 - DNA, 19 bp, Homo sapiens
agggactctgaagcctctg

SEQ ID NO: 4039552 - DNA, 22 bp, Homo sapiens
agggactctgaagcctctggga

SEQ ID NO: 4039553 - DNA, 13 bp, Homo sapiens
agggacttaaaaa

SEQ ID NO: 4039554 - DNA, 17 bp, Homo sapiens
agggacttaaaaaactt

SEQ ID NO: 4039555 - DNA, 12 bp, Homo sapiens
agggagaaaaga

SEQ ID NO: 4039556 - DNA, 16 bp, Homo sapiens
agggagaatccaaggg

SEQ ID NO: 4039557 - DNA, 20 bp, Homo sapiens
agggagacactggcccctca

SEQ ID NO: 4039558 - DNA, 22 bp, Homo sapiens
agggagacattgtttggatttc

SEQ ID NO: 4039559 - DNA, 19 bp, Homo sapiens
agtaataggagcttccagc

SEQ ID NO: 4039560 - DNA, 18 bp, Homo sapiens
agtaatatttatatattt

SEQ ID NO: 4039561 - DNA, 14 bp, Homo sapiens
agtaatcaataaag

SEQ ID NO: 4039562 - DNA, 15 bp, Homo sapiens
agtaatcaataaaga

SEQ ID NO: 4039563 - DNA, 22 bp, Homo sapiens
agtaatcaatacagacaaggtt

SEQ ID NO: 4039564 - DNA, 14 bp, Homo sapiens
agtaatcccgccac

SEQ ID NO: 4039565 - DNA, 17 bp, Homo sapiens
agtaatcccgccaccta

SEQ ID NO: 4039566 - DNA, 16 bp, Homo sapiens
agtaatggtgtagaac

SEQ ID NO: 4039567 - DNA, 19 bp, Homo sapiens
agtaatggtgtagaacact

SEQ ID NO: 4039568 - DNA, 19 bp, Homo sapiens
agtaattcaagaaaacaac

SEQ ID NO: 4039569 - DNA, 13 bp, Homo sapiens
agtaattgaaaaa

SEQ ID NO: 4039570 - DNA, 20 bp, Homo sapiens
agtaattgacatgtgccagg

SEQ ID NO: 4039571 - DNA, 16 bp, Homo sapiens
agtaattgcatttgct

SEQ ID NO: 4039572 - DNA, 17 bp, Homo sapiens
agtaattgcatttgctt

SEQ ID NO: 4039573 - DNA, 18 bp, Homo sapiens
agtaattgcatttgcttt

SEQ ID NO: 4039574 - DNA, 12 bp, Homo sapiens
agtaattgtgaa

SEQ ID NO: 4039575 - DNA, 21 bp, Homo sapiens
agtacaaatgccttaaaatgg

SEQ ID NO: 4039576 - DNA, 22 bp, Homo sapiens
agtacaaatgccttaaaatgga

SEQ ID NO: 4039577 - DNA, 14 bp, Homo sapiens
agtacaaattataa

SEQ ID NO: 4039578 - DNA, 21 bp, Homo sapiens
agtacacaataagcaaaaaca

SEQ ID NO: 4039579 - DNA, 15 bp, Homo sapiens
agtacactctgctgt

SEQ ID NO: 4039580 - DNA, 15 bp, Homo sapiens
agtacagcatgtgcc

SEQ ID NO: 4039581 - DNA, 14 bp, Homo sapiens
agtacagcggctcc

SEQ ID NO: 4039582 - DNA, 21 bp, Homo sapiens
agtacagcggctcccctctgc

SEQ ID NO: 4039583 - DNA, 23 bp, Homo sapiens
agtacagcggctcccctctgctt

SEQ ID NO: 4039584 - DNA, 18 bp, Homo sapiens
agtacatattaggaaaat

SEQ ID NO: 4039585 - DNA, 22 bp, Homo sapiens
agtacatgataaatgatagaca

SEQ ID NO: 4039586 - DNA, 19 bp, Homo sapiens
agtacatttggagacacaa

SEQ ID NO: 4039587 - DNA, 15 bp, Homo sapiens
agtaccaaagtttta

SEQ ID NO: 4039588 - DNA, 18 bp, Homo sapiens
agtaccaaagttttatca

SEQ ID NO: 4039589 - DNA, 23 bp, Homo sapiens
agtaccagtaggggcttataata

SEQ ID NO: 4039590 - DNA, 19 bp, Homo sapiens
agtaccatagtaccattta

SEQ ID NO: 4039591 - DNA, 23 bp, Homo sapiens
agtaccatagtaccatttataca

SEQ ID NO: 4039592 - DNA, 14 bp, Homo sapiens
agtaccatttatac

SEQ ID NO: 4039593 - DNA, 18 bp, Homo sapiens
agtaccctctcagctcca

SEQ ID NO: 4039594 - DNA, 15 bp, Homo sapiens
agtacctataaagta

SEQ ID NO: 4039595 - DNA, 15 bp, Homo sapiens
agtacctccaagcaa

SEQ ID NO: 4039596 - DNA, 23 bp, Homo sapiens
agtacctctcaagctagtgtttc

SEQ ID NO: 4039597 - DNA, 13 bp, Homo sapiens
agtacctgctgcc

SEQ ID NO: 4039598 - DNA, 15 bp, Homo sapiens
agtacctgctgcccc

SEQ ID NO: 4039599 - DNA, 17 bp, Homo sapiens
agtacctgctgccccag

SEQ ID NO: 4039600 - DNA, 19 bp, Homo sapiens
agtacctgctgccccagct

SEQ ID NO: 4039601 - DNA, 13 bp, Homo sapiens
agtaccttgcttc

SEQ ID NO: 4039602 - DNA, 14 bp, Homo sapiens
agtaccttgcttct

SEQ ID NO: 4039603 - DNA, 14 bp, Homo sapiens
agtacctttgtcac

SEQ ID NO: 4039604 - DNA, 19 bp, Homo sapiens
agtacgtcctgcctggcac

SEQ ID NO: 4039605 - DNA, 13 bp, Homo sapiens
agtacgttattgt

SEQ ID NO: 4039606 - DNA, 23 bp, Homo sapiens
agtactacacatttttaaattgt

SEQ ID NO: 4039607 - DNA, 23 bp, Homo sapiens
agtactagatgcatcactgggtg

SEQ ID NO: 4039608 - DNA, 12 bp, Homo sapiens
agtactatgtat

SEQ ID NO: 4039609 - DNA, 16 bp, Homo sapiens
agtactcctgcaaaat

SEQ ID NO: 4039610 - DNA, 20 bp, Homo sapiens
agtactcctgcaaaatttta

SEQ ID NO: 4039611 - DNA, 21 bp, Homo sapiens
agtactcctgcaaaattttat

SEQ ID NO: 4039612 - DNA, 15 bp, Homo sapiens
agtactccttaagaa

SEQ ID NO: 4039613 - DNA, 18 bp, Homo sapiens
agtactccttaagaacac

SEQ ID NO: 4039614 - DNA, 13 bp, Homo sapiens
agtacttaacata

SEQ ID NO: 4039615 - DNA, 18 bp, Homo sapiens
agtacttaggtaattgta

SEQ ID NO: 4039616 - DNA, 12 bp, Homo sapiens
agtacttatctt

SEQ ID NO: 4039617 - DNA, 11 bp, Homo sapiens
agtacttgaaa

SEQ ID NO: 4039618 - DNA, 23 bp, Homo sapiens
agtacttggtttttttttttctt

SEQ ID NO: 4039619 - DNA, 21 bp, Homo sapiens
agtacttgtgaaacacagctg

SEQ ID NO: 4039620 - DNA, 23 bp, Homo sapiens
agtacttgtgaaacacagctgtt

SEQ ID NO: 4039621 - DNA, 14 bp, Homo sapiens
agtacttttattaa

SEQ ID NO: 4039622 - DNA, 17 bp, Homo sapiens
agtagaaaagttgcaga

SEQ ID NO: 4039623 - DNA, 19 bp, Homo sapiens
agtagaaataaaagtgaat

SEQ ID NO: 4039624 - DNA, 19 bp, Homo sapiens
agtagaacagataatcagt

SEQ ID NO: 4039625 - DNA, 20 bp, Homo sapiens
agtagaagtcttagatgtat

SEQ ID NO: 4039626 - DNA, 15 bp, Homo sapiens
agtagaattgcattg

SEQ ID NO: 4039627 - DNA, 16 bp, Homo sapiens
agtagagtcatctcca

SEQ ID NO: 4039628 - DNA, 23 bp, Homo sapiens
agtagagtcatctccatcagctg

SEQ ID NO: 4039629 - DNA, 16 bp, Homo sapiens
agtagcaagttctaga

SEQ ID NO: 4039630 - DNA, 14 bp, Homo sapiens
agtagcatgagaga

SEQ ID NO: 4039631 - DNA, 19 bp, Homo sapiens
agtagcatgttgagccagg

SEQ ID NO: 4039632 - DNA, 18 bp, Homo sapiens
agtagcgttttttaaatg

SEQ ID NO: 4039633 - DNA, 19 bp, Homo sapiens
agtagcgttttttaaatgt

SEQ ID NO: 4039634 - DNA, 21 bp, Homo sapiens
agtagcgttttttaaatgtat

SEQ ID NO: 4039635 - DNA, 16 bp, Homo sapiens
agtagcttaagaaaaa

SEQ ID NO: 4039636 - DNA, 17 bp, Homo sapiens
agtagcttaagaaaaaa

SEQ ID NO: 4039637 - DNA, 16 bp, Homo sapiens
agtagcttgctccctg

SEQ ID NO: 4039638 - DNA, 19 bp, Homo sapiens
agtagcttgctccctgtgt

SEQ ID NO: 4039639 - DNA, 23 bp, Homo sapiens
agtagcttgctccctgtgtccac

SEQ ID NO: 4039640 - DNA, 20 bp, Homo sapiens
agtagctttccacatttgtc

SEQ ID NO: 4039641 - DNA, 18 bp, Homo sapiens
agtaggaatgtacatgaa

SEQ ID NO: 4039642 - DNA, 19 bp, Homo sapiens
agtaggtcctcaataaata

SEQ ID NO: 4039643 - DNA, 16 bp, Homo sapiens
agtagtaatagagcaa

SEQ ID NO: 4039644 - DNA, 14 bp, Homo sapiens
agtagtacttgaaa

SEQ ID NO: 4039645 - DNA, 14 bp, Homo sapiens
agtagttgtattct

SEQ ID NO: 4039646 - DNA, 21 bp, Homo sapiens
agtagttgtattcttctgtat

SEQ ID NO: 4039647 - DNA, 18 bp, Homo sapiens
agtagttttattttaata

SEQ ID NO: 4039648 - DNA, 21 bp, Homo sapiens
agtagtttttacagctgtgtt

SEQ ID NO: 4039649 - DNA, 15 bp, Homo sapiens
agtataaaaacttga

SEQ ID NO: 4039650 - DNA, 17 bp, Homo sapiens
agtataaacaaagttac

SEQ ID NO: 4039651 - DNA, 16 bp, Homo sapiens
agtataagaaatgcat

SEQ ID NO: 4039652 - DNA, 21 bp, Homo sapiens
agtatacagttcaataaactt

SEQ ID NO: 4039653 - DNA, 17 bp, Homo sapiens
agtatatcatgtaaaga

SEQ ID NO: 4039654 - DNA, 18 bp, Homo sapiens
agtatatctggacaagcc

SEQ ID NO: 4039655 - DNA, 16 bp, Homo sapiens
agtatcagtgttttaa

SEQ ID NO: 4039656 - DNA, 15 bp, Homo sapiens
agtatccttccttca

SEQ ID NO: 4039657 - DNA, 16 bp, Homo sapiens
agtatctaacatgtat

SEQ ID NO: 4039658 - DNA, 20 bp, Homo sapiens
agtatcttctatttttatca

SEQ ID NO: 4039659 - DNA, 16 bp, Homo sapiens
agtatgaataaagaca

SEQ ID NO: 4039660 - DNA, 15 bp, Homo sapiens
agtattctcagagca

SEQ ID NO: 4039661 - DNA, 22 bp, Homo sapiens
agtattctcagagcatgtgtca

SEQ ID NO: 4039662 - DNA, 17 bp, Homo sapiens
agtatttatatatttat

SEQ ID NO: 4039663 - DNA, 15 bp, Homo sapiens
agtatttatttaatg

SEQ ID NO: 4039664 - DNA, 20 bp, Homo sapiens
agtatttatttaatgttatg

SEQ ID NO: 4039665 - DNA, 21 bp, Homo sapiens
agtatttattttgtaattatg

SEQ ID NO: 4039666 - DNA, 17 bp, Homo sapiens
agtatttcagtgtagtt

SEQ ID NO: 4039667 - DNA, 20 bp, Homo sapiens
agtatttcagtgtagttaat

SEQ ID NO: 4039668 - DNA, 21 bp, Homo sapiens
agtatttcattgcctgtgtat

SEQ ID NO: 4039669 - DNA, 12 bp, Homo sapiens
agtatttctcag

SEQ ID NO: 4039670 - DNA, 12 bp, Homo sapiens
agtatttgaatt

SEQ ID NO: 4039671 - DNA, 21 bp, Homo sapiens
agtatttgaattaaaacttct

SEQ ID NO: 4039672 - DNA, 21 bp, Homo sapiens
agtatttgggaagtgaagact

SEQ ID NO: 4039673 - DNA, 14 bp, Homo sapiens
agtattttgaagtt

SEQ ID NO: 4039674 - DNA, 17 bp, Homo sapiens
agtcaaaactacaaatc

SEQ ID NO: 4039675 - DNA, 22 bp, Homo sapiens
agtcaaatgtaatgtggcttct

SEQ ID NO: 4039676 - DNA, 15 bp, Homo sapiens
agtcaaattaataat

SEQ ID NO: 4039677 - DNA, 18 bp, Homo sapiens
agtcaaattaataatctt

SEQ ID NO: 4039678 - DNA, 20 bp, Homo sapiens
agtcaaattaataatcttat

SEQ ID NO: 4039679 - DNA, 14 bp, Homo sapiens
agtcaagaagaaaa

SEQ ID NO: 4039680 - DNA, 11 bp, Homo sapiens
agtcacacagt

SEQ ID NO: 4039681 - DNA, 13 bp, Homo sapiens
agtcacacccact

SEQ ID NO: 4039682 - DNA, 16 bp, Homo sapiens
agtcacactgctagca

SEQ ID NO: 4039683 - DNA, 21 bp, Homo sapiens
agtcacccctttctgtcccac

SEQ ID NO: 4039684 - DNA, 13 bp, Homo sapiens
agtcacctgctcc

SEQ ID NO: 4039685 - DNA, 13 bp, Homo sapiens
agtcaccttttct

SEQ ID NO: 4039686 - DNA, 22 bp, Homo sapiens
agtcaccttttctgtggctggc

SEQ ID NO: 4039687 - DNA, 16 bp, Homo sapiens
agtcacgctggggctc

SEQ ID NO: 4039688 - DNA, 20 bp, Homo sapiens
agtcacgctggggctctctg

SEQ ID NO: 4039689 - DNA, 22 bp, Homo sapiens
agtcactaatatagtagatttt

SEQ ID NO: 4039690 - DNA, 13 bp, Homo sapiens
agtcactccctct

SEQ ID NO: 4039691 - DNA, 13 bp, Homo sapiens
agtcactgcacag

SEQ ID NO: 4039692 - DNA, 13 bp, Homo sapiens
agtcagaaaactt

SEQ ID NO: 4039693 - DNA, 23 bp, Homo sapiens
agtcagaaaactttaaaaaatat

SEQ ID NO: 4039694 - DNA, 23 bp, Homo sapiens
agtcagagcccctacagcattgt

SEQ ID NO: 4039695 - DNA, 15 bp, Homo sapiens
agtcagagtccagtg

SEQ ID NO: 4039696 - DNA, 21 bp, Homo sapiens
agtcagatgagcaaggacatt

SEQ ID NO: 4039697 - DNA, 20 bp, Homo sapiens
agtcagcatgcttcccagag

SEQ ID NO: 4039698 - DNA, 23 bp, Homo sapiens
agtcagcatgcttcccagaggga

SEQ ID NO: 4039699 - DNA, 16 bp, Homo sapiens
agtcaggctgcagagg

SEQ ID NO: 4039700 - DNA, 15 bp, Homo sapiens
agtcagtgtctggct

SEQ ID NO: 4039701 - DNA, 16 bp, Homo sapiens
agtcagtgttgagatg

SEQ ID NO: 4039702 - DNA, 22 bp, Homo sapiens
agtcataggttaatatttaaga

SEQ ID NO: 4039703 - DNA, 15 bp, Homo sapiens
agtcatcatcagggc

SEQ ID NO: 4039704 - DNA, 17 bp, Homo sapiens
agtcatcatcagggcct

SEQ ID NO: 4039705 - DNA, 18 bp, Homo sapiens
agtcatcatcagggcctg

SEQ ID NO: 4039706 - DNA, 19 bp, Homo sapiens
agtcatcatcagggcctgg

SEQ ID NO: 4039707 - DNA, 17 bp, Homo sapiens
agtcatccaacaagaag

SEQ ID NO: 4039708 - DNA, 13 bp, Homo sapiens
agtcatccagtct

SEQ ID NO: 4039709 - DNA, 17 bp, Homo sapiens
agtcatctccatcagct

SEQ ID NO: 4039710 - DNA, 19 bp, Homo sapiens
agtcatctgttagggcctt

SEQ ID NO: 4039711 - DNA, 17 bp, Homo sapiens
agtcatgcataaatatg

SEQ ID NO: 4039712 - DNA, 19 bp, Homo sapiens
agtcatgcataaatatgca

SEQ ID NO: 4039713 - DNA, 20 bp, Homo sapiens
agtcatgcataaatatgcag

SEQ ID NO: 4039714 - DNA, 21 bp, Homo sapiens
agtcatgcataaatatgcagt

SEQ ID NO: 4039715 - DNA, 22 bp, Homo sapiens
agtcatgcataaatatgcagtg

SEQ ID NO: 4039716 - DNA, 13 bp, Homo sapiens
agtcatgctcccc

SEQ ID NO: 4039717 - DNA, 23 bp, Homo sapiens
agtcatgctcccctgtgccagcc

SEQ ID NO: 4039718 - DNA, 22 bp, Homo sapiens
agtcatggagaatctgctgcat

SEQ ID NO: 4039719 - DNA, 21 bp, Homo sapiens
agtcatggctaatttaacacc

SEQ ID NO: 4039720 - DNA, 17 bp, Homo sapiens
agtcatggtgttgcgta

SEQ ID NO: 4039721 - DNA, 15 bp, Homo sapiens
agtcatgtgtgaaca

SEQ ID NO: 4039722 - DNA, 14 bp, Homo sapiens
agtcattagactcc

SEQ ID NO: 4039723 - DNA, 15 bp, Homo sapiens
agtcattagactcct

SEQ ID NO: 4039724 - DNA, 16 bp, Homo sapiens
agtcattagactcctc

SEQ ID NO: 4039725 - DNA, 16 bp, Homo sapiens
agtcattctaggatgt

SEQ ID NO: 4039726 - DNA, 18 bp, Homo sapiens
agtcattctaggatgtgg

SEQ ID NO: 4039727 - DNA, 18 bp, Homo sapiens
agtcattgtatgttatta

SEQ ID NO: 4039728 - DNA, 17 bp, Homo sapiens
agtcatttactaaacat

SEQ ID NO: 4039729 - DNA, 18 bp, Homo sapiens
agtcatttactaaacata

SEQ ID NO: 4039730 - DNA, 19 bp, Homo sapiens
agtccaaatgtcctccaga

SEQ ID NO: 4039731 - DNA, 18 bp, Homo sapiens
agtccagacccaagtcaa

SEQ ID NO: 4039732 - DNA, 18 bp, Homo sapiens
agtccagggtttctctgc

SEQ ID NO: 4039733 - DNA, 15 bp, Homo sapiens
agtccattctcccag

SEQ ID NO: 4039734 - DNA, 20 bp, Homo sapiens
agtccatttatatatgaaaa

SEQ ID NO: 4039735 - DNA, 20 bp, Homo sapiens
agtccatttcccacatcttt

SEQ ID NO: 4039736 - DNA, 14 bp, Homo sapiens
agtcccaaggaaag

SEQ ID NO: 4039737 - DNA, 17 bp, Homo sapiens
agtcccaaggaaagccc

SEQ ID NO: 4039738 - DNA, 20 bp, Homo sapiens
agtcccaaggaaagccccag

SEQ ID NO: 4039739 - DNA, 20 bp, Homo sapiens
agtcccagctacttgggagg

SEQ ID NO: 4039740 - DNA, 17 bp, Homo sapiens
agtcccagtattctcag

SEQ ID NO: 4039741 - DNA, 18 bp, Homo sapiens
agtccccatttctgcctc

SEQ ID NO: 4039742 - DNA, 16 bp, Homo sapiens
agtcccctcacctcct

SEQ ID NO: 4039743 - DNA, 14 bp, Homo sapiens
agtcccctccagga

SEQ ID NO: 4039744 - DNA, 21 bp, Homo sapiens
agtccctcaagccaccagatg

SEQ ID NO: 4039745 - DNA, 10 bp, Homo sapiens
agtccctccc

SEQ ID NO: 4039746 - DNA, 16 bp, Homo sapiens
agtccctccctgcctg

SEQ ID NO: 4039747 - DNA, 17 bp, Homo sapiens
agtccctccctgcctga

SEQ ID NO: 4039748 - DNA, 23 bp, Homo sapiens
agtcccttcccctccctggctcc

SEQ ID NO: 4039749 - DNA, 21 bp, Homo sapiens
agtccgacctggcctgtctgt

SEQ ID NO: 4039750 - DNA, 18 bp, Homo sapiens
agtccgcagaagccctga

SEQ ID NO: 4039751 - DNA, 18 bp, Homo sapiens
agtcctcactcccagtcc

SEQ ID NO: 4039752 - DNA, 22 bp, Homo sapiens
agtcctccagaactcttcctcc

SEQ ID NO: 4039753 - DNA, 13 bp, Homo sapiens
agtcctgactggg

SEQ ID NO: 4039754 - DNA, 16 bp, Homo sapiens
agtcctgactgggctg

SEQ ID NO: 4039755 - DNA, 22 bp, Homo sapiens
agtcctgactgggctgggtttg

SEQ ID NO: 4039756 - DNA, 15 bp, Homo sapiens
agtcctgaggagagg

SEQ ID NO: 4039757 - DNA, 13 bp, Homo sapiens
agtcctgcctggc

SEQ ID NO: 4039758 - DNA, 21 bp, Homo sapiens
agtggctcgtatcccaaatct

SEQ ID NO: 4039759 - DNA, 14 bp, Homo sapiens
agtggctgccacac

SEQ ID NO: 4039760 - DNA, 20 bp, Homo sapiens
agtggctgggtgggcccaga

SEQ ID NO: 4039761 - DNA, 15 bp, Homo sapiens
agtggcttcaaaata

SEQ ID NO: 4039762 - DNA, 17 bp, Homo sapiens
agtggcttcatctgtca

SEQ ID NO: 4039763 - DNA, 18 bp, Homo sapiens
agtggcttcccagctctg

SEQ ID NO: 4039764 - DNA, 20 bp, Homo sapiens
agtgggaaggacttggcgcg

SEQ ID NO: 4039765 - DNA, 19 bp, Homo sapiens
agtgggacagggcatggcc

SEQ ID NO: 4039766 - DNA, 19 bp, Homo sapiens
agtgggaccacatgccact

SEQ ID NO: 4039767 - DNA, 14 bp, Homo sapiens
agtgggagaaggca

SEQ ID NO: 4039768 - DNA, 13 bp, Homo sapiens
agtgggagccctg

SEQ ID NO: 4039769 - DNA, 11 bp, Homo sapiens
agtgggatggg

SEQ ID NO: 4039770 - DNA, 13 bp, Homo sapiens
agtgggatgggac

SEQ ID NO: 4039771 - DNA, 14 bp, Homo sapiens
agtgggcacctcag

SEQ ID NO: 4039772 - DNA, 16 bp, Homo sapiens
agtgggcacctcagaa

SEQ ID NO: 4039773 - DNA, 18 bp, Homo sapiens
agtgggcgttgggagcct

SEQ ID NO: 4039774 - DNA, 15 bp, Homo sapiens
agtggggaactgagg

SEQ ID NO: 4039775 - DNA, 20 bp, Homo sapiens
agtggggatggggcctccct

SEQ ID NO: 4039776 - DNA, 14 bp, Homo sapiens
agtggggtgctggg

SEQ ID NO: 4039777 - DNA, 20 bp, Homo sapiens
agtggggttatctctgtgtt

SEQ ID NO: 4039778 - DNA, 22 bp, Homo sapiens
agtggggttgcaaccactgcaa

SEQ ID NO: 4039779 - DNA, 16 bp, Homo sapiens
agtgggttattctgga

SEQ ID NO: 4039780 - DNA, 19 bp, Homo sapiens
agtggtaagctctggcttt

SEQ ID NO: 4039781 - DNA, 22 bp, Homo sapiens
agtggtcaaaccgcactcaccc

SEQ ID NO: 4039782 - DNA, 20 bp, Homo sapiens
agtggtctttcctatcatgg

SEQ ID NO: 4039783 - DNA, 13 bp, Homo sapiens
agtggtctttctg

SEQ ID NO: 4039784 - DNA, 13 bp, Homo sapiens
agtggtctttgta

SEQ ID NO: 4039785 - DNA, 16 bp, Homo sapiens
agtggtctttgtaaga

SEQ ID NO: 4039786 - DNA, 18 bp, Homo sapiens
agtggtctttgtaagagt

SEQ ID NO: 4039787 - DNA, 20 bp, Homo sapiens
agtggtgtgatctcggctca

SEQ ID NO: 4039788 - DNA, 16 bp, Homo sapiens
agtggttaggcagcaa

SEQ ID NO: 4039789 - DNA, 14 bp, Homo sapiens
agtgtaaatccttt

SEQ ID NO: 4039790 - DNA, 18 bp, Homo sapiens
agtgtaacaattgtgtag

SEQ ID NO: 4039791 - DNA, 13 bp, Homo sapiens
agtgtaacagctg

SEQ ID NO: 4039792 - DNA, 15 bp, Homo sapiens
agtgtaacagctgag

SEQ ID NO: 4039793 - DNA, 17 bp, Homo sapiens
agtgtaacagctgaggt

SEQ ID NO: 4039794 - DNA, 13 bp, Homo sapiens
agtgtaataagac

SEQ ID NO: 4039795 - DNA, 16 bp, Homo sapiens
agtgtacatagtgtaa

SEQ ID NO: 4039796 - DNA, 16 bp, Homo sapiens
agtgtaccatttgcct

SEQ ID NO: 4039797 - DNA, 14 bp, Homo sapiens
agtgtacctcctct

SEQ ID NO: 4039798 - DNA, 15 bp, Homo sapiens
agtgtacctcctctc

SEQ ID NO: 4039799 - DNA, 22 bp, Homo sapiens
agtgtacctcctctcagtgttt

SEQ ID NO: 4039800 - DNA, 13 bp, Homo sapiens
agtgtacctgtgt

SEQ ID NO: 4039801 - DNA, 17 bp, Homo sapiens
agtgtacctgtgtacat

SEQ ID NO: 4039802 - DNA, 17 bp, Homo sapiens
agtgtacttaactattc

SEQ ID NO: 4039803 - DNA, 20 bp, Homo sapiens
agtgtagaagcattccttct

SEQ ID NO: 4039804 - DNA, 18 bp, Homo sapiens
agtgtagtcaggtgctca

SEQ ID NO: 4039805 - DNA, 12 bp, Homo sapiens
agtgtatttatt

SEQ ID NO: 4039806 - DNA, 21 bp, Homo sapiens
agtgtatttttcaataaagca

SEQ ID NO: 4039807 - DNA, 16 bp, Homo sapiens
agtgtcaagtcctgac

SEQ ID NO: 4039808 - DNA, 21 bp, Homo sapiens
agtgtcacctctctcagagca

SEQ ID NO: 4039809 - DNA, 15 bp, Homo sapiens
agtgtcaggccccca

SEQ ID NO: 4039810 - DNA, 16 bp, Homo sapiens
agtgtcctccaagtgc

SEQ ID NO: 4039811 - DNA, 22 bp, Homo sapiens
agtgtcctcttccctctctgca

SEQ ID NO: 4039812 - DNA, 14 bp, Homo sapiens
agtgtccttagaac

SEQ ID NO: 4039813 - DNA, 14 bp, Homo sapiens
agtgtccttagtgt

SEQ ID NO: 4039814 - DNA, 16 bp, Homo sapiens
agtgtccttagtgtat

SEQ ID NO: 4039815 - DNA, 20 bp, Homo sapiens
agtgtctataaaagaaacac

SEQ ID NO: 4039816 - DNA, 13 bp, Homo sapiens
agtgtctggcttt

SEQ ID NO: 4039817 - DNA, 13 bp, Homo sapiens
agtgtcttccata

SEQ ID NO: 4039818 - DNA, 15 bp, Homo sapiens
agtgtcttccataat

SEQ ID NO: 4039819 - DNA, 17 bp, Homo sapiens
agtgtgaatagcctggc

SEQ ID NO: 4039820 - DNA, 16 bp, Homo sapiens
agtgtgacagggccag

SEQ ID NO: 4039821 - DNA, 13 bp, Homo sapiens
agtgtgagctctt

SEQ ID NO: 4039822 - DNA, 16 bp, Homo sapiens
agtgtgcacgagtggg

SEQ ID NO: 4039823 - DNA, 19 bp, Homo sapiens
agtgtgcacgagtgggaag

SEQ ID NO: 4039824 - DNA, 22 bp, Homo sapiens
agtgtggttatgaactttatag

SEQ ID NO: 4039825 - DNA, 11 bp, Homo sapiens
agtgtgtaaag

SEQ ID NO: 4039826 - DNA, 16 bp, Homo sapiens
agtgtgtattgttccc

SEQ ID NO: 4039827 - DNA, 19 bp, Homo sapiens
agtgtgtattgttcccagt

SEQ ID NO: 4039828 - DNA, 13 bp, Homo sapiens
agtgtgtcttcct

SEQ ID NO: 4039829 - DNA, 22 bp, Homo sapiens
agtgtgtgaactgctttcaagt

SEQ ID NO: 4039830 - DNA, 14 bp, Homo sapiens
agtgtgtgacattc

SEQ ID NO: 4039831 - DNA, 14 bp, Homo sapiens
agtgtgtgtgcaga

SEQ ID NO: 4039832 - DNA, 16 bp, Homo sapiens
agtgtgtgtgtgcatg

SEQ ID NO: 4039833 - DNA, 18 bp, Homo sapiens
agtgtgtgtgtgcatgtg

SEQ ID NO: 4039834 - DNA, 20 bp, Homo sapiens
agtgtgtgtgtgtggtccat

SEQ ID NO: 4039835 - DNA, 23 bp, Homo sapiens
agtgtgtgtgtgtggtccatgcc

SEQ ID NO: 4039836 - DNA, 15 bp, Homo sapiens
agtgtgttgttgctt

SEQ ID NO: 4039837 - DNA, 22 bp, Homo sapiens
agtgttagttataaatagcctt

SEQ ID NO: 4039838 - DNA, 16 bp, Homo sapiens
agtgttcctatttggg

SEQ ID NO: 4039839 - DNA, 20 bp, Homo sapiens
agtgttcctatttggggctt

SEQ ID NO: 4039840 - DNA, 23 bp, Homo sapiens
agtgttcctttttaaatgtgaat

SEQ ID NO: 4039841 - DNA, 13 bp, Homo sapiens
agtgttctcacag

SEQ ID NO: 4039842 - DNA, 17 bp, Homo sapiens
agtgttctgcaaaaata

SEQ ID NO: 4039843 - DNA, 18 bp, Homo sapiens
agtgttctgctcctgctt

SEQ ID NO: 4039844 - DNA, 22 bp, Homo sapiens
agtgttctgctcctgcttttct

SEQ ID NO: 4039845 - DNA, 19 bp, Homo sapiens
agtgttgagacccaggcct

SEQ ID NO: 4039846 - DNA, 15 bp, Homo sapiens
agtgttgctcagctc

SEQ ID NO: 4039847 - DNA, 16 bp, Homo sapiens
agtgttgtgttcctgg

SEQ ID NO: 4039848 - DNA, 17 bp, Homo sapiens
agtgttgtgttcctggc

SEQ ID NO: 4039849 - DNA, 18 bp, Homo sapiens
agtgttgtgttcctggct

SEQ ID NO: 4039850 - DNA, 20 bp, Homo sapiens
agtgtttcagctaagggaag

SEQ ID NO: 4039851 - DNA, 21 bp, Homo sapiens
agtgtttcagctaagggaaga

SEQ ID NO: 4039852 - DNA, 16 bp, Homo sapiens
agtgtttcccataatt

SEQ ID NO: 4039853 - DNA, 17 bp, Homo sapiens
agtgttttaaattctga

SEQ ID NO: 4039854 - DNA, 16 bp, Homo sapiens
agtgttttattttcaa

SEQ ID NO: 4039855 - DNA, 13 bp, Homo sapiens
agtgttttctggg

SEQ ID NO: 4039856 - DNA, 22 bp, Homo sapiens
agtgttttggactccatctctc

SEQ ID NO: 4039857 - DNA, 21 bp, Homo sapiens
agttaaaagaatgtaaaatat

SEQ ID NO: 4039858 - DNA, 21 bp, Homo sapiens
agttaaatagagtatatgcac

SEQ ID NO: 4039859 - DNA, 23 bp, Homo sapiens
agttaaatagagtatatgcactt

SEQ ID NO: 4039860 - DNA, 14 bp, Homo sapiens
agttaacaaggaat

SEQ ID NO: 4039861 - DNA, 16 bp, Homo sapiens
agttaacaaggaatgc

SEQ ID NO: 4039862 - DNA, 17 bp, Homo sapiens
agttaacaaggaatgcc

SEQ ID NO: 4039863 - DNA, 23 bp, Homo sapiens
agttaacaaggaatgcctgtgcc

SEQ ID NO: 4039864 - DNA, 20 bp, Homo sapiens
agttaacacaatgtgaattt

SEQ ID NO: 4039865 - DNA, 20 bp, Homo sapiens
agttaactattgcatttata

SEQ ID NO: 4039866 - DNA, 18 bp, Homo sapiens
agttaactttaagactga

SEQ ID NO: 4039867 - DNA, 12 bp, Homo sapiens
agttaagaagct

SEQ ID NO: 4039868 - DNA, 19 bp, Homo sapiens
agttaagagaaactttata

SEQ ID NO: 4039869 - DNA, 11 bp, Homo sapiens
agttaataatg

SEQ ID NO: 4039870 - DNA, 15 bp, Homo sapiens
agttaatattgtgaa

SEQ ID NO: 4039871 - DNA, 14 bp, Homo sapiens
agttaatgagccat

SEQ ID NO: 4039872 - DNA, 15 bp, Homo sapiens
agttaatttatctaa

SEQ ID NO: 4039873 - DNA, 22 bp, Homo sapiens
agttacacagaaatgctgctgg

SEQ ID NO: 4039874 - DNA, 20 bp, Homo sapiens
agttacagcctgttagtaac

SEQ ID NO: 4039875 - DNA, 18 bp, Homo sapiens
cacaaggatagatgctgg

SEQ ID NO: 4039876 - DNA, 22 bp, Homo sapiens
cacaaggatagatgctggccca

SEQ ID NO: 4039877 - DNA, 12 bp, Homo sapiens
cacaaggctggc

SEQ ID NO: 4039878 - DNA, 22 bp, Homo sapiens
cacaagtgccactgcccgagct

SEQ ID NO: 4039879 - DNA, 12 bp, Homo sapiens
cacaagtggtgt

SEQ ID NO: 4039880 - DNA, 21 bp, Homo sapiens
cacaatccctggggctgtgca

SEQ ID NO: 4039881 - DNA, 22 bp, Homo sapiens
cacaatcctaacacattatcgg

SEQ ID NO: 4039882 - DNA, 22 bp, Homo sapiens
cacaatgatgattaaacacctg

SEQ ID NO: 4039883 - DNA, 23 bp, Homo sapiens
cacaatgatgattaaacacctga

SEQ ID NO: 4039884 - DNA, 16 bp, Homo sapiens
cacaatgtcagtattt

SEQ ID NO: 4039885 - DNA, 18 bp, Homo sapiens
cacaatgtcagtatttca

SEQ ID NO: 4039886 - DNA, 16 bp, Homo sapiens
cacaattgttttacct

SEQ ID NO: 4039887 - DNA, 15 bp, Homo sapiens
cacacaaaaaaagac

SEQ ID NO: 4039888 - DNA, 18 bp, Homo sapiens
cacacaaaccttctgcct

SEQ ID NO: 4039889 - DNA, 18 bp, Homo sapiens
cacacaagaagaagggca

SEQ ID NO: 4039890 - DNA, 17 bp, Homo sapiens
cacacacaaaaaaagac

SEQ ID NO: 4039891 - DNA, 14 bp, Homo sapiens
cacacacaaacctt

SEQ ID NO: 4039892 - DNA, 11 bp, Homo sapiens
cacacacacaa

SEQ ID NO: 4039893 - DNA, 13 bp, Homo sapiens
cacacacacacac

SEQ ID NO: 4039894 - DNA, 16 bp, Homo sapiens
cacacacacacacagg

SEQ ID NO: 4039895 - DNA, 15 bp, Homo sapiens
cacacacacacactg

SEQ ID NO: 4039896 - DNA, 13 bp, Homo sapiens
cacacacacgcac

SEQ ID NO: 4039897 - DNA, 13 bp, Homo sapiens
cacacacagcccc

SEQ ID NO: 4039898 - DNA, 13 bp, Homo sapiens
cacacacccaggc

SEQ ID NO: 4039899 - DNA, 15 bp, Homo sapiens
cacacacccaggccc

SEQ ID NO: 4039900 - DNA, 18 bp, Homo sapiens
cacacaccctgaggtcag

SEQ ID NO: 4039901 - DNA, 14 bp, Homo sapiens
cacacacctccgag

SEQ ID NO: 4039902 - DNA, 16 bp, Homo sapiens
cacacacgcacgcaca

SEQ ID NO: 4039903 - DNA, 18 bp, Homo sapiens
cacacacgcacgcacaca

SEQ ID NO: 4039904 - DNA, 19 bp, Homo sapiens
cacacacgctttcttatgc

SEQ ID NO: 4039905 - DNA, 21 bp, Homo sapiens
cacacagaggctgcctctccc

SEQ ID NO: 4039906 - DNA, 15 bp, Homo sapiens
cacacagagtggtct

SEQ ID NO: 4039907 - DNA, 18 bp, Homo sapiens
cacacagatacacacaca

SEQ ID NO: 4039908 - DNA, 12 bp, Homo sapiens
cacacagcactc

SEQ ID NO: 4039909 - DNA, 14 bp, Homo sapiens
cacacagcactctc

SEQ ID NO: 4039910 - DNA, 15 bp, Homo sapiens
cacacagcagcagtt

SEQ ID NO: 4039911 - DNA, 21 bp, Homo sapiens
cacacagcagccccccagcac

SEQ ID NO: 4039912 - DNA, 14 bp, Homo sapiens
cacacagctgagca

SEQ ID NO: 4039913 - DNA, 16 bp, Homo sapiens
cacacagctgagcact

SEQ ID NO: 4039914 - DNA, 17 bp, Homo sapiens
cacacagctgagcactt

SEQ ID NO: 4039915 - DNA, 13 bp, Homo sapiens
cacacagctgggc

SEQ ID NO: 4039916 - DNA, 15 bp, Homo sapiens
cacacagctgggcaa

SEQ ID NO: 4039917 - DNA, 16 bp, Homo sapiens
cacacatgggcagccc

SEQ ID NO: 4039918 - DNA, 19 bp, Homo sapiens
cacacattcccccaccagc

SEQ ID NO: 4039919 - DNA, 18 bp, Homo sapiens
cacaccacaattctccct

SEQ ID NO: 4039920 - DNA, 22 bp, Homo sapiens
cacaccagccttggtgccacca

SEQ ID NO: 4039921 - DNA, 19 bp, Homo sapiens
cacaccaggctgtgggcct

SEQ ID NO: 4039922 - DNA, 21 bp, Homo sapiens
cacaccaggctgtgggcctca

SEQ ID NO: 4039923 - DNA, 22 bp, Homo sapiens
cacaccaggctgtgggcctcaa

SEQ ID NO: 4039924 - DNA, 16 bp, Homo sapiens
cacaccagtcacatga

SEQ ID NO: 4039925 - DNA, 13 bp, Homo sapiens
cacacccactccc

SEQ ID NO: 4039926 - DNA, 23 bp, Homo sapiens
cacacccaggcacttaagcacaa

SEQ ID NO: 4039927 - DNA, 22 bp, Homo sapiens
cacacccaggcccatgccaagg

SEQ ID NO: 4039928 - DNA, 14 bp, Homo sapiens
cacaccccacaccc

SEQ ID NO: 4039929 - DNA, 17 bp, Homo sapiens
cacacccctgtcccacc

SEQ ID NO: 4039930 - DNA, 21 bp, Homo sapiens
cacaccctcccccgccactcc

SEQ ID NO: 4039931 - DNA, 12 bp, Homo sapiens
cacaccctgagg

SEQ ID NO: 4039932 - DNA, 13 bp, Homo sapiens
cacaccctgaggt

SEQ ID NO: 4039933 - DNA, 21 bp, Homo sapiens
cacaccctgaggtcagggagt

SEQ ID NO: 4039934 - DNA, 18 bp, Homo sapiens
cacacctcagttcccttg

SEQ ID NO: 4039935 - DNA, 16 bp, Homo sapiens
cacacctgaacttgcc

SEQ ID NO: 4039936 - DNA, 15 bp, Homo sapiens
cacacgcacaaacac

SEQ ID NO: 4039937 - DNA, 18 bp, Homo sapiens
cacacgcacaaacacaca

SEQ ID NO: 4039938 - DNA, 22 bp, Homo sapiens
cacacgcacaaacacacacact

SEQ ID NO: 4039939 - DNA, 21 bp, Homo sapiens
cacacgcaggaactcccagca

SEQ ID NO: 4039940 - DNA, 19 bp, Homo sapiens
cacacgcctgtaatcccag

SEQ ID NO: 4039941 - DNA, 23 bp, Homo sapiens
cacacggactcccgggccacgcc

SEQ ID NO: 4039942 - DNA, 18 bp, Homo sapiens
cacactaatctgaaagga

SEQ ID NO: 4039943 - DNA, 21 bp, Homo sapiens
cacactacagagcagctcccc

SEQ ID NO: 4039944 - DNA, 17 bp, Homo sapiens
cacactagcctctccag

SEQ ID NO: 4039945 - DNA, 20 bp, Homo sapiens
cacactataaggctgagggc

SEQ ID NO: 4039946 - DNA, 18 bp, Homo sapiens
cacactattaccatgaga

SEQ ID NO: 4039947 - DNA, 19 bp, Homo sapiens
cacactattaccatgagaa

SEQ ID NO: 4039948 - DNA, 20 bp, Homo sapiens
cacactcaggcctgtgccca

SEQ ID NO: 4039949 - DNA, 13 bp, Homo sapiens
cacactccctgct

SEQ ID NO: 4039950 - DNA, 15 bp, Homo sapiens
cacactccctgcttg

SEQ ID NO: 4039951 - DNA, 13 bp, Homo sapiens
cacactgctctta

SEQ ID NO: 4039952 - DNA, 16 bp, Homo sapiens
cacactggtacttaga

SEQ ID NO: 4039953 - DNA, 18 bp, Homo sapiens
cacactggtacttagagt

SEQ ID NO: 4039954 - DNA, 15 bp, Homo sapiens
cacactgttactcca

SEQ ID NO: 4039955 - DNA, 18 bp, Homo sapiens
cacactgttactccacag

SEQ ID NO: 4039956 - DNA, 14 bp, Homo sapiens
cacacttcaggctc

SEQ ID NO: 4039957 - DNA, 15 bp, Homo sapiens
cacacttctgtgaga

SEQ ID NO: 4039958 - DNA, 19 bp, Homo sapiens
cacacttgagaggatgaat

SEQ ID NO: 4039959 - DNA, 14 bp, Homo sapiens
cacacttgctgggg

SEQ ID NO: 4039960 - DNA, 22 bp, Homo sapiens
cacacttgtaggataagtgaaa

SEQ ID NO: 4039961 - DNA, 18 bp, Homo sapiens
cacacttgtcggctccag

SEQ ID NO: 4039962 - DNA, 16 bp, Homo sapiens
cacacttgttccagct

SEQ ID NO: 4039963 - DNA, 19 bp, Homo sapiens
cacacttgttccagctctt

SEQ ID NO: 4039964 - DNA, 14 bp, Homo sapiens
cacagaaaaagcat

SEQ ID NO: 4039965 - DNA, 14 bp, Homo sapiens
cacagaaaagcata

SEQ ID NO: 4039966 - DNA, 16 bp, Homo sapiens
cacagaaaccaatttt

SEQ ID NO: 4039967 - DNA, 14 bp, Homo sapiens
cacagaaatgctgc

SEQ ID NO: 4039968 - DNA, 18 bp, Homo sapiens
cacagaaatgctgctggc

SEQ ID NO: 4039969 - DNA, 15 bp, Homo sapiens
cacagaaccttcaac

SEQ ID NO: 4039970 - DNA, 23 bp, Homo sapiens
cacagaagcctaggaggactggg

SEQ ID NO: 4039971 - DNA, 20 bp, Homo sapiens
cagcagccccgtctgcccac

SEQ ID NO: 4039972 - DNA, 22 bp, Homo sapiens
cagcagccccgtctgcccacca

SEQ ID NO: 4039973 - DNA, 11 bp, Homo sapiens
cagcagcccta

SEQ ID NO: 4039974 - DNA, 20 bp, Homo sapiens
cagcagccctaaggatctct

SEQ ID NO: 4039975 - DNA, 24 bp, Homo sapiens
cagcagccctaaggatctctcagg

SEQ ID NO: 4039976 - DNA, 13 bp, Homo sapiens
cagcagccctcaa

SEQ ID NO: 4039977 - DNA, 18 bp, Homo sapiens
cagcagccctcaacaggc

SEQ ID NO: 4039978 - DNA, 21 bp, Homo sapiens
cagcagccctcaacaggccca

SEQ ID NO: 4039979 - DNA, 17 bp, Homo sapiens
cagcagcctttaatgca

SEQ ID NO: 4039980 - DNA, 17 bp, Homo sapiens
cagcagcttcaccagag

SEQ ID NO: 4039981 - DNA, 18 bp, Homo sapiens
cagcagcttcaccagagc

SEQ ID NO: 4039982 - DNA, 14 bp, Homo sapiens
cagcaggaagccag

SEQ ID NO: 4039983 - DNA, 11 bp, Homo sapiens
cagcaggagag

SEQ ID NO: 4039984 - DNA, 19 bp, Homo sapiens
cagcaggagagactgagca

SEQ ID NO: 4039985 - DNA, 21 bp, Homo sapiens
cagcaggagagactgagcagc

SEQ ID NO: 4039986 - DNA, 11 bp, Homo sapiens
cagcaggcagc

SEQ ID NO: 4039987 - DNA, 13 bp, Homo sapiens
cagcaggcagcct

SEQ ID NO: 4039988 - DNA, 15 bp, Homo sapiens
cagcaggcagccttg

SEQ ID NO: 4039989 - DNA, 16 bp, Homo sapiens
cagcaggcagcgccaa

SEQ ID NO: 4039990 - DNA, 20 bp, Homo sapiens
cagcagggtagtctggtttc

SEQ ID NO: 4039991 - DNA, 23 bp, Homo sapiens
cagcagtcccagtattctcagag

SEQ ID NO: 4039992 - DNA, 19 bp, Homo sapiens
cagcagtcctttgtaaaca

SEQ ID NO: 4039993 - DNA, 20 bp, Homo sapiens
cagcagtcttatgcttccag

SEQ ID NO: 4039994 - DNA, 15 bp, Homo sapiens
cagcagtgaccacac

SEQ ID NO: 4039995 - DNA, 21 bp, Homo sapiens
cagcagtgagtctcttcagaa

SEQ ID NO: 4039996 - DNA, 20 bp, Homo sapiens
cagcagtgatctcagggcag

SEQ ID NO: 4039997 - DNA, 14 bp, Homo sapiens
cagcagtgtggaga

SEQ ID NO: 4039998 - DNA, 19 bp, Homo sapiens
cagcagtgtggagaccctg

SEQ ID NO: 4039999 - DNA, 17 bp, Homo sapiens
cagcagtgttccccatc

SEQ ID NO: 4040000 - DNA, 13 bp, Homo sapiens
cagcagtgttctc

SEQ ID NO: 4040001 - DNA, 18 bp, Homo sapiens
cagcagtgttctcacagt

SEQ ID NO: 4040002 - DNA, 19 bp, Homo sapiens
cagcagtttccgaggctga

SEQ ID NO: 4040003 - DNA, 19 bp, Homo sapiens
cagcatagcaagacacatc

SEQ ID NO: 4040004 - DNA, 17 bp, Homo sapiens
cagcatcactccccaag

SEQ ID NO: 4040005 - DNA, 20 bp, Homo sapiens
cagcatcatggaggtttgaa

SEQ ID NO: 4040006 - DNA, 22 bp, Homo sapiens
cagcatccaccttggctctgcc

SEQ ID NO: 4040007 - DNA, 13 bp, Homo sapiens
cagcatccctgga

SEQ ID NO: 4040008 - DNA, 14 bp, Homo sapiens
cacgaccggggcca

SEQ ID NO: 4040009 - DNA, 15 bp, Homo sapiens
cacgacgctgcagag

SEQ ID NO: 4040010 - DNA, 18 bp, Homo sapiens
cacgagagcgcagcatcc

SEQ ID NO: 4040011 - DNA, 13 bp, Homo sapiens
cacgagggctggc

SEQ ID NO: 4040012 - DNA, 15 bp, Homo sapiens
cacgaggtcaggaga

SEQ ID NO: 4040013 - DNA, 12 bp, Homo sapiens
cacgatgaaaaa

SEQ ID NO: 4040014 - DNA, 14 bp, Homo sapiens
cacgattggagaat

SEQ ID NO: 4040015 - DNA, 19 bp, Homo sapiens
cacgattggagaatacttt

SEQ ID NO: 4040016 - DNA, 14 bp, Homo sapiens
cacgcacaaacaca

SEQ ID NO: 4040017 - DNA, 15 bp, Homo sapiens
cacgcacaaacacac

SEQ ID NO: 4040018 - DNA, 20 bp, Homo sapiens
cacgcacaaacacacacact

SEQ ID NO: 4040019 - DNA, 13 bp, Homo sapiens
cacgcacacacac

SEQ ID NO: 4040020 - DNA, 12 bp, Homo sapiens
cacgcacctgcc

SEQ ID NO: 4040021 - DNA, 15 bp, Homo sapiens
cacgcacctgcctca

SEQ ID NO: 4040022 - DNA, 16 bp, Homo sapiens
cacgcacgcacacaca

SEQ ID NO: 4040023 - DNA, 14 bp, Homo sapiens
cacgcactgggcca

SEQ ID NO: 4040024 - DNA, 16 bp, Homo sapiens
cacgcactgggccacg

SEQ ID NO: 4040025 - DNA, 14 bp, Homo sapiens
cacgccccagcccg

SEQ ID NO: 4040026 - DNA, 18 bp, Homo sapiens
cacgccccagcccgacaa

SEQ ID NO: 4040027 - DNA, 13 bp, Homo sapiens
cacgcctcctggc

SEQ ID NO: 4040028 - DNA, 16 bp, Homo sapiens
cacgcctcctggccag

SEQ ID NO: 4040029 - DNA, 18 bp, Homo sapiens
cacgcctgtaatcccagc

SEQ ID NO: 4040030 - DNA, 15 bp, Homo sapiens
cacgccttcccctca

SEQ ID NO: 4040031 - DNA, 16 bp, Homo sapiens
cacgccttcccctcag

SEQ ID NO: 4040032 - DNA, 21 bp, Homo sapiens
cacgctcacccagtcacctcc

SEQ ID NO: 4040033 - DNA, 12 bp, Homo sapiens
cacgctccagct

SEQ ID NO: 4040034 - DNA, 14 bp, Homo sapiens
cacgctccagctgc

SEQ ID NO: 4040035 - DNA, 15 bp, Homo sapiens
cacgctccagctgcc

SEQ ID NO: 4040036 - DNA, 19 bp, Homo sapiens
cacgctccagctgccccgg

SEQ ID NO: 4040037 - DNA, 16 bp, Homo sapiens
cacgctcgcgggcagc

SEQ ID NO: 4040038 - DNA, 14 bp, Homo sapiens
cacgctgtcctctc

SEQ ID NO: 4040039 - DNA, 23 bp, Homo sapiens
cacgctgtcctctcgagcccaga

SEQ ID NO: 4040040 - DNA, 17 bp, Homo sapiens
cacgctttctagctgtt

SEQ ID NO: 4040041 - DNA, 15 bp, Homo sapiens
cacggctgagccttc

SEQ ID NO: 4040042 - DNA, 18 bp, Homo sapiens
cacggggttccctcctag

SEQ ID NO: 4040043 - DNA, 15 bp, Homo sapiens
cacggtagtgcctga

SEQ ID NO: 4040044 - DNA, 17 bp, Homo sapiens
cacggtatttatagaga

SEQ ID NO: 4040045 - DNA, 17 bp, Homo sapiens
cacggtcacacggccac

SEQ ID NO: 4040046 - DNA, 18 bp, Homo sapiens
cacgtctggccaggcact

SEQ ID NO: 4040047 - DNA, 20 bp, Homo sapiens
cacgtcttcttgctgcagcc

SEQ ID NO: 4040048 - DNA, 17 bp, Homo sapiens
cacgtcttggtgccttt

SEQ ID NO: 4040049 - DNA, 18 bp, Homo sapiens
cacgtgacagtgcctggg

SEQ ID NO: 4040050 - DNA, 14 bp, Homo sapiens
cacgtgcaaggact

SEQ ID NO: 4040051 - DNA, 23 bp, Homo sapiens
cacgtggagagctggtgcccgga

SEQ ID NO: 4040052 - DNA, 18 bp, Homo sapiens
cacgtggcctcttgagca

SEQ ID NO: 4040053 - DNA, 23 bp, Homo sapiens
cacgtggcctcttgagcagtggc

SEQ ID NO: 4040054 - DNA, 23 bp, Homo sapiens
cacgtggttggggccctgccctg

SEQ ID NO: 4040055 - DNA, 14 bp, Homo sapiens
cacgtgtcttccac

SEQ ID NO: 4040056 - DNA, 16 bp, Homo sapiens
cacgttcataaccaac

SEQ ID NO: 4040057 - DNA, 16 bp, Homo sapiens
cacgttgcctctactt

SEQ ID NO: 4040058 - DNA, 18 bp, Homo sapiens
cacgttggccggcggcta

SEQ ID NO: 4040059 - DNA, 14 bp, Homo sapiens
cactaaaattttag

SEQ ID NO: 4040060 - DNA, 19 bp, Homo sapiens
cactaaaccgataatgcat

SEQ ID NO: 4040061 - DNA, 18 bp, Homo sapiens
cactaaagccagcctgac

SEQ ID NO: 4040062 - DNA, 18 bp, Homo sapiens
cactaaagcttcagactc

SEQ ID NO: 4040063 - DNA, 21 bp, Homo sapiens
cactaacatttcccccgagct

SEQ ID NO: 4040064 - DNA, 22 bp, Homo sapiens
cactaaccaagctgagtttcct

SEQ ID NO: 4040065 - DNA, 21 bp, Homo sapiens
cactaagagaaaattgcacta

SEQ ID NO: 4040066 - DNA, 11 bp, Homo sapiens
cactaattcat

SEQ ID NO: 4040067 - DNA, 21 bp, Homo sapiens
cactaattttagtattcattc

SEQ ID NO: 4040068 - DNA, 21 bp, Homo sapiens
cactacaagtcagctccagct

SEQ ID NO: 4040069 - DNA, 16 bp, Homo sapiens
cactacaccttgcctt

SEQ ID NO: 4040070 - DNA, 18 bp, Homo sapiens
cactacagagcagctccc

SEQ ID NO: 4040071 - DNA, 21 bp, Homo sapiens
cactacaggtgaaggctctca

SEQ ID NO: 4040072 - DNA, 22 bp, Homo sapiens
cactacaggtgaaggctctcac

SEQ ID NO: 4040073 - DNA, 19 bp, Homo sapiens
cactacataaactgacttt

SEQ ID NO: 4040074 - DNA, 22 bp, Homo sapiens
cactaccaaaggacacttatcc

SEQ ID NO: 4040075 - DNA, 21 bp, Homo sapiens
cactaccacgccaagctaatt

SEQ ID NO: 4040076 - DNA, 14 bp, Homo sapiens
cactaccccacacc

SEQ ID NO: 4040077 - DNA, 21 bp, Homo sapiens
cactaccccacaccagccttg

SEQ ID NO: 4040078 - DNA, 19 bp, Homo sapiens
cactaccccatatacacct

SEQ ID NO: 4040079 - DNA, 15 bp, Homo sapiens
cactactgacatgtg

SEQ ID NO: 4040080 - DNA, 16 bp, Homo sapiens
cactactgcagcacct

SEQ ID NO: 4040081 - DNA, 17 bp, Homo sapiens
cactactgcagcacctc

SEQ ID NO: 4040082 - DNA, 12 bp, Homo sapiens
cactactgggtg

SEQ ID NO: 4040083 - DNA, 13 bp, Homo sapiens
cactactgggtgt

SEQ ID NO: 4040084 - DNA, 22 bp, Homo sapiens
cactactgggtgtcatttcatt

SEQ ID NO: 4040085 - DNA, 17 bp, Homo sapiens
cactagaactctccatc

SEQ ID NO: 4040086 - DNA, 13 bp, Homo sapiens
cactagaagaaaa

SEQ ID NO: 4040087 - DNA, 18 bp, Homo sapiens
cactagaagaaaagccca

SEQ ID NO: 4040088 - DNA, 20 bp, Homo sapiens
cactagaagaaaagcccatt

SEQ ID NO: 4040089 - DNA, 13 bp, Homo sapiens
cactagaatggat

SEQ ID NO: 4040090 - DNA, 21 bp, Homo sapiens
cactagcctctccaggaatgc

SEQ ID NO: 4040091 - DNA, 12 bp, Homo sapiens
cactagtgccaa

SEQ ID NO: 4040092 - DNA, 16 bp, Homo sapiens
cactagtgtcaggccc

SEQ ID NO: 4040093 - DNA, 12 bp, Homo sapiens
cactataaatgg

SEQ ID NO: 4040094 - DNA, 18 bp, Homo sapiens
cactataatgtaagctct

SEQ ID NO: 4040095 - DNA, 14 bp, Homo sapiens
cactatctttctga

SEQ ID NO: 4040096 - DNA, 14 bp, Homo sapiens
cactatgaagatgt

SEQ ID NO: 4040097 - DNA, 19 bp, Homo sapiens
cagagaagcggatttccag

SEQ ID NO: 4040098 - DNA, 11 bp, Homo sapiens
cagagaagttc

SEQ ID NO: 4040099 - DNA, 15 bp, Homo sapiens
cagagaattctctta

SEQ ID NO: 4040100 - DNA, 22 bp, Homo sapiens
cagagacaaatatttctagaca

SEQ ID NO: 4040101 - DNA, 21 bp, Homo sapiens
cagagacagctgatacttcat

SEQ ID NO: 4040102 - DNA, 16 bp, Homo sapiens
cagagaccaggctgtg

SEQ ID NO: 4040103 - DNA, 17 bp, Homo sapiens
cagagacccaacagcag

SEQ ID NO: 4040104 - DNA, 13 bp, Homo sapiens
cagagacgcccag

SEQ ID NO: 4040105 - DNA, 15 bp, Homo sapiens
cagagacgcccagcc

SEQ ID NO: 4040106 - DNA, 16 bp, Homo sapiens
cagagacgcccagccc

SEQ ID NO: 4040107 - DNA, 18 bp, Homo sapiens
cagagacgcccagcccca

SEQ ID NO: 4040108 - DNA, 20 bp, Homo sapiens
cagagacgcccagccccatc

SEQ ID NO: 4040109 - DNA, 18 bp, Homo sapiens
cagagactgcaagctgct

SEQ ID NO: 4040110 - DNA, 15 bp, Homo sapiens
cagagagacagactt

SEQ ID NO: 4040111 - DNA, 17 bp, Homo sapiens
cagagagacagacttga

SEQ ID NO: 4040112 - DNA, 13 bp, Homo sapiens
cagagagagagaa

SEQ ID NO: 4040113 - DNA, 17 bp, Homo sapiens
cagagagagaggacaga

SEQ ID NO: 4040114 - DNA, 15 bp, Homo sapiens
cagagagcaaggcat

SEQ ID NO: 4040115 - DNA, 21 bp, Homo sapiens
cagagagccattttgtgaatg

SEQ ID NO: 4040116 - DNA, 13 bp, Homo sapiens
cagagagctggta

SEQ ID NO: 4040117 - DNA, 19 bp, Homo sapiens
cagagagctggtagttagt

SEQ ID NO: 4040118 - DNA, 20 bp, Homo sapiens
cagagagcttaaattgtcat

SEQ ID NO: 4040119 - DNA, 13 bp, Homo sapiens
cagagaggagaaa

SEQ ID NO: 4040120 - DNA, 21 bp, Homo sapiens
cagagaggagaaacacatctt

SEQ ID NO: 4040121 - DNA, 16 bp, Homo sapiens
cagagataaagacctt

SEQ ID NO: 4040122 - DNA, 23 bp, Homo sapiens
cagagatccaaaagaagccccca

SEQ ID NO: 4040123 - DNA, 14 bp, Homo sapiens
cagagatgtgcacc

SEQ ID NO: 4040124 - DNA, 15 bp, Homo sapiens
caagagcagcctgtg

SEQ ID NO: 4040125 - DNA, 14 bp, Homo sapiens
caagagctgccctc

SEQ ID NO: 4040126 - DNA, 18 bp, Homo sapiens
caagagctgccctccttg

SEQ ID NO: 4040127 - DNA, 20 bp, Homo sapiens
caagagctgccctccttgtc

SEQ ID NO: 4040128 - DNA, 23 bp, Homo sapiens
caagaggcagagttctgtgaaga

SEQ ID NO: 4040129 - DNA, 14 bp, Homo sapiens
caagagggcactgg

SEQ ID NO: 4040130 - DNA, 15 bp, Homo sapiens
caagagggggtggag

SEQ ID NO: 4040131 - DNA, 21 bp, Homo sapiens
caagagggtgacagcttcctt

SEQ ID NO: 4040132 - DNA, 15 bp, Homo sapiens
caagaggtgggaggg

SEQ ID NO: 4040133 - DNA, 20 bp, Homo sapiens
caagagtaactttactctgt

SEQ ID NO: 4040134 - DNA, 18 bp, Homo sapiens
caagagtgattgcagctt

SEQ ID NO: 4040135 - DNA, 15 bp, Homo sapiens
caagataactgagaa

SEQ ID NO: 4040136 - DNA, 15 bp, Homo sapiens
caagatattgtacat

SEQ ID NO: 4040137 - DNA, 17 bp, Homo sapiens
caagatattgtacataa

SEQ ID NO: 4040138 - DNA, 16 bp, Homo sapiens
caagatatttatatat

SEQ ID NO: 4040139 - DNA, 19 bp, Homo sapiens
caagatccatttgcctttc

SEQ ID NO: 4040140 - DNA, 20 bp, Homo sapiens
caagatccatttgcctttct

SEQ ID NO: 4040141 - DNA, 22 bp, Homo sapiens
caagatccatttgcctttctgg

SEQ ID NO: 4040142 - DNA, 22 bp, Homo sapiens
caagatcctgtctttaaggaaa

SEQ ID NO: 4040143 - DNA, 16 bp, Homo sapiens
caagatcgcgccactg

SEQ ID NO: 4040144 - DNA, 18 bp, Homo sapiens
caagatcttgtctccact

SEQ ID NO: 4040145 - DNA, 15 bp, Homo sapiens
caagatgaaataatt

SEQ ID NO: 4040146 - DNA, 19 bp, Homo sapiens
caagatgaaataatttttc

SEQ ID NO: 4040147 - DNA, 18 bp, Homo sapiens
caagatgaaggagaggca

SEQ ID NO: 4040148 - DNA, 15 bp, Homo sapiens
caagatgactggggt

SEQ ID NO: 4040149 - DNA, 16 bp, Homo sapiens
caagatggaaaggatt

SEQ ID NO: 4040150 - DNA, 14 bp, Homo sapiens
caagatggtccatt

SEQ ID NO: 4040151 - DNA, 23 bp, Homo sapiens
caagatggtccatttgttcctgc

SEQ ID NO: 4040152 - DNA, 19 bp, Homo sapiens
caagcaaaccaatggtgat

SEQ ID NO: 4040153 - DNA, 19 bp, Homo sapiens
caagcaaaggtgaagagac

SEQ ID NO: 4040154 - DNA, 15 bp, Homo sapiens
caagcaacatttgta

SEQ ID NO: 4040155 - DNA, 16 bp, Homo sapiens
caagcaatcctcctgc

SEQ ID NO: 4040156 - DNA, 21 bp, Homo sapiens
caagcaatcctcctgcctcag

SEQ ID NO: 4040157 - DNA, 15 bp, Homo sapiens
caagcacagagcctg

SEQ ID NO: 4040158 - DNA, 22 bp, Homo sapiens
caagcacagagcctggccccag

SEQ ID NO: 4040159 - DNA, 13 bp, Homo sapiens
caagcacagcagc

SEQ ID NO: 4040160 - DNA, 17 bp, Homo sapiens
caagcacagcagcctgg

SEQ ID NO: 4040161 - DNA, 18 bp, Homo sapiens
caagcagagtgcacagct

SEQ ID NO: 4040162 - DNA, 21 bp, Homo sapiens
caagcagagtgcacagctgtc

SEQ ID NO: 4040163 - DNA, 16 bp, Homo sapiens
caagcagctgaagaaa

SEQ ID NO: 4040164 - DNA, 19 bp, Homo sapiens
caagcagctgaagaaaaaa

SEQ ID NO: 4040165 - DNA, 15 bp, Homo sapiens
caagcaggacctggc

SEQ ID NO: 4040166 - DNA, 12 bp, Homo sapiens
caagcaggaggc

SEQ ID NO: 4040167 - DNA, 15 bp, Homo sapiens
caagcaggcactgta

SEQ ID NO: 4040168 - DNA, 20 bp, Homo sapiens
caagccaacttgtaaataca

SEQ ID NO: 4040169 - DNA, 20 bp, Homo sapiens
caagccacaagtcttccaga

SEQ ID NO: 4040170 - DNA, 15 bp, Homo sapiens
caagccacaggaagg

SEQ ID NO: 4040171 - DNA, 14 bp, Homo sapiens
caagccagacctag

SEQ ID NO: 4040172 - DNA, 21 bp, Homo sapiens
caagccagacctagcaggctg

SEQ ID NO: 4040173 - DNA, 22 bp, Homo sapiens
caagccagacctagcaggctgt

SEQ ID NO: 4040174 - DNA, 17 bp, Homo sapiens
caagccatgtataaatg

SEQ ID NO: 4040175 - DNA, 13 bp, Homo sapiens
caagcccaccagg

SEQ ID NO: 4040176 - DNA, 18 bp, Homo sapiens
caagcccaccaggtgtca

SEQ ID NO: 4040177 - DNA, 15 bp, Homo sapiens
caagcccaggccacc

SEQ ID NO: 4040178 - DNA, 14 bp, Homo sapiens
caagcccaggtgcc

SEQ ID NO: 4040179 - DNA, 17 bp, Homo sapiens
caagccccagcagccct

SEQ ID NO: 4040180 - DNA, 19 bp, Homo sapiens
caagccccagcagccctca

SEQ ID NO: 4040181 - DNA, 14 bp, Homo sapiens
caagccccatttcc

SEQ ID NO: 4040182 - DNA, 18 bp, Homo sapiens
caagcccgttagccccag

SEQ ID NO: 4040183 - DNA, 18 bp, Homo sapiens
caagccctacagagctgt

SEQ ID NO: 4040184 - DNA, 16 bp, Homo sapiens
caagccgtggcttccc

SEQ ID NO: 4040185 - DNA, 22 bp, Homo sapiens
caagcctcatgccaaccctggg

SEQ ID NO: 4040186 - DNA, 17 bp, Homo sapiens
caagcctttatggctgc

SEQ ID NO: 4040187 - DNA, 16 bp, Homo sapiens
caagctagtgtttcta

SEQ ID NO: 4040188 - DNA, 15 bp, Homo sapiens
caagctatctaaagt

SEQ ID NO: 4040189 - DNA, 17 bp, Homo sapiens
caagctatctaaagttt

SEQ ID NO: 4040190 - DNA, 15 bp, Homo sapiens
caagctattcaattc

SEQ ID NO: 4040191 - DNA, 21 bp, Homo sapiens
caagctcagaggcgcactgtg

SEQ ID NO: 4040192 - DNA, 14 bp, Homo sapiens
caagctgcctctgg

SEQ ID NO: 4040193 - DNA, 16 bp, Homo sapiens
caagctgcctctgggc

SEQ ID NO: 4040194 - DNA, 17 bp, Homo sapiens
caagctgcctctgggcc

SEQ ID NO: 4040195 - DNA, 15 bp, Homo sapiens
caagctggaagaagt

SEQ ID NO: 4040196 - DNA, 17 bp, Homo sapiens
caagctgttgaccaggc

SEQ ID NO: 4040197 - DNA, 19 bp, Homo sapiens
caagctgttgaccaggcac

SEQ ID NO: 4040198 - DNA, 15 bp, Homo sapiens
caagcttaatagccc

SEQ ID NO: 4040199 - DNA, 15 bp, Homo sapiens
caagcttcttgctga

SEQ ID NO: 4040200 - DNA, 21 bp, Homo sapiens
caagctttcttctacaaccag

SEQ ID NO: 4040201 - DNA, 23 bp, Homo sapiens
caagctttcttctacaaccagag

SEQ ID NO: 4040202 - DNA, 12 bp, Homo sapiens
caagctttggtt

SEQ ID NO: 4040203 - DNA, 22 bp, Homo sapiens
caaggaaaccgcctagtttact

SEQ ID NO: 4040204 - DNA, 11 bp, Homo sapiens
caaggaagagc

SEQ ID NO: 4040205 - DNA, 18 bp, Homo sapiens
caaggaaggaaagaaaga

SEQ ID NO: 4040206 - DNA, 16 bp, Homo sapiens
caaggaataaatgaga

SEQ ID NO: 4040207 - DNA, 18 bp, Homo sapiens
caaggaatgcctgtgcca

SEQ ID NO: 4040208 - DNA, 21 bp, Homo sapiens
caaggaatgcctgtgccaata

SEQ ID NO: 4040209 - DNA, 17 bp, Homo sapiens
caaggactcccggagcc

SEQ ID NO: 4040210 - DNA, 20 bp, Homo sapiens
caaggactgagcaccctctg

SEQ ID NO: 4040211 - DNA, 14 bp, Homo sapiens
caaggactgaggga

SEQ ID NO: 4040212 - DNA, 19 bp, Homo sapiens
caaggacttcctgtccagc

SEQ ID NO: 4040213 - DNA, 22 bp, Homo sapiens
caaggacttcctgtccagctcc

SEQ ID NO: 4040214 - DNA, 16 bp, Homo sapiens
caaggagaccaagtcc

SEQ ID NO: 4040215 - DNA, 16 bp, Homo sapiens
caaggagtcagacatt

SEQ ID NO: 4040216 - DNA, 21 bp, Homo sapiens
caaggagttccatgaagacca

SEQ ID NO: 4040217 - DNA, 16 bp, Homo sapiens
caaggatagatgctgg

SEQ ID NO: 4040218 - DNA, 21 bp, Homo sapiens
caaggatagatgctggcccag

SEQ ID NO: 4040219 - DNA, 17 bp, Homo sapiens
caaggatcctctccact

SEQ ID NO: 4040220 - DNA, 21 bp, Homo sapiens
caaggatcctctccactccat

SEQ ID NO: 4040221 - DNA, 14 bp, Homo sapiens
caaggccagagtgg

SEQ ID NO: 4040222 - DNA, 20 bp, Homo sapiens
caaggccagagtggcctggc

SEQ ID NO: 4040223 - DNA, 20 bp, Homo sapiens
caaggccagtccccatttct

SEQ ID NO: 4040224 - DNA, 13 bp, Homo sapiens
attcgccatctga

SEQ ID NO: 4040225 - DNA, 22 bp, Homo sapiens
attcgctgtaccctttaagata

SEQ ID NO: 4040226 - DNA, 15 bp, Homo sapiens
attcgggccacaggg

SEQ ID NO: 4040227 - DNA, 24 bp, Homo sapiens
attcgtaatcatccccatcctcca

SEQ ID NO: 4040228 - DNA, 16 bp, Homo sapiens
attcgtgtgttttttt

SEQ ID NO: 4040229 - DNA, 19 bp, Homo sapiens
attcgttgtgttttttaag

SEQ ID NO: 4040230 - DNA, 14 bp, Homo sapiens
attctaaaaccatt

SEQ ID NO: 4040231 - DNA, 19 bp, Homo sapiens
attctaagccctttgccat

SEQ ID NO: 4040232 - DNA, 15 bp, Homo sapiens
attctacagaataat

SEQ ID NO: 4040233 - DNA, 21 bp, Homo sapiens
attctagctgtatgatttgtt

SEQ ID NO: 4040234 - DNA, 15 bp, Homo sapiens
attctatatgaattt

SEQ ID NO: 4040235 - DNA, 16 bp, Homo sapiens
attctatatgaattta

SEQ ID NO: 4040236 - DNA, 20 bp, Homo sapiens
attctatccccaatcagctc

SEQ ID NO: 4040237 - DNA, 19 bp, Homo sapiens
attctatcgttattataaa

SEQ ID NO: 4040238 - DNA, 23 bp, Homo sapiens
attctatcgttattataaatgtt

SEQ ID NO: 4040239 - DNA, 20 bp, Homo sapiens
attctatgttaaatactgtg

SEQ ID NO: 4040240 - DNA, 18 bp, Homo sapiens
attctattgccttctttg

SEQ ID NO: 4040241 - DNA, 19 bp, Homo sapiens
attctattgccttctttga

SEQ ID NO: 4040242 - DNA, 23 bp, Homo sapiens
attctattgtattatttggagtt

SEQ ID NO: 4040243 - DNA, 20 bp, Homo sapiens
attctatttatatgtacatg

SEQ ID NO: 4040244 - DNA, 13 bp, Homo sapiens
attctcaaagcag

SEQ ID NO: 4040245 - DNA, 13 bp, Homo sapiens
attctcaccagga

SEQ ID NO: 4040246 - DNA, 15 bp, Homo sapiens
atttaatatcttcag

SEQ ID NO: 4040247 - DNA, 18 bp, Homo sapiens
atttaatccttctttgta

SEQ ID NO: 4040248 - DNA, 22 bp, Homo sapiens
atttaatccttctttgtaatac

SEQ ID NO: 4040249 - DNA, 14 bp, Homo sapiens
atttaatgaaagac

SEQ ID NO: 4040250 - DNA, 15 bp, Homo sapiens
atttaatgaaagact

SEQ ID NO: 4040251 - DNA, 15 bp, Homo sapiens
atttaatttagtgat

SEQ ID NO: 4040252 - DNA, 12 bp, Homo sapiens
atttaatttcca

SEQ ID NO: 4040253 - DNA, 19 bp, Homo sapiens
atttacaaaaatataaaat

SEQ ID NO: 4040254 - DNA, 20 bp, Homo sapiens
atttacaaaaatataaaata

SEQ ID NO: 4040255 - DNA, 21 bp, Homo sapiens
atttacagcctcacttgaatg

SEQ ID NO: 4040256 - DNA, 18 bp, Homo sapiens
atttacagtccttcaaaa

SEQ ID NO: 4040257 - DNA, 20 bp, Homo sapiens
atttacatgaattgcatttt

SEQ ID NO: 4040258 - DNA, 21 bp, Homo sapiens
atttacatgaattgcatttta

SEQ ID NO: 4040259 - DNA, 19 bp, Homo sapiens
atttacatgttttaaagaa

SEQ ID NO: 4040260 - DNA, 15 bp, Homo sapiens
atttacattctagtt

SEQ ID NO: 4040261 - DNA, 18 bp, Homo sapiens
atttacattctagttcag

SEQ ID NO: 4040262 - DNA, 19 bp, Homo sapiens
atttacattctagttcaga

SEQ ID NO: 4040263 - DNA, 21 bp, Homo sapiens
atttacattctagttcagagc

SEQ ID NO: 4040264 - DNA, 17 bp, Homo sapiens
atttacgctttgattca

SEQ ID NO: 4040265 - DNA, 19 bp, Homo sapiens
atttacgctttgattcata

SEQ ID NO: 4040266 - DNA, 15 bp, Homo sapiens
atttactaaacatat

SEQ ID NO: 4040267 - DNA, 16 bp, Homo sapiens
atttactctaaaaact

SEQ ID NO: 4040268 - DNA, 17 bp, Homo sapiens
atttactctaaaaactg

SEQ ID NO: 4040269 - DNA, 20 bp, Homo sapiens
atttactggacataacattt

SEQ ID NO: 4040270 - DNA, 19 bp, Homo sapiens
atttacttcttatacattt

SEQ ID NO: 4040271 - DNA, 12 bp, Homo sapiens
atttacttttaa

SEQ ID NO: 4040272 - DNA, 16 bp, Homo sapiens
atttagaaactgattt

SEQ ID NO: 4040273 - DNA, 17 bp, Homo sapiens
atttagaaactgatttc

SEQ ID NO: 4040274 - DNA, 23 bp, Homo sapiens
atttagaaactgatttcttcaga

SEQ ID NO: 4040275 - DNA, 16 bp, Homo sapiens
atttagaaatcaagca

SEQ ID NO: 4040276 - DNA, 17 bp, Homo sapiens
atttagagatgaattaa

SEQ ID NO: 4040277 - DNA, 22 bp, Homo sapiens
atttaggcagattgaaaaggac

SEQ ID NO: 4040278 - DNA, 22 bp, Homo sapiens
atttagggtactaaatttaaat

SEQ ID NO: 4040279 - DNA, 17 bp, Homo sapiens
atttaggtttttattag

SEQ ID NO: 4040280 - DNA, 16 bp, Homo sapiens
atttagtcatgtgacc

SEQ ID NO: 4040281 - DNA, 12 bp, Homo sapiens
atttagttcttt

SEQ ID NO: 4040282 - DNA, 16 bp, Homo sapiens
atttagttgtaaacca

SEQ ID NO: 4040283 - DNA, 12 bp, Homo sapiens
atttagtttcag

SEQ ID NO: 4040284 - DNA, 20 bp, Homo sapiens
atttagtttcagtagattgc

SEQ ID NO: 4040285 - DNA, 23 bp, Homo sapiens
atttagtttcagtagattgcaga

SEQ ID NO: 4040286 - DNA, 14 bp, Homo sapiens
atttataaaacttc

SEQ ID NO: 4040287 - DNA, 21 bp, Homo sapiens
atttataaacagacaatatgt

SEQ ID NO: 4040288 - DNA, 23 bp, Homo sapiens
atttataaacagacaatatgtga

SEQ ID NO: 4040289 - DNA, 13 bp, Homo sapiens
atttataaatgct

SEQ ID NO: 4040290 - DNA, 14 bp, Homo sapiens
atttataaatgcta

SEQ ID NO: 4040291 - DNA, 17 bp, Homo sapiens
atttataaatgctattt

SEQ ID NO: 4040292 - DNA, 13 bp, Homo sapiens
atttataactcat

SEQ ID NO: 4040293 - DNA, 19 bp, Homo sapiens
atttataactcatcataaa

SEQ ID NO: 4040294 - DNA, 23 bp, Homo sapiens
atttataactcatcataaaataa

SEQ ID NO: 4040295 - DNA, 22 bp, Homo sapiens
atttataagcagatttaacaat

SEQ ID NO: 4040296 - DNA, 16 bp, Homo sapiens
atttataatgttagta

SEQ ID NO: 4040297 - DNA, 14 bp, Homo sapiens
atttataattccta

SEQ ID NO: 4040298 - DNA, 22 bp, Homo sapiens
atttatacctcaaactatctgg

SEQ ID NO: 4040299 - DNA, 14 bp, Homo sapiens
atttataggccagg

SEQ ID NO: 4040300 - DNA, 18 bp, Homo sapiens
atttatatatgaaaacta

SEQ ID NO: 4040301 - DNA, 20 bp, Homo sapiens
atttatatatgaaaactata

SEQ ID NO: 4040302 - DNA, 15 bp, Homo sapiens
atttatatatgtatt

SEQ ID NO: 4040303 - DNA, 14 bp, Homo sapiens
atttatatatttat

SEQ ID NO: 4040304 - DNA, 15 bp, Homo sapiens
atttatatatttata

SEQ ID NO: 4040305 - DNA, 17 bp, Homo sapiens
atttatatatttataac

SEQ ID NO: 4040306 - DNA, 20 bp, Homo sapiens
atttatatggggaatatatt

SEQ ID NO: 4040307 - DNA, 18 bp, Homo sapiens
atttatcaaaatgtagct

SEQ ID NO: 4040308 - DNA, 13 bp, Homo sapiens
atttatcaaagca

SEQ ID NO: 4040309 - DNA, 17 bp, Homo sapiens
atttatcagtgacagag

SEQ ID NO: 4040310 - DNA, 20 bp, Homo sapiens
atttatccacaggaaagtgt

SEQ ID NO: 4040311 - DNA, 15 bp, Homo sapiens
atttatctaaattaa

SEQ ID NO: 4040312 - DNA, 22 bp, Homo sapiens
atttatgaagtttaaaacagta

SEQ ID NO: 4040313 - DNA, 13 bp, Homo sapiens
atttatgatttaa

SEQ ID NO: 4040314 - DNA, 16 bp, Homo sapiens
atttatgatttaataa

SEQ ID NO: 4040315 - DNA, 16 bp, Homo sapiens
atttatgcaaggtatt

SEQ ID NO: 4040316 - DNA, 17 bp, Homo sapiens
atttatgcacattcacg

SEQ ID NO: 4040317 - DNA, 22 bp, Homo sapiens
atttatgccttgatgatttaat

SEQ ID NO: 4040318 - DNA, 12 bp, Homo sapiens
atttatgtagat

SEQ ID NO: 4040319 - DNA, 18 bp, Homo sapiens
atttatgtgtgaggagct

SEQ ID NO: 4040320 - DNA, 22 bp, Homo sapiens
atttattaaacagatttttaca

SEQ ID NO: 4040321 - DNA, 23 bp, Homo sapiens
atttattaaacagatttttacaa

SEQ ID NO: 4040322 - DNA, 18 bp, Homo sapiens
atttattaaataaaatca

SEQ ID NO: 4040323 - DNA, 16 bp, Homo sapiens
atttattaagatggat

SEQ ID NO: 4040324 - DNA, 22 bp, Homo sapiens
atttattaagatggattctcag

SEQ ID NO: 4040325 - DNA, 14 bp, Homo sapiens
atttattaatattt

SEQ ID NO: 4040326 - DNA, 16 bp, Homo sapiens
atttattaatttgaaa

SEQ ID NO: 4040327 - DNA, 18 bp, Homo sapiens
atttattaatttgaaacc

SEQ ID NO: 4040328 - DNA, 12 bp, Homo sapiens
atttattacaac

SEQ ID NO: 4040329 - DNA, 14 bp, Homo sapiens
atttattacctctg

SEQ ID NO: 4040330 - DNA, 14 bp, Homo sapiens
atttattactgtcc

SEQ ID NO: 4040331 - DNA, 15 bp, Homo sapiens
atttattactgtccc

SEQ ID NO: 4040332 - DNA, 18 bp, Homo sapiens
atttattcaattcctctg

SEQ ID NO: 4040333 - DNA, 22 bp, Homo sapiens
atttattgagtacctactgtgt

SEQ ID NO: 4040334 - DNA, 14 bp, Homo sapiens
atttattgttagaa

SEQ ID NO: 4040335 - DNA, 21 bp, Homo sapiens
atttattgtttatgtaaatgt

SEQ ID NO: 4040336 - DNA, 20 bp, Homo sapiens
atttattgtttatttatcag

SEQ ID NO: 4040337 - DNA, 21 bp, Homo sapiens
atttattgtttatttatcagt

SEQ ID NO: 4040338 - DNA, 20 bp, Homo sapiens
atttatttaaagcattgctt

SEQ ID NO: 4040339 - DNA, 12 bp, Homo sapiens
atttatttaata

SEQ ID NO: 4040340 - DNA, 14 bp, Homo sapiens
atttatttatgtgt

SEQ ID NO: 4040341 - DNA, 13 bp, Homo sapiens
atttatttattat

SEQ ID NO: 4040342 - DNA, 14 bp, Homo sapiens
atttatttcaaaaa

SEQ ID NO: 4040343 - DNA, 20 bp, Homo sapiens
atttatttccactaaaaata

SEQ ID NO: 4040344 - DNA, 15 bp, Homo sapiens
atttatttccccagg

SEQ ID NO: 4040345 - DNA, 15 bp, Homo sapiens
atttatttcctccct

SEQ ID NO: 4040346 - DNA, 14 bp, Homo sapiens
atttattttaagca

SEQ ID NO: 4040347 - DNA, 21 bp, Homo sapiens
atttattttatttatttaatt

SEQ ID NO: 4040348 - DNA, 16 bp, Homo sapiens
atttattttcttttga

SEQ ID NO: 4040349 - DNA, 14 bp, Homo sapiens
caataaacttagag

SEQ ID NO: 4040350 - DNA, 22 bp, Homo sapiens
caataaacttagaggaaaatga

SEQ ID NO: 4040351 - DNA, 12 bp, Homo sapiens
caataaagaaaa

SEQ ID NO: 4040352 - DNA, 19 bp, Homo sapiens
caataaagaaaacttccat

SEQ ID NO: 4040353 - DNA, 17 bp, Homo sapiens
caataaagcactgagca

SEQ ID NO: 4040354 - DNA, 17 bp, Homo sapiens
caataaatctgacccag

SEQ ID NO: 4040355 - DNA, 18 bp, Homo sapiens
caataaatctgacccagt

SEQ ID NO: 4040356 - DNA, 15 bp, Homo sapiens
caataaatctttcaa

SEQ ID NO: 4040357 - DNA, 12 bp, Homo sapiens
caataaatgaat

SEQ ID NO: 4040358 - DNA, 14 bp, Homo sapiens
caataaatgtattc

SEQ ID NO: 4040359 - DNA, 18 bp, Homo sapiens
caataaatgtattcaaat

SEQ ID NO: 4040360 - DNA, 17 bp, Homo sapiens
caataaccaagtttatt

SEQ ID NO: 4040361 - DNA, 21 bp, Homo sapiens
caataaccgcttggtttgcaa

SEQ ID NO: 4040362 - DNA, 14 bp, Homo sapiens
caataactactgtg

SEQ ID NO: 4040363 - DNA, 15 bp, Homo sapiens
caataactactgtgt

SEQ ID NO: 4040364 - DNA, 18 bp, Homo sapiens
caataactactgtgttcc

SEQ ID NO: 4040365 - DNA, 21 bp, Homo sapiens
caataactactgtgttcctgg

SEQ ID NO: 4040366 - DNA, 22 bp, Homo sapiens
caataactactgtgttcctggc

SEQ ID NO: 4040367 - DNA, 16 bp, Homo sapiens
caataacttctatatt

SEQ ID NO: 4040368 - DNA, 14 bp, Homo sapiens
caataagaaatgaa

SEQ ID NO: 4040369 - DNA, 17 bp, Homo sapiens
caataagaaatgaacaa

SEQ ID NO: 4040370 - DNA, 12 bp, Homo sapiens
caataagcaaaa

SEQ ID NO: 4040371 - DNA, 23 bp, Homo sapiens
caataaggtcaagggaaaacccc

SEQ ID NO: 4040372 - DNA, 21 bp, Homo sapiens
caataatataataatagttat

SEQ ID NO: 4040373 - DNA, 22 bp, Homo sapiens
caataatataataatagttatt

SEQ ID NO: 4040374 - DNA, 13 bp, Homo sapiens
caatacaaatgga

SEQ ID NO: 4040375 - DNA, 16 bp, Homo sapiens
caatacaaatggattt

SEQ ID NO: 4040376 - DNA, 16 bp, Homo sapiens
caatagagactgtaga

SEQ ID NO: 4040377 - DNA, 19 bp, Homo sapiens
caatagcagacagtgtttt

SEQ ID NO: 4040378 - DNA, 15 bp, Homo sapiens
caataggctgttccc

SEQ ID NO: 4040379 - DNA, 16 bp, Homo sapiens
caatagtgtgttctga

SEQ ID NO: 4040380 - DNA, 13 bp, Homo sapiens
caatataaaccgt

SEQ ID NO: 4040381 - DNA, 17 bp, Homo sapiens
caatatctaatatatat

SEQ ID NO: 4040382 - DNA, 12 bp, Homo sapiens
caatatgtatgc

SEQ ID NO: 4040383 - DNA, 14 bp, Homo sapiens
caatatgtatgctt

SEQ ID NO: 4040384 - DNA, 15 bp, Homo sapiens
caatatgtatgcttt

SEQ ID NO: 4040385 - DNA, 16 bp, Homo sapiens
caatatgtgagtgcct

SEQ ID NO: 4040386 - DNA, 17 bp, Homo sapiens
caatatgtgagtgcctt

SEQ ID NO: 4040387 - DNA, 20 bp, Homo sapiens
caatatgtgagtgccttttg

SEQ ID NO: 4040388 - DNA, 14 bp, Homo sapiens
caatattaaataca

SEQ ID NO: 4040389 - DNA, 15 bp, Homo sapiens
caatattaaatacag

SEQ ID NO: 4040390 - DNA, 14 bp, Homo sapiens
caatattaaatctg

SEQ ID NO: 4040391 - DNA, 13 bp, Homo sapiens
caatattataatt

SEQ ID NO: 4040392 - DNA, 22 bp, Homo sapiens
caatattataatttttttcaat

SEQ ID NO: 4040393 - DNA, 18 bp, Homo sapiens
caatattatactaagaaa

SEQ ID NO: 4040394 - DNA, 19 bp, Homo sapiens
caatattatactaagaaaa

SEQ ID NO: 4040395 - DNA, 13 bp, Homo sapiens
caatattatgaaa

SEQ ID NO: 4040396 - DNA, 18 bp, Homo sapiens
caatattatgaaatttca

SEQ ID NO: 4040397 - DNA, 20 bp, Homo sapiens
caatattatgaaatttcact

SEQ ID NO: 4040398 - DNA, 13 bp, Homo sapiens
caatattccttag

SEQ ID NO: 4040399 - DNA, 14 bp, Homo sapiens
caatatttattatt

SEQ ID NO: 4040400 - DNA, 23 bp, Homo sapiens
caatatttttatatcatgcaaaa

SEQ ID NO: 4040401 - DNA, 18 bp, Homo sapiens
caatcaaaggaaaatagt

SEQ ID NO: 4040402 - DNA, 15 bp, Homo sapiens
caatcaactctaata

SEQ ID NO: 4040403 - DNA, 20 bp, Homo sapiens
caatcaaggttataattttt

SEQ ID NO: 4040404 - DNA, 21 bp, Homo sapiens
caatcaataacagccgctcca

SEQ ID NO: 4040405 - DNA, 12 bp, Homo sapiens
caatcagctcct

SEQ ID NO: 4040406 - DNA, 17 bp, Homo sapiens
caatcagtagcttaaga

SEQ ID NO: 4040407 - DNA, 22 bp, Homo sapiens
caatcagtagcttaagaaaaaa

SEQ ID NO: 4040408 - DNA, 17 bp, Homo sapiens
caatcatgaaatatgca

SEQ ID NO: 4040409 - DNA, 13 bp, Homo sapiens
caatcatttctca

SEQ ID NO: 4040410 - DNA, 17 bp, Homo sapiens
caatcatttctcactgt

SEQ ID NO: 4040411 - DNA, 15 bp, Homo sapiens
caatccacctgcctt

SEQ ID NO: 4040412 - DNA, 23 bp, Homo sapiens
caatccaccttcaggccccgccc

SEQ ID NO: 4040413 - DNA, 13 bp, Homo sapiens
caatccagagagc

SEQ ID NO: 4040414 - DNA, 17 bp, Homo sapiens
caatccataactttagt

SEQ ID NO: 4040415 - DNA, 16 bp, Homo sapiens
caatccatcagtgcca

SEQ ID NO: 4040416 - DNA, 22 bp, Homo sapiens
caatccatgttagtttttactt

SEQ ID NO: 4040417 - DNA, 23 bp, Homo sapiens
caatccatgttagtttttacttt

SEQ ID NO: 4040418 - DNA, 17 bp, Homo sapiens
caatcccaccaaccctc

SEQ ID NO: 4040419 - DNA, 22 bp, Homo sapiens
caatcccaccaaccctcagagc

SEQ ID NO: 4040420 - DNA, 23 bp, Homo sapiens
caatcccaccaaccctcagagcc

SEQ ID NO: 4040421 - DNA, 15 bp, Homo sapiens
caatcccagggctgg

SEQ ID NO: 4040422 - DNA, 15 bp, Homo sapiens
caatcccgtgaaaga

SEQ ID NO: 4040423 - DNA, 14 bp, Homo sapiens
caatccctggggct

SEQ ID NO: 4040424 - DNA, 15 bp, Homo sapiens
caatccgagcagtgg

SEQ ID NO: 4040425 - DNA, 20 bp, Homo sapiens
caatcctaatttctcctccc

SEQ ID NO: 4040426 - DNA, 21 bp, Homo sapiens
caatcctaatttctcctccct

SEQ ID NO: 4040427 - DNA, 17 bp, Homo sapiens
caatcctcactgggtgg

SEQ ID NO: 4040428 - DNA, 14 bp, Homo sapiens
caatcctcctgcct

SEQ ID NO: 4040429 - DNA, 16 bp, Homo sapiens
caatcctttctgccca

SEQ ID NO: 4040430 - DNA, 19 bp, Homo sapiens
caatctattgcttcaccat

SEQ ID NO: 4040431 - DNA, 22 bp, Homo sapiens
caatctcttcattattctctgc

SEQ ID NO: 4040432 - DNA, 17 bp, Homo sapiens
caatctgcacactccag

SEQ ID NO: 4040433 - DNA, 16 bp, Homo sapiens
caatctggaagaaaaa

SEQ ID NO: 4040434 - DNA, 17 bp, Homo sapiens
caatctggcccttacac

SEQ ID NO: 4040435 - DNA, 23 bp, Homo sapiens
caatctgtgatgacattccctgc

SEQ ID NO: 4040436 - DNA, 18 bp, Homo sapiens
caatcttgctttgtgtat

SEQ ID NO: 4040437 - DNA, 18 bp, Homo sapiens
caatgaaaggtactatat

SEQ ID NO: 4040438 - DNA, 23 bp, Homo sapiens
caatgaaatacacaagtaaacat

SEQ ID NO: 4040439 - DNA, 18 bp, Homo sapiens
caatgaacacttataagt

SEQ ID NO: 4040440 - DNA, 16 bp, Homo sapiens
caatgaagaagtttct

SEQ ID NO: 4040441 - DNA, 21 bp, Homo sapiens
caatgaagccagctcacagtg

SEQ ID NO: 4040442 - DNA, 14 bp, Homo sapiens
caatgaatattgaa

SEQ ID NO: 4040443 - DNA, 15 bp, Homo sapiens
caatgacatcttcaa

SEQ ID NO: 4040444 - DNA, 19 bp, Homo sapiens
caatgacatcttcaaagct

SEQ ID NO: 4040445 - DNA, 11 bp, Homo sapiens
caatgactact

SEQ ID NO: 4040446 - DNA, 19 bp, Homo sapiens
caatgaggcagatagcact

SEQ ID NO: 4040447 - DNA, 17 bp, Homo sapiens
caatgaggtctgaaatg

SEQ ID NO: 4040448 - DNA, 19 bp, Homo sapiens
caatgaggtctgaaatgga

SEQ ID NO: 4040449 - DNA, 15 bp, Homo sapiens
caatgattgttaatt

SEQ ID NO: 4040450 - DNA, 16 bp, Homo sapiens
caatgcaagagtgatt

SEQ ID NO: 4040451 - DNA, 22 bp, Homo sapiens
caatgcaagagtgattgcagct

SEQ ID NO: 4040452 - DNA, 18 bp, Homo sapiens
caatgcagcaaggccctg

SEQ ID NO: 4040453 - DNA, 13 bp, Homo sapiens
caatgcccagcag

SEQ ID NO: 4040454 - DNA, 13 bp, Homo sapiens
caatgcctggaga

SEQ ID NO: 4040455 - DNA, 14 bp, Homo sapiens
caatgctgatttgg

SEQ ID NO: 4040456 - DNA, 11 bp, Homo sapiens
caatgcttaaa

SEQ ID NO: 4040457 - DNA, 13 bp, Homo sapiens
caatgcttaaact

SEQ ID NO: 4040458 - DNA, 21 bp, Homo sapiens
caatgcttaaactaaataatg

SEQ ID NO: 4040459 - DNA, 20 bp, Homo sapiens
caatgcttttatatggccca

SEQ ID NO: 4040460 - DNA, 20 bp, Homo sapiens
caatggagactgtctcaaga

SEQ ID NO: 4040461 - DNA, 23 bp, Homo sapiens
caatggcgcctgctccctccaga

SEQ ID NO: 4040462 - DNA, 10 bp, Homo sapiens
caatgggact

SEQ ID NO: 4040463 - DNA, 14 bp, Homo sapiens
caatgggactggag

SEQ ID NO: 4040464 - DNA, 19 bp, Homo sapiens
caatgggagctgaggccac

SEQ ID NO: 4040465 - DNA, 17 bp, Homo sapiens
caatgggcactgggatg

SEQ ID NO: 4040466 - DNA, 18 bp, Homo sapiens
caatgggcactgggatga

SEQ ID NO: 4040467 - DNA, 16 bp, Homo sapiens
caatgggctcttccaa

SEQ ID NO: 4040468 - DNA, 19 bp, Homo sapiens
caatggtgatcctctattt

SEQ ID NO: 4040469 - DNA, 20 bp, Homo sapiens
caatggtgatcctctatttt

SEQ ID NO: 4040470 - DNA, 18 bp, Homo sapiens
caatgtattttatcttat

SEQ ID NO: 4040471 - DNA, 21 bp, Homo sapiens
caatgtcacaacctctctgat

SEQ ID NO: 4040472 - DNA, 14 bp, Homo sapiens
caatgtcacttaaa

SEQ ID NO: 4040473 - DNA, 14 bp, Homo sapiens
caatgtcaggaaca

SEQ ID NO: 4040474 - DNA, 16 bp, Homo sapiens
caatgtcaggaacaga

SEQ ID NO: 4040475 - DNA, 19 bp, Homo sapiens
caatgtcaggaacagaagg

SEQ ID NO: 4040476 - DNA, 21 bp, Homo sapiens
caatgtcgagtatattattat

SEQ ID NO: 4040477 - DNA, 20 bp, Homo sapiens
caatgtctgagtgaacctgt

SEQ ID NO: 4040478 - DNA, 14 bp, Homo sapiens
caatgtgaacttta

SEQ ID NO: 4040479 - DNA, 18 bp, Homo sapiens
caatgtgaactttattaa

SEQ ID NO: 4040480 - DNA, 19 bp, Homo sapiens
caatgtgaactttattaaa

SEQ ID NO: 4040481 - DNA, 16 bp, Homo sapiens
caatgtgctactgatt

SEQ ID NO: 4040482 - DNA, 23 bp, Homo sapiens
caatgtggcaaggaaaaacaggt

SEQ ID NO: 4040483 - DNA, 20 bp, Homo sapiens
caatgttaaggaaactctta

SEQ ID NO: 4040484 - DNA, 15 bp, Homo sapiens
caatgttcattgtaa

SEQ ID NO: 4040485 - DNA, 20 bp, Homo sapiens
caatgtttatgcaaggaagg

SEQ ID NO: 4040486 - DNA, 23 bp, Homo sapiens
caatgtttatgcaaggaaggaaa

SEQ ID NO: 4040487 - DNA, 17 bp, Homo sapiens
caatgtttcttctaggt

SEQ ID NO: 4040488 - DNA, 23 bp, Homo sapiens
caattaaaaaaaaagatctgttt

SEQ ID NO: 4040489 - DNA, 22 bp, Homo sapiens
caattaaaaaaaattaaaacca

SEQ ID NO: 4040490 - DNA, 13 bp, Homo sapiens
caattaaaggtcc

SEQ ID NO: 4040491 - DNA, 12 bp, Homo sapiens
caattaaagtct

SEQ ID NO: 4040492 - DNA, 14 bp, Homo sapiens
caattaaatgtagg

SEQ ID NO: 4040493 - DNA, 15 bp, Homo sapiens
caattaatagtttgt

SEQ ID NO: 4040494 - DNA, 18 bp, Homo sapiens
caattaatagtttgtcta

SEQ ID NO: 4040495 - DNA, 15 bp, Homo sapiens
caattaggaagtgta

SEQ ID NO: 4040496 - DNA, 22 bp, Homo sapiens
caattaggaagtgtaacagctg

SEQ ID NO: 4040497 - DNA, 23 bp, Homo sapiens
caattaggaagtgtaacagctga

SEQ ID NO: 4040498 - DNA, 17 bp, Homo sapiens
caattaggtttttcctt

SEQ ID NO: 4040499 - DNA, 18 bp, Homo sapiens
caattagtttccttttta

SEQ ID NO: 4040500 - DNA, 22 bp, Homo sapiens
caattattgttacacattaagt

SEQ ID NO: 4040501 - DNA, 18 bp, Homo sapiens
caattatttgcatatttt

SEQ ID NO: 4040502 - DNA, 20 bp, Homo sapiens
caattatttgcatattttga

SEQ ID NO: 4040503 - DNA, 23 bp, Homo sapiens
caattatttgcatattttgagaa

SEQ ID NO: 4040504 - DNA, 13 bp, Homo sapiens
caattcagacagg

SEQ ID NO: 4040505 - DNA, 23 bp, Homo sapiens
caattcagacaggcaaataaaag

SEQ ID NO: 4040506 - DNA, 13 bp, Homo sapiens
caattccacctgc

SEQ ID NO: 4040507 - DNA, 11 bp, Homo sapiens
caattcccctc

SEQ ID NO: 4040508 - DNA, 13 bp, Homo sapiens
caattcccctctg

SEQ ID NO: 4040509 - DNA, 21 bp, Homo sapiens
caattccctctctcagcacag

SEQ ID NO: 4040510 - DNA, 22 bp, Homo sapiens
caattccctctctcagcacagc

SEQ ID NO: 4040511 - DNA, 16 bp, Homo sapiens
caattcctagataaaa

SEQ ID NO: 4040512 - DNA, 16 bp, Homo sapiens
caattctcctgcctca

SEQ ID NO: 4040513 - DNA, 21 bp, Homo sapiens
caattctcctgcctcagcctc

SEQ ID NO: 4040514 - DNA, 19 bp, Homo sapiens
caattcttttaactgttgt

SEQ ID NO: 4040515 - DNA, 12 bp, Homo sapiens
caattggaggaa

SEQ ID NO: 4040516 - DNA, 16 bp, Homo sapiens
caattggcagtgactt

SEQ ID NO: 4040517 - DNA, 17 bp, Homo sapiens
caattggcagtgacttt

SEQ ID NO: 4040518 - DNA, 21 bp, Homo sapiens
caattggtaaaactcactgtg

SEQ ID NO: 4040519 - DNA, 21 bp, Homo sapiens
caattgtgagccaccacgtcc

SEQ ID NO: 4040520 - DNA, 16 bp, Homo sapiens
caattgtgtagccttt

SEQ ID NO: 4040521 - DNA, 17 bp, Homo sapiens
caattgtgtagcctttt

SEQ ID NO: 4040522 - DNA, 23 bp, Homo sapiens
caattgttttacctgttctgaaa

SEQ ID NO: 4040523 - DNA, 19 bp, Homo sapiens
caatttcaattttgtctgt

SEQ ID NO: 4040524 - DNA, 17 bp, Homo sapiens
caatttcttggtattat

SEQ ID NO: 4040525 - DNA, 20 bp, Homo sapiens
caatttgatacataataaaa

SEQ ID NO: 4040526 - DNA, 23 bp, Homo sapiens
caatttgtaattgcttacatttt

SEQ ID NO: 4040527 - DNA, 15 bp, Homo sapiens
caatttgtttaaaga

SEQ ID NO: 4040528 - DNA, 17 bp, Homo sapiens
caatttgtttaaagaat

SEQ ID NO: 4040529 - DNA, 18 bp, Homo sapiens
caatttgtttaaagaata

SEQ ID NO: 4040530 - DNA, 13 bp, Homo sapiens
caattttaaagac

SEQ ID NO: 4040531 - DNA, 22 bp, Homo sapiens
caattttataaggacttcctga

SEQ ID NO: 4040532 - DNA, 16 bp, Homo sapiens
caattttctaagcaat

SEQ ID NO: 4040533 - DNA, 18 bp, Homo sapiens
cacaaaagttagctgagc

SEQ ID NO: 4040534 - DNA, 15 bp, Homo sapiens
cacaaaatctgtcca

SEQ ID NO: 4040535 - DNA, 12 bp, Homo sapiens
cacaaacacaca

SEQ ID NO: 4040536 - DNA, 17 bp, Homo sapiens
cacaaaccttctgcctt

SEQ ID NO: 4040537 - DNA, 19 bp, Homo sapiens
cacaaacttttatactctt

SEQ ID NO: 4040538 - DNA, 16 bp, Homo sapiens
cacaaaggtataattt

SEQ ID NO: 4040539 - DNA, 23 bp, Homo sapiens
cacaaccaccgttacaagtatac

SEQ ID NO: 4040540 - DNA, 15 bp, Homo sapiens
cacaacccccagctc

SEQ ID NO: 4040541 - DNA, 16 bp, Homo sapiens
cacaacccccagctcc

SEQ ID NO: 4040542 - DNA, 17 bp, Homo sapiens
cacaacctagggcaagt

SEQ ID NO: 4040543 - DNA, 21 bp, Homo sapiens
cacaactgcaataacttctga

SEQ ID NO: 4040544 - DNA, 15 bp, Homo sapiens
cacaagagacttaaa

SEQ ID NO: 4040545 - DNA, 20 bp, Homo sapiens
cacaagagcccagcagggcc

SEQ ID NO: 4040546 - DNA, 21 bp, Homo sapiens
cacaagagcccagcagggcct

SEQ ID NO: 4040547 - DNA, 15 bp, Homo sapiens
cacatgattgtataa

SEQ ID NO: 4040548 - DNA, 18 bp, Homo sapiens
cacatgattgtataagca

SEQ ID NO: 4040549 - DNA, 23 bp, Homo sapiens
cacatgattgtataagcatgctt

SEQ ID NO: 4040550 - DNA, 14 bp, Homo sapiens
cacatgccacctgg

SEQ ID NO: 4040551 - DNA, 14 bp, Homo sapiens
cacatgccactgcc

SEQ ID NO: 4040552 - DNA, 15 bp, Homo sapiens
cacatgccactgcct

SEQ ID NO: 4040553 - DNA, 18 bp, Homo sapiens
cacatgccactgcctgca

SEQ ID NO: 4040554 - DNA, 14 bp, Homo sapiens
cacatgcctgcgcc

SEQ ID NO: 4040555 - DNA, 20 bp, Homo sapiens
cacatggagccccctctgcc

SEQ ID NO: 4040556 - DNA, 14 bp, Homo sapiens
cacatgggcagccc

SEQ ID NO: 4040557 - DNA, 16 bp, Homo sapiens
cacattaaaaaatgaa

SEQ ID NO: 4040558 - DNA, 16 bp, Homo sapiens
cacattatcgggagca

SEQ ID NO: 4040559 - DNA, 22 bp, Homo sapiens
cacattatcgggagcagtgtct

SEQ ID NO: 4040560 - DNA, 13 bp, Homo sapiens
cacattatttgca

SEQ ID NO: 4040561 - DNA, 14 bp, Homo sapiens
cacattatttgcat

SEQ ID NO: 4040562 - DNA, 22 bp, Homo sapiens
cacattcccccaccagctgcag

SEQ ID NO: 4040563 - DNA, 13 bp, Homo sapiens
cacattctatttt

SEQ ID NO: 4040564 - DNA, 23 bp, Homo sapiens
cacattgagctgatataaattct

SEQ ID NO: 4040565 - DNA, 14 bp, Homo sapiens
cacattgcattcta

SEQ ID NO: 4040566 - DNA, 15 bp, Homo sapiens
cacattgcattctat

SEQ ID NO: 4040567 - DNA, 19 bp, Homo sapiens
cacattgtttgctgctatt

SEQ ID NO: 4040568 - DNA, 16 bp, Homo sapiens
cacatttctgatcaga

SEQ ID NO: 4040569 - DNA, 19 bp, Homo sapiens
cacatttctttgcattcca

SEQ ID NO: 4040570 - DNA, 19 bp, Homo sapiens
caccaaaaaaatccagaaa

SEQ ID NO: 4040571 - DNA, 15 bp, Homo sapiens
caccaacaccacggt

SEQ ID NO: 4040572 - DNA, 15 bp, Homo sapiens
caccaacagtgtgaa

SEQ ID NO: 4040573 - DNA, 13 bp, Homo sapiens
caccaagcacagc

SEQ ID NO: 4040574 - DNA, 16 bp, Homo sapiens
caccaagcacagcagc

SEQ ID NO: 4040575 - DNA, 15 bp, Homo sapiens
caccaaggtcttcag

SEQ ID NO: 4040576 - DNA, 15 bp, Homo sapiens
caccaatcccagggc

SEQ ID NO: 4040577 - DNA, 21 bp, Homo sapiens
caccaatcccagggctggctc

SEQ ID NO: 4040578 - DNA, 14 bp, Homo sapiens
caccacaattctcc

SEQ ID NO: 4040579 - DNA, 20 bp, Homo sapiens
caccacaattctccctatct

SEQ ID NO: 4040580 - DNA, 15 bp, Homo sapiens
caccacagacacaca

SEQ ID NO: 4040581 - DNA, 19 bp, Homo sapiens
caccacatctgccagacct

SEQ ID NO: 4040582 - DNA, 18 bp, Homo sapiens
caccaccccaacaaacca

SEQ ID NO: 4040583 - DNA, 14 bp, Homo sapiens
caccaccccctcaa

SEQ ID NO: 4040584 - DNA, 18 bp, Homo sapiens
caccaccccctcaagccc

SEQ ID NO: 4040585 - DNA, 22 bp, Homo sapiens
caccaccctagtcccttcccct

SEQ ID NO: 4040586 - DNA, 17 bp, Homo sapiens
caccaccctccttccca

SEQ ID NO: 4040587 - DNA, 16 bp, Homo sapiens
caccacctcactcctg

SEQ ID NO: 4040588 - DNA, 14 bp, Homo sapiens
caccacctccctca

SEQ ID NO: 4040589 - DNA, 15 bp, Homo sapiens
caccacctgcctcta

SEQ ID NO: 4040590 - DNA, 16 bp, Homo sapiens
caccacggcgtttttt

SEQ ID NO: 4040591 - DNA, 17 bp, Homo sapiens
caccacggtagtgcctg

SEQ ID NO: 4040592 - DNA, 19 bp, Homo sapiens
caccactaggaatcccaga

SEQ ID NO: 4040593 - DNA, 23 bp, Homo sapiens
caccactatctccgttccatctg

SEQ ID NO: 4040594 - DNA, 19 bp, Homo sapiens
caccagacacccaggactt

SEQ ID NO: 4040595 - DNA, 17 bp, Homo sapiens
caccagacgtcaggccc

SEQ ID NO: 4040596 - DNA, 16 bp, Homo sapiens
caccagagcagatgca

SEQ ID NO: 4040597 - DNA, 18 bp, Homo sapiens
caccagagcagatgcaga

SEQ ID NO: 4040598 - DNA, 16 bp, Homo sapiens
caccagagcccatgct

SEQ ID NO: 4040599 - DNA, 19 bp, Homo sapiens
caccagagcccatgctcaa

SEQ ID NO: 4040600 - DNA, 23 bp, Homo sapiens
caccagatgcaacctcactatgg

SEQ ID NO: 4040601 - DNA, 15 bp, Homo sapiens
caccagcatccacct

SEQ ID NO: 4040602 - DNA, 22 bp, Homo sapiens
caccagcatccaccttggctct

SEQ ID NO: 4040603 - DNA, 18 bp, Homo sapiens
caccagccacagcctccc

SEQ ID NO: 4040604 - DNA, 12 bp, Homo sapiens
caccagccagcg

SEQ ID NO: 4040605 - DNA, 16 bp, Homo sapiens
caccagccccaatcca

SEQ ID NO: 4040606 - DNA, 23 bp, Homo sapiens
caccagcccccgccccagagtgg

SEQ ID NO: 4040607 - DNA, 15 bp, Homo sapiens
caccagcccggcctg

SEQ ID NO: 4040608 - DNA, 16 bp, Homo sapiens
caccagccgccccagc

SEQ ID NO: 4040609 - DNA, 20 bp, Homo sapiens
caccagccgccccagcccct

SEQ ID NO: 4040610 - DNA, 11 bp, Homo sapiens
caccagctcgt

SEQ ID NO: 4040611 - DNA, 14 bp, Homo sapiens
caccagctgcagcc

SEQ ID NO: 4040612 - DNA, 17 bp, Homo sapiens
caccagcttctccaggc

SEQ ID NO: 4040613 - DNA, 11 bp, Homo sapiens
caccaggactt

SEQ ID NO: 4040614 - DNA, 15 bp, Homo sapiens
caccaggatggccct

SEQ ID NO: 4040615 - DNA, 19 bp, Homo sapiens
caccaggccgtgccttgtt

SEQ ID NO: 4040616 - DNA, 17 bp, Homo sapiens
caccaggctgtgggcct

SEQ ID NO: 4040617 - DNA, 18 bp, Homo sapiens
caccaggctgtgggcctc

SEQ ID NO: 4040618 - DNA, 13 bp, Homo sapiens
caccagggaagaa

SEQ ID NO: 4040619 - DNA, 15 bp, Homo sapiens
caccagggaagaaga

SEQ ID NO: 4040620 - DNA, 17 bp, Homo sapiens
caccaggtgcatgcatg

SEQ ID NO: 4040621 - DNA, 16 bp, Homo sapiens
caccagtcacatgacc

SEQ ID NO: 4040622 - DNA, 16 bp, Homo sapiens
caccagtgtcccctcc

SEQ ID NO: 4040623 - DNA, 22 bp, Homo sapiens
caccagtgtcctccaagtgccc

SEQ ID NO: 4040624 - DNA, 19 bp, Homo sapiens
caccatactccttgcttcc

SEQ ID NO: 4040625 - DNA, 22 bp, Homo sapiens
caccatactccttgcttcctga

SEQ ID NO: 4040626 - DNA, 18 bp, Homo sapiens
caccatatgaattgtaca

SEQ ID NO: 4040627 - DNA, 16 bp, Homo sapiens
caccatccctgatggc

SEQ ID NO: 4040628 - DNA, 19 bp, Homo sapiens
caccatgggaaactgttgt

SEQ ID NO: 4040629 - DNA, 23 bp, Homo sapiens
caccatgggaaactgttgtgggc

SEQ ID NO: 4040630 - DNA, 18 bp, Homo sapiens
caccatgtattcatccag

SEQ ID NO: 4040631 - DNA, 19 bp, Homo sapiens
caccatgtattcatccaga

SEQ ID NO: 4040632 - DNA, 22 bp, Homo sapiens
caccatgtgccatctgtacata

SEQ ID NO: 4040633 - DNA, 20 bp, Homo sapiens
caccatgttgcccaggctgg

SEQ ID NO: 4040634 - DNA, 13 bp, Homo sapiens
caccattctacct

SEQ ID NO: 4040635 - DNA, 14 bp, Homo sapiens
caccattctcctgc

SEQ ID NO: 4040636 - DNA, 20 bp, Homo sapiens
caccattgtgaagcacctac

SEQ ID NO: 4040637 - DNA, 13 bp, Homo sapiens
cacccaactactg

SEQ ID NO: 4040638 - DNA, 14 bp, Homo sapiens
cacccaactactga

SEQ ID NO: 4040639 - DNA, 16 bp, Homo sapiens
cacccaagcaaggcca

SEQ ID NO: 4040640 - DNA, 17 bp, Homo sapiens
caccctgtactgttctg

SEQ ID NO: 4040641 - DNA, 23 bp, Homo sapiens
caccctgtactgttctgtgtctt

SEQ ID NO: 4040642 - DNA, 17 bp, Homo sapiens
caccctgtcaagttaac

SEQ ID NO: 4040643 - DNA, 13 bp, Homo sapiens
caccctgtgccat

SEQ ID NO: 4040644 - DNA, 16 bp, Homo sapiens
caccctgtggccctgg

SEQ ID NO: 4040645 - DNA, 19 bp, Homo sapiens
cacccttagaaaatgtgtc

SEQ ID NO: 4040646 - DNA, 22 bp, Homo sapiens
cacccttcccctccttctccct

SEQ ID NO: 4040647 - DNA, 21 bp, Homo sapiens
cacccttggcctgtctcatcc

SEQ ID NO: 4040648 - DNA, 20 bp, Homo sapiens
caccctttgctgtgaggctg

SEQ ID NO: 4040649 - DNA, 17 bp, Homo sapiens
caccgacgcgtctcctg

SEQ ID NO: 4040650 - DNA, 15 bp, Homo sapiens
caccgactagccagg

SEQ ID NO: 4040651 - DNA, 22 bp, Homo sapiens
attgagctgatataaattctgt

SEQ ID NO: 4040652 - DNA, 12 bp, Homo sapiens
attgaggaagag

SEQ ID NO: 4040653 - DNA, 15 bp, Homo sapiens
attgaggaagagtct

SEQ ID NO: 4040654 - DNA, 14 bp, Homo sapiens
attgaggagctgca

SEQ ID NO: 4040655 - DNA, 13 bp, Homo sapiens
attgaggatggaa

SEQ ID NO: 4040656 - DNA, 16 bp, Homo sapiens
attgaggtaagttttt

SEQ ID NO: 4040657 - DNA, 22 bp, Homo sapiens
attgagtaatggtgtagaacac

SEQ ID NO: 4040658 - DNA, 21 bp, Homo sapiens
attgatatacacggatgactt

SEQ ID NO: 4040659 - DNA, 15 bp, Homo sapiens
attgatcataaactg

SEQ ID NO: 4040660 - DNA, 20 bp, Homo sapiens
attgatcctagtgtctttaa

SEQ ID NO: 4040661 - DNA, 23 bp, Homo sapiens
attgatcggagcctcctctctca

SEQ ID NO: 4040662 - DNA, 21 bp, Homo sapiens
attgatgaaaagatttaagca

SEQ ID NO: 4040663 - DNA, 22 bp, Homo sapiens
attgatgaaaagatttaagcac

SEQ ID NO: 4040664 - DNA, 14 bp, Homo sapiens
attgatgtatatgt

SEQ ID NO: 4040665 - DNA, 12 bp, Homo sapiens
attgatttgcat

SEQ ID NO: 4040666 - DNA, 15 bp, Homo sapiens
attgatttttcttct

SEQ ID NO: 4040667 - DNA, 17 bp, Homo sapiens
attgcaaatcttgaaat

SEQ ID NO: 4040668 - DNA, 16 bp, Homo sapiens
attgcaatttcttagg

SEQ ID NO: 4040669 - DNA, 13 bp, Homo sapiens
attgcacagaatt

SEQ ID NO: 4040670 - DNA, 17 bp, Homo sapiens
attgcacctggatgtac

SEQ ID NO: 4040671 - DNA, 16 bp, Homo sapiens
attgcacgtggcctct

SEQ ID NO: 4040672 - DNA, 15 bp, Homo sapiens
attgttgaaattttg

SEQ ID NO: 4040673 - DNA, 16 bp, Homo sapiens
attgttgaaattttgc

SEQ ID NO: 4040674 - DNA, 14 bp, Homo sapiens
attgttgcattgct

SEQ ID NO: 4040675 - DNA, 12 bp, Homo sapiens
attgttggctat

SEQ ID NO: 4040676 - DNA, 14 bp, Homo sapiens
attgttggctattt

SEQ ID NO: 4040677 - DNA, 14 bp, Homo sapiens
attgttgtataatt

SEQ ID NO: 4040678 - DNA, 19 bp, Homo sapiens
attgttgtttctttctagt

SEQ ID NO: 4040679 - DNA, 15 bp, Homo sapiens
attgtttaaaattca

SEQ ID NO: 4040680 - DNA, 16 bp, Homo sapiens
attgtttaaaattcag

SEQ ID NO: 4040681 - DNA, 19 bp, Homo sapiens
attgtttaaaattcagttt

SEQ ID NO: 4040682 - DNA, 14 bp, Homo sapiens
attgtttaaagatg

SEQ ID NO: 4040683 - DNA, 21 bp, Homo sapiens
attgtttaagtgttgtaaata

SEQ ID NO: 4040684 - DNA, 12 bp, Homo sapiens
attgtttatgta

SEQ ID NO: 4040685 - DNA, 15 bp, Homo sapiens
attgtttatttatca

SEQ ID NO: 4040686 - DNA, 17 bp, Homo sapiens
attgtttatttatcagt

SEQ ID NO: 4040687 - DNA, 19 bp, Homo sapiens
attgtttatttatcagtga

SEQ ID NO: 4040688 - DNA, 18 bp, Homo sapiens
attgtttcatatctggtc

SEQ ID NO: 4040689 - DNA, 12 bp, Homo sapiens
attgtttctgca

SEQ ID NO: 4040690 - DNA, 19 bp, Homo sapiens
attgtttctttaagaaagt

SEQ ID NO: 4040691 - DNA, 20 bp, Homo sapiens
attgtttctttaagaaagta

SEQ ID NO: 4040692 - DNA, 15 bp, Homo sapiens
attgtttgcttattg

SEQ ID NO: 4040693 - DNA, 21 bp, Homo sapiens
attgtttgcttattgttccaa

SEQ ID NO: 4040694 - DNA, 17 bp, Homo sapiens
attgttttaatctgaaa

SEQ ID NO: 4040695 - DNA, 21 bp, Homo sapiens
attgttttacctgttctgaaa

SEQ ID NO: 4040696 - DNA, 21 bp, Homo sapiens
attgttttctatttatgcctt

SEQ ID NO: 4040697 - DNA, 22 bp, Homo sapiens
attgttttctatttatgccttg

SEQ ID NO: 4040698 - DNA, 19 bp, Homo sapiens
attgttttctttaaagatg

SEQ ID NO: 4040699 - DNA, 15 bp, Homo sapiens
attgttttgcacttt

SEQ ID NO: 4040700 - DNA, 16 bp, Homo sapiens
attgtttttgaattta

SEQ ID NO: 4040701 - DNA, 17 bp, Homo sapiens
attgtttttgtatttat

SEQ ID NO: 4040702 - DNA, 21 bp, Homo sapiens
atttaaaaaaatcacaaaaat

SEQ ID NO: 4040703 - DNA, 16 bp, Homo sapiens
atttaaaaatatttca

SEQ ID NO: 4040704 - DNA, 18 bp, Homo sapiens
atttaaaaatatttcaga

SEQ ID NO: 4040705 - DNA, 11 bp, Homo sapiens
atttaaaactt

SEQ ID NO: 4040706 - DNA, 14 bp, Homo sapiens
atttaaaataaatt

SEQ ID NO: 4040707 - DNA, 11 bp, Homo sapiens
atttaaaatta

SEQ ID NO: 4040708 - DNA, 14 bp, Homo sapiens
atttaaaattaagt

SEQ ID NO: 4040709 - DNA, 15 bp, Homo sapiens
atttaaaattaagta

SEQ ID NO: 4040710 - DNA, 19 bp, Homo sapiens
atttaaaattaagtagaac

SEQ ID NO: 4040711 - DNA, 19 bp, Homo sapiens
atttaaacaataaatgtgc

SEQ ID NO: 4040712 - DNA, 14 bp, Homo sapiens
atttaaacacacag

SEQ ID NO: 4040713 - DNA, 15 bp, Homo sapiens
atttaaacagcagtg

SEQ ID NO: 4040714 - DNA, 16 bp, Homo sapiens
atttaaacagcagtgt

SEQ ID NO: 4040715 - DNA, 19 bp, Homo sapiens
atttaaacctttttcttga

SEQ ID NO: 4040716 - DNA, 16 bp, Homo sapiens
atttaaactatcttgt

SEQ ID NO: 4040717 - DNA, 18 bp, Homo sapiens
atttaaacttacaaactt

SEQ ID NO: 4040718 - DNA, 13 bp, Homo sapiens
atttaaagatatt

SEQ ID NO: 4040719 - DNA, 21 bp, Homo sapiens
atttaaagcattgctgttatg

SEQ ID NO: 4040720 - DNA, 15 bp, Homo sapiens
atttaaagcctcctc

SEQ ID NO: 4040721 - DNA, 21 bp, Homo sapiens
atttaaaggcttaggcatgtt

SEQ ID NO: 4040722 - DNA, 18 bp, Homo sapiens
atttaaagggaaaaccct

SEQ ID NO: 4040723 - DNA, 15 bp, Homo sapiens
atttaaatataattc

SEQ ID NO: 4040724 - DNA, 19 bp, Homo sapiens
atttaaatataattctgta

SEQ ID NO: 4040725 - DNA, 20 bp, Homo sapiens
atttaaatataattctgtaa

SEQ ID NO: 4040726 - DNA, 23 bp, Homo sapiens
atttaaatgttatgactatgtaa

SEQ ID NO: 4040727 - DNA, 18 bp, Homo sapiens
atttaaatttaaagatat

SEQ ID NO: 4040728 - DNA, 15 bp, Homo sapiens
atttaacaaactaaa

SEQ ID NO: 4040729 - DNA, 15 bp, Homo sapiens
atttaacagtcattt

SEQ ID NO: 4040730 - DNA, 16 bp, Homo sapiens
atttaacagtcattta

SEQ ID NO: 4040731 - DNA, 17 bp, Homo sapiens
atttaacagtcatttaa

SEQ ID NO: 4040732 - DNA, 15 bp, Homo sapiens
atttaacattattta

SEQ ID NO: 4040733 - DNA, 20 bp, Homo sapiens
atttaacattatttatatgg

SEQ ID NO: 4040734 - DNA, 13 bp, Homo sapiens
atttaactgcctt

SEQ ID NO: 4040735 - DNA, 18 bp, Homo sapiens
atttaagaaaagcacttt

SEQ ID NO: 4040736 - DNA, 15 bp, Homo sapiens
atttaagataattat

SEQ ID NO: 4040737 - DNA, 15 bp, Homo sapiens
atttaagcacaaact

SEQ ID NO: 4040738 - DNA, 12 bp, Homo sapiens
atttaagcattg

SEQ ID NO: 4040739 - DNA, 15 bp, Homo sapiens
atttaagcattgttt

SEQ ID NO: 4040740 - DNA, 17 bp, Homo sapiens
atttaagcctcatattt

SEQ ID NO: 4040741 - DNA, 19 bp, Homo sapiens
atttaagcctcatatttaa

SEQ ID NO: 4040742 - DNA, 21 bp, Homo sapiens
atttaagcctcatatttaaag

SEQ ID NO: 4040743 - DNA, 17 bp, Homo sapiens
atttaagccttataaac

SEQ ID NO: 4040744 - DNA, 20 bp, Homo sapiens
atttaagccttataaaccaa

SEQ ID NO: 4040745 - DNA, 19 bp, Homo sapiens
atttaagggaaagaaaatg

SEQ ID NO: 4040746 - DNA, 18 bp, Homo sapiens
atttaagtagaaaagttg

SEQ ID NO: 4040747 - DNA, 20 bp, Homo sapiens
atttaagtgcgtgtgtagag

SEQ ID NO: 4040748 - DNA, 20 bp, Homo sapiens
atttaagtttcaaacttact

SEQ ID NO: 4040749 - DNA, 22 bp, Homo sapiens
atttaataaaataattctaaag

SEQ ID NO: 4040750 - DNA, 15 bp, Homo sapiens
atttaataaagaaat

SEQ ID NO: 4040751 - DNA, 18 bp, Homo sapiens
atttaataaagaaatatt

SEQ ID NO: 4040752 - DNA, 15 bp, Homo sapiens
atttaataacattac

SEQ ID NO: 4040753 - DNA, 17 bp, Homo sapiens
atttaataacattacct

SEQ ID NO: 4040754 - DNA, 23 bp, Homo sapiens
atttaataacattaccttactgt

SEQ ID NO: 4040755 - DNA, 21 bp, Homo sapiens
atggcttaatgtttattcctg

SEQ ID NO: 4040756 - DNA, 17 bp, Homo sapiens
atgggaaagccacctct

SEQ ID NO: 4040757 - DNA, 14 bp, Homo sapiens
atgggaagacatga

SEQ ID NO: 4040758 - DNA, 13 bp, Homo sapiens
atgggaagcaata

SEQ ID NO: 4040759 - DNA, 14 bp, Homo sapiens
atgggaatttgtca

SEQ ID NO: 4040760 - DNA, 20 bp, Homo sapiens
atgggactggagtcagatga

SEQ ID NO: 4040761 - DNA, 21 bp, Homo sapiens
atgggactggagtcagatgag

SEQ ID NO: 4040762 - DNA, 12 bp, Homo sapiens
atgggagccagc

SEQ ID NO: 4040763 - DNA, 17 bp, Homo sapiens
atgggagccagctgctt

SEQ ID NO: 4040764 - DNA, 13 bp, Homo sapiens
atgggagccccag

SEQ ID NO: 4040765 - DNA, 14 bp, Homo sapiens
atgggagctcctct

SEQ ID NO: 4040766 - DNA, 22 bp, Homo sapiens
atgggagggggcttgaagccaa

SEQ ID NO: 4040767 - DNA, 16 bp, Homo sapiens
atgggagtgagacaga

SEQ ID NO: 4040768 - DNA, 16 bp, Homo sapiens
atgggagtgggcacct

SEQ ID NO: 4040769 - DNA, 20 bp, Homo sapiens
atgggagtgggcacctcaga

SEQ ID NO: 4040770 - DNA, 14 bp, Homo sapiens
atgggatgagaaaa

SEQ ID NO: 4040771 - DNA, 22 bp, Homo sapiens
atgggcagcccaaagctgcagg

SEQ ID NO: 4040772 - DNA, 21 bp, Homo sapiens
atgggcataggtaagctgtgc

SEQ ID NO: 4040773 - DNA, 18 bp, Homo sapiens
atgggccacggctgagcc

SEQ ID NO: 4040774 - DNA, 22 bp, Homo sapiens
atgggcctgccgggctgagggc

SEQ ID NO: 4040775 - DNA, 15 bp, Homo sapiens
atgggcttcactgta

SEQ ID NO: 4040776 - DNA, 17 bp, Homo sapiens
atggggaggcaagtgtg

SEQ ID NO: 4040777 - DNA, 16 bp, Homo sapiens
atggggagtcccaaag

SEQ ID NO: 4040778 - DNA, 22 bp, Homo sapiens
atggggataaaatgactactta

SEQ ID NO: 4040779 - DNA, 15 bp, Homo sapiens
atggggcaagacaga

SEQ ID NO: 4040780 - DNA, 13 bp, Homo sapiens
atggggccagatc

SEQ ID NO: 4040781 - DNA, 19 bp, Homo sapiens
atggggccagatccagcct

SEQ ID NO: 4040782 - DNA, 22 bp, Homo sapiens
atggggccagatccagcctggg

SEQ ID NO: 4040783 - DNA, 17 bp, Homo sapiens
atggggcctccctcctt

SEQ ID NO: 4040784 - DNA, 18 bp, Homo sapiens
atgggggaactcagatcc

SEQ ID NO: 4040785 - DNA, 16 bp, Homo sapiens
atgggggatgggccag

SEQ ID NO: 4040786 - DNA, 15 bp, Homo sapiens
atgggggcagggctg

SEQ ID NO: 4040787 - DNA, 16 bp, Homo sapiens
atgggggcagggctgt

SEQ ID NO: 4040788 - DNA, 22 bp, Homo sapiens
atgggggcatctcttccccaga

SEQ ID NO: 4040789 - DNA, 23 bp, Homo sapiens
atgggggcatctcttccccagag

SEQ ID NO: 4040790 - DNA, 11 bp, Homo sapiens
atggggtgggg

SEQ ID NO: 4040791 - DNA, 22 bp, Homo sapiens
atgggtagggctctgacaaagc

SEQ ID NO: 4040792 - DNA, 12 bp, Homo sapiens
atgggtagggta

SEQ ID NO: 4040793 - DNA, 16 bp, Homo sapiens
atgggtagggtaaatc

SEQ ID NO: 4040794 - DNA, 22 bp, Homo sapiens
atgggtccaggggtctgtctgc

SEQ ID NO: 4040795 - DNA, 21 bp, Homo sapiens
atgggtcctagcccttccctg

SEQ ID NO: 4040796 - DNA, 17 bp, Homo sapiens
atgggtctggctgagct

SEQ ID NO: 4040797 - DNA, 22 bp, Homo sapiens
atgggtgaagggagagccagct

SEQ ID NO: 4040798 - DNA, 14 bp, Homo sapiens
atggtaactgcttt

SEQ ID NO: 4040799 - DNA, 18 bp, Homo sapiens
attaacttatttagagat

SEQ ID NO: 4040800 - DNA, 11 bp, Homo sapiens
attaagaaacc

SEQ ID NO: 4040801 - DNA, 12 bp, Homo sapiens
attaagaaacct

SEQ ID NO: 4040802 - DNA, 13 bp, Homo sapiens
attaagaaagact

SEQ ID NO: 4040803 - DNA, 14 bp, Homo sapiens
attaagaaagacta

SEQ ID NO: 4040804 - DNA, 17 bp, Homo sapiens
attaagatacaaattaa

SEQ ID NO: 4040805 - DNA, 15 bp, Homo sapiens
attaagatggattct

SEQ ID NO: 4040806 - DNA, 23 bp, Homo sapiens
attaagatggattctcagatatt

SEQ ID NO: 4040807 - DNA, 14 bp, Homo sapiens
attaagatgtatat

SEQ ID NO: 4040808 - DNA, 14 bp, Homo sapiens
attaagtagaacaa

SEQ ID NO: 4040809 - DNA, 12 bp, Homo sapiens
attaataaagac

SEQ ID NO: 4040810 - DNA, 16 bp, Homo sapiens
attaatatatgtatta

SEQ ID NO: 4040811 - DNA, 21 bp, Homo sapiens
attaatatatgtattatttat

SEQ ID NO: 4040812 - DNA, 18 bp, Homo sapiens
attaatatccctacatgt

SEQ ID NO: 4040813 - DNA, 20 bp, Homo sapiens
attaatatccctacatgtat

SEQ ID NO: 4040814 - DNA, 12 bp, Homo sapiens
attaatatgaaa

SEQ ID NO: 4040815 - DNA, 13 bp, Homo sapiens
attaatatgagtt

SEQ ID NO: 4040816 - DNA, 13 bp, Homo sapiens
attaatattgtat

SEQ ID NO: 4040817 - DNA, 18 bp, Homo sapiens
attaatattgtattgctg

SEQ ID NO: 4040818 - DNA, 23 bp, Homo sapiens
attaatatttaacattatttata

SEQ ID NO: 4040819 - DNA, 18 bp, Homo sapiens
attaatcacctctctgta

SEQ ID NO: 4040820 - DNA, 18 bp, Homo sapiens
attaatctttctttacct

SEQ ID NO: 4040821 - DNA, 18 bp, Homo sapiens
attaatgcctctcccgca

SEQ ID NO: 4040822 - DNA, 19 bp, Homo sapiens
attaatgcgatttcttcct

SEQ ID NO: 4040823 - DNA, 18 bp, Homo sapiens
attaatgtcatgttgctt

SEQ ID NO: 4040824 - DNA, 18 bp, Homo sapiens
attaatgttaattcagca

SEQ ID NO: 4040825 - DNA, 12 bp, Homo sapiens
attaatgtttct

SEQ ID NO: 4040826 - DNA, 14 bp, Homo sapiens
attaattctataag

SEQ ID NO: 4040827 - DNA, 16 bp, Homo sapiens
attaattcttcacctg

SEQ ID NO: 4040828 - DNA, 17 bp, Homo sapiens
attaattcttcacctgt

SEQ ID NO: 4040829 - DNA, 13 bp, Homo sapiens
attaattgtaatc

SEQ ID NO: 4040830 - DNA, 20 bp, Homo sapiens
attaattgtaatctgaataa

SEQ ID NO: 4040831 - DNA, 18 bp, Homo sapiens
attaattgttttgcactt

SEQ ID NO: 4040832 - DNA, 18 bp, Homo sapiens
attcatgcctttcatagt

SEQ ID NO: 4040833 - DNA, 17 bp, Homo sapiens
attcatgtattttgttt

SEQ ID NO: 4040834 - DNA, 19 bp, Homo sapiens
attcattatttttccactt

SEQ ID NO: 4040835 - DNA, 12 bp, Homo sapiens
attcattctcat

SEQ ID NO: 4040836 - DNA, 19 bp, Homo sapiens
attcattctgtgatcattt

SEQ ID NO: 4040837 - DNA, 12 bp, Homo sapiens
attcattggtga

SEQ ID NO: 4040838 - DNA, 13 bp, Homo sapiens
attcatttaaaat

SEQ ID NO: 4040839 - DNA, 15 bp, Homo sapiens
attcatttaaaatga

SEQ ID NO: 4040840 - DNA, 17 bp, Homo sapiens
attcatttaaaatgatt

SEQ ID NO: 4040841 - DNA, 18 bp, Homo sapiens
attcattttcatcactgg

SEQ ID NO: 4040842 - DNA, 14 bp, Homo sapiens
attcattttcctgt

SEQ ID NO: 4040843 - DNA, 17 bp, Homo sapiens
attcattttcctgttca

SEQ ID NO: 4040844 - DNA, 24 bp, Homo sapiens
attcattttcctgttcagtgagat

SEQ ID NO: 4040845 - DNA, 13 bp, Homo sapiens
attcattttctga

SEQ ID NO: 4040846 - DNA, 15 bp, Homo sapiens
attcattttctgaca

SEQ ID NO: 4040847 - DNA, 15 bp, Homo sapiens
attccaaagctttat

SEQ ID NO: 4040848 - DNA, 23 bp, Homo sapiens
attccaaagctttattaccagtg

SEQ ID NO: 4040849 - DNA, 17 bp, Homo sapiens
attccactacacctggc

SEQ ID NO: 4040850 - DNA, 22 bp, Homo sapiens
attccactacacctggctgagg

SEQ ID NO: 4040851 - DNA, 21 bp, Homo sapiens
attccagaagaagagaagctg

SEQ ID NO: 4040852 - DNA, 18 bp, Homo sapiens
attccagaatatctggga

SEQ ID NO: 4040853 - DNA, 19 bp, Homo sapiens
attccagaatcttgacttt

SEQ ID NO: 4040854 - DNA, 14 bp, Homo sapiens
attccagaatgctg

SEQ ID NO: 4040855 - DNA, 19 bp, Homo sapiens
attccagagagtggctcct

SEQ ID NO: 4040856 - DNA, 11 bp, Homo sapiens
attccagcaat

SEQ ID NO: 4040857 - DNA, 16 bp, Homo sapiens
attccagcaataagaa

SEQ ID NO: 4040858 - DNA, 18 bp, Homo sapiens
attccagcaataagaaat

SEQ ID NO: 4040859 - DNA, 19 bp, Homo sapiens
attccagcaataagaaatg

SEQ ID NO: 4040860 - DNA, 20 bp, Homo sapiens
attccagcaataagaaatga

SEQ ID NO: 4040861 - DNA, 22 bp, Homo sapiens
attccagctgtcactctgtgcc

SEQ ID NO: 4040862 - DNA, 23 bp, Homo sapiens
attccagctgtcactctgtgcct

SEQ ID NO: 4040863 - DNA, 15 bp, Homo sapiens
attccaggaattcct

SEQ ID NO: 4040864 - DNA, 20 bp, Homo sapiens
attccagtcaggctctctgg

SEQ ID NO: 4040865 - DNA, 14 bp, Homo sapiens
attccatcaataaa

SEQ ID NO: 4040866 - DNA, 18 bp, Homo sapiens
attccatcaataaatgct

SEQ ID NO: 4040867 - DNA, 23 bp, Homo sapiens
attccatcaataaatgctctatt

SEQ ID NO: 4040868 - DNA, 13 bp, Homo sapiens
attccattatctt

SEQ ID NO: 4040869 - DNA, 19 bp, Homo sapiens
attccattgcctagctctt

SEQ ID NO: 4040870 - DNA, 16 bp, Homo sapiens
attccccaccctcccc

SEQ ID NO: 4040871 - DNA, 18 bp, Homo sapiens
attcccccaccagctgca

SEQ ID NO: 4040872 - DNA, 13 bp, Homo sapiens
attccctccattt

SEQ ID NO: 4040873 - DNA, 17 bp, Homo sapiens
attccctctcctgccca

SEQ ID NO: 4040874 - DNA, 17 bp, Homo sapiens
attccctctctcagcac

SEQ ID NO: 4040875 - DNA, 18 bp, Homo sapiens
attccctttgacttcagc

SEQ ID NO: 4040876 - DNA, 20 bp, Homo sapiens
attcctaacacagcatgtgt

SEQ ID NO: 4040877 - DNA, 13 bp, Homo sapiens
attcctacaactt

SEQ ID NO: 4040878 - DNA, 21 bp, Homo sapiens
attcctacaacttaatggaaa

SEQ ID NO: 4040879 - DNA, 15 bp, Homo sapiens
attcctacagcacta

SEQ ID NO: 4040880 - DNA, 17 bp, Homo sapiens
attcctacagcactact

SEQ ID NO: 4040881 - DNA, 23 bp, Homo sapiens
attcctacagcactactgggtgt

SEQ ID NO: 4040882 - DNA, 19 bp, Homo sapiens
attcctagataaaaagatg

SEQ ID NO: 4040883 - DNA, 19 bp, Homo sapiens
attcctatatcctgtgact

SEQ ID NO: 4040884 - DNA, 22 bp, Homo sapiens
attcctccaaatctcttgcttg

SEQ ID NO: 4040885 - DNA, 16 bp, Homo sapiens
attcctccctccggcc

SEQ ID NO: 4040886 - DNA, 13 bp, Homo sapiens
attcctctgggaa

SEQ ID NO: 4040887 - DNA, 15 bp, Homo sapiens
attcctgaagaacca

SEQ ID NO: 4040888 - DNA, 19 bp, Homo sapiens
attcctgaatgaaatatca

SEQ ID NO: 4040889 - DNA, 19 bp, Homo sapiens
attcctgatcccatggcca

SEQ ID NO: 4040890 - DNA, 19 bp, Homo sapiens
attcctggtttgactcagt

SEQ ID NO: 4040891 - DNA, 23 bp, Homo sapiens
attcctggtttgactcagttcca

SEQ ID NO: 4040892 - DNA, 19 bp, Homo sapiens
attccttagactcttttcc

SEQ ID NO: 4040893 - DNA, 22 bp, Homo sapiens
attccttagactcttttccttc

SEQ ID NO: 4040894 - DNA, 11 bp, Homo sapiens
attccttctct

SEQ ID NO: 4040895 - DNA, 15 bp, Homo sapiens
attccttctctgaac

SEQ ID NO: 4040896 - DNA, 16 bp, Homo sapiens
attccttctctgaaca

SEQ ID NO: 4040897 - DNA, 16 bp, Homo sapiens
attccttctttgataa

SEQ ID NO: 4040898 - DNA, 17 bp, Homo sapiens
attccttctttgataat

SEQ ID NO: 4040899 - DNA, 22 bp, Homo sapiens
attccttctttgataatgttaa

SEQ ID NO: 4040900 - DNA, 19 bp, Homo sapiens
attccttgatcattttggg

SEQ ID NO: 4040901 - DNA, 17 bp, Homo sapiens
attcctttctcatccca

SEQ ID NO: 4040902 - DNA, 14 bp, Homo sapiens
attccttttctgta

SEQ ID NO: 4040903 - DNA, 18 bp, Homo sapiens
attccttttgtgtacagt

SEQ ID NO: 4040904 - DNA, 17 bp, Homo sapiens
attcgacataccccact

SEQ ID NO: 4040905 - DNA, 12 bp, Homo sapiens
attcgccatctg

SEQ ID NO: 4040906 - DNA, 23 bp, Homo sapiens
atgaccaaatatcaccaggactg

SEQ ID NO: 4040907 - DNA, 14 bp, Homo sapiens
atgaccagaagcct

SEQ ID NO: 4040908 - DNA, 19 bp, Homo sapiens
atgaccagggatgctgggc

SEQ ID NO: 4040909 - DNA, 21 bp, Homo sapiens
atgaccagggatgctgggctg

SEQ ID NO: 4040910 - DNA, 23 bp, Homo sapiens
atgaccagggatgctgggctggg

SEQ ID NO: 4040911 - DNA, 13 bp, Homo sapiens
atgaccagtaaag

SEQ ID NO: 4040912 - DNA, 17 bp, Homo sapiens
atgaccatactgaggga

SEQ ID NO: 4040913 - DNA, 13 bp, Homo sapiens
atgacccccccag

SEQ ID NO: 4040914 - DNA, 16 bp, Homo sapiens
atgacccccccagctt

SEQ ID NO: 4040915 - DNA, 19 bp, Homo sapiens
atgacccctcgtccacccc

SEQ ID NO: 4040916 - DNA, 20 bp, Homo sapiens
atgacctctgtcctccctct

SEQ ID NO: 4040917 - DNA, 18 bp, Homo sapiens
atgacgcggctcaaaagg

SEQ ID NO: 4040918 - DNA, 19 bp, Homo sapiens
atgacggaagaacatagaa

SEQ ID NO: 4040919 - DNA, 21 bp, Homo sapiens
atgacggaagaacatagaact

SEQ ID NO: 4040920 - DNA, 16 bp, Homo sapiens
atgactaaaaatatta

SEQ ID NO: 4040921 - DNA, 23 bp, Homo sapiens
atgactaaaaatattataactta

SEQ ID NO: 4040922 - DNA, 12 bp, Homo sapiens
atgactaaagag

SEQ ID NO: 4040923 - DNA, 14 bp, Homo sapiens
atgactaaagagag

SEQ ID NO: 4040924 - DNA, 15 bp, Homo sapiens
atgactaaagagaga

SEQ ID NO: 4040925 - DNA, 18 bp, Homo sapiens
atgactaaagagagaatg

SEQ ID NO: 4040926 - DNA, 19 bp, Homo sapiens
atgactaaagagagaatgt

SEQ ID NO: 4040927 - DNA, 21 bp, Homo sapiens
atgactaaagagagaatgtag

SEQ ID NO: 4040928 - DNA, 15 bp, Homo sapiens
atgactatgtaaact

SEQ ID NO: 4040929 - DNA, 17 bp, Homo sapiens
atgactcacatgatgca

SEQ ID NO: 4040930 - DNA, 22 bp, Homo sapiens
atgactccactgtttttctcta

SEQ ID NO: 4040931 - DNA, 10 bp, Homo sapiens
atgactgggc

SEQ ID NO: 4040932 - DNA, 12 bp, Homo sapiens
atgactgggcct

SEQ ID NO: 4040933 - DNA, 18 bp, Homo sapiens
atgactggggtgggaggt

SEQ ID NO: 4040934 - DNA, 18 bp, Homo sapiens
atgacttaaaattggaaa

SEQ ID NO: 4040935 - DNA, 20 bp, Homo sapiens
atgacttatttctgctctgg

SEQ ID NO: 4040936 - DNA, 23 bp, Homo sapiens
atgactttatatggatgattcag

SEQ ID NO: 4040937 - DNA, 15 bp, Homo sapiens
atgagaagagggcct

SEQ ID NO: 4040938 - DNA, 21 bp, Homo sapiens
atgagaagagggcctgtggga

SEQ ID NO: 4040939 - DNA, 15 bp, Homo sapiens
atgagaaggcagcca

SEQ ID NO: 4040940 - DNA, 23 bp, Homo sapiens
atgagaatctacccccagatcca

SEQ ID NO: 4040941 - DNA, 14 bp, Homo sapiens
atgagaatttctaa

SEQ ID NO: 4040942 - DNA, 23 bp, Homo sapiens
atgagacagggtcttgctctgtc

SEQ ID NO: 4040943 - DNA, 18 bp, Homo sapiens
atgagactctagggtcca

SEQ ID NO: 4040944 - DNA, 18 bp, Homo sapiens
atgagagcccagaggtaa

SEQ ID NO: 4040945 - DNA, 24 bp, Homo sapiens
atgagatgatacatccaaagcaga

SEQ ID NO: 4040946 - DNA, 17 bp, Homo sapiens
atgagcaatatctgcta

SEQ ID NO: 4040947 - DNA, 13 bp, Homo sapiens
atgagcagtcaca

SEQ ID NO: 4040948 - DNA, 16 bp, Homo sapiens
atgagcagtcacactg

SEQ ID NO: 4040949 - DNA, 14 bp, Homo sapiens
atgagccagacaaa

SEQ ID NO: 4040950 - DNA, 16 bp, Homo sapiens
atgagccatcactaga

SEQ ID NO: 4040951 - DNA, 18 bp, Homo sapiens
atgagccatcactagaag

SEQ ID NO: 4040952 - DNA, 20 bp, Homo sapiens
atgagccgctgtgagcccct

SEQ ID NO: 4040953 - DNA, 14 bp, Homo sapiens
atgagcctgcccgc

SEQ ID NO: 4040954 - DNA, 12 bp, Homo sapiens
atgagcctgctg

SEQ ID NO: 4040955 - DNA, 17 bp, Homo sapiens
atgagcctgctggaagc

SEQ ID NO: 4040956 - DNA, 20 bp, Homo sapiens
atgagcctgctggaagccca

SEQ ID NO: 4040957 - DNA, 20 bp, Homo sapiens
atccaaacactgaggcagcc

SEQ ID NO: 4040958 - DNA, 23 bp, Homo sapiens
atccaaagaacttgatttgcatg

SEQ ID NO: 4040959 - DNA, 12 bp, Homo sapiens
atccaacaagaa

SEQ ID NO: 4040960 - DNA, 21 bp, Homo sapiens
atccaacaagaagaaatatga

SEQ ID NO: 4040961 - DNA, 22 bp, Homo sapiens
atccaacaagaagaaatatgaa

SEQ ID NO: 4040962 - DNA, 17 bp, Homo sapiens
atccaagggttgagagc

SEQ ID NO: 4040963 - DNA, 17 bp, Homo sapiens
atccaatcctcactggg

SEQ ID NO: 4040964 - DNA, 19 bp, Homo sapiens
atccaatcctcactgggtg

SEQ ID NO: 4040965 - DNA, 14 bp, Homo sapiens
atccaccacctccc

SEQ ID NO: 4040966 - DNA, 17 bp, Homo sapiens
atccaccacctccctca

SEQ ID NO: 4040967 - DNA, 21 bp, Homo sapiens
atccacccgggggagcccagt

SEQ ID NO: 4040968 - DNA, 22 bp, Homo sapiens
atccacccgggggagcccagtg

SEQ ID NO: 4040969 - DNA, 17 bp, Homo sapiens
atccacctgccttggcc

SEQ ID NO: 4040970 - DNA, 13 bp, Homo sapiens
atccacctgtctc

SEQ ID NO: 4040971 - DNA, 11 bp, Homo sapiens
atccaccttca

SEQ ID NO: 4040972 - DNA, 12 bp, Homo sapiens
atccaccttcag

SEQ ID NO: 4040973 - DNA, 17 bp, Homo sapiens
atccaccttcaggcccc

SEQ ID NO: 4040974 - DNA, 15 bp, Homo sapiens
atccaccttggctct

SEQ ID NO: 4040975 - DNA, 22 bp, Homo sapiens
atccactctaccctcccacccc

SEQ ID NO: 4040976 - DNA, 19 bp, Homo sapiens
atccagaaacttgttcttc

SEQ ID NO: 4040977 - DNA, 21 bp, Homo sapiens
atccagaaacttgttcttcca

SEQ ID NO: 4040978 - DNA, 15 bp, Homo sapiens
atccagaagagccca

SEQ ID NO: 4040979 - DNA, 20 bp, Homo sapiens
atccagacctggctccactc

SEQ ID NO: 4040980 - DNA, 13 bp, Homo sapiens
atccagagttctt

SEQ ID NO: 4040981 - DNA, 14 bp, Homo sapiens
atccagagttctta

SEQ ID NO: 4040982 - DNA, 12 bp, Homo sapiens
atccagcagtgt

SEQ ID NO: 4040983 - DNA, 22 bp, Homo sapiens
atccagcagtgttgctcagctc

SEQ ID NO: 4040984 - DNA, 23 bp, Homo sapiens
atccaggactatatttgggcctg

SEQ ID NO: 4040985 - DNA, 15 bp, Homo sapiens
atccaggcacagctg

SEQ ID NO: 4040986 - DNA, 17 bp, Homo sapiens
atccaggcacagctgag

SEQ ID NO: 4040987 - DNA, 16 bp, Homo sapiens
atccaggcagatccag

SEQ ID NO: 4040988 - DNA, 20 bp, Homo sapiens
atccagggacagaggcccca

SEQ ID NO: 4040989 - DNA, 22 bp, Homo sapiens
atccagtattgctgattttaaa

SEQ ID NO: 4040990 - DNA, 15 bp, Homo sapiens
atccatcagtgccaa

SEQ ID NO: 4040991 - DNA, 14 bp, Homo sapiens
atccatccctccat

SEQ ID NO: 4040992 - DNA, 18 bp, Homo sapiens
atccatctttttcttttt

SEQ ID NO: 4040993 - DNA, 20 bp, Homo sapiens
atccatgttagtttttactt

SEQ ID NO: 4040994 - DNA, 15 bp, Homo sapiens
atccattaggccagc

SEQ ID NO: 4040995 - DNA, 16 bp, Homo sapiens
atccatttgcctttct

SEQ ID NO: 4040996 - DNA, 20 bp, Homo sapiens
atcccaaagttgttgtaacc

SEQ ID NO: 4040997 - DNA, 15 bp, Homo sapiens
atcccaacagccatg

SEQ ID NO: 4040998 - DNA, 22 bp, Homo sapiens
atcccaaccaggcacctcttcc

SEQ ID NO: 4040999 - DNA, 18 bp, Homo sapiens
atcccaacctctttttcc

SEQ ID NO: 4041000 - DNA, 15 bp, Homo sapiens
atcccaactgtcttt

SEQ ID NO: 4041001 - DNA, 17 bp, Homo sapiens
atcccaactgtcttttt

SEQ ID NO: 4041002 - DNA, 16 bp, Homo sapiens
atcccaatcattgttg

SEQ ID NO: 4041003 - DNA, 17 bp, Homo sapiens
atcccaatcattgttgc

SEQ ID NO: 4041004 - DNA, 15 bp, Homo sapiens
atcccaccaaccctc

SEQ ID NO: 4041005 - DNA, 15 bp, Homo sapiens
atcccacccctccat

SEQ ID NO: 4041006 - DNA, 13 bp, Homo sapiens
atcccaccctggg

SEQ ID NO: 4041007 - DNA, 13 bp, Homo sapiens
atcccaccttccc

SEQ ID NO: 4041008 - DNA, 15 bp, Homo sapiens
atcccaccttcccac

SEQ ID NO: 4041009 - DNA, 23 bp, Homo sapiens
atcccagaggtgggatcctccct

SEQ ID NO: 4041010 - DNA, 19 bp, Homo sapiens
atcccagcactttgggagg

SEQ ID NO: 4041011 - DNA, 18 bp, Homo sapiens
atcccagcagcccaagct

SEQ ID NO: 4041012 - DNA, 15 bp, Homo sapiens
atcccagcctggggg

SEQ ID NO: 4041013 - DNA, 23 bp, Homo sapiens
atcccagcctgggggccagtggg

SEQ ID NO: 4041014 - DNA, 21 bp, Homo sapiens
atcccagctttaaaaagaaaa

SEQ ID NO: 4041015 - DNA, 17 bp, Homo sapiens
atcccagggctggctct

SEQ ID NO: 4041016 - DNA, 17 bp, Homo sapiens
atcccaggggcccaagg

SEQ ID NO: 4041017 - DNA, 17 bp, Homo sapiens
atcccatcattttccat

SEQ ID NO: 4041018 - DNA, 21 bp, Homo sapiens
atcccattaatcatttcccca

SEQ ID NO: 4041019 - DNA, 17 bp, Homo sapiens
atccccaatcagctcct

SEQ ID NO: 4041020 - DNA, 12 bp, Homo sapiens
atccccaccagc

SEQ ID NO: 4041021 - DNA, 13 bp, Homo sapiens
atccccaccagct

SEQ ID NO: 4041022 - DNA, 23 bp, Homo sapiens
atccccaggggtcccagccaccc

SEQ ID NO: 4041023 - DNA, 16 bp, Homo sapiens
atccccatcctccaga

SEQ ID NO: 4041024 - DNA, 14 bp, Homo sapiens
atcccctgagcccc

SEQ ID NO: 4041025 - DNA, 18 bp, Homo sapiens
atcccctggactgggagg

SEQ ID NO: 4041026 - DNA, 12 bp, Homo sapiens
atgcctgtgcca

SEQ ID NO: 4041027 - DNA, 13 bp, Homo sapiens
atgccttaaaatg

SEQ ID NO: 4041028 - DNA, 16 bp, Homo sapiens
atgccttaaaatggaa

SEQ ID NO: 4041029 - DNA, 18 bp, Homo sapiens
atgccttaaaatggaatt

SEQ ID NO: 4041030 - DNA, 22 bp, Homo sapiens
atgccttaaaatggaattgaaa

SEQ ID NO: 4041031 - DNA, 20 bp, Homo sapiens
atgccttcttattgctttta

SEQ ID NO: 4041032 - DNA, 12 bp, Homo sapiens
atgccttgtgct

SEQ ID NO: 4041033 - DNA, 19 bp, Homo sapiens
atgccttgtgctgttaata

SEQ ID NO: 4041034 - DNA, 20 bp, Homo sapiens
atgcctttcatagtttatta

SEQ ID NO: 4041035 - DNA, 15 bp, Homo sapiens
atgcctttgagacag

SEQ ID NO: 4041036 - DNA, 16 bp, Homo sapiens
atgccttttttgtagt

SEQ ID NO: 4041037 - DNA, 16 bp, Homo sapiens
atgcgatttcttcctt

SEQ ID NO: 4041038 - DNA, 15 bp, Homo sapiens
atgcgcaatgtggca

SEQ ID NO: 4041039 - DNA, 16 bp, Homo sapiens
atgcgcaatgtggcat

SEQ ID NO: 4041040 - DNA, 21 bp, Homo sapiens
atgcgccttgctgatggcttg

SEQ ID NO: 4041041 - DNA, 13 bp, Homo sapiens
atgctaataaact

SEQ ID NO: 4041042 - DNA, 16 bp, Homo sapiens
atgctacattaatgtt

SEQ ID NO: 4041043 - DNA, 18 bp, Homo sapiens
atgctaggttaattccaa

SEQ ID NO: 4041044 - DNA, 17 bp, Homo sapiens
atgctatggtcaggtta

SEQ ID NO: 4041045 - DNA, 16 bp, Homo sapiens
atgctcaaagaaatct

SEQ ID NO: 4041046 - DNA, 17 bp, Homo sapiens
atgctcaaagaaatcta

SEQ ID NO: 4041047 - DNA, 16 bp, Homo sapiens
atgctcaaccactgtg

SEQ ID NO: 4041048 - DNA, 13 bp, Homo sapiens
atgctcactttat

SEQ ID NO: 4041049 - DNA, 17 bp, Homo sapiens
atgctcactttattatc

SEQ ID NO: 4041050 - DNA, 13 bp, Homo sapiens
atgctccccacag

SEQ ID NO: 4041051 - DNA, 22 bp, Homo sapiens
atgctccctcccctgccctggt

SEQ ID NO: 4041052 - DNA, 13 bp, Homo sapiens
atgctcctcacct

SEQ ID NO: 4041053 - DNA, 20 bp, Homo sapiens
atgctcctcacctgtctagg

SEQ ID NO: 4041054 - DNA, 15 bp, Homo sapiens
atgctctgcatgtta

SEQ ID NO: 4041055 - DNA, 16 bp, Homo sapiens
atgctctttacttcat

SEQ ID NO: 4041056 - DNA, 21 bp, Homo sapiens
atgctctttcccacccagcct

SEQ ID NO: 4041057 - DNA, 22 bp, Homo sapiens
atgctctttcccacccagcctg

SEQ ID NO: 4041058 - DNA, 23 bp, Homo sapiens
atgctctttcccacccagcctgg

SEQ ID NO: 4041059 - DNA, 13 bp, Homo sapiens
atgctgagggtgt

SEQ ID NO: 4041060 - DNA, 18 bp, Homo sapiens
atgctgcaggacttgaga

SEQ ID NO: 4041061 - DNA, 14 bp, Homo sapiens
atgctgccaaattt

SEQ ID NO: 4041062 - DNA, 17 bp, Homo sapiens
atgctgcgcttcgcttg

SEQ ID NO: 4041063 - DNA, 19 bp, Homo sapiens
atgctgctccgcccgctcc

SEQ ID NO: 4041064 - DNA, 20 bp, Homo sapiens
atgctggactggaggcccct

SEQ ID NO: 4041065 - DNA, 14 bp, Homo sapiens
atgctggagaggtt

SEQ ID NO: 4041066 - DNA, 15 bp, Homo sapiens
atgctggagaggtta

SEQ ID NO: 4041067 - DNA, 16 bp, Homo sapiens
atgctggcccagggcc

SEQ ID NO: 4041068 - DNA, 20 bp, Homo sapiens
atgctggcccagggcccaga

SEQ ID NO: 4041069 - DNA, 21 bp, Homo sapiens
atgctggcccagggcccagag

SEQ ID NO: 4041070 - DNA, 15 bp, Homo sapiens
atgctgggctcccgt

SEQ ID NO: 4041071 - DNA, 18 bp, Homo sapiens
atgctgggctgggccctc

SEQ ID NO: 4041072 - DNA, 16 bp, Homo sapiens
atgctgtaaaagcaag

SEQ ID NO: 4041073 - DNA, 18 bp, Homo sapiens
atgctgtaggtggtatgt

SEQ ID NO: 4041074 - DNA, 11 bp, Homo sapiens
atgctgtgaca

SEQ ID NO: 4041075 - DNA, 18 bp, Homo sapiens
atgctgtgctatgaattt

SEQ ID NO: 4041076 - DNA, 11 bp, Homo sapiens
atgctgtttgt

SEQ ID NO: 4041077 - DNA, 17 bp, Homo sapiens
atgcttaaaataagcag

SEQ ID NO: 4041078 - DNA, 19 bp, Homo sapiens
atgcttaatttctaaagat

SEQ ID NO: 4041079 - DNA, 16 bp, Homo sapiens
atgcttccaatcttgc

SEQ ID NO: 4041080 - DNA, 20 bp, Homo sapiens
atgcttccaatcttgctttg

SEQ ID NO: 4041081 - DNA, 22 bp, Homo sapiens
agttgccaccacctctgtggca

SEQ ID NO: 4041082 - DNA, 19 bp, Homo sapiens
agttgcccagcctctttcc

SEQ ID NO: 4041083 - DNA, 23 bp, Homo sapiens
agttgcccgaaactaagccaggc

SEQ ID NO: 4041084 - DNA, 18 bp, Homo sapiens
agttgccctagcccagac

SEQ ID NO: 4041085 - DNA, 14 bp, Homo sapiens
agttgcctttattt

SEQ ID NO: 4041086 - DNA, 19 bp, Homo sapiens
agttgcctttatttgctgt

SEQ ID NO: 4041087 - DNA, 22 bp, Homo sapiens
agttgcgacggagagaaaaaag

SEQ ID NO: 4041088 - DNA, 23 bp, Homo sapiens
agttggctttgcccacccctcac

SEQ ID NO: 4041089 - DNA, 15 bp, Homo sapiens
agttgggagcactgg

SEQ ID NO: 4041090 - DNA, 16 bp, Homo sapiens
agttggtgttgacata

SEQ ID NO: 4041091 - DNA, 18 bp, Homo sapiens
agttgtaaataatttatt

SEQ ID NO: 4041092 - DNA, 22 bp, Homo sapiens
agttgtaaataatttatttaat

SEQ ID NO: 4041093 - DNA, 17 bp, Homo sapiens
agttgtaacttatattg

SEQ ID NO: 4041094 - DNA, 13 bp, Homo sapiens
agttgtacaaatg

SEQ ID NO: 4041095 - DNA, 18 bp, Homo sapiens
agttgtacaaatgtattt

SEQ ID NO: 4041096 - DNA, 19 bp, Homo sapiens
agttgtacaaatgtatttt

SEQ ID NO: 4041097 - DNA, 18 bp, Homo sapiens
agttgtattcttctgtat

SEQ ID NO: 4041098 - DNA, 18 bp, Homo sapiens
atatacagatgaaaattt

SEQ ID NO: 4041099 - DNA, 16 bp, Homo sapiens
atatacagttattttg

SEQ ID NO: 4041100 - DNA, 18 bp, Homo sapiens
atatacagttattttgga

SEQ ID NO: 4041101 - DNA, 18 bp, Homo sapiens
atatacattctttatctt

SEQ ID NO: 4041102 - DNA, 17 bp, Homo sapiens
atatacccccccatgca

SEQ ID NO: 4041103 - DNA, 18 bp, Homo sapiens
atatacctggcttttact

SEQ ID NO: 4041104 - DNA, 13 bp, Homo sapiens
atatactgtgtgc

SEQ ID NO: 4041105 - DNA, 14 bp, Homo sapiens
atatagaagcattt

SEQ ID NO: 4041106 - DNA, 14 bp, Homo sapiens
atatagctgctcct

SEQ ID NO: 4041107 - DNA, 19 bp, Homo sapiens
atatataaaaagaaaagat

SEQ ID NO: 4041108 - DNA, 21 bp, Homo sapiens
atatataaaaagaaaagataa

SEQ ID NO: 4041109 - DNA, 20 bp, Homo sapiens
atatataagtgtacatatgt

SEQ ID NO: 4041110 - DNA, 15 bp, Homo sapiens
atatatacaaggtga

SEQ ID NO: 4041111 - DNA, 19 bp, Homo sapiens
atatatacccccccatgca

SEQ ID NO: 4041112 - DNA, 17 bp, Homo sapiens
atatatagtccagacac

SEQ ID NO: 4041113 - DNA, 20 bp, Homo sapiens
atatatatgtgtgtgtatgt

SEQ ID NO: 4041114 - DNA, 23 bp, Homo sapiens
atatatattctattacattttca

SEQ ID NO: 4041115 - DNA, 12 bp, Homo sapiens
atatatgaataa

SEQ ID NO: 4041116 - DNA, 19 bp, Homo sapiens
atatatgtattatttataa

SEQ ID NO: 4041117 - DNA, 20 bp, Homo sapiens
atatatgtattatttataat

SEQ ID NO: 4041118 - DNA, 12 bp, Homo sapiens
atatatgtattt

SEQ ID NO: 4041119 - DNA, 14 bp, Homo sapiens
atatattattgtaa

SEQ ID NO: 4041120 - DNA, 15 bp, Homo sapiens
atatattattgtaag

SEQ ID NO: 4041121 - DNA, 21 bp, Homo sapiens
atatattctgaagcaacattt

SEQ ID NO: 4041122 - DNA, 14 bp, Homo sapiens
atatattcttataa

SEQ ID NO: 4041123 - DNA, 12 bp, Homo sapiens
atatatttaaaa

SEQ ID NO: 4041124 - DNA, 13 bp, Homo sapiens
atatatttaatga

SEQ ID NO: 4041125 - DNA, 15 bp, Homo sapiens
atatatttaatgata

SEQ ID NO: 4041126 - DNA, 15 bp, Homo sapiens
atatatttataactc

SEQ ID NO: 4041127 - DNA, 23 bp, Homo sapiens
atatatttataactcatcataaa

SEQ ID NO: 4041128 - DNA, 13 bp, Homo sapiens
atatatttattga

SEQ ID NO: 4041129 - DNA, 15 bp, Homo sapiens
atatatttatttaaa

SEQ ID NO: 4041130 - DNA, 16 bp, Homo sapiens
atatatttatttaaag

SEQ ID NO: 4041131 - DNA, 15 bp, Homo sapiens
atatatttcactttt

SEQ ID NO: 4041132 - DNA, 22 bp, Homo sapiens
atatatttcacttttgttctgc

SEQ ID NO: 4041133 - DNA, 23 bp, Homo sapiens
atatatttcacttttgttctgct

SEQ ID NO: 4041134 - DNA, 14 bp, Homo sapiens
atatatttcagata

SEQ ID NO: 4041135 - DNA, 15 bp, Homo sapiens
atatatttttcacag

SEQ ID NO: 4041136 - DNA, 17 bp, Homo sapiens
atatattttttaatttg

SEQ ID NO: 4041137 - DNA, 20 bp, Homo sapiens
atatattttttaatttgatg

SEQ ID NO: 4041138 - DNA, 15 bp, Homo sapiens
atatcaaaattctag

SEQ ID NO: 4041139 - DNA, 21 bp, Homo sapiens
atatcaacagatagttgtgtt

SEQ ID NO: 4041140 - DNA, 19 bp, Homo sapiens
atatcaccaggactgttac

SEQ ID NO: 4041141 - DNA, 20 bp, Homo sapiens
atatcagcctgagtctcctg

SEQ ID NO: 4041142 - DNA, 21 bp, Homo sapiens
atatcagcctgagtctcctgt

SEQ ID NO: 4041143 - DNA, 13 bp, Homo sapiens
atatcatgcaaaa

SEQ ID NO: 4041144 - DNA, 20 bp, Homo sapiens
atatcatgcaaaatatgttt

SEQ ID NO: 4041145 - DNA, 13 bp, Homo sapiens
atatcatgctaaa

SEQ ID NO: 4041146 - DNA, 19 bp, Homo sapiens
atatcatgtaaagaaatgt

SEQ ID NO: 4041147 - DNA, 23 bp, Homo sapiens
atatcatttattttttacattat

SEQ ID NO: 4041148 - DNA, 14 bp, Homo sapiens
atatccaccacctc

SEQ ID NO: 4041149 - DNA, 16 bp, Homo sapiens
atatccaccacctccc

SEQ ID NO: 4041150 - DNA, 15 bp, Homo sapiens
atatccatgtactgt

SEQ ID NO: 4041151 - DNA, 21 bp, Homo sapiens
atatcccagctttaaaaagaa

SEQ ID NO: 4041152 - DNA, 20 bp, Homo sapiens
atatcctctccccctcctcc

SEQ ID NO: 4041153 - DNA, 22 bp, Homo sapiens
atatcctctccccctcctccag

SEQ ID NO: 4041154 - DNA, 15 bp, Homo sapiens
atatcctgagccatc

SEQ ID NO: 4041155 - DNA, 23 bp, Homo sapiens
atatccttctggctgtagataaa

SEQ ID NO: 4041156 - DNA, 15 bp, Homo sapiens
atatcctttctaaca

SEQ ID NO: 4041157 - DNA, 15 bp, Homo sapiens
atatcgctgacttca

SEQ ID NO: 4041158 - DNA, 14 bp, Homo sapiens
atatctattaatat

SEQ ID NO: 4041159 - DNA, 12 bp, Homo sapiens
atatctcatctg

SEQ ID NO: 4041160 - DNA, 11 bp, Homo sapiens
atatctgaaaa

SEQ ID NO: 4041161 - DNA, 16 bp, Homo sapiens
atatctgaaaactgga

SEQ ID NO: 4041162 - DNA, 17 bp, Homo sapiens
atatctgaaaactggaa

SEQ ID NO: 4041163 - DNA, 20 bp, Homo sapiens
atatctgaagagtatccttc

SEQ ID NO: 4041164 - DNA, 12 bp, Homo sapiens
atatctgcaaaa

SEQ ID NO: 4041165 - DNA, 15 bp, Homo sapiens
atatctggacaagcc

SEQ ID NO: 4041166 - DNA, 18 bp, Homo sapiens
atatctgggttaagtgtt

SEQ ID NO: 4041167 - DNA, 15 bp, Homo sapiens
atatctgtaatggta

SEQ ID NO: 4041168 - DNA, 20 bp, Homo sapiens
atatcttcagctctttttgt

SEQ ID NO: 4041169 - DNA, 19 bp, Homo sapiens
atatcttctgatttgtccc

SEQ ID NO: 4041170 - DNA, 16 bp, Homo sapiens
atatctttattaatca

SEQ ID NO: 4041171 - DNA, 21 bp, Homo sapiens
atatctttgtgataatttaag

SEQ ID NO: 4041172 - DNA, 12 bp, Homo sapiens
atatcttttatg

SEQ ID NO: 4041173 - DNA, 13 bp, Homo sapiens
atatcttttggtt

SEQ ID NO: 4041174 - DNA, 11 bp, Homo sapiens
atatttctcaa

SEQ ID NO: 4041175 - DNA, 10 bp, Homo sapiens
atatttctga

SEQ ID NO: 4041176 - DNA, 15 bp, Homo sapiens
atatttcttgctttc

SEQ ID NO: 4041177 - DNA, 13 bp, Homo sapiens
atatttgaatttt

SEQ ID NO: 4041178 - DNA, 20 bp, Homo sapiens
atatttgacttgcatgaaga

SEQ ID NO: 4041179 - DNA, 23 bp, Homo sapiens
atatttgcattgaggaaatatta

SEQ ID NO: 4041180 - DNA, 13 bp, Homo sapiens
atatttgcttttt

SEQ ID NO: 4041181 - DNA, 11 bp, Homo sapiens
atatttgtaca

SEQ ID NO: 4041182 - DNA, 13 bp, Homo sapiens
atatttgtacaaa

SEQ ID NO: 4041183 - DNA, 11 bp, Homo sapiens
atatttgtgta

SEQ ID NO: 4041184 - DNA, 16 bp, Homo sapiens
atattttaaaatgaga

SEQ ID NO: 4041185 - DNA, 23 bp, Homo sapiens
atattttacattcttggaaagtc

SEQ ID NO: 4041186 - DNA, 15 bp, Homo sapiens
atattttatgtgaga

SEQ ID NO: 4041187 - DNA, 24 bp, Homo sapiens
atattttcaaattgtatctagtgc

SEQ ID NO: 4041188 - DNA, 20 bp, Homo sapiens
atattttcaactatgtaggt

SEQ ID NO: 4041189 - DNA, 13 bp, Homo sapiens
atattttcacaat

SEQ ID NO: 4041190 - DNA, 23 bp, Homo sapiens
atattttcttccaagcaaaggtg

SEQ ID NO: 4041191 - DNA, 23 bp, Homo sapiens
atattttgataataaattgaaat

SEQ ID NO: 4041192 - DNA, 23 bp, Homo sapiens
atattttggaaactgctaaattc

SEQ ID NO: 4041193 - DNA, 21 bp, Homo sapiens
atattttgttgccttcatctt

SEQ ID NO: 4041194 - DNA, 21 bp, Homo sapiens
atattttgttgctttcttacc

SEQ ID NO: 4041195 - DNA, 17 bp, Homo sapiens
atatttttaaaaaatga

SEQ ID NO: 4041196 - DNA, 14 bp, Homo sapiens
atatttttatattg

SEQ ID NO: 4041197 - DNA, 18 bp, Homo sapiens
atatttttatatttcctt

SEQ ID NO: 4041198 - DNA, 19 bp, Homo sapiens
atatttttatatttccttt

SEQ ID NO: 4041199 - DNA, 21 bp, Homo sapiens
atatttttatatttcctttat

SEQ ID NO: 4041200 - DNA, 18 bp, Homo sapiens
atatttttggttgtcaat

SEQ ID NO: 4041201 - DNA, 10 bp, Homo sapiens
atatttttgt

SEQ ID NO: 4041202 - DNA, 14 bp, Homo sapiens
atatttttgtactt

SEQ ID NO: 4041203 - DNA, 15 bp, Homo sapiens
atatttttgtacttg

SEQ ID NO: 4041204 - DNA, 16 bp, Homo sapiens
atatttttgtacttga

SEQ ID NO: 4041205 - DNA, 20 bp, Homo sapiens
atattttttaatttgatgaa

SEQ ID NO: 4041206 - DNA, 12 bp, Homo sapiens
atattttttgca

SEQ ID NO: 4041207 - DNA, 16 bp, Homo sapiens
atatttttttaattta

SEQ ID NO: 4041208 - DNA, 20 bp, Homo sapiens
atcaaaaaaagactcagcca

SEQ ID NO: 4041209 - DNA, 16 bp, Homo sapiens
atcaaaacaagtgaaa

SEQ ID NO: 4041210 - DNA, 21 bp, Homo sapiens
atcaaaacctttcaaatatca

SEQ ID NO: 4041211 - DNA, 24 bp, Homo sapiens
atcaaaaggttaataaagtaatta

SEQ ID NO: 4041212 - DNA, 15 bp, Homo sapiens
atcaaaataaaaagt

SEQ ID NO: 4041213 - DNA, 18 bp, Homo sapiens
atcaaaatcactatcttt

SEQ ID NO: 4041214 - DNA, 22 bp, Homo sapiens
atcaaaatcactatctttctga

SEQ ID NO: 4041215 - DNA, 17 bp, Homo sapiens
atcaaaatgtagctttt

SEQ ID NO: 4041216 - DNA, 17 bp, Homo sapiens
atcaaaccctagccttg

SEQ ID NO: 4041217 - DNA, 17 bp, Homo sapiens
atcaaagcatagatgtt

SEQ ID NO: 4041218 - DNA, 13 bp, Homo sapiens
atcaaagccaggg

SEQ ID NO: 4041219 - DNA, 17 bp, Homo sapiens
atcaaataagtatttat

SEQ ID NO: 4041220 - DNA, 20 bp, Homo sapiens
atcaaataagtatttataat

SEQ ID NO: 4041221 - DNA, 15 bp, Homo sapiens
atcaaatactttaaa

SEQ ID NO: 4041222 - DNA, 20 bp, Homo sapiens
atcaaatagaaccactatga

SEQ ID NO: 4041223 - DNA, 18 bp, Homo sapiens
atcaacaagagttgtctt

SEQ ID NO: 4041224 - DNA, 15 bp, Homo sapiens
atcaactttaatcaa

SEQ ID NO: 4041225 - DNA, 21 bp, Homo sapiens
atcaactttaatcaagttgta

SEQ ID NO: 4041226 - DNA, 16 bp, Homo sapiens
atcaagagctgccctc

SEQ ID NO: 4041227 - DNA, 17 bp, Homo sapiens
atcaagagctgccctcc

SEQ ID NO: 4041228 - DNA, 20 bp, Homo sapiens
atcaagagctgccctccttg

SEQ ID NO: 4041229 - DNA, 13 bp, Homo sapiens
atcaagatttttt

SEQ ID NO: 4041230 - DNA, 14 bp, Homo sapiens
atcaagcctttatg

SEQ ID NO: 4041231 - DNA, 22 bp, Homo sapiens
atcaagcctttatggctgctgg

SEQ ID NO: 4041232 - DNA, 21 bp, Homo sapiens
atcaagtatttgggaagtgaa

SEQ ID NO: 4041233 - DNA, 18 bp, Homo sapiens
atcaagtcaatcatttct

SEQ ID NO: 4041234 - DNA, 17 bp, Homo sapiens
atcaagtggcatgtgct

SEQ ID NO: 4041235 - DNA, 15 bp, Homo sapiens
atcaagtgtgcttta

SEQ ID NO: 4041236 - DNA, 16 bp, Homo sapiens
atcaataaaatgtgat

SEQ ID NO: 4041237 - DNA, 22 bp, Homo sapiens
atcaataacagccgctccagag

SEQ ID NO: 4041238 - DNA, 17 bp, Homo sapiens
atcaatacactagttgt

SEQ ID NO: 4041239 - DNA, 15 bp, Homo sapiens
atcaatcaaataagt

SEQ ID NO: 4041240 - DNA, 22 bp, Homo sapiens
atcaatcctgggcaatcagaca

SEQ ID NO: 4041241 - DNA, 16 bp, Homo sapiens
atcaatgaatattgaa

SEQ ID NO: 4041242 - DNA, 18 bp, Homo sapiens
atcaatgaatattgaagt

SEQ ID NO: 4041243 - DNA, 18 bp, Homo sapiens
atcaatgttcattgtaat

SEQ ID NO: 4041244 - DNA, 14 bp, Homo sapiens
atcaattaaatgta

SEQ ID NO: 4041245 - DNA, 20 bp, Homo sapiens
ctctacagtgccaactcctc

SEQ ID NO: 4041246 - DNA, 17 bp, Homo sapiens
ctctaccaaataatttc

SEQ ID NO: 4041247 - DNA, 13 bp, Homo sapiens
ctctaccagttgg

SEQ ID NO: 4041248 - DNA, 17 bp, Homo sapiens
ctctaccagttggcaga

SEQ ID NO: 4041249 - DNA, 22 bp, Homo sapiens
ctctaccagttggcagacagcc

SEQ ID NO: 4041250 - DNA, 23 bp, Homo sapiens
ctctaccagttggcagacagccg

SEQ ID NO: 4041251 - DNA, 14 bp, Homo sapiens
ctctaccatcatcc

SEQ ID NO: 4041252 - DNA, 16 bp, Homo sapiens
ctctacccatgagcct

SEQ ID NO: 4041253 - DNA, 13 bp, Homo sapiens
ctctacccctgct

SEQ ID NO: 4041254 - DNA, 15 bp, Homo sapiens
ctctaccctcccacc

SEQ ID NO: 4041255 - DNA, 15 bp, Homo sapiens
ctctaccctgctccc

SEQ ID NO: 4041256 - DNA, 12 bp, Homo sapiens
ctctaccttcct

SEQ ID NO: 4041257 - DNA, 16 bp, Homo sapiens
ctctaccttcctgtcc

SEQ ID NO: 4041258 - DNA, 23 bp, Homo sapiens
ctctaccttcctgtccctgaggt

SEQ ID NO: 4041259 - DNA, 19 bp, Homo sapiens
ctctacttagcatgtccct

SEQ ID NO: 4041260 - DNA, 20 bp, Homo sapiens
ctctagaattttaagtgctt

SEQ ID NO: 4041261 - DNA, 16 bp, Homo sapiens
ctctagacaagatatt

SEQ ID NO: 4041262 - DNA, 13 bp, Homo sapiens
ctctagagcaggg

SEQ ID NO: 4041263 - DNA, 13 bp, Homo sapiens
ctctagcaggcct

SEQ ID NO: 4041264 - DNA, 14 bp, Homo sapiens
ctctagcaggccta

SEQ ID NO: 4041265 - DNA, 21 bp, Homo sapiens
ctctaggaagacatttttccg

SEQ ID NO: 4041266 - DNA, 14 bp, Homo sapiens
ctctaggcaagcag

SEQ ID NO: 4041267 - DNA, 18 bp, Homo sapiens
ctctaggcaagcaggacc

SEQ ID NO: 4041268 - DNA, 23 bp, Homo sapiens
ctctaggcaagcaggacctggca

SEQ ID NO: 4041269 - DNA, 17 bp, Homo sapiens
ctctaggcctctccagt

SEQ ID NO: 4041270 - DNA, 20 bp, Homo sapiens
ctctaggggtcaggctccat

SEQ ID NO: 4041271 - DNA, 12 bp, Homo sapiens
ctctagggtcca

SEQ ID NO: 4041272 - DNA, 20 bp, Homo sapiens
ctctagtgggacagcccaga

SEQ ID NO: 4041273 - DNA, 22 bp, Homo sapiens
ctctagtgggacagcccagagc

SEQ ID NO: 4041274 - DNA, 15 bp, Homo sapiens
ctctatacatctctc

SEQ ID NO: 4041275 - DNA, 16 bp, Homo sapiens
ctctatcctgggcttt

SEQ ID NO: 4041276 - DNA, 12 bp, Homo sapiens
ctctatgtacta

SEQ ID NO: 4041277 - DNA, 21 bp, Homo sapiens
ctctattctcaaagtttccta

SEQ ID NO: 4041278 - DNA, 19 bp, Homo sapiens
ctctattgggcacagccta

SEQ ID NO: 4041279 - DNA, 13 bp, Homo sapiens
ctctatttaatat

SEQ ID NO: 4041280 - DNA, 14 bp, Homo sapiens
ctctatttaatatt

SEQ ID NO: 4041281 - DNA, 24 bp, Homo sapiens
ctctatttacttctaatcttaaat

SEQ ID NO: 4041282 - DNA, 14 bp, Homo sapiens
ctctatttccccct

SEQ ID NO: 4041283 - DNA, 13 bp, Homo sapiens
ctctatttctgga

SEQ ID NO: 4041284 - DNA, 14 bp, Homo sapiens
ctctattttaaagt

SEQ ID NO: 4041285 - DNA, 13 bp, Homo sapiens
ctctattttgtga

SEQ ID NO: 4041286 - DNA, 15 bp, Homo sapiens
ctctattttgtgatg

SEQ ID NO: 4041287 - DNA, 18 bp, Homo sapiens
ctctcaaaagtctatttt

SEQ ID NO: 4041288 - DNA, 19 bp, Homo sapiens
ctctcaaaagtctattttt

SEQ ID NO: 4041289 - DNA, 23 bp, Homo sapiens
ctctcaaactaaaagacatttgt

SEQ ID NO: 4041290 - DNA, 15 bp, Homo sapiens
ctctcaagaccagag

SEQ ID NO: 4041291 - DNA, 13 bp, Homo sapiens
ctctcaattaaag

SEQ ID NO: 4041292 - DNA, 19 bp, Homo sapiens
ctctcactccccatgccac

SEQ ID NO: 4041293 - DNA, 16 bp, Homo sapiens
ctctcagagcatctgg

SEQ ID NO: 4041294 - DNA, 18 bp, Homo sapiens
ctctcagagcatctggct

SEQ ID NO: 4041295 - DNA, 22 bp, Homo sapiens
ctctcagagcatctggctgttt

SEQ ID NO: 4041296 - DNA, 16 bp, Homo sapiens
ctctcagcacagcctg

SEQ ID NO: 4041297 - DNA, 18 bp, Homo sapiens
ctctcagcacagcctggg

SEQ ID NO: 4041298 - DNA, 17 bp, Homo sapiens
ctctcagccttacattt

SEQ ID NO: 4041299 - DNA, 19 bp, Homo sapiens
ctctcagccttacatttgt

SEQ ID NO: 4041300 - DNA, 12 bp, Homo sapiens
ctctcagctcca

SEQ ID NO: 4041301 - DNA, 13 bp, Homo sapiens
ctctcagctccag

SEQ ID NO: 4041302 - DNA, 15 bp, Homo sapiens
ctctcagctccaggt

SEQ ID NO: 4041303 - DNA, 15 bp, Homo sapiens
ctctcaggagcacag

SEQ ID NO: 4041304 - DNA, 16 bp, Homo sapiens
ctctcaggagcacagg

SEQ ID NO: 4041305 - DNA, 18 bp, Homo sapiens
ctctcaggagcacaggca

SEQ ID NO: 4041306 - DNA, 20 bp, Homo sapiens
ctctcaggagcacaggcagc

SEQ ID NO: 4041307 - DNA, 12 bp, Homo sapiens
ctctcagggcct

SEQ ID NO: 4041308 - DNA, 14 bp, Homo sapiens
ctctcagggcctgg

SEQ ID NO: 4041309 - DNA, 11 bp, Homo sapiens
ctctgagccca

SEQ ID NO: 4041310 - DNA, 18 bp, Homo sapiens
ctctgagcccagctgcct

SEQ ID NO: 4041311 - DNA, 19 bp, Homo sapiens
ctctgagcccagctgcctg

SEQ ID NO: 4041312 - DNA, 13 bp, Homo sapiens
ctctgagcccata

SEQ ID NO: 4041313 - DNA, 17 bp, Homo sapiens
ctctgagcgggaggcag

SEQ ID NO: 4041314 - DNA, 16 bp, Homo sapiens
ctctgagctgctcacc

SEQ ID NO: 4041315 - DNA, 15 bp, Homo sapiens
ctctgaggtgcctgt

SEQ ID NO: 4041316 - DNA, 22 bp, Homo sapiens
ctctgaggtgcctgtcccaccc

SEQ ID NO: 4041317 - DNA, 20 bp, Homo sapiens
ctctgagtttaccatttgta

SEQ ID NO: 4041318 - DNA, 21 bp, Homo sapiens
ctctgagtttaccatttgtaa

SEQ ID NO: 4041319 - DNA, 17 bp, Homo sapiens
ctctgatacccagagca

SEQ ID NO: 4041320 - DNA, 13 bp, Homo sapiens
ctctgatgtccca

SEQ ID NO: 4041321 - DNA, 18 bp, Homo sapiens
ctctgatttgcaaaaaaa

SEQ ID NO: 4041322 - DNA, 22 bp, Homo sapiens
ctctgcaagcttcttgctgatc

SEQ ID NO: 4041323 - DNA, 18 bp, Homo sapiens
ctctgcaattcccctctg

SEQ ID NO: 4041324 - DNA, 15 bp, Homo sapiens
ctctgcacagatgga

SEQ ID NO: 4041325 - DNA, 15 bp, Homo sapiens
ctctgcacccctctg

SEQ ID NO: 4041326 - DNA, 17 bp, Homo sapiens
ctctgcagacttcccag

SEQ ID NO: 4041327 - DNA, 18 bp, Homo sapiens
ctctgcagacttcccagc

SEQ ID NO: 4041328 - DNA, 13 bp, Homo sapiens
ctctgcagatgtg

SEQ ID NO: 4041329 - DNA, 13 bp, Homo sapiens
ctctgcagctgcc

SEQ ID NO: 4041330 - DNA, 13 bp, Homo sapiens
ctctgcatcccag

SEQ ID NO: 4041331 - DNA, 14 bp, Homo sapiens
ctctgccaaaggat

SEQ ID NO: 4041332 - DNA, 21 bp, Homo sapiens
ctctgccaaaggatgtgatat

SEQ ID NO: 4041333 - DNA, 13 bp, Homo sapiens
ctctgccacccac

SEQ ID NO: 4041334 - DNA, 19 bp, Homo sapiens
ctctgccacccactcagga

SEQ ID NO: 4041335 - DNA, 17 bp, Homo sapiens
ctctgccagaagatccc

SEQ ID NO: 4041336 - DNA, 13 bp, Homo sapiens
ctctgccagtgac

SEQ ID NO: 4041337 - DNA, 16 bp, Homo sapiens
ctctgccagtggatcc

SEQ ID NO: 4041338 - DNA, 22 bp, Homo sapiens
ctctgccagtggatcccctgcg

SEQ ID NO: 4041339 - DNA, 20 bp, Homo sapiens
ctctgcccaacccttccctc

SEQ ID NO: 4041340 - DNA, 13 bp, Homo sapiens
ctctgcccagctt

SEQ ID NO: 4041341 - DNA, 15 bp, Homo sapiens
ctctgccccacccaa

SEQ ID NO: 4041342 - DNA, 15 bp, Homo sapiens
ctctgccccacgctg

SEQ ID NO: 4041343 - DNA, 11 bp, Homo sapiens
ctctgcccctg

SEQ ID NO: 4041344 - DNA, 16 bp, Homo sapiens
ctctgcccctggacct

SEQ ID NO: 4041345 - DNA, 20 bp, Homo sapiens
ctctgcccctggacctggga

SEQ ID NO: 4041346 - DNA, 13 bp, Homo sapiens
ctctgccctgtgt

SEQ ID NO: 4041347 - DNA, 14 bp, Homo sapiens
ctctgccctgtgta

SEQ ID NO: 4041348 - DNA, 19 bp, Homo sapiens
ctctgccgctacctccctc

SEQ ID NO: 4041349 - DNA, 22 bp, Homo sapiens
ctctgccggtcgggcagccagc

SEQ ID NO: 4041350 - DNA, 15 bp, Homo sapiens
cgagaggcagagaaa

SEQ ID NO: 4041351 - DNA, 16 bp, Homo sapiens
cgagatcggggtagaa

SEQ ID NO: 4041352 - DNA, 23 bp, Homo sapiens
cgagcaaagatcaaaataaaaag

SEQ ID NO: 4041353 - DNA, 21 bp, Homo sapiens
cgagcagtcctgcctcagcct

SEQ ID NO: 4041354 - DNA, 15 bp, Homo sapiens
cgagcatcctggcca

SEQ ID NO: 4041355 - DNA, 17 bp, Homo sapiens
cgagccgggcctggggc

SEQ ID NO: 4041356 - DNA, 21 bp, Homo sapiens
cgagccttttcacccttctac

SEQ ID NO: 4041357 - DNA, 23 bp, Homo sapiens
cgagcgctttctggaaaagagga

SEQ ID NO: 4041358 - DNA, 19 bp, Homo sapiens
cgagctcttggcctttgca

SEQ ID NO: 4041359 - DNA, 12 bp, Homo sapiens
cgagctgggggg

SEQ ID NO: 4041360 - DNA, 14 bp, Homo sapiens
cgagctggtgcatt

SEQ ID NO: 4041361 - DNA, 21 bp, Homo sapiens
cgagctggtgcattacagaga

SEQ ID NO: 4041362 - DNA, 16 bp, Homo sapiens
cgaggaatctgtgggt

SEQ ID NO: 4041363 - DNA, 23 bp, Homo sapiens
cgaggaggtgcctggagtgccca

SEQ ID NO: 4041364 - DNA, 14 bp, Homo sapiens
cgaggagtaacaat

SEQ ID NO: 4041365 - DNA, 21 bp, Homo sapiens
cgaggagtaacaatacaaatg

SEQ ID NO: 4041366 - DNA, 15 bp, Homo sapiens
cgaggattataaatg

SEQ ID NO: 4041367 - DNA, 23 bp, Homo sapiens
cgaggattataaatgaaatttgc

SEQ ID NO: 4041368 - DNA, 12 bp, Homo sapiens
cgaggcccagcg

SEQ ID NO: 4041369 - DNA, 13 bp, Homo sapiens
cgaggcccagcgg

SEQ ID NO: 4041370 - DNA, 15 bp, Homo sapiens
cgaggcccagcgggc

SEQ ID NO: 4041371 - DNA, 18 bp, Homo sapiens
cgaggcccagcgggcaga

SEQ ID NO: 4041372 - DNA, 22 bp, Homo sapiens
cgaggccctcaatccaccttca

SEQ ID NO: 4041373 - DNA, 18 bp, Homo sapiens
cgaggcgatgccacgctt

SEQ ID NO: 4041374 - DNA, 21 bp, Homo sapiens
cgagggcagggaccacaccct

SEQ ID NO: 4041375 - DNA, 11 bp, Homo sapiens
cgagggctggc

SEQ ID NO: 4041376 - DNA, 14 bp, Homo sapiens
cgagggctggctgg

SEQ ID NO: 4041377 - DNA, 17 bp, Homo sapiens
cgagggctggctggcct

SEQ ID NO: 4041378 - DNA, 14 bp, Homo sapiens
cgagggtcctggct

SEQ ID NO: 4041379 - DNA, 15 bp, Homo sapiens
cgagggtcctggctc

SEQ ID NO: 4041380 - DNA, 16 bp, Homo sapiens
cgagggtcctggctcc

SEQ ID NO: 4041381 - DNA, 23 bp, Homo sapiens
cgagggtcctggctcctgagggg

SEQ ID NO: 4041382 - DNA, 14 bp, Homo sapiens
cgaggtcaggagat

SEQ ID NO: 4041383 - DNA, 15 bp, Homo sapiens
cgagtccaagctggg

SEQ ID NO: 4041384 - DNA, 16 bp, Homo sapiens
cgagtctcttctccac

SEQ ID NO: 4041385 - DNA, 14 bp, Homo sapiens
cgagtgccaggact

SEQ ID NO: 4041386 - DNA, 23 bp, Homo sapiens
cgataaaaaaaaaaaaaaaatta

SEQ ID NO: 4041387 - DNA, 16 bp, Homo sapiens
cgataaaattacaaaa

SEQ ID NO: 4041388 - DNA, 18 bp, Homo sapiens
cgataatgcatgaagcaa

SEQ ID NO: 4041389 - DNA, 18 bp, Homo sapiens
cgatacaccgggcctgga

SEQ ID NO: 4041390 - DNA, 13 bp, Homo sapiens
cgatacctggagc

SEQ ID NO: 4041391 - DNA, 17 bp, Homo sapiens
cgatacctggagcagag

SEQ ID NO: 4041392 - DNA, 13 bp, Homo sapiens
cgatatacagatg

SEQ ID NO: 4041393 - DNA, 18 bp, Homo sapiens
cgatatacagatgaaaat

SEQ ID NO: 4041394 - DNA, 15 bp, Homo sapiens
cgatatactctagat

SEQ ID NO: 4041395 - DNA, 22 bp, Homo sapiens
cgatatttttaaagatctgtaa

SEQ ID NO: 4041396 - DNA, 22 bp, Homo sapiens
cgatccacctgtctcagcctcc

SEQ ID NO: 4041397 - DNA, 15 bp, Homo sapiens
cgatgcagacagggg

SEQ ID NO: 4041398 - DNA, 12 bp, Homo sapiens
cgatgctccctc

SEQ ID NO: 4041399 - DNA, 19 bp, Homo sapiens
cgatgctccctcagcctca

SEQ ID NO: 4041400 - DNA, 20 bp, Homo sapiens
cgatgctccctcagcctcag

SEQ ID NO: 4041401 - DNA, 15 bp, Homo sapiens
cgatggagcccccag

SEQ ID NO: 4041402 - DNA, 17 bp, Homo sapiens
cgatggagcccccagat

SEQ ID NO: 4041403 - DNA, 19 bp, Homo sapiens
cgatggggcaagacagaaa

SEQ ID NO: 4041404 - DNA, 17 bp, Homo sapiens
cgattattatctaaagt

SEQ ID NO: 4041405 - DNA, 12 bp, Homo sapiens
cgattggagaat

SEQ ID NO: 4041406 - DNA, 23 bp, Homo sapiens
cgattggccacctgtagccatct

SEQ ID NO: 4041407 - DNA, 22 bp, Homo sapiens
cgatttttgtatgttatgaaca

SEQ ID NO: 4041408 - DNA, 19 bp, Homo sapiens
cgcaaagggctgaaagcca

SEQ ID NO: 4041409 - DNA, 20 bp, Homo sapiens
cgcaaggccgagcgttccca

SEQ ID NO: 4041410 - DNA, 13 bp, Homo sapiens
cgcaatgtggcat

SEQ ID NO: 4041411 - DNA, 19 bp, Homo sapiens
cgcacaaacacacacacta

SEQ ID NO: 4041412 - DNA, 13 bp, Homo sapiens
cgcacacacacaa

SEQ ID NO: 4041413 - DNA, 16 bp, Homo sapiens
cgcaccaatgcccagc

SEQ ID NO: 4041414 - DNA, 16 bp, Homo sapiens
cgcaccatgtgggcac

SEQ ID NO: 4041415 - DNA, 17 bp, Homo sapiens
cgcaccccggcctcagg

SEQ ID NO: 4041416 - DNA, 15 bp, Homo sapiens
cgcacctgcctcagg

SEQ ID NO: 4041417 - DNA, 18 bp, Homo sapiens
cgcactcacccatgtgcc

SEQ ID NO: 4041418 - DNA, 16 bp, Homo sapiens
cgcactccatgagcac

SEQ ID NO: 4041419 - DNA, 21 bp, Homo sapiens
cgcagacgggcacagacacgc

SEQ ID NO: 4041420 - DNA, 13 bp, Homo sapiens
cgcagccctgctt

SEQ ID NO: 4041421 - DNA, 24 bp, Homo sapiens
cgcagccctgctttgggctgccct

SEQ ID NO: 4041422 - DNA, 17 bp, Homo sapiens
cgcaggattcagccgga

SEQ ID NO: 4041423 - DNA, 16 bp, Homo sapiens
cgcaggggttgcagtg

SEQ ID NO: 4041424 - DNA, 14 bp, Homo sapiens
cgcaggtgggctgg

SEQ ID NO: 4041425 - DNA, 23 bp, Homo sapiens
cgcaggtgggtgctgccctgtgt

SEQ ID NO: 4041426 - DNA, 17 bp, Homo sapiens
cgcagtgctgggaccag

SEQ ID NO: 4041427 - DNA, 22 bp, Homo sapiens
cgcagtgctgggaccagagcca

SEQ ID NO: 4041428 - DNA, 19 bp, Homo sapiens
cgcagtgcttctctacaga

SEQ ID NO: 4041429 - DNA, 13 bp, Homo sapiens
cgcagttctttcc

SEQ ID NO: 4041430 - DNA, 14 bp, Homo sapiens
cgccaccgtgcctg

SEQ ID NO: 4041431 - DNA, 14 bp, Homo sapiens
cgccactccctggg

SEQ ID NO: 4041432 - DNA, 15 bp, Homo sapiens
cgccactccctggga

SEQ ID NO: 4041433 - DNA, 20 bp, Homo sapiens
cgccactccctgggacacag

SEQ ID NO: 4041434 - DNA, 17 bp, Homo sapiens
cgccagaggtgcttcac

SEQ ID NO: 4041435 - DNA, 15 bp, Homo sapiens
ctctgtcccttgctg

SEQ ID NO: 4041436 - DNA, 16 bp, Homo sapiens
ctctgtcccttgctgt

SEQ ID NO: 4041437 - DNA, 15 bp, Homo sapiens
ctctgtctacaaata

SEQ ID NO: 4041438 - DNA, 17 bp, Homo sapiens
ctctgtctcatcctcct

SEQ ID NO: 4041439 - DNA, 18 bp, Homo sapiens
ctctgtctcatcctcctg

SEQ ID NO: 4041440 - DNA, 14 bp, Homo sapiens
ctctgtctgccctt

SEQ ID NO: 4041441 - DNA, 22 bp, Homo sapiens
ctctgtcttcaggctctgccca

SEQ ID NO: 4041442 - DNA, 15 bp, Homo sapiens
ctctgtcttgtgttt

SEQ ID NO: 4041443 - DNA, 14 bp, Homo sapiens
ctctgtgaatacaa

SEQ ID NO: 4041444 - DNA, 21 bp, Homo sapiens
ctctgtgaatacaattaaagg

SEQ ID NO: 4041445 - DNA, 20 bp, Homo sapiens
ctctgtgcacttatttatga

SEQ ID NO: 4041446 - DNA, 20 bp, Homo sapiens
ctctgtgcagtcactggagg

SEQ ID NO: 4041447 - DNA, 20 bp, Homo sapiens
ctctgtgccagggcagcatt

SEQ ID NO: 4041448 - DNA, 21 bp, Homo sapiens
ctctgtgccagggcagcattt

SEQ ID NO: 4041449 - DNA, 14 bp, Homo sapiens
ctctgtgctgtgga

SEQ ID NO: 4041450 - DNA, 21 bp, Homo sapiens
ctctgtgtatgagtgtgaatg

SEQ ID NO: 4041451 - DNA, 17 bp, Homo sapiens
ctctgtgtccttccctg

SEQ ID NO: 4041452 - DNA, 16 bp, Homo sapiens
ctctgtgttcccagag

SEQ ID NO: 4041453 - DNA, 14 bp, Homo sapiens
ctctgtgtttaaaa

SEQ ID NO: 4041454 - DNA, 19 bp, Homo sapiens
ctctgtgtttgttcctaca

SEQ ID NO: 4041455 - DNA, 15 bp, Homo sapiens
ctctgttaaggttga

SEQ ID NO: 4041456 - DNA, 15 bp, Homo sapiens
ctctgttacccaggc

SEQ ID NO: 4041457 - DNA, 19 bp, Homo sapiens
ctctgttacccaggctgga

SEQ ID NO: 4041458 - DNA, 22 bp, Homo sapiens
ctcttaagcagcatggaaaaat

SEQ ID NO: 4041459 - DNA, 22 bp, Homo sapiens
ctcttaagcttccgccgtctca

SEQ ID NO: 4041460 - DNA, 12 bp, Homo sapiens
ctcttaatctgt

SEQ ID NO: 4041461 - DNA, 14 bp, Homo sapiens
ctcttaatctgtgt

SEQ ID NO: 4041462 - DNA, 21 bp, Homo sapiens
ctcttaatctgtgtgtatatt

SEQ ID NO: 4041463 - DNA, 17 bp, Homo sapiens
ctcttactaatgtaaaa

SEQ ID NO: 4041464 - DNA, 14 bp, Homo sapiens
ctcttactctttcc

SEQ ID NO: 4041465 - DNA, 16 bp, Homo sapiens
ctcttactctttccta

SEQ ID NO: 4041466 - DNA, 20 bp, Homo sapiens
ctcttactctttcctatttc

SEQ ID NO: 4041467 - DNA, 14 bp, Homo sapiens
ctcttactttgctt

SEQ ID NO: 4041468 - DNA, 17 bp, Homo sapiens
ctcttactttgcttgag

SEQ ID NO: 4041469 - DNA, 23 bp, Homo sapiens
ctcttactttgcttgagaatcct

SEQ ID NO: 4041470 - DNA, 19 bp, Homo sapiens
ctcttagcagcttccagat

SEQ ID NO: 4041471 - DNA, 19 bp, Homo sapiens
ctcttaggaagagaaacca

SEQ ID NO: 4041472 - DNA, 17 bp, Homo sapiens
ctcttatagaatattta

SEQ ID NO: 4041473 - DNA, 15 bp, Homo sapiens
ctcttattcctctag

SEQ ID NO: 4041474 - DNA, 16 bp, Homo sapiens
ctcttattcctctagg

SEQ ID NO: 4041475 - DNA, 18 bp, Homo sapiens
ctcttattcctctaggca

SEQ ID NO: 4041476 - DNA, 11 bp, Homo sapiens
ctcttcagaaa

SEQ ID NO: 4041477 - DNA, 12 bp, Homo sapiens
ctcttcagaact

SEQ ID NO: 4041478 - DNA, 13 bp, Homo sapiens
ctcttcaggcctc

SEQ ID NO: 4041479 - DNA, 16 bp, Homo sapiens
ctcccacaggcccttc

SEQ ID NO: 4041480 - DNA, 15 bp, Homo sapiens
ctcccacccccatct

SEQ ID NO: 4041481 - DNA, 18 bp, Homo sapiens
ctcccacccccttctctg

SEQ ID NO: 4041482 - DNA, 23 bp, Homo sapiens
ctcccacccccttctctgctcca

SEQ ID NO: 4041483 - DNA, 12 bp, Homo sapiens
ctcccaccctgt

SEQ ID NO: 4041484 - DNA, 20 bp, Homo sapiens
ctcccaccctgtacctcatc

SEQ ID NO: 4041485 - DNA, 23 bp, Homo sapiens
ctcccaccctgtacctcatccca

SEQ ID NO: 4041486 - DNA, 18 bp, Homo sapiens
ctcccacctcacccggcc

SEQ ID NO: 4041487 - DNA, 20 bp, Homo sapiens
ctcccagcctgctgagagcc

SEQ ID NO: 4041488 - DNA, 19 bp, Homo sapiens
ctcccaggcgccccttccc

SEQ ID NO: 4041489 - DNA, 20 bp, Homo sapiens
ctcccaggcgccccttcccc

SEQ ID NO: 4041490 - DNA, 22 bp, Homo sapiens
ctcccaggcgccccttccccct

SEQ ID NO: 4041491 - DNA, 16 bp, Homo sapiens
ctcccaggggtctccc

SEQ ID NO: 4041492 - DNA, 19 bp, Homo sapiens
ctcccaggggtctccctgg

SEQ ID NO: 4041493 - DNA, 18 bp, Homo sapiens
ctcccaggtaccagctgc

SEQ ID NO: 4041494 - DNA, 16 bp, Homo sapiens
ctcccagtcctccaga

SEQ ID NO: 4041495 - DNA, 18 bp, Homo sapiens
ctcccagtcctccagacc

SEQ ID NO: 4041496 - DNA, 19 bp, Homo sapiens
ctcccagtcctccagacca

SEQ ID NO: 4041497 - DNA, 18 bp, Homo sapiens
ctcccagtgaactcctgc

SEQ ID NO: 4041498 - DNA, 21 bp, Homo sapiens
ctcccatcattacccttccct

SEQ ID NO: 4041499 - DNA, 16 bp, Homo sapiens
ctcccatcattccttc

SEQ ID NO: 4041500 - DNA, 13 bp, Homo sapiens
ctcccatcccctg

SEQ ID NO: 4041501 - DNA, 16 bp, Homo sapiens
ctcccatcccctggac

SEQ ID NO: 4041502 - DNA, 15 bp, Homo sapiens
ctcccattcctgaag

SEQ ID NO: 4041503 - DNA, 22 bp, Homo sapiens
ctcccatttctaaagctgaatg

SEQ ID NO: 4041504 - DNA, 21 bp, Homo sapiens
ctccccaaatcaatacactag

SEQ ID NO: 4041505 - DNA, 19 bp, Homo sapiens
ctccccaaccctaggttcc

SEQ ID NO: 4041506 - DNA, 17 bp, Homo sapiens
ctccccaaggccccctg

SEQ ID NO: 4041507 - DNA, 22 bp, Homo sapiens
ctccccaaggccccctgcctgc

SEQ ID NO: 4041508 - DNA, 17 bp, Homo sapiens
ctccccaattctcccct

SEQ ID NO: 4041509 - DNA, 18 bp, Homo sapiens
ctccccacagcgtccctg

SEQ ID NO: 4041510 - DNA, 19 bp, Homo sapiens
ctccccacagcgtccctgg

SEQ ID NO: 4041511 - DNA, 11 bp, Homo sapiens
ctccccagaat

SEQ ID NO: 4041512 - DNA, 15 bp, Homo sapiens
ctccccagcccagag

SEQ ID NO: 4041513 - DNA, 17 bp, Homo sapiens
ctccccagcccagagac

SEQ ID NO: 4041514 - DNA, 13 bp, Homo sapiens
ctccccaggagct

SEQ ID NO: 4041515 - DNA, 15 bp, Homo sapiens
ctccccaggccaggc

SEQ ID NO: 4041516 - DNA, 17 bp, Homo sapiens
ctccccaggccaggcca

SEQ ID NO: 4041517 - DNA, 16 bp, Homo sapiens
ctccccaggctggaga

SEQ ID NO: 4041518 - DNA, 13 bp, Homo sapiens
ctccccagggagc

SEQ ID NO: 4041519 - DNA, 14 bp, Homo sapiens
ctccccagggagct

SEQ ID NO: 4041520 - DNA, 16 bp, Homo sapiens
ctccccagtgtatgtc

SEQ ID NO: 4041521 - DNA, 15 bp, Homo sapiens
ctccccatctgtcca

SEQ ID NO: 4041522 - DNA, 17 bp, Homo sapiens
ctccccatctgtccagc

SEQ ID NO: 4041523 - DNA, 12 bp, Homo sapiens
ctccccatggag

SEQ ID NO: 4041524 - DNA, 17 bp, Homo sapiens
ctccccatggagccagc

SEQ ID NO: 4041525 - DNA, 14 bp, Homo sapiens
ctccccatgtgtcc

SEQ ID NO: 4041526 - DNA, 18 bp, Homo sapiens
ctccccatgtgtcctggt

SEQ ID NO: 4041527 - DNA, 20 bp, Homo sapiens
ctccccatgtgtcctggttc

SEQ ID NO: 4041528 - DNA, 19 bp, Homo sapiens
ctccccatttcccatctgc

SEQ ID NO: 4041529 - DNA, 20 bp, Homo sapiens
ctccccatttcccatctgca

SEQ ID NO: 4041530 - DNA, 22 bp, Homo sapiens
ctccccatttcccatctgcacc

SEQ ID NO: 4041531 - DNA, 16 bp, Homo sapiens
ctcccccatctcccac

SEQ ID NO: 4041532 - DNA, 19 bp, Homo sapiens
ctcccccatctcccaccct

SEQ ID NO: 4041533 - DNA, 21 bp, Homo sapiens
ctcccccccatgcactgtgaa

SEQ ID NO: 4041534 - DNA, 12 bp, Homo sapiens
ctccccctcaac

SEQ ID NO: 4041535 - DNA, 14 bp, Homo sapiens
ctccccctcctcca

SEQ ID NO: 4041536 - DNA, 13 bp, Homo sapiens
ctccccctgcaac

SEQ ID NO: 4041537 - DNA, 14 bp, Homo sapiens
ctccccctgcaact

SEQ ID NO: 4041538 - DNA, 14 bp, Homo sapiens
ctccccgccttaga

SEQ ID NO: 4041539 - DNA, 14 bp, Homo sapiens
ctcccctcccagtc

SEQ ID NO: 4041540 - DNA, 14 bp, Homo sapiens
ctcccctctcagca

SEQ ID NO: 4041541 - DNA, 19 bp, Homo sapiens
ctcccctctgcttctcatc

SEQ ID NO: 4041542 - DNA, 17 bp, Homo sapiens
ctccccttccccttcct

SEQ ID NO: 4041543 - DNA, 16 bp, Homo sapiens
ctcccctttttttccc

SEQ ID NO: 4041544 - DNA, 16 bp, Homo sapiens
ctcccgaagaatgaac

SEQ ID NO: 4041545 - DNA, 22 bp, Homo sapiens
ctcccgaagaatgaacccaaga

SEQ ID NO: 4041546 - DNA, 20 bp, Homo sapiens
ctcctcctcttcaccaggtg

SEQ ID NO: 4041547 - DNA, 12 bp, Homo sapiens
ctcctcctgccc

SEQ ID NO: 4041548 - DNA, 13 bp, Homo sapiens
ctcctcctgccct

SEQ ID NO: 4041549 - DNA, 13 bp, Homo sapiens
ctcctccttccta

SEQ ID NO: 4041550 - DNA, 21 bp, Homo sapiens
ctcctcgggccgaggcccagc

SEQ ID NO: 4041551 - DNA, 13 bp, Homo sapiens
ctcctctaagcca

SEQ ID NO: 4041552 - DNA, 17 bp, Homo sapiens
ctcctctagctgtgggg

SEQ ID NO: 4041553 - DNA, 22 bp, Homo sapiens
ctcctctatcctgggcttttgt

SEQ ID NO: 4041554 - DNA, 18 bp, Homo sapiens
ctcctctcccatccttga

SEQ ID NO: 4041555 - DNA, 22 bp, Homo sapiens
ctcctctccccagcccagagac

SEQ ID NO: 4041556 - DNA, 13 bp, Homo sapiens
ctcctctcctgga

SEQ ID NO: 4041557 - DNA, 14 bp, Homo sapiens
ctcctctctgagac

SEQ ID NO: 4041558 - DNA, 13 bp, Homo sapiens
ctcctctctgggc

SEQ ID NO: 4041559 - DNA, 20 bp, Homo sapiens
ctcctctgcctacagccagg

SEQ ID NO: 4041560 - DNA, 21 bp, Homo sapiens
ctcctctggacggcaggctca

SEQ ID NO: 4041561 - DNA, 12 bp, Homo sapiens
ctcctctggctt

SEQ ID NO: 4041562 - DNA, 18 bp, Homo sapiens
ctcctctggctttcccag

SEQ ID NO: 4041563 - DNA, 16 bp, Homo sapiens
ctcctctgtctgccct

SEQ ID NO: 4041564 - DNA, 15 bp, Homo sapiens
ctcctcttcaccagg

SEQ ID NO: 4041565 - DNA, 16 bp, Homo sapiens
ctcctcttcaccaggt

SEQ ID NO: 4041566 - DNA, 16 bp, Homo sapiens
ctcctcttgattcctg

SEQ ID NO: 4041567 - DNA, 18 bp, Homo sapiens
ctcctgagcctgtgggtc

SEQ ID NO: 4041568 - DNA, 21 bp, Homo sapiens
ctcctgaggggcatctgcccc

SEQ ID NO: 4041569 - DNA, 13 bp, Homo sapiens
ctcctgcccagat

SEQ ID NO: 4041570 - DNA, 13 bp, Homo sapiens
ctcctgccccaca

SEQ ID NO: 4041571 - DNA, 14 bp, Homo sapiens
ctcctgccgcagac

SEQ ID NO: 4041572 - DNA, 16 bp, Homo sapiens
ctcctgccgcagacgg

SEQ ID NO: 4041573 - DNA, 21 bp, Homo sapiens
ctcctgccgcagacgggcaca

SEQ ID NO: 4041574 - DNA, 23 bp, Homo sapiens
ctcctgcctagctgcctagcaag

SEQ ID NO: 4041575 - DNA, 19 bp, Homo sapiens
ctcctgcctgagtttccag

SEQ ID NO: 4041576 - DNA, 14 bp, Homo sapiens
ctcctgcctgtagc

SEQ ID NO: 4041577 - DNA, 19 bp, Homo sapiens
ctcctgcctgtagcagtga

SEQ ID NO: 4041578 - DNA, 18 bp, Homo sapiens
ctcctgcgccctgtgccc

SEQ ID NO: 4041579 - DNA, 17 bp, Homo sapiens
ctcctgctcaccacctg

SEQ ID NO: 4041580 - DNA, 21 bp, Homo sapiens
ctcctgctcaccacctgcctc

SEQ ID NO: 4041581 - DNA, 14 bp, Homo sapiens
ctcctgctctgctc

SEQ ID NO: 4041582 - DNA, 18 bp, Homo sapiens
ctcctgcttttctgtcct

SEQ ID NO: 4041583 - DNA, 17 bp, Homo sapiens
ctcctggaaccttgctg

SEQ ID NO: 4041584 - DNA, 19 bp, Homo sapiens
ctcctggaaccttgctgtc

SEQ ID NO: 4041585 - DNA, 20 bp, Homo sapiens
ctcctggaaccttgctgtcc

SEQ ID NO: 4041586 - DNA, 10 bp, Homo sapiens
ctcctggagg

SEQ ID NO: 4041587 - DNA, 15 bp, Homo sapiens
ctcctggccagacgc

SEQ ID NO: 4041588 - DNA, 18 bp, Homo sapiens
ctcctggcctatccgctg

SEQ ID NO: 4041589 - DNA, 23 bp, Homo sapiens
ctcctggcctatccgctgccagc

SEQ ID NO: 4041590 - DNA, 12 bp, Homo sapiens
ctcctggccttt

SEQ ID NO: 4041591 - DNA, 14 bp, Homo sapiens
ctcctggctgggcc

SEQ ID NO: 4041592 - DNA, 16 bp, Homo sapiens
ctcctggctgggccat

SEQ ID NO: 4041593 - DNA, 19 bp, Homo sapiens
ctcctgggagcccccacca

SEQ ID NO: 4041594 - DNA, 14 bp, Homo sapiens
ctcctgggctcaag

SEQ ID NO: 4041595 - DNA, 19 bp, Homo sapiens
ctcctgggggtggcaggca

SEQ ID NO: 4041596 - DNA, 20 bp, Homo sapiens
ctcctgggggtggcaggcac

SEQ ID NO: 4041597 - DNA, 21 bp, Homo sapiens
ctcctgggggtggcaggcaca

SEQ ID NO: 4041598 - DNA, 24 bp, Homo sapiens
ctcctgggggtggcaggcacacag

SEQ ID NO: 4041599 - DNA, 14 bp, Homo sapiens
ctcctgtccctttt

SEQ ID NO: 4041600 - DNA, 19 bp, Homo sapiens
ctcctgtcccttttccctt

SEQ ID NO: 4041601 - DNA, 12 bp, Homo sapiens
ctcctgtcctcc

SEQ ID NO: 4041602 - DNA, 13 bp, Homo sapiens
ctcctgtcctccc

SEQ ID NO: 4041603 - DNA, 11 bp, Homo sapiens
ctcctgtgcct

SEQ ID NO: 4041604 - DNA, 14 bp, Homo sapiens
ctcctgtgcctggc

SEQ ID NO: 4041605 - DNA, 11 bp, Homo sapiens
ctcctgtgcta

SEQ ID NO: 4041606 - DNA, 14 bp, Homo sapiens
ctcctgtttctcct

SEQ ID NO: 4041607 - DNA, 14 bp, Homo sapiens
ctccttagaaaaaa

SEQ ID NO: 4041608 - DNA, 16 bp, Homo sapiens
ctccttagtcttctca

SEQ ID NO: 4041609 - DNA, 22 bp, Homo sapiens
ctccttcaacaaggcttgctgc

SEQ ID NO: 4041610 - DNA, 14 bp, Homo sapiens
ctccttcagacacc

SEQ ID NO: 4041611 - DNA, 19 bp, Homo sapiens
ctccttcagacaccctcaa

SEQ ID NO: 4041612 - DNA, 16 bp, Homo sapiens
ctccttccacctccct

SEQ ID NO: 4041613 - DNA, 14 bp, Homo sapiens
ctccttccagtgtc

SEQ ID NO: 4041614 - DNA, 20 bp, Homo sapiens
ctccttcccacccctacaca

SEQ ID NO: 4041615 - DNA, 16 bp, Homo sapiens
ctccttcccactcttc

SEQ ID NO: 4041616 - DNA, 14 bp, Homo sapiens
ctccttccccagga

SEQ ID NO: 4041617 - DNA, 22 bp, Homo sapiens
ctccttccccaggatggactct

SEQ ID NO: 4041618 - DNA, 18 bp, Homo sapiens
ctccttccctcaccccca

SEQ ID NO: 4041619 - DNA, 16 bp, Homo sapiens
ctccttcctggcctga

SEQ ID NO: 4041620 - DNA, 20 bp, Homo sapiens
ctccttctaaaaacttctca

SEQ ID NO: 4041621 - DNA, 15 bp, Homo sapiens
ctccttctccttccc

SEQ ID NO: 4041622 - DNA, 22 bp, Homo sapiens
ctccttgccccccgccctcatg

SEQ ID NO: 4041623 - DNA, 13 bp, Homo sapiens
ctccttggcttac

SEQ ID NO: 4041624 - DNA, 16 bp, Homo sapiens
ctccttggcttacctg

SEQ ID NO: 4041625 - DNA, 19 bp, Homo sapiens
ctccttggcttacctgacc

SEQ ID NO: 4041626 - DNA, 21 bp, Homo sapiens
ctccttgggtcattgacctct

SEQ ID NO: 4041627 - DNA, 15 bp, Homo sapiens
ctccttgtccaccca

SEQ ID NO: 4041628 - DNA, 16 bp, Homo sapiens
ctccttgtccacccac

SEQ ID NO: 4041629 - DNA, 20 bp, Homo sapiens
ctcctttagcaggtggtcct

SEQ ID NO: 4041630 - DNA, 20 bp, Homo sapiens
ctcctttcacaaccttctgt

SEQ ID NO: 4041631 - DNA, 14 bp, Homo sapiens
ctcctttctccagc

SEQ ID NO: 4041632 - DNA, 21 bp, Homo sapiens
ctcctttctccagccagcaat

SEQ ID NO: 4041633 - DNA, 22 bp, Homo sapiens
ctcctttgcactgagggccaca

SEQ ID NO: 4041634 - DNA, 15 bp, Homo sapiens
ctcctttgtgtgtgt

SEQ ID NO: 4041635 - DNA, 16 bp, Homo sapiens
ctccttttccagagca

SEQ ID NO: 4041636 - DNA, 13 bp, Homo sapiens
ctcctttttccat

SEQ ID NO: 4041637 - DNA, 14 bp, Homo sapiens
ctcgaaacacagaa

SEQ ID NO: 4041638 - DNA, 20 bp, Homo sapiens
ctcgaaacacagaaaccttt

SEQ ID NO: 4041639 - DNA, 15 bp, Homo sapiens
ctcgacagcgcccct

SEQ ID NO: 4041640 - DNA, 21 bp, Homo sapiens
ctcgacagcgcccctgctgtc

SEQ ID NO: 4041641 - DNA, 22 bp, Homo sapiens
ctcgacagcgcccctgctgtct

SEQ ID NO: 4041642 - DNA, 17 bp, Homo sapiens
ctcgagcagtcctgcct

SEQ ID NO: 4041643 - DNA, 18 bp, Homo sapiens
ctcgagggcagggaccac

SEQ ID NO: 4041644 - DNA, 16 bp, Homo sapiens
ctcgaggggtgggctg

SEQ ID NO: 4041645 - DNA, 17 bp, Homo sapiens
ctcgaggggtgggctgg

SEQ ID NO: 4041646 - DNA, 19 bp, Homo sapiens
ctcgaggggtgggctggta

SEQ ID NO: 4041647 - DNA, 23 bp, Homo sapiens
ctcgagggttgggttcatctgag

SEQ ID NO: 4041648 - DNA, 23 bp, Homo sapiens
ctcgcaaaaacgtatctcctaat

SEQ ID NO: 4041649 - DNA, 14 bp, Homo sapiens
cgggcaccagccag

SEQ ID NO: 4041650 - DNA, 15 bp, Homo sapiens
cgggcaccagccagc

SEQ ID NO: 4041651 - DNA, 23 bp, Homo sapiens
cgggcagagggctggaggcccag

SEQ ID NO: 4041652 - DNA, 12 bp, Homo sapiens
cgggcagccagc

SEQ ID NO: 4041653 - DNA, 15 bp, Homo sapiens
cgggcatcgcaggag

SEQ ID NO: 4041654 - DNA, 20 bp, Homo sapiens
cgggcatggtggctcatgcc

SEQ ID NO: 4041655 - DNA, 16 bp, Homo sapiens
cgggcatgtctgcctg

SEQ ID NO: 4041656 - DNA, 20 bp, Homo sapiens
cgggcatgtctgcctggagt

SEQ ID NO: 4041657 - DNA, 18 bp, Homo sapiens
cgggccaggcccgcaccc

SEQ ID NO: 4041658 - DNA, 17 bp, Homo sapiens
cgggccccacctgcagc

SEQ ID NO: 4041659 - DNA, 21 bp, Homo sapiens
cgggccccacctgcagctccc

SEQ ID NO: 4041660 - DNA, 22 bp, Homo sapiens
cgggccccatcctcatccctga

SEQ ID NO: 4041661 - DNA, 15 bp, Homo sapiens
cgggcccctgggctt

SEQ ID NO: 4041662 - DNA, 18 bp, Homo sapiens
cgggccgaggcccagcgg

SEQ ID NO: 4041663 - DNA, 22 bp, Homo sapiens
cgggccgaggcccagcgggcag

SEQ ID NO: 4041664 - DNA, 18 bp, Homo sapiens
cgggctccagccatctca

SEQ ID NO: 4041665 - DNA, 19 bp, Homo sapiens
cgggctgagggcctgctgg

SEQ ID NO: 4041666 - DNA, 21 bp, Homo sapiens
cggggaagctgccagcccaga

SEQ ID NO: 4041667 - DNA, 14 bp, Homo sapiens
cggggacagaggcc

SEQ ID NO: 4041668 - DNA, 17 bp, Homo sapiens
cggggacagaggcctgc

SEQ ID NO: 4041669 - DNA, 21 bp, Homo sapiens
cggggacagaggcctgcccgg

SEQ ID NO: 4041670 - DNA, 12 bp, Homo sapiens
cggggaccctgt

SEQ ID NO: 4041671 - DNA, 14 bp, Homo sapiens
cggggaccctgtga

SEQ ID NO: 4041672 - DNA, 17 bp, Homo sapiens
cggggcgatgctccctc

SEQ ID NO: 4041673 - DNA, 20 bp, Homo sapiens
cggggcgatgctccctcagc

SEQ ID NO: 4041674 - DNA, 11 bp, Homo sapiens
cggggggaggg

SEQ ID NO: 4041675 - DNA, 21 bp, Homo sapiens
cggggtatcctgggggaccca

SEQ ID NO: 4041676 - DNA, 16 bp, Homo sapiens
cggggtgcccacaggc

SEQ ID NO: 4041677 - DNA, 18 bp, Homo sapiens
cggggtggtgggaaccat

SEQ ID NO: 4041678 - DNA, 23 bp, Homo sapiens
cggggtgtaacttcctgctgcac

SEQ ID NO: 4041679 - DNA, 23 bp, Homo sapiens
cgggtcacttttgttcccaggta

SEQ ID NO: 4041680 - DNA, 20 bp, Homo sapiens
cgggtgaacaaagcagccac

SEQ ID NO: 4041681 - DNA, 19 bp, Homo sapiens
cgggtgatggccagcccct

SEQ ID NO: 4041682 - DNA, 22 bp, Homo sapiens
cgggtgcagacaatcttctgtt

SEQ ID NO: 4041683 - DNA, 20 bp, Homo sapiens
cgggtgggcggcggccacgc

SEQ ID NO: 4041684 - DNA, 22 bp, Homo sapiens
cgggtgtgcaatgtctgagtga

SEQ ID NO: 4041685 - DNA, 16 bp, Homo sapiens
cgggtgtggcctcagc

SEQ ID NO: 4041686 - DNA, 18 bp, Homo sapiens
cgggtgtggcctcagccc

SEQ ID NO: 4041687 - DNA, 14 bp, Homo sapiens
cgggttcagcctgg

SEQ ID NO: 4041688 - DNA, 16 bp, Homo sapiens
cgggttcagcctggcc

SEQ ID NO: 4041689 - DNA, 17 bp, Homo sapiens
cgggttcagcctggcct

SEQ ID NO: 4041690 - DNA, 19 bp, Homo sapiens
cgggttcagcctggcctgc

SEQ ID NO: 4041691 - DNA, 16 bp, Homo sapiens
cgggttccgcaggcag

SEQ ID NO: 4041692 - DNA, 22 bp, Homo sapiens
cgggttcgcaccattctcctgc

SEQ ID NO: 4041693 - DNA, 14 bp, Homo sapiens
cggtaccaatgcag

SEQ ID NO: 4041694 - DNA, 22 bp, Homo sapiens
cggtagccagcacacagggcag

SEQ ID NO: 4041695 - DNA, 19 bp, Homo sapiens
cggtagggaggcagcctcc

SEQ ID NO: 4041696 - DNA, 17 bp, Homo sapiens
cggtcacacggccaccc

SEQ ID NO: 4041697 - DNA, 21 bp, Homo sapiens
cggtcaggctgggcagcccca

SEQ ID NO: 4041698 - DNA, 15 bp, Homo sapiens
cggtcgggcagccag

SEQ ID NO: 4041699 - DNA, 19 bp, Homo sapiens
cggtcgggcagccagcaga

SEQ ID NO: 4041700 - DNA, 14 bp, Homo sapiens
cggtgccatgtctg

SEQ ID NO: 4041701 - DNA, 19 bp, Homo sapiens
cggtgccatgtctgcagtg

SEQ ID NO: 4041702 - DNA, 13 bp, Homo sapiens
cggtgcccacacc

SEQ ID NO: 4041703 - DNA, 17 bp, Homo sapiens
cggtgcccatcctgcca

SEQ ID NO: 4041704 - DNA, 14 bp, Homo sapiens
cggtgctgcaggag

SEQ ID NO: 4041705 - DNA, 15 bp, Homo sapiens
cggtgctgcaggagt

SEQ ID NO: 4041706 - DNA, 19 bp, Homo sapiens
cggtgctgtgagggagggg

SEQ ID NO: 4041707 - DNA, 20 bp, Homo sapiens
cggtggctcatgcctgtaat

SEQ ID NO: 4041708 - DNA, 17 bp, Homo sapiens
cggtggctgccccggcc

SEQ ID NO: 4041709 - DNA, 14 bp, Homo sapiens
cggtggctgggcag

SEQ ID NO: 4041710 - DNA, 21 bp, Homo sapiens
cggtggctgggcagagctgca

SEQ ID NO: 4041711 - DNA, 19 bp, Homo sapiens
cggttcagacccctgcctg

SEQ ID NO: 4041712 - DNA, 21 bp, Homo sapiens
cggtttggggagcagagacac

SEQ ID NO: 4041713 - DNA, 20 bp, Homo sapiens
cgtaaatacacaacacacac

SEQ ID NO: 4041714 - DNA, 12 bp, Homo sapiens
cgtaaccagcca

SEQ ID NO: 4041715 - DNA, 17 bp, Homo sapiens
cgtaataattattatta

SEQ ID NO: 4041716 - DNA, 13 bp, Homo sapiens
cgtacatgtttat

SEQ ID NO: 4041717 - DNA, 14 bp, Homo sapiens
cgtaccccactggg

SEQ ID NO: 4041718 - DNA, 19 bp, Homo sapiens
cgtaccccactgggccagc

SEQ ID NO: 4041719 - DNA, 18 bp, Homo sapiens
cgtagtcggcacagcctg

SEQ ID NO: 4041720 - DNA, 21 bp, Homo sapiens
cgtatctttaaaaagcagtcc

SEQ ID NO: 4041721 - DNA, 18 bp, Homo sapiens
cgtcaccacgactggcca

SEQ ID NO: 4041722 - DNA, 18 bp, Homo sapiens
cgtcactttttggccatg

SEQ ID NO: 4041723 - DNA, 14 bp, Homo sapiens
cgtcaggccctgac

SEQ ID NO: 4041724 - DNA, 16 bp, Homo sapiens
cgtcagggttggtgtg

SEQ ID NO: 4041725 - DNA, 19 bp, Homo sapiens
cgtcagggttggtgtgctg

SEQ ID NO: 4041726 - DNA, 20 bp, Homo sapiens
cgtcagggttggtgtgctga

SEQ ID NO: 4041727 - DNA, 20 bp, Homo sapiens
cgtcatcggaggctgggccc

SEQ ID NO: 4041728 - DNA, 15 bp, Homo sapiens
cgtcatgttcctcaa

SEQ ID NO: 4041729 - DNA, 11 bp, Homo sapiens
cgtccaccccc

SEQ ID NO: 4041730 - DNA, 17 bp, Homo sapiens
cgtccagggtttacatt

SEQ ID NO: 4041731 - DNA, 15 bp, Homo sapiens
cgtccatcagggatc

SEQ ID NO: 4041732 - DNA, 23 bp, Homo sapiens
cgtcccagggtacccgcctgagc

SEQ ID NO: 4041733 - DNA, 14 bp, Homo sapiens
cgtccctggcgcag

SEQ ID NO: 4041734 - DNA, 15 bp, Homo sapiens
cgtccggtgtgtcag

SEQ ID NO: 4041735 - DNA, 15 bp, Homo sapiens
cgtcctccaagctca

SEQ ID NO: 4041736 - DNA, 13 bp, Homo sapiens
cgtcctgcctggc

SEQ ID NO: 4041737 - DNA, 14 bp, Homo sapiens
cgtcctgcctggca

SEQ ID NO: 4041738 - DNA, 15 bp, Homo sapiens
cgtcctgcctggcac

SEQ ID NO: 4041739 - DNA, 14 bp, Homo sapiens
cgtccttttggttt

SEQ ID NO: 4041740 - DNA, 16 bp, Homo sapiens
cgtcgaggggctctca

SEQ ID NO: 4041741 - DNA, 14 bp, Homo sapiens
cgtctccctcgaca

SEQ ID NO: 4041742 - DNA, 18 bp, Homo sapiens
cgtctccctcgacagcgc

SEQ ID NO: 4041743 - DNA, 22 bp, Homo sapiens
cgtctctttttggtaataacaa

SEQ ID NO: 4041744 - DNA, 14 bp, Homo sapiens
cgtctggggtgtgg

SEQ ID NO: 4041745 - DNA, 17 bp, Homo sapiens
cgtcttctccctattcc

SEQ ID NO: 4041746 - DNA, 23 bp, Homo sapiens
cgtcttggtgccttttgtgtgat

SEQ ID NO: 4041747 - DNA, 11 bp, Homo sapiens
cgtctttccca

SEQ ID NO: 4041748 - DNA, 15 bp, Homo sapiens
cgtgaaaacggagct

SEQ ID NO: 4041749 - DNA, 20 bp, Homo sapiens
cgtgaaacacaccaggctgt

SEQ ID NO: 4041750 - DNA, 22 bp, Homo sapiens
cgtgaaacacaccaggctgtgg

SEQ ID NO: 4041751 - DNA, 12 bp, Homo sapiens
cgtgaactgtgc

SEQ ID NO: 4041752 - DNA, 19 bp, Homo sapiens
ccttctttgataatgttaa

SEQ ID NO: 4041753 - DNA, 20 bp, Homo sapiens
ccttctttgataatgttaaa

SEQ ID NO: 4041754 - DNA, 15 bp, Homo sapiens
ccttctttgcagggc

SEQ ID NO: 4041755 - DNA, 12 bp, Homo sapiens
ccttcttttgta

SEQ ID NO: 4041756 - DNA, 20 bp, Homo sapiens
ccttgaacaaaaagtttttt

SEQ ID NO: 4041757 - DNA, 17 bp, Homo sapiens
ccttgaagaacctctca

SEQ ID NO: 4041758 - DNA, 21 bp, Homo sapiens
ccttgaagggtaaagaagttt

SEQ ID NO: 4041759 - DNA, 12 bp, Homo sapiens
ccttgaatgctg

SEQ ID NO: 4041760 - DNA, 14 bp, Homo sapiens
ccttgacatcagtt

SEQ ID NO: 4041761 - DNA, 21 bp, Homo sapiens
ccttgactggacctggtggct

SEQ ID NO: 4041762 - DNA, 14 bp, Homo sapiens
ccttgagaaacctt

SEQ ID NO: 4041763 - DNA, 15 bp, Homo sapiens
ccttgagccctggct

SEQ ID NO: 4041764 - DNA, 16 bp, Homo sapiens
ccttgaggggagccag

SEQ ID NO: 4041765 - DNA, 21 bp, Homo sapiens
ccttgagggtgcttgttccct

SEQ ID NO: 4041766 - DNA, 11 bp, Homo sapiens
ccttgatcatt

SEQ ID NO: 4041767 - DNA, 13 bp, Homo sapiens
ccttgatcatttt

SEQ ID NO: 4041768 - DNA, 14 bp, Homo sapiens
ccttgatcccaatc

SEQ ID NO: 4041769 - DNA, 19 bp, Homo sapiens
ccttgatggagatatttac

SEQ ID NO: 4041770 - DNA, 13 bp, Homo sapiens
ccttgcacccctc

SEQ ID NO: 4041771 - DNA, 18 bp, Homo sapiens
ccttgcacccctcactct

SEQ ID NO: 4041772 - DNA, 19 bp, Homo sapiens
ccttgcagttcagcaccac

SEQ ID NO: 4041773 - DNA, 16 bp, Homo sapiens
ccttgccaagctttct

SEQ ID NO: 4041774 - DNA, 23 bp, Homo sapiens
ccttgccaccccaccctccctgg

SEQ ID NO: 4041775 - DNA, 16 bp, Homo sapiens
ccttgccagagatcca

SEQ ID NO: 4041776 - DNA, 19 bp, Homo sapiens
ccttgcccactcctgctct

SEQ ID NO: 4041777 - DNA, 21 bp, Homo sapiens
ccttgcccactcctgctctgc

SEQ ID NO: 4041778 - DNA, 13 bp, Homo sapiens
ccttgcctctgcc

SEQ ID NO: 4041779 - DNA, 18 bp, Homo sapiens
ccttgcctctgccctgga

SEQ ID NO: 4041780 - DNA, 11 bp, Homo sapiens
ccttgctacct

SEQ ID NO: 4041781 - DNA, 14 bp, Homo sapiens
ccttgctacctcaa

SEQ ID NO: 4041782 - DNA, 17 bp, Homo sapiens
ccttgctcattcttgag

SEQ ID NO: 4041783 - DNA, 13 bp, Homo sapiens
ccttgctcccttc

SEQ ID NO: 4041784 - DNA, 13 bp, Homo sapiens
ccttgctctcctc

SEQ ID NO: 4041785 - DNA, 17 bp, Homo sapiens
ccttgctgaacacacac

SEQ ID NO: 4041786 - DNA, 20 bp, Homo sapiens
ccttgctgctgctgcaccca

SEQ ID NO: 4041787 - DNA, 17 bp, Homo sapiens
ccttgctggaaaaccca

SEQ ID NO: 4041788 - DNA, 13 bp, Homo sapiens
ccttgctgtcctg

SEQ ID NO: 4041789 - DNA, 14 bp, Homo sapiens
ccttgctgtcctga

SEQ ID NO: 4041790 - DNA, 16 bp, Homo sapiens
ccttgctgtcctgatc

SEQ ID NO: 4041791 - DNA, 19 bp, Homo sapiens
ccttgctgtttgtcctgag

SEQ ID NO: 4041792 - DNA, 21 bp, Homo sapiens
ccttgctgtttgtcctgagat

SEQ ID NO: 4041793 - DNA, 13 bp, Homo sapiens
ccttgcttcctga

SEQ ID NO: 4041794 - DNA, 15 bp, Homo sapiens
ccttgctttcctggg

SEQ ID NO: 4041795 - DNA, 13 bp, Homo sapiens
ccttggagcaggc

SEQ ID NO: 4041796 - DNA, 14 bp, Homo sapiens
ccttggagcaggca

SEQ ID NO: 4041797 - DNA, 13 bp, Homo sapiens
ccttggagccccg

SEQ ID NO: 4041798 - DNA, 16 bp, Homo sapiens
ccttggagcttacata

SEQ ID NO: 4041799 - DNA, 22 bp, Homo sapiens
ccttggatcgctaagctggctc

SEQ ID NO: 4041800 - DNA, 15 bp, Homo sapiens
ccttggattttcctg

SEQ ID NO: 4041801 - DNA, 23 bp, Homo sapiens
ccttggcaccagacacccaggac

SEQ ID NO: 4041802 - DNA, 16 bp, Homo sapiens
ccttggccaagagaag

SEQ ID NO: 4041803 - DNA, 17 bp, Homo sapiens
ccttggccaagagaagg

SEQ ID NO: 4041804 - DNA, 17 bp, Homo sapiens
ccttggcctcccaaagt

SEQ ID NO: 4041805 - DNA, 16 bp, Homo sapiens
ccttggcctctttcct

SEQ ID NO: 4041806 - DNA, 19 bp, Homo sapiens
ccttggctctgccagtgga

SEQ ID NO: 4041807 - DNA, 18 bp, Homo sapiens
ccttggctgactggggct

SEQ ID NO: 4041808 - DNA, 19 bp, Homo sapiens
ccttgggacagccagagct

SEQ ID NO: 4041809 - DNA, 19 bp, Homo sapiens
ccttgggcctgggcctctg

SEQ ID NO: 4041810 - DNA, 19 bp, Homo sapiens
ccttgggccttgctgctgc

SEQ ID NO: 4041811 - DNA, 14 bp, Homo sapiens
ccttgggctgctcc

SEQ ID NO: 4041812 - DNA, 16 bp, Homo sapiens
ccttggggtccctcca

SEQ ID NO: 4041813 - DNA, 20 bp, Homo sapiens
ccttggggtccctccacccc

SEQ ID NO: 4041814 - DNA, 21 bp, Homo sapiens
ccttggggtccctccacccca

SEQ ID NO: 4041815 - DNA, 19 bp, Homo sapiens
ccttgggtagtgagcagtg

SEQ ID NO: 4041816 - DNA, 22 bp, Homo sapiens
ccttgggtcattgacctctcag

SEQ ID NO: 4041817 - DNA, 14 bp, Homo sapiens
ccttggtgccacca

SEQ ID NO: 4041818 - DNA, 17 bp, Homo sapiens
ccttggtggcaagagcc

SEQ ID NO: 4041819 - DNA, 16 bp, Homo sapiens
ccttgtccacccacct

SEQ ID NO: 4041820 - DNA, 14 bp, Homo sapiens
ccttgtcctttccc

SEQ ID NO: 4041821 - DNA, 19 bp, Homo sapiens
ccttgtttacacataccct

SEQ ID NO: 4041822 - DNA, 20 bp, Homo sapiens
ccttgtttatcagatacatc

SEQ ID NO: 4041823 - DNA, 22 bp, Homo sapiens
ccttgtttgagtttttcctccc

SEQ ID NO: 4041824 - DNA, 20 bp, Homo sapiens
cctttaaaaaaatttaagtg

SEQ ID NO: 4041825 - DNA, 16 bp, Homo sapiens
cctttaaaggttttta

SEQ ID NO: 4041826 - DNA, 21 bp, Homo sapiens
cctttaaaggtttttaaattg

SEQ ID NO: 4041827 - DNA, 20 bp, Homo sapiens
cctttaacttttttttctct

SEQ ID NO: 4041828 - DNA, 21 bp, Homo sapiens
cctttaacttttttttctctc

SEQ ID NO: 4041829 - DNA, 23 bp, Homo sapiens
cctttaagatatccatctttttc

SEQ ID NO: 4041830 - DNA, 22 bp, Homo sapiens
cctttacaaaagaaataccttg

SEQ ID NO: 4041831 - DNA, 17 bp, Homo sapiens
cctttacttgtctttct

SEQ ID NO: 4041832 - DNA, 12 bp, Homo sapiens
cctttatgtgaa

SEQ ID NO: 4041833 - DNA, 14 bp, Homo sapiens
cctttatgtgaatt

SEQ ID NO: 4041834 - DNA, 23 bp, Homo sapiens
cctttattaccccctccttcaga

SEQ ID NO: 4041835 - DNA, 13 bp, Homo sapiens
cctttattttaga

SEQ ID NO: 4041836 - DNA, 15 bp, Homo sapiens
cctttcacaaccttc

SEQ ID NO: 4041837 - DNA, 15 bp, Homo sapiens
cctttcacttctttc

SEQ ID NO: 4041838 - DNA, 13 bp, Homo sapiens
cctttcaggccta

SEQ ID NO: 4041839 - DNA, 21 bp, Homo sapiens
cctttcaggcctacagccaca

SEQ ID NO: 4041840 - DNA, 18 bp, Homo sapiens
cctttccagagcaaccag

SEQ ID NO: 4041841 - DNA, 14 bp, Homo sapiens
cctttcccaccctc

SEQ ID NO: 4041842 - DNA, 15 bp, Homo sapiens
cctttcccaccctcc

SEQ ID NO: 4041843 - DNA, 12 bp, Homo sapiens
cctttcccttct

SEQ ID NO: 4041844 - DNA, 11 bp, Homo sapiens
cgcccaggaga

SEQ ID NO: 4041845 - DNA, 20 bp, Homo sapiens
cgcccaggctggagtgcagt

SEQ ID NO: 4041846 - DNA, 12 bp, Homo sapiens
cgcccccagtgt

SEQ ID NO: 4041847 - DNA, 13 bp, Homo sapiens
cgcccccagtgtg

SEQ ID NO: 4041848 - DNA, 12 bp, Homo sapiens
cgcccctccaaa

SEQ ID NO: 4041849 - DNA, 15 bp, Homo sapiens
cgcccctccaaacct

SEQ ID NO: 4041850 - DNA, 13 bp, Homo sapiens
cgcccctgctgtc

SEQ ID NO: 4041851 - DNA, 17 bp, Homo sapiens
cgcccctgtggccctgg

SEQ ID NO: 4041852 - DNA, 13 bp, Homo sapiens
cgcccgctcctgc

SEQ ID NO: 4041853 - DNA, 15 bp, Homo sapiens
cgccctcactattct

SEQ ID NO: 4041854 - DNA, 21 bp, Homo sapiens
cgccctcctcgggccgaggcc

SEQ ID NO: 4041855 - DNA, 16 bp, Homo sapiens
cgccctggcaggcagg

SEQ ID NO: 4041856 - DNA, 13 bp, Homo sapiens
cgccctgggctgg

SEQ ID NO: 4041857 - DNA, 19 bp, Homo sapiens
cgccctgggctgtctgtca

SEQ ID NO: 4041858 - DNA, 18 bp, Homo sapiens
cgcccttccatgtgcctt

SEQ ID NO: 4041859 - DNA, 17 bp, Homo sapiens
cgccggggacagaggcc

SEQ ID NO: 4041860 - DNA, 14 bp, Homo sapiens
cgcctcagccctca

SEQ ID NO: 4041861 - DNA, 15 bp, Homo sapiens
cgcctcagggccagg

SEQ ID NO: 4041862 - DNA, 22 bp, Homo sapiens
cgcctccccctcccccattccc

SEQ ID NO: 4041863 - DNA, 22 bp, Homo sapiens
cgcctccctctcagaggcctgc

SEQ ID NO: 4041864 - DNA, 13 bp, Homo sapiens
cgcctcctggcca

SEQ ID NO: 4041865 - DNA, 15 bp, Homo sapiens
cgcctcctggccaga

SEQ ID NO: 4041866 - DNA, 16 bp, Homo sapiens
cgcctcctggccagac

SEQ ID NO: 4041867 - DNA, 22 bp, Homo sapiens
cgcctcctggccagacgctgcc

SEQ ID NO: 4041868 - DNA, 18 bp, Homo sapiens
cgcctgcaggagagagca

SEQ ID NO: 4041869 - DNA, 11 bp, Homo sapiens
cgcctgccatc

SEQ ID NO: 4041870 - DNA, 12 bp, Homo sapiens
cgcctgcctgca

SEQ ID NO: 4041871 - DNA, 17 bp, Homo sapiens
cgcctgctccctccaga

SEQ ID NO: 4041872 - DNA, 20 bp, Homo sapiens
cgcctgtaatcccagcactt

SEQ ID NO: 4041873 - DNA, 20 bp, Homo sapiens
cgcctgtaatcccagctact

SEQ ID NO: 4041874 - DNA, 20 bp, Homo sapiens
cgcctgtagtcccagctact

SEQ ID NO: 4041875 - DNA, 18 bp, Homo sapiens
cgcctttcagcaggcagc

SEQ ID NO: 4041876 - DNA, 15 bp, Homo sapiens
cgcgactaatttcaa

SEQ ID NO: 4041877 - DNA, 14 bp, Homo sapiens
cgcgctcgcccagc

SEQ ID NO: 4041878 - DNA, 12 bp, Homo sapiens
cgcggccagccc

SEQ ID NO: 4041879 - DNA, 22 bp, Homo sapiens
cgcggccagccccggccctggg

SEQ ID NO: 4041880 - DNA, 21 bp, Homo sapiens
cgcggccagcgtcccagggta

SEQ ID NO: 4041881 - DNA, 18 bp, Homo sapiens
cgcggctcaaaaggaaac

SEQ ID NO: 4041882 - DNA, 20 bp, Homo sapiens
cgcgggcagcgggccaggcc

SEQ ID NO: 4041883 - DNA, 13 bp, Homo sapiens
cgcgtcttcctga

SEQ ID NO: 4041884 - DNA, 16 bp, Homo sapiens
cgcgtcttcctgagtg

SEQ ID NO: 4041885 - DNA, 19 bp, Homo sapiens
cgcgtgcacgtggagagct

SEQ ID NO: 4041886 - DNA, 22 bp, Homo sapiens
cgctaaagagcccttgcctccc

SEQ ID NO: 4041887 - DNA, 14 bp, Homo sapiens
cgctacctccctcc

SEQ ID NO: 4041888 - DNA, 17 bp, Homo sapiens
cgctcaccgctggccct

SEQ ID NO: 4041889 - DNA, 22 bp, Homo sapiens
cgctcaccgctggcccttagag

SEQ ID NO: 4041890 - DNA, 20 bp, Homo sapiens
cgctcagacggcggccaggc

SEQ ID NO: 4041891 - DNA, 21 bp, Homo sapiens
cgctcagacggcggccaggca

SEQ ID NO: 4041892 - DNA, 18 bp, Homo sapiens
cgctccagctgccccggc

SEQ ID NO: 4041893 - DNA, 24 bp, Homo sapiens
cgctcccaggttcccccagcaagc

SEQ ID NO: 4041894 - DNA, 23 bp, Homo sapiens
cgctcctgccgcagacgggcaca

SEQ ID NO: 4041895 - DNA, 20 bp, Homo sapiens
cgctcctttgtgtgtgtgtc

SEQ ID NO: 4041896 - DNA, 16 bp, Homo sapiens
cgctcgcccagcagga

SEQ ID NO: 4041897 - DNA, 18 bp, Homo sapiens
cgctcgcccagcaggaga

SEQ ID NO: 4041898 - DNA, 23 bp, Homo sapiens
cgctcgcgggcagcgggccaggc

SEQ ID NO: 4041899 - DNA, 14 bp, Homo sapiens
cgctctcagttctc

SEQ ID NO: 4041900 - DNA, 17 bp, Homo sapiens
cgctgagctgagtggcc

SEQ ID NO: 4041901 - DNA, 18 bp, Homo sapiens
cgctgaggggtctcggat

SEQ ID NO: 4041902 - DNA, 22 bp, Homo sapiens
cgctgaggtgtctggcctgagg

SEQ ID NO: 4041903 - DNA, 19 bp, Homo sapiens
cgctggccgggggaggtgg

SEQ ID NO: 4041904 - DNA, 22 bp, Homo sapiens
cgctggggctctctgagactct

SEQ ID NO: 4041905 - DNA, 21 bp, Homo sapiens
cgctggtggaccacaggcatc

SEQ ID NO: 4041906 - DNA, 17 bp, Homo sapiens
cgctggttggaaagagt

SEQ ID NO: 4041907 - DNA, 13 bp, Homo sapiens
cgctgtcactggc

SEQ ID NO: 4041908 - DNA, 21 bp, Homo sapiens
cgctgtcactggctggctcct

SEQ ID NO: 4041909 - DNA, 19 bp, Homo sapiens
cgctgtcctctcgagccca

SEQ ID NO: 4041910 - DNA, 18 bp, Homo sapiens
cgctgtcgccccaggccc

SEQ ID NO: 4041911 - DNA, 17 bp, Homo sapiens
cgcttctgaatgctgct

SEQ ID NO: 4041912 - DNA, 12 bp, Homo sapiens
cgcttctgactg

SEQ ID NO: 4041913 - DNA, 19 bp, Homo sapiens
cgcttgtagaactcactct

SEQ ID NO: 4041914 - DNA, 22 bp, Homo sapiens
cgcttgtagaactcactctggg

SEQ ID NO: 4041915 - DNA, 12 bp, Homo sapiens
cgctttctcagt

SEQ ID NO: 4041916 - DNA, 13 bp, Homo sapiens
cgctttctcagtg

SEQ ID NO: 4041917 - DNA, 22 bp, Homo sapiens
cgctttctggaaaagaggagtt

SEQ ID NO: 4041918 - DNA, 12 bp, Homo sapiens
cggaacagcaga

SEQ ID NO: 4041919 - DNA, 17 bp, Homo sapiens
cggaaccacagggccag

SEQ ID NO: 4041920 - DNA, 19 bp, Homo sapiens
cggaacggaggcttcagaa

SEQ ID NO: 4041921 - DNA, 12 bp, Homo sapiens
cggaaggccgag

SEQ ID NO: 4041922 - DNA, 21 bp, Homo sapiens
cggaataaactagagaaggga

SEQ ID NO: 4041923 - DNA, 16 bp, Homo sapiens
cggacaagacccccag

SEQ ID NO: 4041924 - DNA, 18 bp, Homo sapiens
cggacaagacccccagca

SEQ ID NO: 4041925 - DNA, 15 bp, Homo sapiens
cggacatactctctg

SEQ ID NO: 4041926 - DNA, 14 bp, Homo sapiens
cctctttccctgcg

SEQ ID NO: 4041927 - DNA, 19 bp, Homo sapiens
cctcttttgttaaataata

SEQ ID NO: 4041928 - DNA, 14 bp, Homo sapiens
cctctttttcctcc

SEQ ID NO: 4041929 - DNA, 19 bp, Homo sapiens
cctcttttttcgtttgttt

SEQ ID NO: 4041930 - DNA, 18 bp, Homo sapiens
cctgaaacagccatgtcc

SEQ ID NO: 4041931 - DNA, 17 bp, Homo sapiens
cctgaaacgctcctttg

SEQ ID NO: 4041932 - DNA, 15 bp, Homo sapiens
cctgaaagaggctga

SEQ ID NO: 4041933 - DNA, 17 bp, Homo sapiens
cctgaacaacgagcctt

SEQ ID NO: 4041934 - DNA, 23 bp, Homo sapiens
cctgaaccacaggagaggatggc

SEQ ID NO: 4041935 - DNA, 15 bp, Homo sapiens
cctgcacctgtgcag

SEQ ID NO: 4041936 - DNA, 18 bp, Homo sapiens
cctgcacgtcatgggagg

SEQ ID NO: 4041937 - DNA, 21 bp, Homo sapiens
cctgcactaatttgatgttta

SEQ ID NO: 4041938 - DNA, 13 bp, Homo sapiens
cctgcactgagag

SEQ ID NO: 4041939 - DNA, 21 bp, Homo sapiens
cctgcactggggagcccgtct

SEQ ID NO: 4041940 - DNA, 15 bp, Homo sapiens
cctgcagagagaagc

SEQ ID NO: 4041941 - DNA, 14 bp, Homo sapiens
cctgtttctgcagc

SEQ ID NO: 4041942 - DNA, 15 bp, Homo sapiens
cctgtttttctgggt

SEQ ID NO: 4041943 - DNA, 16 bp, Homo sapiens
ccttaaaaccaaagag

SEQ ID NO: 4041944 - DNA, 22 bp, Homo sapiens
ccttaaacacaggctgtcctta

SEQ ID NO: 4041945 - DNA, 12 bp, Homo sapiens
ccttaaactgta

SEQ ID NO: 4041946 - DNA, 15 bp, Homo sapiens
ccttaaactgtgtgg

SEQ ID NO: 4041947 - DNA, 17 bp, Homo sapiens
ccttaacccacctctcc

SEQ ID NO: 4041948 - DNA, 19 bp, Homo sapiens
ccttaagaacacaaagcgg

SEQ ID NO: 4041949 - DNA, 17 bp, Homo sapiens
ccttaagagtcatccag

SEQ ID NO: 4041950 - DNA, 14 bp, Homo sapiens
ccttaagctgcagg

SEQ ID NO: 4041951 - DNA, 20 bp, Homo sapiens
ccttaaggacaaaaatgaac

SEQ ID NO: 4041952 - DNA, 13 bp, Homo sapiens
ccttaatttcctt

SEQ ID NO: 4041953 - DNA, 19 bp, Homo sapiens
ccttaccagagacgcccag

SEQ ID NO: 4041954 - DNA, 23 bp, Homo sapiens
ccttaccagagacgcccagcccc

SEQ ID NO: 4041955 - DNA, 15 bp, Homo sapiens
ccttaccccttagcc

SEQ ID NO: 4041956 - DNA, 17 bp, Homo sapiens
ccttaccctccttggga

SEQ ID NO: 4041957 - DNA, 16 bp, Homo sapiens
ccttagaacctttctt

SEQ ID NO: 4041958 - DNA, 16 bp, Homo sapiens
ccttagactcttttcc

SEQ ID NO: 4041959 - DNA, 14 bp, Homo sapiens
ccttagagaccccg

SEQ ID NO: 4041960 - DNA, 20 bp, Homo sapiens
ccttagccctgtctgctagg

SEQ ID NO: 4041961 - DNA, 15 bp, Homo sapiens
ccttaggccttcctc

SEQ ID NO: 4041962 - DNA, 18 bp, Homo sapiens
ccttagggaagctggcct

SEQ ID NO: 4041963 - DNA, 20 bp, Homo sapiens
ccttagggaagctggcctga

SEQ ID NO: 4041964 - DNA, 14 bp, Homo sapiens
ccttagtcttctca

SEQ ID NO: 4041965 - DNA, 17 bp, Homo sapiens
ccttatccctctcttcc

SEQ ID NO: 4041966 - DNA, 20 bp, Homo sapiens
ccttatctgtgcgtgaaaca

SEQ ID NO: 4041967 - DNA, 19 bp, Homo sapiens
ccttatgacttgctacttt

SEQ ID NO: 4041968 - DNA, 15 bp, Homo sapiens
ccttattgtacctct

SEQ ID NO: 4041969 - DNA, 19 bp, Homo sapiens
ccttatttgccttctactc

SEQ ID NO: 4041970 - DNA, 22 bp, Homo sapiens
ccttatttgctaatcaaagcca

SEQ ID NO: 4041971 - DNA, 19 bp, Homo sapiens
ccttcaacaaggcttgctg

SEQ ID NO: 4041972 - DNA, 18 bp, Homo sapiens
ccttcacaccccaggccc

SEQ ID NO: 4041973 - DNA, 17 bp, Homo sapiens
ccttcaccccagtggcc

SEQ ID NO: 4041974 - DNA, 10 bp, Homo sapiens
ccttcagaca

SEQ ID NO: 4041975 - DNA, 20 bp, Homo sapiens
ccttcagacaccctcaacct

SEQ ID NO: 4041976 - DNA, 21 bp, Homo sapiens
ccttcagagtacgtcctgcct

SEQ ID NO: 4041977 - DNA, 23 bp, Homo sapiens
ccttcaggaactggggctttgcc

SEQ ID NO: 4041978 - DNA, 19 bp, Homo sapiens
ccttcagtaccctctcagc

SEQ ID NO: 4041979 - DNA, 23 bp, Homo sapiens
ccttcagtaccctctcagctcca

SEQ ID NO: 4041980 - DNA, 16 bp, Homo sapiens
ccttcatcttcctgtg

SEQ ID NO: 4041981 - DNA, 19 bp, Homo sapiens
ccttcatcttcctgtgtcc

SEQ ID NO: 4041982 - DNA, 20 bp, Homo sapiens
ccttcatcttcctgtgtcct

SEQ ID NO: 4041983 - DNA, 16 bp, Homo sapiens
ccttcatggccccagc

SEQ ID NO: 4041984 - DNA, 17 bp, Homo sapiens
ccttccaaaaattatta

SEQ ID NO: 4041985 - DNA, 21 bp, Homo sapiens
ccttccaactagctgggacta

SEQ ID NO: 4041986 - DNA, 15 bp, Homo sapiens
ccttccacctgctct

SEQ ID NO: 4041987 - DNA, 17 bp, Homo sapiens
ccttccacctgctctgc

SEQ ID NO: 4041988 - DNA, 12 bp, Homo sapiens
ccttccagctcc

SEQ ID NO: 4041989 - DNA, 13 bp, Homo sapiens
ccttccagctcct

SEQ ID NO: 4041990 - DNA, 17 bp, Homo sapiens
ccttccagctcctgtaa

SEQ ID NO: 4041991 - DNA, 14 bp, Homo sapiens
ccttccagctgctg

SEQ ID NO: 4041992 - DNA, 15 bp, Homo sapiens
ccttccagctgctgt

SEQ ID NO: 4041993 - DNA, 12 bp, Homo sapiens
ccttccagggcc

SEQ ID NO: 4041994 - DNA, 13 bp, Homo sapiens
ccttccagggccc

SEQ ID NO: 4041995 - DNA, 22 bp, Homo sapiens
ccttccagtgtccttagaacat

SEQ ID NO: 4041996 - DNA, 23 bp, Homo sapiens
ccttccatagcctaatccctggg

SEQ ID NO: 4041997 - DNA, 24 bp, Homo sapiens
ccttccatccatctttccatccat

SEQ ID NO: 4041998 - DNA, 19 bp, Homo sapiens
ccttccatccctaccccct

SEQ ID NO: 4041999 - DNA, 15 bp, Homo sapiens
ccttccatgtgcctt

SEQ ID NO: 4042000 - DNA, 19 bp, Homo sapiens
ccttccatgtgcctttctt

SEQ ID NO: 4042001 - DNA, 15 bp, Homo sapiens
ccttcccacatgcct

SEQ ID NO: 4042002 - DNA, 18 bp, Homo sapiens
ccttcccactcaccccgg

SEQ ID NO: 4042003 - DNA, 18 bp, Homo sapiens
ccttcccactcttctcat

SEQ ID NO: 4042004 - DNA, 14 bp, Homo sapiens
ccttcccatcgctg

SEQ ID NO: 4042005 - DNA, 22 bp, Homo sapiens
ccttccccatagataggcccct

SEQ ID NO: 4042006 - DNA, 15 bp, Homo sapiens
ccttcccccagccca

SEQ ID NO: 4042007 - DNA, 14 bp, Homo sapiens
ccttccccttcctt

SEQ ID NO: 4042008 - DNA, 17 bp, Homo sapiens
ccttccccttccttctt

SEQ ID NO: 4042009 - DNA, 12 bp, Homo sapiens
ccttccctgcac

SEQ ID NO: 4042010 - DNA, 12 bp, Homo sapiens
ccttcccttgct

SEQ ID NO: 4042011 - DNA, 21 bp, Homo sapiens
ccttccgccaatctggccctt

SEQ ID NO: 4042012 - DNA, 19 bp, Homo sapiens
ccttcctatgcccaggtac

SEQ ID NO: 4042013 - DNA, 19 bp, Homo sapiens
ccttcctcagctgcctcct

SEQ ID NO: 4042014 - DNA, 20 bp, Homo sapiens
ccttcctcagctgcctcctg

SEQ ID NO: 4042015 - DNA, 20 bp, Homo sapiens
ccttcctcatccaccccatc

SEQ ID NO: 4042016 - DNA, 21 bp, Homo sapiens
ccttcctccatcctcctcctt

SEQ ID NO: 4042017 - DNA, 13 bp, Homo sapiens
ccttcctctgctc

SEQ ID NO: 4042018 - DNA, 23 bp, Homo sapiens
ccttcctctgtaagatatcccag

SEQ ID NO: 4042019 - DNA, 13 bp, Homo sapiens
ccttcctggaggc

SEQ ID NO: 4042020 - DNA, 20 bp, Homo sapiens
ccttcctggaggctgcctat

SEQ ID NO: 4042021 - DNA, 22 bp, Homo sapiens
ccttcctggttttgtacactgc

SEQ ID NO: 4042022 - DNA, 13 bp, Homo sapiens
ccttcctgtttca

SEQ ID NO: 4042023 - DNA, 17 bp, Homo sapiens
ccttcctgtttcagacc

SEQ ID NO: 4042024 - DNA, 12 bp, Homo sapiens
ccttccttcagg

SEQ ID NO: 4042025 - DNA, 12 bp, Homo sapiens
ccttcctttctc

SEQ ID NO: 4042026 - DNA, 17 bp, Homo sapiens
ccttcctttctccagga

SEQ ID NO: 4042027 - DNA, 17 bp, Homo sapiens
ccttccttttccctgct

SEQ ID NO: 4042028 - DNA, 17 bp, Homo sapiens
ccttcgtgaacatcccc

SEQ ID NO: 4042029 - DNA, 15 bp, Homo sapiens
ccttctactgagcct

SEQ ID NO: 4042030 - DNA, 15 bp, Homo sapiens
ccttctcagaagcac

SEQ ID NO: 4042031 - DNA, 18 bp, Homo sapiens
ccttctcagaagcacaga

SEQ ID NO: 4042032 - DNA, 13 bp, Homo sapiens
ccttctcattacc

SEQ ID NO: 4042033 - DNA, 18 bp, Homo sapiens
ccttctcattacccaccc

SEQ ID NO: 4042034 - DNA, 15 bp, Homo sapiens
ccttctccaaatgag

SEQ ID NO: 4042035 - DNA, 15 bp, Homo sapiens
ccttctcccagcaca

SEQ ID NO: 4042036 - DNA, 21 bp, Homo sapiens
ccttctcctccccacccgccc

SEQ ID NO: 4042037 - DNA, 14 bp, Homo sapiens
ccttctcctctctg

SEQ ID NO: 4042038 - DNA, 18 bp, Homo sapiens
ccttctcctctctgggcc

SEQ ID NO: 4042039 - DNA, 14 bp, Homo sapiens
ccttctccttccca

SEQ ID NO: 4042040 - DNA, 18 bp, Homo sapiens
ccttctccttccccagga

SEQ ID NO: 4042041 - DNA, 17 bp, Homo sapiens
ccttctctgaacacagg

SEQ ID NO: 4042042 - DNA, 19 bp, Homo sapiens
ccttctctgaacacaggca

SEQ ID NO: 4042043 - DNA, 20 bp, Homo sapiens
ccttctctgctccaccacat

SEQ ID NO: 4042044 - DNA, 18 bp, Homo sapiens
ccttctcttccaggcagc

SEQ ID NO: 4042045 - DNA, 21 bp, Homo sapiens
ccttctgctggataaaatgag

SEQ ID NO: 4042046 - DNA, 15 bp, Homo sapiens
ccttctgtccccagc

SEQ ID NO: 4042047 - DNA, 19 bp, Homo sapiens
ccttctgtccccagccctg

SEQ ID NO: 4042048 - DNA, 14 bp, Homo sapiens
ccttcttcacccag

SEQ ID NO: 4042049 - DNA, 13 bp, Homo sapiens
ccttctttgaaga

SEQ ID NO: 4042050 - DNA, 15 bp, Homo sapiens
ccttctttgaagaag

SEQ ID NO: 4042051 - DNA, 14 bp, Homo sapiens
cccagggcccagag

SEQ ID NO: 4042052 - DNA, 15 bp, Homo sapiens
cccagggccctggcc

SEQ ID NO: 4042053 - DNA, 19 bp, Homo sapiens
cccagggccctggccagcc

SEQ ID NO: 4042054 - DNA, 20 bp, Homo sapiens
cccagggccctggccagccg

SEQ ID NO: 4042055 - DNA, 13 bp, Homo sapiens
cccagggctggct

SEQ ID NO: 4042056 - DNA, 17 bp, Homo sapiens
cccaggggaaaatgaag

SEQ ID NO: 4042057 - DNA, 21 bp, Homo sapiens
cccaggggaaggccctgaggc

SEQ ID NO: 4042058 - DNA, 15 bp, Homo sapiens
cccaggggtcccagc

SEQ ID NO: 4042059 - DNA, 16 bp, Homo sapiens
cccaggggtcccagcc

SEQ ID NO: 4042060 - DNA, 19 bp, Homo sapiens
cccaggggtcccagccacc

SEQ ID NO: 4042061 - DNA, 16 bp, Homo sapiens
cccaggggtctccctg

SEQ ID NO: 4042062 - DNA, 17 bp, Homo sapiens
cccaggggtctccctgg

SEQ ID NO: 4042063 - DNA, 18 bp, Homo sapiens
cccaggggtctccctggc

SEQ ID NO: 4042064 - DNA, 19 bp, Homo sapiens
cccaggggtctccctggct

SEQ ID NO: 4042065 - DNA, 15 bp, Homo sapiens
cccagggtcttccct

SEQ ID NO: 4042066 - DNA, 23 bp, Homo sapiens
cccagggtcttccctacctcagg

SEQ ID NO: 4042067 - DNA, 19 bp, Homo sapiens
cccagggtgaggtggcatg

SEQ ID NO: 4042068 - DNA, 19 bp, Homo sapiens
cccagggttaatagggcct

SEQ ID NO: 4042069 - DNA, 21 bp, Homo sapiens
cccaggtaccacccttcagac

SEQ ID NO: 4042070 - DNA, 15 bp, Homo sapiens
cccaggtaccagctg

SEQ ID NO: 4042071 - DNA, 16 bp, Homo sapiens
cccaggtaccagctgc

SEQ ID NO: 4042072 - DNA, 21 bp, Homo sapiens
cccaggtggagggcacagccc

SEQ ID NO: 4042073 - DNA, 14 bp, Homo sapiens
cccaggtgtgtgct

SEQ ID NO: 4042074 - DNA, 17 bp, Homo sapiens
cccaggttcccccagca

SEQ ID NO: 4042075 - DNA, 18 bp, Homo sapiens
cccaggttcccccagcaa

SEQ ID NO: 4042076 - DNA, 17 bp, Homo sapiens
cccaggttcgagaccca

SEQ ID NO: 4042077 - DNA, 21 bp, Homo sapiens
cccagtaagtttcccctctgg

SEQ ID NO: 4042078 - DNA, 12 bp, Homo sapiens
cccagtcacctc

SEQ ID NO: 4042079 - DNA, 23 bp, Homo sapiens
cccagtccccacccctgccccca

SEQ ID NO: 4042080 - DNA, 21 bp, Homo sapiens
cccagtctctcttaaagttgg

SEQ ID NO: 4042081 - DNA, 15 bp, Homo sapiens
cccagtctctggcag

SEQ ID NO: 4042082 - DNA, 20 bp, Homo sapiens
cccagtctctggcagttctg

SEQ ID NO: 4042083 - DNA, 18 bp, Homo sapiens
cccagtgaagcctctgag

SEQ ID NO: 4042084 - DNA, 13 bp, Homo sapiens
cccagtgacactt

SEQ ID NO: 4042085 - DNA, 14 bp, Homo sapiens
cccagtgcccccac

SEQ ID NO: 4042086 - DNA, 19 bp, Homo sapiens
cccagtgcccccactgacc

SEQ ID NO: 4042087 - DNA, 17 bp, Homo sapiens
cccagtggccactcagc

SEQ ID NO: 4042088 - DNA, 18 bp, Homo sapiens
cccagtgggacagaggag

SEQ ID NO: 4042089 - DNA, 13 bp, Homo sapiens
cccagtgggacca

SEQ ID NO: 4042090 - DNA, 20 bp, Homo sapiens
cccagtgggaccacatgcca

SEQ ID NO: 4042091 - DNA, 16 bp, Homo sapiens
cccagtgttgtttgta

SEQ ID NO: 4042092 - DNA, 17 bp, Homo sapiens
cccagtgttgtttgtaa

SEQ ID NO: 4042093 - DNA, 15 bp, Homo sapiens
cccagttgccatctg

SEQ ID NO: 4042094 - DNA, 21 bp, Homo sapiens
cccagttggggaagccaggtg

SEQ ID NO: 4042095 - DNA, 19 bp, Homo sapiens
cccagttttgttgccccag

SEQ ID NO: 4042096 - DNA, 19 bp, Homo sapiens
cccataattttcttcatgc

SEQ ID NO: 4042097 - DNA, 23 bp, Homo sapiens
cccatagataggcccctggggct

SEQ ID NO: 4042098 - DNA, 13 bp, Homo sapiens
cccatagcttcca

SEQ ID NO: 4042099 - DNA, 15 bp, Homo sapiens
cccatatacacctgg

SEQ ID NO: 4042100 - DNA, 18 bp, Homo sapiens
cccatcagaacctgagct

SEQ ID NO: 4042101 - DNA, 13 bp, Homo sapiens
cccatcatccttt

SEQ ID NO: 4042102 - DNA, 19 bp, Homo sapiens
cccatcatgtggccccacc

SEQ ID NO: 4042103 - DNA, 20 bp, Homo sapiens
cccatccagtctcccaactt

SEQ ID NO: 4042104 - DNA, 15 bp, Homo sapiens
cccatccatcagctc

SEQ ID NO: 4042105 - DNA, 13 bp, Homo sapiens
cccatcccacccc

SEQ ID NO: 4042106 - DNA, 15 bp, Homo sapiens
cccatccccaccagc

SEQ ID NO: 4042107 - DNA, 16 bp, Homo sapiens
cccatccccaccagct

SEQ ID NO: 4042108 - DNA, 21 bp, Homo sapiens
cccatcccctggactgggagg

SEQ ID NO: 4042109 - DNA, 16 bp, Homo sapiens
cccatccctccccagt

SEQ ID NO: 4042110 - DNA, 17 bp, Homo sapiens
cccatcctcatccctga

SEQ ID NO: 4042111 - DNA, 14 bp, Homo sapiens
cccatcctccagag

SEQ ID NO: 4042112 - DNA, 15 bp, Homo sapiens
cccatcctgccatcc

SEQ ID NO: 4042113 - DNA, 14 bp, Homo sapiens
cccatctcagcctc

SEQ ID NO: 4042114 - DNA, 20 bp, Homo sapiens
cccatctcagcctcctgagc

SEQ ID NO: 4042115 - DNA, 13 bp, Homo sapiens
cccatctcaggac

SEQ ID NO: 4042116 - DNA, 15 bp, Homo sapiens
cccatctcccaccct

SEQ ID NO: 4042117 - DNA, 13 bp, Homo sapiens
cccatctccccct

SEQ ID NO: 4042118 - DNA, 12 bp, Homo sapiens
cccatctccctg

SEQ ID NO: 4042119 - DNA, 14 bp, Homo sapiens
cccatctccctgcc

SEQ ID NO: 4042120 - DNA, 23 bp, Homo sapiens
cccatctctccctcccctgccat

SEQ ID NO: 4042121 - DNA, 18 bp, Homo sapiens
cccatctgggtccttgca

SEQ ID NO: 4042122 - DNA, 20 bp, Homo sapiens
cccatgactgcacccagctc

SEQ ID NO: 4042123 - DNA, 22 bp, Homo sapiens
cccatgactgcacccagctcca

SEQ ID NO: 4042124 - DNA, 21 bp, Homo sapiens
cccatgagaccctggtgcctg

SEQ ID NO: 4042125 - DNA, 14 bp, Homo sapiens
cccatgagcctgcc

SEQ ID NO: 4042126 - DNA, 16 bp, Homo sapiens
cccatgccaaggcctc

SEQ ID NO: 4042127 - DNA, 22 bp, Homo sapiens
cccatgccaaggcctccctcag

SEQ ID NO: 4042128 - DNA, 15 bp, Homo sapiens
cccatgcccacctgc

SEQ ID NO: 4042129 - DNA, 18 bp, Homo sapiens
cccatgcccacctgccca

SEQ ID NO: 4042130 - DNA, 22 bp, Homo sapiens
cccatgcctagcagagtgctgg

SEQ ID NO: 4042131 - DNA, 21 bp, Homo sapiens
cccatgctcaaccactgtggc

SEQ ID NO: 4042132 - DNA, 18 bp, Homo sapiens
cccatgctgggctcccgt

SEQ ID NO: 4042133 - DNA, 13 bp, Homo sapiens
cccatggaatatt

SEQ ID NO: 4042134 - DNA, 16 bp, Homo sapiens
cccatggacactccag

SEQ ID NO: 4042135 - DNA, 19 bp, Homo sapiens
cccatgggctcctgcccct

SEQ ID NO: 4042136 - DNA, 16 bp, Homo sapiens
cccatgggctctgaca

SEQ ID NO: 4042137 - DNA, 23 bp, Homo sapiens
cccatgggttgtgtgtttatttc

SEQ ID NO: 4042138 - DNA, 14 bp, Homo sapiens
cccatgtagccccc

SEQ ID NO: 4042139 - DNA, 21 bp, Homo sapiens
cccatgtagccccctggcctc

SEQ ID NO: 4042140 - DNA, 21 bp, Homo sapiens
cccatgtcaccggtcagtgcc

SEQ ID NO: 4042141 - DNA, 22 bp, Homo sapiens
cccatgtcaccggtcagtgcct

SEQ ID NO: 4042142 - DNA, 23 bp, Homo sapiens
cccatgtgtcccctcactctgtc

SEQ ID NO: 4042143 - DNA, 21 bp, Homo sapiens
cccatgtgtcctggttcccgt

SEQ ID NO: 4042144 - DNA, 13 bp, Homo sapiens
cccatgtttcaaa

SEQ ID NO: 4042145 - DNA, 18 bp, Homo sapiens
cccattcagagactgtcc

SEQ ID NO: 4042146 - DNA, 13 bp, Homo sapiens
cccattcccacca

SEQ ID NO: 4042147 - DNA, 15 bp, Homo sapiens
cccattccctccatt

SEQ ID NO: 4042148 - DNA, 18 bp, Homo sapiens
cccattcctgaagaacca

SEQ ID NO: 4042149 - DNA, 19 bp, Homo sapiens
cccattcctgatcccatgg

SEQ ID NO: 4042150 - DNA, 18 bp, Homo sapiens
cccattccttgcgcctca

SEQ ID NO: 4042151 - DNA, 21 bp, Homo sapiens
cccattcggtgtggtgcagtg

SEQ ID NO: 4042152 - DNA, 22 bp, Homo sapiens
cccattctgttttcccccagca

SEQ ID NO: 4042153 - DNA, 17 bp, Homo sapiens
cccatttcccatctgca

SEQ ID NO: 4042154 - DNA, 22 bp, Homo sapiens
ccccatttcccatctgcacccc

SEQ ID NO: 4042155 - DNA, 13 bp, Homo sapiens
ccccatttctatt

SEQ ID NO: 4042156 - DNA, 15 bp, Homo sapiens
ccccatttctgcctc

SEQ ID NO: 4042157 - DNA, 19 bp, Homo sapiens
ccccatttctgcctcgctc

SEQ ID NO: 4042158 - DNA, 15 bp, Homo sapiens
cccccaacctcaggg

SEQ ID NO: 4042159 - DNA, 12 bp, Homo sapiens
cccccacccacc

SEQ ID NO: 4042160 - DNA, 14 bp, Homo sapiens
cccccaccttgatc

SEQ ID NO: 4042161 - DNA, 21 bp, Homo sapiens
cccccagatagagctgggtgg

SEQ ID NO: 4042162 - DNA, 12 bp, Homo sapiens
cccccagcactt

SEQ ID NO: 4042163 - DNA, 18 bp, Homo sapiens
cccccagctaagaacctg

SEQ ID NO: 4042164 - DNA, 12 bp, Homo sapiens
cccccagctccc

SEQ ID NO: 4042165 - DNA, 12 bp, Homo sapiens
cccccagggcct

SEQ ID NO: 4042166 - DNA, 21 bp, Homo sapiens
cccccagggcctccagggccc

SEQ ID NO: 4042167 - DNA, 14 bp, Homo sapiens
cccccaggggcagg

SEQ ID NO: 4042168 - DNA, 15 bp, Homo sapiens
cccccaggggcagga

SEQ ID NO: 4042169 - DNA, 11 bp, Homo sapiens
cccccagtggg

SEQ ID NO: 4042170 - DNA, 14 bp, Homo sapiens
cccccatgggctcc

SEQ ID NO: 4042171 - DNA, 13 bp, Homo sapiens
cccccccatgcag

SEQ ID NO: 4042172 - DNA, 14 bp, Homo sapiens
cccccgagctcttg

SEQ ID NO: 4042173 - DNA, 19 bp, Homo sapiens
cccccgcgctcgcccagca

SEQ ID NO: 4042174 - DNA, 14 bp, Homo sapiens
cccccggccccctg

SEQ ID NO: 4042175 - DNA, 19 bp, Homo sapiens
ccccctaaacccctgtccc

SEQ ID NO: 4042176 - DNA, 18 bp, Homo sapiens
ccccctcccctcccagtc

SEQ ID NO: 4042177 - DNA, 22 bp, Homo sapiens
ccccctctgccggtcgggcagc

SEQ ID NO: 4042178 - DNA, 14 bp, Homo sapiens
ccccctcttccctg

SEQ ID NO: 4042179 - DNA, 20 bp, Homo sapiens
ccccctgcaacttccgctga

SEQ ID NO: 4042180 - DNA, 12 bp, Homo sapiens
ccccctgcatct

SEQ ID NO: 4042181 - DNA, 14 bp, Homo sapiens
ccccctgccctgca

SEQ ID NO: 4042182 - DNA, 18 bp, Homo sapiens
ccccctgctccaccagca

SEQ ID NO: 4042183 - DNA, 20 bp, Homo sapiens
ccccctgctccaccagcagc

SEQ ID NO: 4042184 - DNA, 18 bp, Homo sapiens
ccccctgtagactagtgc

SEQ ID NO: 4042185 - DNA, 14 bp, Homo sapiens
cccccttcctgtcc

SEQ ID NO: 4042186 - DNA, 16 bp, Homo sapiens
cccccttctctgctcc

SEQ ID NO: 4042187 - DNA, 18 bp, Homo sapiens
ccccgagaagtgctcttg

SEQ ID NO: 4042188 - DNA, 18 bp, Homo sapiens
ccccgagctcttggcctt

SEQ ID NO: 4042189 - DNA, 22 bp, Homo sapiens
ccccgagctcttggcctttgca

SEQ ID NO: 4042190 - DNA, 12 bp, Homo sapiens
ccccgagctggg

SEQ ID NO: 4042191 - DNA, 17 bp, Homo sapiens
ccccgccacctcagggc

SEQ ID NO: 4042192 - DNA, 15 bp, Homo sapiens
ccccgccccatgggc

SEQ ID NO: 4042193 - DNA, 18 bp, Homo sapiens
ccccgcctgccctcatgg

SEQ ID NO: 4042194 - DNA, 22 bp, Homo sapiens
ccccgcctttagttctccactg

SEQ ID NO: 4042195 - DNA, 17 bp, Homo sapiens
ccccggacatactctct

SEQ ID NO: 4042196 - DNA, 12 bp, Homo sapiens
ccccggcctcag

SEQ ID NO: 4042197 - DNA, 13 bp, Homo sapiens
ccccggcctcagg

SEQ ID NO: 4042198 - DNA, 14 bp, Homo sapiens
ccccggcctcaggg

SEQ ID NO: 4042199 - DNA, 23 bp, Homo sapiens
ccccggcctcagggcgctcagac

SEQ ID NO: 4042200 - DNA, 17 bp, Homo sapiens
ccccgggttcagcctgg

SEQ ID NO: 4042201 - DNA, 21 bp, Homo sapiens
ccccgggttcagcctggcctg

SEQ ID NO: 4042202 - DNA, 14 bp, Homo sapiens
ccccgtctctacta

SEQ ID NO: 4042203 - DNA, 15 bp, Homo sapiens
ccccgtctgcccacc

SEQ ID NO: 4042204 - DNA, 20 bp, Homo sapiens
ccccgtttctccttttccta

SEQ ID NO: 4042205 - DNA, 13 bp, Homo sapiens
cccctacacacac

SEQ ID NO: 4042206 - DNA, 14 bp, Homo sapiens
cccctacacacaca

SEQ ID NO: 4042207 - DNA, 15 bp, Homo sapiens
cccctacacacacac

SEQ ID NO: 4042208 - DNA, 16 bp, Homo sapiens
cccctacacacacact

SEQ ID NO: 4042209 - DNA, 19 bp, Homo sapiens
cccctacacacacactccc

SEQ ID NO: 4042210 - DNA, 12 bp, Homo sapiens
cccctacccacc

SEQ ID NO: 4042211 - DNA, 18 bp, Homo sapiens
cccctagccaccagtgtc

SEQ ID NO: 4042212 - DNA, 21 bp, Homo sapiens
cccctagccaccagtgtcctc

SEQ ID NO: 4042213 - DNA, 22 bp, Homo sapiens
cccctagccaccagtgtcctcc

SEQ ID NO: 4042214 - DNA, 12 bp, Homo sapiens
cccctatcctct

SEQ ID NO: 4042215 - DNA, 16 bp, Homo sapiens
cccctatcctctgagt

SEQ ID NO: 4042216 - DNA, 12 bp, Homo sapiens
cccctcacctct

SEQ ID NO: 4042217 - DNA, 15 bp, Homo sapiens
cccctcaccttgggc

SEQ ID NO: 4042218 - DNA, 15 bp, Homo sapiens
cccctcactccccag

SEQ ID NO: 4042219 - DNA, 18 bp, Homo sapiens
cccctcactccccaggga

SEQ ID NO: 4042220 - DNA, 17 bp, Homo sapiens
ccctagctttagaccct

SEQ ID NO: 4042221 - DNA, 18 bp, Homo sapiens
ccctagctttagaccctg

SEQ ID NO: 4042222 - DNA, 17 bp, Homo sapiens
ccctagtccccctgttt

SEQ ID NO: 4042223 - DNA, 18 bp, Homo sapiens
ccctatctccttcccacc

SEQ ID NO: 4042224 - DNA, 22 bp, Homo sapiens
ccctatctccttcccaccccta

SEQ ID NO: 4042225 - DNA, 12 bp, Homo sapiens
ccctcaaatgct

SEQ ID NO: 4042226 - DNA, 18 bp, Homo sapiens
ccctcaacaggcccaggg

SEQ ID NO: 4042227 - DNA, 20 bp, Homo sapiens
ccctcaacaggcccagggag

SEQ ID NO: 4042228 - DNA, 14 bp, Homo sapiens
ccctcaagccccag

SEQ ID NO: 4042229 - DNA, 18 bp, Homo sapiens
ccctcaatccaccttcag

SEQ ID NO: 4042230 - DNA, 22 bp, Homo sapiens
ccctcacacacacagctgggca

SEQ ID NO: 4042231 - DNA, 17 bp, Homo sapiens
ccctcacacatccagac

SEQ ID NO: 4042232 - DNA, 12 bp, Homo sapiens
ccctcaccaaca

SEQ ID NO: 4042233 - DNA, 15 bp, Homo sapiens
ccctcacctctccag

SEQ ID NO: 4042234 - DNA, 21 bp, Homo sapiens
ccctcacctgtagcagccagt

SEQ ID NO: 4042235 - DNA, 19 bp, Homo sapiens
ccctcaccttgggctgggg

SEQ ID NO: 4042236 - DNA, 12 bp, Homo sapiens
ccctcactcccc

SEQ ID NO: 4042237 - DNA, 13 bp, Homo sapiens
ccctcactcccca

SEQ ID NO: 4042238 - DNA, 16 bp, Homo sapiens
ccctcactctggcctc

SEQ ID NO: 4042239 - DNA, 15 bp, Homo sapiens
ccctcactctgtcag

SEQ ID NO: 4042240 - DNA, 17 bp, Homo sapiens
ccctcactgaaggacct

SEQ ID NO: 4042241 - DNA, 14 bp, Homo sapiens
ccctcactggatga

SEQ ID NO: 4042242 - DNA, 20 bp, Homo sapiens
ccctcagagccctgccctgc

SEQ ID NO: 4042243 - DNA, 19 bp, Homo sapiens
ccctcagccacacccaggc

SEQ ID NO: 4042244 - DNA, 15 bp, Homo sapiens
ccctcagctctctgg

SEQ ID NO: 4042245 - DNA, 21 bp, Homo sapiens
ccctcaggcataggcctgggt

SEQ ID NO: 4042246 - DNA, 22 bp, Homo sapiens
ccctcaggcataggcctgggtg

SEQ ID NO: 4042247 - DNA, 12 bp, Homo sapiens
ccctcagggatc

SEQ ID NO: 4042248 - DNA, 22 bp, Homo sapiens
ccctcagggatcttgcattccc

SEQ ID NO: 4042249 - DNA, 15 bp, Homo sapiens
ccctcaggggaaaac

SEQ ID NO: 4042250 - DNA, 17 bp, Homo sapiens
ccctcatctatgaggaa

SEQ ID NO: 4042251 - DNA, 20 bp, Homo sapiens
ccctcatggcccccaggggc

SEQ ID NO: 4042252 - DNA, 21 bp, Homo sapiens
ccctcatggcccccaggggca

SEQ ID NO: 4042253 - DNA, 18 bp, Homo sapiens
ccctccaaacctccagcc

SEQ ID NO: 4042254 - DNA, 24 bp, Homo sapiens
ccctccaaacctccagcctccctg

SEQ ID NO: 4042255 - DNA, 13 bp, Homo sapiens
ccctccacatccc

SEQ ID NO: 4042256 - DNA, 15 bp, Homo sapiens
ccctccacctcaaga

SEQ ID NO: 4042257 - DNA, 15 bp, Homo sapiens
ccctccaccttccat

SEQ ID NO: 4042258 - DNA, 17 bp, Homo sapiens
ccctccactcagctgtc

SEQ ID NO: 4042259 - DNA, 23 bp, Homo sapiens
ccctccagaatggaactcaagct

SEQ ID NO: 4042260 - DNA, 23 bp, Homo sapiens
ccctccagcctttggccttggct

SEQ ID NO: 4042261 - DNA, 21 bp, Homo sapiens
ccctccaggagggaccaccct

SEQ ID NO: 4042262 - DNA, 13 bp, Homo sapiens
ccctcccagtcct

SEQ ID NO: 4042263 - DNA, 14 bp, Homo sapiens
ccctcccagtcctc

SEQ ID NO: 4042264 - DNA, 16 bp, Homo sapiens
ccctccccatcccatg

SEQ ID NO: 4042265 - DNA, 20 bp, Homo sapiens
ccctcccccccatgcactgt

SEQ ID NO: 4042266 - DNA, 21 bp, Homo sapiens
ccctcccccgccactcctgaa

SEQ ID NO: 4042267 - DNA, 13 bp, Homo sapiens
ccctccccctcaa

SEQ ID NO: 4042268 - DNA, 13 bp, Homo sapiens
ccctccccctgag

SEQ ID NO: 4042269 - DNA, 15 bp, Homo sapiens
ccctccccgcccctg

SEQ ID NO: 4042270 - DNA, 17 bp, Homo sapiens
ccctcccctcccagtcc

SEQ ID NO: 4042271 - DNA, 23 bp, Homo sapiens
ccctcccgccccttcccactcac

SEQ ID NO: 4042272 - DNA, 12 bp, Homo sapiens
ccctccctgact

SEQ ID NO: 4042273 - DNA, 14 bp, Homo sapiens
ccctccctgcctga

SEQ ID NO: 4042274 - DNA, 21 bp, Homo sapiens
ccctccctgcctgagggcagt

SEQ ID NO: 4042275 - DNA, 12 bp, Homo sapiens
ccctccctggag

SEQ ID NO: 4042276 - DNA, 16 bp, Homo sapiens
ccctccctggctccca

SEQ ID NO: 4042277 - DNA, 13 bp, Homo sapiens
ccctcccttgctg

SEQ ID NO: 4042278 - DNA, 22 bp, Homo sapiens
ccctgctttggctgaggggctt

SEQ ID NO: 4042279 - DNA, 19 bp, Homo sapiens
ccctggaacatcctttgca

SEQ ID NO: 4042280 - DNA, 16 bp, Homo sapiens
ccctggaagagcccag

SEQ ID NO: 4042281 - DNA, 14 bp, Homo sapiens
ccctggacctggga

SEQ ID NO: 4042282 - DNA, 14 bp, Homo sapiens
ccctggactgggag

SEQ ID NO: 4042283 - DNA, 13 bp, Homo sapiens
ccctggagagaag

SEQ ID NO: 4042284 - DNA, 17 bp, Homo sapiens
ccctggagccccttcgg

SEQ ID NO: 4042285 - DNA, 15 bp, Homo sapiens
ccctggagtgcagtt

SEQ ID NO: 4042286 - DNA, 20 bp, Homo sapiens
ccctggagtgtggctgagga

SEQ ID NO: 4042287 - DNA, 23 bp, Homo sapiens
ccctggatcagtcctttgatcag

SEQ ID NO: 4042288 - DNA, 14 bp, Homo sapiens
ccctggcaggcagg

SEQ ID NO: 4042289 - DNA, 12 bp, Homo sapiens
ccctggccagcc

SEQ ID NO: 4042290 - DNA, 15 bp, Homo sapiens
ccctggcccatctca

SEQ ID NO: 4042291 - DNA, 19 bp, Homo sapiens
ccctggcccatctcagcct

SEQ ID NO: 4042292 - DNA, 19 bp, Homo sapiens
ccctggcctctgtgccttc

SEQ ID NO: 4042293 - DNA, 18 bp, Homo sapiens
ccctggcctgaactgagg

SEQ ID NO: 4042294 - DNA, 13 bp, Homo sapiens
ccctggctcccat

SEQ ID NO: 4042295 - DNA, 15 bp, Homo sapiens
ccctggctcccatga

SEQ ID NO: 4042296 - DNA, 16 bp, Homo sapiens
ccctggctccctcctc

SEQ ID NO: 4042297 - DNA, 20 bp, Homo sapiens
ccctggctccctcctccagg

SEQ ID NO: 4042298 - DNA, 13 bp, Homo sapiens
ccctggctctgca

SEQ ID NO: 4042299 - DNA, 13 bp, Homo sapiens
ccctggctctgct

SEQ ID NO: 4042300 - DNA, 14 bp, Homo sapiens
ccctggctgctgcc

SEQ ID NO: 4042301 - DNA, 18 bp, Homo sapiens
ccctggctgctgccccca

SEQ ID NO: 4042302 - DNA, 22 bp, Homo sapiens
ccctggctgctgcccccacccc

SEQ ID NO: 4042303 - DNA, 22 bp, Homo sapiens
ccctggctgttctgtggttcct

SEQ ID NO: 4042304 - DNA, 14 bp, Homo sapiens
ccctggcttcctta

SEQ ID NO: 4042305 - DNA, 16 bp, Homo sapiens
ccctggctttgcctct

SEQ ID NO: 4042306 - DNA, 22 bp, Homo sapiens
ccctggcttttcactgctggct

SEQ ID NO: 4042307 - DNA, 17 bp, Homo sapiens
ccctgggagccagtcct

SEQ ID NO: 4042308 - DNA, 19 bp, Homo sapiens
ccctgggagccagtcctcc

SEQ ID NO: 4042309 - DNA, 19 bp, Homo sapiens
ccctgggatgggaccaggg

SEQ ID NO: 4042310 - DNA, 15 bp, Homo sapiens
ccctgggcaggtgtg

SEQ ID NO: 4042311 - DNA, 13 bp, Homo sapiens
ccctgggccaggg

SEQ ID NO: 4042312 - DNA, 17 bp, Homo sapiens
ccctgggccagggtctg

SEQ ID NO: 4042313 - DNA, 22 bp, Homo sapiens
ccctgggccagggtctgtgtga

SEQ ID NO: 4042314 - DNA, 14 bp, Homo sapiens
ccctgggcccctcc

SEQ ID NO: 4042315 - DNA, 18 bp, Homo sapiens
ccctgggcccctccacgc

SEQ ID NO: 4042316 - DNA, 15 bp, Homo sapiens
ccctgggctggactg

SEQ ID NO: 4042317 - DNA, 20 bp, Homo sapiens
ccctgggctgggtgctggga

SEQ ID NO: 4042318 - DNA, 16 bp, Homo sapiens
ccctgggctgtctgtc

SEQ ID NO: 4042319 - DNA, 17 bp, Homo sapiens
ccctggggcctggacct

SEQ ID NO: 4042320 - DNA, 17 bp, Homo sapiens
ccctggggtggccacca

SEQ ID NO: 4042321 - DNA, 16 bp, Homo sapiens
ccctggtccagggaag

SEQ ID NO: 4042322 - DNA, 15 bp, Homo sapiens
ccctggtcctgaggg

SEQ ID NO: 4042323 - DNA, 18 bp, Homo sapiens
ccctggtgaatcacctgg

SEQ ID NO: 4042324 - DNA, 15 bp, Homo sapiens
ccctggtgcctggct

SEQ ID NO: 4042325 - DNA, 16 bp, Homo sapiens
ccctggtgcctggctc

SEQ ID NO: 4042326 - DNA, 20 bp, Homo sapiens
ccaggtcaccctttgctgtg

SEQ ID NO: 4042327 - DNA, 23 bp, Homo sapiens
ccaggtctcacgggcatgggcac

SEQ ID NO: 4042328 - DNA, 23 bp, Homo sapiens
ccaggtcttgactcatggcagct

SEQ ID NO: 4042329 - DNA, 21 bp, Homo sapiens
ccaggtgaaggaggctccagg

SEQ ID NO: 4042330 - DNA, 20 bp, Homo sapiens
ccaggtgagctctgaccctt

SEQ ID NO: 4042331 - DNA, 11 bp, Homo sapiens
ccaggtgctca

SEQ ID NO: 4042332 - DNA, 15 bp, Homo sapiens
ccaggtgctcattgt

SEQ ID NO: 4042333 - DNA, 18 bp, Homo sapiens
ccaggtggagggcacagc

SEQ ID NO: 4042334 - DNA, 22 bp, Homo sapiens
ccaggtggagggcacagccctc

SEQ ID NO: 4042335 - DNA, 16 bp, Homo sapiens
ccaggtggccactcca

SEQ ID NO: 4042336 - DNA, 21 bp, Homo sapiens
ccaggtggccactccagaccc

SEQ ID NO: 4042337 - DNA, 13 bp, Homo sapiens
ccaggtgtgcctg

SEQ ID NO: 4042338 - DNA, 22 bp, Homo sapiens
ccaggtgtgtccacctgggcat

SEQ ID NO: 4042339 - DNA, 15 bp, Homo sapiens
ccaggttcaacccac

SEQ ID NO: 4042340 - DNA, 21 bp, Homo sapiens
ccaggttccccagccgcccac

SEQ ID NO: 4042341 - DNA, 19 bp, Homo sapiens
ccaggttcccccagcaagc

SEQ ID NO: 4042342 - DNA, 14 bp, Homo sapiens
ccaggttcgagacc

SEQ ID NO: 4042343 - DNA, 23 bp, Homo sapiens
ccaggttttgttccgcccagtgg

SEQ ID NO: 4042344 - DNA, 19 bp, Homo sapiens
ccagtaacgcgtcttcctg

SEQ ID NO: 4042345 - DNA, 23 bp, Homo sapiens
ccagtaagtttcccctctggctt

SEQ ID NO: 4042346 - DNA, 12 bp, Homo sapiens
ccagtacctcca

SEQ ID NO: 4042347 - DNA, 19 bp, Homo sapiens
ccagtacctgggtccccag

SEQ ID NO: 4042348 - DNA, 14 bp, Homo sapiens
ccagtaccttgctt

SEQ ID NO: 4042349 - DNA, 20 bp, Homo sapiens
ccagtaggagaaatctcagc

SEQ ID NO: 4042350 - DNA, 20 bp, Homo sapiens
ccagtaggggcttataataa

SEQ ID NO: 4042351 - DNA, 16 bp, Homo sapiens
ccagtattctcagagc

SEQ ID NO: 4042352 - DNA, 14 bp, Homo sapiens
ccagtattgccccc

SEQ ID NO: 4042353 - DNA, 15 bp, Homo sapiens
ccagtattgccccct

SEQ ID NO: 4042354 - DNA, 15 bp, Homo sapiens
ccagtcacactgtgg

SEQ ID NO: 4042355 - DNA, 18 bp, Homo sapiens
ccagtcacctccccacat

SEQ ID NO: 4042356 - DNA, 14 bp, Homo sapiens
ccagtcaggctctc

SEQ ID NO: 4042357 - DNA, 18 bp, Homo sapiens
ccagtccaaatgtcctcc

SEQ ID NO: 4042358 - DNA, 19 bp, Homo sapiens
ccagtcccagacaattcca

SEQ ID NO: 4042359 - DNA, 19 bp, Homo sapiens
ccagtccccacccctgccc

SEQ ID NO: 4042360 - DNA, 21 bp, Homo sapiens
ccagtccccacccctgccccc

SEQ ID NO: 4042361 - DNA, 22 bp, Homo sapiens
ccagtccccacccctgccccca

SEQ ID NO: 4042362 - DNA, 15 bp, Homo sapiens
ccagtccccagaact

SEQ ID NO: 4042363 - DNA, 17 bp, Homo sapiens
ccagtccccccaccctc

SEQ ID NO: 4042364 - DNA, 14 bp, Homo sapiens
ccagtccccttccc

SEQ ID NO: 4042365 - DNA, 16 bp, Homo sapiens
ccagtcctccagacca

SEQ ID NO: 4042366 - DNA, 17 bp, Homo sapiens
ccagtcctcctgggagc

SEQ ID NO: 4042367 - DNA, 15 bp, Homo sapiens
ccagtcctgcctggc

SEQ ID NO: 4042368 - DNA, 19 bp, Homo sapiens
ccagtcctgcctggccagg

SEQ ID NO: 4042369 - DNA, 21 bp, Homo sapiens
ccagtcctgcctggccaggca

SEQ ID NO: 4042370 - DNA, 12 bp, Homo sapiens
ccagtcctgcta

SEQ ID NO: 4042371 - DNA, 18 bp, Homo sapiens
ccagtcggccccatctct

SEQ ID NO: 4042372 - DNA, 17 bp, Homo sapiens
ccagtctctcttaaagt

SEQ ID NO: 4042373 - DNA, 18 bp, Homo sapiens
ccagtctgggctgccggg

SEQ ID NO: 4042374 - DNA, 19 bp, Homo sapiens
ccagtctgggctgccgggt

SEQ ID NO: 4042375 - DNA, 17 bp, Homo sapiens
ccagtgaaatgtgaagg

SEQ ID NO: 4042376 - DNA, 15 bp, Homo sapiens
ccagtgaactcctgc

SEQ ID NO: 4042377 - DNA, 18 bp, Homo sapiens
ccagtgaactcctgccag

SEQ ID NO: 4042378 - DNA, 16 bp, Homo sapiens
ccagtgaattcttgaa

SEQ ID NO: 4042379 - DNA, 23 bp, Homo sapiens
ccagtgaattcttgaaggaaaat

SEQ ID NO: 4042380 - DNA, 11 bp, Homo sapiens
ccagtgacact

SEQ ID NO: 4042381 - DNA, 17 bp, Homo sapiens
ccagtgacagacaggct

SEQ ID NO: 4042382 - DNA, 18 bp, Homo sapiens
ccagtgacagacaggctc

SEQ ID NO: 4042383 - DNA, 15 bp, Homo sapiens
ccagtgaccccagaa

SEQ ID NO: 4042384 - DNA, 12 bp, Homo sapiens
ccagtgacctgg

SEQ ID NO: 4042385 - DNA, 21 bp, Homo sapiens
ccagtgcacagggaagggctt

SEQ ID NO: 4042386 - DNA, 12 bp, Homo sapiens
ccagtgcagcca

SEQ ID NO: 4042387 - DNA, 23 bp, Homo sapiens
ccagtgccattccactccactca

SEQ ID NO: 4042388 - DNA, 14 bp, Homo sapiens
ccagtgcccccact

SEQ ID NO: 4042389 - DNA, 18 bp, Homo sapiens
ccagtgctcaccagccct

SEQ ID NO: 4042390 - DNA, 20 bp, Homo sapiens
ccagtgctcaccagccctgc

SEQ ID NO: 4042391 - DNA, 20 bp, Homo sapiens
ccagtgctccaggcacccag

SEQ ID NO: 4042392 - DNA, 16 bp, Homo sapiens
ccagtgctctgcctca

SEQ ID NO: 4042393 - DNA, 22 bp, Homo sapiens
ccagtggaacagcgggagacct

SEQ ID NO: 4042394 - DNA, 22 bp, Homo sapiens
ccagtggatcccctgcggtcag

SEQ ID NO: 4042395 - DNA, 19 bp, Homo sapiens
ccagtggatgccacagccc

SEQ ID NO: 4042396 - DNA, 14 bp, Homo sapiens
ccagtgggaccaca

SEQ ID NO: 4042397 - DNA, 17 bp, Homo sapiens
ccagtgggaccacatgc

SEQ ID NO: 4042398 - DNA, 23 bp, Homo sapiens
ccagtgggatgggacagggaggc

SEQ ID NO: 4042399 - DNA, 18 bp, Homo sapiens
ccagtgggcgggccatga

SEQ ID NO: 4042400 - DNA, 13 bp, Homo sapiens
ccagtggggcctg

SEQ ID NO: 4042401 - DNA, 21 bp, Homo sapiens
ccagtggggcctgaggctcct

SEQ ID NO: 4042402 - DNA, 15 bp, Homo sapiens
ccagtggggcctgtg

SEQ ID NO: 4042403 - DNA, 18 bp, Homo sapiens
ccagtggggcctgtggaa

SEQ ID NO: 4042404 - DNA, 15 bp, Homo sapiens
ccagtggtatcctgt

SEQ ID NO: 4042405 - DNA, 19 bp, Homo sapiens
ccagtggtttccagtcatg

SEQ ID NO: 4042406 - DNA, 16 bp, Homo sapiens
ccagtgtcccctccac

SEQ ID NO: 4042407 - DNA, 22 bp, Homo sapiens
ccagtgtcccctccactgtcac

SEQ ID NO: 4042408 - DNA, 23 bp, Homo sapiens
ccagtgtcctccaagtgccccct

SEQ ID NO: 4042409 - DNA, 16 bp, Homo sapiens
ccagtgtccttagaac

SEQ ID NO: 4042410 - DNA, 21 bp, Homo sapiens
ccagtgtctataaaagaaaca

SEQ ID NO: 4042411 - DNA, 22 bp, Homo sapiens
ccagtgtctgggtttttcttgt

SEQ ID NO: 4042412 - DNA, 13 bp, Homo sapiens
ccagtgtgggctt

SEQ ID NO: 4042413 - DNA, 15 bp, Homo sapiens
ccagtgttgtttgta

SEQ ID NO: 4042414 - DNA, 17 bp, Homo sapiens
ccagtgttgtttgtaaa

SEQ ID NO: 4042415 - DNA, 16 bp, Homo sapiens
caggtgggccctctga

SEQ ID NO: 4042416 - DNA, 12 bp, Homo sapiens
caggtggggagt

SEQ ID NO: 4042417 - DNA, 18 bp, Homo sapiens
caggtgggtgctgccctg

SEQ ID NO: 4042418 - DNA, 16 bp, Homo sapiens
caggtgggtgtctgcg

SEQ ID NO: 4042419 - DNA, 15 bp, Homo sapiens
caggtgtcctgagca

SEQ ID NO: 4042420 - DNA, 17 bp, Homo sapiens
caggtgtgcctggaaga

SEQ ID NO: 4042421 - DNA, 21 bp, Homo sapiens
caggtgtgtccacctgggcat

SEQ ID NO: 4042422 - DNA, 20 bp, Homo sapiens
caggtgttctacactcatct

SEQ ID NO: 4042423 - DNA, 14 bp, Homo sapiens
caggtgttgccaaa

SEQ ID NO: 4042424 - DNA, 20 bp, Homo sapiens
caggtgtttggcacccaaat

SEQ ID NO: 4042425 - DNA, 21 bp, Homo sapiens
caggtgttttttatgaagtgc

SEQ ID NO: 4042426 - DNA, 19 bp, Homo sapiens
caggttcaacccacagcta

SEQ ID NO: 4042427 - DNA, 22 bp, Homo sapiens
caggttctattttcttaaacca

SEQ ID NO: 4042428 - DNA, 15 bp, Homo sapiens
caggttctgcctgct

SEQ ID NO: 4042429 - DNA, 15 bp, Homo sapiens
caggttgaagaccta

SEQ ID NO: 4042430 - DNA, 23 bp, Homo sapiens
caggttgaagacctaaccagggc

SEQ ID NO: 4042431 - DNA, 23 bp, Homo sapiens
caggttggaaggggccttgctga

SEQ ID NO: 4042432 - DNA, 21 bp, Homo sapiens
caggttggcaaacgggcttga

SEQ ID NO: 4042433 - DNA, 22 bp, Homo sapiens
caggttgtctgaagtcactgca

SEQ ID NO: 4042434 - DNA, 19 bp, Homo sapiens
cagtaaacaacttgtactt

SEQ ID NO: 4042435 - DNA, 10 bp, Homo sapiens
cagtaaacat

SEQ ID NO: 4042436 - DNA, 16 bp, Homo sapiens
cagtaaacctgtctga

SEQ ID NO: 4042437 - DNA, 12 bp, Homo sapiens
cagtaaatcttt

SEQ ID NO: 4042438 - DNA, 14 bp, Homo sapiens
cagtaatctaggtg

SEQ ID NO: 4042439 - DNA, 21 bp, Homo sapiens
cagtaattggtccgatctttg

SEQ ID NO: 4042440 - DNA, 14 bp, Homo sapiens
cagtaccctctcag

SEQ ID NO: 4042441 - DNA, 20 bp, Homo sapiens
cagtaccctctcagctccag

SEQ ID NO: 4042442 - DNA, 22 bp, Homo sapiens
cagtaccctctcagctccaggt

SEQ ID NO: 4042443 - DNA, 13 bp, Homo sapiens
cagtacctccaag

SEQ ID NO: 4042444 - DNA, 12 bp, Homo sapiens
cagtgcccccac

SEQ ID NO: 4042445 - DNA, 17 bp, Homo sapiens
cagtgcccccactgacc

SEQ ID NO: 4042446 - DNA, 22 bp, Homo sapiens
cagtgccccgtctacagctccc

SEQ ID NO: 4042447 - DNA, 16 bp, Homo sapiens
cagtgccttccataat

SEQ ID NO: 4042448 - DNA, 23 bp, Homo sapiens
cagtgccttccataattatgaca

SEQ ID NO: 4042449 - DNA, 11 bp, Homo sapiens
cagtgccttgc

SEQ ID NO: 4042450 - DNA, 17 bp, Homo sapiens
cagtgcggttcctcatc

SEQ ID NO: 4042451 - DNA, 18 bp, Homo sapiens
cagtgcggttcctcatct

SEQ ID NO: 4042452 - DNA, 14 bp, Homo sapiens
cagtgctagaaaat

SEQ ID NO: 4042453 - DNA, 18 bp, Homo sapiens
cagtgctcaccagccctg

SEQ ID NO: 4042454 - DNA, 14 bp, Homo sapiens
cagtgctctgcctc

SEQ ID NO: 4042455 - DNA, 15 bp, Homo sapiens
cagtgctctgcctca

SEQ ID NO: 4042456 - DNA, 18 bp, Homo sapiens
cagtgctctgcctcagac

SEQ ID NO: 4042457 - DNA, 16 bp, Homo sapiens
cagtgctgatctaaaa

SEQ ID NO: 4042458 - DNA, 18 bp, Homo sapiens
cagtgctgggaccagagc

SEQ ID NO: 4042459 - DNA, 16 bp, Homo sapiens
cagtgctttaatggca

SEQ ID NO: 4042460 - DNA, 19 bp, Homo sapiens
cagtggaacagcgggagac

SEQ ID NO: 4042461 - DNA, 23 bp, Homo sapiens
cagtggaatataaggaaagcaat

SEQ ID NO: 4042462 - DNA, 16 bp, Homo sapiens
cagtggattgcatttc

SEQ ID NO: 4042463 - DNA, 12 bp, Homo sapiens
cagtggctgggt

SEQ ID NO: 4042464 - DNA, 14 bp, Homo sapiens
cagtggctgggtgg

SEQ ID NO: 4042465 - DNA, 18 bp, Homo sapiens
cagtggctggtccagggc

SEQ ID NO: 4042466 - DNA, 21 bp, Homo sapiens
cagtggcttcatctgtcaagt

SEQ ID NO: 4042467 - DNA, 13 bp, Homo sapiens
cagtgggacagag

SEQ ID NO: 4042468 - DNA, 19 bp, Homo sapiens
cagtgggaccacatgccac

SEQ ID NO: 4042469 - DNA, 13 bp, Homo sapiens
cagtgggatggga

SEQ ID NO: 4042470 - DNA, 18 bp, Homo sapiens
cagtgggcgggccatgag

SEQ ID NO: 4042471 - DNA, 18 bp, Homo sapiens
cagtgggcgttgggagcc

SEQ ID NO: 4042472 - DNA, 16 bp, Homo sapiens
cagtggggaactgagg

SEQ ID NO: 4042473 - DNA, 22 bp, Homo sapiens
cagtggggaactgagggcaagg

SEQ ID NO: 4042474 - DNA, 20 bp, Homo sapiens
cagtggggcctgaggctcct

SEQ ID NO: 4042475 - DNA, 21 bp, Homo sapiens
cagtggggcctgaggctcctt

SEQ ID NO: 4042476 - DNA, 15 bp, Homo sapiens
cagtggtaagctctg

SEQ ID NO: 4042477 - DNA, 17 bp, Homo sapiens
cagtggtaagctctggc

SEQ ID NO: 4042478 - DNA, 19 bp, Homo sapiens
cagtgtaatccaggggtgt

SEQ ID NO: 4042479 - DNA, 15 bp, Homo sapiens
cagtgtatcaggtca

SEQ ID NO: 4042480 - DNA, 19 bp, Homo sapiens
cagtgtcacctctctcaga

SEQ ID NO: 4042481 - DNA, 22 bp, Homo sapiens
cagtgtcacctctctcagagca

SEQ ID NO: 4042482 - DNA, 23 bp, Homo sapiens
cagtgtcacctctctcagagcat

SEQ ID NO: 4042483 - DNA, 13 bp, Homo sapiens
cagtgtcccaggc

SEQ ID NO: 4042484 - DNA, 15 bp, Homo sapiens
cagtgtcccaggcag

SEQ ID NO: 4042485 - DNA, 15 bp, Homo sapiens
cagtgtcccctccac

SEQ ID NO: 4042486 - DNA, 16 bp, Homo sapiens
cagtgtcccctccact

SEQ ID NO: 4042487 - DNA, 18 bp, Homo sapiens
cagtgtcctccaagtgcc

SEQ ID NO: 4042488 - DNA, 16 bp, Homo sapiens
cagtgtccttagaaca

SEQ ID NO: 4042489 - DNA, 13 bp, Homo sapiens
cagtgtcctttcc

SEQ ID NO: 4042490 - DNA, 24 bp, Homo sapiens
cagtgtctgtatcggagacagtga

SEQ ID NO: 4042491 - DNA, 17 bp, Homo sapiens
cagtgtctgtgccatgg

SEQ ID NO: 4042492 - DNA, 14 bp, Homo sapiens
cagtgtcttccata

SEQ ID NO: 4042493 - DNA, 15 bp, Homo sapiens
cagtgtcttccataa

SEQ ID NO: 4042494 - DNA, 16 bp, Homo sapiens
cagtgtcttccataat

SEQ ID NO: 4042495 - DNA, 17 bp, Homo sapiens
cagtgtcttccataatg

SEQ ID NO: 4042496 - DNA, 18 bp, Homo sapiens
cagtgtggtttgggaaag

SEQ ID NO: 4042497 - DNA, 14 bp, Homo sapiens
cagtgttagagaaa

SEQ ID NO: 4042498 - DNA, 15 bp, Homo sapiens
cagtgttagagaaat

SEQ ID NO: 4042499 - DNA, 14 bp, Homo sapiens
cagtgttattttct

SEQ ID NO: 4042500 - DNA, 19 bp, Homo sapiens
cagtgttccccatctgggt

SEQ ID NO: 4042501 - DNA, 21 bp, Homo sapiens
cagtgttccccatctgggtcc

SEQ ID NO: 4042502 - DNA, 16 bp, Homo sapiens
cagtgttgctcagctc

SEQ ID NO: 4042503 - DNA, 18 bp, Homo sapiens
cagtgttgtttgtaaata

SEQ ID NO: 4042504 - DNA, 23 bp, Homo sapiens
cagtgttgtttgtaaataagaga

SEQ ID NO: 4042505 - DNA, 18 bp, Homo sapiens
cagtgtttcccataattt

SEQ ID NO: 4042506 - DNA, 21 bp, Homo sapiens
cagtgtttcccataattttct

SEQ ID NO: 4042507 - DNA, 17 bp, Homo sapiens
cagtgtttgggaaatta

SEQ ID NO: 4042508 - DNA, 20 bp, Homo sapiens
cagtgttttaaactctccta

SEQ ID NO: 4042509 - DNA, 15 bp, Homo sapiens
cagtgttttctggga

SEQ ID NO: 4042510 - DNA, 23 bp, Homo sapiens
cagttaacacaatgtgaatttct

SEQ ID NO: 4042511 - DNA, 20 bp, Homo sapiens
cagttaactttcagaagaga

SEQ ID NO: 4042512 - DNA, 11 bp, Homo sapiens
cagttacaaag

SEQ ID NO: 4042513 - DNA, 19 bp, Homo sapiens
cagttagggttttgcaata

SEQ ID NO: 4042514 - DNA, 20 bp, Homo sapiens
cagttagggttttgcaataa

SEQ ID NO: 4042515 - DNA, 22 bp, Homo sapiens
cagttagggttttgcaataact

SEQ ID NO: 4042516 - DNA, 20 bp, Homo sapiens
cagttatgtgaatgatctct

SEQ ID NO: 4042517 - DNA, 14 bp, Homo sapiens
cagttattttgata

SEQ ID NO: 4042518 - DNA, 14 bp, Homo sapiens
cagttattttggat

SEQ ID NO: 4042519 - DNA, 14 bp, Homo sapiens
cagcatccctggag

SEQ ID NO: 4042520 - DNA, 22 bp, Homo sapiens
cagcatccctggagcaggagcc

SEQ ID NO: 4042521 - DNA, 15 bp, Homo sapiens
cagcatcccttccca

SEQ ID NO: 4042522 - DNA, 17 bp, Homo sapiens
cagcatccgcaggtgct

SEQ ID NO: 4042523 - DNA, 23 bp, Homo sapiens
cagcatccgcaggtgctggtccc

SEQ ID NO: 4042524 - DNA, 19 bp, Homo sapiens
cagcatcgggagcacccag

SEQ ID NO: 4042525 - DNA, 21 bp, Homo sapiens
cagcatctggctgtctagaat

SEQ ID NO: 4042526 - DNA, 16 bp, Homo sapiens
cagcatgagactttct

SEQ ID NO: 4042527 - DNA, 21 bp, Homo sapiens
cagcatgagactttctgctgg

SEQ ID NO: 4042528 - DNA, 13 bp, Homo sapiens
cagcatggaaaaa

SEQ ID NO: 4042529 - DNA, 18 bp, Homo sapiens
cagcatggtccctgcctt

SEQ ID NO: 4042530 - DNA, 20 bp, Homo sapiens
cagcatggtccctgccttag

SEQ ID NO: 4042531 - DNA, 23 bp, Homo sapiens
cagcatggtccctgccttaggcc

SEQ ID NO: 4042532 - DNA, 22 bp, Homo sapiens
cagcatgtacggattttcagtt

SEQ ID NO: 4042533 - DNA, 15 bp, Homo sapiens
cagcattctggaggg

SEQ ID NO: 4042534 - DNA, 22 bp, Homo sapiens
cagcattcttgtcacaataaat

SEQ ID NO: 4042535 - DNA, 12 bp, Homo sapiens
cagcattgcttt

SEQ ID NO: 4042536 - DNA, 14 bp, Homo sapiens
cagcattgctttct

SEQ ID NO: 4042537 - DNA, 15 bp, Homo sapiens
cagcatttccttcca

SEQ ID NO: 4042538 - DNA, 21 bp, Homo sapiens
cagcatttccttccagcccat

SEQ ID NO: 4042539 - DNA, 16 bp, Homo sapiens
cagcatttcttttctg

SEQ ID NO: 4042540 - DNA, 20 bp, Homo sapiens
cagcattttcatatccaaga

SEQ ID NO: 4042541 - DNA, 14 bp, Homo sapiens
cagcatttttaatt

SEQ ID NO: 4042542 - DNA, 21 bp, Homo sapiens
cagcatttttaattttcacaa

SEQ ID NO: 4042543 - DNA, 22 bp, Homo sapiens
cagcatttttaattttcacaaa

SEQ ID NO: 4042544 - DNA, 16 bp, Homo sapiens
cagccaaacccatgag

SEQ ID NO: 4042545 - DNA, 19 bp, Homo sapiens
cagccaaacccatgaggca

SEQ ID NO: 4042546 - DNA, 17 bp, Homo sapiens
cagccaaaccctgtctg

SEQ ID NO: 4042547 - DNA, 18 bp, Homo sapiens
cagccaactagcccctgg

SEQ ID NO: 4042548 - DNA, 22 bp, Homo sapiens
cagccaactagcccctggggtg

SEQ ID NO: 4042549 - DNA, 16 bp, Homo sapiens
cagccaagattttcct

SEQ ID NO: 4042550 - DNA, 22 bp, Homo sapiens
cagccaagattttcctcttgtg

SEQ ID NO: 4042551 - DNA, 13 bp, Homo sapiens
cagccaagcttgt

SEQ ID NO: 4042552 - DNA, 13 bp, Homo sapiens
cagccacatcccc

SEQ ID NO: 4042553 - DNA, 14 bp, Homo sapiens
cagccacatcccca

SEQ ID NO: 4042554 - DNA, 19 bp, Homo sapiens
cagccacatccccaagccc

SEQ ID NO: 4042555 - DNA, 13 bp, Homo sapiens
cagccacatggcc

SEQ ID NO: 4042556 - DNA, 14 bp, Homo sapiens
cagccacatggccc

SEQ ID NO: 4042557 - DNA, 17 bp, Homo sapiens
cagccacgattggagaa

SEQ ID NO: 4042558 - DNA, 14 bp, Homo sapiens
cagccactcgggag

SEQ ID NO: 4042559 - DNA, 22 bp, Homo sapiens
cagccacttcggccaggtcaca

SEQ ID NO: 4042560 - DNA, 14 bp, Homo sapiens
cagccagagctggg

SEQ ID NO: 4042561 - DNA, 17 bp, Homo sapiens
cagccagagctgggtgg

SEQ ID NO: 4042562 - DNA, 18 bp, Homo sapiens
cagccagaggagggcaga

SEQ ID NO: 4042563 - DNA, 23 bp, Homo sapiens
cagccagcaatgatgtccagaag

SEQ ID NO: 4042564 - DNA, 19 bp, Homo sapiens
cagccagccgccctgggct

SEQ ID NO: 4042565 - DNA, 14 bp, Homo sapiens
cagccaggagcaga

SEQ ID NO: 4042566 - DNA, 22 bp, Homo sapiens
cagccaggagcagatggacagc

SEQ ID NO: 4042567 - DNA, 18 bp, Homo sapiens
cagccaggagctgtcacc

SEQ ID NO: 4042568 - DNA, 16 bp, Homo sapiens
cagccaggccaacagc

SEQ ID NO: 4042569 - DNA, 13 bp, Homo sapiens
cagccaggctgcc

SEQ ID NO: 4042570 - DNA, 16 bp, Homo sapiens
cagccaggctgccaag

SEQ ID NO: 4042571 - DNA, 22 bp, Homo sapiens
cagccaggctgccaaggccaga

SEQ ID NO: 4042572 - DNA, 23 bp, Homo sapiens
cagccaggctgctaacctggaaa

SEQ ID NO: 4042573 - DNA, 21 bp, Homo sapiens
cagccataggccctttcagtg

SEQ ID NO: 4042574 - DNA, 23 bp, Homo sapiens
cagccatctcatgaggggagagg

SEQ ID NO: 4042575 - DNA, 21 bp, Homo sapiens
cagccatgcccgcattagctc

SEQ ID NO: 4042576 - DNA, 16 bp, Homo sapiens
cagccatgtccaagtt

SEQ ID NO: 4042577 - DNA, 17 bp, Homo sapiens
cagccattgcggcccca

SEQ ID NO: 4042578 - DNA, 18 bp, Homo sapiens
cagccattgcggccccag

SEQ ID NO: 4042579 - DNA, 19 bp, Homo sapiens
cagccattgcggccccagg

SEQ ID NO: 4042580 - DNA, 19 bp, Homo sapiens
cagcccaccctgctcctcc

SEQ ID NO: 4042581 - DNA, 14 bp, Homo sapiens
cagcccactgagaa

SEQ ID NO: 4042582 - DNA, 18 bp, Homo sapiens
cagcccactgcaccgcct

SEQ ID NO: 4042583 - DNA, 13 bp, Homo sapiens
cagcccagaacac

SEQ ID NO: 4042584 - DNA, 21 bp, Homo sapiens
cagcccagagacatacttgaa

SEQ ID NO: 4042585 - DNA, 12 bp, Homo sapiens
cagcccagagcc

SEQ ID NO: 4042586 - DNA, 23 bp, Homo sapiens
cagcccagcagtgtggagaccct

SEQ ID NO: 4042587 - DNA, 12 bp, Homo sapiens
cagcccatccat

SEQ ID NO: 4042588 - DNA, 18 bp, Homo sapiens
cagcccatccattaggcc

SEQ ID NO: 4042589 - DNA, 21 bp, Homo sapiens
cagcccatccattaggccagc

SEQ ID NO: 4042590 - DNA, 17 bp, Homo sapiens
cagcccatgcccacctg

SEQ ID NO: 4042591 - DNA, 21 bp, Homo sapiens
cagcccatgcccacctgccca

SEQ ID NO: 4042592 - DNA, 24 bp, Homo sapiens
cagcccatgcccacctgcccatca

SEQ ID NO: 4042593 - DNA, 14 bp, Homo sapiens
cagccccacacagc

SEQ ID NO: 4042594 - DNA, 16 bp, Homo sapiens
cagccccacacagcta

SEQ ID NO: 4042595 - DNA, 11 bp, Homo sapiens
cagccccaccc

SEQ ID NO: 4042596 - DNA, 13 bp, Homo sapiens
cagccccacccag

SEQ ID NO: 4042597 - DNA, 14 bp, Homo sapiens
cagccccagagaga

SEQ ID NO: 4042598 - DNA, 17 bp, Homo sapiens
cagccccatcagaacct

SEQ ID NO: 4042599 - DNA, 21 bp, Homo sapiens
cagccccatcagaacctgagc

SEQ ID NO: 4042600 - DNA, 23 bp, Homo sapiens
cagccccatcagaacctgagcta

SEQ ID NO: 4042601 - DNA, 13 bp, Homo sapiens
cagccccatccct

SEQ ID NO: 4042602 - DNA, 17 bp, Homo sapiens
cagcccccagcccctcc

SEQ ID NO: 4042603 - DNA, 14 bp, Homo sapiens
cagccccccagcac

SEQ ID NO: 4042604 - DNA, 16 bp, Homo sapiens
cagccccccagcacta

SEQ ID NO: 4042605 - DNA, 12 bp, Homo sapiens
cagccccctcca

SEQ ID NO: 4042606 - DNA, 15 bp, Homo sapiens
cagccccctccacac

SEQ ID NO: 4042607 - DNA, 16 bp, Homo sapiens
cagccccggccctggg

SEQ ID NO: 4042608 - DNA, 19 bp, Homo sapiens
cagccccggtggctgggca

SEQ ID NO: 4042609 - DNA, 20 bp, Homo sapiens
cagccccggtggctgggcag

SEQ ID NO: 4042610 - DNA, 16 bp, Homo sapiens
cagccccgtctgccca

SEQ ID NO: 4042611 - DNA, 14 bp, Homo sapiens
cagcccctactgct

SEQ ID NO: 4042612 - DNA, 16 bp, Homo sapiens
cagcccctactgctgt

SEQ ID NO: 4042613 - DNA, 20 bp, Homo sapiens
cagcccctatagcactgagc

SEQ ID NO: 4042614 - DNA, 21 bp, Homo sapiens
cagcccctatagcactgagct

SEQ ID NO: 4042615 - DNA, 22 bp, Homo sapiens
cagcccctcccccatctcccac

SEQ ID NO: 4042616 - DNA, 13 bp, Homo sapiens
cagcccctggggc

SEQ ID NO: 4042617 - DNA, 20 bp, Homo sapiens
cagcccctggggcccagccc

SEQ ID NO: 4042618 - DNA, 13 bp, Homo sapiens
cagcccctgtccc

SEQ ID NO: 4042619 - DNA, 13 bp, Homo sapiens
cagccccttctcc

SEQ ID NO: 4042620 - DNA, 16 bp, Homo sapiens
cagccccttctcccag

SEQ ID NO: 4042621 - DNA, 17 bp, Homo sapiens
cagccccttctcccagc

SEQ ID NO: 4042622 - DNA, 16 bp, Homo sapiens
cagttattttggatat

SEQ ID NO: 4042623 - DNA, 22 bp, Homo sapiens
cagttcaacctggtggcaccag

SEQ ID NO: 4042624 - DNA, 13 bp, Homo sapiens
cagttcagcacca

SEQ ID NO: 4042625 - DNA, 16 bp, Homo sapiens
cagttcagcaccaccc

SEQ ID NO: 4042626 - DNA, 20 bp, Homo sapiens
cagttcaggagtcccaagga

SEQ ID NO: 4042627 - DNA, 18 bp, Homo sapiens
cagttcatgtttgcttca

SEQ ID NO: 4042628 - DNA, 15 bp, Homo sapiens
cagttcattgcactt

SEQ ID NO: 4042629 - DNA, 18 bp, Homo sapiens
cagttcccttggcctcag

SEQ ID NO: 4042630 - DNA, 15 bp, Homo sapiens
cagttcctttagaaa

SEQ ID NO: 4042631 - DNA, 15 bp, Homo sapiens
cagttcctttgtgtg

SEQ ID NO: 4042632 - DNA, 14 bp, Homo sapiens
cagttctcactcct

SEQ ID NO: 4042633 - DNA, 23 bp, Homo sapiens
cagttctctcccttcctctctcc

SEQ ID NO: 4042634 - DNA, 21 bp, Homo sapiens
cagttctttaagaagatcttt

SEQ ID NO: 4042635 - DNA, 16 bp, Homo sapiens
cagttctttgggccag

SEQ ID NO: 4042636 - DNA, 18 bp, Homo sapiens
cagttctttgggccagac

SEQ ID NO: 4042637 - DNA, 22 bp, Homo sapiens
cagttctttgggccagacatgc

SEQ ID NO: 4042638 - DNA, 19 bp, Homo sapiens
cagttgactttaagtgaaa

SEQ ID NO: 4042639 - DNA, 22 bp, Homo sapiens
cagttgccaccacctctgtggc

SEQ ID NO: 4042640 - DNA, 14 bp, Homo sapiens
cagttgcccagcct

SEQ ID NO: 4042641 - DNA, 17 bp, Homo sapiens
cagttgcccagcctctt

SEQ ID NO: 4042642 - DNA, 20 bp, Homo sapiens
cagttgctctgacgtagaaa

SEQ ID NO: 4042643 - DNA, 18 bp, Homo sapiens
cagttggactctcaggga

SEQ ID NO: 4042644 - DNA, 22 bp, Homo sapiens
cagttggagtttgtgtctgttg

SEQ ID NO: 4042645 - DNA, 17 bp, Homo sapiens
catcagaacctgagcta

SEQ ID NO: 4042646 - DNA, 23 bp, Homo sapiens
catcagacctgtcttccaaggag

SEQ ID NO: 4042647 - DNA, 11 bp, Homo sapiens
catcagcaaac

SEQ ID NO: 4042648 - DNA, 18 bp, Homo sapiens
catcagggatctcagagg

SEQ ID NO: 4042649 - DNA, 12 bp, Homo sapiens
catcagggcctg

SEQ ID NO: 4042650 - DNA, 13 bp, Homo sapiens
catcagggcctgg

SEQ ID NO: 4042651 - DNA, 18 bp, Homo sapiens
catcagtccccctgtgca

SEQ ID NO: 4042652 - DNA, 15 bp, Homo sapiens
catcagttattcatt

SEQ ID NO: 4042653 - DNA, 15 bp, Homo sapiens
catcagttcccccag

SEQ ID NO: 4042654 - DNA, 22 bp, Homo sapiens
catcataaaataaagtatatat

SEQ ID NO: 4042655 - DNA, 23 bp, Homo sapiens
catcataaaataaagtatatata

SEQ ID NO: 4042656 - DNA, 14 bp, Homo sapiens
catcatatgcctga

SEQ ID NO: 4042657 - DNA, 16 bp, Homo sapiens
catcatcagggcctgg

SEQ ID NO: 4042658 - DNA, 11 bp, Homo sapiens
catcatccctt

SEQ ID NO: 4042659 - DNA, 21 bp, Homo sapiens
catcatgcttacaaaaaagaa

SEQ ID NO: 4042660 - DNA, 19 bp, Homo sapiens
catcatggtggatatggtg

SEQ ID NO: 4042661 - DNA, 10 bp, Homo sapiens
catcatgtca

SEQ ID NO: 4042662 - DNA, 22 bp, Homo sapiens
catcatgtggccccacccaatc

SEQ ID NO: 4042663 - DNA, 22 bp, Homo sapiens
catcattacccttccctgcact

SEQ ID NO: 4042664 - DNA, 18 bp, Homo sapiens
cattaactaatctattgg

SEQ ID NO: 4042665 - DNA, 17 bp, Homo sapiens
cattaaggccacatcca

SEQ ID NO: 4042666 - DNA, 13 bp, Homo sapiens
cattaataaagac

SEQ ID NO: 4042667 - DNA, 15 bp, Homo sapiens
cattaatagcagcct

SEQ ID NO: 4042668 - DNA, 23 bp, Homo sapiens
cattaatgttaattcagcactga

SEQ ID NO: 4042669 - DNA, 19 bp, Homo sapiens
cattacatgtgtttattca

SEQ ID NO: 4042670 - DNA, 14 bp, Homo sapiens
cattaccactcagg

SEQ ID NO: 4042671 - DNA, 15 bp, Homo sapiens
cattaccactcaggc

SEQ ID NO: 4042672 - DNA, 23 bp, Homo sapiens
cattacccacccgacctggctgc

SEQ ID NO: 4042673 - DNA, 15 bp, Homo sapiens
cattacctccatcca

SEQ ID NO: 4042674 - DNA, 17 bp, Homo sapiens
cattacctccatccatc

SEQ ID NO: 4042675 - DNA, 18 bp, Homo sapiens
catttgtaaatgctgtgt

SEQ ID NO: 4042676 - DNA, 16 bp, Homo sapiens
catttgtaataaagta

SEQ ID NO: 4042677 - DNA, 18 bp, Homo sapiens
catttgtaataaagtata

SEQ ID NO: 4042678 - DNA, 15 bp, Homo sapiens
catttgtctttttat

SEQ ID NO: 4042679 - DNA, 18 bp, Homo sapiens
catttgtggcagtccctt

SEQ ID NO: 4042680 - DNA, 23 bp, Homo sapiens
catttgtggcagtcccttataat

SEQ ID NO: 4042681 - DNA, 13 bp, Homo sapiens
catttgttaaaat

SEQ ID NO: 4042682 - DNA, 15 bp, Homo sapiens
catttgttaaaatta

SEQ ID NO: 4042683 - DNA, 18 bp, Homo sapiens
catttgttaaaattatca

SEQ ID NO: 4042684 - DNA, 22 bp, Homo sapiens
catttgttaaaattatcaatat

SEQ ID NO: 4042685 - DNA, 20 bp, Homo sapiens
catttgttcagctcccccag

SEQ ID NO: 4042686 - DNA, 12 bp, Homo sapiens
catttgttcctg

SEQ ID NO: 4042687 - DNA, 13 bp, Homo sapiens
catttgttcctgc

SEQ ID NO: 4042688 - DNA, 14 bp, Homo sapiens
catttgttctcaca

SEQ ID NO: 4042689 - DNA, 20 bp, Homo sapiens
catttgttgtgatgtctttt

SEQ ID NO: 4042690 - DNA, 12 bp, Homo sapiens
catttgtttgct

SEQ ID NO: 4042691 - DNA, 20 bp, Homo sapiens
cattttaaaaaaaaaggcat

SEQ ID NO: 4042692 - DNA, 14 bp, Homo sapiens
cattttaattcatc

SEQ ID NO: 4042693 - DNA, 17 bp, Homo sapiens
cattttcaactgctttg

SEQ ID NO: 4042694 - DNA, 16 bp, Homo sapiens
cattttcaccccaccc

SEQ ID NO: 4042695 - DNA, 17 bp, Homo sapiens
cattttccatatcctgg

SEQ ID NO: 4042696 - DNA, 19 bp, Homo sapiens
cattttccatatcctggtg

SEQ ID NO: 4042697 - DNA, 23 bp, Homo sapiens
cattttcccatcatcctttgttc

SEQ ID NO: 4042698 - DNA, 13 bp, Homo sapiens
cattttcctcctc

SEQ ID NO: 4042699 - DNA, 16 bp, Homo sapiens
cattttcctcctctgc

SEQ ID NO: 4042700 - DNA, 19 bp, Homo sapiens
cattttcctcctctgccta

SEQ ID NO: 4042701 - DNA, 11 bp, Homo sapiens
cattttcctgt

SEQ ID NO: 4042702 - DNA, 21 bp, Homo sapiens
cattttctgacatgcattgtt

SEQ ID NO: 4042703 - DNA, 22 bp, Homo sapiens
cattttctgacatgcattgttg

SEQ ID NO: 4042704 - DNA, 23 bp, Homo sapiens
cattttcttattgcgctgctacc

SEQ ID NO: 4042705 - DNA, 14 bp, Homo sapiens
cattttgacctact

SEQ ID NO: 4042706 - DNA, 15 bp, Homo sapiens
cattttgcaaaattt

SEQ ID NO: 4042707 - DNA, 17 bp, Homo sapiens
cattttgcaaaatttcc

SEQ ID NO: 4042708 - DNA, 20 bp, Homo sapiens
cattttgcagcagtgagtct

SEQ ID NO: 4042709 - DNA, 15 bp, Homo sapiens
cattttgcattcaaa

SEQ ID NO: 4042710 - DNA, 15 bp, Homo sapiens
cattttgctattgta

SEQ ID NO: 4042711 - DNA, 18 bp, Homo sapiens
cattttggaagttttcag

SEQ ID NO: 4042712 - DNA, 22 bp, Homo sapiens
cattttggtgtctttctctttt

SEQ ID NO: 4042713 - DNA, 19 bp, Homo sapiens
cattttggtttatttttgt

SEQ ID NO: 4042714 - DNA, 13 bp, Homo sapiens
cattttgtgaatg

SEQ ID NO: 4042715 - DNA, 22 bp, Homo sapiens
cattttgtggtcattaagcatt

SEQ ID NO: 4042716 - DNA, 16 bp, Homo sapiens
catttttaaattgtta

SEQ ID NO: 4042717 - DNA, 17 bp, Homo sapiens
catttttacaataaata

SEQ ID NO: 4042718 - DNA, 17 bp, Homo sapiens
catttttatttatgaag

SEQ ID NO: 4042719 - DNA, 14 bp, Homo sapiens
catttttcaatata

SEQ ID NO: 4042720 - DNA, 15 bp, Homo sapiens
catttttcaatatat

SEQ ID NO: 4042721 - DNA, 14 bp, Homo sapiens
cattttttcttctg

SEQ ID NO: 4042722 - DNA, 15 bp, Homo sapiens
catttttttattcag

SEQ ID NO: 4042723 - DNA, 14 bp, Homo sapiens
ccaaaaaaaaaaga

SEQ ID NO: 4042724 - DNA, 17 bp, Homo sapiens
ccaaaaaaaggaaaaat

SEQ ID NO: 4042725 - DNA, 22 bp, Homo sapiens
ccaaaaaaaggaaaaataatca

SEQ ID NO: 4042726 - DNA, 18 bp, Homo sapiens
ccaaaacaaacaaacaga

SEQ ID NO: 4042727 - DNA, 15 bp, Homo sapiens
ccaaaaccaggcctc

SEQ ID NO: 4042728 - DNA, 22 bp, Homo sapiens
ccaaaagaagcccccagctaag

SEQ ID NO: 4042729 - DNA, 22 bp, Homo sapiens
ccaaaagcgccctcactattct

SEQ ID NO: 4042730 - DNA, 17 bp, Homo sapiens
ccaaaagtccctccctg

SEQ ID NO: 4042731 - DNA, 22 bp, Homo sapiens
ccaaaagtccctccctgcctga

SEQ ID NO: 4042732 - DNA, 11 bp, Homo sapiens
ccaaaatgtga

SEQ ID NO: 4042733 - DNA, 16 bp, Homo sapiens
ccaaacaaatatgcaa

SEQ ID NO: 4042734 - DNA, 19 bp, Homo sapiens
ccaaacaccttccagctcc

SEQ ID NO: 4042735 - DNA, 15 bp, Homo sapiens
ccaaacactgaggca

SEQ ID NO: 4042736 - DNA, 20 bp, Homo sapiens
ccaaacactgaggcagcctt

SEQ ID NO: 4042737 - DNA, 15 bp, Homo sapiens
ccaaacatagcccct

SEQ ID NO: 4042738 - DNA, 20 bp, Homo sapiens
ccaaacatagcccctgcccc

SEQ ID NO: 4042739 - DNA, 13 bp, Homo sapiens
ccaaacatcagac

SEQ ID NO: 4042740 - DNA, 20 bp, Homo sapiens
ccaaacatcagacctgtctt

SEQ ID NO: 4042741 - DNA, 14 bp, Homo sapiens
ccaaaccctgtctg

SEQ ID NO: 4042742 - DNA, 13 bp, Homo sapiens
ccaaacctccagc

SEQ ID NO: 4042743 - DNA, 18 bp, Homo sapiens
ccaaacctccagcctccc

SEQ ID NO: 4042744 - DNA, 13 bp, Homo sapiens
ccaaactgtccct

SEQ ID NO: 4042745 - DNA, 20 bp, Homo sapiens
ccaaactgtccctcccttgc

SEQ ID NO: 4042746 - DNA, 17 bp, Homo sapiens
ccaaagagcctggagaa

SEQ ID NO: 4042747 - DNA, 20 bp, Homo sapiens
ccaaagagcctggagaagct

SEQ ID NO: 4042748 - DNA, 13 bp, Homo sapiens
ccaaagaggctgc

SEQ ID NO: 4042749 - DNA, 16 bp, Homo sapiens
ccaaagaggctgcccc

SEQ ID NO: 4042750 - DNA, 22 bp, Homo sapiens
ccaaagaggctgcccctctcac

SEQ ID NO: 4042751 - DNA, 23 bp, Homo sapiens
ccaaagaggctgcccctctcacc

SEQ ID NO: 4042752 - DNA, 16 bp, Homo sapiens
ccaaagagggcttcct

SEQ ID NO: 4042753 - DNA, 17 bp, Homo sapiens
ccaaagagggcttcctc

SEQ ID NO: 4042754 - DNA, 19 bp, Homo sapiens
ccaaagcagtggagcccag

SEQ ID NO: 4042755 - DNA, 14 bp, Homo sapiens
ccaaagccagtgaa

SEQ ID NO: 4042756 - DNA, 19 bp, Homo sapiens
ccaaagccagtgaaatgtg

SEQ ID NO: 4042757 - DNA, 20 bp, Homo sapiens
ccaaagccagtgaaatgtga

SEQ ID NO: 4042758 - DNA, 12 bp, Homo sapiens
ccaaagctttat

SEQ ID NO: 4042759 - DNA, 14 bp, Homo sapiens
ccaaagctttcctg

SEQ ID NO: 4042760 - DNA, 15 bp, Homo sapiens
ccaaaggacgcctgc

SEQ ID NO: 4042761 - DNA, 15 bp, Homo sapiens
ccaaagttgttgtaa

SEQ ID NO: 4042762 - DNA, 23 bp, Homo sapiens
ccaaagttgttgtaacctgctgt

SEQ ID NO: 4042763 - DNA, 15 bp, Homo sapiens
ccaaatataagacat

SEQ ID NO: 4042764 - DNA, 19 bp, Homo sapiens
ccaaatatgtattttccta

SEQ ID NO: 4042765 - DNA, 18 bp, Homo sapiens
ccaaatcacatctcacct

SEQ ID NO: 4042766 - DNA, 22 bp, Homo sapiens
ccaaatctcaatgaagccagct

SEQ ID NO: 4042767 - DNA, 19 bp, Homo sapiens
ccaaatctctcaaatctgt

SEQ ID NO: 4042768 - DNA, 18 bp, Homo sapiens
ccaaatctgacatattat

SEQ ID NO: 4042769 - DNA, 22 bp, Homo sapiens
ccaaatctgacatattatgcct

SEQ ID NO: 4042770 - DNA, 17 bp, Homo sapiens
ccaaatgcatggtgcag

SEQ ID NO: 4042771 - DNA, 14 bp, Homo sapiens
ccaagtcacacagc

SEQ ID NO: 4042772 - DNA, 15 bp, Homo sapiens
ccaagtcacacagct

SEQ ID NO: 4042773 - DNA, 14 bp, Homo sapiens
ccaagtcacaccca

SEQ ID NO: 4042774 - DNA, 22 bp, Homo sapiens
ccaagtcctggctacatcccag

SEQ ID NO: 4042775 - DNA, 14 bp, Homo sapiens
ccaagtctctctgt

SEQ ID NO: 4042776 - DNA, 16 bp, Homo sapiens
ccaagtgcactttcta

SEQ ID NO: 4042777 - DNA, 17 bp, Homo sapiens
ccaagtgccccctcacc

SEQ ID NO: 4042778 - DNA, 18 bp, Homo sapiens
ccaagtgccccctcacct

SEQ ID NO: 4042779 - DNA, 24 bp, Homo sapiens
ccaagtgccccctcacctctccag

SEQ ID NO: 4042780 - DNA, 18 bp, Homo sapiens
ccaagtggagcctgacag

SEQ ID NO: 4042781 - DNA, 22 bp, Homo sapiens
ccaagtggggtgctgggaggag

SEQ ID NO: 4042782 - DNA, 18 bp, Homo sapiens
ccaagtggtcaggagttg

SEQ ID NO: 4042783 - DNA, 20 bp, Homo sapiens
ccaagttataaatcaatgtc

SEQ ID NO: 4042784 - DNA, 17 bp, Homo sapiens
ccaagttcttcacctct

SEQ ID NO: 4042785 - DNA, 19 bp, Homo sapiens
ccaagttcttcacctctat

SEQ ID NO: 4042786 - DNA, 20 bp, Homo sapiens
ccaagttcttcacctctatc

SEQ ID NO: 4042787 - DNA, 17 bp, Homo sapiens
ccaagtttccatagcaa

SEQ ID NO: 4042788 - DNA, 9 bp, Homo sapiens
ccaataaaa

SEQ ID NO: 4042789 - DNA, 21 bp, Homo sapiens
ccaataaaaagttcagagttc

SEQ ID NO: 4042790 - DNA, 11 bp, Homo sapiens
ccaataaaagt

SEQ ID NO: 4042791 - DNA, 13 bp, Homo sapiens
ccaatcagctcct

SEQ ID NO: 4042792 - DNA, 15 bp, Homo sapiens
ccaatcccagggctg

SEQ ID NO: 4042793 - DNA, 16 bp, Homo sapiens
ccaatcccagggctgg

SEQ ID NO: 4042794 - DNA, 20 bp, Homo sapiens
ccaatcccagggctggctct

SEQ ID NO: 4042795 - DNA, 21 bp, Homo sapiens
ccaatcccagggctggctctg

SEQ ID NO: 4042796 - DNA, 15 bp, Homo sapiens
ccaatcctcactggg

SEQ ID NO: 4042797 - DNA, 18 bp, Homo sapiens
ccaatcctcactgggtgg

SEQ ID NO: 4042798 - DNA, 18 bp, Homo sapiens
ccaatctggcccttacac

SEQ ID NO: 4042799 - DNA, 19 bp, Homo sapiens
ccaatctggcccttacaca

SEQ ID NO: 4042800 - DNA, 23 bp, Homo sapiens
ccaatgagactctagggtccagt

SEQ ID NO: 4042801 - DNA, 19 bp, Homo sapiens
ccaatgaggtctgaaatgg

SEQ ID NO: 4042802 - DNA, 14 bp, Homo sapiens
ccaatgcccagcag

SEQ ID NO: 4042803 - DNA, 21 bp, Homo sapiens
ccaatggagactgtctcaaga

SEQ ID NO: 4042804 - DNA, 22 bp, Homo sapiens
ccaatggtgatcctctattttg

SEQ ID NO: 4042805 - DNA, 21 bp, Homo sapiens
ccaattacatggaacttttct

SEQ ID NO: 4042806 - DNA, 17 bp, Homo sapiens
ccaattactattccctt

SEQ ID NO: 4042807 - DNA, 19 bp, Homo sapiens
ccaattactattccctttg

SEQ ID NO: 4042808 - DNA, 14 bp, Homo sapiens
ccaattagtttcct

SEQ ID NO: 4042809 - DNA, 14 bp, Homo sapiens
ccaattctccttta

SEQ ID NO: 4042810 - DNA, 14 bp, Homo sapiens
ccaattgtgctgcc

SEQ ID NO: 4042811 - DNA, 20 bp, Homo sapiens
ccaatttgtaaaaacagcat

SEQ ID NO: 4042812 - DNA, 13 bp, Homo sapiens
ccacaaaaacagg

SEQ ID NO: 4042813 - DNA, 22 bp, Homo sapiens
ccacaaaaacaggtatatactt

SEQ ID NO: 4042814 - DNA, 16 bp, Homo sapiens
ccacaaatgcaggtgt

SEQ ID NO: 4042815 - DNA, 21 bp, Homo sapiens
ccacaaggacttcctgtccag

SEQ ID NO: 4042816 - DNA, 12 bp, Homo sapiens
ccacaaggctgg

SEQ ID NO: 4042817 - DNA, 13 bp, Homo sapiens
ccacaaggctggc

SEQ ID NO: 4042818 - DNA, 17 bp, Homo sapiens
ccacaaggctggccagc

SEQ ID NO: 4042819 - DNA, 15 bp, Homo sapiens
ccacaagttaaataa

SEQ ID NO: 4042820 - DNA, 16 bp, Homo sapiens
ccacaatgcagttctg

SEQ ID NO: 4042821 - DNA, 18 bp, Homo sapiens
ccacaattattggcaaag

SEQ ID NO: 4042822 - DNA, 19 bp, Homo sapiens
ccacaattattggcaaagt

SEQ ID NO: 4042823 - DNA, 22 bp, Homo sapiens
ccacacaaggatagatgctggc

SEQ ID NO: 4042824 - DNA, 13 bp, Homo sapiens
ccacacacacaaa

SEQ ID NO: 4042825 - DNA, 18 bp, Homo sapiens
ccacacacgcaggaactc

SEQ ID NO: 4042826 - DNA, 22 bp, Homo sapiens
ccacacacgcaggaactcccag

SEQ ID NO: 4042827 - DNA, 15 bp, Homo sapiens
ccacacagctacagc

SEQ ID NO: 4042828 - DNA, 15 bp, Homo sapiens
ccacacagctgccct

SEQ ID NO: 4042829 - DNA, 12 bp, Homo sapiens
ccacaccccagc

SEQ ID NO: 4042830 - DNA, 16 bp, Homo sapiens
ccacaccccagcccac

SEQ ID NO: 4042831 - DNA, 15 bp, Homo sapiens
ccacaccgcagaagc

SEQ ID NO: 4042832 - DNA, 15 bp, Homo sapiens
ccacacctctgccag

SEQ ID NO: 4042833 - DNA, 19 bp, Homo sapiens
ccacacggactcccgggcc

SEQ ID NO: 4042834 - DNA, 23 bp, Homo sapiens
ccacacggactcccgggccacgc

SEQ ID NO: 4042835 - DNA, 23 bp, Homo sapiens
ccacactaacctgggttcccttt

SEQ ID NO: 4042836 - DNA, 17 bp, Homo sapiens
ccacactattaccatga

SEQ ID NO: 4042837 - DNA, 15 bp, Homo sapiens
ccacactcccaaggt

SEQ ID NO: 4042838 - DNA, 16 bp, Homo sapiens
ccacacttcaggctct

SEQ ID NO: 4042839 - DNA, 21 bp, Homo sapiens
ccacacttcaggctcttctcc

SEQ ID NO: 4042840 - DNA, 16 bp, Homo sapiens
ccacacttgctggggc

SEQ ID NO: 4042841 - DNA, 17 bp, Homo sapiens
ccacacttgctggggct

SEQ ID NO: 4042842 - DNA, 12 bp, Homo sapiens
ccacagaacctt

SEQ ID NO: 4042843 - DNA, 14 bp, Homo sapiens
ccacagacacacac

SEQ ID NO: 4042844 - DNA, 16 bp, Homo sapiens
ccacagaccacctgct

SEQ ID NO: 4042845 - DNA, 21 bp, Homo sapiens
ccacagaccacctgcttctga

SEQ ID NO: 4042846 - DNA, 15 bp, Homo sapiens
ccacagagtgagcca

SEQ ID NO: 4042847 - DNA, 18 bp, Homo sapiens
ccacagatgtctctgggg

SEQ ID NO: 4042848 - DNA, 19 bp, Homo sapiens
ccacagatgtctctggggc

SEQ ID NO: 4042849 - DNA, 19 bp, Homo sapiens
ccacagcaaccccaggctg

SEQ ID NO: 4042850 - DNA, 22 bp, Homo sapiens
ccacagcaagtacagcggctcc

SEQ ID NO: 4042851 - DNA, 23 bp, Homo sapiens
ccacagcaagtacagcggctccc

SEQ ID NO: 4042852 - DNA, 14 bp, Homo sapiens
ccacagcacagcca

SEQ ID NO: 4042853 - DNA, 14 bp, Homo sapiens
ccacagcagctgaa

SEQ ID NO: 4042854 - DNA, 15 bp, Homo sapiens
ccacagcatcgggag

SEQ ID NO: 4042855 - DNA, 14 bp, Homo sapiens
ccacagccagagga

SEQ ID NO: 4042856 - DNA, 22 bp, Homo sapiens
ccacagcggaggagaccagctc

SEQ ID NO: 4042857 - DNA, 12 bp, Homo sapiens
ccacagcgtccc

SEQ ID NO: 4042858 - DNA, 17 bp, Homo sapiens
ccacagcgtccctggcg

SEQ ID NO: 4042859 - DNA, 21 bp, Homo sapiens
ccacagcgtccctggcgcagg

SEQ ID NO: 4042860 - DNA, 14 bp, Homo sapiens
ccacagctcctttt

SEQ ID NO: 4042861 - DNA, 16 bp, Homo sapiens
ccacagctgagaatgt

SEQ ID NO: 4042862 - DNA, 12 bp, Homo sapiens
ccacagctgctg

SEQ ID NO: 4042863 - DNA, 14 bp, Homo sapiens
ccacagctgctgtt

SEQ ID NO: 4042864 - DNA, 22 bp, Homo sapiens
ccacaggaagcctgcagtcctg

SEQ ID NO: 4042865 - DNA, 19 bp, Homo sapiens
ccacaggaaggaggggaga

SEQ ID NO: 4042866 - DNA, 15 bp, Homo sapiens
ccacaggcagcccag

SEQ ID NO: 4042867 - DNA, 22 bp, Homo sapiens
ccacaggcatctacacagcctg

SEQ ID NO: 4042868 - DNA, 17 bp, Homo sapiens
ccacagggccagaggga

SEQ ID NO: 4042869 - DNA, 18 bp, Homo sapiens
ccacagggttcaaaatgt

SEQ ID NO: 4042870 - DNA, 15 bp, Homo sapiens
ccacagtagtcttga

SEQ ID NO: 4042871 - DNA, 23 bp, Homo sapiens
ccacatagtgatggttcccctgt

SEQ ID NO: 4042872 - DNA, 15 bp, Homo sapiens
ccacatccacacacg

SEQ ID NO: 4042873 - DNA, 12 bp, Homo sapiens
ccacatccacag

SEQ ID NO: 4042874 - DNA, 12 bp, Homo sapiens
ccacatcccagc

SEQ ID NO: 4042875 - DNA, 17 bp, Homo sapiens
ccacatcccagcagccc

SEQ ID NO: 4042876 - DNA, 16 bp, Homo sapiens
ccacatcgcacactgg

SEQ ID NO: 4042877 - DNA, 19 bp, Homo sapiens
ccacatcgcacactggggc

SEQ ID NO: 4042878 - DNA, 13 bp, Homo sapiens
ccacatctgcctt

SEQ ID NO: 4042879 - DNA, 22 bp, Homo sapiens
ccacatctgccttaaaaccaaa

SEQ ID NO: 4042880 - DNA, 17 bp, Homo sapiens
ccacatgaggccatctc

SEQ ID NO: 4042881 - DNA, 21 bp, Homo sapiens
ccacatgaggccatctcagga

SEQ ID NO: 4042882 - DNA, 16 bp, Homo sapiens
ccacatgccactgcct

SEQ ID NO: 4042883 - DNA, 21 bp, Homo sapiens
ccacatgcctgcgcctgctgc

SEQ ID NO: 4042884 - DNA, 16 bp, Homo sapiens
ccacatttagtcctgt

SEQ ID NO: 4042885 - DNA, 18 bp, Homo sapiens
ccacatttctgatcagag

SEQ ID NO: 4042886 - DNA, 20 bp, Homo sapiens
ccaccaataaatcagaccat

SEQ ID NO: 4042887 - DNA, 14 bp, Homo sapiens
ccaccacctctgtg

SEQ ID NO: 4042888 - DNA, 12 bp, Homo sapiens
ccaccagcagca

SEQ ID NO: 4042889 - DNA, 19 bp, Homo sapiens
ccaccagccgccccagccc

SEQ ID NO: 4042890 - DNA, 21 bp, Homo sapiens
ccaccagccgccccagcccct

SEQ ID NO: 4042891 - DNA, 14 bp, Homo sapiens
ccaccaggagaacc

SEQ ID NO: 4042892 - DNA, 20 bp, Homo sapiens
ccaccagtgtcctccaagtg

SEQ ID NO: 4042893 - DNA, 22 bp, Homo sapiens
ccaccagtgtcctccaagtgcc

SEQ ID NO: 4042894 - DNA, 13 bp, Homo sapiens
ccacccaaagcag

SEQ ID NO: 4042895 - DNA, 16 bp, Homo sapiens
ccacccaaagcagtgg

SEQ ID NO: 4042896 - DNA, 17 bp, Homo sapiens
ccacccaagcccaaact

SEQ ID NO: 4042897 - DNA, 16 bp, Homo sapiens
ccacccacacagctgc

SEQ ID NO: 4042898 - DNA, 18 bp, Homo sapiens
ccacccacacagctgccc

SEQ ID NO: 4042899 - DNA, 20 bp, Homo sapiens
ccacccacacagctgcccta

SEQ ID NO: 4042900 - DNA, 14 bp, Homo sapiens
ccacccaggaggga

SEQ ID NO: 4042901 - DNA, 14 bp, Homo sapiens
ccaccccacctcca

SEQ ID NO: 4042902 - DNA, 16 bp, Homo sapiens
ccaccccacctccact

SEQ ID NO: 4042903 - DNA, 12 bp, Homo sapiens
ccaccccagcct

SEQ ID NO: 4042904 - DNA, 16 bp, Homo sapiens
ccaccccagcctcgcc

SEQ ID NO: 4042905 - DNA, 13 bp, Homo sapiens
ccaccccccacac

SEQ ID NO: 4042906 - DNA, 17 bp, Homo sapiens
ccaccccctgccctgca

SEQ ID NO: 4042907 - DNA, 20 bp, Homo sapiens
ccaccccgggctctctgctg

SEQ ID NO: 4042908 - DNA, 18 bp, Homo sapiens
ccaccccggggaccctgt

SEQ ID NO: 4042909 - DNA, 21 bp, Homo sapiens
ccacccctacacacacactcc

SEQ ID NO: 4042910 - DNA, 22 bp, Homo sapiens
ccacccctacacacacactccc

SEQ ID NO: 4042911 - DNA, 22 bp, Homo sapiens
ccacccctagccaccagtgtcc

SEQ ID NO: 4042912 - DNA, 23 bp, Homo sapiens
ccacccctcactccccagggagc

SEQ ID NO: 4042913 - DNA, 22 bp, Homo sapiens
ccacccctgcccccagccccgg

SEQ ID NO: 4042914 - DNA, 22 bp, Homo sapiens
ccacccctggaagagcccagtc

SEQ ID NO: 4042915 - DNA, 16 bp, Homo sapiens
ccacccgacctggctg

SEQ ID NO: 4042916 - DNA, 18 bp, Homo sapiens
ccacccgacctggctgcc

SEQ ID NO: 4042917 - DNA, 16 bp, Homo sapiens
ccacccgggggagccc

SEQ ID NO: 4042918 - DNA, 21 bp, Homo sapiens
ccacccgggggagcccagtga

SEQ ID NO: 4042919 - DNA, 19 bp, Homo sapiens
ccacccgttctgctggcct

SEQ ID NO: 4042920 - DNA, 17 bp, Homo sapiens
ccaccctccaccttcca

SEQ ID NO: 4042921 - DNA, 15 bp, Homo sapiens
ccaccctccatgctc

SEQ ID NO: 4042922 - DNA, 15 bp, Homo sapiens
ccaccctccctggag

SEQ ID NO: 4042923 - DNA, 22 bp, Homo sapiens
ccaccctcctgccccacactcc

SEQ ID NO: 4042924 - DNA, 13 bp, Homo sapiens
ccaccctgctcct

SEQ ID NO: 4042925 - DNA, 20 bp, Homo sapiens
ccaccctggccgagtccaag

SEQ ID NO: 4042926 - DNA, 13 bp, Homo sapiens
ccacccttggcct

SEQ ID NO: 4042927 - DNA, 20 bp, Homo sapiens
ccaccgctgccagcacagag

SEQ ID NO: 4042928 - DNA, 21 bp, Homo sapiens
ccaccgctgccagcacagagc

SEQ ID NO: 4042929 - DNA, 16 bp, Homo sapiens
ccaccgggagcctccc

SEQ ID NO: 4042930 - DNA, 22 bp, Homo sapiens
ccaccgggcatgtctgcctgga

SEQ ID NO: 4042931 - DNA, 24 bp, Homo sapiens
ccaccgggcatgtctgcctggagt

SEQ ID NO: 4042932 - DNA, 19 bp, Homo sapiens
ccaccgtgcctggccagat

SEQ ID NO: 4042933 - DNA, 15 bp, Homo sapiens
ccaccgtgcctggct

SEQ ID NO: 4042934 - DNA, 18 bp, Homo sapiens
ccacctatctcgtgggag

SEQ ID NO: 4042935 - DNA, 16 bp, Homo sapiens
ccacctcactcctgtt

SEQ ID NO: 4042936 - DNA, 18 bp, Homo sapiens
ccacctcactcctgttac

SEQ ID NO: 4042937 - DNA, 12 bp, Homo sapiens
ccacctcagggc

SEQ ID NO: 4042938 - DNA, 16 bp, Homo sapiens
ccacctcagggcacgc

SEQ ID NO: 4042939 - DNA, 21 bp, Homo sapiens
ccacctccaccacatctgcca

SEQ ID NO: 4042940 - DNA, 15 bp, Homo sapiens
ccacctccacccagc

SEQ ID NO: 4042941 - DNA, 18 bp, Homo sapiens
ccacctccacccagcccc

SEQ ID NO: 4042942 - DNA, 19 bp, Homo sapiens
ccacctccacccagcccct

SEQ ID NO: 4042943 - DNA, 21 bp, Homo sapiens
ccacctccactcccacctcac

SEQ ID NO: 4042944 - DNA, 18 bp, Homo sapiens
ccacctcccccactccca

SEQ ID NO: 4042945 - DNA, 15 bp, Homo sapiens
ccacctccctcacca

SEQ ID NO: 4042946 - DNA, 16 bp, Homo sapiens
ccacctctccaagtct

SEQ ID NO: 4042947 - DNA, 14 bp, Homo sapiens
ccacctcttgtgca

SEQ ID NO: 4042948 - DNA, 17 bp, Homo sapiens
ccacctgacgctgcatg

SEQ ID NO: 4042949 - DNA, 17 bp, Homo sapiens
ccacctgcatctggggc

SEQ ID NO: 4042950 - DNA, 20 bp, Homo sapiens
ccacctgcccatcacagggt

SEQ ID NO: 4042951 - DNA, 12 bp, Homo sapiens
ccacctgcctct

SEQ ID NO: 4042952 - DNA, 13 bp, Homo sapiens
ccacctgcctcta

SEQ ID NO: 4042953 - DNA, 20 bp, Homo sapiens
ccacctgccttggcctccca

SEQ ID NO: 4042954 - DNA, 14 bp, Homo sapiens
ccacctgctctgct

SEQ ID NO: 4042955 - DNA, 21 bp, Homo sapiens
ccacctggatctatccctgcg

SEQ ID NO: 4042956 - DNA, 15 bp, Homo sapiens
ccacctgtagccatc

SEQ ID NO: 4042957 - DNA, 20 bp, Homo sapiens
ccacctgtagccatctgcac

SEQ ID NO: 4042958 - DNA, 18 bp, Homo sapiens
ccacctgtctcagcctcc

SEQ ID NO: 4042959 - DNA, 12 bp, Homo sapiens
ccacctgtgggt

SEQ ID NO: 4042960 - DNA, 22 bp, Homo sapiens
ccaccttcaatgacttctaatt

SEQ ID NO: 4042961 - DNA, 20 bp, Homo sapiens
ccaccttctgtccccagccc

SEQ ID NO: 4042962 - DNA, 14 bp, Homo sapiens
ccaccttggctctg

SEQ ID NO: 4042963 - DNA, 15 bp, Homo sapiens
ccacgaatttgctgg

SEQ ID NO: 4042964 - DNA, 23 bp, Homo sapiens
ccacgaatttgctggggaatctc

SEQ ID NO: 4042965 - DNA, 15 bp, Homo sapiens
ccacgactggccagg

SEQ ID NO: 4042966 - DNA, 14 bp, Homo sapiens
ccacgagggctggc

SEQ ID NO: 4042967 - DNA, 15 bp, Homo sapiens
ccacgagggctggct

SEQ ID NO: 4042968 - DNA, 17 bp, Homo sapiens
ccacgagggctggctgg

SEQ ID NO: 4042969 - DNA, 22 bp, Homo sapiens
ccacgagggctggctggcctca

SEQ ID NO: 4042970 - DNA, 14 bp, Homo sapiens
ccacgattggagaa

SEQ ID NO: 4042971 - DNA, 14 bp, Homo sapiens
ccacgcactgggcc

SEQ ID NO: 4042972 - DNA, 18 bp, Homo sapiens
ccagaagatcccctcagg

SEQ ID NO: 4042973 - DNA, 21 bp, Homo sapiens
ccagaagatgccagcttctct

SEQ ID NO: 4042974 - DNA, 21 bp, Homo sapiens
ccagcaacacaagctggaagc

SEQ ID NO: 4042975 - DNA, 10 bp, Homo sapiens
ccagcaacat

SEQ ID NO: 4042976 - DNA, 20 bp, Homo sapiens
ccagcaagcgggagcccgtg

SEQ ID NO: 4042977 - DNA, 13 bp, Homo sapiens
ccagcaaggcagg

SEQ ID NO: 4042978 - DNA, 14 bp, Homo sapiens
ccagcaaggcaggt

SEQ ID NO: 4042979 - DNA, 16 bp, Homo sapiens
ccagcaataagaaatg

SEQ ID NO: 4042980 - DNA, 12 bp, Homo sapiens
ccagcaatgaca

SEQ ID NO: 4042981 - DNA, 18 bp, Homo sapiens
ccagcaatgatgtccaga

SEQ ID NO: 4042982 - DNA, 14 bp, Homo sapiens
ccagcacaaagcag

SEQ ID NO: 4042983 - DNA, 20 bp, Homo sapiens
ccagcacactatttacaaga

SEQ ID NO: 4042984 - DNA, 23 bp, Homo sapiens
ccagcacagaaggaatctgtgca

SEQ ID NO: 4042985 - DNA, 14 bp, Homo sapiens
ccagcacagagcgt

SEQ ID NO: 4042986 - DNA, 18 bp, Homo sapiens
ccagcacagagcgtcctt

SEQ ID NO: 4042987 - DNA, 20 bp, Homo sapiens
ccagcacagcttagatttca

SEQ ID NO: 4042988 - DNA, 19 bp, Homo sapiens
ccagcaccctctcctgggg

SEQ ID NO: 4042989 - DNA, 22 bp, Homo sapiens
ccagcactaaggccgtgtctct

SEQ ID NO: 4042990 - DNA, 14 bp, Homo sapiens
ccagcactgtgaag

SEQ ID NO: 4042991 - DNA, 17 bp, Homo sapiens
ccagcactgtgaagacc

SEQ ID NO: 4042992 - DNA, 17 bp, Homo sapiens
ccagcacttccatggga

SEQ ID NO: 4042993 - DNA, 15 bp, Homo sapiens
ccagcactttgggag

SEQ ID NO: 4042994 - DNA, 20 bp, Homo sapiens
ccagcactttgggaggccga

SEQ ID NO: 4042995 - DNA, 19 bp, Homo sapiens
ccagcactttgggaggcct

SEQ ID NO: 4042996 - DNA, 15 bp, Homo sapiens
ccagcagaagacaaa

SEQ ID NO: 4042997 - DNA, 22 bp, Homo sapiens
ccagcagaagacaaaaagacaa

SEQ ID NO: 4042998 - DNA, 16 bp, Homo sapiens
ccagcagaggcaggct

SEQ ID NO: 4042999 - DNA, 23 bp, Homo sapiens
ccagcagcagcccaagcttccct

SEQ ID NO: 4043000 - DNA, 21 bp, Homo sapiens
ccagcagccccgtctgcccac

SEQ ID NO: 4043001 - DNA, 21 bp, Homo sapiens
ccagcagccctaaggatctct

SEQ ID NO: 4043002 - DNA, 14 bp, Homo sapiens
ccagcaggaagcca

SEQ ID NO: 4043003 - DNA, 22 bp, Homo sapiens
ccagcaggagagactgagcagc

SEQ ID NO: 4043004 - DNA, 23 bp, Homo sapiens
ccagcagggggagaaacccttca

SEQ ID NO: 4043005 - DNA, 10 bp, Homo sapiens
ccagcagtgt

SEQ ID NO: 4043006 - DNA, 19 bp, Homo sapiens
ccagcagtgttgctcagct

SEQ ID NO: 4043007 - DNA, 15 bp, Homo sapiens
ccagcagttttcaag

SEQ ID NO: 4043008 - DNA, 22 bp, Homo sapiens
ccagcagttttcaagtcaaatt

SEQ ID NO: 4043009 - DNA, 21 bp, Homo sapiens
ccagcatcactccccaaggaa

SEQ ID NO: 4043010 - DNA, 19 bp, Homo sapiens
ccagcatccaccttggctc

SEQ ID NO: 4043011 - DNA, 14 bp, Homo sapiens
ccagcatccctgga

SEQ ID NO: 4043012 - DNA, 17 bp, Homo sapiens
ccagcatccctggagca

SEQ ID NO: 4043013 - DNA, 23 bp, Homo sapiens
ccagcatccctggagcaggagcc

SEQ ID NO: 4043014 - DNA, 17 bp, Homo sapiens
ccagccaaaccctgtct

SEQ ID NO: 4043015 - DNA, 17 bp, Homo sapiens
ccagccaactctgggaa

SEQ ID NO: 4043016 - DNA, 22 bp, Homo sapiens
ccagccagcaatgatgtccaga

SEQ ID NO: 4043017 - DNA, 14 bp, Homo sapiens
ccagccagcagcag

SEQ ID NO: 4043018 - DNA, 19 bp, Homo sapiens
ccagccagcagcagcccaa

SEQ ID NO: 4043019 - DNA, 21 bp, Homo sapiens
ccagccaggcaggtccacaga

SEQ ID NO: 4043020 - DNA, 21 bp, Homo sapiens
ccagccatacttatctctctg

SEQ ID NO: 4043021 - DNA, 11 bp, Homo sapiens
ccagcccagag

SEQ ID NO: 4043022 - DNA, 23 bp, Homo sapiens
ccagcccagagacatacttgaag

SEQ ID NO: 4043023 - DNA, 12 bp, Homo sapiens
ccagcccagcca

SEQ ID NO: 4043024 - DNA, 13 bp, Homo sapiens
ccagcccagccag

SEQ ID NO: 4043025 - DNA, 14 bp, Homo sapiens
ccagcccagccagg

SEQ ID NO: 4043026 - DNA, 15 bp, Homo sapiens
ccagcccagccaggc

SEQ ID NO: 4043027 - DNA, 22 bp, Homo sapiens
ccagcccatccattaggccagc

SEQ ID NO: 4043028 - DNA, 17 bp, Homo sapiens
ccagccccacccaggag

SEQ ID NO: 4043029 - DNA, 18 bp, Homo sapiens
ccagccccacccaggagg

SEQ ID NO: 4043030 - DNA, 19 bp, Homo sapiens
ccagccccatccctgtcct

SEQ ID NO: 4043031 - DNA, 17 bp, Homo sapiens
ccagcccccgccccaga

SEQ ID NO: 4043032 - DNA, 23 bp, Homo sapiens
ccagcccccgccccagagtggcc

SEQ ID NO: 4043033 - DNA, 17 bp, Homo sapiens
ccagccccggcaagcca

SEQ ID NO: 4043034 - DNA, 15 bp, Homo sapiens
ccagcccctcttccc

SEQ ID NO: 4043035 - DNA, 10 bp, Homo sapiens
ccagcccctg

SEQ ID NO: 4043036 - DNA, 16 bp, Homo sapiens
ccagcccctggggccc

SEQ ID NO: 4043037 - DNA, 18 bp, Homo sapiens
ccagcccctggggcccag

SEQ ID NO: 4043038 - DNA, 21 bp, Homo sapiens
ccagcccctggggcccagccc

SEQ ID NO: 4043039 - DNA, 11 bp, Homo sapiens
ccagcccctgt

SEQ ID NO: 4043040 - DNA, 13 bp, Homo sapiens
ccagcccctgtcc

SEQ ID NO: 4043041 - DNA, 17 bp, Homo sapiens
ccagcccctgtcccacc

SEQ ID NO: 4043042 - DNA, 15 bp, Homo sapiens
ccagccccttctccc

SEQ ID NO: 4043043 - DNA, 14 bp, Homo sapiens
ccagccccttgaga

SEQ ID NO: 4043044 - DNA, 13 bp, Homo sapiens
ccagcccggcctg

SEQ ID NO: 4043045 - DNA, 14 bp, Homo sapiens
ccagccctgcagcc

SEQ ID NO: 4043046 - DNA, 13 bp, Homo sapiens
ccagccctggctc

SEQ ID NO: 4043047 - DNA, 17 bp, Homo sapiens
ccagccctggctctgca

SEQ ID NO: 4043048 - DNA, 14 bp, Homo sapiens
ccagccctgtcctg

SEQ ID NO: 4043049 - DNA, 15 bp, Homo sapiens
ccagcccttcctctg

SEQ ID NO: 4043050 - DNA, 16 bp, Homo sapiens
ccagccgccccagccc

SEQ ID NO: 4043051 - DNA, 17 bp, Homo sapiens
ccagccgccccagcccc

SEQ ID NO: 4043052 - DNA, 15 bp, Homo sapiens
ccagccgccctgggc

SEQ ID NO: 4043053 - DNA, 18 bp, Homo sapiens
ccagccgtgatgctcagg

SEQ ID NO: 4043054 - DNA, 23 bp, Homo sapiens
ccagccgtgatgctcaggcttga

SEQ ID NO: 4043055 - DNA, 13 bp, Homo sapiens
ccagcctccctga

SEQ ID NO: 4043056 - DNA, 17 bp, Homo sapiens
ccagcctccctgaagcc

SEQ ID NO: 4043057 - DNA, 17 bp, Homo sapiens
ccagcctccctgtctcc

SEQ ID NO: 4043058 - DNA, 24 bp, Homo sapiens
ccagcctccctgtctccagctgcc

SEQ ID NO: 4043059 - DNA, 18 bp, Homo sapiens
ccagcctccgagagggag

SEQ ID NO: 4043060 - DNA, 12 bp, Homo sapiens
ccagcctcctct

SEQ ID NO: 4043061 - DNA, 14 bp, Homo sapiens
ccagcctcctctgg

SEQ ID NO: 4043062 - DNA, 23 bp, Homo sapiens
ccagcctcctctggacggcaggc

SEQ ID NO: 4043063 - DNA, 21 bp, Homo sapiens
ccagcctcgcctgtcaccccc

SEQ ID NO: 4043064 - DNA, 15 bp, Homo sapiens
ccagcctctggcatt

SEQ ID NO: 4043065 - DNA, 13 bp, Homo sapiens
ccagcctctttcc

SEQ ID NO: 4043066 - DNA, 18 bp, Homo sapiens
ccagcctgaacagaagct

SEQ ID NO: 4043067 - DNA, 17 bp, Homo sapiens
ccagcctgaccttcctt

SEQ ID NO: 4043068 - DNA, 19 bp, Homo sapiens
ccagcctgcccaagcccag

SEQ ID NO: 4043069 - DNA, 17 bp, Homo sapiens
ccagcctgctgagagcc

SEQ ID NO: 4043070 - DNA, 18 bp, Homo sapiens
ccagcctgctgagagccc

SEQ ID NO: 4043071 - DNA, 14 bp, Homo sapiens
ccaggcacagctga

SEQ ID NO: 4043072 - DNA, 19 bp, Homo sapiens
ccaggcaccccctggagag

SEQ ID NO: 4043073 - DNA, 13 bp, Homo sapiens
ccaggcacctccc

SEQ ID NO: 4043074 - DNA, 16 bp, Homo sapiens
ccaggcacggtttgga

SEQ ID NO: 4043075 - DNA, 16 bp, Homo sapiens
ccaggcagatccagga

SEQ ID NO: 4043076 - DNA, 17 bp, Homo sapiens
ccaggcagatccaggac

SEQ ID NO: 4043077 - DNA, 20 bp, Homo sapiens
ccaggcagatctgtgcccca

SEQ ID NO: 4043078 - DNA, 22 bp, Homo sapiens
ccaggcaggggtgggggtggag

SEQ ID NO: 4043079 - DNA, 12 bp, Homo sapiens
ccaggccagcct

SEQ ID NO: 4043080 - DNA, 15 bp, Homo sapiens
ccaggccagcctccg

SEQ ID NO: 4043081 - DNA, 23 bp, Homo sapiens
ccaggccagcctccgagagggag

SEQ ID NO: 4043082 - DNA, 17 bp, Homo sapiens
ccaggcccaaggctccc

SEQ ID NO: 4043083 - DNA, 19 bp, Homo sapiens
ccaggcccaaggctcccgg

SEQ ID NO: 4043084 - DNA, 21 bp, Homo sapiens
ccaggcccgcaccccggcctc

SEQ ID NO: 4043085 - DNA, 23 bp, Homo sapiens
ccaggcccgcaccccggcctcag

SEQ ID NO: 4043086 - DNA, 22 bp, Homo sapiens
ccaggccggcccagatgtgtcc

SEQ ID NO: 4043087 - DNA, 21 bp, Homo sapiens
ccaggccggggtggagcatgg

SEQ ID NO: 4043088 - DNA, 18 bp, Homo sapiens
ccaggcctcaccacctga

SEQ ID NO: 4043089 - DNA, 16 bp, Homo sapiens
ccaggcctctgctgcc

SEQ ID NO: 4043090 - DNA, 13 bp, Homo sapiens
ccaggcctctgtg

SEQ ID NO: 4043091 - DNA, 16 bp, Homo sapiens
ccaggcctctgtgtcc

SEQ ID NO: 4043092 - DNA, 13 bp, Homo sapiens
ccaggcctgcagc

SEQ ID NO: 4043093 - DNA, 14 bp, Homo sapiens
ccaggcctgcagca

SEQ ID NO: 4043094 - DNA, 16 bp, Homo sapiens
ccaggcctgcagcagg

SEQ ID NO: 4043095 - DNA, 13 bp, Homo sapiens
ccaggcctgcctc

SEQ ID NO: 4043096 - DNA, 13 bp, Homo sapiens
ccaggcctggctg

SEQ ID NO: 4043097 - DNA, 18 bp, Homo sapiens
ccaggcctgggtctgtgt

SEQ ID NO: 4043098 - DNA, 19 bp, Homo sapiens
ccaggcctgggtctgtgtc

SEQ ID NO: 4043099 - DNA, 20 bp, Homo sapiens
ccaggcctgggtctgtgtct

SEQ ID NO: 4043100 - DNA, 18 bp, Homo sapiens
ccaggcgccccttccccc

SEQ ID NO: 4043101 - DNA, 23 bp, Homo sapiens
ccaggctctttggggtcagccag

SEQ ID NO: 4043102 - DNA, 13 bp, Homo sapiens
ccaggctgaagca

SEQ ID NO: 4043103 - DNA, 19 bp, Homo sapiens
ccaggctgaccacagcaca

SEQ ID NO: 4043104 - DNA, 19 bp, Homo sapiens
ccaggctgccaaggccaga

SEQ ID NO: 4043105 - DNA, 20 bp, Homo sapiens
ccaggctgccaaggccagag

SEQ ID NO: 4043106 - DNA, 14 bp, Homo sapiens
ccaggctgcctcct

SEQ ID NO: 4043107 - DNA, 21 bp, Homo sapiens
ccaggctgcctcctgccctta

SEQ ID NO: 4043108 - DNA, 21 bp, Homo sapiens
ccaggctgctaacctggaaag

SEQ ID NO: 4043109 - DNA, 13 bp, Homo sapiens
ccaggctggacat

SEQ ID NO: 4043110 - DNA, 21 bp, Homo sapiens
ccaggctggacatgctgactg

SEQ ID NO: 4043111 - DNA, 12 bp, Homo sapiens
ccaggctggaga

SEQ ID NO: 4043112 - DNA, 21 bp, Homo sapiens
ccaggctggagtgcagtggca

SEQ ID NO: 4043113 - DNA, 15 bp, Homo sapiens
ccaggctgtgcagcg

SEQ ID NO: 4043114 - DNA, 22 bp, Homo sapiens
ccaggctgtgggcctcaaggac

SEQ ID NO: 4043115 - DNA, 17 bp, Homo sapiens
ccaggctgttctccagg

SEQ ID NO: 4043116 - DNA, 20 bp, Homo sapiens
ccaggctgttctccaggctt

SEQ ID NO: 4043117 - DNA, 17 bp, Homo sapiens
ccaggcttcacagtctg

SEQ ID NO: 4043118 - DNA, 18 bp, Homo sapiens
ccaggcttcaccctgaat

SEQ ID NO: 4043119 - DNA, 18 bp, Homo sapiens
ccagggaagctggccgag

SEQ ID NO: 4043120 - DNA, 13 bp, Homo sapiens
ccagggacagagg

SEQ ID NO: 4043121 - DNA, 15 bp, Homo sapiens
ccagggagaagctcc

SEQ ID NO: 4043122 - DNA, 17 bp, Homo sapiens
ccagggagcaagacaga

SEQ ID NO: 4043123 - DNA, 18 bp, Homo sapiens
ccagggagcaagacagag

SEQ ID NO: 4043124 - DNA, 22 bp, Homo sapiens
ccagggagcctttggttctggc

SEQ ID NO: 4043125 - DNA, 17 bp, Homo sapiens
ccagggagtccagggtt

SEQ ID NO: 4043126 - DNA, 20 bp, Homo sapiens
ccagggatgaagaaagactc

SEQ ID NO: 4043127 - DNA, 21 bp, Homo sapiens
ccagggatgctgggctgggcc

SEQ ID NO: 4043128 - DNA, 23 bp, Homo sapiens
ccagggatgctgggctgggccct

SEQ ID NO: 4043129 - DNA, 22 bp, Homo sapiens
ccagggatgggggatgggccag

SEQ ID NO: 4043130 - DNA, 22 bp, Homo sapiens
ccagggcaagggttaaggcctg

SEQ ID NO: 4043131 - DNA, 16 bp, Homo sapiens
ccagggcatgtgtatg

SEQ ID NO: 4043132 - DNA, 18 bp, Homo sapiens
ccagggcatgtgtatgtg

SEQ ID NO: 4043133 - DNA, 20 bp, Homo sapiens
ccagggcattcgggccacag

SEQ ID NO: 4043134 - DNA, 14 bp, Homo sapiens
ccagggcccacccc

SEQ ID NO: 4043135 - DNA, 18 bp, Homo sapiens
ccagggcccaccccagcc

SEQ ID NO: 4043136 - DNA, 21 bp, Homo sapiens
ccagggcccaccccagcctcg

SEQ ID NO: 4043137 - DNA, 13 bp, Homo sapiens
ccagggcccagag

SEQ ID NO: 4043138 - DNA, 16 bp, Homo sapiens
ccagggcccagagccc

SEQ ID NO: 4043139 - DNA, 22 bp, Homo sapiens
ccagggcccagagcccagctcc

SEQ ID NO: 4043140 - DNA, 17 bp, Homo sapiens
ccagggcccccatctca

SEQ ID NO: 4043141 - DNA, 16 bp, Homo sapiens
ccagggccctggccag

SEQ ID NO: 4043142 - DNA, 14 bp, Homo sapiens
ccagggctgcccct

SEQ ID NO: 4043143 - DNA, 17 bp, Homo sapiens
ccagggctgccctgaga

SEQ ID NO: 4043144 - DNA, 18 bp, Homo sapiens
ccagggctgccctgagaa

SEQ ID NO: 4043145 - DNA, 18 bp, Homo sapiens
ccagggctggctctgcac

SEQ ID NO: 4043146 - DNA, 11 bp, Homo sapiens
ccagggctggg

SEQ ID NO: 4043147 - DNA, 19 bp, Homo sapiens
ccagggctggggacagagg

SEQ ID NO: 4043148 - DNA, 18 bp, Homo sapiens
ccagggctggggcagcct

SEQ ID NO: 4043149 - DNA, 24 bp, Homo sapiens
ccaggggaacctgccatgccagga

SEQ ID NO: 4043150 - DNA, 15 bp, Homo sapiens
ccaggggaaggccct

SEQ ID NO: 4043151 - DNA, 20 bp, Homo sapiens
ccaggggaaggccctgaggc

SEQ ID NO: 4043152 - DNA, 16 bp, Homo sapiens
ccaggggagttgtgtc

SEQ ID NO: 4043153 - DNA, 19 bp, Homo sapiens
ccaggggcccacagggaac

SEQ ID NO: 4043154 - DNA, 21 bp, Homo sapiens
ccaggggctgggctccctgat

SEQ ID NO: 4043155 - DNA, 14 bp, Homo sapiens
ccaggggtcccagc

SEQ ID NO: 4043156 - DNA, 17 bp, Homo sapiens
ccaggggtcccagccac

SEQ ID NO: 4043157 - DNA, 15 bp, Homo sapiens
ccaggggtctccctg

SEQ ID NO: 4043158 - DNA, 17 bp, Homo sapiens
ccaggggtctccctgga

SEQ ID NO: 4043159 - DNA, 18 bp, Homo sapiens
ccaggggtctccctggct

SEQ ID NO: 4043160 - DNA, 16 bp, Homo sapiens
ccaggggtctgtctgc

SEQ ID NO: 4043161 - DNA, 21 bp, Homo sapiens
ccaggggtgatttcagagagg

SEQ ID NO: 4043162 - DNA, 16 bp, Homo sapiens
ccagggtctgtgtgaa

SEQ ID NO: 4043163 - DNA, 15 bp, Homo sapiens
ccagggtgcccagaa

SEQ ID NO: 4043164 - DNA, 13 bp, Homo sapiens
ccagggtgggtgt

SEQ ID NO: 4043165 - DNA, 18 bp, Homo sapiens
gtttcatgtaatcctcaa

SEQ ID NO: 4043166 - DNA, 16 bp, Homo sapiens
gtttcattctcctgcc

SEQ ID NO: 4043167 - DNA, 17 bp, Homo sapiens
gtttccagcagaagaca

SEQ ID NO: 4043168 - DNA, 15 bp, Homo sapiens
gtttcccataatttt

SEQ ID NO: 4043169 - DNA, 17 bp, Homo sapiens
gtttcctccaagctatt

SEQ ID NO: 4043170 - DNA, 20 bp, Homo sapiens
gtttcctccatttgagaaaa

SEQ ID NO: 4043171 - DNA, 14 bp, Homo sapiens
gtttcctcttccaa

SEQ ID NO: 4043172 - DNA, 20 bp, Homo sapiens
gtttcctgcccagcctgggg

SEQ ID NO: 4043173 - DNA, 23 bp, Homo sapiens
gtttccttgtttatcagatacat

SEQ ID NO: 4043174 - DNA, 13 bp, Homo sapiens
gtttctaaaaaca

SEQ ID NO: 4043175 - DNA, 17 bp, Homo sapiens
gtttctaaaactatggt

SEQ ID NO: 4043176 - DNA, 16 bp, Homo sapiens
gtttctattctgtcag

SEQ ID NO: 4043177 - DNA, 15 bp, Homo sapiens
gtttctccttttcct

SEQ ID NO: 4043178 - DNA, 13 bp, Homo sapiens
gtttctctccctc

SEQ ID NO: 4043179 - DNA, 14 bp, Homo sapiens
gtttctctccctcc

SEQ ID NO: 4043180 - DNA, 16 bp, Homo sapiens
gtttctgaaaattcca

SEQ ID NO: 4043181 - DNA, 15 bp, Homo sapiens
gtttctgcagccctt

SEQ ID NO: 4043182 - DNA, 22 bp, Homo sapiens
gtttctgcagcccttgggcagt

SEQ ID NO: 4043183 - DNA, 16 bp, Homo sapiens
gtttctgccttcttta

SEQ ID NO: 4043184 - DNA, 16 bp, Homo sapiens
gtttctgggtcctgaa

SEQ ID NO: 4043185 - DNA, 22 bp, Homo sapiens
gtttctgggtcctgaagaatta

SEQ ID NO: 4043186 - DNA, 14 bp, Homo sapiens
gtttctgttccaaa

SEQ ID NO: 4043187 - DNA, 17 bp, Homo sapiens
gtttctgtttgattctt

SEQ ID NO: 4043188 - DNA, 13 bp, Homo sapiens
gtttcttcttgtg

SEQ ID NO: 4043189 - DNA, 17 bp, Homo sapiens
gtttctttaagaaagta

SEQ ID NO: 4043190 - DNA, 14 bp, Homo sapiens
gtttctttgtgttg

SEQ ID NO: 4043191 - DNA, 20 bp, Homo sapiens
gtttgaaaacttcagaagca

SEQ ID NO: 4043192 - DNA, 14 bp, Homo sapiens
gtttgaagcctgtg

SEQ ID NO: 4043193 - DNA, 22 bp, Homo sapiens
gtttgaagcctgtgcctcccag

SEQ ID NO: 4043194 - DNA, 19 bp, Homo sapiens
gtttgactagatgatggat

SEQ ID NO: 4043195 - DNA, 13 bp, Homo sapiens
gtttgactcagtt

SEQ ID NO: 4043196 - DNA, 15 bp, Homo sapiens
gtttgagatgctgta

SEQ ID NO: 4043197 - DNA, 14 bp, Homo sapiens
gtttgagctgcctt

SEQ ID NO: 4043198 - DNA, 15 bp, Homo sapiens
gtttgagctgccttc

SEQ ID NO: 4043199 - DNA, 19 bp, Homo sapiens
gtttgagtttttcctccca

SEQ ID NO: 4043200 - DNA, 16 bp, Homo sapiens
gtttgcaggggtgacg

SEQ ID NO: 4043201 - DNA, 14 bp, Homo sapiens
gtttgccccgttct

SEQ ID NO: 4043202 - DNA, 15 bp, Homo sapiens
gtttgccggatacaa

SEQ ID NO: 4043203 - DNA, 18 bp, Homo sapiens
gtttgccttctactttta

SEQ ID NO: 4043204 - DNA, 14 bp, Homo sapiens
gtttgcttaaacaa

SEQ ID NO: 4043205 - DNA, 16 bp, Homo sapiens
gtttgcttaaacaaag

SEQ ID NO: 4043206 - DNA, 16 bp, Homo sapiens
gtttgcttattgttcc

SEQ ID NO: 4043207 - DNA, 18 bp, Homo sapiens
gtttgcttattgttccaa

SEQ ID NO: 4043208 - DNA, 16 bp, Homo sapiens
gtttgcttcataaatg

SEQ ID NO: 4043209 - DNA, 21 bp, Homo sapiens
gtttgcttggtgctggtttat

SEQ ID NO: 4043210 - DNA, 17 bp, Homo sapiens
gtttggaaaagtggcgt

SEQ ID NO: 4043211 - DNA, 19 bp, Homo sapiens
gtttggaaataaactgtgc

SEQ ID NO: 4043212 - DNA, 21 bp, Homo sapiens
gtttggactgcagaagcaagg

SEQ ID NO: 4043213 - DNA, 16 bp, Homo sapiens
gtttggatgtaattta

SEQ ID NO: 4043214 - DNA, 14 bp, Homo sapiens
gtttggcaaggaaa

SEQ ID NO: 4043215 - DNA, 15 bp, Homo sapiens
gtttggcaaggaaag

SEQ ID NO: 4043216 - DNA, 15 bp, Homo sapiens
gtttggcacccaaat

SEQ ID NO: 4043217 - DNA, 15 bp, Homo sapiens
gtttgggaaagatgg

SEQ ID NO: 4043218 - DNA, 21 bp, Homo sapiens
gtttgggcagaagggagaagg

SEQ ID NO: 4043219 - DNA, 19 bp, Homo sapiens
gtttggggcagaaaggact

SEQ ID NO: 4043220 - DNA, 19 bp, Homo sapiens
gtttgggtaaaatactttt

SEQ ID NO: 4043221 - DNA, 22 bp, Homo sapiens
gtttgggtatcctgcccagtgt

SEQ ID NO: 4043222 - DNA, 16 bp, Homo sapiens
gtttggtagttagcca

SEQ ID NO: 4043223 - DNA, 16 bp, Homo sapiens
gtttggtttacattta

SEQ ID NO: 4043224 - DNA, 20 bp, Homo sapiens
gtttggtttacatttaaagc

SEQ ID NO: 4043225 - DNA, 14 bp, Homo sapiens
gtttggtttttatt

SEQ ID NO: 4043226 - DNA, 18 bp, Homo sapiens
gtttgtaaataagagatt

SEQ ID NO: 4043227 - DNA, 16 bp, Homo sapiens
gtttgtaaattatttg

SEQ ID NO: 4043228 - DNA, 17 bp, Homo sapiens
gtttgtagttgttttaa

SEQ ID NO: 4043229 - DNA, 15 bp, Homo sapiens
gtttgtcacaagtgg

SEQ ID NO: 4043230 - DNA, 13 bp, Homo sapiens
gtttgtctatttt

SEQ ID NO: 4043231 - DNA, 15 bp, Homo sapiens
gtttgtctattttaa

SEQ ID NO: 4043232 - DNA, 16 bp, Homo sapiens
gtttgtctattttaaa

SEQ ID NO: 4043233 - DNA, 13 bp, Homo sapiens
gtttgtctcttct

SEQ ID NO: 4043234 - DNA, 15 bp, Homo sapiens
gtttgtctcttctgg

SEQ ID NO: 4043235 - DNA, 18 bp, Homo sapiens
gtttgtctgtttgtttca

SEQ ID NO: 4043236 - DNA, 21 bp, Homo sapiens
gtttgtcttccattccattgt

SEQ ID NO: 4043237 - DNA, 13 bp, Homo sapiens
gtttgtggcctca

SEQ ID NO: 4043238 - DNA, 22 bp, Homo sapiens
gtttgtggctgggggcaggagg

SEQ ID NO: 4043239 - DNA, 22 bp, Homo sapiens
gtttgtgtatttacgctttgat

SEQ ID NO: 4043240 - DNA, 18 bp, Homo sapiens
gtttgttctacatggctt

SEQ ID NO: 4043241 - DNA, 19 bp, Homo sapiens
gtttgttggatcttcaatg

SEQ ID NO: 4043242 - DNA, 13 bp, Homo sapiens
gtttgtttttgct

SEQ ID NO: 4043243 - DNA, 15 bp, Homo sapiens
gttttaaaaagccag

SEQ ID NO: 4043244 - DNA, 19 bp, Homo sapiens
taaaaatggcaaatgcact

SEQ ID NO: 4043245 - DNA, 19 bp, Homo sapiens
taaaaatgtaaatattcta

SEQ ID NO: 4043246 - DNA, 15 bp, Homo sapiens
taaaaattctgaatg

SEQ ID NO: 4043247 - DNA, 17 bp, Homo sapiens
taaaaattctgaatgta

SEQ ID NO: 4043248 - DNA, 17 bp, Homo sapiens
taaaaattgtgatcaga

SEQ ID NO: 4043249 - DNA, 16 bp, Homo sapiens
taaaacaaaatctgaa

SEQ ID NO: 4043250 - DNA, 17 bp, Homo sapiens
taaaacaaaatctgaac

SEQ ID NO: 4043251 - DNA, 17 bp, Homo sapiens
taaaacaaaatttgttt

SEQ ID NO: 4043252 - DNA, 22 bp, Homo sapiens
taaaacaattttttttttcctc

SEQ ID NO: 4043253 - DNA, 13 bp, Homo sapiens
taaaacacagctt

SEQ ID NO: 4043254 - DNA, 10 bp, Homo sapiens
taaaacacta

SEQ ID NO: 4043255 - DNA, 17 bp, Homo sapiens
taaaacactttcaaaac

SEQ ID NO: 4043256 - DNA, 18 bp, Homo sapiens
taaaacagctgtctctaa

SEQ ID NO: 4043257 - DNA, 14 bp, Homo sapiens
taaaacagtattta

SEQ ID NO: 4043258 - DNA, 20 bp, Homo sapiens
taaaacagtatttattttgt

SEQ ID NO: 4043259 - DNA, 23 bp, Homo sapiens
taaaacggtgctgtgagggaggg

SEQ ID NO: 4043260 - DNA, 21 bp, Homo sapiens
taaaacgtcttagagcctttt

SEQ ID NO: 4043261 - DNA, 14 bp, Homo sapiens
taaaactaagcaca

SEQ ID NO: 4043262 - DNA, 18 bp, Homo sapiens
taaaactatggttcccaa

SEQ ID NO: 4043263 - DNA, 15 bp, Homo sapiens
taaaacttcttaaat

SEQ ID NO: 4043264 - DNA, 22 bp, Homo sapiens
taaaacttgatgtgttatctct

SEQ ID NO: 4043265 - DNA, 17 bp, Homo sapiens
taaaactttcctcgcct

SEQ ID NO: 4043266 - DNA, 13 bp, Homo sapiens
taaaagaaacact

SEQ ID NO: 4043267 - DNA, 19 bp, Homo sapiens
taaaagagagagagagaaa

SEQ ID NO: 4043268 - DNA, 13 bp, Homo sapiens
taaaagatcgcag

SEQ ID NO: 4043269 - DNA, 22 bp, Homo sapiens
taaaagcagaaaataaaggaag

SEQ ID NO: 4043270 - DNA, 15 bp, Homo sapiens
taaaagcataaatgc

SEQ ID NO: 4043271 - DNA, 20 bp, Homo sapiens
gttgctctaggaagacattt

SEQ ID NO: 4043272 - DNA, 23 bp, Homo sapiens
gttgctgatgaactcttaatcaa

SEQ ID NO: 4043273 - DNA, 19 bp, Homo sapiens
gttgctgtcataagaatga

SEQ ID NO: 4043274 - DNA, 22 bp, Homo sapiens
gttggaaaagaatacagaaaga

SEQ ID NO: 4043275 - DNA, 14 bp, Homo sapiens
gttggactctcagg

SEQ ID NO: 4043276 - DNA, 17 bp, Homo sapiens
gttggacttttcgttaa

SEQ ID NO: 4043277 - DNA, 21 bp, Homo sapiens
gttggacttttcgttaacatt

SEQ ID NO: 4043278 - DNA, 18 bp, Homo sapiens
gttggatgggagtgggca

SEQ ID NO: 4043279 - DNA, 14 bp, Homo sapiens
gttggatgtagcat

SEQ ID NO: 4043280 - DNA, 18 bp, Homo sapiens
gttggcagatgcagctct

SEQ ID NO: 4043281 - DNA, 13 bp, Homo sapiens
gttggcagcccac

SEQ ID NO: 4043282 - DNA, 14 bp, Homo sapiens
gttggcagcccact

SEQ ID NO: 4043283 - DNA, 20 bp, Homo sapiens
gttggccgtggtccagctct

SEQ ID NO: 4043284 - DNA, 22 bp, Homo sapiens
gttggccgtggtccagctcttg

SEQ ID NO: 4043285 - DNA, 15 bp, Homo sapiens
gttggcgctgaggtg

SEQ ID NO: 4043286 - DNA, 16 bp, Homo sapiens
gttggctatttgaaat

SEQ ID NO: 4043287 - DNA, 12 bp, Homo sapiens
gttggctttgcc

SEQ ID NO: 4043288 - DNA, 16 bp, Homo sapiens
gttgggagcactggag

SEQ ID NO: 4043289 - DNA, 12 bp, Homo sapiens
gttgggcatgtg

SEQ ID NO: 4043290 - DNA, 15 bp, Homo sapiens
gttgggcccagatct

SEQ ID NO: 4043291 - DNA, 14 bp, Homo sapiens
gttggggaggggcg

SEQ ID NO: 4043292 - DNA, 15 bp, Homo sapiens
gttgggttcatctga

SEQ ID NO: 4043293 - DNA, 23 bp, Homo sapiens
gttggtccagagcggaggctgtg

SEQ ID NO: 4043294 - DNA, 16 bp, Homo sapiens
gttggtcggtgggttg

SEQ ID NO: 4043295 - DNA, 21 bp, Homo sapiens
gttgtaactaggctcagagat

SEQ ID NO: 4043296 - DNA, 21 bp, Homo sapiens
gttgtacaaatgtattttgaa

SEQ ID NO: 4043297 - DNA, 20 bp, Homo sapiens
gttgtacatttatgatttaa

SEQ ID NO: 4043298 - DNA, 13 bp, Homo sapiens
gttgtattcttct

SEQ ID NO: 4043299 - DNA, 14 bp, Homo sapiens
gttgtattcttctg

SEQ ID NO: 4043300 - DNA, 23 bp, Homo sapiens
gttgtattttaactcataccttt

SEQ ID NO: 4043301 - DNA, 17 bp, Homo sapiens
gttgtcaagtctctgct

SEQ ID NO: 4043302 - DNA, 22 bp, Homo sapiens
gttgtcaagtctctgctggccc

SEQ ID NO: 4043303 - DNA, 17 bp, Homo sapiens
gttgtctcttctcctta

SEQ ID NO: 4043304 - DNA, 19 bp, Homo sapiens
gttgtctgaagtcactgca

SEQ ID NO: 4043305 - DNA, 16 bp, Homo sapiens
gttgtgaaatttaatg

SEQ ID NO: 4043306 - DNA, 14 bp, Homo sapiens
gttgtgaatgttgt

SEQ ID NO: 4043307 - DNA, 22 bp, Homo sapiens
gttgtgaggcctggccaggcac

SEQ ID NO: 4043308 - DNA, 22 bp, Homo sapiens
gttgtgcatttgttcagctccc

SEQ ID NO: 4043309 - DNA, 16 bp, Homo sapiens
gttgtgttagcctctt

SEQ ID NO: 4043310 - DNA, 14 bp, Homo sapiens
gttgtgttcctggc

SEQ ID NO: 4043311 - DNA, 16 bp, Homo sapiens
gttgtgttttttaaga

SEQ ID NO: 4043312 - DNA, 19 bp, Homo sapiens
gttgttatattatttacat

SEQ ID NO: 4043313 - DNA, 17 bp, Homo sapiens
gttgttgcatgtttgaa

SEQ ID NO: 4043314 - DNA, 15 bp, Homo sapiens
gttgttgtggaagca

SEQ ID NO: 4043315 - DNA, 24 bp, Homo sapiens
gttgttgttaatgaaaatgtcaga

SEQ ID NO: 4043316 - DNA, 13 bp, Homo sapiens
gttgtttctgttc

SEQ ID NO: 4043317 - DNA, 14 bp, Homo sapiens
gttgtttctgttcc

SEQ ID NO: 4043318 - DNA, 13 bp, Homo sapiens
gttgtttgtaaat

SEQ ID NO: 4043319 - DNA, 16 bp, Homo sapiens
gttgttttctggggga

SEQ ID NO: 4043320 - DNA, 19 bp, Homo sapiens
gtttaaaaagtaagttaat

SEQ ID NO: 4043321 - DNA, 21 bp, Homo sapiens
gtttaaaataaaatgaaaatt

SEQ ID NO: 4043322 - DNA, 11 bp, Homo sapiens
gtttaaaattc

SEQ ID NO: 4043323 - DNA, 14 bp, Homo sapiens
gtttaaaattcagt

SEQ ID NO: 4043324 - DNA, 12 bp, Homo sapiens
gtttaaactgat

SEQ ID NO: 4043325 - DNA, 16 bp, Homo sapiens
gtttaaactgattcat

SEQ ID NO: 4043326 - DNA, 16 bp, Homo sapiens
gtttaaagaataaagt

SEQ ID NO: 4043327 - DNA, 16 bp, Homo sapiens
gtttaaagttgcacat

SEQ ID NO: 4043328 - DNA, 21 bp, Homo sapiens
gtttaactttaaggatttgaa

SEQ ID NO: 4043329 - DNA, 20 bp, Homo sapiens
gtttaagaaaagtattttga

SEQ ID NO: 4043330 - DNA, 23 bp, Homo sapiens
gtttaagaaaagtattttgaagt

SEQ ID NO: 4043331 - DNA, 12 bp, Homo sapiens
gtttaagtgttg

SEQ ID NO: 4043332 - DNA, 17 bp, Homo sapiens
gtttaatatttaaacag

SEQ ID NO: 4043333 - DNA, 15 bp, Homo sapiens
gtttaattcagcaga

SEQ ID NO: 4043334 - DNA, 18 bp, Homo sapiens
gtttaatttttatttctt

SEQ ID NO: 4043335 - DNA, 12 bp, Homo sapiens
gtttacatttaa

SEQ ID NO: 4043336 - DNA, 15 bp, Homo sapiens
gtttacatttaaagc

SEQ ID NO: 4043337 - DNA, 21 bp, Homo sapiens
gtttacatttttatttatgaa

SEQ ID NO: 4043338 - DNA, 18 bp, Homo sapiens
gtttaccagttgcctttt

SEQ ID NO: 4043339 - DNA, 17 bp, Homo sapiens
gtttaccatttgtaata

SEQ ID NO: 4043340 - DNA, 20 bp, Homo sapiens
gtttaccatttgtaataaag

SEQ ID NO: 4043341 - DNA, 21 bp, Homo sapiens
gtttaccatttgtaataaagt

SEQ ID NO: 4043342 - DNA, 15 bp, Homo sapiens
gtttacctggggatc

SEQ ID NO: 4043343 - DNA, 23 bp, Homo sapiens
gtttactatgtgccagttcctgt

SEQ ID NO: 4043344 - DNA, 22 bp, Homo sapiens
gtttagaagctgagacacaaag

SEQ ID NO: 4043345 - DNA, 17 bp, Homo sapiens
gtttagcagcagccttt

SEQ ID NO: 4043346 - DNA, 14 bp, Homo sapiens
gtttaggctatttg

SEQ ID NO: 4043347 - DNA, 15 bp, Homo sapiens
gtttaggctatttgt

SEQ ID NO: 4043348 - DNA, 22 bp, Homo sapiens
gtttaggctatttgtaaatctg

SEQ ID NO: 4043349 - DNA, 13 bp, Homo sapiens
gtttataatctga

SEQ ID NO: 4043350 - DNA, 20 bp, Homo sapiens
gtttatactccagtgtacat

SEQ ID NO: 4043351 - DNA, 23 bp, Homo sapiens
gtttatatactgggttcttgttt

SEQ ID NO: 4043352 - DNA, 17 bp, Homo sapiens
taaagaaatgtcttaat

SEQ ID NO: 4043353 - DNA, 15 bp, Homo sapiens
taaagaataatatgc

SEQ ID NO: 4043354 - DNA, 20 bp, Homo sapiens
taaagaatgccatttctcac

SEQ ID NO: 4043355 - DNA, 18 bp, Homo sapiens
taaagaattaatgactta

SEQ ID NO: 4043356 - DNA, 19 bp, Homo sapiens
taaagacgtctctttttgg

SEQ ID NO: 4043357 - DNA, 21 bp, Homo sapiens
taaagacgtctctttttggta

SEQ ID NO: 4043358 - DNA, 12 bp, Homo sapiens
taaagagaagac

SEQ ID NO: 4043359 - DNA, 17 bp, Homo sapiens
taaagagcccttgcctc

SEQ ID NO: 4043360 - DNA, 20 bp, Homo sapiens
taaagaggctgaaagaggcc

SEQ ID NO: 4043361 - DNA, 18 bp, Homo sapiens
taaagatcaagtgggcct

SEQ ID NO: 4043362 - DNA, 16 bp, Homo sapiens
taaagatgaactctga

SEQ ID NO: 4043363 - DNA, 21 bp, Homo sapiens
taaagatgatctactcagaaa

SEQ ID NO: 4043364 - DNA, 17 bp, Homo sapiens
taaagatggtcgtgtgt

SEQ ID NO: 4043365 - DNA, 20 bp, Homo sapiens
taaagatggtcgtgtgtgtg

SEQ ID NO: 4043366 - DNA, 19 bp, Homo sapiens
taaagcaatctgattcagc

SEQ ID NO: 4043367 - DNA, 12 bp, Homo sapiens
taaagcattgct

SEQ ID NO: 4043368 - DNA, 19 bp, Homo sapiens
taaagcattgctgttatgt

SEQ ID NO: 4043369 - DNA, 20 bp, Homo sapiens
taaagcattgctgttatgtc

SEQ ID NO: 4043370 - DNA, 12 bp, Homo sapiens
taaagcatttat

SEQ ID NO: 4043371 - DNA, 13 bp, Homo sapiens
taaagcatttcct

SEQ ID NO: 4043372 - DNA, 11 bp, Homo sapiens
taaagccaagg

SEQ ID NO: 4043373 - DNA, 18 bp, Homo sapiens
taaagcgatatacagatg

SEQ ID NO: 4043374 - DNA, 19 bp, Homo sapiens
taaagctactgatttcctt

SEQ ID NO: 4043375 - DNA, 16 bp, Homo sapiens
taaagctatgttacat

SEQ ID NO: 4043376 - DNA, 10 bp, Homo sapiens
taaagctggc

SEQ ID NO: 4043377 - DNA, 17 bp, Homo sapiens
taaagctggccctgcct

SEQ ID NO: 4043378 - DNA, 18 bp, Homo sapiens
taaagctggccctgcctc

SEQ ID NO: 4043379 - DNA, 23 bp, Homo sapiens
taaagctggccctgcctcctggg

SEQ ID NO: 4043380 - DNA, 19 bp, Homo sapiens
taaagctgtgcttggggtc

SEQ ID NO: 4043381 - DNA, 19 bp, Homo sapiens
taaagcttatttttctgtg

SEQ ID NO: 4043382 - DNA, 14 bp, Homo sapiens
taaaggactgtaat

SEQ ID NO: 4043383 - DNA, 16 bp, Homo sapiens
taaaggagttaagagt

SEQ ID NO: 4043384 - DNA, 15 bp, Homo sapiens
taaaggcagctgttg

SEQ ID NO: 4043385 - DNA, 14 bp, Homo sapiens
taaagggcctgcct

SEQ ID NO: 4043386 - DNA, 18 bp, Homo sapiens
taaagggtgtacttatat

SEQ ID NO: 4043387 - DNA, 15 bp, Homo sapiens
taaaggtcctgccct

SEQ ID NO: 4043388 - DNA, 20 bp, Homo sapiens
taaaggtggtgaggcaataa

SEQ ID NO: 4043389 - DNA, 21 bp, Homo sapiens
taaaggtggtgaggcaataaa

SEQ ID NO: 4043390 - DNA, 13 bp, Homo sapiens
taaagtaaagcta

SEQ ID NO: 4043391 - DNA, 21 bp, Homo sapiens
taaagtacttgagtgtaatgt

SEQ ID NO: 4043392 - DNA, 17 bp, Homo sapiens
taaagtgcttgcttttt

SEQ ID NO: 4043393 - DNA, 16 bp, Homo sapiens
taaagtgtaaatcctt

SEQ ID NO: 4043394 - DNA, 18 bp, Homo sapiens
taaagtgtgttgttgctt

SEQ ID NO: 4043395 - DNA, 17 bp, Homo sapiens
taaagtgtgtttctatg

SEQ ID NO: 4043396 - DNA, 17 bp, Homo sapiens
taaagtgttactttttg

SEQ ID NO: 4043397 - DNA, 15 bp, Homo sapiens
taaagtgtttcagct

SEQ ID NO: 4043398 - DNA, 17 bp, Homo sapiens
taaagttacttgaattt

SEQ ID NO: 4043399 - DNA, 18 bp, Homo sapiens
taaagttacttgaatttc

SEQ ID NO: 4043400 - DNA, 16 bp, Homo sapiens
taaagttactttgtca

SEQ ID NO: 4043401 - DNA, 20 bp, Homo sapiens
taaagttgaagctaagattt

SEQ ID NO: 4043402 - DNA, 13 bp, Homo sapiens
taaagttgcacat

SEQ ID NO: 4043403 - DNA, 22 bp, Homo sapiens
taaagttgcctttatttgctgt

SEQ ID NO: 4043404 - DNA, 14 bp, Homo sapiens
taaataaaactgaa

SEQ ID NO: 4043405 - DNA, 15 bp, Homo sapiens
taaataaaactgaat

SEQ ID NO: 4043406 - DNA, 15 bp, Homo sapiens
taaataaaagcagca

SEQ ID NO: 4043407 - DNA, 12 bp, Homo sapiens
taaataaaatca

SEQ ID NO: 4043408 - DNA, 15 bp, Homo sapiens
taaataaaccactgt

SEQ ID NO: 4043409 - DNA, 11 bp, Homo sapiens
taaataagaga

SEQ ID NO: 4043410 - DNA, 13 bp, Homo sapiens
taaataagagatt

SEQ ID NO: 4043411 - DNA, 20 bp, Homo sapiens
taaataatgaataaactgaa

SEQ ID NO: 4043412 - DNA, 17 bp, Homo sapiens
taaataatttatttaat

SEQ ID NO: 4043413 - DNA, 14 bp, Homo sapiens
taaataattttaat

SEQ ID NO: 4043414 - DNA, 17 bp, Homo sapiens
taaatacaaatctgtat

SEQ ID NO: 4043415 - DNA, 16 bp, Homo sapiens
taaatacaagactgtt

SEQ ID NO: 4043416 - DNA, 20 bp, Homo sapiens
taaatacaagactgttgtga

SEQ ID NO: 4043417 - DNA, 18 bp, Homo sapiens
taaatacacaacacacac

SEQ ID NO: 4043418 - DNA, 23 bp, Homo sapiens
taaatacaccacctcactcctgt

SEQ ID NO: 4043419 - DNA, 14 bp, Homo sapiens
taaatacagacact

SEQ ID NO: 4043420 - DNA, 15 bp, Homo sapiens
taaatacagacacta

SEQ ID NO: 4043421 - DNA, 17 bp, Homo sapiens
taaatagccttcaaaaa

SEQ ID NO: 4043422 - DNA, 14 bp, Homo sapiens
taaatagctatatc

SEQ ID NO: 4043423 - DNA, 16 bp, Homo sapiens
taaatagctatatcca

SEQ ID NO: 4043424 - DNA, 19 bp, Homo sapiens
taaatagctatatccatgt

SEQ ID NO: 4043425 - DNA, 16 bp, Homo sapiens
taaataggagaggatg

SEQ ID NO: 4043426 - DNA, 15 bp, Homo sapiens
taagaaatgaacaaa

SEQ ID NO: 4043427 - DNA, 17 bp, Homo sapiens
taagaaatgaacaaaag

SEQ ID NO: 4043428 - DNA, 19 bp, Homo sapiens
taagaaatgaacaaaagat

SEQ ID NO: 4043429 - DNA, 14 bp, Homo sapiens
taagaacctggaac

SEQ ID NO: 4043430 - DNA, 13 bp, Homo sapiens
taagaacttcatt

SEQ ID NO: 4043431 - DNA, 15 bp, Homo sapiens
taagaagctgttgta

SEQ ID NO: 4043432 - DNA, 21 bp, Homo sapiens
taagaagctgttgtacattta

SEQ ID NO: 4043433 - DNA, 13 bp, Homo sapiens
taagaaggcaaaa

SEQ ID NO: 4043434 - DNA, 18 bp, Homo sapiens
taagaatcagagtagaaa

SEQ ID NO: 4043435 - DNA, 21 bp, Homo sapiens
taagaatcagagtagaaataa

SEQ ID NO: 4043436 - DNA, 13 bp, Homo sapiens
taagaattgacca

SEQ ID NO: 4043437 - DNA, 16 bp, Homo sapiens
taagaattgagtaatg

SEQ ID NO: 4043438 - DNA, 20 bp, Homo sapiens
taagaattgagtaatggtgt

SEQ ID NO: 4043439 - DNA, 10 bp, Homo sapiens
taagaattgt

SEQ ID NO: 4043440 - DNA, 16 bp, Homo sapiens
taagaatttagggaga

SEQ ID NO: 4043441 - DNA, 20 bp, Homo sapiens
taagacataacgtttttcct

SEQ ID NO: 4043442 - DNA, 21 bp, Homo sapiens
taagacataacgtttttcctt

SEQ ID NO: 4043443 - DNA, 22 bp, Homo sapiens
taagacataacgtttttccttt

SEQ ID NO: 4043444 - DNA, 17 bp, Homo sapiens
taagacatgatttcctt

SEQ ID NO: 4043445 - DNA, 12 bp, Homo sapiens
taagacatgtga

SEQ ID NO: 4043446 - DNA, 20 bp, Homo sapiens
taagacatgtgaggaggaaa

SEQ ID NO: 4043447 - DNA, 21 bp, Homo sapiens
taagacatgtgaggaggaaaa

SEQ ID NO: 4043448 - DNA, 17 bp, Homo sapiens
taagacatttgtttgct

SEQ ID NO: 4043449 - DNA, 19 bp, Homo sapiens
taagacatttgtttgctgt

SEQ ID NO: 4043450 - DNA, 18 bp, Homo sapiens
taagacctggcagctctg

SEQ ID NO: 4043451 - DNA, 14 bp, Homo sapiens
taagactgaatgtt

SEQ ID NO: 4043452 - DNA, 20 bp, Homo sapiens
taagactgaatgttttattt

SEQ ID NO: 4043453 - DNA, 15 bp, Homo sapiens
taagactgtgtattc

SEQ ID NO: 4043454 - DNA, 21 bp, Homo sapiens
taagactgtttttaagtaact

SEQ ID NO: 4043455 - DNA, 21 bp, Homo sapiens
taagagaaactttatacatta

SEQ ID NO: 4043456 - DNA, 22 bp, Homo sapiens
taagagaaactttatacattag

SEQ ID NO: 4043457 - DNA, 13 bp, Homo sapiens
taagagaaagaaa

SEQ ID NO: 4043458 - DNA, 14 bp, Homo sapiens
taagagaagtgagt

SEQ ID NO: 4043459 - DNA, 15 bp, Homo sapiens
taagagaatgttcct

SEQ ID NO: 4043460 - DNA, 22 bp, Homo sapiens
taagagaattatatatttctaa

SEQ ID NO: 4043461 - DNA, 15 bp, Homo sapiens
taagagatgggacta

SEQ ID NO: 4043462 - DNA, 19 bp, Homo sapiens
taagagcaccttcctcact

SEQ ID NO: 4043463 - DNA, 14 bp, Homo sapiens
taagagtgctgggc

SEQ ID NO: 4043464 - DNA, 13 bp, Homo sapiens
taagagtgtagaa

SEQ ID NO: 4043465 - DNA, 16 bp, Homo sapiens
taagagtgtagaagca

SEQ ID NO: 4043466 - DNA, 22 bp, Homo sapiens
taagagtgtagaagcattcctt

SEQ ID NO: 4043467 - DNA, 21 bp, Homo sapiens
taagagttagtttctttggga

SEQ ID NO: 4043468 - DNA, 16 bp, Homo sapiens
taagataaatgtgctg

SEQ ID NO: 4043469 - DNA, 18 bp, Homo sapiens
taagataatagtttacat

SEQ ID NO: 4043470 - DNA, 12 bp, Homo sapiens
taagataattat

SEQ ID NO: 4043471 - DNA, 13 bp, Homo sapiens
taagataattata

SEQ ID NO: 4043472 - DNA, 22 bp, Homo sapiens
taagatacaagtttcagacagg

SEQ ID NO: 4043473 - DNA, 17 bp, Homo sapiens
taagatatccatctttt

SEQ ID NO: 4043474 - DNA, 22 bp, Homo sapiens
taagatggattctcagatattt

SEQ ID NO: 4043475 - DNA, 19 bp, Homo sapiens
taagatttagagatgaatt

SEQ ID NO: 4043476 - DNA, 14 bp, Homo sapiens
taagattttacaaa

SEQ ID NO: 4043477 - DNA, 15 bp, Homo sapiens
taagatttttctcaa

SEQ ID NO: 4043478 - DNA, 18 bp, Homo sapiens
taagatttttctcaaagt

SEQ ID NO: 4043479 - DNA, 20 bp, Homo sapiens
taagatttttctcaaagttt

SEQ ID NO: 4043480 - DNA, 19 bp, Homo sapiens
taagcaaaggggacagctg

SEQ ID NO: 4043481 - DNA, 14 bp, Homo sapiens
taagcaaatgcatt

SEQ ID NO: 4043482 - DNA, 18 bp, Homo sapiens
taagcaagagagatgttt

SEQ ID NO: 4043483 - DNA, 13 bp, Homo sapiens
taagcactacata

SEQ ID NO: 4043484 - DNA, 16 bp, Homo sapiens
taagcactacataaac

SEQ ID NO: 4043485 - DNA, 22 bp, Homo sapiens
taagcactacataaactgactt

SEQ ID NO: 4043486 - DNA, 18 bp, Homo sapiens
taagcagcatggaaaaat

SEQ ID NO: 4043487 - DNA, 22 bp, Homo sapiens
taagcaggtggatctatttcat

SEQ ID NO: 4043488 - DNA, 21 bp, Homo sapiens
taagcattaccactcaggcat

SEQ ID NO: 4043489 - DNA, 18 bp, Homo sapiens
taagcattgggtgggtaa

SEQ ID NO: 4043490 - DNA, 17 bp, Homo sapiens
taagcattgtttgctta

SEQ ID NO: 4043491 - DNA, 18 bp, Homo sapiens
taagcattgtttgcttat

SEQ ID NO: 4043492 - DNA, 14 bp, Homo sapiens
taagccacttgaaa

SEQ ID NO: 4043493 - DNA, 15 bp, Homo sapiens
taagcccccagggcc

SEQ ID NO: 4043494 - DNA, 20 bp, Homo sapiens
taagcccccagggcctccag

SEQ ID NO: 4043495 - DNA, 21 bp, Homo sapiens
taagcccccagggcctccagg

SEQ ID NO: 4043496 - DNA, 15 bp, Homo sapiens
taagcctacctgctc

SEQ ID NO: 4043497 - DNA, 14 bp, Homo sapiens
taagcctccattta

SEQ ID NO: 4043498 - DNA, 17 bp, Homo sapiens
taagcctccatttagtt

SEQ ID NO: 4043499 - DNA, 16 bp, Homo sapiens
taagccttataaacca

SEQ ID NO: 4043500 - DNA, 16 bp, Homo sapiens
taagcctttccataag

SEQ ID NO: 4043501 - DNA, 20 bp, Homo sapiens
taagccttttatactgatta

SEQ ID NO: 4043502 - DNA, 21 bp, Homo sapiens
taagcgaagtctttgccttct

SEQ ID NO: 4043503 - DNA, 13 bp, Homo sapiens
taagcggaataaa

SEQ ID NO: 4043504 - DNA, 14 bp, Homo sapiens
taagctattcagta

SEQ ID NO: 4043505 - DNA, 20 bp, Homo sapiens
taagctcagtgctctctcca

SEQ ID NO: 4043506 - DNA, 20 bp, Homo sapiens
taagctccttgagtaaaaag

SEQ ID NO: 4043507 - DNA, 15 bp, Homo sapiens
taagctctttgagaa

SEQ ID NO: 4043508 - DNA, 17 bp, Homo sapiens
taagctctttgagaact

SEQ ID NO: 4043509 - DNA, 12 bp, Homo sapiens
taagctggctct

SEQ ID NO: 4043510 - DNA, 15 bp, Homo sapiens
taagcttatgcttaa

SEQ ID NO: 4043511 - DNA, 17 bp, Homo sapiens
taagctttgccagctgc

SEQ ID NO: 4043512 - DNA, 18 bp, Homo sapiens
taagctttgccagctgct

SEQ ID NO: 4043513 - DNA, 21 bp, Homo sapiens
taagctttgccagctgctgct

SEQ ID NO: 4043514 - DNA, 10 bp, Homo sapiens
taaggaaact

SEQ ID NO: 4043515 - DNA, 15 bp, Homo sapiens
taaggaaactcttat

SEQ ID NO: 4043516 - DNA, 17 bp, Homo sapiens
taaggaaactcttatct

SEQ ID NO: 4043517 - DNA, 20 bp, Homo sapiens
taaggaaactcttatctcag

SEQ ID NO: 4043518 - DNA, 15 bp, Homo sapiens
taaggaaccttcctt

SEQ ID NO: 4043519 - DNA, 19 bp, Homo sapiens
taaggaaccttccttcctg

SEQ ID NO: 4043520 - DNA, 14 bp, Homo sapiens
taaggacacactaa

SEQ ID NO: 4043521 - DNA, 18 bp, Homo sapiens
taaggacatttcccaggg

SEQ ID NO: 4043522 - DNA, 14 bp, Homo sapiens
taaggacttcctga

SEQ ID NO: 4043523 - DNA, 17 bp, Homo sapiens
taaggataatgaaataa

SEQ ID NO: 4043524 - DNA, 17 bp, Homo sapiens
taaggatactttacatg

SEQ ID NO: 4043525 - DNA, 17 bp, Homo sapiens
taaggatgtcacagggc

SEQ ID NO: 4043526 - DNA, 19 bp, Homo sapiens
taaggatgtcacagggcca

SEQ ID NO: 4043527 - DNA, 16 bp, Homo sapiens
taaggcccactgtaat

SEQ ID NO: 4043528 - DNA, 19 bp, Homo sapiens
taagggaagacatttcttt

SEQ ID NO: 4043529 - DNA, 21 bp, Homo sapiens
taagggaaggaactctggctt

SEQ ID NO: 4043530 - DNA, 14 bp, Homo sapiens
gtgtgtaggctggg

SEQ ID NO: 4043531 - DNA, 11 bp, Homo sapiens
gtgtgtgccct

SEQ ID NO: 4043532 - DNA, 13 bp, Homo sapiens
gtgtgtggcaggg

SEQ ID NO: 4043533 - DNA, 17 bp, Homo sapiens
gtgtgtggtagaaacaa

SEQ ID NO: 4043534 - DNA, 18 bp, Homo sapiens
gtgtgtggtgaggggctt

SEQ ID NO: 4043535 - DNA, 21 bp, Homo sapiens
gtgtgtggtgaggggctttct

SEQ ID NO: 4043536 - DNA, 12 bp, Homo sapiens
gtgtgtgtatgt

SEQ ID NO: 4043537 - DNA, 13 bp, Homo sapiens
gtgtgtgtatgtg

SEQ ID NO: 4043538 - DNA, 15 bp, Homo sapiens
gtgtgtgtgtcagct

SEQ ID NO: 4043539 - DNA, 13 bp, Homo sapiens
gtgtgtgtgtgca

SEQ ID NO: 4043540 - DNA, 15 bp, Homo sapiens
gtgtgtgtgtgtgtg

SEQ ID NO: 4043541 - DNA, 18 bp, Homo sapiens
gtgtgtttcatccttccc

SEQ ID NO: 4043542 - DNA, 15 bp, Homo sapiens
gtgttacctgtgtgc

SEQ ID NO: 4043543 - DNA, 19 bp, Homo sapiens
gtgttactgtaattcctca

SEQ ID NO: 4043544 - DNA, 18 bp, Homo sapiens
gtgttcaatccagagagc

SEQ ID NO: 4043545 - DNA, 10 bp, Homo sapiens
gtgttcctgg

SEQ ID NO: 4043546 - DNA, 18 bp, Homo sapiens
gtgttcctggcaatagtg

SEQ ID NO: 4043547 - DNA, 21 bp, Homo sapiens
gtgttcctttttaaatgtgaa

SEQ ID NO: 4043548 - DNA, 14 bp, Homo sapiens
gtgttctctcttat

SEQ ID NO: 4043549 - DNA, 17 bp, Homo sapiens
gtgttctgctcctgctt

SEQ ID NO: 4043550 - DNA, 14 bp, Homo sapiens
gtgttctgtttgtt

SEQ ID NO: 4043551 - DNA, 23 bp, Homo sapiens
gtgttctgtttgttattgttttg

SEQ ID NO: 4043552 - DNA, 13 bp, Homo sapiens
gtgttctttcctg

SEQ ID NO: 4043553 - DNA, 15 bp, Homo sapiens
gtgttctttcctgcc

SEQ ID NO: 4043554 - DNA, 14 bp, Homo sapiens
gtgttgagacccag

SEQ ID NO: 4043555 - DNA, 19 bp, Homo sapiens
gtgttgccacagtagaact

SEQ ID NO: 4043556 - DNA, 17 bp, Homo sapiens
gtgttgccactttccaa

SEQ ID NO: 4043557 - DNA, 14 bp, Homo sapiens
gtgttgggagggat

SEQ ID NO: 4043558 - DNA, 17 bp, Homo sapiens
gtgttgtaattcttcag

SEQ ID NO: 4043559 - DNA, 13 bp, Homo sapiens
gtgttgtgttcct

SEQ ID NO: 4043560 - DNA, 17 bp, Homo sapiens
gtgttgtgttcctggct

SEQ ID NO: 4043561 - DNA, 12 bp, Homo sapiens
gtgtttaaaaaa

SEQ ID NO: 4043562 - DNA, 17 bp, Homo sapiens
gtgtttcatccttccca

SEQ ID NO: 4043563 - DNA, 18 bp, Homo sapiens
gtgtttgcttaaacaaag

SEQ ID NO: 4043564 - DNA, 14 bp, Homo sapiens
gtgtttgcttggtg

SEQ ID NO: 4043565 - DNA, 14 bp, Homo sapiens
gtgtttggtttaca

SEQ ID NO: 4043566 - DNA, 13 bp, Homo sapiens
gtgttttaaattc

SEQ ID NO: 4043567 - DNA, 21 bp, Homo sapiens
gtgttttaagactgaatgttt

SEQ ID NO: 4043568 - DNA, 13 bp, Homo sapiens
gtgttttaattta

SEQ ID NO: 4043569 - DNA, 14 bp, Homo sapiens
gtgttttcataata

SEQ ID NO: 4043570 - DNA, 16 bp, Homo sapiens
gtgttttcataataaa

SEQ ID NO: 4043571 - DNA, 18 bp, Homo sapiens
gtgttttctgaataacat

SEQ ID NO: 4043572 - DNA, 18 bp, Homo sapiens
gtgttttgttttttaagg

SEQ ID NO: 4043573 - DNA, 21 bp, Homo sapiens
gtgttttttaagatagtgtaa

SEQ ID NO: 4043574 - DNA, 19 bp, Homo sapiens
gttaaaactgtacatttaa

SEQ ID NO: 4043575 - DNA, 23 bp, Homo sapiens
gttaaaactgtacatttaaaatt

SEQ ID NO: 4043576 - DNA, 22 bp, Homo sapiens
gttaaaatacagttctgtcata

SEQ ID NO: 4043577 - DNA, 19 bp, Homo sapiens
gttaaaatgtgaggaagaa

SEQ ID NO: 4043578 - DNA, 15 bp, Homo sapiens
gttaaaattccatcc

SEQ ID NO: 4043579 - DNA, 20 bp, Homo sapiens
gttaaatactgtgcagaata

SEQ ID NO: 4043580 - DNA, 21 bp, Homo sapiens
gttaaatactgtgcagaataa

SEQ ID NO: 4043581 - DNA, 20 bp, Homo sapiens
gttaaatagagtatatgcac

SEQ ID NO: 4043582 - DNA, 19 bp, Homo sapiens
gttaaatttgtaagtttca

SEQ ID NO: 4043583 - DNA, 18 bp, Homo sapiens
gttaacacaatgtgaatt

SEQ ID NO: 4043584 - DNA, 20 bp, Homo sapiens
gttaaccagaataaagttct

SEQ ID NO: 4043585 - DNA, 22 bp, Homo sapiens
gttaacccttcatcttcctgtg

SEQ ID NO: 4043586 - DNA, 15 bp, Homo sapiens
gttaacctttttgta

SEQ ID NO: 4043587 - DNA, 17 bp, Homo sapiens
gttaactattgcattta

SEQ ID NO: 4043588 - DNA, 18 bp, Homo sapiens
gttaactgttaactatga

SEQ ID NO: 4043589 - DNA, 17 bp, Homo sapiens
gttaactttaagactga

SEQ ID NO: 4043590 - DNA, 23 bp, Homo sapiens
gttaactttaagactgagcacct

SEQ ID NO: 4043591 - DNA, 15 bp, Homo sapiens
gttaagaagctgttg

SEQ ID NO: 4043592 - DNA, 19 bp, Homo sapiens
gttaagaagctgttgtaca

SEQ ID NO: 4043593 - DNA, 15 bp, Homo sapiens
gttaagaatgtcgat

SEQ ID NO: 4043594 - DNA, 17 bp, Homo sapiens
gttaagacatgatttcc

SEQ ID NO: 4043595 - DNA, 22 bp, Homo sapiens
gttaagacatgatttccttgaa

SEQ ID NO: 4043596 - DNA, 12 bp, Homo sapiens
gttaagagaaac

SEQ ID NO: 4043597 - DNA, 14 bp, Homo sapiens
gttaagagaaactt

SEQ ID NO: 4043598 - DNA, 21 bp, Homo sapiens
gttaagagataattcttaaaa

SEQ ID NO: 4043599 - DNA, 12 bp, Homo sapiens
gttaaggacttc

SEQ ID NO: 4043600 - DNA, 11 bp, Homo sapiens
gttaaggcctg

SEQ ID NO: 4043601 - DNA, 13 bp, Homo sapiens
gttaagggaagga

SEQ ID NO: 4043602 - DNA, 17 bp, Homo sapiens
gttaatgaaaatgtcag

SEQ ID NO: 4043603 - DNA, 18 bp, Homo sapiens
gttaattaatgtcatgtt

SEQ ID NO: 4043604 - DNA, 13 bp, Homo sapiens
gttaattcaccta

SEQ ID NO: 4043605 - DNA, 19 bp, Homo sapiens
gttaattccaattatatga

SEQ ID NO: 4043606 - DNA, 14 bp, Homo sapiens
gttaatttttctta

SEQ ID NO: 4043607 - DNA, 20 bp, Homo sapiens
gttacaagattgtaagtaaa

SEQ ID NO: 4043608 - DNA, 22 bp, Homo sapiens
gttacaagtatacttatatttc

SEQ ID NO: 4043609 - DNA, 16 bp, Homo sapiens
gttacactaaaaggtg

SEQ ID NO: 4043610 - DNA, 15 bp, Homo sapiens
gttacagtgcagaca

SEQ ID NO: 4043611 - DNA, 17 bp, Homo sapiens
gttacagtgcagacagg

SEQ ID NO: 4043612 - DNA, 18 bp, Homo sapiens
gttacataagataaatgt

SEQ ID NO: 4043613 - DNA, 16 bp, Homo sapiens
gttacatctgtgcagg

SEQ ID NO: 4043614 - DNA, 14 bp, Homo sapiens
gttacattaatgtt

SEQ ID NO: 4043615 - DNA, 16 bp, Homo sapiens
gttacattaatgttaa

SEQ ID NO: 4043616 - DNA, 16 bp, Homo sapiens
gttacctaaagtattt

SEQ ID NO: 4043617 - DNA, 17 bp, Homo sapiens
gttacctcctataaact

SEQ ID NO: 4043618 - DNA, 19 bp, Homo sapiens
gttacctgacctaaattag

SEQ ID NO: 4043619 - DNA, 15 bp, Homo sapiens
gttactcagggttca

SEQ ID NO: 4043620 - DNA, 23 bp, Homo sapiens
gttactcagggttcatctgtcca

SEQ ID NO: 4043621 - DNA, 19 bp, Homo sapiens
gttactcagtgttagagaa

SEQ ID NO: 4043622 - DNA, 20 bp, Homo sapiens
gttactcagtgttagagaaa

SEQ ID NO: 4043623 - DNA, 23 bp, Homo sapiens
gttactctgcctttctaagactc

SEQ ID NO: 4043624 - DNA, 14 bp, Homo sapiens
gttactctggttct

SEQ ID NO: 4043625 - DNA, 21 bp, Homo sapiens
gttactgaaggtgatggaggt

SEQ ID NO: 4043626 - DNA, 13 bp, Homo sapiens
gttacttcctact

SEQ ID NO: 4043627 - DNA, 15 bp, Homo sapiens
gttacttcttctctt

SEQ ID NO: 4043628 - DNA, 21 bp, Homo sapiens
gttactttatgtttgtctttt

SEQ ID NO: 4043629 - DNA, 19 bp, Homo sapiens
gttactttgtaatttttgg

SEQ ID NO: 4043630 - DNA, 21 bp, Homo sapiens
gttagagagggaccatgtgtc

SEQ ID NO: 4043631 - DNA, 14 bp, Homo sapiens
gttagccccaggga

SEQ ID NO: 4043632 - DNA, 23 bp, Homo sapiens
gttaggatttaacagtcatttaa

SEQ ID NO: 4043633 - DNA, 22 bp, Homo sapiens
gttaggggccttagggcactgg

SEQ ID NO: 4043634 - DNA, 13 bp, Homo sapiens
gttagtagaaatt

SEQ ID NO: 4043635 - DNA, 16 bp, Homo sapiens
gttagtatctaacatg

SEQ ID NO: 4043636 - DNA, 21 bp, Homo sapiens
gttagtattttaatcctgtac

SEQ ID NO: 4043637 - DNA, 17 bp, Homo sapiens
gttagttaaaagcccat

SEQ ID NO: 4043638 - DNA, 15 bp, Homo sapiens
gttagtttacaatat

SEQ ID NO: 4043639 - DNA, 22 bp, Homo sapiens
gttagtttagtgtgtgtgcaga

SEQ ID NO: 4043640 - DNA, 14 bp, Homo sapiens
gttagtttttactt

SEQ ID NO: 4043641 - DNA, 21 bp, Homo sapiens
gttatagtgaatactgctaca

SEQ ID NO: 4043642 - DNA, 16 bp, Homo sapiens
gttatataattcactc

SEQ ID NO: 4043643 - DNA, 20 bp, Homo sapiens
gttatcaaactgctgtcgtt

SEQ ID NO: 4043644 - DNA, 18 bp, Homo sapiens
gttatcgaaataacaatg

SEQ ID NO: 4043645 - DNA, 16 bp, Homo sapiens
gttatctaaaagaaat

SEQ ID NO: 4043646 - DNA, 14 bp, Homo sapiens
gttatctctgtgtt

SEQ ID NO: 4043647 - DNA, 15 bp, Homo sapiens
gttatgactatgtaa

SEQ ID NO: 4043648 - DNA, 17 bp, Homo sapiens
gttatgactatgtaaac

SEQ ID NO: 4043649 - DNA, 21 bp, Homo sapiens
gttatgatattgtttaaaatt

SEQ ID NO: 4043650 - DNA, 15 bp, Homo sapiens
gttatgtctgtttaa

SEQ ID NO: 4043651 - DNA, 14 bp, Homo sapiens
gttattataaatgt

SEQ ID NO: 4043652 - DNA, 21 bp, Homo sapiens
gttattataaatgttagttct

SEQ ID NO: 4043653 - DNA, 14 bp, Homo sapiens
gttattccatcaat

SEQ ID NO: 4043654 - DNA, 17 bp, Homo sapiens
gttattccatcaataaa

SEQ ID NO: 4043655 - DNA, 17 bp, Homo sapiens
gttattccttgatcatt

SEQ ID NO: 4043656 - DNA, 12 bp, Homo sapiens
gttattgttgaa

SEQ ID NO: 4043657 - DNA, 21 bp, Homo sapiens
gttattgttgaacatacttca

SEQ ID NO: 4043658 - DNA, 23 bp, Homo sapiens
gttatttaacagctgaattatct

SEQ ID NO: 4043659 - DNA, 15 bp, Homo sapiens
gttatttaattgaaa

SEQ ID NO: 4043660 - DNA, 14 bp, Homo sapiens
gttatttcttccct

SEQ ID NO: 4043661 - DNA, 17 bp, Homo sapiens
gttatttgtttaccact

SEQ ID NO: 4043662 - DNA, 15 bp, Homo sapiens
gttattttataatca

SEQ ID NO: 4043663 - DNA, 12 bp, Homo sapiens
gttattttctac

SEQ ID NO: 4043664 - DNA, 14 bp, Homo sapiens
gttattttctacag

SEQ ID NO: 4043665 - DNA, 23 bp, Homo sapiens
gttattttctttgaaattgttta

SEQ ID NO: 4043666 - DNA, 15 bp, Homo sapiens
gttattttgataaca

SEQ ID NO: 4043667 - DNA, 15 bp, Homo sapiens
gttattttggatata

SEQ ID NO: 4043668 - DNA, 19 bp, Homo sapiens
gttattttggatatattat

SEQ ID NO: 4043669 - DNA, 21 bp, Homo sapiens
gttattttggatatattattg

SEQ ID NO: 4043670 - DNA, 20 bp, Homo sapiens
gttattttgtgtacaagttg

SEQ ID NO: 4043671 - DNA, 16 bp, Homo sapiens
gttatttttatatcag

SEQ ID NO: 4043672 - DNA, 17 bp, Homo sapiens
gttatttttcaaggaag

SEQ ID NO: 4043673 - DNA, 15 bp, Homo sapiens
gttatttttgtacat

SEQ ID NO: 4043674 - DNA, 22 bp, Homo sapiens
gttcaaatgcattttgggggtt

SEQ ID NO: 4043675 - DNA, 14 bp, Homo sapiens
gttcacaacctagg

SEQ ID NO: 4043676 - DNA, 17 bp, Homo sapiens
gttcacattagaattag

SEQ ID NO: 4043677 - DNA, 16 bp, Homo sapiens
gttcacgcaacttgaa

SEQ ID NO: 4043678 - DNA, 16 bp, Homo sapiens
gttcacgctcacccag

SEQ ID NO: 4043679 - DNA, 15 bp, Homo sapiens
gttcactaaagcagt

SEQ ID NO: 4043680 - DNA, 22 bp, Homo sapiens
gttcactgagctccccagatct

SEQ ID NO: 4043681 - DNA, 17 bp, Homo sapiens
gttcagagccaagcctt

SEQ ID NO: 4043682 - DNA, 23 bp, Homo sapiens
gttcagagccaagccttaaactg

SEQ ID NO: 4043683 - DNA, 16 bp, Homo sapiens
gttcagcactgtccct

SEQ ID NO: 4043684 - DNA, 13 bp, Homo sapiens
gttcagcctggcc

SEQ ID NO: 4043685 - DNA, 15 bp, Homo sapiens
gttcagcctggcctg

SEQ ID NO: 4043686 - DNA, 11 bp, Homo sapiens
gttcagctccc

SEQ ID NO: 4043687 - DNA, 19 bp, Homo sapiens
gttcaggcccggcagggcg

SEQ ID NO: 4043688 - DNA, 20 bp, Homo sapiens
gttcagggaccgtccagggg

SEQ ID NO: 4043689 - DNA, 20 bp, Homo sapiens
gttcaggggactcagccctg

SEQ ID NO: 4043690 - DNA, 22 bp, Homo sapiens
gttcaggtcccacgtctggcca

SEQ ID NO: 4043691 - DNA, 23 bp, Homo sapiens
gttcaggtcccacgtctggccag

SEQ ID NO: 4043692 - DNA, 18 bp, Homo sapiens
gttcagtgtcccaggcag

SEQ ID NO: 4043693 - DNA, 15 bp, Homo sapiens
gttcagtgtttctgg

SEQ ID NO: 4043694 - DNA, 15 bp, Homo sapiens
gttcatccaatcctc

SEQ ID NO: 4043695 - DNA, 13 bp, Homo sapiens
gttcatctgtcca

SEQ ID NO: 4043696 - DNA, 14 bp, Homo sapiens
gttcatgtttgctt

SEQ ID NO: 4043697 - DNA, 16 bp, Homo sapiens
gttcattgcactttga

SEQ ID NO: 4043698 - DNA, 23 bp, Homo sapiens
gttccaaagccagtgaaatgtga

SEQ ID NO: 4043699 - DNA, 14 bp, Homo sapiens
gttccaaattcagt

SEQ ID NO: 4043700 - DNA, 15 bp, Homo sapiens
gttccaaccaggcag

SEQ ID NO: 4043701 - DNA, 21 bp, Homo sapiens
gttccaagacattgtcaataa

SEQ ID NO: 4043702 - DNA, 18 bp, Homo sapiens
gttccagaggtattcctc

SEQ ID NO: 4043703 - DNA, 16 bp, Homo sapiens
gttccagctctttgaa

SEQ ID NO: 4043704 - DNA, 21 bp, Homo sapiens
gttccaggcctgatcttgcct

SEQ ID NO: 4043705 - DNA, 15 bp, Homo sapiens
gttccatgcctgagg

SEQ ID NO: 4043706 - DNA, 23 bp, Homo sapiens
gttccattgaagccgactctggc

SEQ ID NO: 4043707 - DNA, 21 bp, Homo sapiens
gttcccagatggctggaaggg

SEQ ID NO: 4043708 - DNA, 18 bp, Homo sapiens
gttcccatgtagccccct

SEQ ID NO: 4043709 - DNA, 12 bp, Homo sapiens
gttccccagaga

SEQ ID NO: 4043710 - DNA, 23 bp, Homo sapiens
gttccccatctgggtccttgcac

SEQ ID NO: 4043711 - DNA, 12 bp, Homo sapiens
gttcccccagca

SEQ ID NO: 4043712 - DNA, 13 bp, Homo sapiens
gttcccccagcaa

SEQ ID NO: 4043713 - DNA, 17 bp, Homo sapiens
gttcccctgttcactct

SEQ ID NO: 4043714 - DNA, 14 bp, Homo sapiens
gttcccgtttctcc

SEQ ID NO: 4043715 - DNA, 17 bp, Homo sapiens
gttccctcctagctctc

SEQ ID NO: 4043716 - DNA, 20 bp, Homo sapiens
gttccctcctagctctccca

SEQ ID NO: 4043717 - DNA, 16 bp, Homo sapiens
gttccctctgctcagc

SEQ ID NO: 4043718 - DNA, 17 bp, Homo sapiens
gttccctctgctcagcc

SEQ ID NO: 4043719 - DNA, 18 bp, Homo sapiens
gttccctctgctcagcca

SEQ ID NO: 4043720 - DNA, 21 bp, Homo sapiens
gttccctctgctcctggagcc

SEQ ID NO: 4043721 - DNA, 19 bp, Homo sapiens
gttccctcttctaacccaa

SEQ ID NO: 4043722 - DNA, 15 bp, Homo sapiens
gttcccttggcctca

SEQ ID NO: 4043723 - DNA, 18 bp, Homo sapiens
gttcccttggcctcagaa

SEQ ID NO: 4043724 - DNA, 19 bp, Homo sapiens
gttcccttggcctcagaat

SEQ ID NO: 4043725 - DNA, 19 bp, Homo sapiens
gttccctttccttccatcc

SEQ ID NO: 4043726 - DNA, 18 bp, Homo sapiens
gttccgcactttccactt

SEQ ID NO: 4043727 - DNA, 18 bp, Homo sapiens
gttcctattgtcattaaa

SEQ ID NO: 4043728 - DNA, 20 bp, Homo sapiens
gttcctcaaattttttgact

SEQ ID NO: 4043729 - DNA, 20 bp, Homo sapiens
gttcctcatctgagaggctc

SEQ ID NO: 4043730 - DNA, 21 bp, Homo sapiens
gttcctcatctgagaggctct

SEQ ID NO: 4043731 - DNA, 17 bp, Homo sapiens
gtacatatgtaaacata

SEQ ID NO: 4043732 - DNA, 19 bp, Homo sapiens
gtacatggaataacatgta

SEQ ID NO: 4043733 - DNA, 17 bp, Homo sapiens
gtacattcaatgtttat

SEQ ID NO: 4043734 - DNA, 18 bp, Homo sapiens
gtacattcaatgtttatg

SEQ ID NO: 4043735 - DNA, 15 bp, Homo sapiens
gtacatttataattg

SEQ ID NO: 4043736 - DNA, 19 bp, Homo sapiens
gtacatttatttattactg

SEQ ID NO: 4043737 - DNA, 20 bp, Homo sapiens
gtacatttatttattactgt

SEQ ID NO: 4043738 - DNA, 13 bp, Homo sapiens
gtaccaaagtttt

SEQ ID NO: 4043739 - DNA, 18 bp, Homo sapiens
gtaccaaagttttatcaa

SEQ ID NO: 4043740 - DNA, 17 bp, Homo sapiens
gtaccaaatctgacata

SEQ ID NO: 4043741 - DNA, 20 bp, Homo sapiens
gtaccaaatctgacatatta

SEQ ID NO: 4043742 - DNA, 21 bp, Homo sapiens
gtaccaatcattttaattatt

SEQ ID NO: 4043743 - DNA, 13 bp, Homo sapiens
gtaccagccccac

SEQ ID NO: 4043744 - DNA, 16 bp, Homo sapiens
gtaccagctgcgcttg

SEQ ID NO: 4043745 - DNA, 19 bp, Homo sapiens
gtaccagctgcgcttgctt

SEQ ID NO: 4043746 - DNA, 17 bp, Homo sapiens
gtaccaggggctgggct

SEQ ID NO: 4043747 - DNA, 21 bp, Homo sapiens
gtaccaggggctgggctccct

SEQ ID NO: 4043748 - DNA, 22 bp, Homo sapiens
gtacccattctgttttccccca

SEQ ID NO: 4043749 - DNA, 17 bp, Homo sapiens
gtaccctcctggctctt

SEQ ID NO: 4043750 - DNA, 22 bp, Homo sapiens
gtaccctttaagatatccatct

SEQ ID NO: 4043751 - DNA, 20 bp, Homo sapiens
gtacctataaagtaaagcta

SEQ ID NO: 4043752 - DNA, 21 bp, Homo sapiens
gtacctataaagtaaagctaa

SEQ ID NO: 4043753 - DNA, 22 bp, Homo sapiens
gtacctcatgggaagcatgtgg

SEQ ID NO: 4043754 - DNA, 19 bp, Homo sapiens
gtacctcctctcagtgttt

SEQ ID NO: 4043755 - DNA, 12 bp, Homo sapiens
gtacctctcaag

SEQ ID NO: 4043756 - DNA, 15 bp, Homo sapiens
gtacctgatgtacct

SEQ ID NO: 4043757 - DNA, 12 bp, Homo sapiens
gtacctgctgcc

SEQ ID NO: 4043758 - DNA, 17 bp, Homo sapiens
gtacggattttcagtta

SEQ ID NO: 4043759 - DNA, 12 bp, Homo sapiens
gtacgtcccaca

SEQ ID NO: 4043760 - DNA, 17 bp, Homo sapiens
gtacgtcctgcctggca

SEQ ID NO: 4043761 - DNA, 15 bp, Homo sapiens
gtactactagatgtc

SEQ ID NO: 4043762 - DNA, 13 bp, Homo sapiens
gtactatgtatca

SEQ ID NO: 4043763 - DNA, 17 bp, Homo sapiens
gtactatgtatcaatga

SEQ ID NO: 4043764 - DNA, 14 bp, Homo sapiens
gtactcctcccagg

SEQ ID NO: 4043765 - DNA, 16 bp, Homo sapiens
gtactcctgcaaaatt

SEQ ID NO: 4043766 - DNA, 21 bp, Homo sapiens
gtactcctgcaaaattttata

SEQ ID NO: 4043767 - DNA, 21 bp, Homo sapiens
gtactctgaaacacactgaaa

SEQ ID NO: 4043768 - DNA, 23 bp, Homo sapiens
gtactgaaagccttagggaagct

SEQ ID NO: 4043769 - DNA, 18 bp, Homo sapiens
gtactgaatttttttgta

SEQ ID NO: 4043770 - DNA, 14 bp, Homo sapiens
gtactgactttgct

SEQ ID NO: 4043771 - DNA, 17 bp, Homo sapiens
gtactgactttgcttgc

SEQ ID NO: 4043772 - DNA, 16 bp, Homo sapiens
gtactgagccttgtaa

SEQ ID NO: 4043773 - DNA, 21 bp, Homo sapiens
gtactgtatggaaacactgat

SEQ ID NO: 4043774 - DNA, 17 bp, Homo sapiens
gtactgttcggaagggg

SEQ ID NO: 4043775 - DNA, 17 bp, Homo sapiens
gtacttagagtttctgt

SEQ ID NO: 4043776 - DNA, 19 bp, Homo sapiens
gtacttagagtttctgttt

SEQ ID NO: 4043777 - DNA, 21 bp, Homo sapiens
gtacttcccgggccagggctg

SEQ ID NO: 4043778 - DNA, 22 bp, Homo sapiens
gtacttcccgggccagggctgc

SEQ ID NO: 4043779 - DNA, 22 bp, Homo sapiens
gtacttgaaatctaggattatt

SEQ ID NO: 4043780 - DNA, 23 bp, Homo sapiens
gtacttgaagtctaaaagcagaa

SEQ ID NO: 4043781 - DNA, 16 bp, Homo sapiens
gtacttgtgtttgctt

SEQ ID NO: 4043782 - DNA, 20 bp, Homo sapiens
gtactttccacaaatctata

SEQ ID NO: 4043783 - DNA, 19 bp, Homo sapiens
gtacttttgagtgtgtgtg

SEQ ID NO: 4043784 - DNA, 22 bp, Homo sapiens
gtacttttgagtgtgtgtgtgc

SEQ ID NO: 4043785 - DNA, 24 bp, Homo sapiens
gtacttttgagtgtgtgtgtgcat

SEQ ID NO: 4043786 - DNA, 23 bp, Homo sapiens
gtagaaagatccttcgggtgctg

SEQ ID NO: 4043787 - DNA, 20 bp, Homo sapiens
gtagaaatatctgaaaatgt

SEQ ID NO: 4043788 - DNA, 21 bp, Homo sapiens
gtagaaatatctgaaaatgta

SEQ ID NO: 4043789 - DNA, 23 bp, Homo sapiens
gtagaaattttacaataggtgct

SEQ ID NO: 4043790 - DNA, 15 bp, Homo sapiens
gtagaacactaattc

SEQ ID NO: 4043791 - DNA, 18 bp, Homo sapiens
gtagaacactaattcata

SEQ ID NO: 4043792 - DNA, 19 bp, Homo sapiens
gtagaacgtaaccacggaa

SEQ ID NO: 4043793 - DNA, 16 bp, Homo sapiens
gtagaactcactctgg

SEQ ID NO: 4043794 - DNA, 20 bp, Homo sapiens
gtagaactcactctgggctg

SEQ ID NO: 4043795 - DNA, 21 bp, Homo sapiens
gtagaactcactctgggctgt

SEQ ID NO: 4043796 - DNA, 17 bp, Homo sapiens
gtagaactccaggccct

SEQ ID NO: 4043797 - DNA, 18 bp, Homo sapiens
gtagaagcattccttctt

SEQ ID NO: 4043798 - DNA, 21 bp, Homo sapiens
gtagaagcattccttctttga

SEQ ID NO: 4043799 - DNA, 19 bp, Homo sapiens
gtagaatgattaatcaaag

SEQ ID NO: 4043800 - DNA, 15 bp, Homo sapiens
gtagaattgcattga

SEQ ID NO: 4043801 - DNA, 16 bp, Homo sapiens
gtagacctagggagga

SEQ ID NO: 4043802 - DNA, 17 bp, Homo sapiens
gtagacctagggaggac

SEQ ID NO: 4043803 - DNA, 14 bp, Homo sapiens
gtagagcaaaacta

SEQ ID NO: 4043804 - DNA, 14 bp, Homo sapiens
gtagagttaagaag

SEQ ID NO: 4043805 - DNA, 16 bp, Homo sapiens
gtagagttaagaagct

SEQ ID NO: 4043806 - DNA, 23 bp, Homo sapiens
gtagagttgctgagagggctcga

SEQ ID NO: 4043807 - DNA, 20 bp, Homo sapiens
gtagagtttgaaggaggtga

SEQ ID NO: 4043808 - DNA, 15 bp, Homo sapiens
gtagataaataatgt

SEQ ID NO: 4043809 - DNA, 13 bp, Homo sapiens
gtagatagaaata

SEQ ID NO: 4043810 - DNA, 16 bp, Homo sapiens
gtagatattgttttct

SEQ ID NO: 4043811 - DNA, 19 bp, Homo sapiens
gtagatgcatgacttgtgt

SEQ ID NO: 4043812 - DNA, 21 bp, Homo sapiens
gtagatgggagggaggctcag

SEQ ID NO: 4043813 - DNA, 20 bp, Homo sapiens
gtagatgtgcaatagaaata

SEQ ID NO: 4043814 - DNA, 21 bp, Homo sapiens
gtagatgtgcatttttgtgaa

SEQ ID NO: 4043815 - DNA, 11 bp, Homo sapiens
gtagcactgag

SEQ ID NO: 4043816 - DNA, 12 bp, Homo sapiens
gtagccacagct

SEQ ID NO: 4043817 - DNA, 21 bp, Homo sapiens
gtagccacagctgctgttctc

SEQ ID NO: 4043818 - DNA, 14 bp, Homo sapiens
gtagccagcacctg

SEQ ID NO: 4043819 - DNA, 15 bp, Homo sapiens
gtagccatctgcaca

SEQ ID NO: 4043820 - DNA, 14 bp, Homo sapiens
gtagccatggctgg

SEQ ID NO: 4043821 - DNA, 15 bp, Homo sapiens
gtagcccagcactgt

SEQ ID NO: 4043822 - DNA, 17 bp, Homo sapiens
gtagccccctggcctct

SEQ ID NO: 4043823 - DNA, 18 bp, Homo sapiens
gtagccccctggcctctg

SEQ ID NO: 4043824 - DNA, 23 bp, Homo sapiens
gtggaggggtgtggcagtggttt

SEQ ID NO: 4043825 - DNA, 22 bp, Homo sapiens
gtggagtcagcctcgcaggcct

SEQ ID NO: 4043826 - DNA, 16 bp, Homo sapiens
gtggagtctccctctg

SEQ ID NO: 4043827 - DNA, 15 bp, Homo sapiens
gtggatcccctgcgg

SEQ ID NO: 4043828 - DNA, 14 bp, Homo sapiens
gtggatgacacaat

SEQ ID NO: 4043829 - DNA, 16 bp, Homo sapiens
gtggatgacagggcag

SEQ ID NO: 4043830 - DNA, 16 bp, Homo sapiens
gtggatgaggagacag

SEQ ID NO: 4043831 - DNA, 18 bp, Homo sapiens
gtggatggccgtggatgc

SEQ ID NO: 4043832 - DNA, 15 bp, Homo sapiens
gtggatgggaatttg

SEQ ID NO: 4043833 - DNA, 23 bp, Homo sapiens
gtggtccagctcttggcccctgt

SEQ ID NO: 4043834 - DNA, 15 bp, Homo sapiens
gtggtcctgagacct

SEQ ID NO: 4043835 - DNA, 18 bp, Homo sapiens
gtggtctgaatgttctga

SEQ ID NO: 4043836 - DNA, 15 bp, Homo sapiens
gtggtctttgtaaga

SEQ ID NO: 4043837 - DNA, 23 bp, Homo sapiens
gtggtgagcagaagtggagctgg

SEQ ID NO: 4043838 - DNA, 14 bp, Homo sapiens
gtggtggcctcagc

SEQ ID NO: 4043839 - DNA, 18 bp, Homo sapiens
gtggtggcctggtccctg

SEQ ID NO: 4043840 - DNA, 21 bp, Homo sapiens
gtggtgggcattctctctcca

SEQ ID NO: 4043841 - DNA, 22 bp, Homo sapiens
gtggtgggttctttggaaggag

SEQ ID NO: 4043842 - DNA, 11 bp, Homo sapiens
gtggtgtaaag

SEQ ID NO: 4043843 - DNA, 19 bp, Homo sapiens
gtggtgtaaagctggccct

SEQ ID NO: 4043844 - DNA, 14 bp, Homo sapiens
gtggttaggcagca

SEQ ID NO: 4043845 - DNA, 18 bp, Homo sapiens
gtggttattagcaaggct

SEQ ID NO: 4043846 - DNA, 13 bp, Homo sapiens
gtggttcctctgc

SEQ ID NO: 4043847 - DNA, 14 bp, Homo sapiens
gtggttctatttta

SEQ ID NO: 4043848 - DNA, 15 bp, Homo sapiens
gtggttctcatttgg

SEQ ID NO: 4043849 - DNA, 15 bp, Homo sapiens
gtgtaaaatgtgaag

SEQ ID NO: 4043850 - DNA, 16 bp, Homo sapiens
gtgtaaagctggccct

SEQ ID NO: 4043851 - DNA, 19 bp, Homo sapiens
gtgtaaagctggccctgcc

SEQ ID NO: 4043852 - DNA, 22 bp, Homo sapiens
gtgtaaagctggccctgcctcc

SEQ ID NO: 4043853 - DNA, 17 bp, Homo sapiens
gtgtaaatatgtacatt

SEQ ID NO: 4043854 - DNA, 22 bp, Homo sapiens
gtgtaaatatgtacatttgtct

SEQ ID NO: 4043855 - DNA, 15 bp, Homo sapiens
gtgtaacagctgagg

SEQ ID NO: 4043856 - DNA, 13 bp, Homo sapiens
gtgtaacttcctg

SEQ ID NO: 4043857 - DNA, 15 bp, Homo sapiens
gtgtaacttgcttaa

SEQ ID NO: 4043858 - DNA, 21 bp, Homo sapiens
gtgtaagtattcttatttaat

SEQ ID NO: 4043859 - DNA, 12 bp, Homo sapiens
gtgtaataagac

SEQ ID NO: 4043860 - DNA, 13 bp, Homo sapiens
gtgtaataagaca

SEQ ID NO: 4043861 - DNA, 16 bp, Homo sapiens
gtgtacaatgtacaca

SEQ ID NO: 4043862 - DNA, 15 bp, Homo sapiens
gtgtacactaacatt

SEQ ID NO: 4043863 - DNA, 12 bp, Homo sapiens
gtgtacatatgt

SEQ ID NO: 4043864 - DNA, 22 bp, Homo sapiens
gtgtacatggaataacatgtaa

SEQ ID NO: 4043865 - DNA, 19 bp, Homo sapiens
gtgtacttcccgggccagg

SEQ ID NO: 4043866 - DNA, 15 bp, Homo sapiens
gtgtagaacactaat

SEQ ID NO: 4043867 - DNA, 14 bp, Homo sapiens
gtgtagaagcattc

SEQ ID NO: 4043868 - DNA, 17 bp, Homo sapiens
gtgtagaagcattcctt

SEQ ID NO: 4043869 - DNA, 23 bp, Homo sapiens
gtgtagaagcattccttctttga

SEQ ID NO: 4043870 - DNA, 15 bp, Homo sapiens
gtgtagagttaagaa

SEQ ID NO: 4043871 - DNA, 17 bp, Homo sapiens
gtgtagagttaagaagc

SEQ ID NO: 4043872 - DNA, 21 bp, Homo sapiens
gtgtagccaggtatggctctg

SEQ ID NO: 4043873 - DNA, 11 bp, Homo sapiens
gtgtagccttt

SEQ ID NO: 4043874 - DNA, 13 bp, Homo sapiens
gtgtagccttttt

SEQ ID NO: 4043875 - DNA, 22 bp, Homo sapiens
gtgtatcaggtcagggacttgg

SEQ ID NO: 4043876 - DNA, 19 bp, Homo sapiens
gtgtatttattttacagct

SEQ ID NO: 4043877 - DNA, 19 bp, Homo sapiens
gtgtatttccagtgcaatt

SEQ ID NO: 4043878 - DNA, 19 bp, Homo sapiens
gtgtatttcttatacgctt

SEQ ID NO: 4043879 - DNA, 23 bp, Homo sapiens
gtgtatttttcaataaagcattt

SEQ ID NO: 4043880 - DNA, 21 bp, Homo sapiens
gtgtcaacacccctgtgtgga

SEQ ID NO: 4043881 - DNA, 10 bp, Homo sapiens
gtgtcacagt

SEQ ID NO: 4043882 - DNA, 13 bp, Homo sapiens
gtgtcacctctct

SEQ ID NO: 4043883 - DNA, 16 bp, Homo sapiens
gtgtcacctctctcag

SEQ ID NO: 4043884 - DNA, 18 bp, Homo sapiens
gtgtcacctctctcagag

SEQ ID NO: 4043885 - DNA, 18 bp, Homo sapiens
gtgtcatggactgttgcc

SEQ ID NO: 4043886 - DNA, 18 bp, Homo sapiens
gtgtcatttatgaaaaga

SEQ ID NO: 4043887 - DNA, 13 bp, Homo sapiens
gtgtcatttcaaa

SEQ ID NO: 4043888 - DNA, 23 bp, Homo sapiens
gtgtcccaggcagcacagtgtgt

SEQ ID NO: 4043889 - DNA, 22 bp, Homo sapiens
gtgtcccccccaggccttgtcc

SEQ ID NO: 4043890 - DNA, 20 bp, Homo sapiens
gtgtcccctcactctgtcag

SEQ ID NO: 4043891 - DNA, 13 bp, Homo sapiens
gtgtcctgcctgt

SEQ ID NO: 4043892 - DNA, 18 bp, Homo sapiens
gtgtctcttttctctttc

SEQ ID NO: 4043893 - DNA, 22 bp, Homo sapiens
gtgtctcttttctctttctcct

SEQ ID NO: 4043894 - DNA, 14 bp, Homo sapiens
gtgtctgcacccag

SEQ ID NO: 4043895 - DNA, 15 bp, Homo sapiens
gtgtctgctaatgta

SEQ ID NO: 4043896 - DNA, 13 bp, Homo sapiens
gtgtctgtattta

SEQ ID NO: 4043897 - DNA, 14 bp, Homo sapiens
gtgtctgtgccatg

SEQ ID NO: 4043898 - DNA, 14 bp, Homo sapiens
gtgtcttaattatt

SEQ ID NO: 4043899 - DNA, 12 bp, Homo sapiens
gtgtcttagcat

SEQ ID NO: 4043900 - DNA, 13 bp, Homo sapiens
gtgtcttccataa

SEQ ID NO: 4043901 - DNA, 17 bp, Homo sapiens
gtgtcttcctagaattc

SEQ ID NO: 4043902 - DNA, 17 bp, Homo sapiens
gtgtctttatagatgta

SEQ ID NO: 4043903 - DNA, 21 bp, Homo sapiens
gtgtgaacacataaggacgtg

SEQ ID NO: 4043904 - DNA, 20 bp, Homo sapiens
gtgtgaactcaccctgggag

SEQ ID NO: 4043905 - DNA, 22 bp, Homo sapiens
gtgtgaactcaccctgggagcc

SEQ ID NO: 4043906 - DNA, 23 bp, Homo sapiens
gtgtgaactcaccctgggagcca

SEQ ID NO: 4043907 - DNA, 23 bp, Homo sapiens
gtgtgacagggccagtggggcct

SEQ ID NO: 4043908 - DNA, 14 bp, Homo sapiens
gtgtgaccccactg

SEQ ID NO: 4043909 - DNA, 18 bp, Homo sapiens
gtgtgaggagctgctggc

SEQ ID NO: 4043910 - DNA, 14 bp, Homo sapiens
gtgtgagtgtgaca

SEQ ID NO: 4043911 - DNA, 19 bp, Homo sapiens
gtgtgagtgtgacagggcc

SEQ ID NO: 4043912 - DNA, 15 bp, Homo sapiens
gtgtgattgcacaga

SEQ ID NO: 4043913 - DNA, 16 bp, Homo sapiens
gtgtggactgtgatgc

SEQ ID NO: 4043914 - DNA, 21 bp, Homo sapiens
gtgtggagaccctgccacagc

SEQ ID NO: 4043915 - DNA, 22 bp, Homo sapiens
gtgtggatcttgccacatttct

SEQ ID NO: 4043916 - DNA, 23 bp, Homo sapiens
gtgtggatcttgccacatttctg

SEQ ID NO: 4043917 - DNA, 15 bp, Homo sapiens
gtgtggcagagagag

SEQ ID NO: 4043918 - DNA, 12 bp, Homo sapiens
gtgtggcctcag

SEQ ID NO: 4043919 - DNA, 16 bp, Homo sapiens
gtgtggcctcagccct

SEQ ID NO: 4043920 - DNA, 15 bp, Homo sapiens
gtgtggctgaggagg

SEQ ID NO: 4043921 - DNA, 19 bp, Homo sapiens
gtgtggggacacagcagtg

SEQ ID NO: 4043922 - DNA, 23 bp, Homo sapiens
gtgtgggtgtcctgcctgtctgc

SEQ ID NO: 4043923 - DNA, 15 bp, Homo sapiens
gtgtgggttctacag

SEQ ID NO: 4043924 - DNA, 14 bp, Homo sapiens
gtgtggtccatgcc

SEQ ID NO: 4043925 - DNA, 21 bp, Homo sapiens
gtgtggtccatgcccactgct

SEQ ID NO: 4043926 - DNA, 21 bp, Homo sapiens
gtgtggtgaggggctttctct

SEQ ID NO: 4043927 - DNA, 13 bp, Homo sapiens
gtgtggtgcagtg

SEQ ID NO: 4043928 - DNA, 19 bp, Homo sapiens
gtgtggtgcagtgtgaaaa

SEQ ID NO: 4043929 - DNA, 23 bp, Homo sapiens
gtgagctggggactcagggaccg

SEQ ID NO: 4043930 - DNA, 17 bp, Homo sapiens
gtgaggaatgctctgtg

SEQ ID NO: 4043931 - DNA, 20 bp, Homo sapiens
gtgaggacctgtaaggcagg

SEQ ID NO: 4043932 - DNA, 13 bp, Homo sapiens
gtgaggagctggg

SEQ ID NO: 4043933 - DNA, 13 bp, Homo sapiens
gtgaggaggaaaa

SEQ ID NO: 4043934 - DNA, 18 bp, Homo sapiens
gtgaggaggaaaaggaaa

SEQ ID NO: 4043935 - DNA, 14 bp, Homo sapiens
gtgaggctgtcctg

SEQ ID NO: 4043936 - DNA, 16 bp, Homo sapiens
gtgaggctgtcctgta

SEQ ID NO: 4043937 - DNA, 22 bp, Homo sapiens
gtgagggacatgctcacctcta

SEQ ID NO: 4043938 - DNA, 17 bp, Homo sapiens
gtgagggagggctgtca

SEQ ID NO: 4043939 - DNA, 21 bp, Homo sapiens
gtgagggaggggaaaagcatt

SEQ ID NO: 4043940 - DNA, 14 bp, Homo sapiens
gtgaggtgctgatg

SEQ ID NO: 4043941 - DNA, 19 bp, Homo sapiens
gtgaggtgtgcctggcctc

SEQ ID NO: 4043942 - DNA, 21 bp, Homo sapiens
gtgaggtgtgcctggcctctg

SEQ ID NO: 4043943 - DNA, 15 bp, Homo sapiens
gtgagtaagagctgg

SEQ ID NO: 4043944 - DNA, 16 bp, Homo sapiens
gtgagtaagagctggt

SEQ ID NO: 4043945 - DNA, 18 bp, Homo sapiens
gtgagtaatcaatacaga

SEQ ID NO: 4043946 - DNA, 18 bp, Homo sapiens
gtgagtaattttggattt

SEQ ID NO: 4043947 - DNA, 16 bp, Homo sapiens
gtgagtcacctgctcc

SEQ ID NO: 4043948 - DNA, 23 bp, Homo sapiens
gtgagtcacctgctccagaagat

SEQ ID NO: 4043949 - DNA, 14 bp, Homo sapiens
gtgagtcatttaaa

SEQ ID NO: 4043950 - DNA, 14 bp, Homo sapiens
gtgagtcctccaga

SEQ ID NO: 4043951 - DNA, 16 bp, Homo sapiens
gtgagtcctccagaac

SEQ ID NO: 4043952 - DNA, 17 bp, Homo sapiens
gtgagtcctccagaact

SEQ ID NO: 4043953 - DNA, 18 bp, Homo sapiens
gtgagtcctccagaactc

SEQ ID NO: 4043954 - DNA, 17 bp, Homo sapiens
gtgagtgccttttgcag

SEQ ID NO: 4043955 - DNA, 14 bp, Homo sapiens
gtgagtgtgacagg

SEQ ID NO: 4043956 - DNA, 15 bp, Homo sapiens
gtgagtgtgacaggg

SEQ ID NO: 4043957 - DNA, 16 bp, Homo sapiens
gtgagtgtgacagggc

SEQ ID NO: 4043958 - DNA, 18 bp, Homo sapiens
gtgagtgtgacagggcca

SEQ ID NO: 4043959 - DNA, 17 bp, Homo sapiens
gtgagtgtttttatctt

SEQ ID NO: 4043960 - DNA, 22 bp, Homo sapiens
gtgagttctccctgtacagtgt

SEQ ID NO: 4043961 - DNA, 17 bp, Homo sapiens
gtgagtttgagctgcct

SEQ ID NO: 4043962 - DNA, 15 bp, Homo sapiens
gtgataatttaagag

SEQ ID NO: 4043963 - DNA, 16 bp, Homo sapiens
gtgataggcccaaggt

SEQ ID NO: 4043964 - DNA, 23 bp, Homo sapiens
gtgataggcccaaggtcccctcc

SEQ ID NO: 4043965 - DNA, 18 bp, Homo sapiens
gtgatatacaaagtgtac

SEQ ID NO: 4043966 - DNA, 20 bp, Homo sapiens
gtgatcaatatttttatatc

SEQ ID NO: 4043967 - DNA, 21 bp, Homo sapiens
gtgatccatccatctccaggg

SEQ ID NO: 4043968 - DNA, 22 bp, Homo sapiens
gtgatccgcctacctcagcctc

SEQ ID NO: 4043969 - DNA, 12 bp, Homo sapiens
gtgatctccata

SEQ ID NO: 4043970 - DNA, 19 bp, Homo sapiens
gtgatgaatcaatgaaaaa

SEQ ID NO: 4043971 - DNA, 14 bp, Homo sapiens
gtgatgatgctgtg

SEQ ID NO: 4043972 - DNA, 19 bp, Homo sapiens
gtgatggcgaaagagggta

SEQ ID NO: 4043973 - DNA, 18 bp, Homo sapiens
gtgatgtcttttcttggc

SEQ ID NO: 4043974 - DNA, 14 bp, Homo sapiens
gtgatgtttgctct

SEQ ID NO: 4043975 - DNA, 14 bp, Homo sapiens
gtgatgtttgtcct

SEQ ID NO: 4043976 - DNA, 16 bp, Homo sapiens
gtgattgacacacagc

SEQ ID NO: 4043977 - DNA, 13 bp, Homo sapiens
gtgattgcacaga

SEQ ID NO: 4043978 - DNA, 13 bp, Homo sapiens
gtgattgcagctt

SEQ ID NO: 4043979 - DNA, 19 bp, Homo sapiens
gtgattgcagctttatgtt

SEQ ID NO: 4043980 - DNA, 14 bp, Homo sapiens
gtgattgtggaatg

SEQ ID NO: 4043981 - DNA, 21 bp, Homo sapiens
gtgattttatgatcagtgttg

SEQ ID NO: 4043982 - DNA, 20 bp, Homo sapiens
gtgattttcctttgtagcta

SEQ ID NO: 4043983 - DNA, 16 bp, Homo sapiens
gtgcaaggtggccttt

SEQ ID NO: 4043984 - DNA, 17 bp, Homo sapiens
gtgcaaggtggcctttg

SEQ ID NO: 4043985 - DNA, 22 bp, Homo sapiens
gtgcaataaatctgacccagtg

SEQ ID NO: 4043986 - DNA, 21 bp, Homo sapiens
gtgcaatgtctgagtgaacct

SEQ ID NO: 4043987 - DNA, 18 bp, Homo sapiens
gtgcacaaaacccagacc

SEQ ID NO: 4043988 - DNA, 12 bp, Homo sapiens
gtgcacaggcag

SEQ ID NO: 4043989 - DNA, 23 bp, Homo sapiens
gtgcacccatgggctctgacaga

SEQ ID NO: 4043990 - DNA, 16 bp, Homo sapiens
gtgcacccggcctgga

SEQ ID NO: 4043991 - DNA, 13 bp, Homo sapiens
gtgcacctgcccc

SEQ ID NO: 4043992 - DNA, 15 bp, Homo sapiens
gtgcacgtggagagc

SEQ ID NO: 4043993 - DNA, 20 bp, Homo sapiens
gtgcactctgctaatcatgt

SEQ ID NO: 4043994 - DNA, 12 bp, Homo sapiens
gtgcagaataat

SEQ ID NO: 4043995 - DNA, 16 bp, Homo sapiens
gtgcagaataatggaa

SEQ ID NO: 4043996 - DNA, 20 bp, Homo sapiens
gtgcagaataatggaaacat

SEQ ID NO: 4043997 - DNA, 13 bp, Homo sapiens
gtgcagacaggcc

SEQ ID NO: 4043998 - DNA, 15 bp, Homo sapiens
gtgcagagaagctgg

SEQ ID NO: 4043999 - DNA, 20 bp, Homo sapiens
gtgcagagaagctggacttc

SEQ ID NO: 4044000 - DNA, 23 bp, Homo sapiens
gtgcagatgagcagtcacactgt

SEQ ID NO: 4044001 - DNA, 14 bp, Homo sapiens
gtgcagccttctcc

SEQ ID NO: 4044002 - DNA, 12 bp, Homo sapiens
gtgcagctgatt

SEQ ID NO: 4044003 - DNA, 16 bp, Homo sapiens
gtgcagggctggtttg

SEQ ID NO: 4044004 - DNA, 16 bp, Homo sapiens
gtgcaggtgggcactg

SEQ ID NO: 4044005 - DNA, 22 bp, Homo sapiens
gtgcagtatcatgccctgtgca

SEQ ID NO: 4044006 - DNA, 15 bp, Homo sapiens
gtgcagttgacagca

SEQ ID NO: 4044007 - DNA, 19 bp, Homo sapiens
gtgcagttgacagcaggtg

SEQ ID NO: 4044008 - DNA, 20 bp, Homo sapiens
gtgcagttgacagcaggtgg

SEQ ID NO: 4044009 - DNA, 14 bp, Homo sapiens
gtgcataatgataa

SEQ ID NO: 4044010 - DNA, 19 bp, Homo sapiens
gtgcataatgataaaataa

SEQ ID NO: 4044011 - DNA, 12 bp, Homo sapiens
gtgcatccaaag

SEQ ID NO: 4044012 - DNA, 14 bp, Homo sapiens
gtgcatcccccctg

SEQ ID NO: 4044013 - DNA, 15 bp, Homo sapiens
gtgcatctcagccca

SEQ ID NO: 4044014 - DNA, 18 bp, Homo sapiens
gtgcatctcagcccacat

SEQ ID NO: 4044015 - DNA, 16 bp, Homo sapiens
gtgcatggaggccctc

SEQ ID NO: 4044016 - DNA, 23 bp, Homo sapiens
gtgcattacagagaggagaaaca

SEQ ID NO: 4044017 - DNA, 20 bp, Homo sapiens
gtgcatttttggatcatttt

SEQ ID NO: 4044018 - DNA, 16 bp, Homo sapiens
gtgcatttttgtgaaa

SEQ ID NO: 4044019 - DNA, 16 bp, Homo sapiens
gtgccaaaaccaggcc

SEQ ID NO: 4044020 - DNA, 18 bp, Homo sapiens
gtgccaaaaccaggcctc

SEQ ID NO: 4044021 - DNA, 16 bp, Homo sapiens
gtgccaaatgctgggg

SEQ ID NO: 4044022 - DNA, 17 bp, Homo sapiens
gtgccaaatgctggggc

SEQ ID NO: 4044023 - DNA, 14 bp, Homo sapiens
gtgccaataaccaa

SEQ ID NO: 4044024 - DNA, 17 bp, Homo sapiens
gtgccaatgatgtgacc

SEQ ID NO: 4044025 - DNA, 16 bp, Homo sapiens
gtgccaccaaaagtgc

SEQ ID NO: 4044026 - DNA, 22 bp, Homo sapiens
gtgccactgcccgagctggtgc

SEQ ID NO: 4044027 - DNA, 20 bp, Homo sapiens
gtgccagaaacagtgggagc

SEQ ID NO: 4044028 - DNA, 15 bp, Homo sapiens
gtgccagaggccaga

SEQ ID NO: 4044029 - DNA, 14 bp, Homo sapiens
gtgccagcccagag

SEQ ID NO: 4044030 - DNA, 17 bp, Homo sapiens
gtgccaggactccccag

SEQ ID NO: 4044031 - DNA, 21 bp, Homo sapiens
gtgccaggactccccaggcca

SEQ ID NO: 4044032 - DNA, 14 bp, Homo sapiens
ggtgtctggcctga

SEQ ID NO: 4044033 - DNA, 14 bp, Homo sapiens
ggtgtctttctctt

SEQ ID NO: 4044034 - DNA, 17 bp, Homo sapiens
ggtgtgaacccgggagc

SEQ ID NO: 4044035 - DNA, 22 bp, Homo sapiens
ggtgtgagaagtgccttctcct

SEQ ID NO: 4044036 - DNA, 15 bp, Homo sapiens
ggtgtgcctggcctc

SEQ ID NO: 4044037 - DNA, 15 bp, Homo sapiens
ggtgtggctgtgaag

SEQ ID NO: 4044038 - DNA, 19 bp, Homo sapiens
ggtgtggctttccaggcac

SEQ ID NO: 4044039 - DNA, 15 bp, Homo sapiens
ggtgtggggtggggt

SEQ ID NO: 4044040 - DNA, 16 bp, Homo sapiens
ggtgtgggtggaaggg

SEQ ID NO: 4044041 - DNA, 19 bp, Homo sapiens
ggtgtgggtgtcctgcctg

SEQ ID NO: 4044042 - DNA, 19 bp, Homo sapiens
ggtgtgtggtgaggggctt

SEQ ID NO: 4044043 - DNA, 12 bp, Homo sapiens
ggtgttatttgg

SEQ ID NO: 4044044 - DNA, 22 bp, Homo sapiens
ggtgttatttggaaccttgttt

SEQ ID NO: 4044045 - DNA, 16 bp, Homo sapiens
ggtgttctttcctgcc

SEQ ID NO: 4044046 - DNA, 17 bp, Homo sapiens
ggtgttctttcctgccc

SEQ ID NO: 4044047 - DNA, 14 bp, Homo sapiens
ggtgttgggagccc

SEQ ID NO: 4044048 - DNA, 15 bp, Homo sapiens
ggtgttgtgcatttg

SEQ ID NO: 4044049 - DNA, 22 bp, Homo sapiens
ggtgttttttatgaagtgcgtg

SEQ ID NO: 4044050 - DNA, 13 bp, Homo sapiens
ggttaaggcctga

SEQ ID NO: 4044051 - DNA, 15 bp, Homo sapiens
ggttacaaactgcaa

SEQ ID NO: 4044052 - DNA, 16 bp, Homo sapiens
ggttacagagacctat

SEQ ID NO: 4044053 - DNA, 15 bp, Homo sapiens
ggttacttcttctct

SEQ ID NO: 4044054 - DNA, 23 bp, Homo sapiens
ggttatcgaaataacaatgttaa

SEQ ID NO: 4044055 - DNA, 13 bp, Homo sapiens
ggttatttctctg

SEQ ID NO: 4044056 - DNA, 18 bp, Homo sapiens
ggttcagaattaaacttt

SEQ ID NO: 4044057 - DNA, 17 bp, Homo sapiens
ggttcagacccctgcct

SEQ ID NO: 4044058 - DNA, 12 bp, Homo sapiens
ggttcagcctgg

SEQ ID NO: 4044059 - DNA, 17 bp, Homo sapiens
ggttcagcctggcctgc

SEQ ID NO: 4044060 - DNA, 15 bp, Homo sapiens
ggttcatctgagcaa

SEQ ID NO: 4044061 - DNA, 21 bp, Homo sapiens
ggttcatgtagagaaaagcac

SEQ ID NO: 4044062 - DNA, 18 bp, Homo sapiens
ggttcattattggaatta

SEQ ID NO: 4044063 - DNA, 16 bp, Homo sapiens
ggttccaaccaggcag

SEQ ID NO: 4044064 - DNA, 16 bp, Homo sapiens
ggttccatgcctgagg

SEQ ID NO: 4044065 - DNA, 14 bp, Homo sapiens
ggttcccaataaaa

SEQ ID NO: 4044066 - DNA, 16 bp, Homo sapiens
ggttcccaataaaagt

SEQ ID NO: 4044067 - DNA, 17 bp, Homo sapiens
ggttcccaataaaagtg

SEQ ID NO: 4044068 - DNA, 20 bp, Homo sapiens
ggttcccaataaaagtgact

SEQ ID NO: 4044069 - DNA, 19 bp, Homo sapiens
ggttccctcctagctctcc

SEQ ID NO: 4044070 - DNA, 13 bp, Homo sapiens
ggttccctctgag

SEQ ID NO: 4044071 - DNA, 22 bp, Homo sapiens
ggttccctttccttccatccct

SEQ ID NO: 4044072 - DNA, 15 bp, Homo sapiens
ggttcctctgcctgc

SEQ ID NO: 4044073 - DNA, 19 bp, Homo sapiens
ggttccttcctatgcccag

SEQ ID NO: 4044074 - DNA, 17 bp, Homo sapiens
ggttcgagacccaaacc

SEQ ID NO: 4044075 - DNA, 16 bp, Homo sapiens
ggttctaagtgggaga

SEQ ID NO: 4044076 - DNA, 23 bp, Homo sapiens
ggttctaggcatctctgtacttt

SEQ ID NO: 4044077 - DNA, 16 bp, Homo sapiens
ggttctattttcttaa

SEQ ID NO: 4044078 - DNA, 18 bp, Homo sapiens
ggttctcaggtgttgcca

SEQ ID NO: 4044079 - DNA, 21 bp, Homo sapiens
ggttctgcccttatggagctc

SEQ ID NO: 4044080 - DNA, 19 bp, Homo sapiens
ggttctgcctgccagctgc

SEQ ID NO: 4044081 - DNA, 18 bp, Homo sapiens
ggttcttagttctcactg

SEQ ID NO: 4044082 - DNA, 19 bp, Homo sapiens
ggttcttcagggccagtcc

SEQ ID NO: 4044083 - DNA, 15 bp, Homo sapiens
ggttctttggaagga

SEQ ID NO: 4044084 - DNA, 14 bp, Homo sapiens
ggttgacaggaggt

SEQ ID NO: 4044085 - DNA, 13 bp, Homo sapiens
ggttgagaaatga

SEQ ID NO: 4044086 - DNA, 15 bp, Homo sapiens
ggttgagagccagtg

SEQ ID NO: 4044087 - DNA, 17 bp, Homo sapiens
ggttgagagccagtggc

SEQ ID NO: 4044088 - DNA, 14 bp, Homo sapiens
ggttgcaaccactg

SEQ ID NO: 4044089 - DNA, 14 bp, Homo sapiens
ggttgccaggacga

SEQ ID NO: 4044090 - DNA, 15 bp, Homo sapiens
ggttggcaacaggac

SEQ ID NO: 4044091 - DNA, 14 bp, Homo sapiens
ggttggcagtaagg

SEQ ID NO: 4044092 - DNA, 22 bp, Homo sapiens
ggttggccgtggtccagctctt

SEQ ID NO: 4044093 - DNA, 14 bp, Homo sapiens
ggttggggtgacag

SEQ ID NO: 4044094 - DNA, 13 bp, Homo sapiens
ggttggtagggtg

SEQ ID NO: 4044095 - DNA, 15 bp, Homo sapiens
ggttggttttatttg

SEQ ID NO: 4044096 - DNA, 10 bp, Homo sapiens
ggttgtcaat

SEQ ID NO: 4044097 - DNA, 13 bp, Homo sapiens
ggttgtcaatatt

SEQ ID NO: 4044098 - DNA, 14 bp, Homo sapiens
ggttgtttctgttc

SEQ ID NO: 4044099 - DNA, 16 bp, Homo sapiens
ggtttaattcagcaga

SEQ ID NO: 4044100 - DNA, 22 bp, Homo sapiens
ggtttacattcatctcattcca

SEQ ID NO: 4044101 - DNA, 15 bp, Homo sapiens
ggtttatttttgtaa

SEQ ID NO: 4044102 - DNA, 19 bp, Homo sapiens
ggtttcaccatgttgccca

SEQ ID NO: 4044103 - DNA, 18 bp, Homo sapiens
ggtttctctctacagtgc

SEQ ID NO: 4044104 - DNA, 15 bp, Homo sapiens
ggtttctcttctccc

SEQ ID NO: 4044105 - DNA, 22 bp, Homo sapiens
ggtttctcttctccccttccat

SEQ ID NO: 4044106 - DNA, 19 bp, Homo sapiens
ggtttggggagcagagaca

SEQ ID NO: 4044107 - DNA, 13 bp, Homo sapiens
ggtttgtatattg

SEQ ID NO: 4044108 - DNA, 14 bp, Homo sapiens
ggttttaaactttc

SEQ ID NO: 4044109 - DNA, 18 bp, Homo sapiens
ggttttaggtagaaaaac

SEQ ID NO: 4044110 - DNA, 21 bp, Homo sapiens
ggttttgcactcttgtttctc

SEQ ID NO: 4044111 - DNA, 17 bp, Homo sapiens
ggttttggggaaatgtg

SEQ ID NO: 4044112 - DNA, 20 bp, Homo sapiens
ggttttggggtcctgggctg

SEQ ID NO: 4044113 - DNA, 15 bp, Homo sapiens
ggtttttaaattgtt

SEQ ID NO: 4044114 - DNA, 22 bp, Homo sapiens
ggtttttacctgtcacattgca

SEQ ID NO: 4044115 - DNA, 19 bp, Homo sapiens
ggtttttatttctcctttt

SEQ ID NO: 4044116 - DNA, 12 bp, Homo sapiens
ggtttttctcaa

SEQ ID NO: 4044117 - DNA, 14 bp, Homo sapiens
gtaaaaaatggaaa

SEQ ID NO: 4044118 - DNA, 21 bp, Homo sapiens
gtaaaaaatggaaaaaaacat

SEQ ID NO: 4044119 - DNA, 16 bp, Homo sapiens
gggccatgtccaaaga

SEQ ID NO: 4044120 - DNA, 21 bp, Homo sapiens
gggccatgtccaaagaggctg

SEQ ID NO: 4044121 - DNA, 22 bp, Homo sapiens
gggccatgtccaaagaggctgc

SEQ ID NO: 4044122 - DNA, 18 bp, Homo sapiens
gggccattctccacagca

SEQ ID NO: 4044123 - DNA, 23 bp, Homo sapiens
gggccatttccttttctctgccc

SEQ ID NO: 4044124 - DNA, 23 bp, Homo sapiens
gggcccaagacagatgccccaga

SEQ ID NO: 4044125 - DNA, 20 bp, Homo sapiens
gggcccacagacagatccca

SEQ ID NO: 4044126 - DNA, 15 bp, Homo sapiens
gggcccaccccagcc

SEQ ID NO: 4044127 - DNA, 21 bp, Homo sapiens
gggcccaccccagcctcgcct

SEQ ID NO: 4044128 - DNA, 11 bp, Homo sapiens
gggcccagaac

SEQ ID NO: 4044129 - DNA, 22 bp, Homo sapiens
gggcccagaactgcccccactg

SEQ ID NO: 4044130 - DNA, 16 bp, Homo sapiens
gggcccagagcccagc

SEQ ID NO: 4044131 - DNA, 17 bp, Homo sapiens
gggcccagcccagagcc

SEQ ID NO: 4044132 - DNA, 19 bp, Homo sapiens
gggcccagcccagagccac

SEQ ID NO: 4044133 - DNA, 17 bp, Homo sapiens
gggcccaggggctgtgg

SEQ ID NO: 4044134 - DNA, 22 bp, Homo sapiens
gggccccacctgcagctccctc

SEQ ID NO: 4044135 - DNA, 21 bp, Homo sapiens
gggccccagaccccagggcag

SEQ ID NO: 4044136 - DNA, 21 bp, Homo sapiens
gggccccatcctcatccctga

SEQ ID NO: 4044137 - DNA, 14 bp, Homo sapiens
gggcccccatctca

SEQ ID NO: 4044138 - DNA, 16 bp, Homo sapiens
gggccccgccagggct

SEQ ID NO: 4044139 - DNA, 12 bp, Homo sapiens
gggcccctccac

SEQ ID NO: 4044140 - DNA, 18 bp, Homo sapiens
gggcccctccacgcctcc

SEQ ID NO: 4044141 - DNA, 17 bp, Homo sapiens
gggccctctctctgggc

SEQ ID NO: 4044142 - DNA, 14 bp, Homo sapiens
gggccctctcttct

SEQ ID NO: 4044143 - DNA, 19 bp, Homo sapiens
gggccctgcacctgtgcag

SEQ ID NO: 4044144 - DNA, 11 bp, Homo sapiens
gggccctggcc

SEQ ID NO: 4044145 - DNA, 14 bp, Homo sapiens
gggccctggccagc

SEQ ID NO: 4044146 - DNA, 11 bp, Homo sapiens
gggccctgggc

SEQ ID NO: 4044147 - DNA, 19 bp, Homo sapiens
gggcccttgggacagccag

SEQ ID NO: 4044148 - DNA, 17 bp, Homo sapiens
gggcccttggggctggg

SEQ ID NO: 4044149 - DNA, 18 bp, Homo sapiens
gggcccttggggctgggg

SEQ ID NO: 4044150 - DNA, 18 bp, Homo sapiens
gggccgaatcccctccct

SEQ ID NO: 4044151 - DNA, 16 bp, Homo sapiens
gggccgaggcccagcg

SEQ ID NO: 4044152 - DNA, 20 bp, Homo sapiens
gggccgaggcccagcgggca

SEQ ID NO: 4044153 - DNA, 22 bp, Homo sapiens
gggccgggcacggtcacacggc

SEQ ID NO: 4044154 - DNA, 13 bp, Homo sapiens
gggccgggcaggt

SEQ ID NO: 4044155 - DNA, 18 bp, Homo sapiens
gggccggggaagctgcca

SEQ ID NO: 4044156 - DNA, 19 bp, Homo sapiens
gggccggggaagctgccag

SEQ ID NO: 4044157 - DNA, 13 bp, Homo sapiens
gggccgtgcccag

SEQ ID NO: 4044158 - DNA, 20 bp, Homo sapiens
gggcctagcgatctctcctg

SEQ ID NO: 4044159 - DNA, 23 bp, Homo sapiens
gggcctagcgatctctcctggcc

SEQ ID NO: 4044160 - DNA, 14 bp, Homo sapiens
gggcctccagggcc

SEQ ID NO: 4044161 - DNA, 14 bp, Homo sapiens
gggcctccctcctt

SEQ ID NO: 4044162 - DNA, 16 bp, Homo sapiens
gggcctccctccttgg

SEQ ID NO: 4044163 - DNA, 18 bp, Homo sapiens
gggcctccctccttgggt

SEQ ID NO: 4044164 - DNA, 21 bp, Homo sapiens
gggcctgccgggctgagggcc

SEQ ID NO: 4044165 - DNA, 15 bp, Homo sapiens
gggcctgctggaggc

SEQ ID NO: 4044166 - DNA, 13 bp, Homo sapiens
gggcctggacctg

SEQ ID NO: 4044167 - DNA, 16 bp, Homo sapiens
gggcctggacctgcct

SEQ ID NO: 4044168 - DNA, 15 bp, Homo sapiens
gggcctggagcccca

SEQ ID NO: 4044169 - DNA, 16 bp, Homo sapiens
gggcctggcaggccag

SEQ ID NO: 4044170 - DNA, 16 bp, Homo sapiens
gggcctgtggaatgag

SEQ ID NO: 4044171 - DNA, 18 bp, Homo sapiens
gggccttagtgggccagg

SEQ ID NO: 4044172 - DNA, 22 bp, Homo sapiens
gggccttagtgggccagggctg

SEQ ID NO: 4044173 - DNA, 23 bp, Homo sapiens
gggccttgctacctcaaggggga

SEQ ID NO: 4044174 - DNA, 23 bp, Homo sapiens
gggcgcggccagccccggccctg

SEQ ID NO: 4044175 - DNA, 18 bp, Homo sapiens
gggcgctcagacggcggc

SEQ ID NO: 4044176 - DNA, 20 bp, Homo sapiens
gggcgctcagacggcggcca

SEQ ID NO: 4044177 - DNA, 21 bp, Homo sapiens
gggcgctcagacggcggccag

SEQ ID NO: 4044178 - DNA, 12 bp, Homo sapiens
gggcggctgggt

SEQ ID NO: 4044179 - DNA, 20 bp, Homo sapiens
gggctcaagcaatcctcctg

SEQ ID NO: 4044180 - DNA, 17 bp, Homo sapiens
gggctcacggggcctcc

SEQ ID NO: 4044181 - DNA, 16 bp, Homo sapiens
gggctcagggagggag

SEQ ID NO: 4044182 - DNA, 17 bp, Homo sapiens
gggctcagggagggagg

SEQ ID NO: 4044183 - DNA, 10 bp, Homo sapiens
gggctccccg

SEQ ID NO: 4044184 - DNA, 18 bp, Homo sapiens
gggctcctttctccagcc

SEQ ID NO: 4044185 - DNA, 23 bp, Homo sapiens
gggctctgcaattcccctctgct

SEQ ID NO: 4044186 - DNA, 16 bp, Homo sapiens
gggctgagctgcctgt

SEQ ID NO: 4044187 - DNA, 23 bp, Homo sapiens
gggctgagctggggacctggtac

SEQ ID NO: 4044188 - DNA, 17 bp, Homo sapiens
gggctgccaccagcccc

SEQ ID NO: 4044189 - DNA, 14 bp, Homo sapiens
gggctgccctggtg

SEQ ID NO: 4044190 - DNA, 14 bp, Homo sapiens
gggctgctcctcat

SEQ ID NO: 4044191 - DNA, 15 bp, Homo sapiens
gggctggaggcccag

SEQ ID NO: 4044192 - DNA, 16 bp, Homo sapiens
gggctggaggcccagg

SEQ ID NO: 4044193 - DNA, 11 bp, Homo sapiens
gggctggccat

SEQ ID NO: 4044194 - DNA, 18 bp, Homo sapiens
gggctggctctgcactaa

SEQ ID NO: 4044195 - DNA, 22 bp, Homo sapiens
gggctgggcccacccaagcagg

SEQ ID NO: 4044196 - DNA, 16 bp, Homo sapiens
gggctgggggactggg

SEQ ID NO: 4044197 - DNA, 16 bp, Homo sapiens
gggctgggtttgctgt

SEQ ID NO: 4044198 - DNA, 17 bp, Homo sapiens
gggctggtgccccacag

SEQ ID NO: 4044199 - DNA, 15 bp, Homo sapiens
gggctggtgggacag

SEQ ID NO: 4044200 - DNA, 18 bp, Homo sapiens
gggctgtaaaatgcatga

SEQ ID NO: 4044201 - DNA, 16 bp, Homo sapiens
gggcttcactgtataa

SEQ ID NO: 4044202 - DNA, 19 bp, Homo sapiens
gggcttcctctagaagcca

SEQ ID NO: 4044203 - DNA, 14 bp, Homo sapiens
gggcttcctgccct

SEQ ID NO: 4044204 - DNA, 17 bp, Homo sapiens
gggcttcctgcccttcc

SEQ ID NO: 4044205 - DNA, 17 bp, Homo sapiens
gggcttgaagccaaaga

SEQ ID NO: 4044206 - DNA, 20 bp, Homo sapiens
gggcttgatggtgacagctg

SEQ ID NO: 4044207 - DNA, 13 bp, Homo sapiens
gggcttggccagc

SEQ ID NO: 4044208 - DNA, 13 bp, Homo sapiens
gggcttggcctgc

SEQ ID NO: 4044209 - DNA, 19 bp, Homo sapiens
gggcttgggccctgcacag

SEQ ID NO: 4044210 - DNA, 19 bp, Homo sapiens
gggctttctcttccccttc

SEQ ID NO: 4044211 - DNA, 15 bp, Homo sapiens
gggctttctggggcc

SEQ ID NO: 4044212 - DNA, 16 bp, Homo sapiens
gggctttgagggtgga

SEQ ID NO: 4044213 - DNA, 15 bp, Homo sapiens
gggctttgccttgca

SEQ ID NO: 4044214 - DNA, 18 bp, Homo sapiens
ggggaaaaaagcacatac

SEQ ID NO: 4044215 - DNA, 18 bp, Homo sapiens
ggggaaatgtggagaaga

SEQ ID NO: 4044216 - DNA, 13 bp, Homo sapiens
ggggaacagacca

SEQ ID NO: 4044217 - DNA, 11 bp, Homo sapiens
ggggaacagat

SEQ ID NO: 4044218 - DNA, 21 bp, Homo sapiens
ggggaaggagccagtttgccg

SEQ ID NO: 4044219 - DNA, 21 bp, Homo sapiens
ggggaatgagcccagagaaca

SEQ ID NO: 4044220 - DNA, 13 bp, Homo sapiens
ggggacagctgtg

SEQ ID NO: 4044221 - DNA, 14 bp, Homo sapiens
ggggacagctgtgt

SEQ ID NO: 4044222 - DNA, 14 bp, Homo sapiens
gggagtgggcacct

SEQ ID NO: 4044223 - DNA, 15 bp, Homo sapiens
gggagtgggcacctc

SEQ ID NO: 4044224 - DNA, 18 bp, Homo sapiens
gggagtgggcacctcaga

SEQ ID NO: 4044225 - DNA, 20 bp, Homo sapiens
gggagtgggcacctcagaaa

SEQ ID NO: 4044226 - DNA, 22 bp, Homo sapiens
gggagttgtcaagtctctgctg

SEQ ID NO: 4044227 - DNA, 20 bp, Homo sapiens
gggataaccctacacccaga

SEQ ID NO: 4044228 - DNA, 22 bp, Homo sapiens
gggatcactggctggcctgagc

SEQ ID NO: 4044229 - DNA, 19 bp, Homo sapiens
gggatcccaccctggggac

SEQ ID NO: 4044230 - DNA, 21 bp, Homo sapiens
gggatctcagaggctcagaga

SEQ ID NO: 4044231 - DNA, 18 bp, Homo sapiens
gggatcttgcattcccag

SEQ ID NO: 4044232 - DNA, 15 bp, Homo sapiens
gggatgagccgctgt

SEQ ID NO: 4044233 - DNA, 12 bp, Homo sapiens
gggatgctgctc

SEQ ID NO: 4044234 - DNA, 22 bp, Homo sapiens
gggatgctgctccgcccgctcc

SEQ ID NO: 4044235 - DNA, 17 bp, Homo sapiens
gggatgctgggctgggc

SEQ ID NO: 4044236 - DNA, 19 bp, Homo sapiens
gggatggagaggcggcctc

SEQ ID NO: 4044237 - DNA, 15 bp, Homo sapiens
gggatggaggggagt

SEQ ID NO: 4044238 - DNA, 15 bp, Homo sapiens
gggatggggcctccc

SEQ ID NO: 4044239 - DNA, 13 bp, Homo sapiens
gggatgtcagcag

SEQ ID NO: 4044240 - DNA, 21 bp, Homo sapiens
gggatgtcagcagacacacat

SEQ ID NO: 4044241 - DNA, 23 bp, Homo sapiens
gggatgtcagcagacacacatgg

SEQ ID NO: 4044242 - DNA, 22 bp, Homo sapiens
gggatgttcagcactgtccctt

SEQ ID NO: 4044243 - DNA, 14 bp, Homo sapiens
gggattaagaaacc

SEQ ID NO: 4044244 - DNA, 16 bp, Homo sapiens
gggattcaggctgctt

SEQ ID NO: 4044245 - DNA, 18 bp, Homo sapiens
gggattgaggggccctgg

SEQ ID NO: 4044246 - DNA, 20 bp, Homo sapiens
gggattggaccgagctggaa

SEQ ID NO: 4044247 - DNA, 20 bp, Homo sapiens
gggatttaatttccagggtt

SEQ ID NO: 4044248 - DNA, 23 bp, Homo sapiens
gggatttgttgattctctccatt

SEQ ID NO: 4044249 - DNA, 14 bp, Homo sapiens
gggcaaacaggcag

SEQ ID NO: 4044250 - DNA, 15 bp, Homo sapiens
gggcaaacaggcagt

SEQ ID NO: 4044251 - DNA, 20 bp, Homo sapiens
gggcaaagccacaaggctgg

SEQ ID NO: 4044252 - DNA, 23 bp, Homo sapiens
gggcaacgaagaaaaaaaataac

SEQ ID NO: 4044253 - DNA, 13 bp, Homo sapiens
gggcaagggccat

SEQ ID NO: 4044254 - DNA, 17 bp, Homo sapiens
gggcaagtggatgggaa

SEQ ID NO: 4044255 - DNA, 21 bp, Homo sapiens
gggcacaactgcaataacttc

SEQ ID NO: 4044256 - DNA, 23 bp, Homo sapiens
gggcacacgcacaaacacacaca

SEQ ID NO: 4044257 - DNA, 19 bp, Homo sapiens
gggcacagccctccgaccc

SEQ ID NO: 4044258 - DNA, 14 bp, Homo sapiens
gggcacagcctagg

SEQ ID NO: 4044259 - DNA, 9 bp, Homo sapiens
gggcacagg

SEQ ID NO: 4044260 - DNA, 17 bp, Homo sapiens
gggcacagggcaccaga

SEQ ID NO: 4044261 - DNA, 19 bp, Homo sapiens
gggcacagggcaccagagg

SEQ ID NO: 4044262 - DNA, 18 bp, Homo sapiens
gggcaccccagcctgaag

SEQ ID NO: 4044263 - DNA, 13 bp, Homo sapiens
gggcacctcagaa

SEQ ID NO: 4044264 - DNA, 15 bp, Homo sapiens
gggcactggcccagg

SEQ ID NO: 4044265 - DNA, 14 bp, Homo sapiens
gggcactgggctgt

SEQ ID NO: 4044266 - DNA, 13 bp, Homo sapiens
gggcactggtggc

SEQ ID NO: 4044267 - DNA, 18 bp, Homo sapiens
gggcagaagggagaagga

SEQ ID NO: 4044268 - DNA, 19 bp, Homo sapiens
gggcagaagggagaaggat

SEQ ID NO: 4044269 - DNA, 22 bp, Homo sapiens
gggcagactgtgaacttgactg

SEQ ID NO: 4044270 - DNA, 14 bp, Homo sapiens
gggcagagcacagc

SEQ ID NO: 4044271 - DNA, 14 bp, Homo sapiens
gggcagagcaggaa

SEQ ID NO: 4044272 - DNA, 15 bp, Homo sapiens
gggcagagggctgga

SEQ ID NO: 4044273 - DNA, 16 bp, Homo sapiens
gggcagagggctggag

SEQ ID NO: 4044274 - DNA, 21 bp, Homo sapiens
gggcagatccccactgtccta

SEQ ID NO: 4044275 - DNA, 12 bp, Homo sapiens
gggcagcaccct

SEQ ID NO: 4044276 - DNA, 13 bp, Homo sapiens
gggcagcaccctc

SEQ ID NO: 4044277 - DNA, 18 bp, Homo sapiens
gggcagcaccctcccccg

SEQ ID NO: 4044278 - DNA, 17 bp, Homo sapiens
gggcagccaaacccatg

SEQ ID NO: 4044279 - DNA, 13 bp, Homo sapiens
gggcagccagcag

SEQ ID NO: 4044280 - DNA, 14 bp, Homo sapiens
gggcagcgggccag

SEQ ID NO: 4044281 - DNA, 16 bp, Homo sapiens
gggcagcgggccaggc

SEQ ID NO: 4044282 - DNA, 20 bp, Homo sapiens
gggcagcgggccaggcccgc

SEQ ID NO: 4044283 - DNA, 18 bp, Homo sapiens
gggcaggaaggagagcct

SEQ ID NO: 4044284 - DNA, 19 bp, Homo sapiens
gggcaggaaggagagcctg

SEQ ID NO: 4044285 - DNA, 12 bp, Homo sapiens
gggcaggcggtc

SEQ ID NO: 4044286 - DNA, 15 bp, Homo sapiens
gggcaggctgggcca

SEQ ID NO: 4044287 - DNA, 12 bp, Homo sapiens
gggcagggctgt

SEQ ID NO: 4044288 - DNA, 22 bp, Homo sapiens
gggcagtggtaagctctggctt

SEQ ID NO: 4044289 - DNA, 24 bp, Homo sapiens
gggcagttctcactcctaggagag

SEQ ID NO: 4044290 - DNA, 23 bp, Homo sapiens
gggcataggtaagctgtgccttc

SEQ ID NO: 4044291 - DNA, 17 bp, Homo sapiens
gggcatatccaccacct

SEQ ID NO: 4044292 - DNA, 19 bp, Homo sapiens
gggcatccataccagctcg

SEQ ID NO: 4044293 - DNA, 20 bp, Homo sapiens
gggcatccataccagctcgc

SEQ ID NO: 4044294 - DNA, 17 bp, Homo sapiens
gggcatctgcccctccc

SEQ ID NO: 4044295 - DNA, 16 bp, Homo sapiens
gggcatcttgctggct

SEQ ID NO: 4044296 - DNA, 14 bp, Homo sapiens
gggcatgccttgtg

SEQ ID NO: 4044297 - DNA, 20 bp, Homo sapiens
gggcatggccaggtggccac

SEQ ID NO: 4044298 - DNA, 21 bp, Homo sapiens
gggcatggtggctcatgcctg

SEQ ID NO: 4044299 - DNA, 16 bp, Homo sapiens
gggcattcgggccaca

SEQ ID NO: 4044300 - DNA, 19 bp, Homo sapiens
gggcattcgggccacaggg

SEQ ID NO: 4044301 - DNA, 13 bp, Homo sapiens
gggcattctctct

SEQ ID NO: 4044302 - DNA, 21 bp, Homo sapiens
gggcattttcctcctctgcct

SEQ ID NO: 4044303 - DNA, 15 bp, Homo sapiens
gggccaaggtcctgc

SEQ ID NO: 4044304 - DNA, 14 bp, Homo sapiens
gggccaccatccct

SEQ ID NO: 4044305 - DNA, 16 bp, Homo sapiens
gggccacgccccagcc

SEQ ID NO: 4044306 - DNA, 22 bp, Homo sapiens
gggccacgccccagcccgacaa

SEQ ID NO: 4044307 - DNA, 17 bp, Homo sapiens
gggccacgctccagctg

SEQ ID NO: 4044308 - DNA, 17 bp, Homo sapiens
gggccacggctgagcct

SEQ ID NO: 4044309 - DNA, 18 bp, Homo sapiens
gggccacggctgagcctt

SEQ ID NO: 4044310 - DNA, 14 bp, Homo sapiens
gggccagagccagg

SEQ ID NO: 4044311 - DNA, 22 bp, Homo sapiens
gggccagaggaactgtccagag

SEQ ID NO: 4044312 - DNA, 23 bp, Homo sapiens
gggccagaggaactgtccagaga

SEQ ID NO: 4044313 - DNA, 14 bp, Homo sapiens
gggccagaggctgg

SEQ ID NO: 4044314 - DNA, 15 bp, Homo sapiens
gggccagaggctggg

SEQ ID NO: 4044315 - DNA, 16 bp, Homo sapiens
gggccagatccagcct

SEQ ID NO: 4044316 - DNA, 19 bp, Homo sapiens
gggccagatccagcctggg

SEQ ID NO: 4044317 - DNA, 22 bp, Homo sapiens
gggccagcggggctgctcaccc

SEQ ID NO: 4044318 - DNA, 11 bp, Homo sapiens
gggccaggcag

SEQ ID NO: 4044319 - DNA, 12 bp, Homo sapiens
gggccaggcagg

SEQ ID NO: 4044320 - DNA, 21 bp, Homo sapiens
gggccagggctgccctgagaa

SEQ ID NO: 4044321 - DNA, 18 bp, Homo sapiens
gggccagtcctgcctggc

SEQ ID NO: 4044322 - DNA, 20 bp, Homo sapiens
gggccagtggggcctgtgga

SEQ ID NO: 4044323 - DNA, 22 bp, Homo sapiens
gggccatgatggcaacagatct

SEQ ID NO: 4044324 - DNA, 15 bp, Homo sapiens
gggccatgtccaaag

SEQ ID NO: 4044325 - DNA, 15 bp, Homo sapiens
ggggacagcttcctc

SEQ ID NO: 4044326 - DNA, 23 bp, Homo sapiens
ggggacagcttcctcacacccct

SEQ ID NO: 4044327 - DNA, 13 bp, Homo sapiens
ggggaccctgcct

SEQ ID NO: 4044328 - DNA, 23 bp, Homo sapiens
ggggaccgttcagtgtcccaggc

SEQ ID NO: 4044329 - DNA, 14 bp, Homo sapiens
ggggactcagccct

SEQ ID NO: 4044330 - DNA, 15 bp, Homo sapiens
ggggactcagccctg

SEQ ID NO: 4044331 - DNA, 20 bp, Homo sapiens
ggggactctgagcgggaggc

SEQ ID NO: 4044332 - DNA, 14 bp, Homo sapiens
ggggactttattta

SEQ ID NO: 4044333 - DNA, 13 bp, Homo sapiens
ggggagaagagcc

SEQ ID NO: 4044334 - DNA, 17 bp, Homo sapiens
ggggagaagagccctgg

SEQ ID NO: 4044335 - DNA, 21 bp, Homo sapiens
ggggagagacaggcagcccag

SEQ ID NO: 4044336 - DNA, 16 bp, Homo sapiens
ggggagagcctgctgg

SEQ ID NO: 4044337 - DNA, 14 bp, Homo sapiens
ggggagatggggag

SEQ ID NO: 4044338 - DNA, 17 bp, Homo sapiens
ggggagatggggaggag

SEQ ID NO: 4044339 - DNA, 11 bp, Homo sapiens
ggggagcccac

SEQ ID NO: 4044340 - DNA, 22 bp, Homo sapiens
ggggagccccttctgctcagct

SEQ ID NO: 4044341 - DNA, 23 bp, Homo sapiens
ggggaggacctgaccctactccc

SEQ ID NO: 4044342 - DNA, 14 bp, Homo sapiens
ggggaggagatgga

SEQ ID NO: 4044343 - DNA, 15 bp, Homo sapiens
ggggagggaggggaa

SEQ ID NO: 4044344 - DNA, 14 bp, Homo sapiens
ggggagggatgaag

SEQ ID NO: 4044345 - DNA, 15 bp, Homo sapiens
ggggagtagccaagc

SEQ ID NO: 4044346 - DNA, 15 bp, Homo sapiens
ggggagtcccaaagc

SEQ ID NO: 4044347 - DNA, 20 bp, Homo sapiens
ggggataaaatgactactta

SEQ ID NO: 4044348 - DNA, 23 bp, Homo sapiens
ggggatccctcccccccatgcac

SEQ ID NO: 4044349 - DNA, 16 bp, Homo sapiens
ggggatggggcctccc

SEQ ID NO: 4044350 - DNA, 15 bp, Homo sapiens
ggggattgcccctgg

SEQ ID NO: 4044351 - DNA, 22 bp, Homo sapiens
ggggcaaacctagccggaaggc

SEQ ID NO: 4044352 - DNA, 12 bp, Homo sapiens
gggtcccactgc

SEQ ID NO: 4044353 - DNA, 16 bp, Homo sapiens
gggtcccagccacccc

SEQ ID NO: 4044354 - DNA, 16 bp, Homo sapiens
gggtccccagcccttc

SEQ ID NO: 4044355 - DNA, 17 bp, Homo sapiens
gggtcccctccaggagt

SEQ ID NO: 4044356 - DNA, 22 bp, Homo sapiens
gggtcccctctggaatgcactg

SEQ ID NO: 4044357 - DNA, 14 bp, Homo sapiens
gggtcctagccctt

SEQ ID NO: 4044358 - DNA, 18 bp, Homo sapiens
gggtcctagcccttccct

SEQ ID NO: 4044359 - DNA, 16 bp, Homo sapiens
gggtctccctggctcc

SEQ ID NO: 4044360 - DNA, 17 bp, Homo sapiens
gggtctccctggctccc

SEQ ID NO: 4044361 - DNA, 22 bp, Homo sapiens
gggtctcggatgacaccctggc

SEQ ID NO: 4044362 - DNA, 14 bp, Homo sapiens
gggtctctccctca

SEQ ID NO: 4044363 - DNA, 18 bp, Homo sapiens
gggtctctccctcaggtg

SEQ ID NO: 4044364 - DNA, 17 bp, Homo sapiens
gggtctgattttctcac

SEQ ID NO: 4044365 - DNA, 19 bp, Homo sapiens
gggtctgctctttctctgc

SEQ ID NO: 4044366 - DNA, 20 bp, Homo sapiens
gggtctgctctttctctgcc

SEQ ID NO: 4044367 - DNA, 21 bp, Homo sapiens
gggtctgctctttctctgcca

SEQ ID NO: 4044368 - DNA, 22 bp, Homo sapiens
gggtctgctctttctctgccag

SEQ ID NO: 4044369 - DNA, 15 bp, Homo sapiens
gggtctgtgtgaatg

SEQ ID NO: 4044370 - DNA, 22 bp, Homo sapiens
gggtcttgctctgtcccccagg

SEQ ID NO: 4044371 - DNA, 19 bp, Homo sapiens
gggtctttcttgggatagt

SEQ ID NO: 4044372 - DNA, 19 bp, Homo sapiens
gggtgaaaggcagggccct

SEQ ID NO: 4044373 - DNA, 14 bp, Homo sapiens
gggtgaagggagag

SEQ ID NO: 4044374 - DNA, 18 bp, Homo sapiens
gggtgacggccctcatct

SEQ ID NO: 4044375 - DNA, 15 bp, Homo sapiens
gggtgaggaccactc

SEQ ID NO: 4044376 - DNA, 18 bp, Homo sapiens
gggtgaggaccactcctg

SEQ ID NO: 4044377 - DNA, 21 bp, Homo sapiens
ggtcttttttcatttcttcct

SEQ ID NO: 4044378 - DNA, 18 bp, Homo sapiens
ggtgaaccacttcattct

SEQ ID NO: 4044379 - DNA, 22 bp, Homo sapiens
ggtgaaggaggctccaggcagc

SEQ ID NO: 4044380 - DNA, 16 bp, Homo sapiens
ggtgaaggcctggctg

SEQ ID NO: 4044381 - DNA, 18 bp, Homo sapiens
ggtgaaggcctggctgga

SEQ ID NO: 4044382 - DNA, 15 bp, Homo sapiens
ggtgacagagtgagt

SEQ ID NO: 4044383 - DNA, 12 bp, Homo sapiens
ggtgacagtcat

SEQ ID NO: 4044384 - DNA, 23 bp, Homo sapiens
ggtgacagtcatcatcagggcct

SEQ ID NO: 4044385 - DNA, 15 bp, Homo sapiens
ggtgacatgtgaaac

SEQ ID NO: 4044386 - DNA, 23 bp, Homo sapiens
ggtgactgcgatcttcagagcag

SEQ ID NO: 4044387 - DNA, 12 bp, Homo sapiens
ggtgactgtccc

SEQ ID NO: 4044388 - DNA, 23 bp, Homo sapiens
ggtgactgtcccaccgggagcct

SEQ ID NO: 4044389 - DNA, 19 bp, Homo sapiens
ggtgactttgtctctcctg

SEQ ID NO: 4044390 - DNA, 12 bp, Homo sapiens
ggtgagaaaaaa

SEQ ID NO: 4044391 - DNA, 18 bp, Homo sapiens
ggtgagacagttgcccga

SEQ ID NO: 4044392 - DNA, 16 bp, Homo sapiens
ggtgagatcacagcct

SEQ ID NO: 4044393 - DNA, 18 bp, Homo sapiens
ggtgagatcacagcctcc

SEQ ID NO: 4044394 - DNA, 13 bp, Homo sapiens
ggtgagccagtgg

SEQ ID NO: 4044395 - DNA, 18 bp, Homo sapiens
ggtgaggaccactcctgt

SEQ ID NO: 4044396 - DNA, 16 bp, Homo sapiens
ggtgaggggctttctc

SEQ ID NO: 4044397 - DNA, 18 bp, Homo sapiens
ggtgaggggctttctctt

SEQ ID NO: 4044398 - DNA, 17 bp, Homo sapiens
ggtgagtcctccagaac

SEQ ID NO: 4044399 - DNA, 19 bp, Homo sapiens
ggtgagtttgagctgcctt

SEQ ID NO: 4044400 - DNA, 21 bp, Homo sapiens
ggtgagtttgagctgccttcc

SEQ ID NO: 4044401 - DNA, 20 bp, Homo sapiens
ggtgatccgcctacctcagc

SEQ ID NO: 4044402 - DNA, 18 bp, Homo sapiens
ggtgatgtagcccatcct

SEQ ID NO: 4044403 - DNA, 15 bp, Homo sapiens
ggtgatttcagagag

SEQ ID NO: 4044404 - DNA, 16 bp, Homo sapiens
ggtgcaacccttaccc

SEQ ID NO: 4044405 - DNA, 23 bp, Homo sapiens
ggtgcacttggggcacagggaga

SEQ ID NO: 4044406 - DNA, 23 bp, Homo sapiens
ggtgcagacagaagtctcctcaa

SEQ ID NO: 4044407 - DNA, 12 bp, Homo sapiens
ggtgcaggcagg

SEQ ID NO: 4044408 - DNA, 19 bp, Homo sapiens
ggtgcaggtgggcactgga

SEQ ID NO: 4044409 - DNA, 16 bp, Homo sapiens
ggtgcagtgtgaaaag

SEQ ID NO: 4044410 - DNA, 18 bp, Homo sapiens
ggtgccaaaaccaggcct

SEQ ID NO: 4044411 - DNA, 16 bp, Homo sapiens
ggtgccagggcccacc

SEQ ID NO: 4044412 - DNA, 13 bp, Homo sapiens
ggtgccagggtgg

SEQ ID NO: 4044413 - DNA, 18 bp, Homo sapiens
ggtgccatgtctgcagtg

SEQ ID NO: 4044414 - DNA, 14 bp, Homo sapiens
ggtgcccacaggcc

SEQ ID NO: 4044415 - DNA, 15 bp, Homo sapiens
ggtgccccacagcta

SEQ ID NO: 4044416 - DNA, 22 bp, Homo sapiens
ggtgccccaggaccagctcagg

SEQ ID NO: 4044417 - DNA, 22 bp, Homo sapiens
ggtgcctcagactccgccctcc

SEQ ID NO: 4044418 - DNA, 23 bp, Homo sapiens
ggtgcctcagactccgccctcct

SEQ ID NO: 4044419 - DNA, 19 bp, Homo sapiens
ggtgcctcccacacttgct

SEQ ID NO: 4044420 - DNA, 23 bp, Homo sapiens
ggtgcctcccacacttgctgggg

SEQ ID NO: 4044421 - DNA, 18 bp, Homo sapiens
ggtgcctgagaggcaggc

SEQ ID NO: 4044422 - DNA, 13 bp, Homo sapiens
ggtgcctgtccca

SEQ ID NO: 4044423 - DNA, 22 bp, Homo sapiens
ggtgctagcttgacacagtcag

SEQ ID NO: 4044424 - DNA, 17 bp, Homo sapiens
ggtgctataggctggag

SEQ ID NO: 4044425 - DNA, 12 bp, Homo sapiens
ggtgctctgtgt

SEQ ID NO: 4044426 - DNA, 13 bp, Homo sapiens
ggtgctctgtgtt

SEQ ID NO: 4044427 - DNA, 22 bp, Homo sapiens
ggtgctctgtgttcccagaggc

SEQ ID NO: 4044428 - DNA, 20 bp, Homo sapiens
ggtgctgacggccagggaga

SEQ ID NO: 4044429 - DNA, 17 bp, Homo sapiens
ggtgctgcagatttgat

SEQ ID NO: 4044430 - DNA, 20 bp, Homo sapiens
ggtgctgggaggagggagag

SEQ ID NO: 4044431 - DNA, 19 bp, Homo sapiens
ggtgctgtggccagggtga

SEQ ID NO: 4044432 - DNA, 21 bp, Homo sapiens
ggtgcttttatagaggctagc

SEQ ID NO: 4044433 - DNA, 14 bp, Homo sapiens
ggtggagaaaggag

SEQ ID NO: 4044434 - DNA, 13 bp, Homo sapiens
ggtggagggcaca

SEQ ID NO: 4044435 - DNA, 15 bp, Homo sapiens
ggtggagtttctctg

SEQ ID NO: 4044436 - DNA, 16 bp, Homo sapiens
ggtggatgacagggca

SEQ ID NO: 4044437 - DNA, 17 bp, Homo sapiens
ggtggatgacagggcag

SEQ ID NO: 4044438 - DNA, 13 bp, Homo sapiens
ggtggcaagagcc

SEQ ID NO: 4044439 - DNA, 17 bp, Homo sapiens
ggtggcaatgcttaaac

SEQ ID NO: 4044440 - DNA, 18 bp, Homo sapiens
ggtggcacaggccccctt

SEQ ID NO: 4044441 - DNA, 21 bp, Homo sapiens
ggtggcaccagatgcaacctc

SEQ ID NO: 4044442 - DNA, 17 bp, Homo sapiens
ggtggcaggaccaggac

SEQ ID NO: 4044443 - DNA, 21 bp, Homo sapiens
ggtggcaggcacacagcagcc

SEQ ID NO: 4044444 - DNA, 23 bp, Homo sapiens
ggtggcaggcacacagcagcccc

SEQ ID NO: 4044445 - DNA, 21 bp, Homo sapiens
ggtggcatcattccaggcccg

SEQ ID NO: 4044446 - DNA, 23 bp, Homo sapiens
ggtggccactccagacccctggc

SEQ ID NO: 4044447 - DNA, 21 bp, Homo sapiens
ggtggccatccctgggcccct

SEQ ID NO: 4044448 - DNA, 19 bp, Homo sapiens
ggtggcccacgcctgtaat

SEQ ID NO: 4044449 - DNA, 21 bp, Homo sapiens
ggtggcgggcgcctgtaatcc

SEQ ID NO: 4044450 - DNA, 19 bp, Homo sapiens
ggtggctcacgcctgtaat

SEQ ID NO: 4044451 - DNA, 21 bp, Homo sapiens
ggtggctgccccggcctcctc

SEQ ID NO: 4044452 - DNA, 12 bp, Homo sapiens
ggtggctgggca

SEQ ID NO: 4044453 - DNA, 15 bp, Homo sapiens
ggtgggattttgcaa

SEQ ID NO: 4044454 - DNA, 16 bp, Homo sapiens
ggtgggcatgccaccc

SEQ ID NO: 4044455 - DNA, 20 bp, Homo sapiens
ggtgggcccagaactgcccc

SEQ ID NO: 4044456 - DNA, 22 bp, Homo sapiens
ggtgggcccagaactgccccca

SEQ ID NO: 4044457 - DNA, 14 bp, Homo sapiens
ggtgggctggactt

SEQ ID NO: 4044458 - DNA, 15 bp, Homo sapiens
ggtgggcttcctgcc

SEQ ID NO: 4044459 - DNA, 19 bp, Homo sapiens
ggtgggggggcagagccct

SEQ ID NO: 4044460 - DNA, 15 bp, Homo sapiens
ggctgaggccagagt

SEQ ID NO: 4044461 - DNA, 14 bp, Homo sapiens
ggctgaggcctgga

SEQ ID NO: 4044462 - DNA, 17 bp, Homo sapiens
ggctgaggctggcacag

SEQ ID NO: 4044463 - DNA, 21 bp, Homo sapiens
ggctgagggcctgctggaggc

SEQ ID NO: 4044464 - DNA, 16 bp, Homo sapiens
ggctgagggctgccag

SEQ ID NO: 4044465 - DNA, 14 bp, Homo sapiens
ggctgaggttcctc

SEQ ID NO: 4044466 - DNA, 18 bp, Homo sapiens
ggctgaggttcctctgcc

SEQ ID NO: 4044467 - DNA, 19 bp, Homo sapiens
ggctgaggttcctctgcct

SEQ ID NO: 4044468 - DNA, 21 bp, Homo sapiens
ggctgagttctggtcaaagaa

SEQ ID NO: 4044469 - DNA, 17 bp, Homo sapiens
ggctgatgatccagaac

SEQ ID NO: 4044470 - DNA, 17 bp, Homo sapiens
ggctgcacccctgggcc

SEQ ID NO: 4044471 - DNA, 23 bp, Homo sapiens
ggctgcatctgggattcccacca

SEQ ID NO: 4044472 - DNA, 17 bp, Homo sapiens
ggctgccaaggccagag

SEQ ID NO: 4044473 - DNA, 18 bp, Homo sapiens
ggctgccacacccagggg

SEQ ID NO: 4044474 - DNA, 17 bp, Homo sapiens
ggctgccaccagccccc

SEQ ID NO: 4044475 - DNA, 12 bp, Homo sapiens
ggctgcccagga

SEQ ID NO: 4044476 - DNA, 23 bp, Homo sapiens
ggctgcccaggagacagaccact

SEQ ID NO: 4044477 - DNA, 19 bp, Homo sapiens
ggctgccccaacctgctga

SEQ ID NO: 4044478 - DNA, 22 bp, Homo sapiens
ggctgcccctaatctctgtagg

SEQ ID NO: 4044479 - DNA, 23 bp, Homo sapiens
ggctgcccctaatctctgtagga

SEQ ID NO: 4044480 - DNA, 13 bp, Homo sapiens
ggctgcccctctc

SEQ ID NO: 4044481 - DNA, 21 bp, Homo sapiens
ggctgccgggttctagtctcc

SEQ ID NO: 4044482 - DNA, 18 bp, Homo sapiens
ggctgcctcctgccctta

SEQ ID NO: 4044483 - DNA, 17 bp, Homo sapiens
ggctgcggcgtctgtct

SEQ ID NO: 4044484 - DNA, 16 bp, Homo sapiens
ggctggaaggggtcca

SEQ ID NO: 4044485 - DNA, 13 bp, Homo sapiens
ggctggactggag

SEQ ID NO: 4044486 - DNA, 18 bp, Homo sapiens
ggctggactggaggtggg

SEQ ID NO: 4044487 - DNA, 19 bp, Homo sapiens
ggctggaggcccaggctgg

SEQ ID NO: 4044488 - DNA, 13 bp, Homo sapiens
ggctggcagggct

SEQ ID NO: 4044489 - DNA, 15 bp, Homo sapiens
ggctggcagggctgg

SEQ ID NO: 4044490 - DNA, 20 bp, Homo sapiens
ggctggccagcaaggcaggt

SEQ ID NO: 4044491 - DNA, 15 bp, Homo sapiens
ggctggccatggggc

SEQ ID NO: 4044492 - DNA, 20 bp, Homo sapiens
ggctggccccagggcaccct

SEQ ID NO: 4044493 - DNA, 19 bp, Homo sapiens
ggctggcctctggctctca

SEQ ID NO: 4044494 - DNA, 12 bp, Homo sapiens
ggctggcctgag

SEQ ID NO: 4044495 - DNA, 14 bp, Homo sapiens
ggctggcctgagca

SEQ ID NO: 4044496 - DNA, 22 bp, Homo sapiens
ggctggctccagatgcagggca

SEQ ID NO: 4044497 - DNA, 11 bp, Homo sapiens
ggctggctccc

SEQ ID NO: 4044498 - DNA, 21 bp, Homo sapiens
ggctggctccccctccccagg

SEQ ID NO: 4044499 - DNA, 23 bp, Homo sapiens
ggctggctctaccttcctgtccc

SEQ ID NO: 4044500 - DNA, 13 bp, Homo sapiens
ggctggctggcct

SEQ ID NO: 4044501 - DNA, 19 bp, Homo sapiens
ggctgggacgtggctcagc

SEQ ID NO: 4044502 - DNA, 21 bp, Homo sapiens
ggctgggccatgtccaaagag

SEQ ID NO: 4044503 - DNA, 21 bp, Homo sapiens
ggctgggccctctttccctgc

SEQ ID NO: 4044504 - DNA, 15 bp, Homo sapiens
ggctgggggactggg

SEQ ID NO: 4044505 - DNA, 16 bp, Homo sapiens
ggctgggggcaggagg

SEQ ID NO: 4044506 - DNA, 20 bp, Homo sapiens
ggctgggtaatgtgaaggcc

SEQ ID NO: 4044507 - DNA, 22 bp, Homo sapiens
ggctgggtaatgtgaaggccca

SEQ ID NO: 4044508 - DNA, 19 bp, Homo sapiens
ggctgggtcggccctgccc

SEQ ID NO: 4044509 - DNA, 18 bp, Homo sapiens
ggctgggtttgctgtctt

SEQ ID NO: 4044510 - DNA, 19 bp, Homo sapiens
ggctggtaacagttcatgt

SEQ ID NO: 4044511 - DNA, 23 bp, Homo sapiens
ggctggtccagggctagtgactt

SEQ ID NO: 4044512 - DNA, 19 bp, Homo sapiens
ggctggtcctcccatttct

SEQ ID NO: 4044513 - DNA, 16 bp, Homo sapiens
ggctggtgccccacag

SEQ ID NO: 4044514 - DNA, 18 bp, Homo sapiens
ggctggtgccccacagct

SEQ ID NO: 4044515 - DNA, 21 bp, Homo sapiens
ggctggtgccccacagctacc

SEQ ID NO: 4044516 - DNA, 19 bp, Homo sapiens
ggctggtgctgtggccagg

SEQ ID NO: 4044517 - DNA, 18 bp, Homo sapiens
ggctgtcagtatgacatt

SEQ ID NO: 4044518 - DNA, 17 bp, Homo sapiens
ggctgtcatctgtgcac

SEQ ID NO: 4044519 - DNA, 13 bp, Homo sapiens
ggctgtcctgtac

SEQ ID NO: 4044520 - DNA, 16 bp, Homo sapiens
ggctgtctagaatgtg

SEQ ID NO: 4044521 - DNA, 13 bp, Homo sapiens
ggctgtctggggc

SEQ ID NO: 4044522 - DNA, 23 bp, Homo sapiens
ggctgtgcttgaaggccctgctg

SEQ ID NO: 4044523 - DNA, 22 bp, Homo sapiens
ggctgtggaccgtggacaggcc

SEQ ID NO: 4044524 - DNA, 12 bp, Homo sapiens
ggctgtggagca

SEQ ID NO: 4044525 - DNA, 22 bp, Homo sapiens
ggctgtggagcaaaaggcagct

SEQ ID NO: 4044526 - DNA, 16 bp, Homo sapiens
ggctgtgggtagatgt

SEQ ID NO: 4044527 - DNA, 14 bp, Homo sapiens
ggctgtgtcccaga

SEQ ID NO: 4044528 - DNA, 16 bp, Homo sapiens
ggctgttccatgttct

SEQ ID NO: 4044529 - DNA, 12 bp, Homo sapiens
ggcttaatgttt

SEQ ID NO: 4044530 - DNA, 16 bp, Homo sapiens
ggcttagtatttctca

SEQ ID NO: 4044531 - DNA, 21 bp, Homo sapiens
ggcttagtatttctcaggaag

SEQ ID NO: 4044532 - DNA, 19 bp, Homo sapiens
ggcttataaacacattgaa

SEQ ID NO: 4044533 - DNA, 20 bp, Homo sapiens
ggcttatttattaacaggat

SEQ ID NO: 4044534 - DNA, 17 bp, Homo sapiens
ggcttcccgctcagccc

SEQ ID NO: 4044535 - DNA, 21 bp, Homo sapiens
ggcttcccgctcagccctccc

SEQ ID NO: 4044536 - DNA, 20 bp, Homo sapiens
ggcttccctgacttgcttta

SEQ ID NO: 4044537 - DNA, 18 bp, Homo sapiens
ggcttcctgcccttccct

SEQ ID NO: 4044538 - DNA, 12 bp, Homo sapiens
ggcttcctttct

SEQ ID NO: 4044539 - DNA, 12 bp, Homo sapiens
ggcttctccttc

SEQ ID NO: 4044540 - DNA, 16 bp, Homo sapiens
ggcttgaagccaaaga

SEQ ID NO: 4044541 - DNA, 14 bp, Homo sapiens
ggcttgacatgtgc

SEQ ID NO: 4044542 - DNA, 21 bp, Homo sapiens
ggcttgatggtgacagctgca

SEQ ID NO: 4044543 - DNA, 14 bp, Homo sapiens
ggcttgcatgccaa

SEQ ID NO: 4044544 - DNA, 15 bp, Homo sapiens
ggcttggcctgctgt

SEQ ID NO: 4044545 - DNA, 14 bp, Homo sapiens
ggctttccaggcac

SEQ ID NO: 4044546 - DNA, 12 bp, Homo sapiens
ggctttcccagg

SEQ ID NO: 4044547 - DNA, 13 bp, Homo sapiens
ggctttcccagga

SEQ ID NO: 4044548 - DNA, 19 bp, Homo sapiens
ggctttcctgtgccaggtg

SEQ ID NO: 4044549 - DNA, 21 bp, Homo sapiens
ggctttctcttccccttcctg

SEQ ID NO: 4044550 - DNA, 22 bp, Homo sapiens
ggctttctcttccccttcctgt

SEQ ID NO: 4044551 - DNA, 22 bp, Homo sapiens
ggctttgaaacctcagggctgt

SEQ ID NO: 4044552 - DNA, 17 bp, Homo sapiens
ggctttgcccacccctc

SEQ ID NO: 4044553 - DNA, 19 bp, Homo sapiens
ggctttgcctcttctttgt

SEQ ID NO: 4044554 - DNA, 13 bp, Homo sapiens
ggcttttcactgc

SEQ ID NO: 4044555 - DNA, 16 bp, Homo sapiens
ggctttttcctctgag

SEQ ID NO: 4044556 - DNA, 20 bp, Homo sapiens
ggctttttcctctgagccca

SEQ ID NO: 4044557 - DNA, 19 bp, Homo sapiens
ggcttttttaaaaaagcaa

SEQ ID NO: 4044558 - DNA, 20 bp, Homo sapiens
gggaaaagggagaaaaagaa

SEQ ID NO: 4044559 - DNA, 17 bp, Homo sapiens
gggaaaatatttcctga

SEQ ID NO: 4044560 - DNA, 13 bp, Homo sapiens
gggaaaggggtgc

SEQ ID NO: 4044561 - DNA, 20 bp, Homo sapiens
gggaaagtgcatatgaaatc

SEQ ID NO: 4044562 - DNA, 14 bp, Homo sapiens
gggaaataagagag

SEQ ID NO: 4044563 - DNA, 23 bp, Homo sapiens
gggaaatatatacaaaaagaaaa

SEQ ID NO: 4044564 - DNA, 12 bp, Homo sapiens
gggaaatgtgga

SEQ ID NO: 4044565 - DNA, 16 bp, Homo sapiens
gggaacgatgtgtctg

SEQ ID NO: 4044566 - DNA, 17 bp, Homo sapiens
gggaactgagggcaagg

SEQ ID NO: 4044567 - DNA, 19 bp, Homo sapiens
gggaacttgcgagtccaag

SEQ ID NO: 4044568 - DNA, 20 bp, Homo sapiens
gggaagagaagagggcccag

SEQ ID NO: 4044569 - DNA, 23 bp, Homo sapiens
gggaagagaagagggcccagccc

SEQ ID NO: 4044570 - DNA, 13 bp, Homo sapiens
gggaagcagccag

SEQ ID NO: 4044571 - DNA, 17 bp, Homo sapiens
gggaagcagccagctcc

SEQ ID NO: 4044572 - DNA, 21 bp, Homo sapiens
gggaagctgccagcccagaac

SEQ ID NO: 4044573 - DNA, 16 bp, Homo sapiens
gggaagctggcctgag

SEQ ID NO: 4044574 - DNA, 14 bp, Homo sapiens
gggaagctggcttt

SEQ ID NO: 4044575 - DNA, 17 bp, Homo sapiens
gggaaggaactctggct

SEQ ID NO: 4044576 - DNA, 21 bp, Homo sapiens
gggaaggagggtacagctggg

SEQ ID NO: 4044577 - DNA, 16 bp, Homo sapiens
gggaaggccctgaggc

SEQ ID NO: 4044578 - DNA, 19 bp, Homo sapiens
gggaaggccctgaggcgga

SEQ ID NO: 4044579 - DNA, 14 bp, Homo sapiens
gggaagggacacac

SEQ ID NO: 4044580 - DNA, 13 bp, Homo sapiens
gggaagggccagt

SEQ ID NO: 4044581 - DNA, 16 bp, Homo sapiens
gggaagggccagtctg

SEQ ID NO: 4044582 - DNA, 17 bp, Homo sapiens
gggaagggtcatagaaa

SEQ ID NO: 4044583 - DNA, 16 bp, Homo sapiens
gggaagggtttgaatt

SEQ ID NO: 4044584 - DNA, 21 bp, Homo sapiens
gggaaggtggggtcctggagc

SEQ ID NO: 4044585 - DNA, 14 bp, Homo sapiens
gggaatcagaactc

SEQ ID NO: 4044586 - DNA, 21 bp, Homo sapiens
gggaatccagctccctagact

SEQ ID NO: 4044587 - DNA, 15 bp, Homo sapiens
gggaatgagcccaga

SEQ ID NO: 4044588 - DNA, 22 bp, Homo sapiens
gggaatgtttgggcagaaggga

SEQ ID NO: 4044589 - DNA, 19 bp, Homo sapiens
gggacacccctacacacac

SEQ ID NO: 4044590 - DNA, 20 bp, Homo sapiens
gggacagaggccccagcctc

SEQ ID NO: 4044591 - DNA, 22 bp, Homo sapiens
gggacagcatgccccttggctg

SEQ ID NO: 4044592 - DNA, 13 bp, Homo sapiens
gggacagcttcct

SEQ ID NO: 4044593 - DNA, 14 bp, Homo sapiens
gggacatatcagtg

SEQ ID NO: 4044594 - DNA, 18 bp, Homo sapiens
gggacatgctcacctcta

SEQ ID NO: 4044595 - DNA, 19 bp, Homo sapiens
gggacattttctggattct

SEQ ID NO: 4044596 - DNA, 13 bp, Homo sapiens
gggaccaccctcc

SEQ ID NO: 4044597 - DNA, 14 bp, Homo sapiens
gggaccaccctccc

SEQ ID NO: 4044598 - DNA, 17 bp, Homo sapiens
gggaccagagccagatg

SEQ ID NO: 4044599 - DNA, 22 bp, Homo sapiens
gggaccagagccagatgcagga

SEQ ID NO: 4044600 - DNA, 21 bp, Homo sapiens
gggacccaatgtaggagctgc

SEQ ID NO: 4044601 - DNA, 12 bp, Homo sapiens
gggaccctgcct

SEQ ID NO: 4044602 - DNA, 13 bp, Homo sapiens
gggaccggtgctg

SEQ ID NO: 4044603 - DNA, 18 bp, Homo sapiens
gggaccggtgctgcagga

SEQ ID NO: 4044604 - DNA, 19 bp, Homo sapiens
gggaccggtgctgcaggag

SEQ ID NO: 4044605 - DNA, 20 bp, Homo sapiens
gggacgtggctcagccagca

SEQ ID NO: 4044606 - DNA, 18 bp, Homo sapiens
gggactaggacctgagcc

SEQ ID NO: 4044607 - DNA, 24 bp, Homo sapiens
gggactgactttccgagcctccag

SEQ ID NO: 4044608 - DNA, 14 bp, Homo sapiens
gggactggagtcag

SEQ ID NO: 4044609 - DNA, 21 bp, Homo sapiens
gggactggagtcagatgagca

SEQ ID NO: 4044610 - DNA, 15 bp, Homo sapiens
gggactggggggcca

SEQ ID NO: 4044611 - DNA, 18 bp, Homo sapiens
gggacttgaatctttcca

SEQ ID NO: 4044612 - DNA, 23 bp, Homo sapiens
gggactttgctgatttcccctct

SEQ ID NO: 4044613 - DNA, 16 bp, Homo sapiens
gggagaagagccctgg

SEQ ID NO: 4044614 - DNA, 16 bp, Homo sapiens
gggagaagagtgtcag

SEQ ID NO: 4044615 - DNA, 18 bp, Homo sapiens
gggagacagaagcctgga

SEQ ID NO: 4044616 - DNA, 9 bp, Homo sapiens
gggagacct

SEQ ID NO: 4044617 - DNA, 11 bp, Homo sapiens
gggagacctgg

SEQ ID NO: 4044618 - DNA, 21 bp, Homo sapiens
gggagagacaggcagcccagc

SEQ ID NO: 4044619 - DNA, 22 bp, Homo sapiens
gggagagacctcatcaggatga

SEQ ID NO: 4044620 - DNA, 14 bp, Homo sapiens
gggagagccagctc

SEQ ID NO: 4044621 - DNA, 12 bp, Homo sapiens
gggagagcctgc

SEQ ID NO: 4044622 - DNA, 12 bp, Homo sapiens
gggagagctgaa

SEQ ID NO: 4044623 - DNA, 17 bp, Homo sapiens
gggagaggcatggctgg

SEQ ID NO: 4044624 - DNA, 18 bp, Homo sapiens
gggagagggatttccctg

SEQ ID NO: 4044625 - DNA, 17 bp, Homo sapiens
gggagattcaagggacc

SEQ ID NO: 4044626 - DNA, 11 bp, Homo sapiens
gggagcactgg

SEQ ID NO: 4044627 - DNA, 16 bp, Homo sapiens
gggagcagacaggagg

SEQ ID NO: 4044628 - DNA, 15 bp, Homo sapiens
gggagcagggaaggc

SEQ ID NO: 4044629 - DNA, 11 bp, Homo sapiens
gggagcagtgt

SEQ ID NO: 4044630 - DNA, 19 bp, Homo sapiens
gggagccacttctccccag

SEQ ID NO: 4044631 - DNA, 10 bp, Homo sapiens
gggagcccac

SEQ ID NO: 4044632 - DNA, 14 bp, Homo sapiens
gggagccctgacct

SEQ ID NO: 4044633 - DNA, 12 bp, Homo sapiens
gggagcctagct

SEQ ID NO: 4044634 - DNA, 17 bp, Homo sapiens
gggagcctagctcctgc

SEQ ID NO: 4044635 - DNA, 11 bp, Homo sapiens
gggagcctccc

SEQ ID NO: 4044636 - DNA, 13 bp, Homo sapiens
gggagcctccccc

SEQ ID NO: 4044637 - DNA, 20 bp, Homo sapiens
gggagcctccccctcagatg

SEQ ID NO: 4044638 - DNA, 15 bp, Homo sapiens
gggagctctggggac

SEQ ID NO: 4044639 - DNA, 18 bp, Homo sapiens
gggagctctggggacagc

SEQ ID NO: 4044640 - DNA, 23 bp, Homo sapiens
gggagctctggggacagcttcct

SEQ ID NO: 4044641 - DNA, 13 bp, Homo sapiens
gggagctgagcag

SEQ ID NO: 4044642 - DNA, 11 bp, Homo sapiens
gggagctggag

SEQ ID NO: 4044643 - DNA, 12 bp, Homo sapiens
gggaggagaaga

SEQ ID NO: 4044644 - DNA, 18 bp, Homo sapiens
gggaggagggagagggag

SEQ ID NO: 4044645 - DNA, 13 bp, Homo sapiens
gggaggaggggga

SEQ ID NO: 4044646 - DNA, 20 bp, Homo sapiens
gggaggcagaggttgcagtg

SEQ ID NO: 4044647 - DNA, 14 bp, Homo sapiens
gggaggcagggctc

SEQ ID NO: 4044648 - DNA, 17 bp, Homo sapiens
gggaggcctaggcgggc

SEQ ID NO: 4044649 - DNA, 20 bp, Homo sapiens
gggaggcggagagtacagtg

SEQ ID NO: 4044650 - DNA, 20 bp, Homo sapiens
gggaggcggagcttgcagtg

SEQ ID NO: 4044651 - DNA, 13 bp, Homo sapiens
gggaggcttcccc

SEQ ID NO: 4044652 - DNA, 18 bp, Homo sapiens
gggagggaagtgtgagcg

SEQ ID NO: 4044653 - DNA, 22 bp, Homo sapiens
gggagggaagtgtgagcgcctt

SEQ ID NO: 4044654 - DNA, 21 bp, Homo sapiens
gggagggcggtggacaataaa

SEQ ID NO: 4044655 - DNA, 19 bp, Homo sapiens
gggagggttggcacctgca

SEQ ID NO: 4044656 - DNA, 20 bp, Homo sapiens
gggaggtgtttaaagagagg

SEQ ID NO: 4044657 - DNA, 22 bp, Homo sapiens
gggaggtgtttaaagagaggtt

SEQ ID NO: 4044658 - DNA, 23 bp, Homo sapiens
gggagtacctgctgccccagctg

SEQ ID NO: 4044659 - DNA, 14 bp, Homo sapiens
gggagtcagagccc

SEQ ID NO: 4044660 - DNA, 17 bp, Homo sapiens
gggagtcagagccctgg

SEQ ID NO: 4044661 - DNA, 21 bp, Homo sapiens
gggagtcagagccctggctgg

SEQ ID NO: 4044662 - DNA, 22 bp, Homo sapiens
gggagtcagagccctggctggg

SEQ ID NO: 4044663 - DNA, 14 bp, Homo sapiens
gggagtccagggct

SEQ ID NO: 4044664 - DNA, 14 bp, Homo sapiens
gggagtccagggtt

SEQ ID NO: 4044665 - DNA, 19 bp, Homo sapiens
gggagtgagacagaagtaa

SEQ ID NO: 4044666 - DNA, 12 bp, Homo sapiens
gggagtgggcac

SEQ ID NO: 4044667 - DNA, 18 bp, Homo sapiens
ggcgatccacctgtctca

SEQ ID NO: 4044668 - DNA, 14 bp, Homo sapiens
ggcgatgccacgct

SEQ ID NO: 4044669 - DNA, 22 bp, Homo sapiens
ggcgatgctccctcagcctcag

SEQ ID NO: 4044670 - DNA, 17 bp, Homo sapiens
ggcgcatattaagcact

SEQ ID NO: 4044671 - DNA, 21 bp, Homo sapiens
ggcgctagaggccatggaggc

SEQ ID NO: 4044672 - DNA, 19 bp, Homo sapiens
ggcgctagcacagctccct

SEQ ID NO: 4044673 - DNA, 22 bp, Homo sapiens
ggcgctagcacagctcccttct

SEQ ID NO: 4044674 - DNA, 12 bp, Homo sapiens
ggcgctcagacg

SEQ ID NO: 4044675 - DNA, 15 bp, Homo sapiens
ggcgctgaggtgtct

SEQ ID NO: 4044676 - DNA, 19 bp, Homo sapiens
ggcggagagtacagtgagc

SEQ ID NO: 4044677 - DNA, 20 bp, Homo sapiens
ggcggagagtacagtgagcc

SEQ ID NO: 4044678 - DNA, 21 bp, Homo sapiens
ggcggaggctgtgctccgcca

SEQ ID NO: 4044679 - DNA, 19 bp, Homo sapiens
ggcggccacgcactgggcc

SEQ ID NO: 4044680 - DNA, 19 bp, Homo sapiens
ggcggccaggcacagggcc

SEQ ID NO: 4044681 - DNA, 16 bp, Homo sapiens
ggcggcccggccagcg

SEQ ID NO: 4044682 - DNA, 16 bp, Homo sapiens
ggcgggagcatctctt

SEQ ID NO: 4044683 - DNA, 18 bp, Homo sapiens
ggcgggcagagggctgga

SEQ ID NO: 4044684 - DNA, 15 bp, Homo sapiens
ggcggggcccaggag

SEQ ID NO: 4044685 - DNA, 16 bp, Homo sapiens
ggcgggtgatggccag

SEQ ID NO: 4044686 - DNA, 12 bp, Homo sapiens
ggcgtctccctc

SEQ ID NO: 4044687 - DNA, 14 bp, Homo sapiens
ggcgttctgctgcc

SEQ ID NO: 4044688 - DNA, 21 bp, Homo sapiens
ggctaaacatccaatattttc

SEQ ID NO: 4044689 - DNA, 20 bp, Homo sapiens
ggctaaatgcctaataaaca

SEQ ID NO: 4044690 - DNA, 16 bp, Homo sapiens
ggctaacgggaggctg

SEQ ID NO: 4044691 - DNA, 20 bp, Homo sapiens
ggctaacgggaggctgggca

SEQ ID NO: 4044692 - DNA, 19 bp, Homo sapiens
ggctaattcccagagtgtg

SEQ ID NO: 4044693 - DNA, 13 bp, Homo sapiens
ggctacatcccag

SEQ ID NO: 4044694 - DNA, 20 bp, Homo sapiens
ggctacatcccagcctgtgg

SEQ ID NO: 4044695 - DNA, 22 bp, Homo sapiens
ggctacatcccagcctgtggtt

SEQ ID NO: 4044696 - DNA, 15 bp, Homo sapiens
ggctacgaatcttcc

SEQ ID NO: 4044697 - DNA, 13 bp, Homo sapiens
ggctacgcctctt

SEQ ID NO: 4044698 - DNA, 14 bp, Homo sapiens
ggctagagtcctca

SEQ ID NO: 4044699 - DNA, 20 bp, Homo sapiens
ggctagcttctgcttttctg

SEQ ID NO: 4044700 - DNA, 20 bp, Homo sapiens
ggctagtgacttgtgtccca

SEQ ID NO: 4044701 - DNA, 23 bp, Homo sapiens
ggctagtgacttgtgtcccatga

SEQ ID NO: 4044702 - DNA, 20 bp, Homo sapiens
ggctatagctacaggaagca

SEQ ID NO: 4044703 - DNA, 17 bp, Homo sapiens
ggctatggagggtcctc

SEQ ID NO: 4044704 - DNA, 19 bp, Homo sapiens
ggctcaagcaatcctcctg

SEQ ID NO: 4044705 - DNA, 21 bp, Homo sapiens
ggctcaagcaatcctcctgcc

SEQ ID NO: 4044706 - DNA, 22 bp, Homo sapiens
ggctcaagcaatcctcctgcct

SEQ ID NO: 4044707 - DNA, 22 bp, Homo sapiens
ggctcacgcctgtaatcccagc

SEQ ID NO: 4044708 - DNA, 23 bp, Homo sapiens
ggctcacgcctgtaatcccagca

SEQ ID NO: 4044709 - DNA, 20 bp, Homo sapiens
ggctcactgccaggccagcc

SEQ ID NO: 4044710 - DNA, 21 bp, Homo sapiens
ggctcactgccaggccagcct

SEQ ID NO: 4044711 - DNA, 22 bp, Homo sapiens
ggctcactgccaggccagcctc

SEQ ID NO: 4044712 - DNA, 18 bp, Homo sapiens
ggctcagagatgtgcacc

SEQ ID NO: 4044713 - DNA, 19 bp, Homo sapiens
ggctcagatggactgggag

SEQ ID NO: 4044714 - DNA, 11 bp, Homo sapiens
ggctcaggctc

SEQ ID NO: 4044715 - DNA, 14 bp, Homo sapiens
ggctcagggaggga

SEQ ID NO: 4044716 - DNA, 15 bp, Homo sapiens
ggctcatgcacccct

SEQ ID NO: 4044717 - DNA, 12 bp, Homo sapiens
ggctcatgcctg

SEQ ID NO: 4044718 - DNA, 17 bp, Homo sapiens
ggctcatgcctgtaatc

SEQ ID NO: 4044719 - DNA, 14 bp, Homo sapiens
ggctccagaaatgt

SEQ ID NO: 4044720 - DNA, 17 bp, Homo sapiens
ggctccagatgcagggc

SEQ ID NO: 4044721 - DNA, 15 bp, Homo sapiens
ggctccagccatctc

SEQ ID NO: 4044722 - DNA, 14 bp, Homo sapiens
ggctccatgccagc

SEQ ID NO: 4044723 - DNA, 18 bp, Homo sapiens
ggctcccaagtcacaccc

SEQ ID NO: 4044724 - DNA, 19 bp, Homo sapiens
ggctcccacaggcccttcc

SEQ ID NO: 4044725 - DNA, 21 bp, Homo sapiens
ggctcccacaggcccttcctc

SEQ ID NO: 4044726 - DNA, 21 bp, Homo sapiens
ggctcccaggggtctccctgg

SEQ ID NO: 4044727 - DNA, 21 bp, Homo sapiens
ggctccccctccccaggctgg

SEQ ID NO: 4044728 - DNA, 14 bp, Homo sapiens
ggctcccctctgct

SEQ ID NO: 4044729 - DNA, 22 bp, Homo sapiens
ggctcccgtgtatctggacact

SEQ ID NO: 4044730 - DNA, 21 bp, Homo sapiens
ggctccctaaactttggcctt

SEQ ID NO: 4044731 - DNA, 13 bp, Homo sapiens
ggctccctgatga

SEQ ID NO: 4044732 - DNA, 22 bp, Homo sapiens
ggctcctaggggaacagaccag

SEQ ID NO: 4044733 - DNA, 12 bp, Homo sapiens
ggctcctcagag

SEQ ID NO: 4044734 - DNA, 17 bp, Homo sapiens
ggctcctcagagcgcca

SEQ ID NO: 4044735 - DNA, 21 bp, Homo sapiens
ggctcctcagagcgccaggaa

SEQ ID NO: 4044736 - DNA, 17 bp, Homo sapiens
ggctcctcccggtgccc

SEQ ID NO: 4044737 - DNA, 12 bp, Homo sapiens
ggctcctccttg

SEQ ID NO: 4044738 - DNA, 11 bp, Homo sapiens
ggctcctgccc

SEQ ID NO: 4044739 - DNA, 12 bp, Homo sapiens
ggctcctgcccc

SEQ ID NO: 4044740 - DNA, 13 bp, Homo sapiens
ggctcctgcccct

SEQ ID NO: 4044741 - DNA, 22 bp, Homo sapiens
ggctccttagggttttctctct

SEQ ID NO: 4044742 - DNA, 21 bp, Homo sapiens
ggctcgagcagtcctgcctca

SEQ ID NO: 4044743 - DNA, 18 bp, Homo sapiens
ggctcgggagccatgtca

SEQ ID NO: 4044744 - DNA, 22 bp, Homo sapiens
ggctcgggagccatgtcatgtg

SEQ ID NO: 4044745 - DNA, 16 bp, Homo sapiens
ggctctaccttcctgt

SEQ ID NO: 4044746 - DNA, 23 bp, Homo sapiens
ggctctaccttcctgtccctgag

SEQ ID NO: 4044747 - DNA, 15 bp, Homo sapiens
ggctctcctctggct

SEQ ID NO: 4044748 - DNA, 20 bp, Homo sapiens
ggctctgacaaagcttcccg

SEQ ID NO: 4044749 - DNA, 20 bp, Homo sapiens
ggctctgaggtgcctgtccc

SEQ ID NO: 4044750 - DNA, 23 bp, Homo sapiens
ggctctgaggtgcctgtcccacc

SEQ ID NO: 4044751 - DNA, 20 bp, Homo sapiens
ggctctgcaattcccctctg

SEQ ID NO: 4044752 - DNA, 12 bp, Homo sapiens
ggctctgcacag

SEQ ID NO: 4044753 - DNA, 21 bp, Homo sapiens
ggctctggacagcagaagcct

SEQ ID NO: 4044754 - DNA, 23 bp, Homo sapiens
ggctctgggatagctgacccagc

SEQ ID NO: 4044755 - DNA, 22 bp, Homo sapiens
ggctcttaagcagcatggaaaa

SEQ ID NO: 4044756 - DNA, 18 bp, Homo sapiens
ggctcttagcagcttcca

SEQ ID NO: 4044757 - DNA, 21 bp, Homo sapiens
ggctcttagcagcttccagat

SEQ ID NO: 4044758 - DNA, 20 bp, Homo sapiens
ggctcttatgtgtgcctttg

SEQ ID NO: 4044759 - DNA, 12 bp, Homo sapiens
ggctcttctcct

SEQ ID NO: 4044760 - DNA, 16 bp, Homo sapiens
ggctcttctcctttca

SEQ ID NO: 4044761 - DNA, 21 bp, Homo sapiens
ggctcttgatacccccctctg

SEQ ID NO: 4044762 - DNA, 22 bp, Homo sapiens
ggctctttggggtcagccaggg

SEQ ID NO: 4044763 - DNA, 13 bp, Homo sapiens
ggctgaccacagc

SEQ ID NO: 4044764 - DNA, 14 bp, Homo sapiens
ggctgaccaggctt

SEQ ID NO: 4044765 - DNA, 12 bp, Homo sapiens
ggctgacccctc

SEQ ID NO: 4044766 - DNA, 15 bp, Homo sapiens
ggctgacccctctgg

SEQ ID NO: 4044767 - DNA, 23 bp, Homo sapiens
ggctgacgtgtgagggaggacag

SEQ ID NO: 4044768 - DNA, 13 bp, Homo sapiens
ggctgaggccaga

SEQ ID NO: 4044769 - DNA, 23 bp, Homo sapiens
gctagcttgacacagtcagcatg

SEQ ID NO: 4044770 - DNA, 16 bp, Homo sapiens
gctagcttttaggaaa

SEQ ID NO: 4044771 - DNA, 21 bp, Homo sapiens
gctagcttttaggaaaatcac

SEQ ID NO: 4044772 - DNA, 20 bp, Homo sapiens
gctaggcgagtgccaggact

SEQ ID NO: 4044773 - DNA, 14 bp, Homo sapiens
gctagggtggccct

SEQ ID NO: 4044774 - DNA, 15 bp, Homo sapiens
gctagggtggccctt

SEQ ID NO: 4044775 - DNA, 16 bp, Homo sapiens
gctagtatttgaatta

SEQ ID NO: 4044776 - DNA, 19 bp, Homo sapiens
gctagtcttgaatttctga

SEQ ID NO: 4044777 - DNA, 17 bp, Homo sapiens
gctagtgaagaccagag

SEQ ID NO: 4044778 - DNA, 21 bp, Homo sapiens
gctagtgaagaccagagcagt

SEQ ID NO: 4044779 - DNA, 22 bp, Homo sapiens
gctagtgtacctcctctcagtg

SEQ ID NO: 4044780 - DNA, 15 bp, Homo sapiens
gctataaatatataa

SEQ ID NO: 4044781 - DNA, 11 bp, Homo sapiens
gctataatcat

SEQ ID NO: 4044782 - DNA, 23 bp, Homo sapiens
gctataatcattagttttagagg

SEQ ID NO: 4044783 - DNA, 16 bp, Homo sapiens
gctatagctacaggaa

SEQ ID NO: 4044784 - DNA, 18 bp, Homo sapiens
gctatagctacaggaagc

SEQ ID NO: 4044785 - DNA, 15 bp, Homo sapiens
gctatatccatgtac

SEQ ID NO: 4044786 - DNA, 17 bp, Homo sapiens
gctatatccatgtactg

SEQ ID NO: 4044787 - DNA, 18 bp, Homo sapiens
gctatatccatgtactgt

SEQ ID NO: 4044788 - DNA, 21 bp, Homo sapiens
gctatatccatgtactgtagt

SEQ ID NO: 4044789 - DNA, 19 bp, Homo sapiens
gctatccccatctccctgc

SEQ ID NO: 4044790 - DNA, 21 bp, Homo sapiens
gctatccccatctccctgcct

SEQ ID NO: 4044791 - DNA, 18 bp, Homo sapiens
gctatggatggcttctaa

SEQ ID NO: 4044792 - DNA, 13 bp, Homo sapiens
gctatgggagccc

SEQ ID NO: 4044793 - DNA, 18 bp, Homo sapiens
gctatgggagccccaggg

SEQ ID NO: 4044794 - DNA, 19 bp, Homo sapiens
gctatgggagccccagggt

SEQ ID NO: 4044795 - DNA, 13 bp, Homo sapiens
gctattagccagg

SEQ ID NO: 4044796 - DNA, 18 bp, Homo sapiens
gctattagccaggatcat

SEQ ID NO: 4044797 - DNA, 16 bp, Homo sapiens
gctattgacaagtcat

SEQ ID NO: 4044798 - DNA, 16 bp, Homo sapiens
gctattggaggatcag

SEQ ID NO: 4044799 - DNA, 22 bp, Homo sapiens
gctattgtttctttaagaaagt

SEQ ID NO: 4044800 - DNA, 13 bp, Homo sapiens
gctatttaaaact

SEQ ID NO: 4044801 - DNA, 18 bp, Homo sapiens
gctcaaatctattcagac

SEQ ID NO: 4044802 - DNA, 24 bp, Homo sapiens
gctcaagcaatcctcctgcctcag

SEQ ID NO: 4044803 - DNA, 21 bp, Homo sapiens
gctcaagcagcgaccgccccc

SEQ ID NO: 4044804 - DNA, 22 bp, Homo sapiens
gctcaagcagcgaccgccccct

SEQ ID NO: 4044805 - DNA, 17 bp, Homo sapiens
gctcaagcccaggaggg

SEQ ID NO: 4044806 - DNA, 14 bp, Homo sapiens
gctcaataaagatt

SEQ ID NO: 4044807 - DNA, 19 bp, Homo sapiens
gctcaatattcctgaatga

SEQ ID NO: 4044808 - DNA, 16 bp, Homo sapiens
gctcaatcaagaaaat

SEQ ID NO: 4044809 - DNA, 17 bp, Homo sapiens
gctcaatggactggaag

SEQ ID NO: 4044810 - DNA, 18 bp, Homo sapiens
gctcacaacttgggttct

SEQ ID NO: 4044811 - DNA, 22 bp, Homo sapiens
gctcacagaacccttggagcca

SEQ ID NO: 4044812 - DNA, 15 bp, Homo sapiens
gctcacagtacagca

SEQ ID NO: 4044813 - DNA, 12 bp, Homo sapiens
gctcaccacctg

SEQ ID NO: 4044814 - DNA, 13 bp, Homo sapiens
gctcaccacctgc

SEQ ID NO: 4044815 - DNA, 15 bp, Homo sapiens
gctcaccacctgcct

SEQ ID NO: 4044816 - DNA, 13 bp, Homo sapiens
gctcaccagccct

SEQ ID NO: 4044817 - DNA, 17 bp, Homo sapiens
gctcaccagccctgcag

SEQ ID NO: 4044818 - DNA, 18 bp, Homo sapiens
gctcaccagccctgcagc

SEQ ID NO: 4044819 - DNA, 21 bp, Homo sapiens
gctcaccagccctgcagccca

SEQ ID NO: 4044820 - DNA, 20 bp, Homo sapiens
gctcacccaataaacattaa

SEQ ID NO: 4044821 - DNA, 14 bp, Homo sapiens
gctcacccacctct

SEQ ID NO: 4044822 - DNA, 13 bp, Homo sapiens
gctcacccagtca

SEQ ID NO: 4044823 - DNA, 16 bp, Homo sapiens
gctcacccagtcacct

SEQ ID NO: 4044824 - DNA, 19 bp, Homo sapiens
gctcacccagtcacctccc

SEQ ID NO: 4044825 - DNA, 21 bp, Homo sapiens
gctcacccagtcacctcccca

SEQ ID NO: 4044826 - DNA, 15 bp, Homo sapiens
gctcacccctgggca

SEQ ID NO: 4044827 - DNA, 16 bp, Homo sapiens
gctcacccctgggcag

SEQ ID NO: 4044828 - DNA, 17 bp, Homo sapiens
gctcaccgctggccctt

SEQ ID NO: 4044829 - DNA, 19 bp, Homo sapiens
gctcaccgctggcccttag

SEQ ID NO: 4044830 - DNA, 22 bp, Homo sapiens
gctcacgcctgtaatcccagca

SEQ ID NO: 4044831 - DNA, 13 bp, Homo sapiens
gctcactgccagg

SEQ ID NO: 4044832 - DNA, 19 bp, Homo sapiens
gctcactgccaggccagcc

SEQ ID NO: 4044833 - DNA, 17 bp, Homo sapiens
gctcagaacttgctgct

SEQ ID NO: 4044834 - DNA, 20 bp, Homo sapiens
gctcagaacttgctgctgtc

SEQ ID NO: 4044835 - DNA, 20 bp, Homo sapiens
gctcagaataaggcaggcat

SEQ ID NO: 4044836 - DNA, 16 bp, Homo sapiens
gctcagacatgttttc

SEQ ID NO: 4044837 - DNA, 20 bp, Homo sapiens
gctcagacggcggccaggca

SEQ ID NO: 4044838 - DNA, 12 bp, Homo sapiens
gctcagaggccc

SEQ ID NO: 4044839 - DNA, 16 bp, Homo sapiens
gctcagaggcccagga

SEQ ID NO: 4044840 - DNA, 19 bp, Homo sapiens
gctcagaggcgcactgtga

SEQ ID NO: 4044841 - DNA, 16 bp, Homo sapiens
gctcagatggactggg

SEQ ID NO: 4044842 - DNA, 18 bp, Homo sapiens
gctcagcagtgagagcag

SEQ ID NO: 4044843 - DNA, 12 bp, Homo sapiens
gctcagccagca

SEQ ID NO: 4044844 - DNA, 13 bp, Homo sapiens
gctcagccagcac

SEQ ID NO: 4044845 - DNA, 19 bp, Homo sapiens
gctcagccccgagctgtcc

SEQ ID NO: 4044846 - DNA, 17 bp, Homo sapiens
gctcagctctgggccat

SEQ ID NO: 4044847 - DNA, 20 bp, Homo sapiens
gctcaggacagatgccacac

SEQ ID NO: 4044848 - DNA, 19 bp, Homo sapiens
gctcaggcgatccacctgt

SEQ ID NO: 4044849 - DNA, 17 bp, Homo sapiens
gctcaggctctgctggt

SEQ ID NO: 4044850 - DNA, 23 bp, Homo sapiens
gctcagtcccatcagagagcgag

SEQ ID NO: 4044851 - DNA, 16 bp, Homo sapiens
gctcagtctccctttc

SEQ ID NO: 4044852 - DNA, 19 bp, Homo sapiens
gctcagtctccctttccct

SEQ ID NO: 4044853 - DNA, 13 bp, Homo sapiens
gctcatctgttgt

SEQ ID NO: 4044854 - DNA, 19 bp, Homo sapiens
gctcatgcacccctgagcc

SEQ ID NO: 4044855 - DNA, 15 bp, Homo sapiens
gctcattttctggtt

SEQ ID NO: 4044856 - DNA, 21 bp, Homo sapiens
gctccaacctgcaaagatctg

SEQ ID NO: 4044857 - DNA, 18 bp, Homo sapiens
gctccaagacctaggctc

SEQ ID NO: 4044858 - DNA, 20 bp, Homo sapiens
gctccaaggggaatcagaac

SEQ ID NO: 4044859 - DNA, 12 bp, Homo sapiens
gctccaccacat

SEQ ID NO: 4044860 - DNA, 13 bp, Homo sapiens
gctccaccagcag

SEQ ID NO: 4044861 - DNA, 17 bp, Homo sapiens
gctccacccttggcctg

SEQ ID NO: 4044862 - DNA, 15 bp, Homo sapiens
gctccacgaagcctt

SEQ ID NO: 4044863 - DNA, 20 bp, Homo sapiens
gctccactcttgatctctct

SEQ ID NO: 4044864 - DNA, 22 bp, Homo sapiens
gctccactcttgatctctcttg

SEQ ID NO: 4044865 - DNA, 23 bp, Homo sapiens
gctccagaagatgccagcttctc

SEQ ID NO: 4044866 - DNA, 21 bp, Homo sapiens
gctccagacctgatcctggag

SEQ ID NO: 4044867 - DNA, 19 bp, Homo sapiens
gctccagatgcagggcagt

SEQ ID NO: 4044868 - DNA, 22 bp, Homo sapiens
ggcccccagtgggaccacatgc

SEQ ID NO: 4044869 - DNA, 23 bp, Homo sapiens
ggcccccagtgggaccacatgcc

SEQ ID NO: 4044870 - DNA, 24 bp, Homo sapiens
ggcccccagtgggaccacatgcca

SEQ ID NO: 4044871 - DNA, 21 bp, Homo sapiens
ggccccccgcgctcgcccagc

SEQ ID NO: 4044872 - DNA, 12 bp, Homo sapiens
ggccccctgcct

SEQ ID NO: 4044873 - DNA, 13 bp, Homo sapiens
ggccccctgcctg

SEQ ID NO: 4044874 - DNA, 17 bp, Homo sapiens
ggccccctggtctctgg

SEQ ID NO: 4044875 - DNA, 17 bp, Homo sapiens
ggccccgccagggctgg

SEQ ID NO: 4044876 - DNA, 18 bp, Homo sapiens
ggccccgccagggctggg

SEQ ID NO: 4044877 - DNA, 18 bp, Homo sapiens
ggccccgggttcagcctg

SEQ ID NO: 4044878 - DNA, 14 bp, Homo sapiens
ggcccctcaacagc

SEQ ID NO: 4044879 - DNA, 23 bp, Homo sapiens
ggcccctccacgcctcctggcca

SEQ ID NO: 4044880 - DNA, 21 bp, Homo sapiens
ggcccctcctagacccaggtg

SEQ ID NO: 4044881 - DNA, 20 bp, Homo sapiens
ggcccctcttattcctctag

SEQ ID NO: 4044882 - DNA, 13 bp, Homo sapiens
ggcccctggagcc

SEQ ID NO: 4044883 - DNA, 22 bp, Homo sapiens
ggcccctgggcttggcctgctg

SEQ ID NO: 4044884 - DNA, 18 bp, Homo sapiens
ggcccctgtgtgagttga

SEQ ID NO: 4044885 - DNA, 23 bp, Homo sapiens
ggccccttctctccctgccagag

SEQ ID NO: 4044886 - DNA, 16 bp, Homo sapiens
ggcccgacagcctggc

SEQ ID NO: 4044887 - DNA, 22 bp, Homo sapiens
ggcccgcagtgctgggaccaga

SEQ ID NO: 4044888 - DNA, 15 bp, Homo sapiens
ggcccggatgctgct

SEQ ID NO: 4044889 - DNA, 18 bp, Homo sapiens
ggcccggcagggcgggca

SEQ ID NO: 4044890 - DNA, 13 bp, Homo sapiens
ggcccggccagcg

SEQ ID NO: 4044891 - DNA, 19 bp, Homo sapiens
ggcccggccagcgggcaca

SEQ ID NO: 4044892 - DNA, 23 bp, Homo sapiens
ggcccggccagcgggcacagggc

SEQ ID NO: 4044893 - DNA, 15 bp, Homo sapiens
ggcccggccggcctg

SEQ ID NO: 4044894 - DNA, 15 bp, Homo sapiens
ggcccgtcatgttcc

SEQ ID NO: 4044895 - DNA, 21 bp, Homo sapiens
ggccctcatctatgaggaaag

SEQ ID NO: 4044896 - DNA, 16 bp, Homo sapiens
ggccctcccagaacct

SEQ ID NO: 4044897 - DNA, 17 bp, Homo sapiens
ggccctcccagaacctc

SEQ ID NO: 4044898 - DNA, 11 bp, Homo sapiens
ggccctccctg

SEQ ID NO: 4044899 - DNA, 18 bp, Homo sapiens
ggccctctcttctcacct

SEQ ID NO: 4044900 - DNA, 14 bp, Homo sapiens
ggccctctttccct

SEQ ID NO: 4044901 - DNA, 16 bp, Homo sapiens
ggccctctttccctgc

SEQ ID NO: 4044902 - DNA, 19 bp, Homo sapiens
ggccctctttccctgcgag

SEQ ID NO: 4044903 - DNA, 17 bp, Homo sapiens
ggccctgactcctctgg

SEQ ID NO: 4044904 - DNA, 17 bp, Homo sapiens
ggccctgcagccagctc

SEQ ID NO: 4044905 - DNA, 15 bp, Homo sapiens
ggccctgcctcctgg

SEQ ID NO: 4044906 - DNA, 13 bp, Homo sapiens
ggccctgctgccc

SEQ ID NO: 4044907 - DNA, 12 bp, Homo sapiens
ggccctggagga

SEQ ID NO: 4044908 - DNA, 14 bp, Homo sapiens
ggccctggccagcc

SEQ ID NO: 4044909 - DNA, 16 bp, Homo sapiens
ggccctggccagccgg

SEQ ID NO: 4044910 - DNA, 14 bp, Homo sapiens
ggccctggccagga

SEQ ID NO: 4044911 - DNA, 18 bp, Homo sapiens
ggccctggctctgctgtc

SEQ ID NO: 4044912 - DNA, 13 bp, Homo sapiens
ggccctgggcctc

SEQ ID NO: 4044913 - DNA, 11 bp, Homo sapiens
ggccctgggct

SEQ ID NO: 4044914 - DNA, 21 bp, Homo sapiens
ggccctgggctcggaggctgc

SEQ ID NO: 4044915 - DNA, 11 bp, Homo sapiens
ggccctgtccc

SEQ ID NO: 4044916 - DNA, 14 bp, Homo sapiens
ggccctgtcccagg

SEQ ID NO: 4044917 - DNA, 17 bp, Homo sapiens
ggccctgtcccaggccg

SEQ ID NO: 4044918 - DNA, 19 bp, Homo sapiens
ggccctgtcccaggccggc

SEQ ID NO: 4044919 - DNA, 15 bp, Homo sapiens
ggcccttacacactc

SEQ ID NO: 4044920 - DNA, 20 bp, Homo sapiens
ggcccttacttgcttctcta

SEQ ID NO: 4044921 - DNA, 21 bp, Homo sapiens
ggcccttcaggaactggggct

SEQ ID NO: 4044922 - DNA, 17 bp, Homo sapiens
ggcccttgggacagcca

SEQ ID NO: 4044923 - DNA, 18 bp, Homo sapiens
ggcccttgggacagccag

SEQ ID NO: 4044924 - DNA, 17 bp, Homo sapiens
ggcccttggggctgggg

SEQ ID NO: 4044925 - DNA, 19 bp, Homo sapiens
ggccgaaggtgcctcagac

SEQ ID NO: 4044926 - DNA, 19 bp, Homo sapiens
ggccgagctggtttcctgc

SEQ ID NO: 4044927 - DNA, 12 bp, Homo sapiens
ggccgaggccca

SEQ ID NO: 4044928 - DNA, 14 bp, Homo sapiens
ggccgaggcccagc

SEQ ID NO: 4044929 - DNA, 19 bp, Homo sapiens
ggccgaggcccagcgggca

SEQ ID NO: 4044930 - DNA, 14 bp, Homo sapiens
ggccgaggcgggtg

SEQ ID NO: 4044931 - DNA, 24 bp, Homo sapiens
ggccgctgctttgcgctggtggac

SEQ ID NO: 4044932 - DNA, 16 bp, Homo sapiens
ggccggaaccacaggg

SEQ ID NO: 4044933 - DNA, 15 bp, Homo sapiens
ggccggccagcccct

SEQ ID NO: 4044934 - DNA, 15 bp, Homo sapiens
ggccgggcaggtcct

SEQ ID NO: 4044935 - DNA, 18 bp, Homo sapiens
ggccgtctcctccctcag

SEQ ID NO: 4044936 - DNA, 13 bp, Homo sapiens
ggccgtgtctctg

SEQ ID NO: 4044937 - DNA, 16 bp, Homo sapiens
ggcctaaaagtaaaca

SEQ ID NO: 4044938 - DNA, 23 bp, Homo sapiens
ggcctaagacatgtgaggaggaa

SEQ ID NO: 4044939 - DNA, 23 bp, Homo sapiens
ggcctacagccacatccccaagc

SEQ ID NO: 4044940 - DNA, 22 bp, Homo sapiens
ggcctagcgatctctcctggcc

SEQ ID NO: 4044941 - DNA, 23 bp, Homo sapiens
ggcctagcgatctctcctggcct

SEQ ID NO: 4044942 - DNA, 15 bp, Homo sapiens
ggcctcaaggacttg

SEQ ID NO: 4044943 - DNA, 15 bp, Homo sapiens
ggcctcaccacctga

SEQ ID NO: 4044944 - DNA, 17 bp, Homo sapiens
ggcctcacccacccctg

SEQ ID NO: 4044945 - DNA, 19 bp, Homo sapiens
ggcctcaccgagtgggggc

SEQ ID NO: 4044946 - DNA, 15 bp, Homo sapiens
ggcctcagctgcctc

SEQ ID NO: 4044947 - DNA, 17 bp, Homo sapiens
ggcctcagctgcctcac

SEQ ID NO: 4044948 - DNA, 22 bp, Homo sapiens
ggcctcagctgcctcacttcct

SEQ ID NO: 4044949 - DNA, 16 bp, Homo sapiens
ggcctcagggcgctca

SEQ ID NO: 4044950 - DNA, 17 bp, Homo sapiens
ggcctcagggcgctcag

SEQ ID NO: 4044951 - DNA, 13 bp, Homo sapiens
ggcctcaggtgct

SEQ ID NO: 4044952 - DNA, 17 bp, Homo sapiens
ggcctcaggtgctgtcc

SEQ ID NO: 4044953 - DNA, 19 bp, Homo sapiens
ggcctcaggtgctgtccat

SEQ ID NO: 4044954 - DNA, 13 bp, Homo sapiens
ggcctcccaccag

SEQ ID NO: 4044955 - DNA, 15 bp, Homo sapiens
ggcctccctcaggct

SEQ ID NO: 4044956 - DNA, 21 bp, Homo sapiens
ggcctccctcaggctctgtgg

SEQ ID NO: 4044957 - DNA, 12 bp, Homo sapiens
ggcctccctcct

SEQ ID NO: 4044958 - DNA, 17 bp, Homo sapiens
ggcctccctccttgggt

SEQ ID NO: 4044959 - DNA, 23 bp, Homo sapiens
ggcctccctctctcttctgctcc

SEQ ID NO: 4044960 - DNA, 13 bp, Homo sapiens
ggcctccctgcca

SEQ ID NO: 4044961 - DNA, 19 bp, Homo sapiens
ggcctccctgccagtaggg

SEQ ID NO: 4044962 - DNA, 14 bp, Homo sapiens
ggcctcgtgccatg

SEQ ID NO: 4044963 - DNA, 12 bp, Homo sapiens
ggcctctctgcc

SEQ ID NO: 4044964 - DNA, 17 bp, Homo sapiens
ggcctctctgccccacc

SEQ ID NO: 4044965 - DNA, 19 bp, Homo sapiens
ggcctctctgccccaccca

SEQ ID NO: 4044966 - DNA, 21 bp, Homo sapiens
ggcctctgcctccaccctcct

SEQ ID NO: 4044967 - DNA, 14 bp, Homo sapiens
ggcctctgctgaat

SEQ ID NO: 4044968 - DNA, 16 bp, Homo sapiens
ggcctctgtgccttct

SEQ ID NO: 4044969 - DNA, 20 bp, Homo sapiens
ggcctctgtgtccttccctg

SEQ ID NO: 4044970 - DNA, 13 bp, Homo sapiens
ggcctcttgagca

SEQ ID NO: 4044971 - DNA, 16 bp, Homo sapiens
ggcctcttgagcagtg

SEQ ID NO: 4044972 - DNA, 22 bp, Homo sapiens
ggcctcttgagcagtggctggt

SEQ ID NO: 4044973 - DNA, 19 bp, Homo sapiens
ggcctcttgggtcccccac

SEQ ID NO: 4044974 - DNA, 23 bp, Homo sapiens
ggcctgaaagaggctgaggcctg

SEQ ID NO: 4044975 - DNA, 16 bp, Homo sapiens
ggcctgaagccagctg

SEQ ID NO: 4044976 - DNA, 17 bp, Homo sapiens
ggcctgaagccagctgc

SEQ ID NO: 4044977 - DNA, 22 bp, Homo sapiens
ggcctgaatcatgagcctgctg

SEQ ID NO: 4044978 - DNA, 15 bp, Homo sapiens
ggcctgacaccccct

SEQ ID NO: 4044979 - DNA, 13 bp, Homo sapiens
ggcctgactgctc

SEQ ID NO: 4044980 - DNA, 18 bp, Homo sapiens
ggcctgatgacagagcga

SEQ ID NO: 4044981 - DNA, 23 bp, Homo sapiens
ggcctgatgctccctcccctgcc

SEQ ID NO: 4044982 - DNA, 13 bp, Homo sapiens
ggcctgcccctgt

SEQ ID NO: 4044983 - DNA, 17 bp, Homo sapiens
ggcctgccctcagggat

SEQ ID NO: 4044984 - DNA, 14 bp, Homo sapiens
ggcctgctccagac

SEQ ID NO: 4044985 - DNA, 16 bp, Homo sapiens
ggcctgctccagacct

SEQ ID NO: 4044986 - DNA, 17 bp, Homo sapiens
ggcctgctccagacctg

SEQ ID NO: 4044987 - DNA, 17 bp, Homo sapiens
ggcctgctcccagcagc

SEQ ID NO: 4044988 - DNA, 18 bp, Homo sapiens
ggcctgctcccagcagcc

SEQ ID NO: 4044989 - DNA, 18 bp, Homo sapiens
ggcctgctgccagtgcag

SEQ ID NO: 4044990 - DNA, 19 bp, Homo sapiens
ggcctgctgccagtgcagc

SEQ ID NO: 4044991 - DNA, 10 bp, Homo sapiens
ggcctgctgt

SEQ ID NO: 4044992 - DNA, 19 bp, Homo sapiens
ggcctgctgtgattccact

SEQ ID NO: 4044993 - DNA, 13 bp, Homo sapiens
ggcctggacctgc

SEQ ID NO: 4044994 - DNA, 23 bp, Homo sapiens
ggcctggatgccagctgtgtcct

SEQ ID NO: 4044995 - DNA, 15 bp, Homo sapiens
ggcctggcagccgtg

SEQ ID NO: 4044996 - DNA, 17 bp, Homo sapiens
ggcctggcaggccagtg

SEQ ID NO: 4044997 - DNA, 14 bp, Homo sapiens
ggcctggccaggca

SEQ ID NO: 4044998 - DNA, 15 bp, Homo sapiens
ggcctggctgcagct

SEQ ID NO: 4044999 - DNA, 13 bp, Homo sapiens
ggcctggctggag

SEQ ID NO: 4045000 - DNA, 14 bp, Homo sapiens
ggcctggggcctga

SEQ ID NO: 4045001 - DNA, 16 bp, Homo sapiens
ggcctggggcctgaga

SEQ ID NO: 4045002 - DNA, 17 bp, Homo sapiens
ggcctgtagagttgctg

SEQ ID NO: 4045003 - DNA, 12 bp, Homo sapiens
ggcctgtcccaa

SEQ ID NO: 4045004 - DNA, 22 bp, Homo sapiens
ggcctgtcccaattctgcccgc

SEQ ID NO: 4045005 - DNA, 18 bp, Homo sapiens
ggcctgtcccttgcctct

SEQ ID NO: 4045006 - DNA, 21 bp, Homo sapiens
ggcctgtcccttgcctctgcc

SEQ ID NO: 4045007 - DNA, 14 bp, Homo sapiens
ggcctgtcctccaa

SEQ ID NO: 4045008 - DNA, 12 bp, Homo sapiens
ggcctgtgaatc

SEQ ID NO: 4045009 - DNA, 15 bp, Homo sapiens
ggcctgtgcccactc

SEQ ID NO: 4045010 - DNA, 18 bp, Homo sapiens
ggcctgtggaatgagtgt

SEQ ID NO: 4045011 - DNA, 17 bp, Homo sapiens
ggcctgtgggagcctgc

SEQ ID NO: 4045012 - DNA, 20 bp, Homo sapiens
ggcctgtgggagcctgcaaa

SEQ ID NO: 4045013 - DNA, 15 bp, Homo sapiens
ggcctgttgctatag

SEQ ID NO: 4045014 - DNA, 15 bp, Homo sapiens
ggccttaatttcctt

SEQ ID NO: 4045015 - DNA, 17 bp, Homo sapiens
ggccttaatttcctttt

SEQ ID NO: 4045016 - DNA, 15 bp, Homo sapiens
ggccttagggcactg

SEQ ID NO: 4045017 - DNA, 22 bp, Homo sapiens
ggccttagtgggccagggctgc

SEQ ID NO: 4045018 - DNA, 13 bp, Homo sapiens
ggccttgctgctg

SEQ ID NO: 4045019 - DNA, 14 bp, Homo sapiens
ggccttgctgctgc

SEQ ID NO: 4045020 - DNA, 21 bp, Homo sapiens
ggccttgctgctgctgcaccc

SEQ ID NO: 4045021 - DNA, 20 bp, Homo sapiens
ggccttggcttttctagcct

SEQ ID NO: 4045022 - DNA, 12 bp, Homo sapiens
ggcctttccttc

SEQ ID NO: 4045023 - DNA, 15 bp, Homo sapiens
ggcctttccttccct

SEQ ID NO: 4045024 - DNA, 17 bp, Homo sapiens
ggcgacgcggttttttc

SEQ ID NO: 4045025 - DNA, 16 bp, Homo sapiens
ggcgagtgccaggact

SEQ ID NO: 4045026 - DNA, 20 bp, Homo sapiens
gcgggcacagggcaccagag

SEQ ID NO: 4045027 - DNA, 22 bp, Homo sapiens
gcgggcacagggcaccagaggc

SEQ ID NO: 4045028 - DNA, 21 bp, Homo sapiens
gccagtcctcctgggagcccc

SEQ ID NO: 4045029 - DNA, 17 bp, Homo sapiens
gccagtcctgcctggcc

SEQ ID NO: 4045030 - DNA, 14 bp, Homo sapiens
gccagtctgggctg

SEQ ID NO: 4045031 - DNA, 17 bp, Homo sapiens
gccagtctgggctgccg

SEQ ID NO: 4045032 - DNA, 17 bp, Homo sapiens
gccagtgaaatgtgaag

SEQ ID NO: 4045033 - DNA, 18 bp, Homo sapiens
gccagtgaaatgtgaagg

SEQ ID NO: 4045034 - DNA, 15 bp, Homo sapiens
gccagtgagggcagt

SEQ ID NO: 4045035 - DNA, 18 bp, Homo sapiens
gccagtgcgggtgcagac

SEQ ID NO: 4045036 - DNA, 16 bp, Homo sapiens
gccagtgggcgggcca

SEQ ID NO: 4045037 - DNA, 21 bp, Homo sapiens
gccagtggggcctgtggaatg

SEQ ID NO: 4045038 - DNA, 18 bp, Homo sapiens
gccagtttgaagcctgtg

SEQ ID NO: 4045039 - DNA, 22 bp, Homo sapiens
gccataaaacaggtaatataaa

SEQ ID NO: 4045040 - DNA, 16 bp, Homo sapiens
gccataggccctttca

SEQ ID NO: 4045041 - DNA, 20 bp, Homo sapiens
gccatatatgaccagaagcc

SEQ ID NO: 4045042 - DNA, 17 bp, Homo sapiens
gccatatttactacctt

SEQ ID NO: 4045043 - DNA, 14 bp, Homo sapiens
gccatcaaaatgct

SEQ ID NO: 4045044 - DNA, 19 bp, Homo sapiens
gccatcaaaatgcttttta

SEQ ID NO: 4045045 - DNA, 17 bp, Homo sapiens
gccatcaacaagagttg

SEQ ID NO: 4045046 - DNA, 20 bp, Homo sapiens
gccatcactagaagaaaagc

SEQ ID NO: 4045047 - DNA, 12 bp, Homo sapiens
gccatccctggg

SEQ ID NO: 4045048 - DNA, 19 bp, Homo sapiens
gccatccctgggcccctcc

SEQ ID NO: 4045049 - DNA, 15 bp, Homo sapiens
gccatcctccctcca

SEQ ID NO: 4045050 - DNA, 20 bp, Homo sapiens
gccatccttccgccaatctg

SEQ ID NO: 4045051 - DNA, 19 bp, Homo sapiens
gccatctaatgcttgttta

SEQ ID NO: 4045052 - DNA, 15 bp, Homo sapiens
gccatctagccagcc

SEQ ID NO: 4045053 - DNA, 16 bp, Homo sapiens
gccatctagccagccc

SEQ ID NO: 4045054 - DNA, 22 bp, Homo sapiens
gccatctcaggagatggagggc

SEQ ID NO: 4045055 - DNA, 21 bp, Homo sapiens
gccatctcatgaggggagagg

SEQ ID NO: 4045056 - DNA, 22 bp, Homo sapiens
gccatctgcacacacctccgag

SEQ ID NO: 4045057 - DNA, 12 bp, Homo sapiens
gccatgaactgt

SEQ ID NO: 4045058 - DNA, 16 bp, Homo sapiens
gccatgacagaggctg

SEQ ID NO: 4045059 - DNA, 18 bp, Homo sapiens
gccatgacagaggctgca

SEQ ID NO: 4045060 - DNA, 20 bp, Homo sapiens
gccatgacagaggctgcacc

SEQ ID NO: 4045061 - DNA, 23 bp, Homo sapiens
gccatgagatgatacatccaaag

SEQ ID NO: 4045062 - DNA, 16 bp, Homo sapiens
gccatgctgggccact

SEQ ID NO: 4045063 - DNA, 13 bp, Homo sapiens
gccatggaggcag

SEQ ID NO: 4045064 - DNA, 15 bp, Homo sapiens
gccatggggccctcc

SEQ ID NO: 4045065 - DNA, 16 bp, Homo sapiens
gccatggggccctccc

SEQ ID NO: 4045066 - DNA, 17 bp, Homo sapiens
gccatggggccctccca

SEQ ID NO: 4045067 - DNA, 23 bp, Homo sapiens
gccatgtctgcagtgtgcccccc

SEQ ID NO: 4045068 - DNA, 18 bp, Homo sapiens
gccatgtgagccaccgct

SEQ ID NO: 4045069 - DNA, 17 bp, Homo sapiens
gccatgtgcaccttggg

SEQ ID NO: 4045070 - DNA, 19 bp, Homo sapiens
gccattgccaccaggagaa

SEQ ID NO: 4045071 - DNA, 19 bp, Homo sapiens
gccattgcggccccaggag

SEQ ID NO: 4045072 - DNA, 20 bp, Homo sapiens
gccattggctatttaaaact

SEQ ID NO: 4045073 - DNA, 16 bp, Homo sapiens
gcccaaacctttcccc

SEQ ID NO: 4045074 - DNA, 19 bp, Homo sapiens
gcccaaacctttcccccat

SEQ ID NO: 4045075 - DNA, 13 bp, Homo sapiens
gcccaacaggggc

SEQ ID NO: 4045076 - DNA, 16 bp, Homo sapiens
gcccaacccttccctc

SEQ ID NO: 4045077 - DNA, 21 bp, Homo sapiens
gcccaagaatagatgctgact

SEQ ID NO: 4045078 - DNA, 21 bp, Homo sapiens
gcccaagacagatgccccaga

SEQ ID NO: 4045079 - DNA, 19 bp, Homo sapiens
gcccaagagcagagtctgg

SEQ ID NO: 4045080 - DNA, 23 bp, Homo sapiens
gcccaagagcagagtctgggcct

SEQ ID NO: 4045081 - DNA, 14 bp, Homo sapiens
gcccaagcccaggc

SEQ ID NO: 4045082 - DNA, 17 bp, Homo sapiens
gcccaagcccaggccac

SEQ ID NO: 4045083 - DNA, 20 bp, Homo sapiens
gcccaagcttaatagccctc

SEQ ID NO: 4045084 - DNA, 21 bp, Homo sapiens
gcctaaaatataatttttaat

SEQ ID NO: 4045085 - DNA, 23 bp, Homo sapiens
gcctaaaatataatttttaattt

SEQ ID NO: 4045086 - DNA, 15 bp, Homo sapiens
gcctaataaacaatt

SEQ ID NO: 4045087 - DNA, 20 bp, Homo sapiens
gcctacagaacttcagaaag

SEQ ID NO: 4045088 - DNA, 21 bp, Homo sapiens
gcctacagaacttcagaaaga

SEQ ID NO: 4045089 - DNA, 20 bp, Homo sapiens
gcctacagccacatccccaa

SEQ ID NO: 4045090 - DNA, 12 bp, Homo sapiens
gcctacagccag

SEQ ID NO: 4045091 - DNA, 13 bp, Homo sapiens
gcctacagccagg

SEQ ID NO: 4045092 - DNA, 15 bp, Homo sapiens
gcctacagccaggtt

SEQ ID NO: 4045093 - DNA, 23 bp, Homo sapiens
gcctacagctttgatccctgaca

SEQ ID NO: 4045094 - DNA, 21 bp, Homo sapiens
gcctagacttcccaacagcct

SEQ ID NO: 4045095 - DNA, 17 bp, Homo sapiens
gcctagcaagctggcct

SEQ ID NO: 4045096 - DNA, 19 bp, Homo sapiens
gcctagcaagctggcctct

SEQ ID NO: 4045097 - DNA, 15 bp, Homo sapiens
gcctagcagagtgct

SEQ ID NO: 4045098 - DNA, 17 bp, Homo sapiens
gcctagcgatctctcct

SEQ ID NO: 4045099 - DNA, 20 bp, Homo sapiens
gcctagcgatctctcctggc

SEQ ID NO: 4045100 - DNA, 17 bp, Homo sapiens
gcctagcggagcccagc

SEQ ID NO: 4045101 - DNA, 20 bp, Homo sapiens
gcctagcggagcccagcctg

SEQ ID NO: 4045102 - DNA, 23 bp, Homo sapiens
gcctagctcctgccacatggagc

SEQ ID NO: 4045103 - DNA, 20 bp, Homo sapiens
gcctagggtcttgggggtca

SEQ ID NO: 4045104 - DNA, 22 bp, Homo sapiens
gcctattccaggaattcctctt

SEQ ID NO: 4045105 - DNA, 15 bp, Homo sapiens
gcctcaaaggcccgc

SEQ ID NO: 4045106 - DNA, 17 bp, Homo sapiens
gcctcaatgtgaccagg

SEQ ID NO: 4045107 - DNA, 19 bp, Homo sapiens
gcctcagacgttgcctgag

SEQ ID NO: 4045108 - DNA, 16 bp, Homo sapiens
gcctcagactccgccc

SEQ ID NO: 4045109 - DNA, 15 bp, Homo sapiens
gcctcagccctcaga

SEQ ID NO: 4045110 - DNA, 23 bp, Homo sapiens
gcctcagccctcagttccttcat

SEQ ID NO: 4045111 - DNA, 22 bp, Homo sapiens
gcctcagctgacccggcctctc

SEQ ID NO: 4045112 - DNA, 16 bp, Homo sapiens
gcctcagctgcctcac

SEQ ID NO: 4045113 - DNA, 17 bp, Homo sapiens
gcctcagggccaggccc

SEQ ID NO: 4045114 - DNA, 18 bp, Homo sapiens
gcctcagggccaggccca

SEQ ID NO: 4045115 - DNA, 22 bp, Homo sapiens
gcctcagggccaggcccaggcc

SEQ ID NO: 4045116 - DNA, 13 bp, Homo sapiens
gcctcagggcgct

SEQ ID NO: 4045117 - DNA, 19 bp, Homo sapiens
gcctcatactcctgggctc

SEQ ID NO: 4045118 - DNA, 15 bp, Homo sapiens
gcctcatatttaaag

SEQ ID NO: 4045119 - DNA, 22 bp, Homo sapiens
gcctcatatttaaagacaggga

SEQ ID NO: 4045120 - DNA, 15 bp, Homo sapiens
gcctccaagcacaga

SEQ ID NO: 4045121 - DNA, 23 bp, Homo sapiens
gcctccaagcacagagcctggcc

SEQ ID NO: 4045122 - DNA, 16 bp, Homo sapiens
gcctccaagcctgcct

SEQ ID NO: 4045123 - DNA, 17 bp, Homo sapiens
gcctccaagcctgcctc

SEQ ID NO: 4045124 - DNA, 20 bp, Homo sapiens
gcctccaagcctgcctccca

SEQ ID NO: 4045125 - DNA, 17 bp, Homo sapiens
gcctccaccctcctcct

SEQ ID NO: 4045126 - DNA, 17 bp, Homo sapiens
gcctccatttagttctt

SEQ ID NO: 4045127 - DNA, 12 bp, Homo sapiens
gcctcccacact

SEQ ID NO: 4045128 - DNA, 18 bp, Homo sapiens
gcctcccacacttgctgg

SEQ ID NO: 4045129 - DNA, 12 bp, Homo sapiens
gcctcccaggtt

SEQ ID NO: 4045130 - DNA, 15 bp, Homo sapiens
gcctcccatccaggg

SEQ ID NO: 4045131 - DNA, 19 bp, Homo sapiens
gcctccccatctgtccagc

SEQ ID NO: 4045132 - DNA, 13 bp, Homo sapiens
gcctccccatttc

SEQ ID NO: 4045133 - DNA, 16 bp, Homo sapiens
gcctccccatttccca

SEQ ID NO: 4045134 - DNA, 18 bp, Homo sapiens
gcctccccatttcccatc

SEQ ID NO: 4045135 - DNA, 15 bp, Homo sapiens
gcctccccctcagat

SEQ ID NO: 4045136 - DNA, 22 bp, Homo sapiens
gcctccccctcccccattccct

SEQ ID NO: 4045137 - DNA, 11 bp, Homo sapiens
gcctcccctcc

SEQ ID NO: 4045138 - DNA, 12 bp, Homo sapiens
gcctccctcagg

SEQ ID NO: 4045139 - DNA, 23 bp, Homo sapiens
gcctccctctcagaggcctgctg

SEQ ID NO: 4045140 - DNA, 24 bp, Homo sapiens
gcctccctctcagaggcctgctgc

SEQ ID NO: 4045141 - DNA, 16 bp, Homo sapiens
gcctccctctctcttc

SEQ ID NO: 4045142 - DNA, 22 bp, Homo sapiens
gcctccctgaaaatgtttttct

SEQ ID NO: 4045143 - DNA, 14 bp, Homo sapiens
gcctccctgtctcc

SEQ ID NO: 4045144 - DNA, 20 bp, Homo sapiens
gcctccctgtctccagctgc

SEQ ID NO: 4045145 - DNA, 21 bp, Homo sapiens
gcctccctgtctccagctgcc

SEQ ID NO: 4045146 - DNA, 14 bp, Homo sapiens
gcctcccttgggct

SEQ ID NO: 4045147 - DNA, 16 bp, Homo sapiens
gcctccgagagggaga

SEQ ID NO: 4045148 - DNA, 15 bp, Homo sapiens
gcctcctcatcccgt

SEQ ID NO: 4045149 - DNA, 14 bp, Homo sapiens
gcctcctgagcctg

SEQ ID NO: 4045150 - DNA, 15 bp, Homo sapiens
gcctcctgagcctgt

SEQ ID NO: 4045151 - DNA, 14 bp, Homo sapiens
gcctcctgcctgcc

SEQ ID NO: 4045152 - DNA, 12 bp, Homo sapiens
gcctcctgcgcc

SEQ ID NO: 4045153 - DNA, 15 bp, Homo sapiens
gcctcctggccagac

SEQ ID NO: 4045154 - DNA, 17 bp, Homo sapiens
gcctcctgggaagatga

SEQ ID NO: 4045155 - DNA, 13 bp, Homo sapiens
gcctcctgtgggg

SEQ ID NO: 4045156 - DNA, 16 bp, Homo sapiens
gcctccttccacctcc

SEQ ID NO: 4045157 - DNA, 19 bp, Homo sapiens
gcctccttccacctccctc

SEQ ID NO: 4045158 - DNA, 19 bp, Homo sapiens
gcctcgcaggcctccctgc

SEQ ID NO: 4045159 - DNA, 13 bp, Homo sapiens
gcctcgcctgtca

SEQ ID NO: 4045160 - DNA, 17 bp, Homo sapiens
gcctcgcctgtcacccc

SEQ ID NO: 4045161 - DNA, 17 bp, Homo sapiens
gcctcggcctcccaaag

SEQ ID NO: 4045162 - DNA, 16 bp, Homo sapiens
gcctcgtccctccctc

SEQ ID NO: 4045163 - DNA, 20 bp, Homo sapiens
gcctcgttggaagaggaaca

SEQ ID NO: 4045164 - DNA, 22 bp, Homo sapiens
gcctctaccagttggcagacag

SEQ ID NO: 4045165 - DNA, 15 bp, Homo sapiens
gcctctcccatcact

SEQ ID NO: 4045166 - DNA, 16 bp, Homo sapiens
gcctctcccgcaccag

SEQ ID NO: 4045167 - DNA, 19 bp, Homo sapiens
gcctctctgccccacccaa

SEQ ID NO: 4045168 - DNA, 22 bp, Homo sapiens
gcctctctgccccacccaagcc

SEQ ID NO: 4045169 - DNA, 17 bp, Homo sapiens
gcctctctggaaagagg

SEQ ID NO: 4045170 - DNA, 23 bp, Homo sapiens
gcctctctggaaagaggctctgg

SEQ ID NO: 4045171 - DNA, 20 bp, Homo sapiens
gcctctgcagtctcatttct

SEQ ID NO: 4045172 - DNA, 21 bp, Homo sapiens
gcctctgcagtctcatttctc

SEQ ID NO: 4045173 - DNA, 20 bp, Homo sapiens
gcctctgcggggcagggcct

SEQ ID NO: 4045174 - DNA, 13 bp, Homo sapiens
gcctctggctaga

SEQ ID NO: 4045175 - DNA, 19 bp, Homo sapiens
gcctctggctagaggccag

SEQ ID NO: 4045176 - DNA, 13 bp, Homo sapiens
gcctctgggccat

SEQ ID NO: 4045177 - DNA, 20 bp, Homo sapiens
gcctcttcttcttcagaaga

SEQ ID NO: 4045178 - DNA, 16 bp, Homo sapiens
gcctcttctttgtgcc

SEQ ID NO: 4045179 - DNA, 17 bp, Homo sapiens
gcctctttcccttccag

SEQ ID NO: 4045180 - DNA, 13 bp, Homo sapiens
gcctgaaacagcc

SEQ ID NO: 4045181 - DNA, 23 bp, Homo sapiens
gcctgaaagaggctgaggcctgg

SEQ ID NO: 4045182 - DNA, 17 bp, Homo sapiens
gcctgaatcatgagcct

SEQ ID NO: 4045183 - DNA, 19 bp, Homo sapiens
gcctgaatcatgagcctgc

SEQ ID NO: 4045184 - DNA, 20 bp, Homo sapiens
gcctgacaccccctccccgc

SEQ ID NO: 4045185 - DNA, 16 bp, Homo sapiens
gcctgacactgagccc

SEQ ID NO: 4045186 - DNA, 20 bp, Homo sapiens
gcaggggagacaggagccta

SEQ ID NO: 4045187 - DNA, 19 bp, Homo sapiens
gcaggggccctgcagctct

SEQ ID NO: 4045188 - DNA, 20 bp, Homo sapiens
gcaggggccctgcagctctc

SEQ ID NO: 4045189 - DNA, 15 bp, Homo sapiens
gcagggggccccgcc

SEQ ID NO: 4045190 - DNA, 18 bp, Homo sapiens
gcagggggccccgccagg

SEQ ID NO: 4045191 - DNA, 20 bp, Homo sapiens
gcagggggccccgccagggc

SEQ ID NO: 4045192 - DNA, 21 bp, Homo sapiens
gcagggggccccgccagggct

SEQ ID NO: 4045193 - DNA, 22 bp, Homo sapiens
gcaggggtaggggtagggagcc

SEQ ID NO: 4045194 - DNA, 19 bp, Homo sapiens
gcaggggtccttggtgtga

SEQ ID NO: 4045195 - DNA, 20 bp, Homo sapiens
gcaggggtgggggtggaggc

SEQ ID NO: 4045196 - DNA, 19 bp, Homo sapiens
gcagggtctgtttggactg

SEQ ID NO: 4045197 - DNA, 19 bp, Homo sapiens
gcagggtgtctgccccctc

SEQ ID NO: 4045198 - DNA, 21 bp, Homo sapiens
gcaggtcctgcccatgtgtcc

SEQ ID NO: 4045199 - DNA, 13 bp, Homo sapiens
gcaggtgccaggg

SEQ ID NO: 4045200 - DNA, 19 bp, Homo sapiens
gcaggtgccagggcccacc

SEQ ID NO: 4045201 - DNA, 21 bp, Homo sapiens
gcaggtgcctgttgaatctga

SEQ ID NO: 4045202 - DNA, 19 bp, Homo sapiens
gcaggtggatctatttcat

SEQ ID NO: 4045203 - DNA, 19 bp, Homo sapiens
gcaggttcccaagctcaga

SEQ ID NO: 4045204 - DNA, 19 bp, Homo sapiens
gcaggttctgcctgctttg

SEQ ID NO: 4045205 - DNA, 16 bp, Homo sapiens
gcaggttggaaggggc

SEQ ID NO: 4045206 - DNA, 21 bp, Homo sapiens
gcaggttggcaaacgggcttg

SEQ ID NO: 4045207 - DNA, 14 bp, Homo sapiens
gcagtaaaaactgt

SEQ ID NO: 4045208 - DNA, 15 bp, Homo sapiens
gcagtaaatttgcta

SEQ ID NO: 4045209 - DNA, 23 bp, Homo sapiens
gcagtacctataaagtaaagcta

SEQ ID NO: 4045210 - DNA, 19 bp, Homo sapiens
gcagtagaaataatatgca

SEQ ID NO: 4045211 - DNA, 23 bp, Homo sapiens
gcagtatttcatttcttgtcaat

SEQ ID NO: 4045212 - DNA, 17 bp, Homo sapiens
gcagtattttgtgtcct

SEQ ID NO: 4045213 - DNA, 23 bp, Homo sapiens
gcagtattttgtgtcctccagga

SEQ ID NO: 4045214 - DNA, 17 bp, Homo sapiens
gcagtcaccaccacccg

SEQ ID NO: 4045215 - DNA, 14 bp, Homo sapiens
gcagtcactggagg

SEQ ID NO: 4045216 - DNA, 23 bp, Homo sapiens
gcagtcactggaggttgaagcca

SEQ ID NO: 4045217 - DNA, 19 bp, Homo sapiens
gcagtcagagtccagtgct

SEQ ID NO: 4045218 - DNA, 14 bp, Homo sapiens
gcagtcatcagaag

SEQ ID NO: 4045219 - DNA, 14 bp, Homo sapiens
gcagtcatctactt

SEQ ID NO: 4045220 - DNA, 21 bp, Homo sapiens
gcagtcccagtattctcagag

SEQ ID NO: 4045221 - DNA, 22 bp, Homo sapiens
gcagtcccagtattctcagagc

SEQ ID NO: 4045222 - DNA, 20 bp, Homo sapiens
gcagtcgcctgcctgcagca

SEQ ID NO: 4045223 - DNA, 22 bp, Homo sapiens
gcagtcgcctgcctgcagcagg

SEQ ID NO: 4045224 - DNA, 23 bp, Homo sapiens
gcagtcgcctgcctgcagcaggc

SEQ ID NO: 4045225 - DNA, 21 bp, Homo sapiens
gcagtcttatgcttccagaaa

SEQ ID NO: 4045226 - DNA, 22 bp, Homo sapiens
gcagtcttatgcttccagaaac

SEQ ID NO: 4045227 - DNA, 21 bp, Homo sapiens
gcagtgagaaaaagctcctgt

SEQ ID NO: 4045228 - DNA, 23 bp, Homo sapiens
gcagtgagaaaaagctcctgtcc

SEQ ID NO: 4045229 - DNA, 14 bp, Homo sapiens
gcagtgagagcaga

SEQ ID NO: 4045230 - DNA, 13 bp, Homo sapiens
gcagtgagcagaa

SEQ ID NO: 4045231 - DNA, 19 bp, Homo sapiens
gcagtgagttacagcgaga

SEQ ID NO: 4045232 - DNA, 20 bp, Homo sapiens
gcagtgagttacagcgagag

SEQ ID NO: 4045233 - DNA, 15 bp, Homo sapiens
gcagtgccccaggga

SEQ ID NO: 4045234 - DNA, 16 bp, Homo sapiens
gcagtgccccagggag

SEQ ID NO: 4045235 - DNA, 22 bp, Homo sapiens
gcagtgccttccataattatga

SEQ ID NO: 4045236 - DNA, 13 bp, Homo sapiens
gcagtgctgggac

SEQ ID NO: 4045237 - DNA, 17 bp, Homo sapiens
gcagtgctgggaccaga

SEQ ID NO: 4045238 - DNA, 18 bp, Homo sapiens
gcagtgctgggaccagag

SEQ ID NO: 4045239 - DNA, 23 bp, Homo sapiens
gcagtgcttccaaggatggacca

SEQ ID NO: 4045240 - DNA, 14 bp, Homo sapiens
gcagtggaggtggg

SEQ ID NO: 4045241 - DNA, 15 bp, Homo sapiens
gcagtggctggtcca

SEQ ID NO: 4045242 - DNA, 19 bp, Homo sapiens
gcagtggctggtccagggc

SEQ ID NO: 4045243 - DNA, 21 bp, Homo sapiens
gcagtgggacagggcatggcc

SEQ ID NO: 4045244 - DNA, 12 bp, Homo sapiens
gcagtgtgaaaa

SEQ ID NO: 4045245 - DNA, 13 bp, Homo sapiens
gcagtgtgccccc

SEQ ID NO: 4045246 - DNA, 14 bp, Homo sapiens
gccaatctggccct

SEQ ID NO: 4045247 - DNA, 18 bp, Homo sapiens
gccaatgccccactggca

SEQ ID NO: 4045248 - DNA, 16 bp, Homo sapiens
gccacaaggctggcca

SEQ ID NO: 4045249 - DNA, 15 bp, Homo sapiens
gccacaagtcttcca

SEQ ID NO: 4045250 - DNA, 20 bp, Homo sapiens
gccacaatgcagttctgagc

SEQ ID NO: 4045251 - DNA, 15 bp, Homo sapiens
gccacacccaggcac

SEQ ID NO: 4045252 - DNA, 14 bp, Homo sapiens
gccacacccagggg

SEQ ID NO: 4045253 - DNA, 21 bp, Homo sapiens
gccacacgcactggtgccaaa

SEQ ID NO: 4045254 - DNA, 18 bp, Homo sapiens
gccacactattaccatga

SEQ ID NO: 4045255 - DNA, 16 bp, Homo sapiens
gccacactcagcacaa

SEQ ID NO: 4045256 - DNA, 12 bp, Homo sapiens
gccacagccaga

SEQ ID NO: 4045257 - DNA, 13 bp, Homo sapiens
gccacagccagag

SEQ ID NO: 4045258 - DNA, 16 bp, Homo sapiens
gccacagctgctgttc

SEQ ID NO: 4045259 - DNA, 19 bp, Homo sapiens
gccacagctgctgttctca

SEQ ID NO: 4045260 - DNA, 10 bp, Homo sapiens
gccacagctt

SEQ ID NO: 4045261 - DNA, 13 bp, Homo sapiens
gccacagcttttg

SEQ ID NO: 4045262 - DNA, 20 bp, Homo sapiens
gccacaggaaggaggggaga

SEQ ID NO: 4045263 - DNA, 20 bp, Homo sapiens
gccacagggcggtgctagct

SEQ ID NO: 4045264 - DNA, 16 bp, Homo sapiens
gccacatacaggtgct

SEQ ID NO: 4045265 - DNA, 23 bp, Homo sapiens
gccacatccacagtctcccccac

SEQ ID NO: 4045266 - DNA, 18 bp, Homo sapiens
gccacatccccaagccca

SEQ ID NO: 4045267 - DNA, 13 bp, Homo sapiens
gccacatggagcc

SEQ ID NO: 4045268 - DNA, 15 bp, Homo sapiens
gccacatggagcccc

SEQ ID NO: 4045269 - DNA, 12 bp, Homo sapiens
gccacatttctg

SEQ ID NO: 4045270 - DNA, 20 bp, Homo sapiens
gccacatttctgatcagagg

SEQ ID NO: 4045271 - DNA, 22 bp, Homo sapiens
gccacatttggaatactttttg

SEQ ID NO: 4045272 - DNA, 14 bp, Homo sapiens
gccaccacgtccag

SEQ ID NO: 4045273 - DNA, 17 bp, Homo sapiens
gccaccaggatggccct

SEQ ID NO: 4045274 - DNA, 12 bp, Homo sapiens
gccaccatccct

SEQ ID NO: 4045275 - DNA, 21 bp, Homo sapiens
gccaccatccctgatggcaga

SEQ ID NO: 4045276 - DNA, 15 bp, Homo sapiens
gccaccatcctgctg

SEQ ID NO: 4045277 - DNA, 14 bp, Homo sapiens
gccacccactcagg

SEQ ID NO: 4045278 - DNA, 18 bp, Homo sapiens
gccaccccgggctctctg

SEQ ID NO: 4045279 - DNA, 21 bp, Homo sapiens
gccaccccgggctctctgctg

SEQ ID NO: 4045280 - DNA, 19 bp, Homo sapiens
gccaccctcacacacacag

SEQ ID NO: 4045281 - DNA, 22 bp, Homo sapiens
gccaccgggacagacctggaca

SEQ ID NO: 4045282 - DNA, 23 bp, Homo sapiens
gccaccgggacagacctggacac

SEQ ID NO: 4045283 - DNA, 22 bp, Homo sapiens
gccaccgggcatgtctgcctgg

SEQ ID NO: 4045284 - DNA, 14 bp, Homo sapiens
gccaccgtgcctgg

SEQ ID NO: 4045285 - DNA, 21 bp, Homo sapiens
gccacctatctcgtgggagag

SEQ ID NO: 4045286 - DNA, 20 bp, Homo sapiens
gccacctccctgacccgtct

SEQ ID NO: 4045287 - DNA, 13 bp, Homo sapiens
gccacctctctcc

SEQ ID NO: 4045288 - DNA, 16 bp, Homo sapiens
gccacctctctccttt

SEQ ID NO: 4045289 - DNA, 13 bp, Homo sapiens
gccacctggatct

SEQ ID NO: 4045290 - DNA, 15 bp, Homo sapiens
gccacgcactgggcc

SEQ ID NO: 4045291 - DNA, 14 bp, Homo sapiens
gccacgccccagcc

SEQ ID NO: 4045292 - DNA, 16 bp, Homo sapiens
gccacgctccagctgc

SEQ ID NO: 4045293 - DNA, 18 bp, Homo sapiens
gaggggttggtgggaggg

SEQ ID NO: 4045294 - DNA, 22 bp, Homo sapiens
gagggtctcgctgtcactggct

SEQ ID NO: 4045295 - DNA, 17 bp, Homo sapiens
gagggtgggggagggag

SEQ ID NO: 4045296 - DNA, 24 bp, Homo sapiens
gagggttcctcttaggtcagatgg

SEQ ID NO: 4045297 - DNA, 15 bp, Homo sapiens
gagggttctaagtgg

SEQ ID NO: 4045298 - DNA, 22 bp, Homo sapiens
gaggtaaaagtgtgagcagtga

SEQ ID NO: 4045299 - DNA, 15 bp, Homo sapiens
gaggtaacagaacag

SEQ ID NO: 4045300 - DNA, 18 bp, Homo sapiens
gaggtaacagaacagctt

SEQ ID NO: 4045301 - DNA, 20 bp, Homo sapiens
gaggtagaccaggatttcta

SEQ ID NO: 4045302 - DNA, 23 bp, Homo sapiens
gaggtagagtttgaaggaggtga

SEQ ID NO: 4045303 - DNA, 22 bp, Homo sapiens
gaggtcacattcaggaagatga

SEQ ID NO: 4045304 - DNA, 16 bp, Homo sapiens
gaggtcactggaaagg

SEQ ID NO: 4045305 - DNA, 17 bp, Homo sapiens
gaggtcactggaaaggg

SEQ ID NO: 4045306 - DNA, 20 bp, Homo sapiens
gaggtcactggaaaggggag

SEQ ID NO: 4045307 - DNA, 22 bp, Homo sapiens
gaggtcaggaagcaggggtggg

SEQ ID NO: 4045308 - DNA, 23 bp, Homo sapiens
gaggtcaggaagcaggggtgggg

SEQ ID NO: 4045309 - DNA, 17 bp, Homo sapiens
gaggtcaggacggctcc

SEQ ID NO: 4045310 - DNA, 21 bp, Homo sapiens
gaggtcaggacggctcctcag

SEQ ID NO: 4045311 - DNA, 14 bp, Homo sapiens
gaggtccaagcaga

SEQ ID NO: 4045312 - DNA, 22 bp, Homo sapiens
gaggtccctgtgtgtaggctgg

SEQ ID NO: 4045313 - DNA, 14 bp, Homo sapiens
gaggtctcttgagg

SEQ ID NO: 4045314 - DNA, 14 bp, Homo sapiens
gaggtctgaaatgg

SEQ ID NO: 4045315 - DNA, 12 bp, Homo sapiens
gaggtctgttta

SEQ ID NO: 4045316 - DNA, 22 bp, Homo sapiens
gaggtcttttgacatgtggaaa

SEQ ID NO: 4045317 - DNA, 15 bp, Homo sapiens
gaggtgaaagggagc

SEQ ID NO: 4045318 - DNA, 15 bp, Homo sapiens
gaggtgagagtggga

SEQ ID NO: 4045319 - DNA, 21 bp, Homo sapiens
gaggtgaggggggctggcggg

SEQ ID NO: 4045320 - DNA, 21 bp, Homo sapiens
gaggtgcctgtcccaccccca

SEQ ID NO: 4045321 - DNA, 13 bp, Homo sapiens
gaggtggaagaag

SEQ ID NO: 4045322 - DNA, 16 bp, Homo sapiens
gaggtggaagaaggga

SEQ ID NO: 4045323 - DNA, 19 bp, Homo sapiens
gaggtggaagaagggagaa

SEQ ID NO: 4045324 - DNA, 19 bp, Homo sapiens
gaggtggaggctgcagtga

SEQ ID NO: 4045325 - DNA, 21 bp, Homo sapiens
gaggtggccagagctgggagg

SEQ ID NO: 4045326 - DNA, 15 bp, Homo sapiens
gaggtgggaggtgga

SEQ ID NO: 4045327 - DNA, 18 bp, Homo sapiens
gaggtgggaggtggaaga

SEQ ID NO: 4045328 - DNA, 17 bp, Homo sapiens
gaggtgggatcctccct

SEQ ID NO: 4045329 - DNA, 11 bp, Homo sapiens
gaggtgggcat

SEQ ID NO: 4045330 - DNA, 21 bp, Homo sapiens
gaggtgggtgtgggtggaagg

SEQ ID NO: 4045331 - DNA, 21 bp, Homo sapiens
gaggtgtacactaacatttcc

SEQ ID NO: 4045332 - DNA, 15 bp, Homo sapiens
gaggtgtccaactgg

SEQ ID NO: 4045333 - DNA, 16 bp, Homo sapiens
gaggtgtccaactggc

SEQ ID NO: 4045334 - DNA, 15 bp, Homo sapiens
gaggtgtctggcctg

SEQ ID NO: 4045335 - DNA, 12 bp, Homo sapiens
gaggtgtgcctg

SEQ ID NO: 4045336 - DNA, 18 bp, Homo sapiens
gaggtgtgcctggcctct

SEQ ID NO: 4045337 - DNA, 14 bp, Homo sapiens
gaggtgtttaaaga

SEQ ID NO: 4045338 - DNA, 13 bp, Homo sapiens
gaggttataggtc

SEQ ID NO: 4045339 - DNA, 16 bp, Homo sapiens
gaggttcctctgcctg

SEQ ID NO: 4045340 - DNA, 13 bp, Homo sapiens
gaggttctcagag

SEQ ID NO: 4045341 - DNA, 16 bp, Homo sapiens
gaggttctcagagcca

SEQ ID NO: 4045342 - DNA, 19 bp, Homo sapiens
gaggttctcagagccaagt

SEQ ID NO: 4045343 - DNA, 15 bp, Homo sapiens
gaggttgaagccaag

SEQ ID NO: 4045344 - DNA, 14 bp, Homo sapiens
gaggttgggtgggc

SEQ ID NO: 4045345 - DNA, 21 bp, Homo sapiens
gagtaaaaaaaaaaacaatta

SEQ ID NO: 4045346 - DNA, 16 bp, Homo sapiens
gagtaaattgctctgt

SEQ ID NO: 4045347 - DNA, 21 bp, Homo sapiens
gagtaactattattataggta

SEQ ID NO: 4045348 - DNA, 19 bp, Homo sapiens
gagtaatggtgtagaacac

SEQ ID NO: 4045349 - DNA, 18 bp, Homo sapiens
gagtaattgcatttgctt

SEQ ID NO: 4045350 - DNA, 17 bp, Homo sapiens
gagtaattttggatttt

SEQ ID NO: 4045351 - DNA, 13 bp, Homo sapiens
gagtacaaatgcc

SEQ ID NO: 4045352 - DNA, 14 bp, Homo sapiens
gagtacaaatgcct

SEQ ID NO: 4045353 - DNA, 16 bp, Homo sapiens
gagtacctgctgcccc

SEQ ID NO: 4045354 - DNA, 17 bp, Homo sapiens
gagtacgtcctgcctgg

SEQ ID NO: 4045355 - DNA, 20 bp, Homo sapiens
gagtacgtcctgcctggcac

SEQ ID NO: 4045356 - DNA, 14 bp, Homo sapiens
gagtactatattta

SEQ ID NO: 4045357 - DNA, 15 bp, Homo sapiens
gagtactatatttac

SEQ ID NO: 4045358 - DNA, 16 bp, Homo sapiens
gagtactatatttaca

SEQ ID NO: 4045359 - DNA, 21 bp, Homo sapiens
gagtagttgatgttgcatttt

SEQ ID NO: 4045360 - DNA, 15 bp, Homo sapiens
gagtataagaaatgc

SEQ ID NO: 4045361 - DNA, 17 bp, Homo sapiens
gagtataagaaatgcat

SEQ ID NO: 4045362 - DNA, 18 bp, Homo sapiens
gagtataagaaatgcata

SEQ ID NO: 4045363 - DNA, 11 bp, Homo sapiens
gagtatatgtc

SEQ ID NO: 4045364 - DNA, 20 bp, Homo sapiens
gagtatttaggcagattgaa

SEQ ID NO: 4045365 - DNA, 20 bp, Homo sapiens
gagtattttaagaagacata

SEQ ID NO: 4045366 - DNA, 13 bp, Homo sapiens
gagtcacctgctc

SEQ ID NO: 4045367 - DNA, 15 bp, Homo sapiens
gagtcacctgctcca

SEQ ID NO: 4045368 - DNA, 20 bp, Homo sapiens
gagtcaccttttctgtggct

SEQ ID NO: 4045369 - DNA, 16 bp, Homo sapiens
gagtcacgctggggct

SEQ ID NO: 4045370 - DNA, 11 bp, Homo sapiens
gagtcagatga

SEQ ID NO: 4045371 - DNA, 19 bp, Homo sapiens
gagtcagatgagcaaggac

SEQ ID NO: 4045372 - DNA, 16 bp, Homo sapiens
gagtcagccaggagct

SEQ ID NO: 4045373 - DNA, 15 bp, Homo sapiens
gagtcagctgtttct

SEQ ID NO: 4045374 - DNA, 22 bp, Homo sapiens
gagtcaggcagggttaaactgc

SEQ ID NO: 4045375 - DNA, 15 bp, Homo sapiens
gagtcagtcgccttt

SEQ ID NO: 4045376 - DNA, 19 bp, Homo sapiens
gagtcagtgtctggctttt

SEQ ID NO: 4045377 - DNA, 14 bp, Homo sapiens
gagtcatggctaat

SEQ ID NO: 4045378 - DNA, 15 bp, Homo sapiens
gagtcatttaaatgt

SEQ ID NO: 4045379 - DNA, 18 bp, Homo sapiens
gagtcatttatgagcaga

SEQ ID NO: 4045380 - DNA, 13 bp, Homo sapiens
gagtccaaggcca

SEQ ID NO: 4045381 - DNA, 14 bp, Homo sapiens
gagtccaaggccag

SEQ ID NO: 4045382 - DNA, 17 bp, Homo sapiens
gagtccaaggccagtcc

SEQ ID NO: 4045383 - DNA, 15 bp, Homo sapiens
gagtccactgctcca

SEQ ID NO: 4045384 - DNA, 12 bp, Homo sapiens
gataaagatgat

SEQ ID NO: 4045385 - DNA, 13 bp, Homo sapiens
gataaatagaact

SEQ ID NO: 4045386 - DNA, 13 bp, Homo sapiens
gataaatttaatc

SEQ ID NO: 4045387 - DNA, 14 bp, Homo sapiens
gataaccatagcat

SEQ ID NO: 4045388 - DNA, 21 bp, Homo sapiens
gataacctgtacttcaagtta

SEQ ID NO: 4045389 - DNA, 11 bp, Homo sapiens
gataactctcc

SEQ ID NO: 4045390 - DNA, 16 bp, Homo sapiens
gataactttacagaaa

SEQ ID NO: 4045391 - DNA, 17 bp, Homo sapiens
gataagaatgctggttt

SEQ ID NO: 4045392 - DNA, 16 bp, Homo sapiens
gataagactgttttta

SEQ ID NO: 4045393 - DNA, 19 bp, Homo sapiens
gataaggagactgaggctt

SEQ ID NO: 4045394 - DNA, 20 bp, Homo sapiens
gataatgaaataatcagtga

SEQ ID NO: 4045395 - DNA, 17 bp, Homo sapiens
gataatgcatgaagcaa

SEQ ID NO: 4045396 - DNA, 15 bp, Homo sapiens
gataatgtattttaa

SEQ ID NO: 4045397 - DNA, 14 bp, Homo sapiens
gataattataatat

SEQ ID NO: 4045398 - DNA, 14 bp, Homo sapiens
gataattgttgaaa

SEQ ID NO: 4045399 - DNA, 15 bp, Homo sapiens
gacactggcccctca

SEQ ID NO: 4045400 - DNA, 20 bp, Homo sapiens
gacactgtgcccagcccgga

SEQ ID NO: 4045401 - DNA, 19 bp, Homo sapiens
gacacttcacgcccttggc

SEQ ID NO: 4045402 - DNA, 18 bp, Homo sapiens
gacacttcagagagctgg

SEQ ID NO: 4045403 - DNA, 19 bp, Homo sapiens
gacacttcagagagctggt

SEQ ID NO: 4045404 - DNA, 23 bp, Homo sapiens
gacacttgccttcttcacccagc

SEQ ID NO: 4045405 - DNA, 14 bp, Homo sapiens
gacactttttcttt

SEQ ID NO: 4045406 - DNA, 15 bp, Homo sapiens
gacagaaaagtgcct

SEQ ID NO: 4045407 - DNA, 14 bp, Homo sapiens
gacagaaactggat

SEQ ID NO: 4045408 - DNA, 12 bp, Homo sapiens
gacagaaagcag

SEQ ID NO: 4045409 - DNA, 23 bp, Homo sapiens
gacagaagcctggactctgcccc

SEQ ID NO: 4045410 - DNA, 19 bp, Homo sapiens
gacagaaggctcctgcccc

SEQ ID NO: 4045411 - DNA, 17 bp, Homo sapiens
gacagaagtctcctcaa

SEQ ID NO: 4045412 - DNA, 15 bp, Homo sapiens
gacagacacacacac

SEQ ID NO: 4045413 - DNA, 18 bp, Homo sapiens
gacagagacgcaggaatg

SEQ ID NO: 4045414 - DNA, 21 bp, Homo sapiens
gacagagcctgccccagcgct

SEQ ID NO: 4045415 - DNA, 17 bp, Homo sapiens
gacagagcgcccctccc

SEQ ID NO: 4045416 - DNA, 17 bp, Homo sapiens
gacagaggaaagggctg

SEQ ID NO: 4045417 - DNA, 21 bp, Homo sapiens
gacagaggaaagggctggctc

SEQ ID NO: 4045418 - DNA, 23 bp, Homo sapiens
gacagaggaaagggctggctccc

SEQ ID NO: 4045419 - DNA, 18 bp, Homo sapiens
gacagaggccccagcctc

SEQ ID NO: 4045420 - DNA, 13 bp, Homo sapiens
gacagaggcctgc

SEQ ID NO: 4045421 - DNA, 13 bp, Homo sapiens
gacagaggctgca

SEQ ID NO: 4045422 - DNA, 13 bp, Homo sapiens
gacagagttcaca

SEQ ID NO: 4045423 - DNA, 21 bp, Homo sapiens
gacagagttcacaggaggcca

SEQ ID NO: 4045424 - DNA, 17 bp, Homo sapiens
gacagatgtcagccgag

SEQ ID NO: 4045425 - DNA, 17 bp, Homo sapiens
gacagcagaagcctcca

SEQ ID NO: 4045426 - DNA, 16 bp, Homo sapiens
gacagcaggtgggaaa

SEQ ID NO: 4045427 - DNA, 19 bp, Homo sapiens
gacagcagtcttatgcttc

SEQ ID NO: 4045428 - DNA, 21 bp, Homo sapiens
gacagcatcccttcccacatg

SEQ ID NO: 4045429 - DNA, 15 bp, Homo sapiens
gacagcatgcccctt

SEQ ID NO: 4045430 - DNA, 22 bp, Homo sapiens
gacagcatgccccttggctgga

SEQ ID NO: 4045431 - DNA, 16 bp, Homo sapiens
gacagccagagctggg

SEQ ID NO: 4045432 - DNA, 17 bp, Homo sapiens
gacagcccagagcctgg

SEQ ID NO: 4045433 - DNA, 16 bp, Homo sapiens
gacagcctcccacccc

SEQ ID NO: 4045434 - DNA, 18 bp, Homo sapiens
gacagcctgcagcaggaa

SEQ ID NO: 4045435 - DNA, 12 bp, Homo sapiens
gacagctccacc

SEQ ID NO: 4045436 - DNA, 17 bp, Homo sapiens
gacagctgatacttcat

SEQ ID NO: 4045437 - DNA, 23 bp, Homo sapiens
gacagcttagaattatttgcact

SEQ ID NO: 4045438 - DNA, 13 bp, Homo sapiens
gacagcttcctca

SEQ ID NO: 4045439 - DNA, 14 bp, Homo sapiens
gacagcttcctcac

SEQ ID NO: 4045440 - DNA, 16 bp, Homo sapiens
gacagcttcctcacac

SEQ ID NO: 4045441 - DNA, 20 bp, Homo sapiens
gacagcttcctcacacccct

SEQ ID NO: 4045442 - DNA, 11 bp, Homo sapiens
gacaggagcct

SEQ ID NO: 4045443 - DNA, 14 bp, Homo sapiens
gacaggagcctagc

SEQ ID NO: 4045444 - DNA, 22 bp, Homo sapiens
gacaggaggcggcccggccagc

SEQ ID NO: 4045445 - DNA, 23 bp, Homo sapiens
gacaggaggcggcccggccagcg

SEQ ID NO: 4045446 - DNA, 17 bp, Homo sapiens
gacaggagggcaagggc

SEQ ID NO: 4045447 - DNA, 22 bp, Homo sapiens
gacaggagtcagtgtctggctt

SEQ ID NO: 4045448 - DNA, 16 bp, Homo sapiens
gacaggcagcccagca

SEQ ID NO: 4045449 - DNA, 15 bp, Homo sapiens
gacaggccaggtggt

SEQ ID NO: 4045450 - DNA, 19 bp, Homo sapiens
gacaggccatgtgagccac

SEQ ID NO: 4045451 - DNA, 23 bp, Homo sapiens
gacaggcgagagaggagccagac

SEQ ID NO: 4045452 - DNA, 13 bp, Homo sapiens
gacaggctcttag

SEQ ID NO: 4045453 - DNA, 12 bp, Homo sapiens
gacaggctggct

SEQ ID NO: 4045454 - DNA, 22 bp, Homo sapiens
gacaggctggctccagatgcag

SEQ ID NO: 4045455 - DNA, 22 bp, Homo sapiens
gacagggaggccacacgcactg

SEQ ID NO: 4045456 - DNA, 10 bp, Homo sapiens
gacagggcca

SEQ ID NO: 4045457 - DNA, 20 bp, Homo sapiens
gacagggccagtggggcctg

SEQ ID NO: 4045458 - DNA, 17 bp, Homo sapiens
gacagggggccagaaca

SEQ ID NO: 4045459 - DNA, 21 bp, Homo sapiens
gacagggtcttttttcatttc

SEQ ID NO: 4045460 - DNA, 17 bp, Homo sapiens
gacagggtttcaccatg

SEQ ID NO: 4045461 - DNA, 19 bp, Homo sapiens
gacagtcatcatcagggcc

SEQ ID NO: 4045462 - DNA, 23 bp, Homo sapiens
gacagtcatcatcagggcctggg

SEQ ID NO: 4045463 - DNA, 13 bp, Homo sapiens
gacagtctcactt

SEQ ID NO: 4045464 - DNA, 19 bp, Homo sapiens
gacagtgatattggaactt

SEQ ID NO: 4045465 - DNA, 15 bp, Homo sapiens
gacagtgccttctct

SEQ ID NO: 4045466 - DNA, 23 bp, Homo sapiens
gacagtttaccagttgcctttta

SEQ ID NO: 4045467 - DNA, 22 bp, Homo sapiens
gacataacgtttttcctttaaa

SEQ ID NO: 4045468 - DNA, 20 bp, Homo sapiens
cttgcaacttcatgtcaact

SEQ ID NO: 4045469 - DNA, 14 bp, Homo sapiens
cttgcacccctcac

SEQ ID NO: 4045470 - DNA, 17 bp, Homo sapiens
cttgcactctcttggct

SEQ ID NO: 4045471 - DNA, 12 bp, Homo sapiens
cttgcagaactt

SEQ ID NO: 4045472 - DNA, 20 bp, Homo sapiens
cttgcagccacatggcccca

SEQ ID NO: 4045473 - DNA, 22 bp, Homo sapiens
cttgcagttcagcaccacccta

SEQ ID NO: 4045474 - DNA, 21 bp, Homo sapiens
cttgcataataagctaaagag

SEQ ID NO: 4045475 - DNA, 22 bp, Homo sapiens
cttgcataataagctaaagagg

SEQ ID NO: 4045476 - DNA, 21 bp, Homo sapiens
cttgcataggctcttaagcag

SEQ ID NO: 4045477 - DNA, 14 bp, Homo sapiens
cttgcatgaagaga

SEQ ID NO: 4045478 - DNA, 23 bp, Homo sapiens
cttgccaatgaggtctgaaatgg

SEQ ID NO: 4045479 - DNA, 18 bp, Homo sapiens
cttgccaccccaccctcc

SEQ ID NO: 4045480 - DNA, 11 bp, Homo sapiens
cttgccagaga

SEQ ID NO: 4045481 - DNA, 16 bp, Homo sapiens
cttgccagagatccaa

SEQ ID NO: 4045482 - DNA, 15 bp, Homo sapiens
cttgcccaagtcaca

SEQ ID NO: 4045483 - DNA, 19 bp, Homo sapiens
cttgcccaagtcacacagc

SEQ ID NO: 4045484 - DNA, 20 bp, Homo sapiens
cttgcccaagtcacacagct

SEQ ID NO: 4045485 - DNA, 15 bp, Homo sapiens
cttgcccactcctgc

SEQ ID NO: 4045486 - DNA, 16 bp, Homo sapiens
cttgcccactcctgct

SEQ ID NO: 4045487 - DNA, 19 bp, Homo sapiens
cttgcccagactacagggc

SEQ ID NO: 4045488 - DNA, 20 bp, Homo sapiens
cttgcccaggtcaccaagca

SEQ ID NO: 4045489 - DNA, 23 bp, Homo sapiens
cttgcccaggtcaccaagcagtg

SEQ ID NO: 4045490 - DNA, 12 bp, Homo sapiens
cttgcccatcct

SEQ ID NO: 4045491 - DNA, 14 bp, Homo sapiens
cttgcccatcctga

SEQ ID NO: 4045492 - DNA, 19 bp, Homo sapiens
cttgccccccgccctcatg

SEQ ID NO: 4045493 - DNA, 20 bp, Homo sapiens
cttgccccccgccctcatgg

SEQ ID NO: 4045494 - DNA, 23 bp, Homo sapiens
cttgccctcccaaagtgctggga

SEQ ID NO: 4045495 - DNA, 21 bp, Homo sapiens
cttgcctaactaactggcagg

SEQ ID NO: 4045496 - DNA, 18 bp, Homo sapiens
cttgcctcaatgccagta

SEQ ID NO: 4045497 - DNA, 14 bp, Homo sapiens
cttgcctgctgggc

SEQ ID NO: 4045498 - DNA, 20 bp, Homo sapiens
cttgcctggagacgtggaac

SEQ ID NO: 4045499 - DNA, 17 bp, Homo sapiens
cttgcctggggtctgag

SEQ ID NO: 4045500 - DNA, 23 bp, Homo sapiens
cttgccttcctcagctgcctcct

SEQ ID NO: 4045501 - DNA, 19 bp, Homo sapiens
cttgccttcttcacccagc

SEQ ID NO: 4045502 - DNA, 19 bp, Homo sapiens
cttgcctttcgaggcctga

SEQ ID NO: 4045503 - DNA, 20 bp, Homo sapiens
cttgcctttcgaggcctgaa

SEQ ID NO: 4045504 - DNA, 13 bp, Homo sapiens
cttgcgagtccaa

SEQ ID NO: 4045505 - DNA, 15 bp, Homo sapiens
cttgcgagtccaagg

SEQ ID NO: 4045506 - DNA, 19 bp, Homo sapiens
cttgcgcctcagccctcag

SEQ ID NO: 4045507 - DNA, 20 bp, Homo sapiens
cttgcgcctcagccctcagt

SEQ ID NO: 4045508 - DNA, 15 bp, Homo sapiens
cttgcgtatgtctgt

SEQ ID NO: 4045509 - DNA, 22 bp, Homo sapiens
cttgctaccacggcctcctttc

SEQ ID NO: 4045510 - DNA, 15 bp, Homo sapiens
cttgctcattcttga

SEQ ID NO: 4045511 - DNA, 16 bp, Homo sapiens
cttgctcccaacccat

SEQ ID NO: 4045512 - DNA, 13 bp, Homo sapiens
cttgctcccttca

SEQ ID NO: 4045513 - DNA, 12 bp, Homo sapiens
cttgctctgtcc

SEQ ID NO: 4045514 - DNA, 18 bp, Homo sapiens
cttgctctgtcccccagg

SEQ ID NO: 4045515 - DNA, 15 bp, Homo sapiens
cttgctgaacacaca

SEQ ID NO: 4045516 - DNA, 22 bp, Homo sapiens
cttgctgatcagagttcctcct

SEQ ID NO: 4045517 - DNA, 18 bp, Homo sapiens
cttgctgatggcttgaca

SEQ ID NO: 4045518 - DNA, 16 bp, Homo sapiens
cttgctgctgctgcac

SEQ ID NO: 4045519 - DNA, 12 bp, Homo sapiens
cttgctgctgtc

SEQ ID NO: 4045520 - DNA, 21 bp, Homo sapiens
cttgctggacggggactgggg

SEQ ID NO: 4045521 - DNA, 16 bp, Homo sapiens
cttgctgtcctgatct

SEQ ID NO: 4045522 - DNA, 17 bp, Homo sapiens
cttgctgtcctgatctg

SEQ ID NO: 4045523 - DNA, 17 bp, Homo sapiens
cttgctgtctctgctcg

SEQ ID NO: 4045524 - DNA, 13 bp, Homo sapiens
cttgcttcctgat

SEQ ID NO: 4045525 - DNA, 19 bp, Homo sapiens
cttgcttcttactgataat

SEQ ID NO: 4045526 - DNA, 13 bp, Homo sapiens
cttgcttgctttt

SEQ ID NO: 4045527 - DNA, 12 bp, Homo sapiens
cttgcttgtcat

SEQ ID NO: 4045528 - DNA, 14 bp, Homo sapiens
cttgcttgtcattg

SEQ ID NO: 4045529 - DNA, 21 bp, Homo sapiens
cttgctttctatgctgtttgt

SEQ ID NO: 4045530 - DNA, 23 bp, Homo sapiens
cttgctttttgcccgttgaccag

SEQ ID NO: 4045531 - DNA, 21 bp, Homo sapiens
cttggaaagaaacaaccgttg

SEQ ID NO: 4045532 - DNA, 21 bp, Homo sapiens
cttggaaatagaaagaagcca

SEQ ID NO: 4045533 - DNA, 16 bp, Homo sapiens
cttggaacattggaat

SEQ ID NO: 4045534 - DNA, 22 bp, Homo sapiens
cttggacaaacctagaattttc

SEQ ID NO: 4045535 - DNA, 16 bp, Homo sapiens
cttggaccatgccaga

SEQ ID NO: 4045536 - DNA, 20 bp, Homo sapiens
cttggactgttttgaaaagt

SEQ ID NO: 4045537 - DNA, 15 bp, Homo sapiens
cttggagaccctgca

SEQ ID NO: 4045538 - DNA, 14 bp, Homo sapiens
cttggagctgtgag

SEQ ID NO: 4045539 - DNA, 17 bp, Homo sapiens
cttggaggccaccggga

SEQ ID NO: 4045540 - DNA, 15 bp, Homo sapiens
cttggaggtcacagc

SEQ ID NO: 4045541 - DNA, 16 bp, Homo sapiens
cttggagtagacaaaa

SEQ ID NO: 4045542 - DNA, 21 bp, Homo sapiens
cttggatcgctaagctggctc

SEQ ID NO: 4045543 - DNA, 22 bp, Homo sapiens
cttggatcgctaagctggctct

SEQ ID NO: 4045544 - DNA, 16 bp, Homo sapiens
cttggatttagtttca

SEQ ID NO: 4045545 - DNA, 18 bp, Homo sapiens
cttggcaaaagccttgtg

SEQ ID NO: 4045546 - DNA, 23 bp, Homo sapiens
cttggcaaaagccttgtgtatat

SEQ ID NO: 4045547 - DNA, 19 bp, Homo sapiens
cttggcaccagacacccag

SEQ ID NO: 4045548 - DNA, 20 bp, Homo sapiens
cttggcaccagacacccagg

SEQ ID NO: 4045549 - DNA, 21 bp, Homo sapiens
cttggcaccagacacccagga

SEQ ID NO: 4045550 - DNA, 17 bp, Homo sapiens
cttggccaagagaaggg

SEQ ID NO: 4045551 - DNA, 16 bp, Homo sapiens
cttggcccctgtgtga

SEQ ID NO: 4045552 - DNA, 11 bp, Homo sapiens
cttggcctcag

SEQ ID NO: 4045553 - DNA, 22 bp, Homo sapiens
cttggcctcccaaagtgctgag

SEQ ID NO: 4045554 - DNA, 15 bp, Homo sapiens
cttggcctgctgtga

SEQ ID NO: 4045555 - DNA, 14 bp, Homo sapiens
cttggcctttgcat

SEQ ID NO: 4045556 - DNA, 16 bp, Homo sapiens
cttggcctttgcattt

SEQ ID NO: 4045557 - DNA, 17 bp, Homo sapiens
cttggcgtggagccagg

SEQ ID NO: 4045558 - DNA, 18 bp, Homo sapiens
cttggcgtggagccaggg

SEQ ID NO: 4045559 - DNA, 12 bp, Homo sapiens
cttggctcagac

SEQ ID NO: 4045560 - DNA, 14 bp, Homo sapiens
cttggctcagacat

SEQ ID NO: 4045561 - DNA, 16 bp, Homo sapiens
cttggctcagacatgt

SEQ ID NO: 4045562 - DNA, 16 bp, Homo sapiens
cttggctctcctctgg

SEQ ID NO: 4045563 - DNA, 13 bp, Homo sapiens
cttggctctgcca

SEQ ID NO: 4045564 - DNA, 14 bp, Homo sapiens
cttggctctgccag

SEQ ID NO: 4045565 - DNA, 15 bp, Homo sapiens
cttggctgacccctc

SEQ ID NO: 4045566 - DNA, 16 bp, Homo sapiens
cttggctgactggggc

SEQ ID NO: 4045567 - DNA, 12 bp, Homo sapiens
cttggctgtgag

SEQ ID NO: 4045568 - DNA, 14 bp, Homo sapiens
cttggcttacctga

SEQ ID NO: 4045569 - DNA, 15 bp, Homo sapiens
cttggcttacctgac

SEQ ID NO: 4045570 - DNA, 16 bp, Homo sapiens
cttggcttacctgacc

SEQ ID NO: 4045571 - DNA, 21 bp, Homo sapiens
gaccccaaagagcctggagaa

SEQ ID NO: 4045572 - DNA, 13 bp, Homo sapiens
gaccccactgcca

SEQ ID NO: 4045573 - DNA, 17 bp, Homo sapiens
gaccccaggctggacat

SEQ ID NO: 4045574 - DNA, 16 bp, Homo sapiens
gacccccaccctgcac

SEQ ID NO: 4045575 - DNA, 15 bp, Homo sapiens
gacccccccagcttc

SEQ ID NO: 4045576 - DNA, 21 bp, Homo sapiens
gacccccgaggggagggcagg

SEQ ID NO: 4045577 - DNA, 21 bp, Homo sapiens
gacccctagttccctctgctc

SEQ ID NO: 4045578 - DNA, 16 bp, Homo sapiens
gacccctcgtccaccc

SEQ ID NO: 4045579 - DNA, 15 bp, Homo sapiens
gacccctctggccag

SEQ ID NO: 4045580 - DNA, 20 bp, Homo sapiens
gacccctctggccaggatgg

SEQ ID NO: 4045581 - DNA, 21 bp, Homo sapiens
gacccctgctcccagcctgct

SEQ ID NO: 4045582 - DNA, 13 bp, Homo sapiens
gacccctggcttt

SEQ ID NO: 4045583 - DNA, 21 bp, Homo sapiens
gacccctggcttttcactgct

SEQ ID NO: 4045584 - DNA, 22 bp, Homo sapiens
gacccctggcttttcactgctg

SEQ ID NO: 4045585 - DNA, 17 bp, Homo sapiens
gacccggaggggcctgg

SEQ ID NO: 4045586 - DNA, 14 bp, Homo sapiens
gacccggcctctct

SEQ ID NO: 4045587 - DNA, 15 bp, Homo sapiens
gaccctacaggagag

SEQ ID NO: 4045588 - DNA, 20 bp, Homo sapiens
gaccctcatggcccccaggg

SEQ ID NO: 4045589 - DNA, 20 bp, Homo sapiens
gaccctcgggccccatcctc

SEQ ID NO: 4045590 - DNA, 15 bp, Homo sapiens
gaccctctgaatggt

SEQ ID NO: 4045591 - DNA, 16 bp, Homo sapiens
gaccctgaaggggcca

SEQ ID NO: 4045592 - DNA, 17 bp, Homo sapiens
gaccctgccacagccag

SEQ ID NO: 4045593 - DNA, 18 bp, Homo sapiens
gaccctgccacagccaga

SEQ ID NO: 4045594 - DNA, 22 bp, Homo sapiens
gaccctgccacagccagaggag

SEQ ID NO: 4045595 - DNA, 15 bp, Homo sapiens
gaccctgcctcagct

SEQ ID NO: 4045596 - DNA, 22 bp, Homo sapiens
gaccctgggtgggctctgtgca

SEQ ID NO: 4045597 - DNA, 18 bp, Homo sapiens
gaccctggtgcctggctc

SEQ ID NO: 4045598 - DNA, 17 bp, Homo sapiens
gacccttcttgcctgct

SEQ ID NO: 4045599 - DNA, 22 bp, Homo sapiens
gacccttcttgcctgctgggct

SEQ ID NO: 4045600 - DNA, 21 bp, Homo sapiens
gacccttgacacctgctgaga

SEQ ID NO: 4045601 - DNA, 23 bp, Homo sapiens
gaccctttagccaaacccttgtc

SEQ ID NO: 4045602 - DNA, 22 bp, Homo sapiens
gaccctttgcctttcttctgcc

SEQ ID NO: 4045603 - DNA, 15 bp, Homo sapiens
gacccttttctcagg

SEQ ID NO: 4045604 - DNA, 15 bp, Homo sapiens
gaccggtgctgcagg

SEQ ID NO: 4045605 - DNA, 16 bp, Homo sapiens
gaccgtactctcacat

SEQ ID NO: 4045606 - DNA, 17 bp, Homo sapiens
gaccgtggacaggccca

SEQ ID NO: 4045607 - DNA, 22 bp, Homo sapiens
gacctaaccagggccagaagta

SEQ ID NO: 4045608 - DNA, 17 bp, Homo sapiens
gacctacattccctctc

SEQ ID NO: 4045609 - DNA, 21 bp, Homo sapiens
gacctactaggagaggggggc

SEQ ID NO: 4045610 - DNA, 13 bp, Homo sapiens
gacctactctcat

SEQ ID NO: 4045611 - DNA, 13 bp, Homo sapiens
gacctagcaggct

SEQ ID NO: 4045612 - DNA, 15 bp, Homo sapiens
gacctagcaggctgt

SEQ ID NO: 4045613 - DNA, 21 bp, Homo sapiens
gacctagggaggaccttatct

SEQ ID NO: 4045614 - DNA, 22 bp, Homo sapiens
gacctatgtcctaaggacacac

SEQ ID NO: 4045615 - DNA, 10 bp, Homo sapiens
gacctcatca

SEQ ID NO: 4045616 - DNA, 23 bp, Homo sapiens
gacctcatcaggatgaacccagg

SEQ ID NO: 4045617 - DNA, 20 bp, Homo sapiens
gacctcatctcccgagcaat

SEQ ID NO: 4045618 - DNA, 21 bp, Homo sapiens
gacctccgcccctgcccccgc

SEQ ID NO: 4045619 - DNA, 19 bp, Homo sapiens
gacctccttagccctgtct

SEQ ID NO: 4045620 - DNA, 20 bp, Homo sapiens
gacctccttagccctgtctg

SEQ ID NO: 4045621 - DNA, 12 bp, Homo sapiens
gacctctcaggg

SEQ ID NO: 4045622 - DNA, 18 bp, Homo sapiens
gacctctcagggcctggc

SEQ ID NO: 4045623 - DNA, 19 bp, Homo sapiens
gacctctcagggcctggca

SEQ ID NO: 4045624 - DNA, 12 bp, Homo sapiens
gacctcttgctg

SEQ ID NO: 4045625 - DNA, 17 bp, Homo sapiens
gacctcttgctgtctct

SEQ ID NO: 4045626 - DNA, 18 bp, Homo sapiens
gacctgaccccattcctg

SEQ ID NO: 4045627 - DNA, 13 bp, Homo sapiens
gacctgagctggc

SEQ ID NO: 4045628 - DNA, 16 bp, Homo sapiens
gacctgagctggccag

SEQ ID NO: 4045629 - DNA, 19 bp, Homo sapiens
gacctgccaggcaggggtg

SEQ ID NO: 4045630 - DNA, 20 bp, Homo sapiens
gacctgccaggcaggggtgg

SEQ ID NO: 4045631 - DNA, 21 bp, Homo sapiens
gacctgccaggcaggggtggg

SEQ ID NO: 4045632 - DNA, 19 bp, Homo sapiens
gacctgcctcctgcctgcc

SEQ ID NO: 4045633 - DNA, 22 bp, Homo sapiens
gacctgcctcctgcctgcccct

SEQ ID NO: 4045634 - DNA, 17 bp, Homo sapiens
gacctgctccgctgctc

SEQ ID NO: 4045635 - DNA, 19 bp, Homo sapiens
gacctgctccgctgctcct

SEQ ID NO: 4045636 - DNA, 13 bp, Homo sapiens
gacctgctgaagt

SEQ ID NO: 4045637 - DNA, 17 bp, Homo sapiens
gacctgcttagctgcct

SEQ ID NO: 4045638 - DNA, 16 bp, Homo sapiens
gacctggcactgggag

SEQ ID NO: 4045639 - DNA, 20 bp, Homo sapiens
gacctggcactgggaggcag

SEQ ID NO: 4045640 - DNA, 16 bp, Homo sapiens
gacctggctccactct

SEQ ID NO: 4045641 - DNA, 22 bp, Homo sapiens
gacctggctgcccctcaccttg

SEQ ID NO: 4045642 - DNA, 17 bp, Homo sapiens
gacctgggaacgactgg

SEQ ID NO: 4045643 - DNA, 13 bp, Homo sapiens
gacctggtcaggg

SEQ ID NO: 4045644 - DNA, 22 bp, Homo sapiens
gacctggttggccgtggtccag

SEQ ID NO: 4045645 - DNA, 19 bp, Homo sapiens
gacctgtctataagagaat

SEQ ID NO: 4045646 - DNA, 20 bp, Homo sapiens
gacctgtcttccaaggagac

SEQ ID NO: 4045647 - DNA, 16 bp, Homo sapiens
gacctgtgagcccagc

SEQ ID NO: 4045648 - DNA, 20 bp, Homo sapiens
gacctgtgctagttttacag

SEQ ID NO: 4045649 - DNA, 18 bp, Homo sapiens
gacctgttaaaattatac

SEQ ID NO: 4045650 - DNA, 18 bp, Homo sapiens
gacctgttagcagacagg

SEQ ID NO: 4045651 - DNA, 16 bp, Homo sapiens
gaccttaggccttcct

SEQ ID NO: 4045652 - DNA, 18 bp, Homo sapiens
gaccttaggccttcctct

SEQ ID NO: 4045653 - DNA, 21 bp, Homo sapiens
gaccttaggccttcctctctc

SEQ ID NO: 4045654 - DNA, 22 bp, Homo sapiens
gaccttatctgtgcgtgaaaca

SEQ ID NO: 4045655 - DNA, 12 bp, Homo sapiens
gaccttcctcat

SEQ ID NO: 4045656 - DNA, 22 bp, Homo sapiens
gaccttgcaacctcaccttcct

SEQ ID NO: 4045657 - DNA, 18 bp, Homo sapiens
gaccttggggtacaattg

SEQ ID NO: 4045658 - DNA, 20 bp, Homo sapiens
gaccttttaaagtgtttcag

SEQ ID NO: 4045659 - DNA, 18 bp, Homo sapiens
gacgatgtttatgttctt

SEQ ID NO: 4045660 - DNA, 15 bp, Homo sapiens
gacgattccttctct

SEQ ID NO: 4045661 - DNA, 19 bp, Homo sapiens
gacgcacacagctgagcac

SEQ ID NO: 4045662 - DNA, 23 bp, Homo sapiens
gacgcaccggcctggctgcagct

SEQ ID NO: 4045663 - DNA, 12 bp, Homo sapiens
gacgcccagccc

SEQ ID NO: 4045664 - DNA, 13 bp, Homo sapiens
gacgcccagcccc

SEQ ID NO: 4045665 - DNA, 22 bp, Homo sapiens
gacgccggggacagaggcctgc

SEQ ID NO: 4045666 - DNA, 12 bp, Homo sapiens
gacgcctgcagg

SEQ ID NO: 4045667 - DNA, 14 bp, Homo sapiens
gacgcgtctcctgt

SEQ ID NO: 4045668 - DNA, 13 bp, Homo sapiens
gacgctgcagagc

SEQ ID NO: 4045669 - DNA, 18 bp, Homo sapiens
gacgctgccgctgccgct

SEQ ID NO: 4045670 - DNA, 21 bp, Homo sapiens
gacgctgccgctgccgctgca

SEQ ID NO: 4045671 - DNA, 13 bp, Homo sapiens
gacgcttctgaat

SEQ ID NO: 4045672 - DNA, 13 bp, Homo sapiens
gacgctttgtctg

SEQ ID NO: 4045673 - DNA, 15 bp, Homo sapiens
gacggagagaaaaaa

SEQ ID NO: 4045674 - DNA, 12 bp, Homo sapiens
gacattaacagt

SEQ ID NO: 4045675 - DNA, 17 bp, Homo sapiens
gacattaacagttttcc

SEQ ID NO: 4045676 - DNA, 18 bp, Homo sapiens
gacattaacagttttcca

SEQ ID NO: 4045677 - DNA, 14 bp, Homo sapiens
gacattcacctgcc

SEQ ID NO: 4045678 - DNA, 16 bp, Homo sapiens
gacattcacctgcccc

SEQ ID NO: 4045679 - DNA, 21 bp, Homo sapiens
gacattgcgtttgacctttta

SEQ ID NO: 4045680 - DNA, 21 bp, Homo sapiens
gacattgtttggatttccttt

SEQ ID NO: 4045681 - DNA, 22 bp, Homo sapiens
gacattgtttggatttccttta

SEQ ID NO: 4045682 - DNA, 13 bp, Homo sapiens
gacatttaaatgt

SEQ ID NO: 4045683 - DNA, 13 bp, Homo sapiens
gacatttaattta

SEQ ID NO: 4045684 - DNA, 14 bp, Homo sapiens
gacatttaatttag

SEQ ID NO: 4045685 - DNA, 21 bp, Homo sapiens
gacatttcttttctttttaca

SEQ ID NO: 4045686 - DNA, 22 bp, Homo sapiens
gacatttgggagacatgtgaca

SEQ ID NO: 4045687 - DNA, 21 bp, Homo sapiens
gacattttacattaaattttt

SEQ ID NO: 4045688 - DNA, 20 bp, Homo sapiens
gaccaaccctggggaaggag

SEQ ID NO: 4045689 - DNA, 16 bp, Homo sapiens
gaccaacctgctctgt

SEQ ID NO: 4045690 - DNA, 20 bp, Homo sapiens
gaccaacctgctctgtcccc

SEQ ID NO: 4045691 - DNA, 17 bp, Homo sapiens
gaccaactctctcctgt

SEQ ID NO: 4045692 - DNA, 14 bp, Homo sapiens
gaccaactgcccta

SEQ ID NO: 4045693 - DNA, 13 bp, Homo sapiens
gaccaagaactgc

SEQ ID NO: 4045694 - DNA, 15 bp, Homo sapiens
gaccaagaactgcat

SEQ ID NO: 4045695 - DNA, 16 bp, Homo sapiens
gaccaagtcctggcta

SEQ ID NO: 4045696 - DNA, 21 bp, Homo sapiens
gaccaataaaatttctaagag

SEQ ID NO: 4045697 - DNA, 15 bp, Homo sapiens
gaccaattgtgctgc

SEQ ID NO: 4045698 - DNA, 12 bp, Homo sapiens
gaccacagcaca

SEQ ID NO: 4045699 - DNA, 21 bp, Homo sapiens
gaccacaggcatctacacagc

SEQ ID NO: 4045700 - DNA, 21 bp, Homo sapiens
gaccacagggttcaaaatgtc

SEQ ID NO: 4045701 - DNA, 17 bp, Homo sapiens
gaccacatctttatctg

SEQ ID NO: 4045702 - DNA, 15 bp, Homo sapiens
gaccacatgccactg

SEQ ID NO: 4045703 - DNA, 18 bp, Homo sapiens
gaccacatgccactgcct

SEQ ID NO: 4045704 - DNA, 19 bp, Homo sapiens
gaccacatgccactgcctg

SEQ ID NO: 4045705 - DNA, 22 bp, Homo sapiens
gaccaccaccccaacaaaccat

SEQ ID NO: 4045706 - DNA, 20 bp, Homo sapiens
gaccaccagccgccccagcc

SEQ ID NO: 4045707 - DNA, 23 bp, Homo sapiens
gaccaccagccgccccagcccct

SEQ ID NO: 4045708 - DNA, 16 bp, Homo sapiens
gaccacctgcttctga

SEQ ID NO: 4045709 - DNA, 16 bp, Homo sapiens
gaccaccttctgtccc

SEQ ID NO: 4045710 - DNA, 21 bp, Homo sapiens
gaccacgctttctagctgttg

SEQ ID NO: 4045711 - DNA, 15 bp, Homo sapiens
gaccacttccagggg

SEQ ID NO: 4045712 - DNA, 16 bp, Homo sapiens
gaccagaagccaaaga

SEQ ID NO: 4045713 - DNA, 13 bp, Homo sapiens
gaccagaagcctt

SEQ ID NO: 4045714 - DNA, 17 bp, Homo sapiens
gaccagacaagctgttg

SEQ ID NO: 4045715 - DNA, 14 bp, Homo sapiens
gaccagagccagat

SEQ ID NO: 4045716 - DNA, 15 bp, Homo sapiens
gaccagagccagatg

SEQ ID NO: 4045717 - DNA, 16 bp, Homo sapiens
gaccagagccagatgc

SEQ ID NO: 4045718 - DNA, 18 bp, Homo sapiens
gaccagagccagatgcag

SEQ ID NO: 4045719 - DNA, 23 bp, Homo sapiens
gaccagagccagatgcaggacag

SEQ ID NO: 4045720 - DNA, 17 bp, Homo sapiens
gaccagcactgtctcag

SEQ ID NO: 4045721 - DNA, 12 bp, Homo sapiens
gaccagctcagg

SEQ ID NO: 4045722 - DNA, 16 bp, Homo sapiens
gaccaggactccctcc

SEQ ID NO: 4045723 - DNA, 20 bp, Homo sapiens
gaccaggatcccaagcctcc

SEQ ID NO: 4045724 - DNA, 21 bp, Homo sapiens
gaccaggatcccaagcctcct

SEQ ID NO: 4045725 - DNA, 15 bp, Homo sapiens
gaccagggatgctgg

SEQ ID NO: 4045726 - DNA, 20 bp, Homo sapiens
gaccagggatgctgggctgg

SEQ ID NO: 4045727 - DNA, 18 bp, Homo sapiens
gaccagggctggggcagc

SEQ ID NO: 4045728 - DNA, 17 bp, Homo sapiens
gaccagttgggagcact

SEQ ID NO: 4045729 - DNA, 15 bp, Homo sapiens
gaccataatgttaca

SEQ ID NO: 4045730 - DNA, 21 bp, Homo sapiens
gaccatccactctaccctccc

SEQ ID NO: 4045731 - DNA, 14 bp, Homo sapiens
gaccatcctggcta

SEQ ID NO: 4045732 - DNA, 16 bp, Homo sapiens
gaccatctgattaaaa

SEQ ID NO: 4045733 - DNA, 18 bp, Homo sapiens
gaccatcttcataatttg

SEQ ID NO: 4045734 - DNA, 21 bp, Homo sapiens
gaccatgaagtaaattatgta

SEQ ID NO: 4045735 - DNA, 12 bp, Homo sapiens
gaccatgccaga

SEQ ID NO: 4045736 - DNA, 14 bp, Homo sapiens
gaccatgccagatt

SEQ ID NO: 4045737 - DNA, 15 bp, Homo sapiens
gaccatgccagattc

SEQ ID NO: 4045738 - DNA, 12 bp, Homo sapiens
gaccatgtgtca

SEQ ID NO: 4045739 - DNA, 15 bp, Homo sapiens
gaccattaataaaga

SEQ ID NO: 4045740 - DNA, 17 bp, Homo sapiens
gacccaagtcaaagatg

SEQ ID NO: 4045741 - DNA, 23 bp, Homo sapiens
gacccacagactggttttgcaac

SEQ ID NO: 4045742 - DNA, 16 bp, Homo sapiens
gacccactgatctcta

SEQ ID NO: 4045743 - DNA, 16 bp, Homo sapiens
gacccagaatggagcc

SEQ ID NO: 4045744 - DNA, 12 bp, Homo sapiens
gacccagcagga

SEQ ID NO: 4045745 - DNA, 18 bp, Homo sapiens
gacccaggacccccgagg

SEQ ID NO: 4045746 - DNA, 17 bp, Homo sapiens
gacccaggcctgtggcc

SEQ ID NO: 4045747 - DNA, 15 bp, Homo sapiens
gacccagtgccccca

SEQ ID NO: 4045748 - DNA, 17 bp, Homo sapiens
gacccagtgcccccact

SEQ ID NO: 4045749 - DNA, 18 bp, Homo sapiens
gaccccaaagagcctgga

SEQ ID NO: 4045750 - DNA, 16 bp, Homo sapiens
gactggaggtgggcat

SEQ ID NO: 4045751 - DNA, 17 bp, Homo sapiens
gactggaggtgggcatg

SEQ ID NO: 4045752 - DNA, 16 bp, Homo sapiens
gactggagtcagatga

SEQ ID NO: 4045753 - DNA, 18 bp, Homo sapiens
gactggagtcagatgagc

SEQ ID NO: 4045754 - DNA, 20 bp, Homo sapiens
gactggagtcagatgagcaa

SEQ ID NO: 4045755 - DNA, 20 bp, Homo sapiens
gactggctagagtcctcact

SEQ ID NO: 4045756 - DNA, 19 bp, Homo sapiens
gactgggaggagggggagg

SEQ ID NO: 4045757 - DNA, 13 bp, Homo sapiens
gactgggaggtag

SEQ ID NO: 4045758 - DNA, 17 bp, Homo sapiens
gactgggagtcagagcc

SEQ ID NO: 4045759 - DNA, 12 bp, Homo sapiens
gactgggcctcc

SEQ ID NO: 4045760 - DNA, 15 bp, Homo sapiens
gagaagggatggagg

SEQ ID NO: 4045761 - DNA, 19 bp, Homo sapiens
gagaaggtaaggtgtgaac

SEQ ID NO: 4045762 - DNA, 14 bp, Homo sapiens
gagaagtgccttct

SEQ ID NO: 4045763 - DNA, 15 bp, Homo sapiens
gagaagtgccttctc

SEQ ID NO: 4045764 - DNA, 17 bp, Homo sapiens
gagaatactttgcttca

SEQ ID NO: 4045765 - DNA, 18 bp, Homo sapiens
gagaatactttgcttcat

SEQ ID NO: 4045766 - DNA, 21 bp, Homo sapiens
gagaatccaagggttgagagc

SEQ ID NO: 4045767 - DNA, 20 bp, Homo sapiens
gagaatcccactttctatag

SEQ ID NO: 4045768 - DNA, 14 bp, Homo sapiens
gagaatcccttaaa

SEQ ID NO: 4045769 - DNA, 14 bp, Homo sapiens
gagaatggagacag

SEQ ID NO: 4045770 - DNA, 20 bp, Homo sapiens
gagaatggtgtgaacccggg

SEQ ID NO: 4045771 - DNA, 23 bp, Homo sapiens
gagaatgtgtgtgtgtggcaggg

SEQ ID NO: 4045772 - DNA, 18 bp, Homo sapiens
gagaattgcttgaaccca

SEQ ID NO: 4045773 - DNA, 21 bp, Homo sapiens
gagaatttaagtagaaaagtt

SEQ ID NO: 4045774 - DNA, 13 bp, Homo sapiens
gagaatttctaaa

SEQ ID NO: 4045775 - DNA, 15 bp, Homo sapiens
gagaattttaaatta

SEQ ID NO: 4045776 - DNA, 17 bp, Homo sapiens
gagacaagaaatccctg

SEQ ID NO: 4045777 - DNA, 22 bp, Homo sapiens
gagacacaggcacgggtccctg

SEQ ID NO: 4045778 - DNA, 17 bp, Homo sapiens
gagacacttgccttctt

SEQ ID NO: 4045779 - DNA, 21 bp, Homo sapiens
gagacagaccacttgccacgc

SEQ ID NO: 4045780 - DNA, 23 bp, Homo sapiens
gagacagaggaaagggctggctc

SEQ ID NO: 4045781 - DNA, 16 bp, Homo sapiens
gagacaggagcctagc

SEQ ID NO: 4045782 - DNA, 15 bp, Homo sapiens
gagacaggagggcaa

SEQ ID NO: 4045783 - DNA, 19 bp, Homo sapiens
gagacaggcagcccagcag

SEQ ID NO: 4045784 - DNA, 19 bp, Homo sapiens
gagacagggtttcaccatg

SEQ ID NO: 4045785 - DNA, 16 bp, Homo sapiens
gagacagtttcttagc

SEQ ID NO: 4045786 - DNA, 21 bp, Homo sapiens
gagacagtttcttagcttttt

SEQ ID NO: 4045787 - DNA, 16 bp, Homo sapiens
gagacattgacaccag

SEQ ID NO: 4045788 - DNA, 22 bp, Homo sapiens
gagaccaagactctgaaatctc

SEQ ID NO: 4045789 - DNA, 16 bp, Homo sapiens
gagaccagcctgggca

SEQ ID NO: 4045790 - DNA, 22 bp, Homo sapiens
gagaccagctcagaggcccagg

SEQ ID NO: 4045791 - DNA, 22 bp, Homo sapiens
gagaccagtgtatcaggtcagg

SEQ ID NO: 4045792 - DNA, 23 bp, Homo sapiens
gagaccagttgggagcactggag

SEQ ID NO: 4045793 - DNA, 16 bp, Homo sapiens
gagaccatcctggcta

SEQ ID NO: 4045794 - DNA, 15 bp, Homo sapiens
gagacccaaaccccc

SEQ ID NO: 4045795 - DNA, 19 bp, Homo sapiens
gagacccaacagcagtgat

SEQ ID NO: 4045796 - DNA, 14 bp, Homo sapiens
gagacccaggcctg

SEQ ID NO: 4045797 - DNA, 13 bp, Homo sapiens
gagacccccacac

SEQ ID NO: 4045798 - DNA, 15 bp, Homo sapiens
gagacccccacacct

SEQ ID NO: 4045799 - DNA, 23 bp, Homo sapiens
gagacccccacacctcagttccc

SEQ ID NO: 4045800 - DNA, 17 bp, Homo sapiens
gagaccctacaggagag

SEQ ID NO: 4045801 - DNA, 23 bp, Homo sapiens
gagaccctcgcccaactccacca

SEQ ID NO: 4045802 - DNA, 20 bp, Homo sapiens
gagaccgtcgggggctgagg

SEQ ID NO: 4045803 - DNA, 11 bp, Homo sapiens
gagacctcatc

SEQ ID NO: 4045804 - DNA, 12 bp, Homo sapiens
gagacctcatca

SEQ ID NO: 4045805 - DNA, 20 bp, Homo sapiens
gagacctcatcaggatgaac

SEQ ID NO: 4045806 - DNA, 19 bp, Homo sapiens
gagacctggcactggatgc

SEQ ID NO: 4045807 - DNA, 21 bp, Homo sapiens
gagacgccactccctgggaca

SEQ ID NO: 4045808 - DNA, 22 bp, Homo sapiens
gagacgcccagccccatccctg

SEQ ID NO: 4045809 - DNA, 18 bp, Homo sapiens
gagacgtggaacctctgt

SEQ ID NO: 4045810 - DNA, 22 bp, Homo sapiens
gagacgtggaacctctgtctca

SEQ ID NO: 4045811 - DNA, 15 bp, Homo sapiens
gagactaagccctgt

SEQ ID NO: 4045812 - DNA, 16 bp, Homo sapiens
gagactagattgcctt

SEQ ID NO: 4045813 - DNA, 22 bp, Homo sapiens
gagactatttaaacttataaat

SEQ ID NO: 4045814 - DNA, 13 bp, Homo sapiens
gagactctgtctc

SEQ ID NO: 4045815 - DNA, 21 bp, Homo sapiens
gagactgagatcactgactct

SEQ ID NO: 4045816 - DNA, 22 bp, Homo sapiens
gagactgataacttggggaggc

SEQ ID NO: 4045817 - DNA, 13 bp, Homo sapiens
gagactgggaaga

SEQ ID NO: 4045818 - DNA, 21 bp, Homo sapiens
gagactgggaagataggctct

SEQ ID NO: 4045819 - DNA, 16 bp, Homo sapiens
gagactgggagccact

SEQ ID NO: 4045820 - DNA, 15 bp, Homo sapiens
gagactgggtaggaa

SEQ ID NO: 4045821 - DNA, 23 bp, Homo sapiens
gagactgtagattgcttctgtag

SEQ ID NO: 4045822 - DNA, 19 bp, Homo sapiens
gagactgtcggagaggctg

SEQ ID NO: 4045823 - DNA, 22 bp, Homo sapiens
gagactgtctcaagagggcact

SEQ ID NO: 4045824 - DNA, 23 bp, Homo sapiens
gagacttactgggtgaggaaatc

SEQ ID NO: 4045825 - DNA, 14 bp, Homo sapiens
gagactttctgctg

SEQ ID NO: 4045826 - DNA, 14 bp, Homo sapiens
gagagaaattctgt

SEQ ID NO: 4045827 - DNA, 16 bp, Homo sapiens
gagagaaattctgtta

SEQ ID NO: 4045828 - DNA, 13 bp, Homo sapiens
gagagaagctctt

SEQ ID NO: 4045829 - DNA, 22 bp, Homo sapiens
gagagaatgtgtgtgtgtggca

SEQ ID NO: 4045830 - DNA, 21 bp, Homo sapiens
gagagacaggcagcccagcag

SEQ ID NO: 4045831 - DNA, 21 bp, Homo sapiens
gagagacgcagtccgcccagg

SEQ ID NO: 4045832 - DNA, 21 bp, Homo sapiens
gagagacgccactccctggga

SEQ ID NO: 4045833 - DNA, 14 bp, Homo sapiens
gagagagagagagg

SEQ ID NO: 4045834 - DNA, 19 bp, Homo sapiens
gagagaggttgaaaaacaa

SEQ ID NO: 4045835 - DNA, 14 bp, Homo sapiens
gagagatatatctg

SEQ ID NO: 4045836 - DNA, 18 bp, Homo sapiens
gagagatatatctgaaaa

SEQ ID NO: 4045837 - DNA, 13 bp, Homo sapiens
gagagcaactctg

SEQ ID NO: 4045838 - DNA, 13 bp, Homo sapiens
gagagcagcagca

SEQ ID NO: 4045839 - DNA, 14 bp, Homo sapiens
gagagcagctccct

SEQ ID NO: 4045840 - DNA, 15 bp, Homo sapiens
gagagcagctccctt

SEQ ID NO: 4045841 - DNA, 21 bp, Homo sapiens
gagagcagctttaaactcagg

SEQ ID NO: 4045842 - DNA, 18 bp, Homo sapiens
gagagccaacctcggctt

SEQ ID NO: 4045843 - DNA, 17 bp, Homo sapiens
gagagccagtggcgggt

SEQ ID NO: 4045844 - DNA, 14 bp, Homo sapiens
gagagcccattccc

SEQ ID NO: 4045845 - DNA, 20 bp, Homo sapiens
gagagccgtggtccctgagg

SEQ ID NO: 4045846 - DNA, 13 bp, Homo sapiens
gagagcctgctgc

SEQ ID NO: 4045847 - DNA, 19 bp, Homo sapiens
gagagcctggtgctgctgc

SEQ ID NO: 4045848 - DNA, 13 bp, Homo sapiens
gagagctggtgcc

SEQ ID NO: 4045849 - DNA, 19 bp, Homo sapiens
gagaggaatgcctgtgtga

SEQ ID NO: 4045850 - DNA, 19 bp, Homo sapiens
gagaggacaatactggggt

SEQ ID NO: 4045851 - DNA, 17 bp, Homo sapiens
gagaggagccagacaga

SEQ ID NO: 4045852 - DNA, 17 bp, Homo sapiens
gagaggaggcagccccc

SEQ ID NO: 4045853 - DNA, 21 bp, Homo sapiens
gagaggatgaatgtatgtgca

SEQ ID NO: 4045854 - DNA, 14 bp, Homo sapiens
gagaggatgagagc

SEQ ID NO: 4045855 - DNA, 18 bp, Homo sapiens
gagaggatgagagcccag

SEQ ID NO: 4045856 - DNA, 19 bp, Homo sapiens
gagaggatgagagcccaga

SEQ ID NO: 4045857 - DNA, 14 bp, Homo sapiens
gagaggatgtgcaa

SEQ ID NO: 4045858 - DNA, 20 bp, Homo sapiens
gagaggatgtggaaagcact

SEQ ID NO: 4045859 - DNA, 14 bp, Homo sapiens
gagaggcaatgatt

SEQ ID NO: 4045860 - DNA, 13 bp, Homo sapiens
gagaggcactcag

SEQ ID NO: 4045861 - DNA, 19 bp, Homo sapiens
gagaggcactcagtgagcc

SEQ ID NO: 4045862 - DNA, 15 bp, Homo sapiens
gagaggcaggcatag

SEQ ID NO: 4045863 - DNA, 18 bp, Homo sapiens
gagaggccaaaggctggt

SEQ ID NO: 4045864 - DNA, 17 bp, Homo sapiens
gagaggctctccgtgca

SEQ ID NO: 4045865 - DNA, 18 bp, Homo sapiens
gagaggctgtctggggcc

SEQ ID NO: 4045866 - DNA, 14 bp, Homo sapiens
gagagggagagaga

SEQ ID NO: 4045867 - DNA, 23 bp, Homo sapiens
gagagggatttccctgcagacct

SEQ ID NO: 4045868 - DNA, 18 bp, Homo sapiens
gagaggggagagctgaac

SEQ ID NO: 4045869 - DNA, 23 bp, Homo sapiens
gagctctggggacagcttcctca

SEQ ID NO: 4045870 - DNA, 17 bp, Homo sapiens
gagctcttcaggcctcc

SEQ ID NO: 4045871 - DNA, 19 bp, Homo sapiens
gagctcttcaggcctccct

SEQ ID NO: 4045872 - DNA, 22 bp, Homo sapiens
gagctcttcaggcctccctctc

SEQ ID NO: 4045873 - DNA, 13 bp, Homo sapiens
gagctcttccctt

SEQ ID NO: 4045874 - DNA, 14 bp, Homo sapiens
gagctcttggcctt

SEQ ID NO: 4045875 - DNA, 22 bp, Homo sapiens
gagctgaacccattttgagtga

SEQ ID NO: 4045876 - DNA, 23 bp, Homo sapiens
gagctgaacccattttgagtgac

SEQ ID NO: 4045877 - DNA, 19 bp, Homo sapiens
gagctgagcagcctctgga

SEQ ID NO: 4045878 - DNA, 17 bp, Homo sapiens
gagctgaggccacactc

SEQ ID NO: 4045879 - DNA, 17 bp, Homo sapiens
gagctgatataaattct

SEQ ID NO: 4045880 - DNA, 19 bp, Homo sapiens
gagctgatataaattctgt

SEQ ID NO: 4045881 - DNA, 16 bp, Homo sapiens
gagctgcaccaggtag

SEQ ID NO: 4045882 - DNA, 22 bp, Homo sapiens
gagctgcactgatcacccaatg

SEQ ID NO: 4045883 - DNA, 14 bp, Homo sapiens
gagctgcagcctgg

SEQ ID NO: 4045884 - DNA, 15 bp, Homo sapiens
gagctgcagcctggc

SEQ ID NO: 4045885 - DNA, 17 bp, Homo sapiens
gagctgcagcctggctg

SEQ ID NO: 4045886 - DNA, 11 bp, Homo sapiens
gagctgcaggg

SEQ ID NO: 4045887 - DNA, 21 bp, Homo sapiens
gagctgccagtggggcctgag

SEQ ID NO: 4045888 - DNA, 11 bp, Homo sapiens
gagctgccctc

SEQ ID NO: 4045889 - DNA, 15 bp, Homo sapiens
gagctgccctccttg

SEQ ID NO: 4045890 - DNA, 23 bp, Homo sapiens
gagctgccctccttgtccaccca

SEQ ID NO: 4045891 - DNA, 19 bp, Homo sapiens
gagctgccttccctagctt

SEQ ID NO: 4045892 - DNA, 15 bp, Homo sapiens
gagctgctgccatga

SEQ ID NO: 4045893 - DNA, 20 bp, Homo sapiens
gagctggcaaaggtggctct

SEQ ID NO: 4045894 - DNA, 14 bp, Homo sapiens
gagctggctccagc

SEQ ID NO: 4045895 - DNA, 21 bp, Homo sapiens
gagctgggacacttaacagat

SEQ ID NO: 4045896 - DNA, 18 bp, Homo sapiens
gagctggggactcaggga

SEQ ID NO: 4045897 - DNA, 22 bp, Homo sapiens
gagctggggggttggcagccca

SEQ ID NO: 4045898 - DNA, 22 bp, Homo sapiens
gagctgtggaggattgctatct

SEQ ID NO: 4045899 - DNA, 19 bp, Homo sapiens
gagctgtttatggcctcag

SEQ ID NO: 4045900 - DNA, 19 bp, Homo sapiens
gagcttcggttctccagaa

SEQ ID NO: 4045901 - DNA, 13 bp, Homo sapiens
gagcttgaagatt

SEQ ID NO: 4045902 - DNA, 19 bp, Homo sapiens
gagcttgctttgatttaca

SEQ ID NO: 4045903 - DNA, 20 bp, Homo sapiens
gagcttgggcagtgccccag

SEQ ID NO: 4045904 - DNA, 14 bp, Homo sapiens
gagcttgtgtcctg

SEQ ID NO: 4045905 - DNA, 21 bp, Homo sapiens
gagctttctgtccttttggca

SEQ ID NO: 4045906 - DNA, 13 bp, Homo sapiens
gagctttgtgctt

SEQ ID NO: 4045907 - DNA, 18 bp, Homo sapiens
gagcttttttctttaaga

SEQ ID NO: 4045908 - DNA, 14 bp, Homo sapiens
gaggaaaaaggtca

SEQ ID NO: 4045909 - DNA, 21 bp, Homo sapiens
gaggaaaagtaaggtgcagtt

SEQ ID NO: 4045910 - DNA, 22 bp, Homo sapiens
gaggaaagcacagaggcctcct

SEQ ID NO: 4045911 - DNA, 17 bp, Homo sapiens
gaggaacccccaccaga

SEQ ID NO: 4045912 - DNA, 20 bp, Homo sapiens
gaggaacccccaccagacat

SEQ ID NO: 4045913 - DNA, 16 bp, Homo sapiens
gaggaactgtccagag

SEQ ID NO: 4045914 - DNA, 21 bp, Homo sapiens
gaggaactgtccagagagcaa

SEQ ID NO: 4045915 - DNA, 19 bp, Homo sapiens
gaggaaggaacagcaatgg

SEQ ID NO: 4045916 - DNA, 19 bp, Homo sapiens
gaggaatctgtgggtctgg

SEQ ID NO: 4045917 - DNA, 20 bp, Homo sapiens
gaggaatctgtgggtctggg

SEQ ID NO: 4045918 - DNA, 21 bp, Homo sapiens
gaggaatctgtgggtctggga

SEQ ID NO: 4045919 - DNA, 22 bp, Homo sapiens
gaggaatctgtgggtctgggag

SEQ ID NO: 4045920 - DNA, 13 bp, Homo sapiens
gaggacactcccg

SEQ ID NO: 4045921 - DNA, 15 bp, Homo sapiens
gaggacagcttgagc

SEQ ID NO: 4045922 - DNA, 18 bp, Homo sapiens
gaggacagcttgagccgg

SEQ ID NO: 4045923 - DNA, 22 bp, Homo sapiens
gaggaccactcctgtacactga

SEQ ID NO: 4045924 - DNA, 13 bp, Homo sapiens
gaggaccagggct

SEQ ID NO: 4045925 - DNA, 16 bp, Homo sapiens
gaggaccgctgataag

SEQ ID NO: 4045926 - DNA, 15 bp, Homo sapiens
gaggaccttatctgt

SEQ ID NO: 4045927 - DNA, 22 bp, Homo sapiens
gaggacgtcatcggaggctggg

SEQ ID NO: 4045928 - DNA, 17 bp, Homo sapiens
gaggactcccaaccctg

SEQ ID NO: 4045929 - DNA, 18 bp, Homo sapiens
gaggactcccaaccctgg

SEQ ID NO: 4045930 - DNA, 14 bp, Homo sapiens
gaggagaagaaaat

SEQ ID NO: 4045931 - DNA, 13 bp, Homo sapiens
gaggagaccagct

SEQ ID NO: 4045932 - DNA, 15 bp, Homo sapiens
gaggagaccagctca

SEQ ID NO: 4045933 - DNA, 16 bp, Homo sapiens
gaggagaccagctcag

SEQ ID NO: 4045934 - DNA, 20 bp, Homo sapiens
gaggagaggggaagggccag

SEQ ID NO: 4045935 - DNA, 21 bp, Homo sapiens
gaggagcccatactcagcctg

SEQ ID NO: 4045936 - DNA, 14 bp, Homo sapiens
gaggagccccagct

SEQ ID NO: 4045937 - DNA, 20 bp, Homo sapiens
gaggagctctaccctgctcc

SEQ ID NO: 4045938 - DNA, 14 bp, Homo sapiens
gaggaggaaaagga

SEQ ID NO: 4045939 - DNA, 16 bp, Homo sapiens
gaggaggcctgtccca

SEQ ID NO: 4045940 - DNA, 22 bp, Homo sapiens
gaggaggccttgggctctgctg

SEQ ID NO: 4045941 - DNA, 15 bp, Homo sapiens
gaggagggatgctgc

SEQ ID NO: 4045942 - DNA, 12 bp, Homo sapiens
gaggagggcaga

SEQ ID NO: 4045943 - DNA, 11 bp, Homo sapiens
gaggaggggag

SEQ ID NO: 4045944 - DNA, 12 bp, Homo sapiens
gaggaggggagg

SEQ ID NO: 4045945 - DNA, 12 bp, Homo sapiens
gaggagggtggg

SEQ ID NO: 4045946 - DNA, 15 bp, Homo sapiens
gaggagggtggggga

SEQ ID NO: 4045947 - DNA, 21 bp, Homo sapiens
gaggagtaacaatacaaatgg

SEQ ID NO: 4045948 - DNA, 22 bp, Homo sapiens
gaggagtaacaatacaaatgga

SEQ ID NO: 4045949 - DNA, 20 bp, Homo sapiens
gaggagtttcgaggtagagt

SEQ ID NO: 4045950 - DNA, 21 bp, Homo sapiens
gaggatgaatgtatgtgcact

SEQ ID NO: 4045951 - DNA, 14 bp, Homo sapiens
gaggatgagagccc

SEQ ID NO: 4045952 - DNA, 13 bp, Homo sapiens
gaggatgtccctg

SEQ ID NO: 4045953 - DNA, 15 bp, Homo sapiens
gaggattgctatctg

SEQ ID NO: 4045954 - DNA, 20 bp, Homo sapiens
gaggatttaagggatggaaa

SEQ ID NO: 4045955 - DNA, 22 bp, Homo sapiens
gaggatttaagggatggaaaag

SEQ ID NO: 4045956 - DNA, 14 bp, Homo sapiens
gaggcaagaaaagg

SEQ ID NO: 4045957 - DNA, 13 bp, Homo sapiens
gaggcaagagaat

SEQ ID NO: 4045958 - DNA, 17 bp, Homo sapiens
gaggcactcagtgagcc

SEQ ID NO: 4045959 - DNA, 16 bp, Homo sapiens
gaggcagagaaagaag

SEQ ID NO: 4045960 - DNA, 12 bp, Homo sapiens
gaggcagagttt

SEQ ID NO: 4045961 - DNA, 12 bp, Homo sapiens
gaggcagcccgc

SEQ ID NO: 4045962 - DNA, 21 bp, Homo sapiens
gaggcagctatctgcactcta

SEQ ID NO: 4045963 - DNA, 19 bp, Homo sapiens
gaggcagcttcaagtgcct

SEQ ID NO: 4045964 - DNA, 23 bp, Homo sapiens
gaggcaggaggattgcttgagcc

SEQ ID NO: 4045965 - DNA, 12 bp, Homo sapiens
gaggcaggctgg

SEQ ID NO: 4045966 - DNA, 16 bp, Homo sapiens
gaggcagggctctccc

SEQ ID NO: 4045967 - DNA, 18 bp, Homo sapiens
gaggcagttgcccagcct

SEQ ID NO: 4045968 - DNA, 18 bp, Homo sapiens
gaggcatgcacatctgga

SEQ ID NO: 4045969 - DNA, 15 bp, Homo sapiens
gaggcatggccctgg

SEQ ID NO: 4045970 - DNA, 18 bp, Homo sapiens
gaggccaaaggctggtgg

SEQ ID NO: 4045971 - DNA, 15 bp, Homo sapiens
gaggccaataaaaag

SEQ ID NO: 4045972 - DNA, 16 bp, Homo sapiens
cttccaggggaacctg

SEQ ID NO: 4045973 - DNA, 19 bp, Homo sapiens
cttccaggggaacctgcca

SEQ ID NO: 4045974 - DNA, 19 bp, Homo sapiens
cttccaggtatctccagga

SEQ ID NO: 4045975 - DNA, 19 bp, Homo sapiens
cttccagtttattccagag

SEQ ID NO: 4045976 - DNA, 20 bp, Homo sapiens
cttccagtttattccagagc

SEQ ID NO: 4045977 - DNA, 21 bp, Homo sapiens
cttccagtttattccagagct

SEQ ID NO: 4045978 - DNA, 11 bp, Homo sapiens
cttccataatg

SEQ ID NO: 4045979 - DNA, 14 bp, Homo sapiens
cttccataattatg

SEQ ID NO: 4045980 - DNA, 17 bp, Homo sapiens
cttccatacacagagga

SEQ ID NO: 4045981 - DNA, 14 bp, Homo sapiens
cttccatacagctc

SEQ ID NO: 4045982 - DNA, 16 bp, Homo sapiens
cttccatacagctcta

SEQ ID NO: 4045983 - DNA, 22 bp, Homo sapiens
cttccatagcctaatccctggg

SEQ ID NO: 4045984 - DNA, 23 bp, Homo sapiens
cttccataggacatactgcatgt

SEQ ID NO: 4045985 - DNA, 17 bp, Homo sapiens
cttccatccctaccccc

SEQ ID NO: 4045986 - DNA, 16 bp, Homo sapiens
cttccatctctgactt

SEQ ID NO: 4045987 - DNA, 17 bp, Homo sapiens
cttccatgagaacagca

SEQ ID NO: 4045988 - DNA, 13 bp, Homo sapiens
cttccatgcctta

SEQ ID NO: 4045989 - DNA, 19 bp, Homo sapiens
cttccatgtatcttttgaa

SEQ ID NO: 4045990 - DNA, 16 bp, Homo sapiens
cttccatgtgcctttc

SEQ ID NO: 4045991 - DNA, 12 bp, Homo sapiens
cttccatttata

SEQ ID NO: 4045992 - DNA, 16 bp, Homo sapiens
cttccatttctgcctt

SEQ ID NO: 4045993 - DNA, 20 bp, Homo sapiens
cttccatttctgccttttgt

SEQ ID NO: 4045994 - DNA, 19 bp, Homo sapiens
cttccattttcccccacta

SEQ ID NO: 4045995 - DNA, 23 bp, Homo sapiens
cttccattttcccccactactgc

SEQ ID NO: 4045996 - DNA, 13 bp, Homo sapiens
cttcccaccccta

SEQ ID NO: 4045997 - DNA, 21 bp, Homo sapiens
cttcccacccctacacacaca

SEQ ID NO: 4045998 - DNA, 16 bp, Homo sapiens
cttcccactcttctca

SEQ ID NO: 4045999 - DNA, 14 bp, Homo sapiens
cttcccactggagg

SEQ ID NO: 4046000 - DNA, 20 bp, Homo sapiens
cttcccagagggagcaggcc

SEQ ID NO: 4046001 - DNA, 23 bp, Homo sapiens
cttcccagttcaggagtcccaag

SEQ ID NO: 4046002 - DNA, 17 bp, Homo sapiens
cttcccataataaagca

SEQ ID NO: 4046003 - DNA, 18 bp, Homo sapiens
cttcccatgactgcaccc

SEQ ID NO: 4046004 - DNA, 12 bp, Homo sapiens
cttcccattcca

SEQ ID NO: 4046005 - DNA, 16 bp, Homo sapiens
cttcccatttcttccc

SEQ ID NO: 4046006 - DNA, 21 bp, Homo sapiens
cttccccaccgcagtcaccac

SEQ ID NO: 4046007 - DNA, 13 bp, Homo sapiens
cttccccagagag

SEQ ID NO: 4046008 - DNA, 14 bp, Homo sapiens
cttccccagagagg

SEQ ID NO: 4046009 - DNA, 12 bp, Homo sapiens
cttccccaggat

SEQ ID NO: 4046010 - DNA, 23 bp, Homo sapiens
cttccccaggatggactcttctc

SEQ ID NO: 4046011 - DNA, 15 bp, Homo sapiens
cttccccctccaatc

SEQ ID NO: 4046012 - DNA, 18 bp, Homo sapiens
cttccccctgtagactag

SEQ ID NO: 4046013 - DNA, 14 bp, Homo sapiens
cttcccctccctgg

SEQ ID NO: 4046014 - DNA, 16 bp, Homo sapiens
cttcccctccctggct

SEQ ID NO: 4046015 - DNA, 15 bp, Homo sapiens
cttccccttagaaac

SEQ ID NO: 4046016 - DNA, 14 bp, Homo sapiens
cttccccttccctt

SEQ ID NO: 4046017 - DNA, 15 bp, Homo sapiens
cttccccttcctgtt

SEQ ID NO: 4046018 - DNA, 13 bp, Homo sapiens
cttccccttctgt

SEQ ID NO: 4046019 - DNA, 15 bp, Homo sapiens
cttcccgctcagccc

SEQ ID NO: 4046020 - DNA, 18 bp, Homo sapiens
cttcccgggccagggctg

SEQ ID NO: 4046021 - DNA, 16 bp, Homo sapiens
cttccctacctcaggc

SEQ ID NO: 4046022 - DNA, 17 bp, Homo sapiens
cttccctacctcaggca

SEQ ID NO: 4046023 - DNA, 20 bp, Homo sapiens
cttccctacctcaggcagga

SEQ ID NO: 4046024 - DNA, 20 bp, Homo sapiens
cttccctagagggttcctgt

SEQ ID NO: 4046025 - DNA, 23 bp, Homo sapiens
cttccctagagggttcctgtaga

SEQ ID NO: 4046026 - DNA, 19 bp, Homo sapiens
cttccctcacccccagcac

SEQ ID NO: 4046027 - DNA, 11 bp, Homo sapiens
cttccctccaa

SEQ ID NO: 4046028 - DNA, 18 bp, Homo sapiens
cttccctccctgctgtca

SEQ ID NO: 4046029 - DNA, 17 bp, Homo sapiens
cttccctccgccttctc

SEQ ID NO: 4046030 - DNA, 12 bp, Homo sapiens
cttccctctctg

SEQ ID NO: 4046031 - DNA, 16 bp, Homo sapiens
cttccctctgggcacg

SEQ ID NO: 4046032 - DNA, 18 bp, Homo sapiens
cttccctgacttgcttta

SEQ ID NO: 4046033 - DNA, 21 bp, Homo sapiens
cttccctgattgacctgctcc

SEQ ID NO: 4046034 - DNA, 13 bp, Homo sapiens
cttccctgctctt

SEQ ID NO: 4046035 - DNA, 16 bp, Homo sapiens
cttccctgctttgcat

SEQ ID NO: 4046036 - DNA, 16 bp, Homo sapiens
cttccctgggctgcca

SEQ ID NO: 4046037 - DNA, 18 bp, Homo sapiens
cttccctgggctgccacc

SEQ ID NO: 4046038 - DNA, 22 bp, Homo sapiens
cttccctgtatgattccttgat

SEQ ID NO: 4046039 - DNA, 20 bp, Homo sapiens
cttccgccaatctggccctt

SEQ ID NO: 4046040 - DNA, 13 bp, Homo sapiens
cttccgctgaggg

SEQ ID NO: 4046041 - DNA, 22 bp, Homo sapiens
cttcctacatcttcttcccagt

SEQ ID NO: 4046042 - DNA, 18 bp, Homo sapiens
cttcctacccacacctct

SEQ ID NO: 4046043 - DNA, 14 bp, Homo sapiens
cttcctactcttct

SEQ ID NO: 4046044 - DNA, 15 bp, Homo sapiens
cttcctactcttctc

SEQ ID NO: 4046045 - DNA, 16 bp, Homo sapiens
cttcctactcttctct

SEQ ID NO: 4046046 - DNA, 18 bp, Homo sapiens
cttcctactcttctctct

SEQ ID NO: 4046047 - DNA, 19 bp, Homo sapiens
cttcctactcttctctctg

SEQ ID NO: 4046048 - DNA, 17 bp, Homo sapiens
cttcctaggtccaagcc

SEQ ID NO: 4046049 - DNA, 18 bp, Homo sapiens
cttcctatgcccaggtac

SEQ ID NO: 4046050 - DNA, 18 bp, Homo sapiens
cttcctcacacccctgtc

SEQ ID NO: 4046051 - DNA, 20 bp, Homo sapiens
cttcctcacacccctgtccc

SEQ ID NO: 4046052 - DNA, 14 bp, Homo sapiens
cttcctcacttcca

SEQ ID NO: 4046053 - DNA, 10 bp, Homo sapiens
cttcctcagc

SEQ ID NO: 4046054 - DNA, 12 bp, Homo sapiens
cttcctcagctg

SEQ ID NO: 4046055 - DNA, 23 bp, Homo sapiens
cttcctcatccaccccatccctc

SEQ ID NO: 4046056 - DNA, 23 bp, Homo sapiens
cttcctccatcctcctccttcct

SEQ ID NO: 4046057 - DNA, 16 bp, Homo sapiens
cttcctcctccccact

SEQ ID NO: 4046058 - DNA, 17 bp, Homo sapiens
cttcctcctccccactt

SEQ ID NO: 4046059 - DNA, 18 bp, Homo sapiens
cttcctctagaagccaag

SEQ ID NO: 4046060 - DNA, 19 bp, Homo sapiens
cttcctctagaagccaagg

SEQ ID NO: 4046061 - DNA, 13 bp, Homo sapiens
cttcctctcaggc

SEQ ID NO: 4046062 - DNA, 16 bp, Homo sapiens
cttcctctccactgcc

SEQ ID NO: 4046063 - DNA, 21 bp, Homo sapiens
cttcctctccactgccttcga

SEQ ID NO: 4046064 - DNA, 16 bp, Homo sapiens
cttcctctctccagat

SEQ ID NO: 4046065 - DNA, 14 bp, Homo sapiens
cttcctctgctccc

SEQ ID NO: 4046066 - DNA, 22 bp, Homo sapiens
cttcctctgtaagatatcccag

SEQ ID NO: 4046067 - DNA, 15 bp, Homo sapiens
cttcctgaaggggga

SEQ ID NO: 4046068 - DNA, 13 bp, Homo sapiens
cttcctgcaagga

SEQ ID NO: 4046069 - DNA, 15 bp, Homo sapiens
cttcctgcaattttc

SEQ ID NO: 4046070 - DNA, 17 bp, Homo sapiens
cttcctgcaattttcta

SEQ ID NO: 4046071 - DNA, 18 bp, Homo sapiens
cttcctgcgtcctcctca

SEQ ID NO: 4046072 - DNA, 17 bp, Homo sapiens
cttcctgctacaggagg

SEQ ID NO: 4046073 - DNA, 14 bp, Homo sapiens
cttcctgctgcacc

SEQ ID NO: 4046074 - DNA, 12 bp, Homo sapiens
cttctggctcaa

SEQ ID NO: 4046075 - DNA, 17 bp, Homo sapiens
cttctgggagcaggaac

SEQ ID NO: 4046076 - DNA, 16 bp, Homo sapiens
cttctgggcacagtgg

SEQ ID NO: 4046077 - DNA, 16 bp, Homo sapiens
cttctgggcctgacca

SEQ ID NO: 4046078 - DNA, 15 bp, Homo sapiens
cttctggggcaggct

SEQ ID NO: 4046079 - DNA, 19 bp, Homo sapiens
cttctggggcaggctgggc

SEQ ID NO: 4046080 - DNA, 19 bp, Homo sapiens
cttctgggttcaagcgatt

SEQ ID NO: 4046081 - DNA, 19 bp, Homo sapiens
cttatttccaagtaagagt

SEQ ID NO: 4046082 - DNA, 13 bp, Homo sapiens
cttattttacatt

SEQ ID NO: 4046083 - DNA, 14 bp, Homo sapiens
cttattttctctgt

SEQ ID NO: 4046084 - DNA, 19 bp, Homo sapiens
cttattttgcattccagaa

SEQ ID NO: 4046085 - DNA, 20 bp, Homo sapiens
cttattttgcattccagaat

SEQ ID NO: 4046086 - DNA, 22 bp, Homo sapiens
cttatttttctgaggtccttat

SEQ ID NO: 4046087 - DNA, 22 bp, Homo sapiens
cttcaaaaagagagattctcca

SEQ ID NO: 4046088 - DNA, 17 bp, Homo sapiens
cttcaaatacaaagtaa

SEQ ID NO: 4046089 - DNA, 18 bp, Homo sapiens
cttcaaatacaaagtaaa

SEQ ID NO: 4046090 - DNA, 15 bp, Homo sapiens
cttcaaatatttccc

SEQ ID NO: 4046091 - DNA, 16 bp, Homo sapiens
cttcaaatccttccaa

SEQ ID NO: 4046092 - DNA, 18 bp, Homo sapiens
cttcaaatccttccaaaa

SEQ ID NO: 4046093 - DNA, 18 bp, Homo sapiens
cttcaaattaaaacagct

SEQ ID NO: 4046094 - DNA, 24 bp, Homo sapiens
cttcaacagaccccctctagaaat

SEQ ID NO: 4046095 - DNA, 20 bp, Homo sapiens
cttcaacatcaatgttcatt

SEQ ID NO: 4046096 - DNA, 16 bp, Homo sapiens
cttcaacatcctgcca

SEQ ID NO: 4046097 - DNA, 19 bp, Homo sapiens
cttcaacatgctccaaata

SEQ ID NO: 4046098 - DNA, 20 bp, Homo sapiens
cttcaaccattccccatggg

SEQ ID NO: 4046099 - DNA, 23 bp, Homo sapiens
cttcaagctgttatttcttccct

SEQ ID NO: 4046100 - DNA, 20 bp, Homo sapiens
cttcaagtgccttttgctgc

SEQ ID NO: 4046101 - DNA, 22 bp, Homo sapiens
cttcaagtgccttttgctgcgc

SEQ ID NO: 4046102 - DNA, 23 bp, Homo sapiens
cttcaagtgccttttgctgcgca

SEQ ID NO: 4046103 - DNA, 20 bp, Homo sapiens
cttcaatgctagaaaatcga

SEQ ID NO: 4046104 - DNA, 18 bp, Homo sapiens
cttcaatgggctcttcca

SEQ ID NO: 4046105 - DNA, 19 bp, Homo sapiens
cttcaatgggctcttccaa

SEQ ID NO: 4046106 - DNA, 18 bp, Homo sapiens
cttcaatgtgcataatga

SEQ ID NO: 4046107 - DNA, 16 bp, Homo sapiens
cttcacaccccaggcc

SEQ ID NO: 4046108 - DNA, 17 bp, Homo sapiens
cttcacaccccaggccc

SEQ ID NO: 4046109 - DNA, 19 bp, Homo sapiens
cttcacaccccaggccctt

SEQ ID NO: 4046110 - DNA, 13 bp, Homo sapiens
cttcacagtctgg

SEQ ID NO: 4046111 - DNA, 17 bp, Homo sapiens
cttcacagtctggtgct

SEQ ID NO: 4046112 - DNA, 14 bp, Homo sapiens
cttcacattaaaaa

SEQ ID NO: 4046113 - DNA, 21 bp, Homo sapiens
cttcaccctgaatggttccat

SEQ ID NO: 4046114 - DNA, 13 bp, Homo sapiens
cttcacctctatc

SEQ ID NO: 4046115 - DNA, 15 bp, Homo sapiens
cttcacctctatcca

SEQ ID NO: 4046116 - DNA, 16 bp, Homo sapiens
cttcacctgttatgta

SEQ ID NO: 4046117 - DNA, 20 bp, Homo sapiens
cttcacttctgactcttccc

SEQ ID NO: 4046118 - DNA, 11 bp, Homo sapiens
cttcagaaaga

SEQ ID NO: 4046119 - DNA, 14 bp, Homo sapiens
cttcagactcaagt

SEQ ID NO: 4046120 - DNA, 22 bp, Homo sapiens
cttcagagagctggtagttagt

SEQ ID NO: 4046121 - DNA, 20 bp, Homo sapiens
cttcagagtacgtcctgcct

SEQ ID NO: 4046122 - DNA, 21 bp, Homo sapiens
cttcagagtacgtcctgcctg

SEQ ID NO: 4046123 - DNA, 12 bp, Homo sapiens
cttcagagtgaa

SEQ ID NO: 4046124 - DNA, 14 bp, Homo sapiens
cttcagagtgaaga

SEQ ID NO: 4046125 - DNA, 18 bp, Homo sapiens
cttcagatattattgctt

SEQ ID NO: 4046126 - DNA, 18 bp, Homo sapiens
cttcagatggaaactctt

SEQ ID NO: 4046127 - DNA, 24 bp, Homo sapiens
cttcagattgttaggagtggttct

SEQ ID NO: 4046128 - DNA, 15 bp, Homo sapiens
cttcagcccccagcc

SEQ ID NO: 4046129 - DNA, 16 bp, Homo sapiens
cttcagcccccagccc

SEQ ID NO: 4046130 - DNA, 17 bp, Homo sapiens
cttcagcccccagcccc

SEQ ID NO: 4046131 - DNA, 16 bp, Homo sapiens
cttcagcgtaaaatgg

SEQ ID NO: 4046132 - DNA, 15 bp, Homo sapiens
cttcagctctttttg

SEQ ID NO: 4046133 - DNA, 13 bp, Homo sapiens
cttcagctgcctg

SEQ ID NO: 4046134 - DNA, 15 bp, Homo sapiens
cttcagctgcctgaa

SEQ ID NO: 4046135 - DNA, 23 bp, Homo sapiens
cttcagctgcctgaaacagccat

SEQ ID NO: 4046136 - DNA, 16 bp, Homo sapiens
cttcaggaaaataaat

SEQ ID NO: 4046137 - DNA, 17 bp, Homo sapiens
cttcaggagaaactgct

SEQ ID NO: 4046138 - DNA, 15 bp, Homo sapiens
cttcaggcctccctc

SEQ ID NO: 4046139 - DNA, 18 bp, Homo sapiens
cttcaggctctgcccagg

SEQ ID NO: 4046140 - DNA, 14 bp, Homo sapiens
cttcaggctcttct

SEQ ID NO: 4046141 - DNA, 16 bp, Homo sapiens
cttcaggctcttctcc

SEQ ID NO: 4046142 - DNA, 16 bp, Homo sapiens
cttcagggcagggctc

SEQ ID NO: 4046143 - DNA, 19 bp, Homo sapiens
cttcagggcagggctctga

SEQ ID NO: 4046144 - DNA, 19 bp, Homo sapiens
cttcagtaccctctcagct

SEQ ID NO: 4046145 - DNA, 22 bp, Homo sapiens
cttcagtaccctctcagctcca

SEQ ID NO: 4046146 - DNA, 20 bp, Homo sapiens
cttcagttggttgtgtcttt

SEQ ID NO: 4046147 - DNA, 16 bp, Homo sapiens
cttcagtttttgtgtt

SEQ ID NO: 4046148 - DNA, 12 bp, Homo sapiens
cttcataatttg

SEQ ID NO: 4046149 - DNA, 20 bp, Homo sapiens
cttcatattctaaaaccatt

SEQ ID NO: 4046150 - DNA, 19 bp, Homo sapiens
cttcatccaacttccaaga

SEQ ID NO: 4046151 - DNA, 15 bp, Homo sapiens
cttcatcgaatctac

SEQ ID NO: 4046152 - DNA, 13 bp, Homo sapiens
cttcatctcccac

SEQ ID NO: 4046153 - DNA, 15 bp, Homo sapiens
cttcatcttcctgtg

SEQ ID NO: 4046154 - DNA, 20 bp, Homo sapiens
cttcatcttcctgtgtcctg

SEQ ID NO: 4046155 - DNA, 12 bp, Homo sapiens
cttcatgcaatg

SEQ ID NO: 4046156 - DNA, 15 bp, Homo sapiens
cttcatgctcagccc

SEQ ID NO: 4046157 - DNA, 20 bp, Homo sapiens
cttcatgtcaacttctggct

SEQ ID NO: 4046158 - DNA, 23 bp, Homo sapiens
cttcatgtcaacttctggctcct

SEQ ID NO: 4046159 - DNA, 14 bp, Homo sapiens
cttcattattctct

SEQ ID NO: 4046160 - DNA, 22 bp, Homo sapiens
cttcattctccttgttgttggt

SEQ ID NO: 4046161 - DNA, 22 bp, Homo sapiens
cttcattctcgtgagtcattta

SEQ ID NO: 4046162 - DNA, 15 bp, Homo sapiens
cttcattgtccctct

SEQ ID NO: 4046163 - DNA, 22 bp, Homo sapiens
cttcattttattaatatttttc

SEQ ID NO: 4046164 - DNA, 17 bp, Homo sapiens
cttcatttttaatttgt

SEQ ID NO: 4046165 - DNA, 14 bp, Homo sapiens
cttccaaggagacc

SEQ ID NO: 4046166 - DNA, 16 bp, Homo sapiens
cttccaatcttgcttt

SEQ ID NO: 4046167 - DNA, 15 bp, Homo sapiens
cttccacctccctcc

SEQ ID NO: 4046168 - DNA, 12 bp, Homo sapiens
cttccagaatgc

SEQ ID NO: 4046169 - DNA, 23 bp, Homo sapiens
cttccagaatgctgaactccttg

SEQ ID NO: 4046170 - DNA, 23 bp, Homo sapiens
cttccagcccatccaaacactga

SEQ ID NO: 4046171 - DNA, 12 bp, Homo sapiens
cttccagctcct

SEQ ID NO: 4046172 - DNA, 14 bp, Homo sapiens
cttccagctcctgt

SEQ ID NO: 4046173 - DNA, 15 bp, Homo sapiens
cttccagcttcaggc

SEQ ID NO: 4046174 - DNA, 20 bp, Homo sapiens
cttccagcttcaggcaccag

SEQ ID NO: 4046175 - DNA, 15 bp, Homo sapiens
cttctgtatttcctt

SEQ ID NO: 4046176 - DNA, 11 bp, Homo sapiens
cttctgtgggc

SEQ ID NO: 4046177 - DNA, 15 bp, Homo sapiens
cttctgtgggcccct

SEQ ID NO: 4046178 - DNA, 19 bp, Homo sapiens
cttctgtgggcccctcaac

SEQ ID NO: 4046179 - DNA, 20 bp, Homo sapiens
cttctgtgggcccctcaaca

SEQ ID NO: 4046180 - DNA, 21 bp, Homo sapiens
cttctgtgggcccctcaacag

SEQ ID NO: 4046181 - DNA, 13 bp, Homo sapiens
cttctgtgtatct

SEQ ID NO: 4046182 - DNA, 14 bp, Homo sapiens
cttctgttctgcag

SEQ ID NO: 4046183 - DNA, 13 bp, Homo sapiens
cttcttaaagagt

SEQ ID NO: 4046184 - DNA, 12 bp, Homo sapiens
cttcttaattaa

SEQ ID NO: 4046185 - DNA, 17 bp, Homo sapiens
cttcttaattaatttga

SEQ ID NO: 4046186 - DNA, 18 bp, Homo sapiens
cttcttaattaatttgat

SEQ ID NO: 4046187 - DNA, 21 bp, Homo sapiens
cttcttaattaatttgattaa

SEQ ID NO: 4046188 - DNA, 23 bp, Homo sapiens
cttcttcaaatacaaagtaaata

SEQ ID NO: 4046189 - DNA, 18 bp, Homo sapiens
cttcttcacccagctaat

SEQ ID NO: 4046190 - DNA, 22 bp, Homo sapiens
cttcttcacccagctaatctgt

SEQ ID NO: 4046191 - DNA, 16 bp, Homo sapiens
cttcttcagagtgaag

SEQ ID NO: 4046192 - DNA, 23 bp, Homo sapiens
cttcttcctacatcttcttccca

SEQ ID NO: 4046193 - DNA, 15 bp, Homo sapiens
cttcttcctttctct

SEQ ID NO: 4046194 - DNA, 16 bp, Homo sapiens
cttcttctgaaagaat

SEQ ID NO: 4046195 - DNA, 14 bp, Homo sapiens
cttcttcttcagaa

SEQ ID NO: 4046196 - DNA, 14 bp, Homo sapiens
cttcttgcctgctg

SEQ ID NO: 4046197 - DNA, 17 bp, Homo sapiens
cttcttgctgcagcctg

SEQ ID NO: 4046198 - DNA, 18 bp, Homo sapiens
cttcttgggccccagacc

SEQ ID NO: 4046199 - DNA, 19 bp, Homo sapiens
cttcttgggccccagaccc

SEQ ID NO: 4046200 - DNA, 16 bp, Homo sapiens
cttcttgtttccttgt

SEQ ID NO: 4046201 - DNA, 23 bp, Homo sapiens
cttctttctctcagccttacatt

SEQ ID NO: 4046202 - DNA, 14 bp, Homo sapiens
cttctttgaagaag

SEQ ID NO: 4046203 - DNA, 14 bp, Homo sapiens
cttctttgtgcctt

SEQ ID NO: 4046204 - DNA, 16 bp, Homo sapiens
cttctttgtgcctttg

SEQ ID NO: 4046205 - DNA, 21 bp, Homo sapiens
cttctttgtgcctttggcctg

SEQ ID NO: 4046206 - DNA, 13 bp, Homo sapiens
cttcttttgatta

SEQ ID NO: 4046207 - DNA, 14 bp, Homo sapiens
cttcttttgattat

SEQ ID NO: 4046208 - DNA, 16 bp, Homo sapiens
cttcttttttttcatt

SEQ ID NO: 4046209 - DNA, 16 bp, Homo sapiens
cttgaaaagaaagtgt

SEQ ID NO: 4046210 - DNA, 19 bp, Homo sapiens
cttgaaaagttcagggacc

SEQ ID NO: 4046211 - DNA, 20 bp, Homo sapiens
cttgaaagattttattgtat

SEQ ID NO: 4046212 - DNA, 20 bp, Homo sapiens
cttgaaattaagaaggcaaa

SEQ ID NO: 4046213 - DNA, 15 bp, Homo sapiens
cttgaaattactgtg

SEQ ID NO: 4046214 - DNA, 16 bp, Homo sapiens
cttgaaattactgtgt

SEQ ID NO: 4046215 - DNA, 17 bp, Homo sapiens
cttgaaattactgtgta

SEQ ID NO: 4046216 - DNA, 22 bp, Homo sapiens
cttgaaattactgtgtaaatat

SEQ ID NO: 4046217 - DNA, 15 bp, Homo sapiens
cttgaacaaaaagtt

SEQ ID NO: 4046218 - DNA, 15 bp, Homo sapiens
cttgaacccaggaga

SEQ ID NO: 4046219 - DNA, 19 bp, Homo sapiens
cttgaactctgttccccca

SEQ ID NO: 4046220 - DNA, 21 bp, Homo sapiens
cttgaactgttctggcctcag

SEQ ID NO: 4046221 - DNA, 22 bp, Homo sapiens
cttgaactgttctggcctcaga

SEQ ID NO: 4046222 - DNA, 23 bp, Homo sapiens
cttgaagaaacagagtggcctcc

SEQ ID NO: 4046223 - DNA, 12 bp, Homo sapiens
cttgaagccaaa

SEQ ID NO: 4046224 - DNA, 15 bp, Homo sapiens
cttgaagcctgctcc

SEQ ID NO: 4046225 - DNA, 15 bp, Homo sapiens
cttgaaggccctgct

SEQ ID NO: 4046226 - DNA, 18 bp, Homo sapiens
cttgaaggccctgctgag

SEQ ID NO: 4046227 - DNA, 15 bp, Homo sapiens
cttgaagggccagag

SEQ ID NO: 4046228 - DNA, 15 bp, Homo sapiens
cttgaatgctgccag

SEQ ID NO: 4046229 - DNA, 23 bp, Homo sapiens
cttgaatggcaatgttttgcttt

SEQ ID NO: 4046230 - DNA, 18 bp, Homo sapiens
cttgaatgtggtctcagg

SEQ ID NO: 4046231 - DNA, 19 bp, Homo sapiens
cttgaatgtggtctcagga

SEQ ID NO: 4046232 - DNA, 13 bp, Homo sapiens
cttgacacctgct

SEQ ID NO: 4046233 - DNA, 20 bp, Homo sapiens
cttgaccattaataaagaca

SEQ ID NO: 4046234 - DNA, 15 bp, Homo sapiens
cttgaccgtactctc

SEQ ID NO: 4046235 - DNA, 18 bp, Homo sapiens
cttgaccgtactctcaca

SEQ ID NO: 4046236 - DNA, 18 bp, Homo sapiens
cttgacctcactcagaag

SEQ ID NO: 4046237 - DNA, 21 bp, Homo sapiens
cttgacctcatctcccgagca

SEQ ID NO: 4046238 - DNA, 18 bp, Homo sapiens
cttgactcatggcagctg

SEQ ID NO: 4046239 - DNA, 19 bp, Homo sapiens
cttgactcatggcagctgt

SEQ ID NO: 4046240 - DNA, 12 bp, Homo sapiens
cttgactgcatt

SEQ ID NO: 4046241 - DNA, 13 bp, Homo sapiens
cttgactttctga

SEQ ID NO: 4046242 - DNA, 11 bp, Homo sapiens
cttgagaaacc

SEQ ID NO: 4046243 - DNA, 12 bp, Homo sapiens
cttgagaaacct

SEQ ID NO: 4046244 - DNA, 23 bp, Homo sapiens
cttgagaagacctcacctagaaa

SEQ ID NO: 4046245 - DNA, 16 bp, Homo sapiens
cttgagacaatgtttt

SEQ ID NO: 4046246 - DNA, 22 bp, Homo sapiens
cttgagacacggagcccagccc

SEQ ID NO: 4046247 - DNA, 13 bp, Homo sapiens
cttgagccagtaa

SEQ ID NO: 4046248 - DNA, 14 bp, Homo sapiens
cttgaggagtgtga

SEQ ID NO: 4046249 - DNA, 16 bp, Homo sapiens
cttgagggcccagagc

SEQ ID NO: 4046250 - DNA, 18 bp, Homo sapiens
cttgagggcccagagcag

SEQ ID NO: 4046251 - DNA, 19 bp, Homo sapiens
cttgagggcccagagcagg

SEQ ID NO: 4046252 - DNA, 20 bp, Homo sapiens
cttgaggggagccaggaggg

SEQ ID NO: 4046253 - DNA, 18 bp, Homo sapiens
cttgaggtcttttgacat

SEQ ID NO: 4046254 - DNA, 22 bp, Homo sapiens
cttgagtggggttatctctgtg

SEQ ID NO: 4046255 - DNA, 16 bp, Homo sapiens
cttgagtgtaatgttt

SEQ ID NO: 4046256 - DNA, 20 bp, Homo sapiens
cttgagtgtaatgtttgtta

SEQ ID NO: 4046257 - DNA, 14 bp, Homo sapiens
cttgagtgttcctt

SEQ ID NO: 4046258 - DNA, 19 bp, Homo sapiens
cttgagtgttcctttttaa

SEQ ID NO: 4046259 - DNA, 21 bp, Homo sapiens
cttgagtgttcctttttaaat

SEQ ID NO: 4046260 - DNA, 17 bp, Homo sapiens
cttgatacccccctctg

SEQ ID NO: 4046261 - DNA, 19 bp, Homo sapiens
cttgatacccccctctgtc

SEQ ID NO: 4046262 - DNA, 14 bp, Homo sapiens
cttgatccagaaga

SEQ ID NO: 4046263 - DNA, 14 bp, Homo sapiens
cttgatctctcttg

SEQ ID NO: 4046264 - DNA, 18 bp, Homo sapiens
ctgttcctccctcccaca

SEQ ID NO: 4046265 - DNA, 12 bp, Homo sapiens
ctgttcctttta

SEQ ID NO: 4046266 - DNA, 16 bp, Homo sapiens
ctgttctaacatgtaa

SEQ ID NO: 4046267 - DNA, 14 bp, Homo sapiens
ctgttctagttttt

SEQ ID NO: 4046268 - DNA, 18 bp, Homo sapiens
ctgttctgaaatgttctt

SEQ ID NO: 4046269 - DNA, 14 bp, Homo sapiens
ctgttctgctggga

SEQ ID NO: 4046270 - DNA, 14 bp, Homo sapiens
ctgttctggaggaa

SEQ ID NO: 4046271 - DNA, 12 bp, Homo sapiens
ctgttctggggg

SEQ ID NO: 4046272 - DNA, 19 bp, Homo sapiens
ctgttctgtggttcctctg

SEQ ID NO: 4046273 - DNA, 20 bp, Homo sapiens
ctgttctgtggttcctctgc

SEQ ID NO: 4046274 - DNA, 15 bp, Homo sapiens
ctgttcttcctccag

SEQ ID NO: 4046275 - DNA, 21 bp, Homo sapiens
ctgttcttcctccagctgcac

SEQ ID NO: 4046276 - DNA, 12 bp, Homo sapiens
ctgttcttcctg

SEQ ID NO: 4046277 - DNA, 18 bp, Homo sapiens
ctgttgctatagagccta

SEQ ID NO: 4046278 - DNA, 12 bp, Homo sapiens
ctgttgtacatt

SEQ ID NO: 4046279 - DNA, 13 bp, Homo sapiens
ctgttgtacattt

SEQ ID NO: 4046280 - DNA, 17 bp, Homo sapiens
ctgttgtacatttatga

SEQ ID NO: 4046281 - DNA, 18 bp, Homo sapiens
ctgttgtacatttatgat

SEQ ID NO: 4046282 - DNA, 20 bp, Homo sapiens
ctgttgtgggcgctgcttcc

SEQ ID NO: 4046283 - DNA, 13 bp, Homo sapiens
ctgttgttgttaa

SEQ ID NO: 4046284 - DNA, 12 bp, Homo sapiens
ctgtttaagaaa

SEQ ID NO: 4046285 - DNA, 22 bp, Homo sapiens
ctgtttaagaaaagtattttga

SEQ ID NO: 4046286 - DNA, 16 bp, Homo sapiens
ctgtttaatatttaaa

SEQ ID NO: 4046287 - DNA, 18 bp, Homo sapiens
ctgtttataatctgaaga

SEQ ID NO: 4046288 - DNA, 20 bp, Homo sapiens
cttacattagcagtttgctt

SEQ ID NO: 4046289 - DNA, 16 bp, Homo sapiens
cttacattgcctgact

SEQ ID NO: 4046290 - DNA, 18 bp, Homo sapiens
cttacatttgtgagattc

SEQ ID NO: 4046291 - DNA, 18 bp, Homo sapiens
cttacctgacctcttgct

SEQ ID NO: 4046292 - DNA, 19 bp, Homo sapiens
cttacctgacctcttgctg

SEQ ID NO: 4046293 - DNA, 20 bp, Homo sapiens
cttacctgacctcttgctgt

SEQ ID NO: 4046294 - DNA, 24 bp, Homo sapiens
cttactaagctttgccagctgctg

SEQ ID NO: 4046295 - DNA, 15 bp, Homo sapiens
cttactaatgtaaaa

SEQ ID NO: 4046296 - DNA, 15 bp, Homo sapiens
cttactataatttga

SEQ ID NO: 4046297 - DNA, 11 bp, Homo sapiens
cttactatttc

SEQ ID NO: 4046298 - DNA, 22 bp, Homo sapiens
cttactatttctgggtcttttg

SEQ ID NO: 4046299 - DNA, 22 bp, Homo sapiens
cttactattttgacagttattt

SEQ ID NO: 4046300 - DNA, 17 bp, Homo sapiens
cttactctgtccattta

SEQ ID NO: 4046301 - DNA, 17 bp, Homo sapiens
cttactgattattttct

SEQ ID NO: 4046302 - DNA, 17 bp, Homo sapiens
cttactgtggaggaagg

SEQ ID NO: 4046303 - DNA, 18 bp, Homo sapiens
cttactgtggaggaagga

SEQ ID NO: 4046304 - DNA, 14 bp, Homo sapiens
cttacttctcacta

SEQ ID NO: 4046305 - DNA, 12 bp, Homo sapiens
cttactttgctt

SEQ ID NO: 4046306 - DNA, 13 bp, Homo sapiens
cttactttgcttg

SEQ ID NO: 4046307 - DNA, 20 bp, Homo sapiens
cttagaaacactgcaaattt

SEQ ID NO: 4046308 - DNA, 13 bp, Homo sapiens
cttagaaatactt

SEQ ID NO: 4046309 - DNA, 19 bp, Homo sapiens
cttagaacattttaattca

SEQ ID NO: 4046310 - DNA, 17 bp, Homo sapiens
cttagaacctttctgtg

SEQ ID NO: 4046311 - DNA, 15 bp, Homo sapiens
cttagaacctttctt

SEQ ID NO: 4046312 - DNA, 15 bp, Homo sapiens
cttagactcttttcc

SEQ ID NO: 4046313 - DNA, 19 bp, Homo sapiens
cttagacttcgactcagga

SEQ ID NO: 4046314 - DNA, 20 bp, Homo sapiens
cttagacttcgactcaggat

SEQ ID NO: 4046315 - DNA, 18 bp, Homo sapiens
cttagagagaggaggcag

SEQ ID NO: 4046316 - DNA, 22 bp, Homo sapiens
cttagagtttctgtttgattct

SEQ ID NO: 4046317 - DNA, 15 bp, Homo sapiens
cttagcagcttccag

SEQ ID NO: 4046318 - DNA, 19 bp, Homo sapiens
cttagcatagcttattatt

SEQ ID NO: 4046319 - DNA, 22 bp, Homo sapiens
cttagctactgtatgcaaagtc

SEQ ID NO: 4046320 - DNA, 21 bp, Homo sapiens
cttagcttgcacatgaatgca

SEQ ID NO: 4046321 - DNA, 15 bp, Homo sapiens
cttaggaaaggagat

SEQ ID NO: 4046322 - DNA, 22 bp, Homo sapiens
cttaggcatgtaggaccctgca

SEQ ID NO: 4046323 - DNA, 13 bp, Homo sapiens
cttaggccttcct

SEQ ID NO: 4046324 - DNA, 23 bp, Homo sapiens
cttaggccttcctctctccagat

SEQ ID NO: 4046325 - DNA, 12 bp, Homo sapiens
cttagggaaaga

SEQ ID NO: 4046326 - DNA, 17 bp, Homo sapiens
cttagggaagctggcct

SEQ ID NO: 4046327 - DNA, 18 bp, Homo sapiens
cttagggcactgggctgt

SEQ ID NO: 4046328 - DNA, 17 bp, Homo sapiens
cttagggttttctctct

SEQ ID NO: 4046329 - DNA, 13 bp, Homo sapiens
cttagtaggtcct

SEQ ID NO: 4046330 - DNA, 20 bp, Homo sapiens
cttagtaggtcctcaataaa

SEQ ID NO: 4046331 - DNA, 16 bp, Homo sapiens
cttagtattgacaact

SEQ ID NO: 4046332 - DNA, 15 bp, Homo sapiens
cttagtatttctcag

SEQ ID NO: 4046333 - DNA, 16 bp, Homo sapiens
cttagtatttctcagg

SEQ ID NO: 4046334 - DNA, 15 bp, Homo sapiens
cttagtcatggtgtt

SEQ ID NO: 4046335 - DNA, 18 bp, Homo sapiens
cttagtctcagtttgtgt

SEQ ID NO: 4046336 - DNA, 20 bp, Homo sapiens
cttagtcttctcatagcatt

SEQ ID NO: 4046337 - DNA, 21 bp, Homo sapiens
cttagtcttctcatagcatta

SEQ ID NO: 4046338 - DNA, 15 bp, Homo sapiens
cttagtgactcttga

SEQ ID NO: 4046339 - DNA, 19 bp, Homo sapiens
cttagtgcggacaagtttt

SEQ ID NO: 4046340 - DNA, 20 bp, Homo sapiens
cttagtgcggacaagtttta

SEQ ID NO: 4046341 - DNA, 14 bp, Homo sapiens
cttagtgggccagg

SEQ ID NO: 4046342 - DNA, 17 bp, Homo sapiens
cttagtggttccccacc

SEQ ID NO: 4046343 - DNA, 16 bp, Homo sapiens
cttagttactttttcc

SEQ ID NO: 4046344 - DNA, 23 bp, Homo sapiens
cttagttgacaacctagaatgtc

SEQ ID NO: 4046345 - DNA, 14 bp, Homo sapiens
cttagttggctgga

SEQ ID NO: 4046346 - DNA, 20 bp, Homo sapiens
cttataaacacattgaatgc

SEQ ID NO: 4046347 - DNA, 21 bp, Homo sapiens
cttataaatcatattgatgaa

SEQ ID NO: 4046348 - DNA, 19 bp, Homo sapiens
cttataagtgaagtgatac

SEQ ID NO: 4046349 - DNA, 14 bp, Homo sapiens
cttataataaagaa

SEQ ID NO: 4046350 - DNA, 15 bp, Homo sapiens
cttatacatttgata

SEQ ID NO: 4046351 - DNA, 19 bp, Homo sapiens
cttatacgcttttctttgt

SEQ ID NO: 4046352 - DNA, 13 bp, Homo sapiens
cttatagaataaa

SEQ ID NO: 4046353 - DNA, 17 bp, Homo sapiens
cttatagaataaaagct

SEQ ID NO: 4046354 - DNA, 21 bp, Homo sapiens
cttatagaataaaagctgtgg

SEQ ID NO: 4046355 - DNA, 16 bp, Homo sapiens
cttatagaatatttat

SEQ ID NO: 4046356 - DNA, 17 bp, Homo sapiens
cttataggcctgtccct

SEQ ID NO: 4046357 - DNA, 18 bp, Homo sapiens
cttatattgaagacaatt

SEQ ID NO: 4046358 - DNA, 13 bp, Homo sapiens
cttatatttacaa

SEQ ID NO: 4046359 - DNA, 17 bp, Homo sapiens
cttatatttacaataaa

SEQ ID NO: 4046360 - DNA, 14 bp, Homo sapiens
cttatatttcccta

SEQ ID NO: 4046361 - DNA, 21 bp, Homo sapiens
cttatcaaggactctggtttc

SEQ ID NO: 4046362 - DNA, 19 bp, Homo sapiens
cttatccaggactctgtca

SEQ ID NO: 4046363 - DNA, 15 bp, Homo sapiens
cttatctagctgcat

SEQ ID NO: 4046364 - DNA, 21 bp, Homo sapiens
cttatctcagtcatgcataaa

SEQ ID NO: 4046365 - DNA, 22 bp, Homo sapiens
cttatctcagtcatgcataaat

SEQ ID NO: 4046366 - DNA, 17 bp, Homo sapiens
cttatctgtgcgtgaaa

SEQ ID NO: 4046367 - DNA, 15 bp, Homo sapiens
cttatgaatatattt

SEQ ID NO: 4046368 - DNA, 20 bp, Homo sapiens
cttatgattaaacttccttc

SEQ ID NO: 4046369 - DNA, 16 bp, Homo sapiens
cttatgcaaaatggaa

SEQ ID NO: 4046370 - DNA, 17 bp, Homo sapiens
cttatggaattgatttg

SEQ ID NO: 4046371 - DNA, 14 bp, Homo sapiens
cttatggtccagaa

SEQ ID NO: 4046372 - DNA, 21 bp, Homo sapiens
cttatgtatcagtgtcctttc

SEQ ID NO: 4046373 - DNA, 15 bp, Homo sapiens
cttattaaagtattc

SEQ ID NO: 4046374 - DNA, 12 bp, Homo sapiens
cttattaatttc

SEQ ID NO: 4046375 - DNA, 15 bp, Homo sapiens
cttattcctctaggc

SEQ ID NO: 4046376 - DNA, 22 bp, Homo sapiens
ctgggtgcaggagcgctccctt

SEQ ID NO: 4046377 - DNA, 17 bp, Homo sapiens
ctgggtgcctcccacac

SEQ ID NO: 4046378 - DNA, 15 bp, Homo sapiens
ctgggtgctggctgc

SEQ ID NO: 4046379 - DNA, 11 bp, Homo sapiens
ctgggtggcct

SEQ ID NO: 4046380 - DNA, 19 bp, Homo sapiens
ctgggtgggcccagaactg

SEQ ID NO: 4046381 - DNA, 15 bp, Homo sapiens
ctgggtgggctctgt

SEQ ID NO: 4046382 - DNA, 21 bp, Homo sapiens
ctgggtggggtgaggaccact

SEQ ID NO: 4046383 - DNA, 19 bp, Homo sapiens
ctgggtggtaccctctgga

SEQ ID NO: 4046384 - DNA, 14 bp, Homo sapiens
ctgggtggtggcct

SEQ ID NO: 4046385 - DNA, 20 bp, Homo sapiens
ctgggtgtcatttcattcca

SEQ ID NO: 4046386 - DNA, 14 bp, Homo sapiens
ctgggttccctttc

SEQ ID NO: 4046387 - DNA, 22 bp, Homo sapiens
ctgggtttattacatggcagtg

SEQ ID NO: 4046388 - DNA, 23 bp, Homo sapiens
ctgggtttattacatggcagtgt

SEQ ID NO: 4046389 - DNA, 17 bp, Homo sapiens
ctgggtttccagggcac

SEQ ID NO: 4046390 - DNA, 12 bp, Homo sapiens
ctgggtttcttt

SEQ ID NO: 4046391 - DNA, 16 bp, Homo sapiens
ctgggtttttcttgtg

SEQ ID NO: 4046392 - DNA, 20 bp, Homo sapiens
ctgggtttttcttgtggtgt

SEQ ID NO: 4046393 - DNA, 14 bp, Homo sapiens
ctggtaacagtggc

SEQ ID NO: 4046394 - DNA, 19 bp, Homo sapiens
ctggtacttagagtttctg

SEQ ID NO: 4046395 - DNA, 20 bp, Homo sapiens
ctggtacttagagtttctgt

SEQ ID NO: 4046396 - DNA, 23 bp, Homo sapiens
ctggtagcataaataaaactgaa

SEQ ID NO: 4046397 - DNA, 17 bp, Homo sapiens
ctggtaggttgggacac

SEQ ID NO: 4046398 - DNA, 20 bp, Homo sapiens
ctggtaggttgggacaccag

SEQ ID NO: 4046399 - DNA, 19 bp, Homo sapiens
ctggtagttagtagcatgt

SEQ ID NO: 4046400 - DNA, 18 bp, Homo sapiens
ctggtattctgttctgga

SEQ ID NO: 4046401 - DNA, 22 bp, Homo sapiens
ctggtcaagttgagatttttaa

SEQ ID NO: 4046402 - DNA, 16 bp, Homo sapiens
ctggtcacagcctcct

SEQ ID NO: 4046403 - DNA, 17 bp, Homo sapiens
ctggtcacagcctcctc

SEQ ID NO: 4046404 - DNA, 18 bp, Homo sapiens
ctggtcacagcctcctct

SEQ ID NO: 4046405 - DNA, 17 bp, Homo sapiens
ctggctccctcctccag

SEQ ID NO: 4046406 - DNA, 15 bp, Homo sapiens
ctggctcctagggga

SEQ ID NO: 4046407 - DNA, 12 bp, Homo sapiens
ctggctcctcaa

SEQ ID NO: 4046408 - DNA, 15 bp, Homo sapiens
ctggctcctttacaa

SEQ ID NO: 4046409 - DNA, 22 bp, Homo sapiens
ctggctcctttacaaaagaaat

SEQ ID NO: 4046410 - DNA, 18 bp, Homo sapiens
ctggctctaccttcctgt

SEQ ID NO: 4046411 - DNA, 17 bp, Homo sapiens
ctggctctcatggggtc

SEQ ID NO: 4046412 - DNA, 18 bp, Homo sapiens
ctggctctgcaatgggca

SEQ ID NO: 4046413 - DNA, 15 bp, Homo sapiens
ctggctctgcactaa

SEQ ID NO: 4046414 - DNA, 15 bp, Homo sapiens
ctggctctgctgtcc

SEQ ID NO: 4046415 - DNA, 16 bp, Homo sapiens
ctggctcttctgccca

SEQ ID NO: 4046416 - DNA, 23 bp, Homo sapiens
ctggctcttgatacccccctctg

SEQ ID NO: 4046417 - DNA, 23 bp, Homo sapiens
ctggctgaccccaaagagcctgg

SEQ ID NO: 4046418 - DNA, 22 bp, Homo sapiens
ctggctgagcagttcccctgga

SEQ ID NO: 4046419 - DNA, 17 bp, Homo sapiens
ctgctgtcttccccacc

SEQ ID NO: 4046420 - DNA, 17 bp, Homo sapiens
ctgctgtgaaccctggg

SEQ ID NO: 4046421 - DNA, 23 bp, Homo sapiens
ctgctgtgaaccctggggcctga

SEQ ID NO: 4046422 - DNA, 14 bp, Homo sapiens
ctgctgtgcgtgga

SEQ ID NO: 4046423 - DNA, 19 bp, Homo sapiens
ctgctgttctcaggacagc

SEQ ID NO: 4046424 - DNA, 20 bp, Homo sapiens
ctgctgttctcaggacagca

SEQ ID NO: 4046425 - DNA, 12 bp, Homo sapiens
ctgcttaattca

SEQ ID NO: 4046426 - DNA, 16 bp, Homo sapiens
ctgcttaggagagacc

SEQ ID NO: 4046427 - DNA, 14 bp, Homo sapiens
ctgcttcaaatatt

SEQ ID NO: 4046428 - DNA, 19 bp, Homo sapiens
ctgcttcaaggcttccact

SEQ ID NO: 4046429 - DNA, 23 bp, Homo sapiens
ctgcttccggtagggaggcagcc

SEQ ID NO: 4046430 - DNA, 15 bp, Homo sapiens
ctgcttctcatccca

SEQ ID NO: 4046431 - DNA, 13 bp, Homo sapiens
ctgcttctccaag

SEQ ID NO: 4046432 - DNA, 14 bp, Homo sapiens
ctgcttctgaactc

SEQ ID NO: 4046433 - DNA, 20 bp, Homo sapiens
ctgcttctgaactcaagctg

SEQ ID NO: 4046434 - DNA, 17 bp, Homo sapiens
ctgcttgatgaagcaag

SEQ ID NO: 4046435 - DNA, 21 bp, Homo sapiens
ctgcttgatgaagcaaggaag

SEQ ID NO: 4046436 - DNA, 20 bp, Homo sapiens
ctgcttgcaggaggccaaac

SEQ ID NO: 4046437 - DNA, 20 bp, Homo sapiens
ctgcttgcttgctttttaat

SEQ ID NO: 4046438 - DNA, 22 bp, Homo sapiens
ctgcttgttgcatttccagctg

SEQ ID NO: 4046439 - DNA, 20 bp, Homo sapiens
ctgctttaaagggcctgcct

SEQ ID NO: 4046440 - DNA, 22 bp, Homo sapiens
ctgctttaaagggcctgcctgg

SEQ ID NO: 4046441 - DNA, 16 bp, Homo sapiens
ctgctttatcttttca

SEQ ID NO: 4046442 - DNA, 12 bp, Homo sapiens
ctgctttcaagt

SEQ ID NO: 4046443 - DNA, 16 bp, Homo sapiens
ctgctttctgttgtca

SEQ ID NO: 4046444 - DNA, 22 bp, Homo sapiens
ctgctttgcaaacatcaacctg

SEQ ID NO: 4046445 - DNA, 23 bp, Homo sapiens
ctgctttgcaaacatcaacctgg

SEQ ID NO: 4046446 - DNA, 15 bp, Homo sapiens
ctgctttgcatcttt

SEQ ID NO: 4046447 - DNA, 15 bp, Homo sapiens
ctgctttggctgagg

SEQ ID NO: 4046448 - DNA, 16 bp, Homo sapiens
ctgctttggctgaggg

SEQ ID NO: 4046449 - DNA, 20 bp, Homo sapiens
ctgctttgggaagccgtgct

SEQ ID NO: 4046450 - DNA, 16 bp, Homo sapiens
ctgctttgggctgccc

SEQ ID NO: 4046451 - DNA, 18 bp, Homo sapiens
ctgctttgggctgccctg

SEQ ID NO: 4046452 - DNA, 19 bp, Homo sapiens
ctgctttgggctgccctgg

SEQ ID NO: 4046453 - DNA, 20 bp, Homo sapiens
ctgctttgggctgccctggt

SEQ ID NO: 4046454 - DNA, 14 bp, Homo sapiens
ctgctttgtctcct

SEQ ID NO: 4046455 - DNA, 22 bp, Homo sapiens
ctgcttttattaaatttgttga

SEQ ID NO: 4046456 - DNA, 14 bp, Homo sapiens
ctgcttttctgccc

SEQ ID NO: 4046457 - DNA, 18 bp, Homo sapiens
ctgcttttctgccctggc

SEQ ID NO: 4046458 - DNA, 16 bp, Homo sapiens
ctgcttttctgtcctg

SEQ ID NO: 4046459 - DNA, 19 bp, Homo sapiens
ctgcttttctgtcctgggc

SEQ ID NO: 4046460 - DNA, 19 bp, Homo sapiens
ctgctttttaaagaatgct

SEQ ID NO: 4046461 - DNA, 22 bp, Homo sapiens
ctgctttttaaagaatgctctt

SEQ ID NO: 4046462 - DNA, 13 bp, Homo sapiens
ctggaaaagaaga

SEQ ID NO: 4046463 - DNA, 22 bp, Homo sapiens
ctggaaaagaagaaactttgcc

SEQ ID NO: 4046464 - DNA, 14 bp, Homo sapiens
ctggaaaagaggag

SEQ ID NO: 4046465 - DNA, 18 bp, Homo sapiens
ctggaaaatgtgacccag

SEQ ID NO: 4046466 - DNA, 16 bp, Homo sapiens
ctggaaacctctggag

SEQ ID NO: 4046467 - DNA, 13 bp, Homo sapiens
ctggaaaggggag

SEQ ID NO: 4046468 - DNA, 16 bp, Homo sapiens
ctggaaatattaagaa

SEQ ID NO: 4046469 - DNA, 22 bp, Homo sapiens
ctggaacatcctttgcagggca

SEQ ID NO: 4046470 - DNA, 24 bp, Homo sapiens
ctggaacatcctttgcagggcagc

SEQ ID NO: 4046471 - DNA, 14 bp, Homo sapiens
ctggaacatggcta

SEQ ID NO: 4046472 - DNA, 20 bp, Homo sapiens
ctggaacatggctagccttt

SEQ ID NO: 4046473 - DNA, 22 bp, Homo sapiens
ctggaaccaatcccgtgaaaga

SEQ ID NO: 4046474 - DNA, 18 bp, Homo sapiens
ctggaacccagactcaga

SEQ ID NO: 4046475 - DNA, 15 bp, Homo sapiens
ctggaacctcagcct

SEQ ID NO: 4046476 - DNA, 17 bp, Homo sapiens
ctggaacctcagcctgg

SEQ ID NO: 4046477 - DNA, 22 bp, Homo sapiens
ctggaacctcagcctggccaga

SEQ ID NO: 4046478 - DNA, 20 bp, Homo sapiens
ctggaaccttgctgtcctga

SEQ ID NO: 4046479 - DNA, 12 bp, Homo sapiens
ctggaagaaaaa

SEQ ID NO: 4046480 - DNA, 14 bp, Homo sapiens
ctggaagaaaaaaa

SEQ ID NO: 4046481 - DNA, 18 bp, Homo sapiens
ctggaagaaaaaaaccac

SEQ ID NO: 4046482 - DNA, 11 bp, Homo sapiens
ctggaagagcc

SEQ ID NO: 4046483 - DNA, 14 bp, Homo sapiens
ctggaagagcccag

SEQ ID NO: 4046484 - DNA, 15 bp, Homo sapiens
ctggaagagcccagt

SEQ ID NO: 4046485 - DNA, 17 bp, Homo sapiens
ctggaagagctaggcag

SEQ ID NO: 4046486 - DNA, 12 bp, Homo sapiens
ctggaagcacat

SEQ ID NO: 4046487 - DNA, 15 bp, Homo sapiens
ctggaagcacatgtt

SEQ ID NO: 4046488 - DNA, 14 bp, Homo sapiens
ctggaagcccagcc

SEQ ID NO: 4046489 - DNA, 19 bp, Homo sapiens
ctggaagctaatttgcatt

SEQ ID NO: 4046490 - DNA, 13 bp, Homo sapiens
ctggaaggaacat

SEQ ID NO: 4046491 - DNA, 19 bp, Homo sapiens
ctggaagtccaatgtggca

SEQ ID NO: 4046492 - DNA, 16 bp, Homo sapiens
ctggaataaagttgca

SEQ ID NO: 4046493 - DNA, 13 bp, Homo sapiens
ctggaataagaag

SEQ ID NO: 4046494 - DNA, 18 bp, Homo sapiens
ctggaataatttgtaaat

SEQ ID NO: 4046495 - DNA, 21 bp, Homo sapiens
ctggaatcattgtccagagct

SEQ ID NO: 4046496 - DNA, 19 bp, Homo sapiens
ctggaatctggagaccagg

SEQ ID NO: 4046497 - DNA, 13 bp, Homo sapiens
ctggaatgcactg

SEQ ID NO: 4046498 - DNA, 22 bp, Homo sapiens
ctggaatggtacatgtcttcca

SEQ ID NO: 4046499 - DNA, 14 bp, Homo sapiens
ctggaatgtaatca

SEQ ID NO: 4046500 - DNA, 15 bp, Homo sapiens
ctggaatgtaatcaa

SEQ ID NO: 4046501 - DNA, 21 bp, Homo sapiens
ctggaatgtaatcaatgtttc

SEQ ID NO: 4046502 - DNA, 16 bp, Homo sapiens
ctggaatgtttttccc

SEQ ID NO: 4046503 - DNA, 15 bp, Homo sapiens
ctggacaagcagagg

SEQ ID NO: 4046504 - DNA, 18 bp, Homo sapiens
ctggacaagcagaggtgg

SEQ ID NO: 4046505 - DNA, 15 bp, Homo sapiens
ctggacacccctgct

SEQ ID NO: 4046506 - DNA, 20 bp, Homo sapiens
ctggacactagggtcaggcg

SEQ ID NO: 4046507 - DNA, 22 bp, Homo sapiens
ctggacactagggtcaggcggg

SEQ ID NO: 4046508 - DNA, 17 bp, Homo sapiens
ctggacactcagacctg

SEQ ID NO: 4046509 - DNA, 18 bp, Homo sapiens
ctggacactcagacctga

SEQ ID NO: 4046510 - DNA, 20 bp, Homo sapiens
ctggacacttcacgcccttg

SEQ ID NO: 4046511 - DNA, 11 bp, Homo sapiens
ctggacagaac

SEQ ID NO: 4046512 - DNA, 15 bp, Homo sapiens
ctggacagcagaagc

SEQ ID NO: 4046513 - DNA, 14 bp, Homo sapiens
ctggacagccagtg

SEQ ID NO: 4046514 - DNA, 22 bp, Homo sapiens
ctggacagccagtgacctttga

SEQ ID NO: 4046515 - DNA, 13 bp, Homo sapiens
ctggacagcccca

SEQ ID NO: 4046516 - DNA, 20 bp, Homo sapiens
ctggacaggctctgcttctc

SEQ ID NO: 4046517 - DNA, 19 bp, Homo sapiens
ctggacctatgtcctaagg

SEQ ID NO: 4046518 - DNA, 12 bp, Homo sapiens
ctggacctgcct

SEQ ID NO: 4046519 - DNA, 20 bp, Homo sapiens
ctggacgctgtcctgagatg

SEQ ID NO: 4046520 - DNA, 14 bp, Homo sapiens
ctggacggaagtgg

SEQ ID NO: 4046521 - DNA, 14 bp, Homo sapiens
ctggacggcaggct

SEQ ID NO: 4046522 - DNA, 21 bp, Homo sapiens
ctggacggcaggctcactgcc

SEQ ID NO: 4046523 - DNA, 22 bp, Homo sapiens
ctggacggcaggctcactgcca

SEQ ID NO: 4046524 - DNA, 15 bp, Homo sapiens
ctggacggggactgg

SEQ ID NO: 4046525 - DNA, 14 bp, Homo sapiens
ctggactattgtgc

SEQ ID NO: 4046526 - DNA, 19 bp, Homo sapiens
ctggactattgtgccaact

SEQ ID NO: 4046527 - DNA, 15 bp, Homo sapiens
ctggactctgcatcc

SEQ ID NO: 4046528 - DNA, 23 bp, Homo sapiens
ctggactctgcatcccagcacct

SEQ ID NO: 4046529 - DNA, 13 bp, Homo sapiens
ctggactgcttgg

SEQ ID NO: 4046530 - DNA, 15 bp, Homo sapiens
ctggactggaggtgg

SEQ ID NO: 4046531 - DNA, 24 bp, Homo sapiens
ctggactggaggtgggcatgccac

SEQ ID NO: 4046532 - DNA, 14 bp, Homo sapiens
ctggactgggaggt

SEQ ID NO: 4046533 - DNA, 15 bp, Homo sapiens
ctggacttctacctg

SEQ ID NO: 4046534 - DNA, 18 bp, Homo sapiens
ctggacttctacctgccc

SEQ ID NO: 4046535 - DNA, 13 bp, Homo sapiens
ctggacttctgtg

SEQ ID NO: 4046536 - DNA, 20 bp, Homo sapiens
ctggacttctgtgggcccct

SEQ ID NO: 4046537 - DNA, 13 bp, Homo sapiens
ctggactttcctg

SEQ ID NO: 4046538 - DNA, 14 bp, Homo sapiens
ctggactttcctgc

SEQ ID NO: 4046539 - DNA, 22 bp, Homo sapiens
ctggactttgcttcccctccag

SEQ ID NO: 4046540 - DNA, 23 bp, Homo sapiens
ctggactttgcttcccctccagg

SEQ ID NO: 4046541 - DNA, 23 bp, Homo sapiens
ctggactttggttctctccagga

SEQ ID NO: 4046542 - DNA, 13 bp, Homo sapiens
ctggagaagctga

SEQ ID NO: 4046543 - DNA, 17 bp, Homo sapiens
ctggagaagctgatgct

SEQ ID NO: 4046544 - DNA, 17 bp, Homo sapiens
ctggagaccagggagcc

SEQ ID NO: 4046545 - DNA, 12 bp, Homo sapiens
ctggagaccccc

SEQ ID NO: 4046546 - DNA, 21 bp, Homo sapiens
ctggagacgtggaacctctgt

SEQ ID NO: 4046547 - DNA, 12 bp, Homo sapiens
ctggagaggtta

SEQ ID NO: 4046548 - DNA, 22 bp, Homo sapiens
ctggagatactggtggaagttc

SEQ ID NO: 4046549 - DNA, 18 bp, Homo sapiens
ctggagcagaccaccccg

SEQ ID NO: 4046550 - DNA, 13 bp, Homo sapiens
ctggagccccatc

SEQ ID NO: 4046551 - DNA, 13 bp, Homo sapiens
ctggagcccccag

SEQ ID NO: 4046552 - DNA, 15 bp, Homo sapiens
ctggagcccccagca

SEQ ID NO: 4046553 - DNA, 16 bp, Homo sapiens
ctggagcccccagcag

SEQ ID NO: 4046554 - DNA, 20 bp, Homo sapiens
ctggagcccccagcagaggc

SEQ ID NO: 4046555 - DNA, 16 bp, Homo sapiens
ctggagccctgttcct

SEQ ID NO: 4046556 - DNA, 21 bp, Homo sapiens
ctggagccctgttcctccctc

SEQ ID NO: 4046557 - DNA, 19 bp, Homo sapiens
ctggagcggagaggaagcc

SEQ ID NO: 4046558 - DNA, 20 bp, Homo sapiens
ctggagcggagaggaagcca

SEQ ID NO: 4046559 - DNA, 14 bp, Homo sapiens
ctggagctcatctg

SEQ ID NO: 4046560 - DNA, 17 bp, Homo sapiens
ctggaggaaagggagga

SEQ ID NO: 4046561 - DNA, 22 bp, Homo sapiens
ctggaggaaggggggttgcagt

SEQ ID NO: 4046562 - DNA, 21 bp, Homo sapiens
ctggaggaattcagctcagct

SEQ ID NO: 4046563 - DNA, 20 bp, Homo sapiens
ctggaggacctgcccggtgg

SEQ ID NO: 4046564 - DNA, 14 bp, Homo sapiens
ctggaggagcagca

SEQ ID NO: 4046565 - DNA, 16 bp, Homo sapiens
ctggaggagcagcagc

SEQ ID NO: 4046566 - DNA, 14 bp, Homo sapiens
ctggaggaggcctg

SEQ ID NO: 4046567 - DNA, 15 bp, Homo sapiens
ctggaggcccaggct

SEQ ID NO: 4046568 - DNA, 18 bp, Homo sapiens
ctggaggcccaggctggg

SEQ ID NO: 4046569 - DNA, 14 bp, Homo sapiens
ctggaggcccagtt

SEQ ID NO: 4046570 - DNA, 20 bp, Homo sapiens
ctggaggcccctggagccag

SEQ ID NO: 4046571 - DNA, 21 bp, Homo sapiens
ctggaggcccctggagccaga

SEQ ID NO: 4046572 - DNA, 14 bp, Homo sapiens
ctggaggcctcagg

SEQ ID NO: 4046573 - DNA, 21 bp, Homo sapiens
ctggaggccttccagctgctg

SEQ ID NO: 4046574 - DNA, 14 bp, Homo sapiens
ctggaggctgccta

SEQ ID NO: 4046575 - DNA, 16 bp, Homo sapiens
ctggaggggagagctt

SEQ ID NO: 4046576 - DNA, 22 bp, Homo sapiens
ctggaggggagagctttgtgct

SEQ ID NO: 4046577 - DNA, 22 bp, Homo sapiens
ctggaggtcacattcaggaaga

SEQ ID NO: 4046578 - DNA, 13 bp, Homo sapiens
ctggaggtgggca

SEQ ID NO: 4046579 - DNA, 16 bp, Homo sapiens
ctggaggtgggcatgc

SEQ ID NO: 4046580 - DNA, 16 bp, Homo sapiens
ctggaggttgaagcca

SEQ ID NO: 4046581 - DNA, 19 bp, Homo sapiens
ctggaggttgaagccaagt

SEQ ID NO: 4046582 - DNA, 13 bp, Homo sapiens
ctggagtctggag

SEQ ID NO: 4046583 - DNA, 16 bp, Homo sapiens
ctggagtgcagtggca

SEQ ID NO: 4046584 - DNA, 15 bp, Homo sapiens
ctggagtgctgtgct

SEQ ID NO: 4046585 - DNA, 20 bp, Homo sapiens
ctggagtggaaggtctattg

SEQ ID NO: 4046586 - DNA, 21 bp, Homo sapiens
ctggagtggaaggtctattgg

SEQ ID NO: 4046587 - DNA, 16 bp, Homo sapiens
ctggagtgggcagagc

SEQ ID NO: 4046588 - DNA, 18 bp, Homo sapiens
ctggagtgtggctgagga

SEQ ID NO: 4046589 - DNA, 20 bp, Homo sapiens
ctggagtgtggctgaggagg

SEQ ID NO: 4046590 - DNA, 22 bp, Homo sapiens
ctggagttacattaatgttaat

SEQ ID NO: 4046591 - DNA, 18 bp, Homo sapiens
ctggagttgatctggaac

SEQ ID NO: 4046592 - DNA, 22 bp, Homo sapiens
ctggagttgatctggaacccag

SEQ ID NO: 4046593 - DNA, 13 bp, Homo sapiens
ctggagtttcatg

SEQ ID NO: 4046594 - DNA, 22 bp, Homo sapiens
ctggagtttttgtttggagagc

SEQ ID NO: 4046595 - DNA, 13 bp, Homo sapiens
ctggataaaatga

SEQ ID NO: 4046596 - DNA, 15 bp, Homo sapiens
ctggataacttaggt

SEQ ID NO: 4046597 - DNA, 18 bp, Homo sapiens
ctggataggagcctgctg

SEQ ID NO: 4046598 - DNA, 13 bp, Homo sapiens
ctggatattttca

SEQ ID NO: 4046599 - DNA, 22 bp, Homo sapiens
ctggatattttcaaattgtatc

SEQ ID NO: 4046600 - DNA, 14 bp, Homo sapiens
ctggatcacagctg

SEQ ID NO: 4046601 - DNA, 13 bp, Homo sapiens
ctggatcagggaa

SEQ ID NO: 4046602 - DNA, 21 bp, Homo sapiens
ctggatccctgcccttctcaa

SEQ ID NO: 4046603 - DNA, 23 bp, Homo sapiens
ctggatgaagattctcctgtgct

SEQ ID NO: 4046604 - DNA, 13 bp, Homo sapiens
ctggatgagactt

SEQ ID NO: 4046605 - DNA, 14 bp, Homo sapiens
ctggatgccagctg

SEQ ID NO: 4046606 - DNA, 18 bp, Homo sapiens
ctggatgccagctgtgtc

SEQ ID NO: 4046607 - DNA, 21 bp, Homo sapiens
ctggatggaggaaaaccaagc

SEQ ID NO: 4046608 - DNA, 21 bp, Homo sapiens
ctggatggcggaagctgctac

SEQ ID NO: 4046609 - DNA, 17 bp, Homo sapiens
ctggattcattgtctct

SEQ ID NO: 4046610 - DNA, 12 bp, Homo sapiens
ctggattggcca

SEQ ID NO: 4046611 - DNA, 15 bp, Homo sapiens
ctggcaatagtgtgt

SEQ ID NO: 4046612 - DNA, 15 bp, Homo sapiens
ctggcaattgtctat

SEQ ID NO: 4046613 - DNA, 17 bp, Homo sapiens
ctggcacagggcagtgg

SEQ ID NO: 4046614 - DNA, 21 bp, Homo sapiens
ctggcacggtggctcaggcct

SEQ ID NO: 4046615 - DNA, 19 bp, Homo sapiens
ctggcactaccaaaggaca

SEQ ID NO: 4046616 - DNA, 15 bp, Homo sapiens
ctggcactataatgt

SEQ ID NO: 4046617 - DNA, 20 bp, Homo sapiens
ctggcactgactgggcatag

SEQ ID NO: 4046618 - DNA, 18 bp, Homo sapiens
ctggcactgggaggcagg

SEQ ID NO: 4046619 - DNA, 23 bp, Homo sapiens
ctggcacttactggtccttacca

SEQ ID NO: 4046620 - DNA, 22 bp, Homo sapiens
ctggcagacttgcccaggtcac

SEQ ID NO: 4046621 - DNA, 13 bp, Homo sapiens
ctggcagccgtgc

SEQ ID NO: 4046622 - DNA, 21 bp, Homo sapiens
ctggcagccgtgccttcagct

SEQ ID NO: 4046623 - DNA, 22 bp, Homo sapiens
ctggcagccgtgccttcagctc

SEQ ID NO: 4046624 - DNA, 12 bp, Homo sapiens
ctggcagcctcc

SEQ ID NO: 4046625 - DNA, 23 bp, Homo sapiens
ctgctaccgccctgggctggact

SEQ ID NO: 4046626 - DNA, 20 bp, Homo sapiens
ctgctaggcgagtgccagga

SEQ ID NO: 4046627 - DNA, 18 bp, Homo sapiens
ctgctatatataaaacgg

SEQ ID NO: 4046628 - DNA, 16 bp, Homo sapiens
ctgctatccccatctc

SEQ ID NO: 4046629 - DNA, 21 bp, Homo sapiens
ctgctcaactctacccctgct

SEQ ID NO: 4046630 - DNA, 22 bp, Homo sapiens
ctgctcaactctacccctgctc

SEQ ID NO: 4046631 - DNA, 20 bp, Homo sapiens
ctgctcaagaagacatggag

SEQ ID NO: 4046632 - DNA, 23 bp, Homo sapiens
ctgctcaagaagacatggagact

SEQ ID NO: 4046633 - DNA, 17 bp, Homo sapiens
ctgctcaccacctgcct

SEQ ID NO: 4046634 - DNA, 19 bp, Homo sapiens
ctgctcaccgcccatcagg

SEQ ID NO: 4046635 - DNA, 20 bp, Homo sapiens
ctgctcaccgcccatcaggg

SEQ ID NO: 4046636 - DNA, 16 bp, Homo sapiens
ctgctcaccggagtca

SEQ ID NO: 4046637 - DNA, 22 bp, Homo sapiens
ctgctcagaacttgctgctgtc

SEQ ID NO: 4046638 - DNA, 15 bp, Homo sapiens
ctgctcagccaagct

SEQ ID NO: 4046639 - DNA, 16 bp, Homo sapiens
ctgctcagccaagctt

SEQ ID NO: 4046640 - DNA, 16 bp, Homo sapiens
ctgctccaccacatcc

SEQ ID NO: 4046641 - DNA, 15 bp, Homo sapiens
ctgctccaccagcag

SEQ ID NO: 4046642 - DNA, 14 bp, Homo sapiens
ctgctccacccttg

SEQ ID NO: 4046643 - DNA, 16 bp, Homo sapiens
ctgctccacccttggc

SEQ ID NO: 4046644 - DNA, 21 bp, Homo sapiens
ctgctccacgaagccttaagc

SEQ ID NO: 4046645 - DNA, 11 bp, Homo sapiens
ctgctccagaa

SEQ ID NO: 4046646 - DNA, 21 bp, Homo sapiens
ctgctccagacctgatcctgg

SEQ ID NO: 4046647 - DNA, 19 bp, Homo sapiens
ctgctccagctctggcatg

SEQ ID NO: 4046648 - DNA, 12 bp, Homo sapiens
ctgctccaggcc

SEQ ID NO: 4046649 - DNA, 21 bp, Homo sapiens
ctgctccatttataaccccag

SEQ ID NO: 4046650 - DNA, 23 bp, Homo sapiens
ctgctccatttataaccccagcc

SEQ ID NO: 4046651 - DNA, 14 bp, Homo sapiens
ctgctcccagcagc

SEQ ID NO: 4046652 - DNA, 17 bp, Homo sapiens
ctgctcccagcagccct

SEQ ID NO: 4046653 - DNA, 13 bp, Homo sapiens
ctgctcccagcct

SEQ ID NO: 4046654 - DNA, 17 bp, Homo sapiens
ctgctcccattcctccc

SEQ ID NO: 4046655 - DNA, 16 bp, Homo sapiens
ctgctccccagccctg

SEQ ID NO: 4046656 - DNA, 17 bp, Homo sapiens
ctgctccccagccctgg

SEQ ID NO: 4046657 - DNA, 19 bp, Homo sapiens
ctgctccccagccctggct

SEQ ID NO: 4046658 - DNA, 19 bp, Homo sapiens
ctgctcccccttttccctc

SEQ ID NO: 4046659 - DNA, 13 bp, Homo sapiens
ctgctccctccag

SEQ ID NO: 4046660 - DNA, 15 bp, Homo sapiens
ctgctccctccagaa

SEQ ID NO: 4046661 - DNA, 22 bp, Homo sapiens
ctgctccctgctttggctgagg

SEQ ID NO: 4046662 - DNA, 13 bp, Homo sapiens
ctgctccctggca

SEQ ID NO: 4046663 - DNA, 14 bp, Homo sapiens
ctgctccgcccgct

SEQ ID NO: 4046664 - DNA, 15 bp, Homo sapiens
ctgctccgctgctcc

SEQ ID NO: 4046665 - DNA, 16 bp, Homo sapiens
ctgctccgctgctcct

SEQ ID NO: 4046666 - DNA, 21 bp, Homo sapiens
ctgctccgctgctccttggct

SEQ ID NO: 4046667 - DNA, 13 bp, Homo sapiens
ctgctcctgcagc

SEQ ID NO: 4046668 - DNA, 16 bp, Homo sapiens
ctgctcctgcagcatg

SEQ ID NO: 4046669 - DNA, 14 bp, Homo sapiens
ctgctcctgctttt

SEQ ID NO: 4046670 - DNA, 15 bp, Homo sapiens
ctgctcctgcttttc

SEQ ID NO: 4046671 - DNA, 14 bp, Homo sapiens
ctgctccttccctt

SEQ ID NO: 4046672 - DNA, 20 bp, Homo sapiens
ctgctccttggcttacctga

SEQ ID NO: 4046673 - DNA, 15 bp, Homo sapiens
ctgctcgccctcctt

SEQ ID NO: 4046674 - DNA, 22 bp, Homo sapiens
ctgctcgccctcctttctgtgc

SEQ ID NO: 4046675 - DNA, 19 bp, Homo sapiens
ctgctctacccatgagcct

SEQ ID NO: 4046676 - DNA, 22 bp, Homo sapiens
ctgctctacccatgagcctgcc

SEQ ID NO: 4046677 - DNA, 17 bp, Homo sapiens
ctgctctagtgggacag

SEQ ID NO: 4046678 - DNA, 13 bp, Homo sapiens
ctgctctcagctc

SEQ ID NO: 4046679 - DNA, 17 bp, Homo sapiens
ctgctctcagctccggg

SEQ ID NO: 4046680 - DNA, 11 bp, Homo sapiens
ctgctctgctc

SEQ ID NO: 4046681 - DNA, 17 bp, Homo sapiens
ctgctctggttgtttct

SEQ ID NO: 4046682 - DNA, 21 bp, Homo sapiens
ctgctctggttgtttctgttc

SEQ ID NO: 4046683 - DNA, 15 bp, Homo sapiens
ctgctcttaagaaac

SEQ ID NO: 4046684 - DNA, 22 bp, Homo sapiens
ctgctctttctacatgactggg

SEQ ID NO: 4046685 - DNA, 16 bp, Homo sapiens
ctgctctttctctgcc

SEQ ID NO: 4046686 - DNA, 19 bp, Homo sapiens
ctgctctttctctgccagt

SEQ ID NO: 4046687 - DNA, 21 bp, Homo sapiens
ctgctgaccaattgtgctgcc

SEQ ID NO: 4046688 - DNA, 22 bp, Homo sapiens
ctgctgaccaattgtgctgcca

SEQ ID NO: 4046689 - DNA, 23 bp, Homo sapiens
ctgctgaccaattgtgctgccat

SEQ ID NO: 4046690 - DNA, 20 bp, Homo sapiens
ctgctgagagcccccacctt

SEQ ID NO: 4046691 - DNA, 20 bp, Homo sapiens
ctgctgcacccaactactga

SEQ ID NO: 4046692 - DNA, 20 bp, Homo sapiens
ctgctgcagattagttcttt

SEQ ID NO: 4046693 - DNA, 23 bp, Homo sapiens
ctgctgcagattagttctttttg

SEQ ID NO: 4046694 - DNA, 16 bp, Homo sapiens
ctgctgcatagctcta

SEQ ID NO: 4046695 - DNA, 14 bp, Homo sapiens
ctgctgccccagct

SEQ ID NO: 4046696 - DNA, 15 bp, Homo sapiens
ctgctgccccagctg

SEQ ID NO: 4046697 - DNA, 16 bp, Homo sapiens
ctgctgcccctgcagt

SEQ ID NO: 4046698 - DNA, 21 bp, Homo sapiens
ctgctgcctctttccctagga

SEQ ID NO: 4046699 - DNA, 22 bp, Homo sapiens
ctgctgcctctttccctaggaa

SEQ ID NO: 4046700 - DNA, 16 bp, Homo sapiens
ctgctgcctgctgaga

SEQ ID NO: 4046701 - DNA, 17 bp, Homo sapiens
ctgctgcgcccttacct

SEQ ID NO: 4046702 - DNA, 16 bp, Homo sapiens
ctgctgctacaatgtc

SEQ ID NO: 4046703 - DNA, 14 bp, Homo sapiens
ctgctgctgcaccc

SEQ ID NO: 4046704 - DNA, 15 bp, Homo sapiens
ctgctgctgcgccct

SEQ ID NO: 4046705 - DNA, 15 bp, Homo sapiens
ctgctgctggatcac

SEQ ID NO: 4046706 - DNA, 16 bp, Homo sapiens
ctgctggaagcccagc

SEQ ID NO: 4046707 - DNA, 12 bp, Homo sapiens
ctgctggccaaa

SEQ ID NO: 4046708 - DNA, 16 bp, Homo sapiens
ctgctggcccagccaa

SEQ ID NO: 4046709 - DNA, 14 bp, Homo sapiens
ctgctggccgaccc

SEQ ID NO: 4046710 - DNA, 15 bp, Homo sapiens
ctgctggcctggatc

SEQ ID NO: 4046711 - DNA, 13 bp, Homo sapiens
ctgctggctgcct

SEQ ID NO: 4046712 - DNA, 20 bp, Homo sapiens
ctgctggcttccagcttcag

SEQ ID NO: 4046713 - DNA, 21 bp, Homo sapiens
ctgctggcttccagcttcagg

SEQ ID NO: 4046714 - DNA, 17 bp, Homo sapiens
ctgctgggagttctaga

SEQ ID NO: 4046715 - DNA, 13 bp, Homo sapiens
ctgctgggctccc

SEQ ID NO: 4046716 - DNA, 16 bp, Homo sapiens
ctgctgggctcccccc

SEQ ID NO: 4046717 - DNA, 17 bp, Homo sapiens
ctgctgggctcccccca

SEQ ID NO: 4046718 - DNA, 16 bp, Homo sapiens
ctgctgggctgagtga

SEQ ID NO: 4046719 - DNA, 18 bp, Homo sapiens
ctgctgggctgagtgaca

SEQ ID NO: 4046720 - DNA, 22 bp, Homo sapiens
ctgctgggctgagtgacacaag

SEQ ID NO: 4046721 - DNA, 16 bp, Homo sapiens
ctgctgggcttcctgt

SEQ ID NO: 4046722 - DNA, 16 bp, Homo sapiens
ctgctggtcacagcct

SEQ ID NO: 4046723 - DNA, 17 bp, Homo sapiens
ctgctggtcacttcttc

SEQ ID NO: 4046724 - DNA, 17 bp, Homo sapiens
ctgctggtgccagggtg

SEQ ID NO: 4046725 - DNA, 19 bp, Homo sapiens
ctgctgtacccagatgcct

SEQ ID NO: 4046726 - DNA, 16 bp, Homo sapiens
ctgctgtcattgcttc

SEQ ID NO: 4046727 - DNA, 18 bp, Homo sapiens
ctgctgtcattgcttctt

SEQ ID NO: 4046728 - DNA, 14 bp, Homo sapiens
ttcattcattcact

SEQ ID NO: 4046729 - DNA, 18 bp, Homo sapiens
ttcattcctaacacagca

SEQ ID NO: 4046730 - DNA, 12 bp, Homo sapiens
ttcattctcata

SEQ ID NO: 4046731 - DNA, 15 bp, Homo sapiens
ttcattctccttgtt

SEQ ID NO: 4046732 - DNA, 21 bp, Homo sapiens
ttcattctcgtgagtcattta

SEQ ID NO: 4046733 - DNA, 15 bp, Homo sapiens
ttcattctggtcatt

SEQ ID NO: 4046734 - DNA, 17 bp, Homo sapiens
ttcattctgtgatcatt

SEQ ID NO: 4046735 - DNA, 13 bp, Homo sapiens
ttcattgctgtga

SEQ ID NO: 4046736 - DNA, 18 bp, Homo sapiens
ttcattggtgaagtaaat

SEQ ID NO: 4046737 - DNA, 21 bp, Homo sapiens
ttcatttagctaaacggattc

SEQ ID NO: 4046738 - DNA, 21 bp, Homo sapiens
ttcatttcttacgttctttca

SEQ ID NO: 4046739 - DNA, 19 bp, Homo sapiens
ttcatttcttcctcagctg

SEQ ID NO: 4046740 - DNA, 11 bp, Homo sapiens
ttcatttcttg

SEQ ID NO: 4046741 - DNA, 16 bp, Homo sapiens
ttcatttgatgctaaa

SEQ ID NO: 4046742 - DNA, 22 bp, Homo sapiens
ttcatttggttcattaattcta

SEQ ID NO: 4046743 - DNA, 22 bp, Homo sapiens
ttcatttgtttgtttgtttgtc

SEQ ID NO: 4046744 - DNA, 16 bp, Homo sapiens
ttcattttcatcactg

SEQ ID NO: 4046745 - DNA, 13 bp, Homo sapiens
ttcattttcctgt

SEQ ID NO: 4046746 - DNA, 20 bp, Homo sapiens
ttcattttcctgttcagtga

SEQ ID NO: 4046747 - DNA, 21 bp, Homo sapiens
ttcattttctgacatgcattg

SEQ ID NO: 4046748 - DNA, 22 bp, Homo sapiens
ttcattttctgacatgcattgt

SEQ ID NO: 4046749 - DNA, 16 bp, Homo sapiens
ttcattttggttttgt

SEQ ID NO: 4046750 - DNA, 18 bp, Homo sapiens
ttccaaaaaggttgctgt

SEQ ID NO: 4046751 - DNA, 13 bp, Homo sapiens
ttccaaaattctt

SEQ ID NO: 4046752 - DNA, 22 bp, Homo sapiens
ttccaaacatgaggttctctct

SEQ ID NO: 4046753 - DNA, 16 bp, Homo sapiens
ttccaaacctgacaga

SEQ ID NO: 4046754 - DNA, 19 bp, Homo sapiens
ttccaaagcacattgaaag

SEQ ID NO: 4046755 - DNA, 15 bp, Homo sapiens
ttccaaattcagttt

SEQ ID NO: 4046756 - DNA, 18 bp, Homo sapiens
ttccaaattcagtttcat

SEQ ID NO: 4046757 - DNA, 18 bp, Homo sapiens
ttccaacaccacagacac

SEQ ID NO: 4046758 - DNA, 21 bp, Homo sapiens
ttccaacaccacagacacaca

SEQ ID NO: 4046759 - DNA, 15 bp, Homo sapiens
ttccaaccaggcagt

SEQ ID NO: 4046760 - DNA, 17 bp, Homo sapiens
ttccaagacattgtcaa

SEQ ID NO: 4046761 - DNA, 19 bp, Homo sapiens
ttccaagacattgtcaata

SEQ ID NO: 4046762 - DNA, 15 bp, Homo sapiens
ttccaagaggctgta

SEQ ID NO: 4046763 - DNA, 13 bp, Homo sapiens
ttccaaggagacc

SEQ ID NO: 4046764 - DNA, 16 bp, Homo sapiens
ttccaaggagttccat

SEQ ID NO: 4046765 - DNA, 17 bp, Homo sapiens
ttccaagggtactaagg

SEQ ID NO: 4046766 - DNA, 15 bp, Homo sapiens
ttccaatcttgcttt

SEQ ID NO: 4046767 - DNA, 18 bp, Homo sapiens
ttccacaaaatctgtcca

SEQ ID NO: 4046768 - DNA, 21 bp, Homo sapiens
ttccacagcctgcaagtcagt

SEQ ID NO: 4046769 - DNA, 23 bp, Homo sapiens
ttccacctccaccacatctgcca

SEQ ID NO: 4046770 - DNA, 18 bp, Homo sapiens
ttccacgcagttctttcc

SEQ ID NO: 4046771 - DNA, 17 bp, Homo sapiens
ttccactacacctggct

SEQ ID NO: 4046772 - DNA, 22 bp, Homo sapiens
ttccactacacctggctgaggt

SEQ ID NO: 4046773 - DNA, 21 bp, Homo sapiens
ttccacttagaaattgcattt

SEQ ID NO: 4046774 - DNA, 17 bp, Homo sapiens
ttccacttgagtgtcaa

SEQ ID NO: 4046775 - DNA, 15 bp, Homo sapiens
ttccactttgttctt

SEQ ID NO: 4046776 - DNA, 23 bp, Homo sapiens
ttccactttgttctttaggagat

SEQ ID NO: 4046777 - DNA, 16 bp, Homo sapiens
ttccagaagaagagaa

SEQ ID NO: 4046778 - DNA, 19 bp, Homo sapiens
ttccagaatatctgggatt

SEQ ID NO: 4046779 - DNA, 12 bp, Homo sapiens
ttccagaatctt

SEQ ID NO: 4046780 - DNA, 14 bp, Homo sapiens
ttccagaatgctgt

SEQ ID NO: 4046781 - DNA, 16 bp, Homo sapiens
ttccagaatgctgtac

SEQ ID NO: 4046782 - DNA, 20 bp, Homo sapiens
ttccagacttccttgagaca

SEQ ID NO: 4046783 - DNA, 21 bp, Homo sapiens
ttccagagagtggctcctccc

SEQ ID NO: 4046784 - DNA, 11 bp, Homo sapiens
ttgtaaataca

SEQ ID NO: 4046785 - DNA, 17 bp, Homo sapiens
ttgtaaatactgcttga

SEQ ID NO: 4046786 - DNA, 13 bp, Homo sapiens
ttgtaaatattta

SEQ ID NO: 4046787 - DNA, 20 bp, Homo sapiens
ttgtaaatgattttaatttt

SEQ ID NO: 4046788 - DNA, 22 bp, Homo sapiens
ttgtaaattaaacataaaacaa

SEQ ID NO: 4046789 - DNA, 14 bp, Homo sapiens
ttgtaacctcagct

SEQ ID NO: 4046790 - DNA, 15 bp, Homo sapiens
ttgtaacctcagctc

SEQ ID NO: 4046791 - DNA, 18 bp, Homo sapiens
ttgtaacttatattgaag

SEQ ID NO: 4046792 - DNA, 19 bp, Homo sapiens
ttgtaagaaggcaatatta

SEQ ID NO: 4046793 - DNA, 21 bp, Homo sapiens
ttgtaagagtgtagaagcatt

SEQ ID NO: 4046794 - DNA, 22 bp, Homo sapiens
ttgtaagagtgtagaagcattc

SEQ ID NO: 4046795 - DNA, 19 bp, Homo sapiens
ttgtaagtcagtgttgaga

SEQ ID NO: 4046796 - DNA, 21 bp, Homo sapiens
ttgtaagtcagtgttgagatg

SEQ ID NO: 4046797 - DNA, 18 bp, Homo sapiens
ttgtaagttgtacaaatg

SEQ ID NO: 4046798 - DNA, 19 bp, Homo sapiens
ttgtaagttgtacaaatgt

SEQ ID NO: 4046799 - DNA, 13 bp, Homo sapiens
ttgtaagtttcag

SEQ ID NO: 4046800 - DNA, 14 bp, Homo sapiens
ttgtaataagcaat

SEQ ID NO: 4046801 - DNA, 22 bp, Homo sapiens
ttgtaatactttctatgtgaca

SEQ ID NO: 4046802 - DNA, 16 bp, Homo sapiens
ttgtaatcaagccttt

SEQ ID NO: 4046803 - DNA, 21 bp, Homo sapiens
ttgtaatgtgtgaaaaagatg

SEQ ID NO: 4046804 - DNA, 17 bp, Homo sapiens
ttgtaattatgatttgg

SEQ ID NO: 4046805 - DNA, 19 bp, Homo sapiens
ttgtaattgcttacatttt

SEQ ID NO: 4046806 - DNA, 15 bp, Homo sapiens
ttgtgtatatttgta

SEQ ID NO: 4046807 - DNA, 20 bp, Homo sapiens
ttgtgtatcgtaaccagcca

SEQ ID NO: 4046808 - DNA, 20 bp, Homo sapiens
ttgtgtatttacgctttgat

SEQ ID NO: 4046809 - DNA, 20 bp, Homo sapiens
ttgtgttaagtatgtgtaaa

SEQ ID NO: 4046810 - DNA, 13 bp, Homo sapiens
ttgtgttcctggc

SEQ ID NO: 4046811 - DNA, 21 bp, Homo sapiens
ttgtgttgtaattcttcagtt

SEQ ID NO: 4046812 - DNA, 16 bp, Homo sapiens
ttgtgtttggtttaca

SEQ ID NO: 4046813 - DNA, 15 bp, Homo sapiens
ttgtgttttttaaga

SEQ ID NO: 4046814 - DNA, 16 bp, Homo sapiens
ttgtgttttttaagat

SEQ ID NO: 4046815 - DNA, 21 bp, Homo sapiens
ttgtgttttttaagatagtgt

SEQ ID NO: 4046816 - DNA, 13 bp, Homo sapiens
ttgttaaaaataa

SEQ ID NO: 4046817 - DNA, 21 bp, Homo sapiens
ttgttaaaaataaatcccatg

SEQ ID NO: 4046818 - DNA, 12 bp, Homo sapiens
ttgttaaatttt

SEQ ID NO: 4046819 - DNA, 14 bp, Homo sapiens
ttgttaagaaaaat

SEQ ID NO: 4046820 - DNA, 21 bp, Homo sapiens
ttgttacaggcaccgagaatg

SEQ ID NO: 4046821 - DNA, 22 bp, Homo sapiens
ttgttactctggttctttgttt

SEQ ID NO: 4046822 - DNA, 16 bp, Homo sapiens
ttgttagatagctgca

SEQ ID NO: 4046823 - DNA, 18 bp, Homo sapiens
ttgttagtttacaatatt

SEQ ID NO: 4046824 - DNA, 16 bp, Homo sapiens
ttgttatcagtcaata

SEQ ID NO: 4046825 - DNA, 20 bp, Homo sapiens
ttgttattccatcaataaat

SEQ ID NO: 4046826 - DNA, 15 bp, Homo sapiens
ttgttattttggaaa

SEQ ID NO: 4046827 - DNA, 14 bp, Homo sapiens
ttgttcaaacaata

SEQ ID NO: 4046828 - DNA, 15 bp, Homo sapiens
ttgttcaaatgcatt

SEQ ID NO: 4046829 - DNA, 21 bp, Homo sapiens
ttgttccaagacattgtcaat

SEQ ID NO: 4046830 - DNA, 22 bp, Homo sapiens
ttgttccctgtgtcatttcaaa

SEQ ID NO: 4046831 - DNA, 23 bp, Homo sapiens
ttgttctccgggtgtggcctcag

SEQ ID NO: 4046832 - DNA, 12 bp, Homo sapiens
ttgttctgggct

SEQ ID NO: 4046833 - DNA, 14 bp, Homo sapiens
ttgttctttaaagt

SEQ ID NO: 4046834 - DNA, 14 bp, Homo sapiens
ttgttgaggtggtc

SEQ ID NO: 4046835 - DNA, 21 bp, Homo sapiens
ttgttgaggtggtctgaatgt

SEQ ID NO: 4046836 - DNA, 16 bp, Homo sapiens
ttgttgcaagatgtga

SEQ ID NO: 4046837 - DNA, 18 bp, Homo sapiens
ttgttgcaagatgtgaat

SEQ ID NO: 4046838 - DNA, 17 bp, Homo sapiens
ttgttgcatgtttgaaa

SEQ ID NO: 4046839 - DNA, 20 bp, Homo sapiens
ttgttgccatgtgcaccttg

SEQ ID NO: 4046840 - DNA, 15 bp, Homo sapiens
ttgttggatcttcaa

SEQ ID NO: 4046841 - DNA, 20 bp, Homo sapiens
ttgttggatcttcaatggct

SEQ ID NO: 4046842 - DNA, 15 bp, Homo sapiens
ttgttggctatttga

SEQ ID NO: 4046843 - DNA, 20 bp, Homo sapiens
ttgttgtataatttcgagat

SEQ ID NO: 4046844 - DNA, 21 bp, Homo sapiens
ttgttgttaatgaaaatgtca

SEQ ID NO: 4046845 - DNA, 13 bp, Homo sapiens
ttgttgtttgctt

SEQ ID NO: 4046846 - DNA, 18 bp, Homo sapiens
ttgtttaaagaataaagt

SEQ ID NO: 4046847 - DNA, 22 bp, Homo sapiens
ttgtttatcagatacatcactg

SEQ ID NO: 4046848 - DNA, 15 bp, Homo sapiens
ttgtttctgttccaa

SEQ ID NO: 4046849 - DNA, 16 bp, Homo sapiens
ttgtttctgttccaaa

SEQ ID NO: 4046850 - DNA, 17 bp, Homo sapiens
ttgtttctgttccaaat

SEQ ID NO: 4046851 - DNA, 15 bp, Homo sapiens
ttgtttcttccaaag

SEQ ID NO: 4046852 - DNA, 13 bp, Homo sapiens
ttgtttcttttaa

SEQ ID NO: 4046853 - DNA, 14 bp, Homo sapiens
ttgtttgctgctat

SEQ ID NO: 4046854 - DNA, 13 bp, Homo sapiens
ttgtttgcttatt

SEQ ID NO: 4046855 - DNA, 16 bp, Homo sapiens
ttgtttggatgtaatt

SEQ ID NO: 4046856 - DNA, 18 bp, Homo sapiens
ttgtttggatgtaattta

SEQ ID NO: 4046857 - DNA, 15 bp, Homo sapiens
ttgtttggatttcct

SEQ ID NO: 4046858 - DNA, 21 bp, Homo sapiens
ttgtttgggtatcctgcccag

SEQ ID NO: 4046859 - DNA, 22 bp, Homo sapiens
ttgtttgtaaataagagatttg

SEQ ID NO: 4046860 - DNA, 16 bp, Homo sapiens
ttgttttaagcaaatg

SEQ ID NO: 4046861 - DNA, 16 bp, Homo sapiens
ttgttttcagtgtaca

SEQ ID NO: 4046862 - DNA, 22 bp, Homo sapiens
ttgttttctttctttaaatgtt

SEQ ID NO: 4046863 - DNA, 16 bp, Homo sapiens
ttgttttgcacttttt

SEQ ID NO: 4046864 - DNA, 19 bp, Homo sapiens
ttgttttgctgagagcata

SEQ ID NO: 4046865 - DNA, 13 bp, Homo sapiens
ttgttttgcttcc

SEQ ID NO: 4046866 - DNA, 16 bp, Homo sapiens
ttgttttgcttcccct

SEQ ID NO: 4046867 - DNA, 13 bp, Homo sapiens
ttgttttgtattg

SEQ ID NO: 4046868 - DNA, 16 bp, Homo sapiens
ttgttttgtgcagaga

SEQ ID NO: 4046869 - DNA, 15 bp, Homo sapiens
ttgtttttgctttct

SEQ ID NO: 4046870 - DNA, 23 bp, Homo sapiens
ttgtttttttaaatcgccttgaa

SEQ ID NO: 4046871 - DNA, 22 bp, Homo sapiens
tttaaaaaaaaaagttacagaa

SEQ ID NO: 4046872 - DNA, 17 bp, Homo sapiens
tttaaaaaacagaaaaa

SEQ ID NO: 4046873 - DNA, 14 bp, Homo sapiens
tttaaaaagccagt

SEQ ID NO: 4046874 - DNA, 19 bp, Homo sapiens
tttaaaaagggaagaaact

SEQ ID NO: 4046875 - DNA, 20 bp, Homo sapiens
tttaaaaagggaagaaactg

SEQ ID NO: 4046876 - DNA, 17 bp, Homo sapiens
tttaaaaatacacttgt

SEQ ID NO: 4046877 - DNA, 13 bp, Homo sapiens
tttaaaacactaa

SEQ ID NO: 4046878 - DNA, 13 bp, Homo sapiens
tttaaaagaatga

SEQ ID NO: 4046879 - DNA, 21 bp, Homo sapiens
tttaaaagagagagagagaaa

SEQ ID NO: 4046880 - DNA, 22 bp, Homo sapiens
tttaaaagagagagagagaaaa

SEQ ID NO: 4046881 - DNA, 23 bp, Homo sapiens
tttaaaagagagagagagaaaaa

SEQ ID NO: 4046882 - DNA, 17 bp, Homo sapiens
tttaaaataaaatgaaa

SEQ ID NO: 4046883 - DNA, 22 bp, Homo sapiens
tttaaaataaaatgaaaattgt

SEQ ID NO: 4046884 - DNA, 13 bp, Homo sapiens
tttaaaatagaaa

SEQ ID NO: 4046885 - DNA, 14 bp, Homo sapiens
tttaaaatatttaa

SEQ ID NO: 4046886 - DNA, 20 bp, Homo sapiens
tttaaaatatttgaatgaaa

SEQ ID NO: 4046887 - DNA, 17 bp, Homo sapiens
ttcctttgtcttcaaac

SEQ ID NO: 4046888 - DNA, 13 bp, Homo sapiens
ttcctttgtgctt

SEQ ID NO: 4046889 - DNA, 14 bp, Homo sapiens
ttccttttccctgc

SEQ ID NO: 4046890 - DNA, 21 bp, Homo sapiens
ttccttttctgtataaagttc

SEQ ID NO: 4046891 - DNA, 18 bp, Homo sapiens
ttcctttttaaatgtgaa

SEQ ID NO: 4046892 - DNA, 23 bp, Homo sapiens
ttcctttttaaatgtgaattttt

SEQ ID NO: 4046893 - DNA, 15 bp, Homo sapiens
ttcctttttctgatt

SEQ ID NO: 4046894 - DNA, 14 bp, Homo sapiens
ttcctttttcttcg

SEQ ID NO: 4046895 - DNA, 17 bp, Homo sapiens
ttcctttttcttcgctg

SEQ ID NO: 4046896 - DNA, 15 bp, Homo sapiens
ttcctttttgacact

SEQ ID NO: 4046897 - DNA, 16 bp, Homo sapiens
ttcctttttgacactg

SEQ ID NO: 4046898 - DNA, 18 bp, Homo sapiens
ttcctttttgacactgaa

SEQ ID NO: 4046899 - DNA, 14 bp, Homo sapiens
ttcgaaactgccaa

SEQ ID NO: 4046900 - DNA, 14 bp, Homo sapiens
ttcgagaccagcct

SEQ ID NO: 4046901 - DNA, 20 bp, Homo sapiens
ttcgataaacaacaaggtgg

SEQ ID NO: 4046902 - DNA, 18 bp, Homo sapiens
ttcgcaccattctcctgc

SEQ ID NO: 4046903 - DNA, 23 bp, Homo sapiens
ttcgcacctaccatcagggacag

SEQ ID NO: 4046904 - DNA, 18 bp, Homo sapiens
ttcgcatggtcacacact

SEQ ID NO: 4046905 - DNA, 17 bp, Homo sapiens
ttcggacagacatatgg

SEQ ID NO: 4046906 - DNA, 19 bp, Homo sapiens
ttcggcagaggaaccccca

SEQ ID NO: 4046907 - DNA, 21 bp, Homo sapiens
ttcggcagaggaacccccacc

SEQ ID NO: 4046908 - DNA, 20 bp, Homo sapiens
ttcggccgagctggtttcct

SEQ ID NO: 4046909 - DNA, 21 bp, Homo sapiens
ttcggggcgatgctccctcag

SEQ ID NO: 4046910 - DNA, 17 bp, Homo sapiens
ttcgtgaacatcccctc

SEQ ID NO: 4046911 - DNA, 15 bp, Homo sapiens
ttcgtgcactctgct

SEQ ID NO: 4046912 - DNA, 23 bp, Homo sapiens
ttcgttaattaatgtcatgttgc

SEQ ID NO: 4046913 - DNA, 17 bp, Homo sapiens
ttcgtttttcttggggt

SEQ ID NO: 4046914 - DNA, 14 bp, Homo sapiens
ttctaaaaacttct

SEQ ID NO: 4046915 - DNA, 19 bp, Homo sapiens
ttctaaaacttgtatgttt

SEQ ID NO: 4046916 - DNA, 19 bp, Homo sapiens
ttctaaacccaatccaaat

SEQ ID NO: 4046917 - DNA, 20 bp, Homo sapiens
ttctaaactaggctccttca

SEQ ID NO: 4046918 - DNA, 13 bp, Homo sapiens
ttctaaagataat

SEQ ID NO: 4046919 - DNA, 19 bp, Homo sapiens
ttctaaagctgaatgtcaa

SEQ ID NO: 4046920 - DNA, 18 bp, Homo sapiens
ttctaaatgaatgtttac

SEQ ID NO: 4046921 - DNA, 13 bp, Homo sapiens
ttctaaatgcata

SEQ ID NO: 4046922 - DNA, 20 bp, Homo sapiens
ttctaaatgcatatcctgag

SEQ ID NO: 4046923 - DNA, 23 bp, Homo sapiens
ttctaaatgcatatcctgagcca

SEQ ID NO: 4046924 - DNA, 21 bp, Homo sapiens
ttctctgcccagcttttcatt

SEQ ID NO: 4046925 - DNA, 12 bp, Homo sapiens
ttctctgccctt

SEQ ID NO: 4046926 - DNA, 21 bp, Homo sapiens
ttctctgccgctacctccctc

SEQ ID NO: 4046927 - DNA, 22 bp, Homo sapiens
ttctctgccgctacctccctcc

SEQ ID NO: 4046928 - DNA, 11 bp, Homo sapiens
ttctctgctcc

SEQ ID NO: 4046929 - DNA, 14 bp, Homo sapiens
ttctctgctccacc

SEQ ID NO: 4046930 - DNA, 19 bp, Homo sapiens
ttctctggtaatattgact

SEQ ID NO: 4046931 - DNA, 18 bp, Homo sapiens
ttctctgtgtttgttcct

SEQ ID NO: 4046932 - DNA, 15 bp, Homo sapiens
ttctctgttcccttg

SEQ ID NO: 4046933 - DNA, 18 bp, Homo sapiens
ttctcttagctactgtat

SEQ ID NO: 4046934 - DNA, 20 bp, Homo sapiens
ttctcttccagtttctgtaa

SEQ ID NO: 4046935 - DNA, 23 bp, Homo sapiens
ttctcttccccttcctgtttcag

SEQ ID NO: 4046936 - DNA, 23 bp, Homo sapiens
ttctcttccctgcgcctgtgatg

SEQ ID NO: 4046937 - DNA, 20 bp, Homo sapiens
ttctcttctccccttccatt

SEQ ID NO: 4046938 - DNA, 21 bp, Homo sapiens
ttctcttgaaaagttcaggga

SEQ ID NO: 4046939 - DNA, 18 bp, Homo sapiens
ttctcttgagtcacactg

SEQ ID NO: 4046940 - DNA, 22 bp, Homo sapiens
ttctcttgggaactgaactcac

SEQ ID NO: 4046941 - DNA, 13 bp, Homo sapiens
ttctctttctctc

SEQ ID NO: 4046942 - DNA, 22 bp, Homo sapiens
ttctgaaattcacagaagccta

SEQ ID NO: 4046943 - DNA, 16 bp, Homo sapiens
ttctgaatgctgctac

SEQ ID NO: 4046944 - DNA, 22 bp, Homo sapiens
ttctgacaaaaagtttccatat

SEQ ID NO: 4046945 - DNA, 14 bp, Homo sapiens
ttctgacattaaca

SEQ ID NO: 4046946 - DNA, 15 bp, Homo sapiens
ttctgacattaacag

SEQ ID NO: 4046947 - DNA, 18 bp, Homo sapiens
ttctgaccctgcttcaaa

SEQ ID NO: 4046948 - DNA, 21 bp, Homo sapiens
ttctgagcagtgcctcttgtc

SEQ ID NO: 4046949 - DNA, 15 bp, Homo sapiens
ttctgaggtccttat

SEQ ID NO: 4046950 - DNA, 12 bp, Homo sapiens
ttctgatcagag

SEQ ID NO: 4046951 - DNA, 13 bp, Homo sapiens
ttctgatcagagg

SEQ ID NO: 4046952 - DNA, 14 bp, Homo sapiens
ttctgatcagaggt

SEQ ID NO: 4046953 - DNA, 18 bp, Homo sapiens
ttctgatgaatctcaaag

SEQ ID NO: 4046954 - DNA, 16 bp, Homo sapiens
ttctgatgtctctaaa

SEQ ID NO: 4046955 - DNA, 14 bp, Homo sapiens
ttctgattagaaat

SEQ ID NO: 4046956 - DNA, 19 bp, Homo sapiens
ttctgcaaaaatatttata

SEQ ID NO: 4046957 - DNA, 15 bp, Homo sapiens
ttctgcagtaaatct

SEQ ID NO: 4046958 - DNA, 17 bp, Homo sapiens
ttctgcatatgttgaat

SEQ ID NO: 4046959 - DNA, 22 bp, Homo sapiens
ttctgcatatgttgaatacttt

SEQ ID NO: 4046960 - DNA, 16 bp, Homo sapiens
ttctgcattgctagat

SEQ ID NO: 4046961 - DNA, 20 bp, Homo sapiens
ttctgcattgctagataaaa

SEQ ID NO: 4046962 - DNA, 16 bp, Homo sapiens
ttctgccagggagctt

SEQ ID NO: 4046963 - DNA, 13 bp, Homo sapiens
ttctgccctggct

SEQ ID NO: 4046964 - DNA, 14 bp, Homo sapiens
ttctgccctggctg

SEQ ID NO: 4046965 - DNA, 18 bp, Homo sapiens
ttctgccctggctgctgc

SEQ ID NO: 4046966 - DNA, 22 bp, Homo sapiens
ttctgccctttcctaggcccag

SEQ ID NO: 4046967 - DNA, 21 bp, Homo sapiens
ttctgcctgaggggcagcctg

SEQ ID NO: 4046968 - DNA, 12 bp, Homo sapiens
ttctgcctgcca

SEQ ID NO: 4046969 - DNA, 22 bp, Homo sapiens
ttctgcctgccagctgcactga

SEQ ID NO: 4046970 - DNA, 10 bp, Homo sapiens
ttctgccttt

SEQ ID NO: 4046971 - DNA, 23 bp, Homo sapiens
ttctgcctttgatgttacagatt

SEQ ID NO: 4046972 - DNA, 9 bp, Homo sapiens
ttctgctcc

SEQ ID NO: 4046973 - DNA, 18 bp, Homo sapiens
ttctgctccacccttggc

SEQ ID NO: 4046974 - DNA, 13 bp, Homo sapiens
ttctgctcctgct

SEQ ID NO: 4046975 - DNA, 17 bp, Homo sapiens
ttctgctcctgcttttc

SEQ ID NO: 4046976 - DNA, 15 bp, Homo sapiens
ttctgctctcagctc

SEQ ID NO: 4046977 - DNA, 21 bp, Homo sapiens
ttctgctctggttgtttctgt

SEQ ID NO: 4046978 - DNA, 16 bp, Homo sapiens
ttctgctcttttcctg

SEQ ID NO: 4046979 - DNA, 14 bp, Homo sapiens
ttctgctgcccctg

SEQ ID NO: 4046980 - DNA, 14 bp, Homo sapiens
ttctgctggcctgg

SEQ ID NO: 4046981 - DNA, 19 bp, Homo sapiens
ttctgctttatcttttcat

SEQ ID NO: 4046982 - DNA, 18 bp, Homo sapiens
ttctgcttttctgccctg

SEQ ID NO: 4046983 - DNA, 15 bp, Homo sapiens
ttctggaatgtaatc

SEQ ID NO: 4046984 - DNA, 22 bp, Homo sapiens
ttctggaatttgttcaagtttt

SEQ ID NO: 4046985 - DNA, 19 bp, Homo sapiens
ttctggaggaaagggagga

SEQ ID NO: 4046986 - DNA, 21 bp, Homo sapiens
ttctggccaaggggtgggcct

SEQ ID NO: 4046987 - DNA, 14 bp, Homo sapiens
ttctggcctgcctt

SEQ ID NO: 4046988 - DNA, 20 bp, Homo sapiens
ttctggcctgccttcgttaa

SEQ ID NO: 4046989 - DNA, 10 bp, Homo sapiens
ttctggctca

SEQ ID NO: 4046990 - DNA, 19 bp, Homo sapiens
ttctggctgaacactggca

SEQ ID NO: 4046991 - DNA, 15 bp, Homo sapiens
ttctgggagcagaaa

SEQ ID NO: 4046992 - DNA, 15 bp, Homo sapiens
ttctgttctgctggg

SEQ ID NO: 4046993 - DNA, 20 bp, Homo sapiens
ttctgttgtcattgctgttg

SEQ ID NO: 4046994 - DNA, 12 bp, Homo sapiens
ttctgtttgtta

SEQ ID NO: 4046995 - DNA, 18 bp, Homo sapiens
ttctgttttcccccagca

SEQ ID NO: 4046996 - DNA, 23 bp, Homo sapiens
ttctgttttgtttggcaaggaaa

SEQ ID NO: 4046997 - DNA, 17 bp, Homo sapiens
ttcttaaaaaattgaaa

SEQ ID NO: 4046998 - DNA, 19 bp, Homo sapiens
ttcttaaaattcaagaaaa

SEQ ID NO: 4046999 - DNA, 23 bp, Homo sapiens
ttcttaaaattcaagaaaataaa

SEQ ID NO: 4047000 - DNA, 12 bp, Homo sapiens
ttcttaaatatg

SEQ ID NO: 4047001 - DNA, 21 bp, Homo sapiens
ttcttaaattttgtaggattt

SEQ ID NO: 4047002 - DNA, 18 bp, Homo sapiens
ttcttaagacatgtatca

SEQ ID NO: 4047003 - DNA, 17 bp, Homo sapiens
ttcttaatgttcacata

SEQ ID NO: 4047004 - DNA, 14 bp, Homo sapiens
ttcttaattaattt

SEQ ID NO: 4047005 - DNA, 22 bp, Homo sapiens
ttcttacctactattggcccta

SEQ ID NO: 4047006 - DNA, 13 bp, Homo sapiens
ttcttagttactt

SEQ ID NO: 4047007 - DNA, 16 bp, Homo sapiens
ttcttatagaataaaa

SEQ ID NO: 4047008 - DNA, 14 bp, Homo sapiens
ttcttatgaggagg

SEQ ID NO: 4047009 - DNA, 17 bp, Homo sapiens
ttcttatgcaaaatgga

SEQ ID NO: 4047010 - DNA, 19 bp, Homo sapiens
ttcttatgtgacattaaca

SEQ ID NO: 4047011 - DNA, 20 bp, Homo sapiens
ttcttatgtgacattaacaa

SEQ ID NO: 4047012 - DNA, 21 bp, Homo sapiens
ttcttattaattcttcacctg

SEQ ID NO: 4047013 - DNA, 22 bp, Homo sapiens
ttcttattaattcttcacctgt

SEQ ID NO: 4047014 - DNA, 20 bp, Homo sapiens
ttcttattttgcattccaga

SEQ ID NO: 4047015 - DNA, 13 bp, Homo sapiens
ttcttcacctcta

SEQ ID NO: 4047016 - DNA, 22 bp, Homo sapiens
ttcttcacctgttatgtatgaa

SEQ ID NO: 4047017 - DNA, 17 bp, Homo sapiens
ttcttcacttcaagctg

SEQ ID NO: 4047018 - DNA, 17 bp, Homo sapiens
ttcttcagaagacactg

SEQ ID NO: 4047019 - DNA, 15 bp, Homo sapiens
ttcttcagagtgaag

SEQ ID NO: 4047020 - DNA, 21 bp, Homo sapiens
ttcttcagagtgaagaatctt

SEQ ID NO: 4047021 - DNA, 18 bp, Homo sapiens
ttcttcagcgtaaaatgg

SEQ ID NO: 4047022 - DNA, 22 bp, Homo sapiens
ttcttcagcgtaaaatggtgaa

SEQ ID NO: 4047023 - DNA, 18 bp, Homo sapiens
ttcttcaggaaaataaat

SEQ ID NO: 4047024 - DNA, 21 bp, Homo sapiens
ttcttcattcaatacaagtgt

SEQ ID NO: 4047025 - DNA, 20 bp, Homo sapiens
ttcttcccaatagcaaggct

SEQ ID NO: 4047026 - DNA, 17 bp, Homo sapiens
ttcttcccactttcatc

SEQ ID NO: 4047027 - DNA, 15 bp, Homo sapiens
ttcttcccagtaagt

SEQ ID NO: 4047028 - DNA, 15 bp, Homo sapiens
ttcttcctcactatg

SEQ ID NO: 4047029 - DNA, 13 bp, Homo sapiens
ttcttcctcagct

SEQ ID NO: 4047030 - DNA, 11 bp, Homo sapiens
ttcttcctgtg

SEQ ID NO: 4047031 - DNA, 9 bp, Homo sapiens
ttcttcctt

SEQ ID NO: 4047032 - DNA, 18 bp, Homo sapiens
ttcttcctttcttccttg

SEQ ID NO: 4047033 - DNA, 23 bp, Homo sapiens
ttcttcgctggactattgtgcca

SEQ ID NO: 4047034 - DNA, 20 bp, Homo sapiens
ttcttctgcaacatttgaca

SEQ ID NO: 4047035 - DNA, 20 bp, Homo sapiens
ttcttctgtcctgagaagca

SEQ ID NO: 4047036 - DNA, 16 bp, Homo sapiens
ttcttctgttctgcag

SEQ ID NO: 4047037 - DNA, 14 bp, Homo sapiens
ttcttcttttactt

SEQ ID NO: 4047038 - DNA, 14 bp, Homo sapiens
ttcttgaaagctgt

SEQ ID NO: 4047039 - DNA, 14 bp, Homo sapiens
ttcttgcagattct

SEQ ID NO: 4047040 - DNA, 15 bp, Homo sapiens
ttcttgcctgctggg

SEQ ID NO: 4047041 - DNA, 22 bp, Homo sapiens
ttcttgctcccttcagccccca

SEQ ID NO: 4047042 - DNA, 20 bp, Homo sapiens
ttcttgctctatctctcaaa

SEQ ID NO: 4047043 - DNA, 12 bp, Homo sapiens
ttcttgctttca

SEQ ID NO: 4047044 - DNA, 19 bp, Homo sapiens
ttcttggcaaaagccttgt

SEQ ID NO: 4047045 - DNA, 20 bp, Homo sapiens
ttcttggcaaaagccttgtg

SEQ ID NO: 4047046 - DNA, 23 bp, Homo sapiens
ttcttggcaaaagccttgtgtat

SEQ ID NO: 4047047 - DNA, 15 bp, Homo sapiens
ttcttggcccaggat

SEQ ID NO: 4047048 - DNA, 19 bp, Homo sapiens
ttcttgggatagtgttctg

SEQ ID NO: 4047049 - DNA, 23 bp, Homo sapiens
ttcttggggtactcttgatgtga

SEQ ID NO: 4047050 - DNA, 14 bp, Homo sapiens
ttcttggtagagat

SEQ ID NO: 4047051 - DNA, 14 bp, Homo sapiens
ttcttggtgctctg

SEQ ID NO: 4047052 - DNA, 17 bp, Homo sapiens
ttcttggtgctctgtgt

SEQ ID NO: 4047053 - DNA, 16 bp, Homo sapiens
ttcttgtcttttcaga

SEQ ID NO: 4047054 - DNA, 15 bp, Homo sapiens
ttcttgttttatata

SEQ ID NO: 4047055 - DNA, 13 bp, Homo sapiens
ttctttaaaagaa

SEQ ID NO: 4047056 - DNA, 19 bp, Homo sapiens
ttctttaaaagaatgacta

SEQ ID NO: 4047057 - DNA, 14 bp, Homo sapiens
ttctttaaagaagt

SEQ ID NO: 4047058 - DNA, 14 bp, Homo sapiens
ttctttaaatgttt

SEQ ID NO: 4047059 - DNA, 14 bp, Homo sapiens
ttctttaggagatt

SEQ ID NO: 4047060 - DNA, 15 bp, Homo sapiens
ttctttaggagattt

SEQ ID NO: 4047061 - DNA, 22 bp, Homo sapiens
ttctttaggagattttaggtgt

SEQ ID NO: 4047062 - DNA, 15 bp, Homo sapiens
ttgaccgacagcttt

SEQ ID NO: 4047063 - DNA, 20 bp, Homo sapiens
ttgaccgcgactaatttcaa

SEQ ID NO: 4047064 - DNA, 17 bp, Homo sapiens
ttgacctctcagggcct

SEQ ID NO: 4047065 - DNA, 21 bp, Homo sapiens
ttgacctgctccgctgctcct

SEQ ID NO: 4047066 - DNA, 19 bp, Homo sapiens
ttgactagggattcaggct

SEQ ID NO: 4047067 - DNA, 16 bp, Homo sapiens
ttgactcatggcagct

SEQ ID NO: 4047068 - DNA, 22 bp, Homo sapiens
ttgactcatggcagctgtttct

SEQ ID NO: 4047069 - DNA, 17 bp, Homo sapiens
ttgactctaaatgcagt

SEQ ID NO: 4047070 - DNA, 20 bp, Homo sapiens
ttgactcttttgagtggtaa

SEQ ID NO: 4047071 - DNA, 15 bp, Homo sapiens
ttgactcttttgcca

SEQ ID NO: 4047072 - DNA, 20 bp, Homo sapiens
ttgactgaagatgcagctca

SEQ ID NO: 4047073 - DNA, 21 bp, Homo sapiens
ttgactgatgctgagattctt

SEQ ID NO: 4047074 - DNA, 16 bp, Homo sapiens
ttgacttattttctct

SEQ ID NO: 4047075 - DNA, 18 bp, Homo sapiens
ttgacttcagctgcctga

SEQ ID NO: 4047076 - DNA, 23 bp, Homo sapiens
ttgacttcagctgcctgaaacag

SEQ ID NO: 4047077 - DNA, 16 bp, Homo sapiens
ttgacttgattagtgc

SEQ ID NO: 4047078 - DNA, 23 bp, Homo sapiens
ttgactttacgcccatctcagga

SEQ ID NO: 4047079 - DNA, 21 bp, Homo sapiens
ttgagaaatatggacacttaa

SEQ ID NO: 4047080 - DNA, 21 bp, Homo sapiens
ttgagaactacctggatttgt

SEQ ID NO: 4047081 - DNA, 23 bp, Homo sapiens
ttgagaactggttttagcattta

SEQ ID NO: 4047082 - DNA, 13 bp, Homo sapiens
ttgagaattttaa

SEQ ID NO: 4047083 - DNA, 13 bp, Homo sapiens
ttgagacagtttc

SEQ ID NO: 4047084 - DNA, 15 bp, Homo sapiens
ttgagaccagcctgg

SEQ ID NO: 4047085 - DNA, 16 bp, Homo sapiens
ttgagactatttaaac

SEQ ID NO: 4047086 - DNA, 14 bp, Homo sapiens
ttgagagttctaaa

SEQ ID NO: 4047087 - DNA, 22 bp, Homo sapiens
ttgagatggggataaaatgact

SEQ ID NO: 4047088 - DNA, 12 bp, Homo sapiens
ttgagattagag

SEQ ID NO: 4047089 - DNA, 18 bp, Homo sapiens
ttgagatttttaagaact

SEQ ID NO: 4047090 - DNA, 19 bp, Homo sapiens
ttgagatttttaagaactt

SEQ ID NO: 4047091 - DNA, 14 bp, Homo sapiens
ttgcagctttatgt

SEQ ID NO: 4047092 - DNA, 18 bp, Homo sapiens
ttgcaggaggccaaactg

SEQ ID NO: 4047093 - DNA, 23 bp, Homo sapiens
ttgcaggaggccaaactgtccct

SEQ ID NO: 4047094 - DNA, 21 bp, Homo sapiens
ttgcagggcagccccacaact

SEQ ID NO: 4047095 - DNA, 23 bp, Homo sapiens
ttgcagggtcctcttctgggcct

SEQ ID NO: 4047096 - DNA, 18 bp, Homo sapiens
ttgcaggtggaactcagt

SEQ ID NO: 4047097 - DNA, 15 bp, Homo sapiens
ttgcagtaactgttt

SEQ ID NO: 4047098 - DNA, 16 bp, Homo sapiens
ttgcagttcagcacca

SEQ ID NO: 4047099 - DNA, 20 bp, Homo sapiens
ttgcataataagctaaagag

SEQ ID NO: 4047100 - DNA, 21 bp, Homo sapiens
ttgcataataagctaaagagg

SEQ ID NO: 4047101 - DNA, 16 bp, Homo sapiens
ttgcatactgagccaa

SEQ ID NO: 4047102 - DNA, 19 bp, Homo sapiens
ttgcataggctcttaagca

SEQ ID NO: 4047103 - DNA, 15 bp, Homo sapiens
ttgcatattttgaga

SEQ ID NO: 4047104 - DNA, 20 bp, Homo sapiens
ttgcatctaggtaattttta

SEQ ID NO: 4047105 - DNA, 20 bp, Homo sapiens
ttgcattaaattcacaaact

SEQ ID NO: 4047106 - DNA, 21 bp, Homo sapiens
ttgcattaaattcacaaactt

SEQ ID NO: 4047107 - DNA, 22 bp, Homo sapiens
ttgcattaaattcacaaacttt

SEQ ID NO: 4047108 - DNA, 11 bp, Homo sapiens
ttgcattcaaa

SEQ ID NO: 4047109 - DNA, 17 bp, Homo sapiens
ttgcattcctttgtctt

SEQ ID NO: 4047110 - DNA, 15 bp, Homo sapiens
ttgcattctattgcc

SEQ ID NO: 4047111 - DNA, 16 bp, Homo sapiens
ttgcattctattgcct

SEQ ID NO: 4047112 - DNA, 18 bp, Homo sapiens
ttgcattctattgccttc

SEQ ID NO: 4047113 - DNA, 19 bp, Homo sapiens
ttgcattctattgccttct

SEQ ID NO: 4047114 - DNA, 14 bp, Homo sapiens
ttgcattgaatata

SEQ ID NO: 4047115 - DNA, 17 bp, Homo sapiens
ttgcattgaggaaatat

SEQ ID NO: 4047116 - DNA, 21 bp, Homo sapiens
ttgcattgaggaaatattaat

SEQ ID NO: 4047117 - DNA, 14 bp, Homo sapiens
ttgcatttactttt

SEQ ID NO: 4047118 - DNA, 16 bp, Homo sapiens
ttgcatttagcttctt

SEQ ID NO: 4047119 - DNA, 18 bp, Homo sapiens
ttgcatttagcttctttc

SEQ ID NO: 4047120 - DNA, 15 bp, Homo sapiens
ttgcatttatatgta

SEQ ID NO: 4047121 - DNA, 13 bp, Homo sapiens
ttgcatttccagc

SEQ ID NO: 4047122 - DNA, 15 bp, Homo sapiens
ttgcatttggtcaag

SEQ ID NO: 4047123 - DNA, 18 bp, Homo sapiens
ttgccaaaaaaaaaagaa

SEQ ID NO: 4047124 - DNA, 15 bp, Homo sapiens
ttgccaagaaaatga

SEQ ID NO: 4047125 - DNA, 22 bp, Homo sapiens
ttgccacagctggagctctcaa

SEQ ID NO: 4047126 - DNA, 17 bp, Homo sapiens
ttgccacagtagaactg

SEQ ID NO: 4047127 - DNA, 12 bp, Homo sapiens
ttgccacatttc

SEQ ID NO: 4047128 - DNA, 23 bp, Homo sapiens
ttgccacatttctgatcagaggt

SEQ ID NO: 4047129 - DNA, 21 bp, Homo sapiens
ttgccaccatgtattcatcca

SEQ ID NO: 4047130 - DNA, 17 bp, Homo sapiens
ttgccaccccaccctcc

SEQ ID NO: 4047131 - DNA, 18 bp, Homo sapiens
ttgccaccccaccctccc

SEQ ID NO: 4047132 - DNA, 22 bp, Homo sapiens
ttgccaccccaccctccctgga

SEQ ID NO: 4047133 - DNA, 23 bp, Homo sapiens
ttgccaccccaccctccctggag

SEQ ID NO: 4047134 - DNA, 12 bp, Homo sapiens
ttgccactaatt

SEQ ID NO: 4047135 - DNA, 16 bp, Homo sapiens
ttgccactaattttag

SEQ ID NO: 4047136 - DNA, 15 bp, Homo sapiens
ttgccagaaagcata

SEQ ID NO: 4047137 - DNA, 19 bp, Homo sapiens
ttgccagctgctgctggat

SEQ ID NO: 4047138 - DNA, 20 bp, Homo sapiens
ttgccatgggcttcactgta

SEQ ID NO: 4047139 - DNA, 22 bp, Homo sapiens
ttgccatgggcttcactgtata

SEQ ID NO: 4047140 - DNA, 20 bp, Homo sapiens
ttgcccaagtcacacagcta

SEQ ID NO: 4047141 - DNA, 13 bp, Homo sapiens
ttgcccacccctc

SEQ ID NO: 4047142 - DNA, 18 bp, Homo sapiens
ttgcccaggctggtctca

SEQ ID NO: 4047143 - DNA, 18 bp, Homo sapiens
ttgccccagacctggaag

SEQ ID NO: 4047144 - DNA, 21 bp, Homo sapiens
ttgcccccaaacccccattct

SEQ ID NO: 4047145 - DNA, 16 bp, Homo sapiens
ttgccccccgccctca

SEQ ID NO: 4047146 - DNA, 17 bp, Homo sapiens
ttgcccctggctttgcc

SEQ ID NO: 4047147 - DNA, 20 bp, Homo sapiens
ttgcccctggctttgcctct

SEQ ID NO: 4047148 - DNA, 19 bp, Homo sapiens
ttgcccctttctcttttcc

SEQ ID NO: 4047149 - DNA, 17 bp, Homo sapiens
ttgcccttcacagtgtt

SEQ ID NO: 4047150 - DNA, 18 bp, Homo sapiens
ttgcccttcacagtgttt

SEQ ID NO: 4047151 - DNA, 15 bp, Homo sapiens
ttgccgctgtataaa

SEQ ID NO: 4047152 - DNA, 19 bp, Homo sapiens
ttgcctaataaacatcctt

SEQ ID NO: 4047153 - DNA, 17 bp, Homo sapiens
ttgcctcatattgtcct

SEQ ID NO: 4047154 - DNA, 21 bp, Homo sapiens
ttgcctccccatttcccatct

SEQ ID NO: 4047155 - DNA, 12 bp, Homo sapiens
ttgcctctactt

SEQ ID NO: 4047156 - DNA, 14 bp, Homo sapiens
ttgcctctgccctg

SEQ ID NO: 4047157 - DNA, 19 bp, Homo sapiens
ttgcctctgccctggattg

SEQ ID NO: 4047158 - DNA, 12 bp, Homo sapiens
ttgcctcttctt

SEQ ID NO: 4047159 - DNA, 15 bp, Homo sapiens
ttgcctcttctttgt

SEQ ID NO: 4047160 - DNA, 21 bp, Homo sapiens
ttgcctcttctttgtgccttt

SEQ ID NO: 4047161 - DNA, 21 bp, Homo sapiens
ttgcctgagaagaagtggctg

SEQ ID NO: 4047162 - DNA, 19 bp, Homo sapiens
ttgcctgcagagagaagcc

SEQ ID NO: 4047163 - DNA, 16 bp, Homo sapiens
ttgcctggttttgtct

SEQ ID NO: 4047164 - DNA, 17 bp, Homo sapiens
ttgccttctttgaagaa

SEQ ID NO: 4047165 - DNA, 18 bp, Homo sapiens
ttgccttctttgaagaag

SEQ ID NO: 4047166 - DNA, 16 bp, Homo sapiens
ttggctatttaaaact

SEQ ID NO: 4047167 - DNA, 14 bp, Homo sapiens
ttggctcaatcctc

SEQ ID NO: 4047168 - DNA, 21 bp, Homo sapiens
ttggctcccaagtcacaccca

SEQ ID NO: 4047169 - DNA, 16 bp, Homo sapiens
ttggctgacccctctg

SEQ ID NO: 4047170 - DNA, 18 bp, Homo sapiens
ttggctgacccctctggt

SEQ ID NO: 4047171 - DNA, 15 bp, Homo sapiens
ttggctgactggggc

SEQ ID NO: 4047172 - DNA, 16 bp, Homo sapiens
ttggcttacctgacct

SEQ ID NO: 4047173 - DNA, 14 bp, Homo sapiens
ttggcttataaaca

SEQ ID NO: 4047174 - DNA, 17 bp, Homo sapiens
ttggcttcctttcttgg

SEQ ID NO: 4047175 - DNA, 22 bp, Homo sapiens
ttggcttcctttcttggttcat

SEQ ID NO: 4047176 - DNA, 21 bp, Homo sapiens
ttggcttttcttatttaaaat

SEQ ID NO: 4047177 - DNA, 21 bp, Homo sapiens
ttgggaaaaaaacttggcact

SEQ ID NO: 4047178 - DNA, 22 bp, Homo sapiens
ttgggaaagatggataaactga

SEQ ID NO: 4047179 - DNA, 13 bp, Homo sapiens
ttgggaaagtatt

SEQ ID NO: 4047180 - DNA, 23 bp, Homo sapiens
ttgggaaattaaatccaataaaa

SEQ ID NO: 4047181 - DNA, 18 bp, Homo sapiens
ttgggaactgaactcact

SEQ ID NO: 4047182 - DNA, 18 bp, Homo sapiens
ttgggaagaatccagtat

SEQ ID NO: 4047183 - DNA, 22 bp, Homo sapiens
ttgggacccaaaacacaggaag

SEQ ID NO: 4047184 - DNA, 14 bp, Homo sapiens
ttgggagacatgtg

SEQ ID NO: 4047185 - DNA, 15 bp, Homo sapiens
ttgggagcactggag

SEQ ID NO: 4047186 - DNA, 16 bp, Homo sapiens
ttgggagcactggagt

SEQ ID NO: 4047187 - DNA, 16 bp, Homo sapiens
ttgggaggccgaggcg

SEQ ID NO: 4047188 - DNA, 21 bp, Homo sapiens
ttgggatcccaccctggggac

SEQ ID NO: 4047189 - DNA, 17 bp, Homo sapiens
ttgggcacagtccagac

SEQ ID NO: 4047190 - DNA, 20 bp, Homo sapiens
ttgggcagaagggagaagga

SEQ ID NO: 4047191 - DNA, 18 bp, Homo sapiens
ttgggcagcaatttaaat

SEQ ID NO: 4047192 - DNA, 19 bp, Homo sapiens
ttgggcagcaatttaaatg

SEQ ID NO: 4047193 - DNA, 13 bp, Homo sapiens
ttgggccagacat

SEQ ID NO: 4047194 - DNA, 19 bp, Homo sapiens
ttgggcctgctccagacct

SEQ ID NO: 4047195 - DNA, 15 bp, Homo sapiens
ttgggcctgggcctc

SEQ ID NO: 4047196 - DNA, 17 bp, Homo sapiens
ttgggcctgggcctctg

SEQ ID NO: 4047197 - DNA, 17 bp, Homo sapiens
ttgggccttgctgctgc

SEQ ID NO: 4047198 - DNA, 18 bp, Homo sapiens
ttgggctgggggactggg

SEQ ID NO: 4047199 - DNA, 22 bp, Homo sapiens
ttggggaggagggggccgggcg

SEQ ID NO: 4047200 - DNA, 15 bp, Homo sapiens
ttggggagggagggg

SEQ ID NO: 4047201 - DNA, 23 bp, Homo sapiens
ttggggagggaggggaaatgtaa

SEQ ID NO: 4047202 - DNA, 13 bp, Homo sapiens
ttggggaggggcg

SEQ ID NO: 4047203 - DNA, 20 bp, Homo sapiens
ttggggagttaagacctggc

SEQ ID NO: 4047204 - DNA, 21 bp, Homo sapiens
ttggggagttaagacctggca

SEQ ID NO: 4047205 - DNA, 11 bp, Homo sapiens
ttgggggaggc

SEQ ID NO: 4047206 - DNA, 16 bp, Homo sapiens
ttgggggctgtgggga

SEQ ID NO: 4047207 - DNA, 17 bp, Homo sapiens
ttgggggttcaggcccg

SEQ ID NO: 4047208 - DNA, 20 bp, Homo sapiens
ttggggtccctccaccccac

SEQ ID NO: 4047209 - DNA, 13 bp, Homo sapiens
ttggggtctcttt

SEQ ID NO: 4047210 - DNA, 17 bp, Homo sapiens
ttgggtaaaatactttt

SEQ ID NO: 4047211 - DNA, 21 bp, Homo sapiens
ttgggtcattgacctctcagg

SEQ ID NO: 4047212 - DNA, 22 bp, Homo sapiens
ttgggtctacaagtatatgtga

SEQ ID NO: 4047213 - DNA, 16 bp, Homo sapiens
ttgggttcatctgagc

SEQ ID NO: 4047214 - DNA, 17 bp, Homo sapiens
ttgggttcattattgga

SEQ ID NO: 4047215 - DNA, 15 bp, Homo sapiens
ttggtaatgcttgga

SEQ ID NO: 4047216 - DNA, 15 bp, Homo sapiens
ttggtaattattttg

SEQ ID NO: 4047217 - DNA, 23 bp, Homo sapiens
ttggtactttccacaaatctata

SEQ ID NO: 4047218 - DNA, 13 bp, Homo sapiens
ttggtagagattc

SEQ ID NO: 4047219 - DNA, 15 bp, Homo sapiens
ttggtagagattcat

SEQ ID NO: 4047220 - DNA, 21 bp, Homo sapiens
ttggtataatgtttaaatcat

SEQ ID NO: 4047221 - DNA, 16 bp, Homo sapiens
ttggtatcaagaaagt

SEQ ID NO: 4047222 - DNA, 17 bp, Homo sapiens
ttggtatcaagaaagtc

SEQ ID NO: 4047223 - DNA, 12 bp, Homo sapiens
ttggtcagcttt

SEQ ID NO: 4047224 - DNA, 15 bp, Homo sapiens
ttggtcagcttttgt

SEQ ID NO: 4047225 - DNA, 14 bp, Homo sapiens
ttggtccaaaaaaa

SEQ ID NO: 4047226 - DNA, 16 bp, Homo sapiens
ttggtccaaaaaaagg

SEQ ID NO: 4047227 - DNA, 14 bp, Homo sapiens
ttggtctttgtatc

SEQ ID NO: 4047228 - DNA, 12 bp, Homo sapiens
ttggtgccacca

SEQ ID NO: 4047229 - DNA, 13 bp, Homo sapiens
ttggtgccaccaa

SEQ ID NO: 4047230 - DNA, 15 bp, Homo sapiens
ttggtgtaatttgaa

SEQ ID NO: 4047231 - DNA, 21 bp, Homo sapiens
ttggtgtgattgcacagaatt

SEQ ID NO: 4047232 - DNA, 14 bp, Homo sapiens
ttggttcataaatg

SEQ ID NO: 4047233 - DNA, 22 bp, Homo sapiens
ttggttcttggtagagattcat

SEQ ID NO: 4047234 - DNA, 18 bp, Homo sapiens
ttggttgtcaatattaaa

SEQ ID NO: 4047235 - DNA, 14 bp, Homo sapiens
ttggtttatttttg

SEQ ID NO: 4047236 - DNA, 17 bp, Homo sapiens
ttggtttatttttgtaa

SEQ ID NO: 4047237 - DNA, 21 bp, Homo sapiens
ttggtttgtggcgtctccctc

SEQ ID NO: 4047238 - DNA, 20 bp, Homo sapiens
ttgtaaaaaaaaatgccttt

SEQ ID NO: 4047239 - DNA, 21 bp, Homo sapiens
ttgtaaaaaaaaatgcctttg

SEQ ID NO: 4047240 - DNA, 23 bp, Homo sapiens
ttgtaaaaacagcattgctttct

SEQ ID NO: 4047241 - DNA, 21 bp, Homo sapiens
ttgtaaaaatgaaagtgactt

SEQ ID NO: 4047242 - DNA, 14 bp, Homo sapiens
ttgtaaataagaga

SEQ ID NO: 4047243 - DNA, 20 bp, Homo sapiens
ttaaagcttatttttctgtg

SEQ ID NO: 4047244 - DNA, 21 bp, Homo sapiens
ttaaagcttatttttctgtga

SEQ ID NO: 4047245 - DNA, 12 bp, Homo sapiens
ttaaaggagtta

SEQ ID NO: 4047246 - DNA, 16 bp, Homo sapiens
ttaaagtaattgttcc

SEQ ID NO: 4047247 - DNA, 20 bp, Homo sapiens
ttaaagtaattgttccagag

SEQ ID NO: 4047248 - DNA, 16 bp, Homo sapiens
ttaaagtatatattta

SEQ ID NO: 4047249 - DNA, 18 bp, Homo sapiens
ttaaagtcaggtccaatt

SEQ ID NO: 4047250 - DNA, 18 bp, Homo sapiens
ttaaagtctaaacaaaat

SEQ ID NO: 4047251 - DNA, 14 bp, Homo sapiens
ttaaagtgactttc

SEQ ID NO: 4047252 - DNA, 13 bp, Homo sapiens
ttaaataaatcat

SEQ ID NO: 4047253 - DNA, 15 bp, Homo sapiens
ttaaataaatcataa

SEQ ID NO: 4047254 - DNA, 15 bp, Homo sapiens
ttaaataatgttcat

SEQ ID NO: 4047255 - DNA, 12 bp, Homo sapiens
ttaaataatttc

SEQ ID NO: 4047256 - DNA, 18 bp, Homo sapiens
ttaaatacagacactaag

SEQ ID NO: 4047257 - DNA, 19 bp, Homo sapiens
ttaaatactgtgcagaata

SEQ ID NO: 4047258 - DNA, 13 bp, Homo sapiens
ttaaatacttcat

SEQ ID NO: 4047259 - DNA, 17 bp, Homo sapiens
ttaaatagatacaaatg

SEQ ID NO: 4047260 - DNA, 18 bp, Homo sapiens
ttaaataggatattaaca

SEQ ID NO: 4047261 - DNA, 12 bp, Homo sapiens
ttaaatataatt

SEQ ID NO: 4047262 - DNA, 16 bp, Homo sapiens
ttaaatataattctgt

SEQ ID NO: 4047263 - DNA, 16 bp, Homo sapiens
ttaaatatatattttg

SEQ ID NO: 4047264 - DNA, 17 bp, Homo sapiens
ttaaatatcttttatgt

SEQ ID NO: 4047265 - DNA, 18 bp, Homo sapiens
ttaaatatcttttatgtt

SEQ ID NO: 4047266 - DNA, 22 bp, Homo sapiens
ttaaatatcttttatgtttgaa

SEQ ID NO: 4047267 - DNA, 14 bp, Homo sapiens
ttaaatcatgtatg

SEQ ID NO: 4047268 - DNA, 20 bp, Homo sapiens
ttaaatcatgtatgttatga

SEQ ID NO: 4047269 - DNA, 14 bp, Homo sapiens
ttaaatccaataaa

SEQ ID NO: 4047270 - DNA, 15 bp, Homo sapiens
ttaaatgaaagcatg

SEQ ID NO: 4047271 - DNA, 19 bp, Homo sapiens
ttaaatgtatactatagta

SEQ ID NO: 4047272 - DNA, 16 bp, Homo sapiens
ttaaatgtgaattttt

SEQ ID NO: 4047273 - DNA, 17 bp, Homo sapiens
ttaaatgttttataagt

SEQ ID NO: 4047274 - DNA, 16 bp, Homo sapiens
ttaaattatgtataaa

SEQ ID NO: 4047275 - DNA, 23 bp, Homo sapiens
ttaaattctccagttttttgtta

SEQ ID NO: 4047276 - DNA, 18 bp, Homo sapiens
ttaaattgtttcatatct

SEQ ID NO: 4047277 - DNA, 18 bp, Homo sapiens
ttaaatttaaagatattg

SEQ ID NO: 4047278 - DNA, 18 bp, Homo sapiens
ttaaatttcttatgtgac

SEQ ID NO: 4047279 - DNA, 19 bp, Homo sapiens
ttaaatttcttatgtgaca

SEQ ID NO: 4047280 - DNA, 22 bp, Homo sapiens
ttaaatttcttatgtgacatta

SEQ ID NO: 4047281 - DNA, 19 bp, Homo sapiens
ttaaattttgtaggatttt

SEQ ID NO: 4047282 - DNA, 16 bp, Homo sapiens
ttaaattttttttaca

SEQ ID NO: 4047283 - DNA, 15 bp, Homo sapiens
ttaacaaaagcaaga

SEQ ID NO: 4047284 - DNA, 17 bp, Homo sapiens
ttaacaaactaaaaata

SEQ ID NO: 4047285 - DNA, 16 bp, Homo sapiens
ttatcaaaactttctt

SEQ ID NO: 4047286 - DNA, 16 bp, Homo sapiens
ttatcaaaatgtagct

SEQ ID NO: 4047287 - DNA, 21 bp, Homo sapiens
ttatcaaaccctagccttgct

SEQ ID NO: 4047288 - DNA, 13 bp, Homo sapiens
ttatcaaagcata

SEQ ID NO: 4047289 - DNA, 22 bp, Homo sapiens
ttatcaagtttgggtctgtgct

SEQ ID NO: 4047290 - DNA, 17 bp, Homo sapiens
ttatcagatacatcact

SEQ ID NO: 4047291 - DNA, 20 bp, Homo sapiens
ttatcagatacatcactgct

SEQ ID NO: 4047292 - DNA, 14 bp, Homo sapiens
ttatcagtcaatat

SEQ ID NO: 4047293 - DNA, 15 bp, Homo sapiens
ttatcagtcaatatt

SEQ ID NO: 4047294 - DNA, 21 bp, Homo sapiens
ttatcagtcataactaaataa

SEQ ID NO: 4047295 - DNA, 16 bp, Homo sapiens
ttatcagtgacagagt

SEQ ID NO: 4047296 - DNA, 21 bp, Homo sapiens
ttatcagtttccagtctcaaa

SEQ ID NO: 4047297 - DNA, 14 bp, Homo sapiens
ttatcatcaagcag

SEQ ID NO: 4047298 - DNA, 20 bp, Homo sapiens
ttatcattaatttttaattg

SEQ ID NO: 4047299 - DNA, 21 bp, Homo sapiens
ttatcattaatttttaattga

SEQ ID NO: 4047300 - DNA, 15 bp, Homo sapiens
ttatccaaaatgtgt

SEQ ID NO: 4047301 - DNA, 22 bp, Homo sapiens
ttatccaaaatgtgtatttctt

SEQ ID NO: 4047302 - DNA, 22 bp, Homo sapiens
ttatccaaggtgtaactctaat

SEQ ID NO: 4047303 - DNA, 12 bp, Homo sapiens
ttatccaggact

SEQ ID NO: 4047304 - DNA, 20 bp, Homo sapiens
ttatccctcacctgtagcag

SEQ ID NO: 4047305 - DNA, 12 bp, Homo sapiens
ttatccctctct

SEQ ID NO: 4047306 - DNA, 16 bp, Homo sapiens
ttatccctctcttccc

SEQ ID NO: 4047307 - DNA, 17 bp, Homo sapiens
ttatccctctcttcccc

SEQ ID NO: 4047308 - DNA, 18 bp, Homo sapiens
ttatccctctcttcccct

SEQ ID NO: 4047309 - DNA, 19 bp, Homo sapiens
ttatcgccctggcaggcag

SEQ ID NO: 4047310 - DNA, 20 bp, Homo sapiens
ttatcgccctggcaggcagg

SEQ ID NO: 4047311 - DNA, 23 bp, Homo sapiens
ttatcgggagcagtgtcttccat

SEQ ID NO: 4047312 - DNA, 21 bp, Homo sapiens
ttatctaaaagaaatgtctat

SEQ ID NO: 4047313 - DNA, 14 bp, Homo sapiens
ttatctaaattaaa

SEQ ID NO: 4047314 - DNA, 19 bp, Homo sapiens
ttatctatacatatcttta

SEQ ID NO: 4047315 - DNA, 20 bp, Homo sapiens
ttatctcagtcatgcataaa

SEQ ID NO: 4047316 - DNA, 21 bp, Homo sapiens
ttatctcagtcatgcataaat

SEQ ID NO: 4047317 - DNA, 23 bp, Homo sapiens
ttatctgggattatggttttgtg

SEQ ID NO: 4047318 - DNA, 12 bp, Homo sapiens
ttatctgtcaca

SEQ ID NO: 4047319 - DNA, 14 bp, Homo sapiens
ttatcttattttct

SEQ ID NO: 4047320 - DNA, 14 bp, Homo sapiens
ttatcttttcataa

SEQ ID NO: 4047321 - DNA, 15 bp, Homo sapiens
ttatgaaagaatata

SEQ ID NO: 4047322 - DNA, 11 bp, Homo sapiens
ttatgaagttt

SEQ ID NO: 4047323 - DNA, 13 bp, Homo sapiens
ttatgaagtttaa

SEQ ID NO: 4047324 - DNA, 14 bp, Homo sapiens
ttatgaagtttaaa

SEQ ID NO: 4047325 - DNA, 13 bp, Homo sapiens
ttatgaatcagtg

SEQ ID NO: 4047326 - DNA, 14 bp, Homo sapiens
ttatgacagttata

SEQ ID NO: 4047327 - DNA, 16 bp, Homo sapiens
ttatgactatgtaaac

SEQ ID NO: 4047328 - DNA, 13 bp, Homo sapiens
ttatgagtttttg

SEQ ID NO: 4047329 - DNA, 23 bp, Homo sapiens
ttatgagtttttgatagctttat

SEQ ID NO: 4047330 - DNA, 22 bp, Homo sapiens
ttatgatattgtttaaaattca

SEQ ID NO: 4047331 - DNA, 14 bp, Homo sapiens
ttatgatatttctt

SEQ ID NO: 4047332 - DNA, 16 bp, Homo sapiens
ttatgatgtatattta

SEQ ID NO: 4047333 - DNA, 16 bp, Homo sapiens
ttatgatttccttcaa

SEQ ID NO: 4047334 - DNA, 13 bp, Homo sapiens
ttatgatttgggt

SEQ ID NO: 4047335 - DNA, 15 bp, Homo sapiens
ttatgcaaaatggaa

SEQ ID NO: 4047336 - DNA, 18 bp, Homo sapiens
ttatgcaaggaaggaaag

SEQ ID NO: 4047337 - DNA, 18 bp, Homo sapiens
ttatgcagatagaatcaa

SEQ ID NO: 4047338 - DNA, 17 bp, Homo sapiens
ttatgcatttggaatta

SEQ ID NO: 4047339 - DNA, 22 bp, Homo sapiens
ttatgccacttccttttaactg

SEQ ID NO: 4047340 - DNA, 16 bp, Homo sapiens
ttatgcttaaattcaa

SEQ ID NO: 4047341 - DNA, 13 bp, Homo sapiens
ttatggaaaactg

SEQ ID NO: 4047342 - DNA, 23 bp, Homo sapiens
ttatggaagatagttttctcctt

SEQ ID NO: 4047343 - DNA, 21 bp, Homo sapiens
ttatggaattaaccatttaat

SEQ ID NO: 4047344 - DNA, 19 bp, Homo sapiens
ttatggaattgatttgcat

SEQ ID NO: 4047345 - DNA, 20 bp, Homo sapiens
ttatggaattgatttgcatt

SEQ ID NO: 4047346 - DNA, 11 bp, Homo sapiens
ttatggatgca

SEQ ID NO: 4047347 - DNA, 15 bp, Homo sapiens
ttatgggccctgcct

SEQ ID NO: 4047348 - DNA, 22 bp, Homo sapiens
ttatggtaactgctttctgttc

SEQ ID NO: 4047349 - DNA, 23 bp, Homo sapiens
ttatggtaactgctttctgttcc

SEQ ID NO: 4047350 - DNA, 17 bp, Homo sapiens
ttatggttttgtgatgt

SEQ ID NO: 4047351 - DNA, 15 bp, Homo sapiens
ttatgtagtaattga

SEQ ID NO: 4047352 - DNA, 22 bp, Homo sapiens
ttatgtatcagtgtcctttcca

SEQ ID NO: 4047353 - DNA, 23 bp, Homo sapiens
ttatgtatgaaggaatcattcca

SEQ ID NO: 4047354 - DNA, 18 bp, Homo sapiens
ttatgtgaaatgctttct

SEQ ID NO: 4047355 - DNA, 20 bp, Homo sapiens
ttatgtgaatttttaagctg

SEQ ID NO: 4047356 - DNA, 19 bp, Homo sapiens
ttatgtgacattttacatt

SEQ ID NO: 4047357 - DNA, 18 bp, Homo sapiens
ttatgtgccgtgttattg

SEQ ID NO: 4047358 - DNA, 21 bp, Homo sapiens
ttatgtggcttgtttatcctt

SEQ ID NO: 4047359 - DNA, 19 bp, Homo sapiens
ttatgtgggttgcctggtg

SEQ ID NO: 4047360 - DNA, 13 bp, Homo sapiens
ttatgttcttata

SEQ ID NO: 4047361 - DNA, 15 bp, Homo sapiens
ttatgtttgaatatg

SEQ ID NO: 4047362 - DNA, 21 bp, Homo sapiens
ttattaaacagatttttacaa

SEQ ID NO: 4047363 - DNA, 21 bp, Homo sapiens
ttattaaagtctaaacaaaat

SEQ ID NO: 4047364 - DNA, 22 bp, Homo sapiens
ttattaaagtctaaacaaaatt

SEQ ID NO: 4047365 - DNA, 15 bp, Homo sapiens
ttattaactttaatg

SEQ ID NO: 4047366 - DNA, 11 bp, Homo sapiens
ttattaatatt

SEQ ID NO: 4047367 - DNA, 14 bp, Homo sapiens
ttattaatatttgt

SEQ ID NO: 4047368 - DNA, 13 bp, Homo sapiens
ttattaatcacta

SEQ ID NO: 4047369 - DNA, 13 bp, Homo sapiens
ttattacctctga

SEQ ID NO: 4047370 - DNA, 15 bp, Homo sapiens
ttattacctctgata

SEQ ID NO: 4047371 - DNA, 13 bp, Homo sapiens
ttattactctcac

SEQ ID NO: 4047372 - DNA, 12 bp, Homo sapiens
ttattagaaacc

SEQ ID NO: 4047373 - DNA, 20 bp, Homo sapiens
ttattagcaaggctgggtaa

SEQ ID NO: 4047374 - DNA, 17 bp, Homo sapiens
ttattagggagaaaatt

SEQ ID NO: 4047375 - DNA, 24 bp, Homo sapiens
ttattagtaccatagtaccattta

SEQ ID NO: 4047376 - DNA, 14 bp, Homo sapiens
ttattataaactgt

SEQ ID NO: 4047377 - DNA, 12 bp, Homo sapiens
ttattataaatg

SEQ ID NO: 4047378 - DNA, 14 bp, Homo sapiens
ttattataaatgtt

SEQ ID NO: 4047379 - DNA, 20 bp, Homo sapiens
ttattataatcctcaagaga

SEQ ID NO: 4047380 - DNA, 22 bp, Homo sapiens
ttattatctaaagtgtgttgtt

SEQ ID NO: 4047381 - DNA, 19 bp, Homo sapiens
ttattatgaagaattgcca

SEQ ID NO: 4047382 - DNA, 12 bp, Homo sapiens
ttattatttaat

SEQ ID NO: 4047383 - DNA, 16 bp, Homo sapiens
ttattattttcacctg

SEQ ID NO: 4047384 - DNA, 15 bp, Homo sapiens
ttattattttggggt

SEQ ID NO: 4047385 - DNA, 18 bp, Homo sapiens
ttattcaattcctctggg

SEQ ID NO: 4047386 - DNA, 13 bp, Homo sapiens
ttattcagtaaac

SEQ ID NO: 4047387 - DNA, 17 bp, Homo sapiens
ttattcagtaaacaact

SEQ ID NO: 4047388 - DNA, 16 bp, Homo sapiens
ttattcattagctgtg

SEQ ID NO: 4047389 - DNA, 23 bp, Homo sapiens
ttattcattctgtgatcatttat

SEQ ID NO: 4047390 - DNA, 13 bp, Homo sapiens
ttattcatttaaa

SEQ ID NO: 4047391 - DNA, 20 bp, Homo sapiens
ttattcatttaaaatgatta

SEQ ID NO: 4047392 - DNA, 22 bp, Homo sapiens
ttattccagaatgctgtacatc

SEQ ID NO: 4047393 - DNA, 17 bp, Homo sapiens
ttattcctgataataat

SEQ ID NO: 4047394 - DNA, 20 bp, Homo sapiens
ttattcctgataataattga

SEQ ID NO: 4047395 - DNA, 21 bp, Homo sapiens
ttattcctgataataattgat

SEQ ID NO: 4047396 - DNA, 21 bp, Homo sapiens
ttattctaagccctttgccat

SEQ ID NO: 4047397 - DNA, 14 bp, Homo sapiens
ttattctcaaagca

SEQ ID NO: 4047398 - DNA, 13 bp, Homo sapiens
ttattctggagtt

SEQ ID NO: 4047399 - DNA, 16 bp, Homo sapiens
ttattctgttttgcac

SEQ ID NO: 4047400 - DNA, 15 bp, Homo sapiens
ttattcttccagaat

SEQ ID NO: 4047401 - DNA, 23 bp, Homo sapiens
ttattgaaggaagccaaatttat

SEQ ID NO: 4047402 - DNA, 11 bp, Homo sapiens
ttattgacact

SEQ ID NO: 4047403 - DNA, 13 bp, Homo sapiens
ttattgacactga

SEQ ID NO: 4047404 - DNA, 17 bp, Homo sapiens
ttattgacactgaactt

SEQ ID NO: 4047405 - DNA, 13 bp, Homo sapiens
ttattgagaattt

SEQ ID NO: 4047406 - DNA, 18 bp, Homo sapiens
ttattgcccatgggatat

SEQ ID NO: 4047407 - DNA, 20 bp, Homo sapiens
ttattgctagtatttgaatt

SEQ ID NO: 4047408 - DNA, 13 bp, Homo sapiens
ttattggaattaa

SEQ ID NO: 4047409 - DNA, 22 bp, Homo sapiens
ttattggaattaacctggtgct

SEQ ID NO: 4047410 - DNA, 21 bp, Homo sapiens
ttattggcaaagtttaaatgt

SEQ ID NO: 4047411 - DNA, 23 bp, Homo sapiens
ttattggcaaagtttaaatgtat

SEQ ID NO: 4047412 - DNA, 19 bp, Homo sapiens
ttattgtaagttgtacaaa

SEQ ID NO: 4047413 - DNA, 22 bp, Homo sapiens
ttattgtaagttgtacaaatgt

SEQ ID NO: 4047414 - DNA, 14 bp, Homo sapiens
ttatttaaaaatat

SEQ ID NO: 4047415 - DNA, 21 bp, Homo sapiens
ttatttaaaaatatttcagat

SEQ ID NO: 4047416 - DNA, 20 bp, Homo sapiens
ttatttaaactctgttgcaa

SEQ ID NO: 4047417 - DNA, 14 bp, Homo sapiens
ttatttaaagcatt

SEQ ID NO: 4047418 - DNA, 18 bp, Homo sapiens
ttatttaaataaaatcac

SEQ ID NO: 4047419 - DNA, 15 bp, Homo sapiens
ttatttacagatgaa

SEQ ID NO: 4047420 - DNA, 15 bp, Homo sapiens
ttatttagacaagag

SEQ ID NO: 4047421 - DNA, 12 bp, Homo sapiens
ttatttagagat

SEQ ID NO: 4047422 - DNA, 18 bp, Homo sapiens
ttatttatcaaaatgtag

SEQ ID NO: 4047423 - DNA, 15 bp, Homo sapiens
ttatttatgaagttt

SEQ ID NO: 4047424 - DNA, 15 bp, Homo sapiens
ttatttatggaatta

SEQ ID NO: 4047425 - DNA, 12 bp, Homo sapiens
ttatttatttct

SEQ ID NO: 4047426 - DNA, 16 bp, Homo sapiens
ttatttcaataaatct

SEQ ID NO: 4047427 - DNA, 12 bp, Homo sapiens
ttatttcaatat

SEQ ID NO: 4047428 - DNA, 22 bp, Homo sapiens
ttatttcactatcttcttcaaa

SEQ ID NO: 4047429 - DNA, 14 bp, Homo sapiens
ttatttcatccagt

SEQ ID NO: 4047430 - DNA, 22 bp, Homo sapiens
ttatttctaatccttttcctta

SEQ ID NO: 4047431 - DNA, 22 bp, Homo sapiens
ttatttctagtccaaaattaca

SEQ ID NO: 4047432 - DNA, 19 bp, Homo sapiens
ttatttctagttctttcct

SEQ ID NO: 4047433 - DNA, 19 bp, Homo sapiens
ttatttctcgggtgcattt

SEQ ID NO: 4047434 - DNA, 20 bp, Homo sapiens
ttatttctgcatatgttgaa

SEQ ID NO: 4047435 - DNA, 13 bp, Homo sapiens
ttatttcttccct

SEQ ID NO: 4047436 - DNA, 18 bp, Homo sapiens
ttatttggaaccttgttt

SEQ ID NO: 4047437 - DNA, 16 bp, Homo sapiens
ttatttgttgttttct

SEQ ID NO: 4047438 - DNA, 12 bp, Homo sapiens
ttattttacatt

SEQ ID NO: 4047439 - DNA, 16 bp, Homo sapiens
ttattttataatcaat

SEQ ID NO: 4047440 - DNA, 18 bp, Homo sapiens
ttattttcccctatcatt

SEQ ID NO: 4047441 - DNA, 21 bp, Homo sapiens
ttattttctggtagatagaaa

SEQ ID NO: 4047442 - DNA, 22 bp, Homo sapiens
ttattttggaaaataaattatt

SEQ ID NO: 4047443 - DNA, 14 bp, Homo sapiens
ttattttggatata

SEQ ID NO: 4047444 - DNA, 17 bp, Homo sapiens
ttattttgtaattatga

SEQ ID NO: 4047445 - DNA, 20 bp, Homo sapiens
ttatttttatatcagcctga

SEQ ID NO: 4047446 - DNA, 12 bp, Homo sapiens
ttatttttctga

SEQ ID NO: 4047447 - DNA, 14 bp, Homo sapiens
ttattttttaatta

SEQ ID NO: 4047448 - DNA, 14 bp, Homo sapiens
ttattttttacatt

SEQ ID NO: 4047449 - DNA, 23 bp, Homo sapiens
ttattttttggtggtgaaattga

SEQ ID NO: 4047450 - DNA, 17 bp, Homo sapiens
ttcaaaaaaacactagt

SEQ ID NO: 4047451 - DNA, 12 bp, Homo sapiens
ttcaaaagaaag

SEQ ID NO: 4047452 - DNA, 15 bp, Homo sapiens
ttcaaaagattaatg

SEQ ID NO: 4047453 - DNA, 16 bp, Homo sapiens
ttcaaaatccttccaa

SEQ ID NO: 4047454 - DNA, 14 bp, Homo sapiens
ttcaaaatgtctgt

SEQ ID NO: 4047455 - DNA, 18 bp, Homo sapiens
ttcaaaatgtctgtagct

SEQ ID NO: 4047456 - DNA, 16 bp, Homo sapiens
ttcaaaattaaatctg

SEQ ID NO: 4047457 - DNA, 19 bp, Homo sapiens
ttcaaactgtgaagcattt

SEQ ID NO: 4047458 - DNA, 12 bp, Homo sapiens
ttcaaactttca

SEQ ID NO: 4047459 - DNA, 21 bp, Homo sapiens
ttcaaagtgttgtgttcctgg

SEQ ID NO: 4047460 - DNA, 23 bp, Homo sapiens
ttcaaatcaatctgtaaaactaa

SEQ ID NO: 4047461 - DNA, 22 bp, Homo sapiens
ttcaaatgatttttacaagttt

SEQ ID NO: 4047462 - DNA, 13 bp, Homo sapiens
ttcaaatgcattt

SEQ ID NO: 4047463 - DNA, 16 bp, Homo sapiens
ttcaaattgtcttttg

SEQ ID NO: 4047464 - DNA, 23 bp, Homo sapiens
ttcaacagaccccctctagaaat

SEQ ID NO: 4047465 - DNA, 15 bp, Homo sapiens
ttcaacatcaatgtt

SEQ ID NO: 4047466 - DNA, 14 bp, Homo sapiens
ttcaacatcctgcc

SEQ ID NO: 4047467 - DNA, 19 bp, Homo sapiens
ttcaaccactgtaaaatga

SEQ ID NO: 4047468 - DNA, 14 bp, Homo sapiens
ttcaaccagataac

SEQ ID NO: 4047469 - DNA, 17 bp, Homo sapiens
ttcaacccacagctact

SEQ ID NO: 4047470 - DNA, 22 bp, Homo sapiens
ttcaacctggtggcaccagatg

SEQ ID NO: 4047471 - DNA, 13 bp, Homo sapiens
ttcaacgcagccc

SEQ ID NO: 4047472 - DNA, 14 bp, Homo sapiens
ttcaactgaaaaga

SEQ ID NO: 4047473 - DNA, 16 bp, Homo sapiens
ttcaagaacctggaaa

SEQ ID NO: 4047474 - DNA, 23 bp, Homo sapiens
ttcaagctgttatttcttccctg

SEQ ID NO: 4047475 - DNA, 20 bp, Homo sapiens
ttcaagtgccttttgctgcg

SEQ ID NO: 4047476 - DNA, 18 bp, Homo sapiens
ttcaagtgtccccagacc

SEQ ID NO: 4047477 - DNA, 19 bp, Homo sapiens
ttcaataaagcactgagca

SEQ ID NO: 4047478 - DNA, 15 bp, Homo sapiens
ttcaatatattgaac

SEQ ID NO: 4047479 - DNA, 14 bp, Homo sapiens
ttcaatattgacat

SEQ ID NO: 4047480 - DNA, 17 bp, Homo sapiens
ttcaatattgacatttg

SEQ ID NO: 4047481 - DNA, 21 bp, Homo sapiens
ttcaatccagagagcttaaat

SEQ ID NO: 4047482 - DNA, 20 bp, Homo sapiens
ttcaatctcccgctgctgct

SEQ ID NO: 4047483 - DNA, 17 bp, Homo sapiens
ttcaatgacttctaatt

SEQ ID NO: 4047484 - DNA, 15 bp, Homo sapiens
ttcaatgtgcataat

SEQ ID NO: 4047485 - DNA, 21 bp, Homo sapiens
ttcaattacaaagcagttact

SEQ ID NO: 4047486 - DNA, 21 bp, Homo sapiens
ttcaattcagattgtcttgca

SEQ ID NO: 4047487 - DNA, 16 bp, Homo sapiens
ttcaattcctctggga

SEQ ID NO: 4047488 - DNA, 14 bp, Homo sapiens
ttcaattgtaaatt

SEQ ID NO: 4047489 - DNA, 22 bp, Homo sapiens
ttcacaaaatgtctcagttttc

SEQ ID NO: 4047490 - DNA, 17 bp, Homo sapiens
ttcacaaacttttatac

SEQ ID NO: 4047491 - DNA, 22 bp, Homo sapiens
ttcacaaacttttatactcttt

SEQ ID NO: 4047492 - DNA, 21 bp, Homo sapiens
ttcacacatgcctatattatc

SEQ ID NO: 4047493 - DNA, 13 bp, Homo sapiens
ttcacaccccagg

SEQ ID NO: 4047494 - DNA, 17 bp, Homo sapiens
ttcacaccccaggccct

SEQ ID NO: 4047495 - DNA, 14 bp, Homo sapiens
ttcacacctgcaga

SEQ ID NO: 4047496 - DNA, 18 bp, Homo sapiens
ttcacagaaaaagcatga

SEQ ID NO: 4047497 - DNA, 13 bp, Homo sapiens
ttcacaggaggcc

SEQ ID NO: 4047498 - DNA, 17 bp, Homo sapiens
ttcacagtctggtgctt

SEQ ID NO: 4047499 - DNA, 12 bp, Homo sapiens
ttcacagtgttt

SEQ ID NO: 4047500 - DNA, 22 bp, Homo sapiens
ttcacagtgtttcgacagctga

SEQ ID NO: 4047501 - DNA, 13 bp, Homo sapiens
ttcacagtttttc

SEQ ID NO: 4047502 - DNA, 17 bp, Homo sapiens
ttcacattaaaaaatga

SEQ ID NO: 4047503 - DNA, 18 bp, Homo sapiens
ttcacattaaaaaatgaa

SEQ ID NO: 4047504 - DNA, 20 bp, Homo sapiens
ttcacattgtttgctgctat

SEQ ID NO: 4047505 - DNA, 13 bp, Homo sapiens
ttcaccaaaatta

SEQ ID NO: 4047506 - DNA, 15 bp, Homo sapiens
ttcaccaaaattatc

SEQ ID NO: 4047507 - DNA, 12 bp, Homo sapiens
ttcaccaggtgc

SEQ ID NO: 4047508 - DNA, 18 bp, Homo sapiens
ttcacccagctaatctgt

SEQ ID NO: 4047509 - DNA, 22 bp, Homo sapiens
ttcaccccagtggccactcagc

SEQ ID NO: 4047510 - DNA, 21 bp, Homo sapiens
ttcaccctgcattacatgtgt

SEQ ID NO: 4047511 - DNA, 19 bp, Homo sapiens
ttcaccgtgttagccagga

SEQ ID NO: 4047512 - DNA, 12 bp, Homo sapiens
ttcacctgttat

SEQ ID NO: 4047513 - DNA, 15 bp, Homo sapiens
ttcacctgttatgta

SEQ ID NO: 4047514 - DNA, 14 bp, Homo sapiens
ttcaccttgaagaa

SEQ ID NO: 4047515 - DNA, 20 bp, Homo sapiens
ttcacgtaagatacaagttt

SEQ ID NO: 4047516 - DNA, 22 bp, Homo sapiens
ttcacgtcttggtgccttttgt

SEQ ID NO: 4047517 - DNA, 12 bp, Homo sapiens
ttcactgagctc

SEQ ID NO: 4047518 - DNA, 15 bp, Homo sapiens
ttcactgcaattttg

SEQ ID NO: 4047519 - DNA, 13 bp, Homo sapiens
ttcactgctggct

SEQ ID NO: 4047520 - DNA, 17 bp, Homo sapiens
ttcactgctggctgcct

SEQ ID NO: 4047521 - DNA, 18 bp, Homo sapiens
ttcactgctggctgcctt

SEQ ID NO: 4047522 - DNA, 19 bp, Homo sapiens
ttcactgctggctgcctta

SEQ ID NO: 4047523 - DNA, 19 bp, Homo sapiens
ttcactggagttacattaa

SEQ ID NO: 4047524 - DNA, 15 bp, Homo sapiens
ttcactgtataaact

SEQ ID NO: 4047525 - DNA, 16 bp, Homo sapiens
ttcactgtctgtctgg

SEQ ID NO: 4047526 - DNA, 22 bp, Homo sapiens
ttcactgttagctttttaaaac

SEQ ID NO: 4047527 - DNA, 17 bp, Homo sapiens
ttcacttgaaagatttt

SEQ ID NO: 4047528 - DNA, 22 bp, Homo sapiens
ttcactttgctctcaattaaag

SEQ ID NO: 4047529 - DNA, 13 bp, Homo sapiens
ttcacttttgttc

SEQ ID NO: 4047530 - DNA, 16 bp, Homo sapiens
ttcagaaaaagaaatg

SEQ ID NO: 4047531 - DNA, 15 bp, Homo sapiens
ttcagaaaatgttct

SEQ ID NO: 4047532 - DNA, 17 bp, Homo sapiens
ttcagaacctcttcccc

SEQ ID NO: 4047533 - DNA, 18 bp, Homo sapiens
ttcagaacctcttcccca

SEQ ID NO: 4047534 - DNA, 19 bp, Homo sapiens
ttcagaacctcttccccag

SEQ ID NO: 4047535 - DNA, 16 bp, Homo sapiens
ttcagaagacactgca

SEQ ID NO: 4047536 - DNA, 12 bp, Homo sapiens
ttcagaagagat

SEQ ID NO: 4047537 - DNA, 23 bp, Homo sapiens
ttcagaaggttattttctttatc

SEQ ID NO: 4047538 - DNA, 15 bp, Homo sapiens
ttcagaatttagtgt

SEQ ID NO: 4047539 - DNA, 21 bp, Homo sapiens
ttcagaatttagtgtatccat

SEQ ID NO: 4047540 - DNA, 15 bp, Homo sapiens
ttcagacaagcaaca

SEQ ID NO: 4047541 - DNA, 21 bp, Homo sapiens
ttcagacaagcaacaggtttt

SEQ ID NO: 4047542 - DNA, 10 bp, Homo sapiens
ttcagacagg

SEQ ID NO: 4047543 - DNA, 14 bp, Homo sapiens
ttcagaccccccca

SEQ ID NO: 4047544 - DNA, 23 bp, Homo sapiens
ttcagacccccccatttcccgca

SEQ ID NO: 4047545 - DNA, 23 bp, Homo sapiens
ttcagagccaagccttaaactgt

SEQ ID NO: 4047546 - DNA, 12 bp, Homo sapiens
ttcagatacatg

SEQ ID NO: 4047547 - DNA, 15 bp, Homo sapiens
ttcagatatcaaaat

SEQ ID NO: 4047548 - DNA, 18 bp, Homo sapiens
ttcagatatcaaaattct

SEQ ID NO: 4047549 - DNA, 20 bp, Homo sapiens
ttcagcacccccacccacct

SEQ ID NO: 4047550 - DNA, 20 bp, Homo sapiens
ttcagcactgtcccttgcct

SEQ ID NO: 4047551 - DNA, 19 bp, Homo sapiens
ttcagcacttaactacttt

SEQ ID NO: 4047552 - DNA, 13 bp, Homo sapiens
ttcagcaggcagc

SEQ ID NO: 4047553 - DNA, 18 bp, Homo sapiens
ttcagctaagggaagaca

SEQ ID NO: 4047554 - DNA, 20 bp, Homo sapiens
ttcagctagcttttaggaaa

SEQ ID NO: 4047555 - DNA, 16 bp, Homo sapiens
ttcagctgagccctgg

SEQ ID NO: 4047556 - DNA, 18 bp, Homo sapiens
ttcagctgagccctgggg

SEQ ID NO: 4047557 - DNA, 18 bp, Homo sapiens
ttcagctgcctgaaacag

SEQ ID NO: 4047558 - DNA, 15 bp, Homo sapiens
ttcaggaaaataaat

SEQ ID NO: 4047559 - DNA, 14 bp, Homo sapiens
ttcaggaatttaaa

SEQ ID NO: 4047560 - DNA, 18 bp, Homo sapiens
ttcaggaatttaaaatta

SEQ ID NO: 4047561 - DNA, 12 bp, Homo sapiens
ttcaggagggat

SEQ ID NO: 4047562 - DNA, 16 bp, Homo sapiens
ttcaggatacatgtgc

SEQ ID NO: 4047563 - DNA, 17 bp, Homo sapiens
ttcaggatactctgtca

SEQ ID NO: 4047564 - DNA, 16 bp, Homo sapiens
ttcaggctcttctcct

SEQ ID NO: 4047565 - DNA, 16 bp, Homo sapiens
ttcaggctgcttggga

SEQ ID NO: 4047566 - DNA, 19 bp, Homo sapiens
ttcaggcttcctgcaattt

SEQ ID NO: 4047567 - DNA, 17 bp, Homo sapiens
ttcagggaccgtccagg

SEQ ID NO: 4047568 - DNA, 18 bp, Homo sapiens
ttcagggaccgtccaggg

SEQ ID NO: 4047569 - DNA, 16 bp, Homo sapiens
ttcaggggactcagcc

SEQ ID NO: 4047570 - DNA, 20 bp, Homo sapiens
ttcaggggactcagccctga

SEQ ID NO: 4047571 - DNA, 23 bp, Homo sapiens
ttcaggggctgggggtgctggat

SEQ ID NO: 4047572 - DNA, 21 bp, Homo sapiens
ttcaggggggttgtgaggcct

SEQ ID NO: 4047573 - DNA, 13 bp, Homo sapiens
ttcaggtgacatg

SEQ ID NO: 4047574 - DNA, 21 bp, Homo sapiens
ttcaggtgacatgtgaaacct

SEQ ID NO: 4047575 - DNA, 23 bp, Homo sapiens
ttcaggtgacatgtgaaaccttt

SEQ ID NO: 4047576 - DNA, 22 bp, Homo sapiens
ttcaggtgtcatggactgttgc

SEQ ID NO: 4047577 - DNA, 19 bp, Homo sapiens
ttcaggttatcgaaataac

SEQ ID NO: 4047578 - DNA, 13 bp, Homo sapiens
ttcagtaaacaac

SEQ ID NO: 4047579 - DNA, 21 bp, Homo sapiens
ttcagtaccctctcagctcca

SEQ ID NO: 4047580 - DNA, 20 bp, Homo sapiens
ttcagtataatttaacttca

SEQ ID NO: 4047581 - DNA, 16 bp, Homo sapiens
ttcagtatcatctcca

SEQ ID NO: 4047582 - DNA, 22 bp, Homo sapiens
ttcagtcatagcaagcttttgc

SEQ ID NO: 4047583 - DNA, 20 bp, Homo sapiens
ttcagtgagggtcttcttac

SEQ ID NO: 4047584 - DNA, 12 bp, Homo sapiens
ttcagtgtacat

SEQ ID NO: 4047585 - DNA, 18 bp, Homo sapiens
ttcagtgtagttaattta

SEQ ID NO: 4047586 - DNA, 10 bp, Homo sapiens
ttcagtgttt

SEQ ID NO: 4047587 - DNA, 21 bp, Homo sapiens
ttcagtgtttctggggagctg

SEQ ID NO: 4047588 - DNA, 19 bp, Homo sapiens
ttcagttacaagattgtaa

SEQ ID NO: 4047589 - DNA, 22 bp, Homo sapiens
ttcagttcccaccatctgatta

SEQ ID NO: 4047590 - DNA, 18 bp, Homo sapiens
ttcagttggttgtgtctt

SEQ ID NO: 4047591 - DNA, 17 bp, Homo sapiens
ttcagttgttcttttta

SEQ ID NO: 4047592 - DNA, 23 bp, Homo sapiens
ttcagttgtttgtttttgcttgt

SEQ ID NO: 4047593 - DNA, 21 bp, Homo sapiens
ttcagtttgaaaatattttgt

SEQ ID NO: 4047594 - DNA, 13 bp, Homo sapiens
tgttggaaaagaa

SEQ ID NO: 4047595 - DNA, 14 bp, Homo sapiens
tgttggagtgagga

SEQ ID NO: 4047596 - DNA, 15 bp, Homo sapiens
tgttggcagatgcag

SEQ ID NO: 4047597 - DNA, 14 bp, Homo sapiens
tgttggccaggctg

SEQ ID NO: 4047598 - DNA, 16 bp, Homo sapiens
tgttggctatttgaaa

SEQ ID NO: 4047599 - DNA, 17 bp, Homo sapiens
tgttggctatttgaaat

SEQ ID NO: 4047600 - DNA, 14 bp, Homo sapiens
tgttggctttgttt

SEQ ID NO: 4047601 - DNA, 24 bp, Homo sapiens
tgttgggggggaccctgcctcagc

SEQ ID NO: 4047602 - DNA, 19 bp, Homo sapiens
tgttggttgttttttcctt

SEQ ID NO: 4047603 - DNA, 14 bp, Homo sapiens
tgttgtaaatattt

SEQ ID NO: 4047604 - DNA, 14 bp, Homo sapiens
tgttgtaacctgct

SEQ ID NO: 4047605 - DNA, 18 bp, Homo sapiens
tgttgtacatttatgatt

SEQ ID NO: 4047606 - DNA, 23 bp, Homo sapiens
tgttgtacatttatgatttaata

SEQ ID NO: 4047607 - DNA, 20 bp, Homo sapiens
tgttgtcgtaaagatttggg

SEQ ID NO: 4047608 - DNA, 13 bp, Homo sapiens
tgttgtctcttct

SEQ ID NO: 4047609 - DNA, 17 bp, Homo sapiens
tgttgtctcttctcctt

SEQ ID NO: 4047610 - DNA, 12 bp, Homo sapiens
tgttgtgaatgt

SEQ ID NO: 4047611 - DNA, 20 bp, Homo sapiens
tgttgtgatgtattctagct

SEQ ID NO: 4047612 - DNA, 14 bp, Homo sapiens
tgttgtgatgtctt

SEQ ID NO: 4047613 - DNA, 14 bp, Homo sapiens
tgttgtggaagcat

SEQ ID NO: 4047614 - DNA, 22 bp, Homo sapiens
tgttgtgggcgctgcttccagg

SEQ ID NO: 4047615 - DNA, 14 bp, Homo sapiens
tgttgtgttcctgg

SEQ ID NO: 4047616 - DNA, 19 bp, Homo sapiens
tgttgtgttcctggctgat

SEQ ID NO: 4047617 - DNA, 17 bp, Homo sapiens
tgttgttaatgaaaatg

SEQ ID NO: 4047618 - DNA, 11 bp, Homo sapiens
tgttgttattt

SEQ ID NO: 4047619 - DNA, 13 bp, Homo sapiens
tgttgttatttaa

SEQ ID NO: 4047620 - DNA, 21 bp, Homo sapiens
tgttgtttgtaaataagagat

SEQ ID NO: 4047621 - DNA, 19 bp, Homo sapiens
tgttgtttgtttttttgcc

SEQ ID NO: 4047622 - DNA, 16 bp, Homo sapiens
tgttgttttctggggg

SEQ ID NO: 4047623 - DNA, 19 bp, Homo sapiens
tgtttaaaaagtaagttaa

SEQ ID NO: 4047624 - DNA, 14 bp, Homo sapiens
tgtttaaaattcag

SEQ ID NO: 4047625 - DNA, 12 bp, Homo sapiens
tgtttaaagaga

SEQ ID NO: 4047626 - DNA, 13 bp, Homo sapiens
tgtttaaatcatg

SEQ ID NO: 4047627 - DNA, 14 bp, Homo sapiens
tgtttaaatcatgt

SEQ ID NO: 4047628 - DNA, 18 bp, Homo sapiens
tgtttaagacacttccgt

SEQ ID NO: 4047629 - DNA, 19 bp, Homo sapiens
tgtttaagacacttccgtc

SEQ ID NO: 4047630 - DNA, 20 bp, Homo sapiens
tgtttaatattgagaaagaa

SEQ ID NO: 4047631 - DNA, 14 bp, Homo sapiens
tgtttaatatttaa

SEQ ID NO: 4047632 - DNA, 15 bp, Homo sapiens
tgtttaatatttaaa

SEQ ID NO: 4047633 - DNA, 17 bp, Homo sapiens
ctcacccacccctgcac

SEQ ID NO: 4047634 - DNA, 14 bp, Homo sapiens
ctcacccagtcacc

SEQ ID NO: 4047635 - DNA, 12 bp, Homo sapiens
ctcaccccatcc

SEQ ID NO: 4047636 - DNA, 19 bp, Homo sapiens
ctcaccccatcccacaccc

SEQ ID NO: 4047637 - DNA, 14 bp, Homo sapiens
ctcacccccatccc

SEQ ID NO: 4047638 - DNA, 13 bp, Homo sapiens
ctcaccccggcag

SEQ ID NO: 4047639 - DNA, 12 bp, Homo sapiens
ctcacccctggg

SEQ ID NO: 4047640 - DNA, 18 bp, Homo sapiens
ctcacccctgggcaggcg

SEQ ID NO: 4047641 - DNA, 14 bp, Homo sapiens
ctcaccgcccatca

SEQ ID NO: 4047642 - DNA, 17 bp, Homo sapiens
ctcacctcatgcccacc

SEQ ID NO: 4047643 - DNA, 16 bp, Homo sapiens
ctcacctctccaggtg

SEQ ID NO: 4047644 - DNA, 17 bp, Homo sapiens
ctcacctctccaggtgc

SEQ ID NO: 4047645 - DNA, 21 bp, Homo sapiens
ctcacctctggactggctaga

SEQ ID NO: 4047646 - DNA, 22 bp, Homo sapiens
ctcacctgtctaggtctcctca

SEQ ID NO: 4047647 - DNA, 13 bp, Homo sapiens
ctcaccttcctgt

SEQ ID NO: 4047648 - DNA, 17 bp, Homo sapiens
ctcaccttggcaccaga

SEQ ID NO: 4047649 - DNA, 19 bp, Homo sapiens
ctcaccttggcaccagaca

SEQ ID NO: 4047650 - DNA, 17 bp, Homo sapiens
ctcaccttgggctgggg

SEQ ID NO: 4047651 - DNA, 14 bp, Homo sapiens
ctcacctttgtttt

SEQ ID NO: 4047652 - DNA, 17 bp, Homo sapiens
ctcacgggcatgggcac

SEQ ID NO: 4047653 - DNA, 21 bp, Homo sapiens
ctcacgggcatgggcactccc

SEQ ID NO: 4047654 - DNA, 14 bp, Homo sapiens
ctcacggggcctcc

SEQ ID NO: 4047655 - DNA, 17 bp, Homo sapiens
ctcacggggcctccaac

SEQ ID NO: 4047656 - DNA, 17 bp, Homo sapiens
ctcactatcctacccca

SEQ ID NO: 4047657 - DNA, 21 bp, Homo sapiens
ctcactatggtatgctggcca

SEQ ID NO: 4047658 - DNA, 23 bp, Homo sapiens
ctcactatggtatgctggccagc

SEQ ID NO: 4047659 - DNA, 21 bp, Homo sapiens
ctcactccacagagtgagcca

SEQ ID NO: 4047660 - DNA, 14 bp, Homo sapiens
ctcactcccacctg

SEQ ID NO: 4047661 - DNA, 22 bp, Homo sapiens
ctcactccccagggagctctgg

SEQ ID NO: 4047662 - DNA, 19 bp, Homo sapiens
ctcactcctacctggtaat

SEQ ID NO: 4047663 - DNA, 18 bp, Homo sapiens
ctcactcctaggagagcc

SEQ ID NO: 4047664 - DNA, 11 bp, Homo sapiens
ctcactcctgt

SEQ ID NO: 4047665 - DNA, 11 bp, Homo sapiens
ctcactctgtc

SEQ ID NO: 4047666 - DNA, 15 bp, Homo sapiens
ctcactctgtcagcc

SEQ ID NO: 4047667 - DNA, 23 bp, Homo sapiens
ctcactgaaacatggctgtgttt

SEQ ID NO: 4047668 - DNA, 14 bp, Homo sapiens
ctcactgaactcca

SEQ ID NO: 4047669 - DNA, 23 bp, Homo sapiens
ctcactgaagcctgcgttggtcc

SEQ ID NO: 4047670 - DNA, 18 bp, Homo sapiens
ctcactgaaggacctgag

SEQ ID NO: 4047671 - DNA, 22 bp, Homo sapiens
tgtgtcccccccaggccttgtc

SEQ ID NO: 4047672 - DNA, 12 bp, Homo sapiens
tgtgtcccctca

SEQ ID NO: 4047673 - DNA, 15 bp, Homo sapiens
tgtgtcccctcactc

SEQ ID NO: 4047674 - DNA, 19 bp, Homo sapiens
tgtgtcccctcactctgtc

SEQ ID NO: 4047675 - DNA, 14 bp, Homo sapiens
tgtgtcctcaggga

SEQ ID NO: 4047676 - DNA, 22 bp, Homo sapiens
tgtgtcctgtcctttcttgcag

SEQ ID NO: 4047677 - DNA, 22 bp, Homo sapiens
tgtgtctaaatttgaatgttaa

SEQ ID NO: 4047678 - DNA, 16 bp, Homo sapiens
tgtgtctcttttctct

SEQ ID NO: 4047679 - DNA, 16 bp, Homo sapiens
tgtgtctgctaatgta

SEQ ID NO: 4047680 - DNA, 18 bp, Homo sapiens
tgtgtctttatagatgta

SEQ ID NO: 4047681 - DNA, 22 bp, Homo sapiens
tgtgtgaaaggaagctccactg

SEQ ID NO: 4047682 - DNA, 20 bp, Homo sapiens
tgtgtgaaataccagtgtgg

SEQ ID NO: 4047683 - DNA, 20 bp, Homo sapiens
tgtgtgaactgctttcaagt

SEQ ID NO: 4047684 - DNA, 13 bp, Homo sapiens
tgtgtgagttgag

SEQ ID NO: 4047685 - DNA, 15 bp, Homo sapiens
tgtgtgatgcgcctt

SEQ ID NO: 4047686 - DNA, 18 bp, Homo sapiens
tgtgtgccgagcccttgc

SEQ ID NO: 4047687 - DNA, 21 bp, Homo sapiens
tgtgtgccgagcccttgccca

SEQ ID NO: 4047688 - DNA, 20 bp, Homo sapiens
tgtgtggacccccaccctgc

SEQ ID NO: 4047689 - DNA, 14 bp, Homo sapiens
tgtgtggtagaaac

SEQ ID NO: 4047690 - DNA, 15 bp, Homo sapiens
tgtgtggtagaaaca

SEQ ID NO: 4047691 - DNA, 20 bp, Homo sapiens
tgtgtggtccatgcccactg

SEQ ID NO: 4047692 - DNA, 16 bp, Homo sapiens
tgtgtggtggcctcag

SEQ ID NO: 4047693 - DNA, 11 bp, Homo sapiens
tgtgtgtgtat

SEQ ID NO: 4047694 - DNA, 14 bp, Homo sapiens
tgtgtgtgtatgtg

SEQ ID NO: 4047695 - DNA, 14 bp, Homo sapiens
tgtgtgtgtcagct

SEQ ID NO: 4047696 - DNA, 13 bp, Homo sapiens
tgtgtgtgtgaat

SEQ ID NO: 4047697 - DNA, 13 bp, Homo sapiens
tgtgtgtgtgcat

SEQ ID NO: 4047698 - DNA, 11 bp, Homo sapiens
tgtgtgtgtgt

SEQ ID NO: 4047699 - DNA, 12 bp, Homo sapiens
tgtgtgtgtgta

SEQ ID NO: 4047700 - DNA, 13 bp, Homo sapiens
tgtgtgtgtgtat

SEQ ID NO: 4047701 - DNA, 13 bp, Homo sapiens
tgtgtgtgtgtgt

SEQ ID NO: 4047702 - DNA, 14 bp, Homo sapiens
tgtgtgtgtgtgtg

SEQ ID NO: 4047703 - DNA, 20 bp, Homo sapiens
tgtgttccaaacatgaggtt

SEQ ID NO: 4047704 - DNA, 16 bp, Homo sapiens
tgtgttcccagaggca

SEQ ID NO: 4047705 - DNA, 16 bp, Homo sapiens
tgtgttcctggcaata

SEQ ID NO: 4047706 - DNA, 15 bp, Homo sapiens
tgtgacttctccagg

SEQ ID NO: 4047707 - DNA, 20 bp, Homo sapiens
tgtgagaaaaccccttccca

SEQ ID NO: 4047708 - DNA, 22 bp, Homo sapiens
tgtgagaaaaccccttcccatt

SEQ ID NO: 4047709 - DNA, 16 bp, Homo sapiens
tgtgagacccccacac

SEQ ID NO: 4047710 - DNA, 18 bp, Homo sapiens
tgtgagattttttattgc

SEQ ID NO: 4047711 - DNA, 14 bp, Homo sapiens
tgtgagcagtgagt

SEQ ID NO: 4047712 - DNA, 12 bp, Homo sapiens
tgtgagcccctg

SEQ ID NO: 4047713 - DNA, 14 bp, Homo sapiens
tgtgagcgccttgg

SEQ ID NO: 4047714 - DNA, 15 bp, Homo sapiens
tgtgagcgccttggt

SEQ ID NO: 4047715 - DNA, 17 bp, Homo sapiens
tgtgagcgccttggtat

SEQ ID NO: 4047716 - DNA, 17 bp, Homo sapiens
tgtgagctcttccctta

SEQ ID NO: 4047717 - DNA, 15 bp, Homo sapiens
tgtgagctgcaccag

SEQ ID NO: 4047718 - DNA, 20 bp, Homo sapiens
tgtgagctgcaccaggtaga

SEQ ID NO: 4047719 - DNA, 16 bp, Homo sapiens
tgtgagctgctgccat

SEQ ID NO: 4047720 - DNA, 17 bp, Homo sapiens
tgtgaggagctgctggc

SEQ ID NO: 4047721 - DNA, 14 bp, Homo sapiens
tgtgaggaggaaaa

SEQ ID NO: 4047722 - DNA, 23 bp, Homo sapiens
tgtgaggattatgggtcctgcaa

SEQ ID NO: 4047723 - DNA, 14 bp, Homo sapiens
tgtgaggcctggcc

SEQ ID NO: 4047724 - DNA, 18 bp, Homo sapiens
tgtgaggcctggccaggc

SEQ ID NO: 4047725 - DNA, 22 bp, Homo sapiens
tgtgagggacatgctcacctct

SEQ ID NO: 4047726 - DNA, 19 bp, Homo sapiens
tgtgagtaagagctggtgt

SEQ ID NO: 4047727 - DNA, 12 bp, Homo sapiens
tgtgagtgtgac

SEQ ID NO: 4047728 - DNA, 16 bp, Homo sapiens
tgtgagtgtgacaggg

SEQ ID NO: 4047729 - DNA, 17 bp, Homo sapiens
tgtgagtgtgacagggc

SEQ ID NO: 4047730 - DNA, 17 bp, Homo sapiens
tgtgagtgtttttatct

SEQ ID NO: 4047731 - DNA, 14 bp, Homo sapiens
tgtgatagcacttt

SEQ ID NO: 4047732 - DNA, 17 bp, Homo sapiens
tgtgatcacgcctggct

SEQ ID NO: 4047733 - DNA, 18 bp, Homo sapiens
tgtgatcacgcctggcta

SEQ ID NO: 4047734 - DNA, 20 bp, Homo sapiens
tgtgatgaatcaatgaaaaa

SEQ ID NO: 4047735 - DNA, 18 bp, Homo sapiens
tgtgatgatgctgtgaca

SEQ ID NO: 4047736 - DNA, 17 bp, Homo sapiens
tgtgatgccacacagag

SEQ ID NO: 4047737 - DNA, 23 bp, Homo sapiens
tgtgatgcttataataaagaaaa

SEQ ID NO: 4047738 - DNA, 16 bp, Homo sapiens
tgtgatgtattctagc

SEQ ID NO: 4047739 - DNA, 22 bp, Homo sapiens
tgtgattaacatctacaatcag

SEQ ID NO: 4047740 - DNA, 14 bp, Homo sapiens
tgtgattgcacaga

SEQ ID NO: 4047741 - DNA, 16 bp, Homo sapiens
tgtgattgcacagaat

SEQ ID NO: 4047742 - DNA, 13 bp, Homo sapiens
tgtgattgctgcc

SEQ ID NO: 4047743 - DNA, 14 bp, Homo sapiens
tgtgattgtggaat

SEQ ID NO: 4047744 - DNA, 21 bp, Homo sapiens
tgtgatttctttaaaagaatg

SEQ ID NO: 4047745 - DNA, 14 bp, Homo sapiens
tgtgcaatagaaat

SEQ ID NO: 4047746 - DNA, 14 bp, Homo sapiens
tgtgcacatttctt

SEQ ID NO: 4047747 - DNA, 13 bp, Homo sapiens
tgtgcacccggcc

SEQ ID NO: 4047748 - DNA, 15 bp, Homo sapiens
tgtgcacccggcctg

SEQ ID NO: 4047749 - DNA, 17 bp, Homo sapiens
tgtgcactgtcactttg

SEQ ID NO: 4047750 - DNA, 21 bp, Homo sapiens
tgtgcactgtcactttgctct

SEQ ID NO: 4047751 - DNA, 17 bp, Homo sapiens
tgtgcacttatttatga

SEQ ID NO: 4047752 - DNA, 15 bp, Homo sapiens
tgtgcagaataatgg

SEQ ID NO: 4047753 - DNA, 18 bp, Homo sapiens
tgtgcagcacgtctcaga

SEQ ID NO: 4047754 - DNA, 17 bp, Homo sapiens
tgtgcagggagggcagt

SEQ ID NO: 4047755 - DNA, 14 bp, Homo sapiens
tgtgcagggctggt

SEQ ID NO: 4047756 - DNA, 16 bp, Homo sapiens
tgtgcagggctggttt

SEQ ID NO: 4047757 - DNA, 18 bp, Homo sapiens
tgtgcagtcactggaggt

SEQ ID NO: 4047758 - DNA, 18 bp, Homo sapiens
tgtgcataatgataaaat

SEQ ID NO: 4047759 - DNA, 20 bp, Homo sapiens
tgtgcataatgataaaataa

SEQ ID NO: 4047760 - DNA, 21 bp, Homo sapiens
tgtgcataatgataaaataaa

SEQ ID NO: 4047761 - DNA, 15 bp, Homo sapiens
tgtgcatagtgctgg

SEQ ID NO: 4047762 - DNA, 17 bp, Homo sapiens
tgtgcatagtgctggga

SEQ ID NO: 4047763 - DNA, 15 bp, Homo sapiens
tgtgcatgtgtgtgt

SEQ ID NO: 4047764 - DNA, 18 bp, Homo sapiens
tgtgcatttgttcagctc

SEQ ID NO: 4047765 - DNA, 16 bp, Homo sapiens
tgtgccacccaccagg

SEQ ID NO: 4047766 - DNA, 20 bp, Homo sapiens
tgtgccacccaccagggcga

SEQ ID NO: 4047767 - DNA, 13 bp, Homo sapiens
tgtgccagggcag

SEQ ID NO: 4047768 - DNA, 15 bp, Homo sapiens
tgtgccagttcctgt

SEQ ID NO: 4047769 - DNA, 23 bp, Homo sapiens
tgtgcccctggcccatctcagcc

SEQ ID NO: 4047770 - DNA, 16 bp, Homo sapiens
tgtgccgaatgtgcag

SEQ ID NO: 4047771 - DNA, 14 bp, Homo sapiens
tgtgccgagccctt

SEQ ID NO: 4047772 - DNA, 12 bp, Homo sapiens
tgtgcctcctca

SEQ ID NO: 4047773 - DNA, 15 bp, Homo sapiens
tgtgcctctgggact

SEQ ID NO: 4047774 - DNA, 14 bp, Homo sapiens
tgtgcctggcctct

SEQ ID NO: 4047775 - DNA, 21 bp, Homo sapiens
tgtgcctgggggagttttcct

SEQ ID NO: 4047776 - DNA, 22 bp, Homo sapiens
tgtgcctgggggagttttcctc

SEQ ID NO: 4047777 - DNA, 13 bp, Homo sapiens
tgtgccttgtttt

SEQ ID NO: 4047778 - DNA, 10 bp, Homo sapiens
tgtgcctttg

SEQ ID NO: 4047779 - DNA, 15 bp, Homo sapiens
tgtgcgtgaaacaca

SEQ ID NO: 4047780 - DNA, 16 bp, Homo sapiens
tgtgcgtgaaacacac

SEQ ID NO: 4047781 - DNA, 22 bp, Homo sapiens
tgtgcgtgaaacacaccaggct

SEQ ID NO: 4047782 - DNA, 15 bp, Homo sapiens
tgtgcgtggaaaaag

SEQ ID NO: 4047783 - DNA, 17 bp, Homo sapiens
tgtgcgtggaaaaagac

SEQ ID NO: 4047784 - DNA, 13 bp, Homo sapiens
tgtgctagatgtg

SEQ ID NO: 4047785 - DNA, 14 bp, Homo sapiens
tgtgctatgaattt

SEQ ID NO: 4047786 - DNA, 13 bp, Homo sapiens
tgtaaaccaaagc

SEQ ID NO: 4047787 - DNA, 17 bp, Homo sapiens
tgtaaaggtttcatgtt

SEQ ID NO: 4047788 - DNA, 17 bp, Homo sapiens
tgtaaagtgtaaatcct

SEQ ID NO: 4047789 - DNA, 12 bp, Homo sapiens
tgtaaataagag

SEQ ID NO: 4047790 - DNA, 15 bp, Homo sapiens
tgtaaataagagatt

SEQ ID NO: 4047791 - DNA, 16 bp, Homo sapiens
tgtaaatagtatttga

SEQ ID NO: 4047792 - DNA, 13 bp, Homo sapiens
tgtaaatatatgt

SEQ ID NO: 4047793 - DNA, 22 bp, Homo sapiens
tgtaaatatatgtctgataatg

SEQ ID NO: 4047794 - DNA, 14 bp, Homo sapiens
tgtaaatattctat

SEQ ID NO: 4047795 - DNA, 16 bp, Homo sapiens
tgtaaatattctatat

SEQ ID NO: 4047796 - DNA, 20 bp, Homo sapiens
tgtaaatattctatatgaat

SEQ ID NO: 4047797 - DNA, 16 bp, Homo sapiens
tgtaaatctgccacaa

SEQ ID NO: 4047798 - DNA, 14 bp, Homo sapiens
tgtaaattatttgc

SEQ ID NO: 4047799 - DNA, 16 bp, Homo sapiens
tgtaaattatttgcta

SEQ ID NO: 4047800 - DNA, 18 bp, Homo sapiens
tgtaaattatttgctaag

SEQ ID NO: 4047801 - DNA, 15 bp, Homo sapiens
tgtaaatttataaat

SEQ ID NO: 4047802 - DNA, 16 bp, Homo sapiens
tgtaacaattgtgtag

SEQ ID NO: 4047803 - DNA, 22 bp, Homo sapiens
tgtaacaattgtgtagcctttt

SEQ ID NO: 4047804 - DNA, 21 bp, Homo sapiens
tgtaacacagtcattctagga

SEQ ID NO: 4047805 - DNA, 14 bp, Homo sapiens
tgtaacacataaac

SEQ ID NO: 4047806 - DNA, 17 bp, Homo sapiens
tgtaacatactggcctg

SEQ ID NO: 4047807 - DNA, 22 bp, Homo sapiens
tgtaaccatttctcactagtgt

SEQ ID NO: 4047808 - DNA, 15 bp, Homo sapiens
tgtaacctcagctct

SEQ ID NO: 4047809 - DNA, 19 bp, Homo sapiens
tgtaacctcagctctggga

SEQ ID NO: 4047810 - DNA, 22 bp, Homo sapiens
tgtaacgtgtgctgtgtttgct

SEQ ID NO: 4047811 - DNA, 19 bp, Homo sapiens
tgtaactccagatagagaa

SEQ ID NO: 4047812 - DNA, 21 bp, Homo sapiens
tgtaactccagatagagaaat

SEQ ID NO: 4047813 - DNA, 14 bp, Homo sapiens
tgtaacttcctgct

SEQ ID NO: 4047814 - DNA, 17 bp, Homo sapiens
tgtaacttcctgctgca

SEQ ID NO: 4047815 - DNA, 19 bp, Homo sapiens
tgtaacttcctgctgcacc

SEQ ID NO: 4047816 - DNA, 16 bp, Homo sapiens
tgtaacttgcttaaat

SEQ ID NO: 4047817 - DNA, 20 bp, Homo sapiens
tgtaacttgcttaaatttct

SEQ ID NO: 4047818 - DNA, 17 bp, Homo sapiens
tgtaagaaggcaatatt

SEQ ID NO: 4047819 - DNA, 19 bp, Homo sapiens
tgtaagagcaccttcctca

SEQ ID NO: 4047820 - DNA, 15 bp, Homo sapiens
tgtaagagtgtagaa

SEQ ID NO: 4047821 - DNA, 20 bp, Homo sapiens
tgtaagagtgtagaagcatt

SEQ ID NO: 4047822 - DNA, 21 bp, Homo sapiens
tgtaagagtgtagaagcattc

SEQ ID NO: 4047823 - DNA, 14 bp, Homo sapiens
tgtaagcctgcaag

SEQ ID NO: 4047824 - DNA, 21 bp, Homo sapiens
tgtaagtaacttcacattaaa

SEQ ID NO: 4047825 - DNA, 14 bp, Homo sapiens
tgtaagtgtgagta

SEQ ID NO: 4047826 - DNA, 13 bp, Homo sapiens
tgtaagttgtaca

SEQ ID NO: 4047827 - DNA, 14 bp, Homo sapiens
tgtaagttgtacaa

SEQ ID NO: 4047828 - DNA, 17 bp, Homo sapiens
tgtaagttgtacaaatg

SEQ ID NO: 4047829 - DNA, 18 bp, Homo sapiens
tgtaagttgtacaaatgt

SEQ ID NO: 4047830 - DNA, 15 bp, Homo sapiens
tgtaagtttcaggtg

SEQ ID NO: 4047831 - DNA, 13 bp, Homo sapiens
tgtaataaagtat

SEQ ID NO: 4047832 - DNA, 19 bp, Homo sapiens
tgtaataaagtatataatt

SEQ ID NO: 4047833 - DNA, 22 bp, Homo sapiens
tgtaataactgtgaagtttaca

SEQ ID NO: 4047834 - DNA, 13 bp, Homo sapiens
tgtaataagacat

SEQ ID NO: 4047835 - DNA, 18 bp, Homo sapiens
tgtaataagacataacgt

SEQ ID NO: 4047836 - DNA, 14 bp, Homo sapiens
tgtaataattgctc

SEQ ID NO: 4047837 - DNA, 14 bp, Homo sapiens
tgtaatactggaat

SEQ ID NO: 4047838 - DNA, 19 bp, Homo sapiens
tgtaatataccagcttgta

SEQ ID NO: 4047839 - DNA, 16 bp, Homo sapiens
tgtaatatttagctgt

SEQ ID NO: 4047840 - DNA, 14 bp, Homo sapiens
tgtaatcaatgttt

SEQ ID NO: 4047841 - DNA, 17 bp, Homo sapiens
tgtaatcccagctactt

SEQ ID NO: 4047842 - DNA, 22 bp, Homo sapiens
tgtaatcccagctacttgggag

SEQ ID NO: 4047843 - DNA, 21 bp, Homo sapiens
tgtaatctctctgcagctgcc

SEQ ID NO: 4047844 - DNA, 18 bp, Homo sapiens
tgtaatgtgtggtggcct

SEQ ID NO: 4047845 - DNA, 16 bp, Homo sapiens
tgtaatgttactgatc

SEQ ID NO: 4047846 - DNA, 17 bp, Homo sapiens
tgtaatgttactgatca

SEQ ID NO: 4047847 - DNA, 19 bp, Homo sapiens
tgtaatgttactgatcatg

SEQ ID NO: 4047848 - DNA, 16 bp, Homo sapiens
tgtaatgtttgttacc

SEQ ID NO: 4047849 - DNA, 14 bp, Homo sapiens
tgtaattctaaatg

SEQ ID NO: 4047850 - DNA, 15 bp, Homo sapiens
tgtaattctaaatga

SEQ ID NO: 4047851 - DNA, 14 bp, Homo sapiens
tgtaattgcttaca

SEQ ID NO: 4047852 - DNA, 13 bp, Homo sapiens
tgtaattgtgtaa

SEQ ID NO: 4047853 - DNA, 14 bp, Homo sapiens
tgtaattgtgtaaa

SEQ ID NO: 4047854 - DNA, 22 bp, Homo sapiens
tgtaattgtgtaaaaaatggaa

SEQ ID NO: 4047855 - DNA, 14 bp, Homo sapiens
tgtaatttagaaac

SEQ ID NO: 4047856 - DNA, 20 bp, Homo sapiens
tgtaatttagggtactaaat

SEQ ID NO: 4047857 - DNA, 21 bp, Homo sapiens
tgtaatttagggtactaaatt

SEQ ID NO: 4047858 - DNA, 19 bp, Homo sapiens
tgtacaaagtagaagtctt

SEQ ID NO: 4047859 - DNA, 13 bp, Homo sapiens
tgtacaaatgtat

SEQ ID NO: 4047860 - DNA, 18 bp, Homo sapiens
tgtacaaatgtattttga

SEQ ID NO: 4047861 - DNA, 15 bp, Homo sapiens
tgtacaagttgttat

SEQ ID NO: 4047862 - DNA, 18 bp, Homo sapiens
tgtacaatgtacacactg

SEQ ID NO: 4047863 - DNA, 22 bp, Homo sapiens
tgtacacactggtacttagagt

SEQ ID NO: 4047864 - DNA, 12 bp, Homo sapiens
tgtacacagtca

SEQ ID NO: 4047865 - DNA, 16 bp, Homo sapiens
tgtacactaacatttc

SEQ ID NO: 4047866 - DNA, 14 bp, Homo sapiens
tgtacactgaatat

SEQ ID NO: 4047867 - DNA, 21 bp, Homo sapiens
tgtacactgaatatttatatt

SEQ ID NO: 4047868 - DNA, 14 bp, Homo sapiens
tgtacactgctgta

SEQ ID NO: 4047869 - DNA, 15 bp, Homo sapiens
tgtacagaatatttc

SEQ ID NO: 4047870 - DNA, 19 bp, Homo sapiens
tgtacagaatttccactgt

SEQ ID NO: 4047871 - DNA, 22 bp, Homo sapiens
tgtacagtgtctgtgccatgga

SEQ ID NO: 4047872 - DNA, 16 bp, Homo sapiens
tgtacataaaagaatt

SEQ ID NO: 4047873 - DNA, 21 bp, Homo sapiens
tgtacatctattttggattgt

SEQ ID NO: 4047874 - DNA, 23 bp, Homo sapiens
tgtacatctattttggattgtat

SEQ ID NO: 4047875 - DNA, 21 bp, Homo sapiens
tgtatcaggaaatatatatgt

SEQ ID NO: 4047876 - DNA, 19 bp, Homo sapiens
tgtatcaggtcagggactt

SEQ ID NO: 4047877 - DNA, 16 bp, Homo sapiens
tgtatcagtgtccttt

SEQ ID NO: 4047878 - DNA, 18 bp, Homo sapiens
tgtatcagtgtcctttcc

SEQ ID NO: 4047879 - DNA, 15 bp, Homo sapiens
tgtatcattaatgta

SEQ ID NO: 4047880 - DNA, 21 bp, Homo sapiens
tgtatccttccaatttggaat

SEQ ID NO: 4047881 - DNA, 13 bp, Homo sapiens
tgtatctgagcag

SEQ ID NO: 4047882 - DNA, 18 bp, Homo sapiens
tgtatcttccatatttgg

SEQ ID NO: 4047883 - DNA, 18 bp, Homo sapiens
tgtatgaaaaattgggga

SEQ ID NO: 4047884 - DNA, 20 bp, Homo sapiens
tgtatgaactttatctaaag

SEQ ID NO: 4047885 - DNA, 16 bp, Homo sapiens
tgtatgactaaagaga

SEQ ID NO: 4047886 - DNA, 18 bp, Homo sapiens
tgtatgccaagtgagaag

SEQ ID NO: 4047887 - DNA, 15 bp, Homo sapiens
tgtatgctgatcatc

SEQ ID NO: 4047888 - DNA, 23 bp, Homo sapiens
tgtatgctgatcatcgccagagg

SEQ ID NO: 4047889 - DNA, 13 bp, Homo sapiens
tgtatggatttaa

SEQ ID NO: 4047890 - DNA, 18 bp, Homo sapiens
tgtatgggagcttaactt

SEQ ID NO: 4047891 - DNA, 16 bp, Homo sapiens
tggtcgaggagtaaca

SEQ ID NO: 4047892 - DNA, 17 bp, Homo sapiens
tggtcgaggagtaacaa

SEQ ID NO: 4047893 - DNA, 14 bp, Homo sapiens
tggtcgagtgacac

SEQ ID NO: 4047894 - DNA, 15 bp, Homo sapiens
tggtcgcccaggaga

SEQ ID NO: 4047895 - DNA, 17 bp, Homo sapiens
tggtctaacactggcat

SEQ ID NO: 4047896 - DNA, 23 bp, Homo sapiens
tggtctaacactggcatgttcaa

SEQ ID NO: 4047897 - DNA, 12 bp, Homo sapiens
tggtctcaggat

SEQ ID NO: 4047898 - DNA, 12 bp, Homo sapiens
tggtctgaatgt

SEQ ID NO: 4047899 - DNA, 14 bp, Homo sapiens
tggtctgaatgttc

SEQ ID NO: 4047900 - DNA, 15 bp, Homo sapiens
tggtctgaatgttct

SEQ ID NO: 4047901 - DNA, 16 bp, Homo sapiens
tggtctgaatgttctg

SEQ ID NO: 4047902 - DNA, 18 bp, Homo sapiens
tggtctgaatgttctgac

SEQ ID NO: 4047903 - DNA, 22 bp, Homo sapiens
tggtctgaatgttctgacatta

SEQ ID NO: 4047904 - DNA, 17 bp, Homo sapiens
tggtctgaggatgtaga

SEQ ID NO: 4047905 - DNA, 16 bp, Homo sapiens
tggtctgatttcagga

SEQ ID NO: 4047906 - DNA, 13 bp, Homo sapiens
tggtctgccagaa

SEQ ID NO: 4047907 - DNA, 17 bp, Homo sapiens
tggtctgccagaatact

SEQ ID NO: 4047908 - DNA, 20 bp, Homo sapiens
tggtcttaaatgctcatttt

SEQ ID NO: 4047909 - DNA, 17 bp, Homo sapiens
tggtcttgagatgtctt

SEQ ID NO: 4047910 - DNA, 17 bp, Homo sapiens
tggtctttctggagagg

SEQ ID NO: 4047911 - DNA, 12 bp, Homo sapiens
tggtcttttcct

SEQ ID NO: 4047912 - DNA, 19 bp, Homo sapiens
tggtcttttcctcgcttct

SEQ ID NO: 4047913 - DNA, 20 bp, Homo sapiens
tggtcttttcctcgcttctt

SEQ ID NO: 4047914 - DNA, 19 bp, Homo sapiens
tggtgaaattgactgatga

SEQ ID NO: 4047915 - DNA, 16 bp, Homo sapiens
tggtgaagtaaattag

SEQ ID NO: 4047916 - DNA, 23 bp, Homo sapiens
tggtgaatcacctggctgagcag

SEQ ID NO: 4047917 - DNA, 17 bp, Homo sapiens
tggtgaatggccttcct

SEQ ID NO: 4047918 - DNA, 18 bp, Homo sapiens
tggtgacagctgcaagcc

SEQ ID NO: 4047919 - DNA, 14 bp, Homo sapiens
tggtgactgtccca

SEQ ID NO: 4047920 - DNA, 15 bp, Homo sapiens
tggtgactgtcccac

SEQ ID NO: 4047921 - DNA, 15 bp, Homo sapiens
tggtgaggggctttc

SEQ ID NO: 4047922 - DNA, 17 bp, Homo sapiens
tggtgatcaattaaatg

SEQ ID NO: 4047923 - DNA, 17 bp, Homo sapiens
tggtgcagagaagctgg

SEQ ID NO: 4047924 - DNA, 22 bp, Homo sapiens
tggtgcagagaagctggacttc

SEQ ID NO: 4047925 - DNA, 16 bp, Homo sapiens
tggtgcattacagaga

SEQ ID NO: 4047926 - DNA, 13 bp, Homo sapiens
tggtgccagggtg

SEQ ID NO: 4047927 - DNA, 13 bp, Homo sapiens
tggtgccccacag

SEQ ID NO: 4047928 - DNA, 17 bp, Homo sapiens
tggtgctggatattttc

SEQ ID NO: 4047929 - DNA, 17 bp, Homo sapiens
tggtgcttgggagagtc

SEQ ID NO: 4047930 - DNA, 19 bp, Homo sapiens
tggtgcttgggagagtcag

SEQ ID NO: 4047931 - DNA, 12 bp, Homo sapiens
tggtggatgtga

SEQ ID NO: 4047932 - DNA, 17 bp, Homo sapiens
tggtggcagtggaggtg

SEQ ID NO: 4047933 - DNA, 19 bp, Homo sapiens
tggtggcccgacagcctgg

SEQ ID NO: 4047934 - DNA, 10 bp, Homo sapiens
tggtggcctc

SEQ ID NO: 4047935 - DNA, 12 bp, Homo sapiens
tggtggcctcag

SEQ ID NO: 4047936 - DNA, 15 bp, Homo sapiens
tggtggcctggtccc

SEQ ID NO: 4047937 - DNA, 16 bp, Homo sapiens
tggtggctcatgcctg

SEQ ID NO: 4047938 - DNA, 17 bp, Homo sapiens
tggtggctcatgcctgt

SEQ ID NO: 4047939 - DNA, 17 bp, Homo sapiens
tggtgggcattctctct

SEQ ID NO: 4047940 - DNA, 19 bp, Homo sapiens
tggtgggttcaggggactc

SEQ ID NO: 4047941 - DNA, 15 bp, Homo sapiens
tggtgtaaagctggc

SEQ ID NO: 4047942 - DNA, 17 bp, Homo sapiens
tggtgtaaagctggccc

SEQ ID NO: 4047943 - DNA, 14 bp, Homo sapiens
tggtgtaataagac

SEQ ID NO: 4047944 - DNA, 16 bp, Homo sapiens
tggtgtaataagacat

SEQ ID NO: 4047945 - DNA, 17 bp, Homo sapiens
tggtgtaatttgaagat

SEQ ID NO: 4047946 - DNA, 15 bp, Homo sapiens
tggtgtagaacacta

SEQ ID NO: 4047947 - DNA, 21 bp, Homo sapiens
tggtgtagaacactaattcat

SEQ ID NO: 4047948 - DNA, 17 bp, Homo sapiens
tggtgtgaacccgggag

SEQ ID NO: 4047949 - DNA, 17 bp, Homo sapiens
tggtgtgggtgtcctgc

SEQ ID NO: 4047950 - DNA, 13 bp, Homo sapiens
tggtgtttattgc

SEQ ID NO: 4047951 - DNA, 23 bp, Homo sapiens
tggttacctgacctaaattagat

SEQ ID NO: 4047952 - DNA, 15 bp, Homo sapiens
tggttacttcttctc

SEQ ID NO: 4047953 - DNA, 21 bp, Homo sapiens
tggttacttcttctcttagat

SEQ ID NO: 4047954 - DNA, 18 bp, Homo sapiens
tggttatgaaagaatata

SEQ ID NO: 4047955 - DNA, 20 bp, Homo sapiens
tggttatgaaagaatatatt

SEQ ID NO: 4047956 - DNA, 13 bp, Homo sapiens
tggttcataaatg

SEQ ID NO: 4047957 - DNA, 16 bp, Homo sapiens
tggttcattaattcta

SEQ ID NO: 4047958 - DNA, 15 bp, Homo sapiens
tggttcccaataaaa

SEQ ID NO: 4047959 - DNA, 11 bp, Homo sapiens
tggttcccctg

SEQ ID NO: 4047960 - DNA, 18 bp, Homo sapiens
tggttcccctgttcactc

SEQ ID NO: 4047961 - DNA, 13 bp, Homo sapiens
tggttcctctgct

SEQ ID NO: 4047962 - DNA, 18 bp, Homo sapiens
tggttcgatacctggagc

SEQ ID NO: 4047963 - DNA, 21 bp, Homo sapiens
tggttcttggtagagattcat

SEQ ID NO: 4047964 - DNA, 15 bp, Homo sapiens
tggttgatggaaaat

SEQ ID NO: 4047965 - DNA, 21 bp, Homo sapiens
tggttgatggaaaataaacat

SEQ ID NO: 4047966 - DNA, 21 bp, Homo sapiens
tggttggccgtggtccagctc

SEQ ID NO: 4047967 - DNA, 17 bp, Homo sapiens
tggttggttttatttgt

SEQ ID NO: 4047968 - DNA, 14 bp, Homo sapiens
tggttgtgtctttt

SEQ ID NO: 4047969 - DNA, 20 bp, Homo sapiens
tggtttaaaaatacatgttc

SEQ ID NO: 4047970 - DNA, 17 bp, Homo sapiens
tggtttaattcagcaga

SEQ ID NO: 4047971 - DNA, 20 bp, Homo sapiens
tggtttacaggccctgctcc

SEQ ID NO: 4047972 - DNA, 13 bp, Homo sapiens
tggtttacattta

SEQ ID NO: 4047973 - DNA, 20 bp, Homo sapiens
tggtttacatttaaagcatt

SEQ ID NO: 4047974 - DNA, 20 bp, Homo sapiens
tggtttatttgttgttttct

SEQ ID NO: 4047975 - DNA, 16 bp, Homo sapiens
tggtttatttttgtaa

SEQ ID NO: 4047976 - DNA, 21 bp, Homo sapiens
tggtttccacgatgaaaaact

SEQ ID NO: 4047977 - DNA, 15 bp, Homo sapiens
tggtttcctgcccag

SEQ ID NO: 4047978 - DNA, 21 bp, Homo sapiens
tggtttcctgcccagcctggg

SEQ ID NO: 4047979 - DNA, 21 bp, Homo sapiens
tggtttctctctacagtgcca

SEQ ID NO: 4047980 - DNA, 23 bp, Homo sapiens
tggtttgcaacctctttgctcaa

SEQ ID NO: 4047981 - DNA, 20 bp, Homo sapiens
tggtttggcatggtgagtgt

SEQ ID NO: 4047982 - DNA, 15 bp, Homo sapiens
tggcccatctcagcc

SEQ ID NO: 4047983 - DNA, 16 bp, Homo sapiens
tggcccatctcagcct

SEQ ID NO: 4047984 - DNA, 17 bp, Homo sapiens
tggccccagcctgggcc

SEQ ID NO: 4047985 - DNA, 12 bp, Homo sapiens
tggccccaggac

SEQ ID NO: 4047986 - DNA, 20 bp, Homo sapiens
tggccccaggacctggctgc

SEQ ID NO: 4047987 - DNA, 19 bp, Homo sapiens
tggccccaggccccagaca

SEQ ID NO: 4047988 - DNA, 14 bp, Homo sapiens
tggccccagggcac

SEQ ID NO: 4047989 - DNA, 15 bp, Homo sapiens
tggccccatcccagt

SEQ ID NO: 4047990 - DNA, 18 bp, Homo sapiens
tggccccatcccagttgg

SEQ ID NO: 4047991 - DNA, 15 bp, Homo sapiens
tggccccctccgtga

SEQ ID NO: 4047992 - DNA, 10 bp, Homo sapiens
tggcccctct

SEQ ID NO: 4047993 - DNA, 16 bp, Homo sapiens
tggcccctctgacctg

SEQ ID NO: 4047994 - DNA, 15 bp, Homo sapiens
tggcccgacagcctg

SEQ ID NO: 4047995 - DNA, 19 bp, Homo sapiens
tggcccgacagcctggcac

SEQ ID NO: 4047996 - DNA, 14 bp, Homo sapiens
tggcccggatgctg

SEQ ID NO: 4047997 - DNA, 17 bp, Homo sapiens
tggcccggatgctgctt

SEQ ID NO: 4047998 - DNA, 16 bp, Homo sapiens
tggcccggccggcctg

SEQ ID NO: 4047999 - DNA, 21 bp, Homo sapiens
tggcccggccggcctggcacc

SEQ ID NO: 4048000 - DNA, 12 bp, Homo sapiens
tggccctgcctc

SEQ ID NO: 4048001 - DNA, 21 bp, Homo sapiens
tggccctgcctcctgggaaga

SEQ ID NO: 4048002 - DNA, 17 bp, Homo sapiens
tggccctggctctgctg

SEQ ID NO: 4048003 - DNA, 17 bp, Homo sapiens
tggcccttacacactca

SEQ ID NO: 4048004 - DNA, 19 bp, Homo sapiens
tggcccttacacactcagg

SEQ ID NO: 4048005 - DNA, 19 bp, Homo sapiens
tggcccttcccactggagg

SEQ ID NO: 4048006 - DNA, 22 bp, Homo sapiens
tggcccttgcagttcagcacca

SEQ ID NO: 4048007 - DNA, 18 bp, Homo sapiens
tggccgagggtcctggct

SEQ ID NO: 4048008 - DNA, 20 bp, Homo sapiens
tggccggcggctactctgga

SEQ ID NO: 4048009 - DNA, 17 bp, Homo sapiens
tggccgggtgcggtggc

SEQ ID NO: 4048010 - DNA, 17 bp, Homo sapiens
tggccgtctcctccctc

SEQ ID NO: 4048011 - DNA, 17 bp, Homo sapiens
tggccgtggatgcgcag

SEQ ID NO: 4048012 - DNA, 18 bp, Homo sapiens
tggccgtggtccagctct

SEQ ID NO: 4048013 - DNA, 23 bp, Homo sapiens
tggccgtggtccagctcttggcc

SEQ ID NO: 4048014 - DNA, 18 bp, Homo sapiens
tggcctaaaactggcctg

SEQ ID NO: 4048015 - DNA, 12 bp, Homo sapiens
tggcctcagccc

SEQ ID NO: 4048016 - DNA, 13 bp, Homo sapiens
tggcctcagccct

SEQ ID NO: 4048017 - DNA, 13 bp, Homo sapiens
tggcctcagctgc

SEQ ID NO: 4048018 - DNA, 17 bp, Homo sapiens
tggcctcagctgcctca

SEQ ID NO: 4048019 - DNA, 13 bp, Homo sapiens
tggcctcccaaag

SEQ ID NO: 4048020 - DNA, 20 bp, Homo sapiens
tggcctcccaaagtgctgag

SEQ ID NO: 4048021 - DNA, 19 bp, Homo sapiens
tggcctcgggacacctgcc

SEQ ID NO: 4048022 - DNA, 23 bp, Homo sapiens
tggcctcgggacacctgccctgc

SEQ ID NO: 4048023 - DNA, 17 bp, Homo sapiens
tggcctcttgagcagtg

SEQ ID NO: 4048024 - DNA, 19 bp, Homo sapiens
tggcctcttgagcagtggc

SEQ ID NO: 4048025 - DNA, 20 bp, Homo sapiens
tggcctgaaccacaggagag

SEQ ID NO: 4048026 - DNA, 12 bp, Homo sapiens
tggcctgaggtc

SEQ ID NO: 4048027 - DNA, 22 bp, Homo sapiens
tggcctgctaaggctcctcctt

SEQ ID NO: 4048028 - DNA, 12 bp, Homo sapiens
tggcctgctgtg

SEQ ID NO: 4048029 - DNA, 19 bp, Homo sapiens
tggcctggagggactttta

SEQ ID NO: 4048030 - DNA, 12 bp, Homo sapiens
tggcctggccag

SEQ ID NO: 4048031 - DNA, 22 bp, Homo sapiens
tggcctgtgcgatcccacccgt

SEQ ID NO: 4048032 - DNA, 15 bp, Homo sapiens
tggccttaatttcct

SEQ ID NO: 4048033 - DNA, 14 bp, Homo sapiens
tggcctttccttcc

SEQ ID NO: 4048034 - DNA, 15 bp, Homo sapiens
tggcctttccttccc

SEQ ID NO: 4048035 - DNA, 16 bp, Homo sapiens
tggcctttccttccct

SEQ ID NO: 4048036 - DNA, 17 bp, Homo sapiens
tggcctttccttccctc

SEQ ID NO: 4048037 - DNA, 21 bp, Homo sapiens
tggcctttgcttatgaatatt

SEQ ID NO: 4048038 - DNA, 14 bp, Homo sapiens
tggcgcaggtgggc

SEQ ID NO: 4048039 - DNA, 16 bp, Homo sapiens
tggcgcaggtgggctg

SEQ ID NO: 4048040 - DNA, 17 bp, Homo sapiens
tggcgtgggagccagcc

SEQ ID NO: 4048041 - DNA, 14 bp, Homo sapiens
tggcgttgttgcat

SEQ ID NO: 4048042 - DNA, 18 bp, Homo sapiens
tggctaaagataattgct

SEQ ID NO: 4048043 - DNA, 22 bp, Homo sapiens
tggctaaagataattgctattt

SEQ ID NO: 4048044 - DNA, 21 bp, Homo sapiens
tggctaactatatttgctttt

SEQ ID NO: 4048045 - DNA, 15 bp, Homo sapiens
tggctaattcccaga

SEQ ID NO: 4048046 - DNA, 18 bp, Homo sapiens
tggctacgcctcttctgt

SEQ ID NO: 4048047 - DNA, 19 bp, Homo sapiens
tggctacgcctcttctgtc

SEQ ID NO: 4048048 - DNA, 22 bp, Homo sapiens
tggctacgcctcttctgtccct

SEQ ID NO: 4048049 - DNA, 22 bp, Homo sapiens
tggctactttggtttctgtctg

SEQ ID NO: 4048050 - DNA, 21 bp, Homo sapiens
tggctagagtcctcactccca

SEQ ID NO: 4048051 - DNA, 13 bp, Homo sapiens
tggctataaatat

SEQ ID NO: 4048052 - DNA, 14 bp, Homo sapiens
tggctatggccacc

SEQ ID NO: 4048053 - DNA, 15 bp, Homo sapiens
tggctatttaaaact

SEQ ID NO: 4048054 - DNA, 24 bp, Homo sapiens
tggctcacagtacagcatgtgcct

SEQ ID NO: 4048055 - DNA, 18 bp, Homo sapiens
tggctcagagcttgaaga

SEQ ID NO: 4048056 - DNA, 12 bp, Homo sapiens
tggctcagccag

SEQ ID NO: 4048057 - DNA, 21 bp, Homo sapiens
tggctcagggtcaaagacaga

SEQ ID NO: 4048058 - DNA, 23 bp, Homo sapiens
tggctccacacacacaaaaaaag

SEQ ID NO: 4048059 - DNA, 13 bp, Homo sapiens
tggctccactctt

SEQ ID NO: 4048060 - DNA, 20 bp, Homo sapiens
tggctccactcttgatctct

SEQ ID NO: 4048061 - DNA, 13 bp, Homo sapiens
tggctccagcctg

SEQ ID NO: 4048062 - DNA, 15 bp, Homo sapiens
tggctccagcctgga

SEQ ID NO: 4048063 - DNA, 17 bp, Homo sapiens
tggctcccacaggccct

SEQ ID NO: 4048064 - DNA, 20 bp, Homo sapiens
tggctcccatgaccatactg

SEQ ID NO: 4048065 - DNA, 17 bp, Homo sapiens
tggctccccctccccag

SEQ ID NO: 4048066 - DNA, 18 bp, Homo sapiens
tggctccccctccccagg

SEQ ID NO: 4048067 - DNA, 20 bp, Homo sapiens
tggctccccctccccaggct

SEQ ID NO: 4048068 - DNA, 15 bp, Homo sapiens
tggctccctcctcca

SEQ ID NO: 4048069 - DNA, 19 bp, Homo sapiens
tggctccctcctccaggcc

SEQ ID NO: 4048070 - DNA, 20 bp, Homo sapiens
tggctccctcctccaggcct

SEQ ID NO: 4048071 - DNA, 21 bp, Homo sapiens
tggctccctcctccaggcctg

SEQ ID NO: 4048072 - DNA, 18 bp, Homo sapiens
tggctcctcccggtgccc

SEQ ID NO: 4048073 - DNA, 20 bp, Homo sapiens
tggctcctgaggggcatctg

SEQ ID NO: 4048074 - DNA, 21 bp, Homo sapiens
tggctcctgaggggcatctgc

SEQ ID NO: 4048075 - DNA, 17 bp, Homo sapiens
tggctccttcccatcgc

SEQ ID NO: 4048076 - DNA, 15 bp, Homo sapiens
tggctcctttacaaa

SEQ ID NO: 4048077 - DNA, 21 bp, Homo sapiens
tggctctaccttcctgtccct

SEQ ID NO: 4048078 - DNA, 14 bp, Homo sapiens
tggctctgacaaga

SEQ ID NO: 4048079 - DNA, 20 bp, Homo sapiens
tggctctgaggtgcctgtcc

SEQ ID NO: 4048080 - DNA, 21 bp, Homo sapiens
tggctctgaggtgcctgtccc

SEQ ID NO: 4048081 - DNA, 16 bp, Homo sapiens
tggagagtcagatctt

SEQ ID NO: 4048082 - DNA, 15 bp, Homo sapiens
tggagagtttcctga

SEQ ID NO: 4048083 - DNA, 20 bp, Homo sapiens
tggatttataaatgctattt

SEQ ID NO: 4048084 - DNA, 13 bp, Homo sapiens
tggatttcagaag

SEQ ID NO: 4048085 - DNA, 13 bp, Homo sapiens
tggatttgaagca

SEQ ID NO: 4048086 - DNA, 13 bp, Homo sapiens
tggatttgacatt

SEQ ID NO: 4048087 - DNA, 21 bp, Homo sapiens
tggatttgattcattttcctg

SEQ ID NO: 4048088 - DNA, 19 bp, Homo sapiens
tggattttctattgttact

SEQ ID NO: 4048089 - DNA, 20 bp, Homo sapiens
tggattttctattgttactc

SEQ ID NO: 4048090 - DNA, 17 bp, Homo sapiens
tggattttttattatta

SEQ ID NO: 4048091 - DNA, 17 bp, Homo sapiens
tggcaaacgctaaagag

SEQ ID NO: 4048092 - DNA, 18 bp, Homo sapiens
tggcaaagcttttagaaa

SEQ ID NO: 4048093 - DNA, 19 bp, Homo sapiens
tggcaaagtttaaatgtat

SEQ ID NO: 4048094 - DNA, 16 bp, Homo sapiens
tggcaacagatctgga

SEQ ID NO: 4048095 - DNA, 20 bp, Homo sapiens
tggcaacagatctggaacct

SEQ ID NO: 4048096 - DNA, 19 bp, Homo sapiens
tggcaacaggacagagttc

SEQ ID NO: 4048097 - DNA, 17 bp, Homo sapiens
tggcaagagtgtggagg

SEQ ID NO: 4048098 - DNA, 19 bp, Homo sapiens
tggcaatgcttaaactaaa

SEQ ID NO: 4048099 - DNA, 18 bp, Homo sapiens
tggcaattgtctatttat

SEQ ID NO: 4048100 - DNA, 23 bp, Homo sapiens
tggcacaatggctaattcccaga

SEQ ID NO: 4048101 - DNA, 21 bp, Homo sapiens
tggcacaggagtgtcctcttc

SEQ ID NO: 4048102 - DNA, 17 bp, Homo sapiens
tggcaccagacacccag

SEQ ID NO: 4048103 - DNA, 20 bp, Homo sapiens
tggcaccagacacccaggac

SEQ ID NO: 4048104 - DNA, 23 bp, Homo sapiens
tggcaccagacacccaggactta

SEQ ID NO: 4048105 - DNA, 21 bp, Homo sapiens
tggcacccaccgtggaggagg

SEQ ID NO: 4048106 - DNA, 14 bp, Homo sapiens
tggcacctgcacac

SEQ ID NO: 4048107 - DNA, 13 bp, Homo sapiens
tggcacctgtctg

SEQ ID NO: 4048108 - DNA, 18 bp, Homo sapiens
tggcacctgtctgctcca

SEQ ID NO: 4048109 - DNA, 19 bp, Homo sapiens
tggcacctgtctgctccag

SEQ ID NO: 4048110 - DNA, 21 bp, Homo sapiens
tggcacctgtctgctccagct

SEQ ID NO: 4048111 - DNA, 23 bp, Homo sapiens
tggcacctgtctgctccagctct

SEQ ID NO: 4048112 - DNA, 19 bp, Homo sapiens
tggcacggtggctcaggcc

SEQ ID NO: 4048113 - DNA, 15 bp, Homo sapiens
tggcactcaactctg

SEQ ID NO: 4048114 - DNA, 15 bp, Homo sapiens
tggcactggatgcag

SEQ ID NO: 4048115 - DNA, 22 bp, Homo sapiens
tggcactggtaggttgggacac

SEQ ID NO: 4048116 - DNA, 19 bp, Homo sapiens
tggcactttttcgtgtgga

SEQ ID NO: 4048117 - DNA, 13 bp, Homo sapiens
tggcagaagacac

SEQ ID NO: 4048118 - DNA, 21 bp, Homo sapiens
tggcagaagacaccagagcag

SEQ ID NO: 4048119 - DNA, 19 bp, Homo sapiens
tggcagaagggaattgctc

SEQ ID NO: 4048120 - DNA, 21 bp, Homo sapiens
tggcagaagggaattgctcag

SEQ ID NO: 4048121 - DNA, 20 bp, Homo sapiens
tggcagaataatctttgggt

SEQ ID NO: 4048122 - DNA, 14 bp, Homo sapiens
tggcagacaaacag

SEQ ID NO: 4048123 - DNA, 22 bp, Homo sapiens
tggcagacaaacagaccataaa

SEQ ID NO: 4048124 - DNA, 21 bp, Homo sapiens
tggcagacagccgtttgttct

SEQ ID NO: 4048125 - DNA, 18 bp, Homo sapiens
tggcagagagagagaaag

SEQ ID NO: 4048126 - DNA, 15 bp, Homo sapiens
tggcagatgcagctc

SEQ ID NO: 4048127 - DNA, 13 bp, Homo sapiens
tggcagattttac

SEQ ID NO: 4048128 - DNA, 16 bp, Homo sapiens
tggcagattttacaaa

SEQ ID NO: 4048129 - DNA, 17 bp, Homo sapiens
tggcagattttacaaaa

SEQ ID NO: 4048130 - DNA, 22 bp, Homo sapiens
tggcagattttacaaaagatgt

SEQ ID NO: 4048131 - DNA, 14 bp, Homo sapiens
tggcagcccactgc

SEQ ID NO: 4048132 - DNA, 21 bp, Homo sapiens
tggcagcctcccatccagggc

SEQ ID NO: 4048133 - DNA, 14 bp, Homo sapiens
tggcagctagtgcc

SEQ ID NO: 4048134 - DNA, 16 bp, Homo sapiens
tggcagctagtgcctt

SEQ ID NO: 4048135 - DNA, 22 bp, Homo sapiens
tggcagctctggacagccccac

SEQ ID NO: 4048136 - DNA, 17 bp, Homo sapiens
tggcagctgtttctcat

SEQ ID NO: 4048137 - DNA, 21 bp, Homo sapiens
tggcagctgtttctcatgaag

SEQ ID NO: 4048138 - DNA, 20 bp, Homo sapiens
tggcaggcacacagcagccc

SEQ ID NO: 4048139 - DNA, 22 bp, Homo sapiens
tggcaggcacacagcagccccc

SEQ ID NO: 4048140 - DNA, 21 bp, Homo sapiens
tggcaggcaggggccctgcag

SEQ ID NO: 4048141 - DNA, 21 bp, Homo sapiens
tggcagggctggccccagggc

SEQ ID NO: 4048142 - DNA, 23 bp, Homo sapiens
tggcagggggccccgccagggct

SEQ ID NO: 4048143 - DNA, 12 bp, Homo sapiens
tggcagtggagg

SEQ ID NO: 4048144 - DNA, 11 bp, Homo sapiens
tggcagtgttt

SEQ ID NO: 4048145 - DNA, 18 bp, Homo sapiens
tggcagtgttttggttca

SEQ ID NO: 4048146 - DNA, 19 bp, Homo sapiens
tggcatcaaccaccatgga

SEQ ID NO: 4048147 - DNA, 20 bp, Homo sapiens
tggcatctttgccttgggct

SEQ ID NO: 4048148 - DNA, 23 bp, Homo sapiens
tggcatctttgccttgggctgct

SEQ ID NO: 4048149 - DNA, 19 bp, Homo sapiens
tggccaaacatcagacctg

SEQ ID NO: 4048150 - DNA, 23 bp, Homo sapiens
tggccaaacatcagacctgtctt

SEQ ID NO: 4048151 - DNA, 11 bp, Homo sapiens
tggccacagca

SEQ ID NO: 4048152 - DNA, 22 bp, Homo sapiens
tggccacatttaatatcttcag

SEQ ID NO: 4048153 - DNA, 19 bp, Homo sapiens
tggccacccgttctgctgg

SEQ ID NO: 4048154 - DNA, 17 bp, Homo sapiens
tggccactccagacccc

SEQ ID NO: 4048155 - DNA, 21 bp, Homo sapiens
tggccacttgggtcttccctg

SEQ ID NO: 4048156 - DNA, 12 bp, Homo sapiens
tggccagacaca

SEQ ID NO: 4048157 - DNA, 18 bp, Homo sapiens
tggccagacacaggccct

SEQ ID NO: 4048158 - DNA, 23 bp, Homo sapiens
tggccagagagcctggtgctgct

SEQ ID NO: 4048159 - DNA, 16 bp, Homo sapiens
tggccagcaaggcagg

SEQ ID NO: 4048160 - DNA, 22 bp, Homo sapiens
tggccagccgggagcttggctc

SEQ ID NO: 4048161 - DNA, 22 bp, Homo sapiens
tggccaggagctcttcaggcct

SEQ ID NO: 4048162 - DNA, 23 bp, Homo sapiens
tggccaggagctcttcaggcctc

SEQ ID NO: 4048163 - DNA, 14 bp, Homo sapiens
tggccaggatggag

SEQ ID NO: 4048164 - DNA, 16 bp, Homo sapiens
tggccaggcactgcct

SEQ ID NO: 4048165 - DNA, 17 bp, Homo sapiens
tggccaggcagatctgt

SEQ ID NO: 4048166 - DNA, 19 bp, Homo sapiens
tggccaggcagatctgtgc

SEQ ID NO: 4048167 - DNA, 12 bp, Homo sapiens
tggccaggccct

SEQ ID NO: 4048168 - DNA, 12 bp, Homo sapiens
tggccagggtga

SEQ ID NO: 4048169 - DNA, 16 bp, Homo sapiens
tggccaggtggccact

SEQ ID NO: 4048170 - DNA, 22 bp, Homo sapiens
tggccagtaaaatactattgcc

SEQ ID NO: 4048171 - DNA, 16 bp, Homo sapiens
tggccagttatccctt

SEQ ID NO: 4048172 - DNA, 12 bp, Homo sapiens
tggccatccctg

SEQ ID NO: 4048173 - DNA, 21 bp, Homo sapiens
tggccatccctgggcccctcc

SEQ ID NO: 4048174 - DNA, 22 bp, Homo sapiens
tggccatccctgggcccctcca

SEQ ID NO: 4048175 - DNA, 15 bp, Homo sapiens
tggccatggggccct

SEQ ID NO: 4048176 - DNA, 19 bp, Homo sapiens
tggccatggggccctccca

SEQ ID NO: 4048177 - DNA, 14 bp, Homo sapiens
tggcccaccgtggc

SEQ ID NO: 4048178 - DNA, 20 bp, Homo sapiens
tggcccacgcctgtaatccc

SEQ ID NO: 4048179 - DNA, 22 bp, Homo sapiens
tggcccagccaaaccctgtctg

SEQ ID NO: 4048180 - DNA, 18 bp, Homo sapiens
tggcccagggcccagagc

SEQ ID NO: 4048181 - DNA, 20 bp, Homo sapiens
tggcccagggcccagagccc

SEQ ID NO: 4048182 - DNA, 21 bp, Homo sapiens
tggcccagggcccagagccca

SEQ ID NO: 4048183 - DNA, 23 bp, Homo sapiens
tggcccagggcccagagcccagc

SEQ ID NO: 4048184 - DNA, 19 bp, Homo sapiens
tgctgggaccagagccaga

SEQ ID NO: 4048185 - DNA, 18 bp, Homo sapiens
tgctgggaggagggagag

SEQ ID NO: 4048186 - DNA, 14 bp, Homo sapiens
tgctgggatttcca

SEQ ID NO: 4048187 - DNA, 16 bp, Homo sapiens
tgctgggatttccaac

SEQ ID NO: 4048188 - DNA, 20 bp, Homo sapiens
tgctgggccactggggactt

SEQ ID NO: 4048189 - DNA, 16 bp, Homo sapiens
tgctgggcctctgcct

SEQ ID NO: 4048190 - DNA, 20 bp, Homo sapiens
tgctgggggaatgagcccag

SEQ ID NO: 4048191 - DNA, 22 bp, Homo sapiens
tgctgggggaatgagcccagag

SEQ ID NO: 4048192 - DNA, 14 bp, Homo sapiens
tgctgggtgcctcc

SEQ ID NO: 4048193 - DNA, 16 bp, Homo sapiens
tgctgggtgcctccca

SEQ ID NO: 4048194 - DNA, 18 bp, Homo sapiens
tgctgggtgcctcccaca

SEQ ID NO: 4048195 - DNA, 19 bp, Homo sapiens
tgctggtaacagtggctgc

SEQ ID NO: 4048196 - DNA, 16 bp, Homo sapiens
tgctggtcacagcctc

SEQ ID NO: 4048197 - DNA, 17 bp, Homo sapiens
tgctggtcacagcctcc

SEQ ID NO: 4048198 - DNA, 19 bp, Homo sapiens
tgctggtcacagcctcctc

SEQ ID NO: 4048199 - DNA, 20 bp, Homo sapiens
tgctggtcacagcctcctct

SEQ ID NO: 4048200 - DNA, 19 bp, Homo sapiens
tgctggtggaaagcgattc

SEQ ID NO: 4048201 - DNA, 22 bp, Homo sapiens
tgctggtgggcttgtcatagcc

SEQ ID NO: 4048202 - DNA, 23 bp, Homo sapiens
tgctggttgtcatttttgcagta

SEQ ID NO: 4048203 - DNA, 15 bp, Homo sapiens
tgctggttttcctaa

SEQ ID NO: 4048204 - DNA, 13 bp, Homo sapiens
tgctggttttcta

SEQ ID NO: 4048205 - DNA, 15 bp, Homo sapiens
tgctgtaaaagcaag

SEQ ID NO: 4048206 - DNA, 17 bp, Homo sapiens
tgctgtaacttaaaata

SEQ ID NO: 4048207 - DNA, 17 bp, Homo sapiens
tgctgtacatctatttt

SEQ ID NO: 4048208 - DNA, 21 bp, Homo sapiens
tgctgtacatctattttggat

SEQ ID NO: 4048209 - DNA, 17 bp, Homo sapiens
tgctgtacccagatgcc

SEQ ID NO: 4048210 - DNA, 21 bp, Homo sapiens
tgctgtatatttgtgatagca

SEQ ID NO: 4048211 - DNA, 15 bp, Homo sapiens
tgctgtattcccata

SEQ ID NO: 4048212 - DNA, 20 bp, Homo sapiens
tgctgtcaagttcctttggg

SEQ ID NO: 4048213 - DNA, 22 bp, Homo sapiens
tgctgtcatgaaatcagcaaga

SEQ ID NO: 4048214 - DNA, 20 bp, Homo sapiens
tgctgtcattgcttcttctg

SEQ ID NO: 4048215 - DNA, 14 bp, Homo sapiens
tgctgtctctgctc

SEQ ID NO: 4048216 - DNA, 15 bp, Homo sapiens
tgctgtctctgctcg

SEQ ID NO: 4048217 - DNA, 16 bp, Homo sapiens
tgctgtctctgctcgc

SEQ ID NO: 4048218 - DNA, 21 bp, Homo sapiens
tgctgtgaaccctggggcctg

SEQ ID NO: 4048219 - DNA, 22 bp, Homo sapiens
tgctgtgacaataagtttgaac

SEQ ID NO: 4048220 - DNA, 19 bp, Homo sapiens
tgctgtgaccatttataat

SEQ ID NO: 4048221 - DNA, 17 bp, Homo sapiens
tgctgtgaggctgtcct

SEQ ID NO: 4048222 - DNA, 23 bp, Homo sapiens
tgctgtgagggaggggaaaagca

SEQ ID NO: 4048223 - DNA, 20 bp, Homo sapiens
tgctgtgatacgatgcttca

SEQ ID NO: 4048224 - DNA, 19 bp, Homo sapiens
tgctgtgccatgctgggcc

SEQ ID NO: 4048225 - DNA, 23 bp, Homo sapiens
tgctgtgccatgctgggccactg

SEQ ID NO: 4048226 - DNA, 17 bp, Homo sapiens
tgctgtggccagggtga

SEQ ID NO: 4048227 - DNA, 13 bp, Homo sapiens
tgctgtgggcagc

SEQ ID NO: 4048228 - DNA, 11 bp, Homo sapiens
tgctgtgtgcc

SEQ ID NO: 4048229 - DNA, 11 bp, Homo sapiens
tgctgtgttaa

SEQ ID NO: 4048230 - DNA, 18 bp, Homo sapiens
tgctgtgttaaataaacc

SEQ ID NO: 4048231 - DNA, 16 bp, Homo sapiens
tgctgtgtttaatttg

SEQ ID NO: 4048232 - DNA, 22 bp, Homo sapiens
tgctgttagtaaatttctgtga

SEQ ID NO: 4048233 - DNA, 19 bp, Homo sapiens
tgctgttatgtctgtttaa

SEQ ID NO: 4048234 - DNA, 13 bp, Homo sapiens
tgctgttctcagg

SEQ ID NO: 4048235 - DNA, 24 bp, Homo sapiens
tgctgttctcaggacagcatccct

SEQ ID NO: 4048236 - DNA, 17 bp, Homo sapiens
tgctgtttgacacctct

SEQ ID NO: 4048237 - DNA, 18 bp, Homo sapiens
tgcttaaaaatcattgat

SEQ ID NO: 4048238 - DNA, 18 bp, Homo sapiens
tgcttaaaaggttgcata

SEQ ID NO: 4048239 - DNA, 13 bp, Homo sapiens
tgcttaaacaaag

SEQ ID NO: 4048240 - DNA, 18 bp, Homo sapiens
tgcttaaactaaataatg

SEQ ID NO: 4048241 - DNA, 13 bp, Homo sapiens
tgcttaaatcagt

SEQ ID NO: 4048242 - DNA, 21 bp, Homo sapiens
tgcttaaatcagttggagttt

SEQ ID NO: 4048243 - DNA, 22 bp, Homo sapiens
tgcttaaatttcttatgtgaca

SEQ ID NO: 4048244 - DNA, 20 bp, Homo sapiens
tgcttaattacaatatttct

SEQ ID NO: 4048245 - DNA, 14 bp, Homo sapiens
tgcttaatttctaa

SEQ ID NO: 4048246 - DNA, 15 bp, Homo sapiens
tgcttaatttctaaa

SEQ ID NO: 4048247 - DNA, 19 bp, Homo sapiens
tgcttaatttctaaagata

SEQ ID NO: 4048248 - DNA, 18 bp, Homo sapiens
tgcttacatttttacaat

SEQ ID NO: 4048249 - DNA, 20 bp, Homo sapiens
tgcttacatttttacaataa

SEQ ID NO: 4048250 - DNA, 16 bp, Homo sapiens
tgcttagctgccttga

SEQ ID NO: 4048251 - DNA, 14 bp, Homo sapiens
tgcttaggatgttt

SEQ ID NO: 4048252 - DNA, 23 bp, Homo sapiens
tgcttaggatgtttttcatgaaa

SEQ ID NO: 4048253 - DNA, 21 bp, Homo sapiens
tgcttagtatctcatcaacaa

SEQ ID NO: 4048254 - DNA, 20 bp, Homo sapiens
tgcttagtgtacttggagta

SEQ ID NO: 4048255 - DNA, 16 bp, Homo sapiens
tgcttagttggctttg

SEQ ID NO: 4048256 - DNA, 23 bp, Homo sapiens
tgcttagttggctttgcccaccc

SEQ ID NO: 4048257 - DNA, 19 bp, Homo sapiens
tgcttataataaagaaaac

SEQ ID NO: 4048258 - DNA, 19 bp, Homo sapiens
tgcttatgaatatttataa

SEQ ID NO: 4048259 - DNA, 16 bp, Homo sapiens
tgcttattgttccaag

SEQ ID NO: 4048260 - DNA, 16 bp, Homo sapiens
tgcttcaagagaaaat

SEQ ID NO: 4048261 - DNA, 16 bp, Homo sapiens
tgcttcaaggcttcca

SEQ ID NO: 4048262 - DNA, 16 bp, Homo sapiens
tgcttcaattaataaa

SEQ ID NO: 4048263 - DNA, 20 bp, Homo sapiens
tgcttcagatattattgctt

SEQ ID NO: 4048264 - DNA, 21 bp, Homo sapiens
tgcttcatagtattggagcac

SEQ ID NO: 4048265 - DNA, 15 bp, Homo sapiens
tgcttccaatcttgc

SEQ ID NO: 4048266 - DNA, 18 bp, Homo sapiens
tgcttccaatcttgcttt

SEQ ID NO: 4048267 - DNA, 12 bp, Homo sapiens
tgcttccagaaa

SEQ ID NO: 4048268 - DNA, 13 bp, Homo sapiens
tgcttccagaaac

SEQ ID NO: 4048269 - DNA, 19 bp, Homo sapiens
tgcttccaggaaactccac

SEQ ID NO: 4048270 - DNA, 14 bp, Homo sapiens
tgcttcccagaggg

SEQ ID NO: 4048271 - DNA, 15 bp, Homo sapiens
tgcttcccagaggga

SEQ ID NO: 4048272 - DNA, 16 bp, Homo sapiens
tgcttcccctccagga

SEQ ID NO: 4048273 - DNA, 22 bp, Homo sapiens
tgcttccggtagggaggcagcc

SEQ ID NO: 4048274 - DNA, 16 bp, Homo sapiens
tgcttcctgatgctgg

SEQ ID NO: 4048275 - DNA, 15 bp, Homo sapiens
tgcttctcaggctat

SEQ ID NO: 4048276 - DNA, 14 bp, Homo sapiens
tgcttctctacaga

SEQ ID NO: 4048277 - DNA, 23 bp, Homo sapiens
tgcttctctagctctctaggcct

SEQ ID NO: 4048278 - DNA, 14 bp, Homo sapiens
tgcttctctccttg

SEQ ID NO: 4048279 - DNA, 15 bp, Homo sapiens
tgaaccagctcatct

SEQ ID NO: 4048280 - DNA, 20 bp, Homo sapiens
tgaaccagctcatctccaag

SEQ ID NO: 4048281 - DNA, 22 bp, Homo sapiens
tgaaccatccacttacatatat

SEQ ID NO: 4048282 - DNA, 14 bp, Homo sapiens
tgaacccaagagca

SEQ ID NO: 4048283 - DNA, 22 bp, Homo sapiens
tgaacccaggacgcttctgaat

SEQ ID NO: 4048284 - DNA, 20 bp, Homo sapiens
tgaacccccgccatccttca

SEQ ID NO: 4048285 - DNA, 15 bp, Homo sapiens
tgaaccctggggcct

SEQ ID NO: 4048286 - DNA, 12 bp, Homo sapiens
tgaacctgccct

SEQ ID NO: 4048287 - DNA, 21 bp, Homo sapiens
tgaacctttttttttgaaaca

SEQ ID NO: 4048288 - DNA, 16 bp, Homo sapiens
tgaacgttattatatt

SEQ ID NO: 4048289 - DNA, 17 bp, Homo sapiens
tgaactcaactttgaca

SEQ ID NO: 4048290 - DNA, 13 bp, Homo sapiens
tgaactcaagctg

SEQ ID NO: 4048291 - DNA, 14 bp, Homo sapiens
tgaactcaagctgc

SEQ ID NO: 4048292 - DNA, 15 bp, Homo sapiens
tgaactcaagctgcg

SEQ ID NO: 4048293 - DNA, 18 bp, Homo sapiens
tgaactcaagctgcgttt

SEQ ID NO: 4048294 - DNA, 15 bp, Homo sapiens
tgaactcaccctggg

SEQ ID NO: 4048295 - DNA, 19 bp, Homo sapiens
tgaactcaccctgggagcc

SEQ ID NO: 4048296 - DNA, 21 bp, Homo sapiens
tgaactcaccctgggagccag

SEQ ID NO: 4048297 - DNA, 18 bp, Homo sapiens
tgaactcactttcctcct

SEQ ID NO: 4048298 - DNA, 20 bp, Homo sapiens
tgaactcactttcctcctga

SEQ ID NO: 4048299 - DNA, 18 bp, Homo sapiens
tgaactcagatctgtctg

SEQ ID NO: 4048300 - DNA, 23 bp, Homo sapiens
tgaactctcaaaagtctattttt

SEQ ID NO: 4048301 - DNA, 20 bp, Homo sapiens
tgaactctggtgctcctgca

SEQ ID NO: 4048302 - DNA, 19 bp, Homo sapiens
tgaactctgttcccccacc

SEQ ID NO: 4048303 - DNA, 22 bp, Homo sapiens
tgaactcttagtgattgagact

SEQ ID NO: 4048304 - DNA, 19 bp, Homo sapiens
tgaactcttctgcaaaaat

SEQ ID NO: 4048305 - DNA, 12 bp, Homo sapiens
tgaactgaagtt

SEQ ID NO: 4048306 - DNA, 17 bp, Homo sapiens
tgaactgaagtttcaca

SEQ ID NO: 4048307 - DNA, 17 bp, Homo sapiens
tgaacttgactgggtga

SEQ ID NO: 4048308 - DNA, 12 bp, Homo sapiens
tgaacttttgta

SEQ ID NO: 4048309 - DNA, 13 bp, Homo sapiens
tgaacttttgtac

SEQ ID NO: 4048310 - DNA, 14 bp, Homo sapiens
tgaacttttgtact

SEQ ID NO: 4048311 - DNA, 13 bp, Homo sapiens
tgaactttttgta

SEQ ID NO: 4048312 - DNA, 13 bp, Homo sapiens
tgaagaaaaaatc

SEQ ID NO: 4048313 - DNA, 14 bp, Homo sapiens
tgaagaaaaaatca

SEQ ID NO: 4048314 - DNA, 20 bp, Homo sapiens
tgaagaaaaaatcagaacta

SEQ ID NO: 4048315 - DNA, 14 bp, Homo sapiens
tgaagaacatgtga

SEQ ID NO: 4048316 - DNA, 19 bp, Homo sapiens
tgaagaaccagtcccccca

SEQ ID NO: 4048317 - DNA, 20 bp, Homo sapiens
tgaagaaccagtccccccac

SEQ ID NO: 4048318 - DNA, 16 bp, Homo sapiens
tgaagaaccctctgtc

SEQ ID NO: 4048319 - DNA, 17 bp, Homo sapiens
tgaagaactagcatata

SEQ ID NO: 4048320 - DNA, 11 bp, Homo sapiens
tgaagaaggtg

SEQ ID NO: 4048321 - DNA, 18 bp, Homo sapiens
tgaagaaggtggaccttt

SEQ ID NO: 4048322 - DNA, 21 bp, Homo sapiens
tgaagaaggtggaccttttaa

SEQ ID NO: 4048323 - DNA, 18 bp, Homo sapiens
tgaagaatagaaacaagc

SEQ ID NO: 4048324 - DNA, 22 bp, Homo sapiens
tgaagaatatttaagaaaagca

SEQ ID NO: 4048325 - DNA, 22 bp, Homo sapiens
tgaagaatgcacaagaatggat

SEQ ID NO: 4048326 - DNA, 17 bp, Homo sapiens
tgaagaattaagataca

SEQ ID NO: 4048327 - DNA, 18 bp, Homo sapiens
tgaagaattgccaatctt

SEQ ID NO: 4048328 - DNA, 12 bp, Homo sapiens
tgaagacaatta

SEQ ID NO: 4048329 - DNA, 20 bp, Homo sapiens
tgaagacaatttgatacata

SEQ ID NO: 4048330 - DNA, 14 bp, Homo sapiens
tgaagacaggatgg

SEQ ID NO: 4048331 - DNA, 18 bp, Homo sapiens
tgaagacatttctgctct

SEQ ID NO: 4048332 - DNA, 20 bp, Homo sapiens
tgaagaccacatccacacac

SEQ ID NO: 4048333 - DNA, 18 bp, Homo sapiens
tgaagaccagagcagttt

SEQ ID NO: 4048334 - DNA, 14 bp, Homo sapiens
tgaagacctaaagt

SEQ ID NO: 4048335 - DNA, 17 bp, Homo sapiens
tgaagacctaaccaggg

SEQ ID NO: 4048336 - DNA, 19 bp, Homo sapiens
tgaagacctaaccagggcc

SEQ ID NO: 4048337 - DNA, 15 bp, Homo sapiens
tgaagactccagaaa

SEQ ID NO: 4048338 - DNA, 14 bp, Homo sapiens
tgaagactgaggac

SEQ ID NO: 4048339 - DNA, 23 bp, Homo sapiens
tgaagagcaagagagcagcaagg

SEQ ID NO: 4048340 - DNA, 20 bp, Homo sapiens
tgaagagcgagactctgtct

SEQ ID NO: 4048341 - DNA, 13 bp, Homo sapiens
tgccaccaggaga

SEQ ID NO: 4048342 - DNA, 14 bp, Homo sapiens
tgccaccaggagaa

SEQ ID NO: 4048343 - DNA, 15 bp, Homo sapiens
tgccaccatcctgct

SEQ ID NO: 4048344 - DNA, 21 bp, Homo sapiens
tgccaccatgtattcatccag

SEQ ID NO: 4048345 - DNA, 12 bp, Homo sapiens
tgccacccactc

SEQ ID NO: 4048346 - DNA, 17 bp, Homo sapiens
tgccacccactcaggat

SEQ ID NO: 4048347 - DNA, 16 bp, Homo sapiens
tgccacccctgtccag

SEQ ID NO: 4048348 - DNA, 12 bp, Homo sapiens
tgccaccctcac

SEQ ID NO: 4048349 - DNA, 15 bp, Homo sapiens
tgccaccctcacaca

SEQ ID NO: 4048350 - DNA, 21 bp, Homo sapiens
tgccaccctcacacacacagc

SEQ ID NO: 4048351 - DNA, 13 bp, Homo sapiens
tgccacctggcaa

SEQ ID NO: 4048352 - DNA, 20 bp, Homo sapiens
tgccacgtggtcactgtgca

SEQ ID NO: 4048353 - DNA, 15 bp, Homo sapiens
tgccacgttccacag

SEQ ID NO: 4048354 - DNA, 18 bp, Homo sapiens
tgccactgcccgagctgg

SEQ ID NO: 4048355 - DNA, 16 bp, Homo sapiens
tgccactgcctgcacc

SEQ ID NO: 4048356 - DNA, 16 bp, Homo sapiens
tgcccccagccccggg

SEQ ID NO: 4048357 - DNA, 17 bp, Homo sapiens
tgccccccacccctgga

SEQ ID NO: 4048358 - DNA, 14 bp, Homo sapiens
tgccccccagcctc

SEQ ID NO: 4048359 - DNA, 15 bp, Homo sapiens
tgccccccagcctct

SEQ ID NO: 4048360 - DNA, 21 bp, Homo sapiens
tgcccccggccccctggtctc

SEQ ID NO: 4048361 - DNA, 14 bp, Homo sapiens
tgccccctcacctc

SEQ ID NO: 4048362 - DNA, 16 bp, Homo sapiens
tgccccctcacctctc

SEQ ID NO: 4048363 - DNA, 14 bp, Homo sapiens
tgccccctctcact

SEQ ID NO: 4048364 - DNA, 13 bp, Homo sapiens
tgccccctgctgg

SEQ ID NO: 4048365 - DNA, 14 bp, Homo sapiens
tgccccctgctggc

SEQ ID NO: 4048366 - DNA, 22 bp, Homo sapiens
tgccccctgctggctcttctgc

SEQ ID NO: 4048367 - DNA, 17 bp, Homo sapiens
tgccccgctttgcggac

SEQ ID NO: 4048368 - DNA, 20 bp, Homo sapiens
tgccccgtctacagctcccc

SEQ ID NO: 4048369 - DNA, 17 bp, Homo sapiens
tgcccctaatctctgta

SEQ ID NO: 4048370 - DNA, 22 bp, Homo sapiens
tgcccctcccccaacccccacc

SEQ ID NO: 4048371 - DNA, 13 bp, Homo sapiens
tgcccctcccttc

SEQ ID NO: 4048372 - DNA, 14 bp, Homo sapiens
tgcccctctcacca

SEQ ID NO: 4048373 - DNA, 13 bp, Homo sapiens
tgcccctgcagtt

SEQ ID NO: 4048374 - DNA, 23 bp, Homo sapiens
tgcccctgcagttggcagaaagg

SEQ ID NO: 4048375 - DNA, 17 bp, Homo sapiens
tgcccctggacctggga

SEQ ID NO: 4048376 - DNA, 17 bp, Homo sapiens
tgcccctggcccatctc

SEQ ID NO: 4048377 - DNA, 21 bp, Homo sapiens
tgcccctggcccatctcagcc

SEQ ID NO: 4048378 - DNA, 19 bp, Homo sapiens
tgcccctggctttgcctct

SEQ ID NO: 4048379 - DNA, 22 bp, Homo sapiens
tgccccttaaacacaggctgtc

SEQ ID NO: 4048380 - DNA, 18 bp, Homo sapiens
tgcccctttctcttttcc

SEQ ID NO: 4048381 - DNA, 20 bp, Homo sapiens
tgcccgagctggtgcattac

SEQ ID NO: 4048382 - DNA, 21 bp, Homo sapiens
tgcccgccagtgcacagggaa

SEQ ID NO: 4048383 - DNA, 20 bp, Homo sapiens
tgcccggctaatttttgtaa

SEQ ID NO: 4048384 - DNA, 19 bp, Homo sapiens
tgcccgggcgcggccagcc

SEQ ID NO: 4048385 - DNA, 15 bp, Homo sapiens
tgccctaagccccca

SEQ ID NO: 4048386 - DNA, 18 bp, Homo sapiens
tgccctaagcccccaggg

SEQ ID NO: 4048387 - DNA, 21 bp, Homo sapiens
tgccctaagcccccagggcct

SEQ ID NO: 4048388 - DNA, 17 bp, Homo sapiens
tgccctcatggcccctc

SEQ ID NO: 4048389 - DNA, 21 bp, Homo sapiens
tgccctcatggcccctctgac

SEQ ID NO: 4048390 - DNA, 23 bp, Homo sapiens
tgccctcatggcccctctgacct

SEQ ID NO: 4048391 - DNA, 19 bp, Homo sapiens
tgccctcattactgggcct

SEQ ID NO: 4048392 - DNA, 19 bp, Homo sapiens
tgccctccttgtccaccca

SEQ ID NO: 4048393 - DNA, 22 bp, Homo sapiens
tgccctccttgtccacccacct

SEQ ID NO: 4048394 - DNA, 14 bp, Homo sapiens
tgccctcgctgctt

SEQ ID NO: 4048395 - DNA, 15 bp, Homo sapiens
tgccctcgctgcttc

SEQ ID NO: 4048396 - DNA, 21 bp, Homo sapiens
tgccctctctgagtctggact

SEQ ID NO: 4048397 - DNA, 23 bp, Homo sapiens
tgccctgagtggatctccaagga

SEQ ID NO: 4048398 - DNA, 16 bp, Homo sapiens
tgccctgctttgcaaa

SEQ ID NO: 4048399 - DNA, 23 bp, Homo sapiens
tgccctggcagggtcatcctgtg

SEQ ID NO: 4048400 - DNA, 16 bp, Homo sapiens
tgccctggctgctgcc

SEQ ID NO: 4048401 - DNA, 18 bp, Homo sapiens
tgccctggctgctgcccc

SEQ ID NO: 4048402 - DNA, 21 bp, Homo sapiens
tgccctggtgaatcacctggc

SEQ ID NO: 4048403 - DNA, 18 bp, Homo sapiens
tgccctggtgctgccaca

SEQ ID NO: 4048404 - DNA, 13 bp, Homo sapiens
tgccctgtgtact

SEQ ID NO: 4048405 - DNA, 20 bp, Homo sapiens
tgccctgtgtacttcccggg

SEQ ID NO: 4048406 - DNA, 20 bp, Homo sapiens
tgccctgttgtgtatagatg

SEQ ID NO: 4048407 - DNA, 11 bp, Homo sapiens
tgcccttccct

SEQ ID NO: 4048408 - DNA, 14 bp, Homo sapiens
tgcccttccctctg

SEQ ID NO: 4048409 - DNA, 16 bp, Homo sapiens
tgcccttccctctggg

SEQ ID NO: 4048410 - DNA, 20 bp, Homo sapiens
tgcccttctcaagactttag

SEQ ID NO: 4048411 - DNA, 14 bp, Homo sapiens
tgccctttggggtc

SEQ ID NO: 4048412 - DNA, 22 bp, Homo sapiens
tgccgaatgtgcaggtttgtta

SEQ ID NO: 4048413 - DNA, 16 bp, Homo sapiens
tgccgagcccttgccc

SEQ ID NO: 4048414 - DNA, 14 bp, Homo sapiens
tgccgaggaccctc

SEQ ID NO: 4048415 - DNA, 18 bp, Homo sapiens
tgccgcagacgggcacag

SEQ ID NO: 4048416 - DNA, 21 bp, Homo sapiens
tgccgcaggtgggtgctgccc

SEQ ID NO: 4048417 - DNA, 23 bp, Homo sapiens
tgccgcaggtgggtgctgccctg

SEQ ID NO: 4048418 - DNA, 15 bp, Homo sapiens
tgccgctacctccct

SEQ ID NO: 4048419 - DNA, 16 bp, Homo sapiens
tgccgctacctccctc

SEQ ID NO: 4048420 - DNA, 17 bp, Homo sapiens
tgccgctacctccctcc

SEQ ID NO: 4048421 - DNA, 18 bp, Homo sapiens
tgccgctgccgctgcacc

SEQ ID NO: 4048422 - DNA, 19 bp, Homo sapiens
tgccgctgtataaagcatg

SEQ ID NO: 4048423 - DNA, 19 bp, Homo sapiens
tgccggtcgggcagccagc

SEQ ID NO: 4048424 - DNA, 23 bp, Homo sapiens
tgccgtagggagtacctgctgcc

SEQ ID NO: 4048425 - DNA, 22 bp, Homo sapiens
tgccgtggattgcacgtggcct

SEQ ID NO: 4048426 - DNA, 23 bp, Homo sapiens
tgccgtgggcctgtcgtgccagt

SEQ ID NO: 4048427 - DNA, 20 bp, Homo sapiens
tgccgtgtgagtgtgacagg

SEQ ID NO: 4048428 - DNA, 21 bp, Homo sapiens
tgccgtgtgagtgtgacaggg

SEQ ID NO: 4048429 - DNA, 22 bp, Homo sapiens
tgcctaagtccagtgtttcttt

SEQ ID NO: 4048430 - DNA, 19 bp, Homo sapiens
tgcctacaaccatccctgc

SEQ ID NO: 4048431 - DNA, 21 bp, Homo sapiens
tgcctacaaccatccctgcca

SEQ ID NO: 4048432 - DNA, 14 bp, Homo sapiens
tgcctacagccagg

SEQ ID NO: 4048433 - DNA, 22 bp, Homo sapiens
tgcctagacttcccaacagcct

SEQ ID NO: 4048434 - DNA, 21 bp, Homo sapiens
tgcctagattaggtagacttt

SEQ ID NO: 4048435 - DNA, 20 bp, Homo sapiens
tgcctagcaagctggcctct

SEQ ID NO: 4048436 - DNA, 21 bp, Homo sapiens
tgcctagcagagtgctggcac

SEQ ID NO: 4048437 - DNA, 16 bp, Homo sapiens
tgcctatattatcata

SEQ ID NO: 4048438 - DNA, 17 bp, Homo sapiens
tgcctatttgtgtggac

SEQ ID NO: 4048439 - DNA, 18 bp, Homo sapiens
tgcctcaatgtgaccagg

SEQ ID NO: 4048440 - DNA, 22 bp, Homo sapiens
tgcctcagacgttgcctgagaa

SEQ ID NO: 4048441 - DNA, 11 bp, Homo sapiens
tgcctcagcct

SEQ ID NO: 4048442 - DNA, 18 bp, Homo sapiens
tgcctcccacacttgctg

SEQ ID NO: 4048443 - DNA, 16 bp, Homo sapiens
tgcctcccaggttcca

SEQ ID NO: 4048444 - DNA, 20 bp, Homo sapiens
tgcctccccatttcccatct

SEQ ID NO: 4048445 - DNA, 18 bp, Homo sapiens
tgcctcctgcctgcccct

SEQ ID NO: 4048446 - DNA, 13 bp, Homo sapiens
tgcctcctgtggg

SEQ ID NO: 4048447 - DNA, 14 bp, Homo sapiens
tgcctcctgtgggg

SEQ ID NO: 4048448 - DNA, 17 bp, Homo sapiens
tgcctccttccacctcc

SEQ ID NO: 4048449 - DNA, 19 bp, Homo sapiens
tgcctccttccacctccct

SEQ ID NO: 4048450 - DNA, 17 bp, Homo sapiens
tgcctcgaaacacagaa

SEQ ID NO: 4048451 - DNA, 23 bp, Homo sapiens
tgcctcgaaacacagaaaccttt

SEQ ID NO: 4048452 - DNA, 19 bp, Homo sapiens
tgcctctaccagttggcag

SEQ ID NO: 4048453 - DNA, 13 bp, Homo sapiens
tgcctctgcagtc

SEQ ID NO: 4048454 - DNA, 14 bp, Homo sapiens
tgcctctgcagtct

SEQ ID NO: 4048455 - DNA, 24 bp, Homo sapiens
tgcctctgcagtctcatttctcat

SEQ ID NO: 4048456 - DNA, 21 bp, Homo sapiens
tgcctctgccaaaggatgtga

SEQ ID NO: 4048457 - DNA, 13 bp, Homo sapiens
tgcctctgccctg

SEQ ID NO: 4048458 - DNA, 16 bp, Homo sapiens
tgcggtagccagcaca

SEQ ID NO: 4048459 - DNA, 19 bp, Homo sapiens
tgcggtcaggctgggcagc

SEQ ID NO: 4048460 - DNA, 22 bp, Homo sapiens
tgcggtcaggctgggcagcccc

SEQ ID NO: 4048461 - DNA, 16 bp, Homo sapiens
tgcgtcctcctcacct

SEQ ID NO: 4048462 - DNA, 18 bp, Homo sapiens
tgcgtgccgtgtgagtgt

SEQ ID NO: 4048463 - DNA, 19 bp, Homo sapiens
tgcgtgccgtgtgagtgtg

SEQ ID NO: 4048464 - DNA, 19 bp, Homo sapiens
tgcgtgtcaatttccctca

SEQ ID NO: 4048465 - DNA, 20 bp, Homo sapiens
tgcgtgtgtagagttaagaa

SEQ ID NO: 4048466 - DNA, 24 bp, Homo sapiens
tgcgtgtgtagagttaagaagctg

SEQ ID NO: 4048467 - DNA, 13 bp, Homo sapiens
tgcgttttggaag

SEQ ID NO: 4048468 - DNA, 20 bp, Homo sapiens
tgctaaatggtcgcccagga

SEQ ID NO: 4048469 - DNA, 16 bp, Homo sapiens
tgctaaattctatgtt

SEQ ID NO: 4048470 - DNA, 22 bp, Homo sapiens
tgctaacaaagacaaaagtctg

SEQ ID NO: 4048471 - DNA, 16 bp, Homo sapiens
tgctaacatctaaaaa

SEQ ID NO: 4048472 - DNA, 19 bp, Homo sapiens
tgctaaggctcctccttgc

SEQ ID NO: 4048473 - DNA, 16 bp, Homo sapiens
tgctaatttaaagaga

SEQ ID NO: 4048474 - DNA, 17 bp, Homo sapiens
tgctaatttaaagagac

SEQ ID NO: 4048475 - DNA, 17 bp, Homo sapiens
tgctaattttctcaaaa

SEQ ID NO: 4048476 - DNA, 13 bp, Homo sapiens
tgctacaacttca

SEQ ID NO: 4048477 - DNA, 15 bp, Homo sapiens
tgctaccgccctggg

SEQ ID NO: 4048478 - DNA, 16 bp, Homo sapiens
tgctaccgccctgggc

SEQ ID NO: 4048479 - DNA, 15 bp, Homo sapiens
tgctaccgttgactt

SEQ ID NO: 4048480 - DNA, 18 bp, Homo sapiens
tgctaccgttgacttcca

SEQ ID NO: 4048481 - DNA, 14 bp, Homo sapiens
tgctactgattgtt

SEQ ID NO: 4048482 - DNA, 21 bp, Homo sapiens
tgctactgcactccagcctgg

SEQ ID NO: 4048483 - DNA, 22 bp, Homo sapiens
tgctacttaattcctttctcat

SEQ ID NO: 4048484 - DNA, 14 bp, Homo sapiens
tgctagaaaatcga

SEQ ID NO: 4048485 - DNA, 21 bp, Homo sapiens
tgctagaaaatttagcccttt

SEQ ID NO: 4048486 - DNA, 23 bp, Homo sapiens
tgctagaaagttagggggttctt

SEQ ID NO: 4048487 - DNA, 19 bp, Homo sapiens
tgctagactctagacaaga

SEQ ID NO: 4048488 - DNA, 17 bp, Homo sapiens
tgctaggcgagtgccag

SEQ ID NO: 4048489 - DNA, 22 bp, Homo sapiens
tgctaggcgagtgccaggactc

SEQ ID NO: 4048490 - DNA, 17 bp, Homo sapiens
tgctagtatttgaatta

SEQ ID NO: 4048491 - DNA, 19 bp, Homo sapiens
tgctagtgggccctctctc

SEQ ID NO: 4048492 - DNA, 16 bp, Homo sapiens
tgctagttttacagat

SEQ ID NO: 4048493 - DNA, 19 bp, Homo sapiens
tgctataggctggagaagc

SEQ ID NO: 4048494 - DNA, 20 bp, Homo sapiens
tgctataggctggagaagct

SEQ ID NO: 4048495 - DNA, 21 bp, Homo sapiens
tgctatatataaaacggtgct

SEQ ID NO: 4048496 - DNA, 14 bp, Homo sapiens
tgctatcacacagt

SEQ ID NO: 4048497 - DNA, 19 bp, Homo sapiens
tgctatccccatctccctg

SEQ ID NO: 4048498 - DNA, 20 bp, Homo sapiens
tgctatgcgggttgattatt

SEQ ID NO: 4048499 - DNA, 16 bp, Homo sapiens
tgctatggatggcttc

SEQ ID NO: 4048500 - DNA, 18 bp, Homo sapiens
tgctatgttactattttc

SEQ ID NO: 4048501 - DNA, 20 bp, Homo sapiens
tgctattggaggatcagttt

SEQ ID NO: 4048502 - DNA, 13 bp, Homo sapiens
tgctattgtaaat

SEQ ID NO: 4048503 - DNA, 15 bp, Homo sapiens
tgctattgtaaatat

SEQ ID NO: 4048504 - DNA, 16 bp, Homo sapiens
tgctattgtaaatatg

SEQ ID NO: 4048505 - DNA, 20 bp, Homo sapiens
tgctatttatttttacaaga

SEQ ID NO: 4048506 - DNA, 14 bp, Homo sapiens
tgctcaaagaaatc

SEQ ID NO: 4048507 - DNA, 15 bp, Homo sapiens
tgctcaaagaaatct

SEQ ID NO: 4048508 - DNA, 21 bp, Homo sapiens
tgctcaaatctattcagacaa

SEQ ID NO: 4048509 - DNA, 15 bp, Homo sapiens
tgctcaaccactgtg

SEQ ID NO: 4048510 - DNA, 14 bp, Homo sapiens
tgctcaccacctgc

SEQ ID NO: 4048511 - DNA, 17 bp, Homo sapiens
tgctcaccacctgcctc

SEQ ID NO: 4048512 - DNA, 18 bp, Homo sapiens
tgctcaccacctgcctct

SEQ ID NO: 4048513 - DNA, 15 bp, Homo sapiens
tgctcactttaaacc

SEQ ID NO: 4048514 - DNA, 14 bp, Homo sapiens
tgctcactttatta

SEQ ID NO: 4048515 - DNA, 16 bp, Homo sapiens
tgctcagaacttgctg

SEQ ID NO: 4048516 - DNA, 21 bp, Homo sapiens
tgctcagaacttgctgctgtc

SEQ ID NO: 4048517 - DNA, 13 bp, Homo sapiens
tgctcagcatgat

SEQ ID NO: 4048518 - DNA, 16 bp, Homo sapiens
tgctcatctgttgtag

SEQ ID NO: 4048519 - DNA, 17 bp, Homo sapiens
tgctcattatgccactt

SEQ ID NO: 4048520 - DNA, 14 bp, Homo sapiens
tgctcattcttgag

SEQ ID NO: 4048521 - DNA, 17 bp, Homo sapiens
tgctcattcttgaggag

SEQ ID NO: 4048522 - DNA, 20 bp, Homo sapiens
tgctcattcttgaggagcat

SEQ ID NO: 4048523 - DNA, 22 bp, Homo sapiens
tgctcattcttgaggagcatta

SEQ ID NO: 4048524 - DNA, 22 bp, Homo sapiens
tgctccaagggaccctttgcct

SEQ ID NO: 4048525 - DNA, 15 bp, Homo sapiens
tgctccaccacatcc

SEQ ID NO: 4048526 - DNA, 18 bp, Homo sapiens
tgctccaccagcagcatg

SEQ ID NO: 4048527 - DNA, 16 bp, Homo sapiens
tgctccacccttggcc

SEQ ID NO: 4048528 - DNA, 18 bp, Homo sapiens
tgctccacccttggcctg

SEQ ID NO: 4048529 - DNA, 21 bp, Homo sapiens
tgctccacgaagccttaagcc

SEQ ID NO: 4048530 - DNA, 16 bp, Homo sapiens
tgctccagaagatgcc

SEQ ID NO: 4048531 - DNA, 22 bp, Homo sapiens
tgctccagaagatgccagcttc

SEQ ID NO: 4048532 - DNA, 19 bp, Homo sapiens
tgctccagctctggcatgg

SEQ ID NO: 4048533 - DNA, 16 bp, Homo sapiens
tgctccaggcctgcag

SEQ ID NO: 4048534 - DNA, 18 bp, Homo sapiens
tgctccaggcctgcagca

SEQ ID NO: 4048535 - DNA, 20 bp, Homo sapiens
tgctccaggcctgcagcagg

SEQ ID NO: 4048536 - DNA, 17 bp, Homo sapiens
tgctccataccttttct

SEQ ID NO: 4048537 - DNA, 20 bp, Homo sapiens
tgctccataccttttctctt

SEQ ID NO: 4048538 - DNA, 17 bp, Homo sapiens
tgctcccatcattcctt

SEQ ID NO: 4048539 - DNA, 19 bp, Homo sapiens
tgctcccattcctccctcc

SEQ ID NO: 4048540 - DNA, 11 bp, Homo sapiens
tgctccccaca

SEQ ID NO: 4048541 - DNA, 20 bp, Homo sapiens
tgctccccacagcgtccctg

SEQ ID NO: 4048542 - DNA, 21 bp, Homo sapiens
tgctccccacagcgtccctgg

SEQ ID NO: 4048543 - DNA, 17 bp, Homo sapiens
tgctccccagccctggc

SEQ ID NO: 4048544 - DNA, 21 bp, Homo sapiens
tgctccctaccccagggccct

SEQ ID NO: 4048545 - DNA, 23 bp, Homo sapiens
tgctccctaccccagggccctgg

SEQ ID NO: 4048546 - DNA, 12 bp, Homo sapiens
tgctccctcagc

SEQ ID NO: 4048547 - DNA, 19 bp, Homo sapiens
tgctccctcagcctcagag

SEQ ID NO: 4048548 - DNA, 21 bp, Homo sapiens
tgctccctcagcctcagagga

SEQ ID NO: 4048549 - DNA, 18 bp, Homo sapiens
tcttcctttctctttctc

SEQ ID NO: 4048550 - DNA, 14 bp, Homo sapiens
tcttcgctggacta

SEQ ID NO: 4048551 - DNA, 18 bp, Homo sapiens
tcttcgctggactattgt

SEQ ID NO: 4048552 - DNA, 21 bp, Homo sapiens
tcttcgctggactattgtgcc

SEQ ID NO: 4048553 - DNA, 16 bp, Homo sapiens
tcttcgtccttttggt

SEQ ID NO: 4048554 - DNA, 14 bp, Homo sapiens
tcttctaaattaaa

SEQ ID NO: 4048555 - DNA, 18 bp, Homo sapiens
tcttctaacccaactgac

SEQ ID NO: 4048556 - DNA, 13 bp, Homo sapiens
tcttctaattatt

SEQ ID NO: 4048557 - DNA, 20 bp, Homo sapiens
tcttctaatttcaaaaatat

SEQ ID NO: 4048558 - DNA, 17 bp, Homo sapiens
tcttctacaaccagagc

SEQ ID NO: 4048559 - DNA, 18 bp, Homo sapiens
tcttctcaaaaaataatt

SEQ ID NO: 4048560 - DNA, 22 bp, Homo sapiens
tcttctcaaaaaataattagtt

SEQ ID NO: 4048561 - DNA, 12 bp, Homo sapiens
tcttctccactg

SEQ ID NO: 4048562 - DNA, 16 bp, Homo sapiens
tcttctccactggatg

SEQ ID NO: 4048563 - DNA, 14 bp, Homo sapiens
tcttctccagattt

SEQ ID NO: 4048564 - DNA, 14 bp, Homo sapiens
tcttctcctttcac

SEQ ID NO: 4048565 - DNA, 23 bp, Homo sapiens
tcttctcggctcaggctctgctg

SEQ ID NO: 4048566 - DNA, 16 bp, Homo sapiens
tcttctgaagattctt

SEQ ID NO: 4048567 - DNA, 17 bp, Homo sapiens
tcttctgcaacatttga

SEQ ID NO: 4048568 - DNA, 21 bp, Homo sapiens
tcttctgcaacatttgacaaa

SEQ ID NO: 4048569 - DNA, 17 bp, Homo sapiens
tcttctgcaagcctcat

SEQ ID NO: 4048570 - DNA, 11 bp, Homo sapiens
tcttctgccct

SEQ ID NO: 4048571 - DNA, 11 bp, Homo sapiens
tcttctgctcc

SEQ ID NO: 4048572 - DNA, 16 bp, Homo sapiens
tcttctgctccaccct

SEQ ID NO: 4048573 - DNA, 12 bp, Homo sapiens
tcttctggaatg

SEQ ID NO: 4048574 - DNA, 12 bp, Homo sapiens
tcttctggctca

SEQ ID NO: 4048575 - DNA, 11 bp, Homo sapiens
tcttctgggca

SEQ ID NO: 4048576 - DNA, 19 bp, Homo sapiens
tcttctggtgttgactgga

SEQ ID NO: 4048577 - DNA, 19 bp, Homo sapiens
tcttctgtatttctaggca

SEQ ID NO: 4048578 - DNA, 12 bp, Homo sapiens
tcttctgtccaa

SEQ ID NO: 4048579 - DNA, 21 bp, Homo sapiens
tcttctgtgaaatataattgt

SEQ ID NO: 4048580 - DNA, 15 bp, Homo sapiens
tcttcttacatgcat

SEQ ID NO: 4048581 - DNA, 13 bp, Homo sapiens
tcttcttcaaata

SEQ ID NO: 4048582 - DNA, 14 bp, Homo sapiens
tcttcttcaaatac

SEQ ID NO: 4048583 - DNA, 14 bp, Homo sapiens
tcttcttcagaaga

SEQ ID NO: 4048584 - DNA, 23 bp, Homo sapiens
tcttcttcatccaacttccaaga

SEQ ID NO: 4048585 - DNA, 16 bp, Homo sapiens
tcttctttaagccata

SEQ ID NO: 4048586 - DNA, 20 bp, Homo sapiens
tcttctttgtgcctttggcc

SEQ ID NO: 4048587 - DNA, 12 bp, Homo sapiens
tcttgaaaagtt

SEQ ID NO: 4048588 - DNA, 15 bp, Homo sapiens
tcttgaaaagttcag

SEQ ID NO: 4048589 - DNA, 14 bp, Homo sapiens
tcttgaaattaaga

SEQ ID NO: 4048590 - DNA, 14 bp, Homo sapiens
tcttgaagtactta

SEQ ID NO: 4048591 - DNA, 11 bp, Homo sapiens
tcttgaatgtg

SEQ ID NO: 4048592 - DNA, 15 bp, Homo sapiens
tcttgaatttctgac

SEQ ID NO: 4048593 - DNA, 19 bp, Homo sapiens
tcttgacattcaaggcatt

SEQ ID NO: 4048594 - DNA, 14 bp, Homo sapiens
tcttgactttctga

SEQ ID NO: 4048595 - DNA, 14 bp, Homo sapiens
tcttgagcagtggc

SEQ ID NO: 4048596 - DNA, 22 bp, Homo sapiens
tcttgaggagcattaaggtatt

SEQ ID NO: 4048597 - DNA, 19 bp, Homo sapiens
tcttgagtataagaaatgc

SEQ ID NO: 4048598 - DNA, 21 bp, Homo sapiens
tcttgagtataagaaatgcat

SEQ ID NO: 4048599 - DNA, 21 bp, Homo sapiens
tcttgatacccccctctgtct

SEQ ID NO: 4048600 - DNA, 12 bp, Homo sapiens
tcttgatgtgaa

SEQ ID NO: 4048601 - DNA, 23 bp, Homo sapiens
tcttgattatccatattgagtca

SEQ ID NO: 4048602 - DNA, 13 bp, Homo sapiens
tcttgattcctgg

SEQ ID NO: 4048603 - DNA, 14 bp, Homo sapiens
tcttgattcctggt

SEQ ID NO: 4048604 - DNA, 17 bp, Homo sapiens
tcttgcaacttcagttt

SEQ ID NO: 4048605 - DNA, 23 bp, Homo sapiens
tcttgcaccccaaagctttcctg

SEQ ID NO: 4048606 - DNA, 19 bp, Homo sapiens
tcttgcagattctatttcc

SEQ ID NO: 4048607 - DNA, 15 bp, Homo sapiens
tcttgcattcatttt

SEQ ID NO: 4048608 - DNA, 14 bp, Homo sapiens
tctctgccccaccc

SEQ ID NO: 4048609 - DNA, 22 bp, Homo sapiens
tctctgccccacccaagcccaa

SEQ ID NO: 4048610 - DNA, 19 bp, Homo sapiens
tctctgcctttgacattta

SEQ ID NO: 4048611 - DNA, 13 bp, Homo sapiens
tctctgctccacc

SEQ ID NO: 4048612 - DNA, 14 bp, Homo sapiens
tctctgctggccca

SEQ ID NO: 4048613 - DNA, 16 bp, Homo sapiens
tctctgctggcccagc

SEQ ID NO: 4048614 - DNA, 21 bp, Homo sapiens
tctctgggcttggggcttcct

SEQ ID NO: 4048615 - DNA, 17 bp, Homo sapiens
tctctggggcagatccc

SEQ ID NO: 4048616 - DNA, 22 bp, Homo sapiens
tctctggggccctgggcctcag

SEQ ID NO: 4048617 - DNA, 23 bp, Homo sapiens
tctctggggccctgggcctcagt

SEQ ID NO: 4048618 - DNA, 15 bp, Homo sapiens
tctctgtcccttgct

SEQ ID NO: 4048619 - DNA, 17 bp, Homo sapiens
tctctgtcccttgctgt

SEQ ID NO: 4048620 - DNA, 18 bp, Homo sapiens
tctctgtcccttgctgta

SEQ ID NO: 4048621 - DNA, 15 bp, Homo sapiens
tctctgtgaatacaa

SEQ ID NO: 4048622 - DNA, 22 bp, Homo sapiens
tctctgtgaatacaattaaagg

SEQ ID NO: 4048623 - DNA, 15 bp, Homo sapiens
tctctgtgctgtgga

SEQ ID NO: 4048624 - DNA, 19 bp, Homo sapiens
tctctgtgcttcaattaat

SEQ ID NO: 4048625 - DNA, 18 bp, Homo sapiens
tctcttaaatataacact

SEQ ID NO: 4048626 - DNA, 13 bp, Homo sapiens
tctcttagaaata

SEQ ID NO: 4048627 - DNA, 16 bp, Homo sapiens
tctcttagctactgta

SEQ ID NO: 4048628 - DNA, 21 bp, Homo sapiens
tctcttaggtgagacagttgc

SEQ ID NO: 4048629 - DNA, 18 bp, Homo sapiens
tctcttatagaatattta

SEQ ID NO: 4048630 - DNA, 20 bp, Homo sapiens
tctcttatagaatatttatt

SEQ ID NO: 4048631 - DNA, 15 bp, Homo sapiens
tctcttcaggttctt

SEQ ID NO: 4048632 - DNA, 17 bp, Homo sapiens
tctcttccccttagaaa

SEQ ID NO: 4048633 - DNA, 18 bp, Homo sapiens
tctcttccccttagaaac

SEQ ID NO: 4048634 - DNA, 19 bp, Homo sapiens
tctcttccccttagaaaca

SEQ ID NO: 4048635 - DNA, 17 bp, Homo sapiens
tctcttccctgcgcctg

SEQ ID NO: 4048636 - DNA, 12 bp, Homo sapiens
tctcttcccttt

SEQ ID NO: 4048637 - DNA, 11 bp, Homo sapiens
tctcttcctac

SEQ ID NO: 4048638 - DNA, 21 bp, Homo sapiens
tctcttctccccttccatttc

SEQ ID NO: 4048639 - DNA, 11 bp, Homo sapiens
tctcttctcct

SEQ ID NO: 4048640 - DNA, 13 bp, Homo sapiens
tctcttctcctta

SEQ ID NO: 4048641 - DNA, 14 bp, Homo sapiens
tctcttctgctcca

SEQ ID NO: 4048642 - DNA, 16 bp, Homo sapiens
tctcttctgctccacc

SEQ ID NO: 4048643 - DNA, 12 bp, Homo sapiens
tctcttgcttgt

SEQ ID NO: 4048644 - DNA, 23 bp, Homo sapiens
tctcttgggaactgaactcactt

SEQ ID NO: 4048645 - DNA, 20 bp, Homo sapiens
tctcttgtcctcttctgctc

SEQ ID NO: 4048646 - DNA, 18 bp, Homo sapiens
tctctttaaaaggaaaga

SEQ ID NO: 4048647 - DNA, 21 bp, Homo sapiens
tctctttaagggcatgccttg

SEQ ID NO: 4048648 - DNA, 22 bp, Homo sapiens
tctctttaagggcatgccttgt

SEQ ID NO: 4048649 - DNA, 16 bp, Homo sapiens
tctctttatacagctg

SEQ ID NO: 4048650 - DNA, 17 bp, Homo sapiens
tctctttatacagctgt

SEQ ID NO: 4048651 - DNA, 17 bp, Homo sapiens
tctctttctctcttccc

SEQ ID NO: 4048652 - DNA, 13 bp, Homo sapiens
tctgaaaatataa

SEQ ID NO: 4048653 - DNA, 16 bp, Homo sapiens
tctgaaacccacagat

SEQ ID NO: 4048654 - DNA, 23 bp, Homo sapiens
tctgaaacccacagatgtctctg

SEQ ID NO: 4048655 - DNA, 15 bp, Homo sapiens
tctgaaactggcttc

SEQ ID NO: 4048656 - DNA, 16 bp, Homo sapiens
tctgaaataaatgttc

SEQ ID NO: 4048657 - DNA, 21 bp, Homo sapiens
tctgaaattcacagaagccta

SEQ ID NO: 4048658 - DNA, 14 bp, Homo sapiens
tctgaaattctaaa

SEQ ID NO: 4048659 - DNA, 18 bp, Homo sapiens
tctgaacacaggcagctt

SEQ ID NO: 4048660 - DNA, 20 bp, Homo sapiens
tctgaagatatatttcactt

SEQ ID NO: 4048661 - DNA, 17 bp, Homo sapiens
tctgaagtcacatcaca

SEQ ID NO: 4048662 - DNA, 20 bp, Homo sapiens
tctgaagtcacatcacagga

SEQ ID NO: 4048663 - DNA, 23 bp, Homo sapiens
tctgaagtcacatcacaggacac

SEQ ID NO: 4048664 - DNA, 23 bp, Homo sapiens
tctgaatgttctgacattaacag

SEQ ID NO: 4048665 - DNA, 19 bp, Homo sapiens
tctgacagtccttggggtt

SEQ ID NO: 4048666 - DNA, 21 bp, Homo sapiens
tctgacatattatgcctgaat

SEQ ID NO: 4048667 - DNA, 17 bp, Homo sapiens
tctgacatgcattgttg

SEQ ID NO: 4048668 - DNA, 22 bp, Homo sapiens
tctgacattaacagttttccat

SEQ ID NO: 4048669 - DNA, 17 bp, Homo sapiens
tctggaattaaggtcaa

SEQ ID NO: 4048670 - DNA, 14 bp, Homo sapiens
tctggacactgcca

SEQ ID NO: 4048671 - DNA, 18 bp, Homo sapiens
tctggacagcagaagcct

SEQ ID NO: 4048672 - DNA, 18 bp, Homo sapiens
tctggacagccccaccct

SEQ ID NO: 4048673 - DNA, 20 bp, Homo sapiens
tctggacagccccaccctgg

SEQ ID NO: 4048674 - DNA, 17 bp, Homo sapiens
tctggacggcaggctca

SEQ ID NO: 4048675 - DNA, 22 bp, Homo sapiens
tctggacggcaggctcactgcc

SEQ ID NO: 4048676 - DNA, 19 bp, Homo sapiens
tctggactgaagcctgcag

SEQ ID NO: 4048677 - DNA, 22 bp, Homo sapiens
tctggactttgcttcccctcca

SEQ ID NO: 4048678 - DNA, 20 bp, Homo sapiens
tctggagaggttataggtca

SEQ ID NO: 4048679 - DNA, 14 bp, Homo sapiens
tctggaggaaaggg

SEQ ID NO: 4048680 - DNA, 17 bp, Homo sapiens
tctggaggacctgcccg

SEQ ID NO: 4048681 - DNA, 16 bp, Homo sapiens
tctggaggccttccag

SEQ ID NO: 4048682 - DNA, 20 bp, Homo sapiens
tctggaggccttccagctgc

SEQ ID NO: 4048683 - DNA, 21 bp, Homo sapiens
tctggagttgatctggaaccc

SEQ ID NO: 4048684 - DNA, 16 bp, Homo sapiens
tctggataggagcctg

SEQ ID NO: 4048685 - DNA, 16 bp, Homo sapiens
tctggattctgaatct

SEQ ID NO: 4048686 - DNA, 18 bp, Homo sapiens
tctggcagttctggaatg

SEQ ID NO: 4048687 - DNA, 19 bp, Homo sapiens
tctggcccttacacactca

SEQ ID NO: 4048688 - DNA, 17 bp, Homo sapiens
tctggcctaaaatcttg

SEQ ID NO: 4048689 - DNA, 14 bp, Homo sapiens
tctggcctctgctg

SEQ ID NO: 4048690 - DNA, 20 bp, Homo sapiens
tctggctgtttagcagaact

SEQ ID NO: 4048691 - DNA, 22 bp, Homo sapiens
tctggctgtttagcagaactca

SEQ ID NO: 4048692 - DNA, 18 bp, Homo sapiens
tctggcttgacagcatga

SEQ ID NO: 4048693 - DNA, 22 bp, Homo sapiens
tctggcttgggcagggtctgtt

SEQ ID NO: 4048694 - DNA, 13 bp, Homo sapiens
tctggctttccca

SEQ ID NO: 4048695 - DNA, 23 bp, Homo sapiens
tctggctttttcctctgagccca

SEQ ID NO: 4048696 - DNA, 20 bp, Homo sapiens
tctgggacctgccaggcagg

SEQ ID NO: 4048697 - DNA, 21 bp, Homo sapiens
tctgggacctgccaggcaggg

SEQ ID NO: 4048698 - DNA, 13 bp, Homo sapiens
tctgggagcagaa

SEQ ID NO: 4048699 - DNA, 18 bp, Homo sapiens
tctgggaggcaagaaaag

SEQ ID NO: 4048700 - DNA, 20 bp, Homo sapiens
tctgggaggcaagaaaagga

SEQ ID NO: 4048701 - DNA, 21 bp, Homo sapiens
tctgggatatggctgcccagg

SEQ ID NO: 4048702 - DNA, 19 bp, Homo sapiens
tctgggattctactttaag

SEQ ID NO: 4048703 - DNA, 21 bp, Homo sapiens
tctgggcacgcctgctggccg

SEQ ID NO: 4048704 - DNA, 18 bp, Homo sapiens
tctgggcattttcctcct

SEQ ID NO: 4048705 - DNA, 14 bp, Homo sapiens
tctgggcctctgac

SEQ ID NO: 4048706 - DNA, 15 bp, Homo sapiens
tctgggcctctgact

SEQ ID NO: 4048707 - DNA, 14 bp, Homo sapiens
tctgggctcaggga

SEQ ID NO: 4048708 - DNA, 22 bp, Homo sapiens
tctgggctgctacccagaaatc

SEQ ID NO: 4048709 - DNA, 21 bp, Homo sapiens
tctgggcttggggcttcctaa

SEQ ID NO: 4048710 - DNA, 13 bp, Homo sapiens
tctggggcagatc

SEQ ID NO: 4048711 - DNA, 11 bp, Homo sapiens
tctggggcagc

SEQ ID NO: 4048712 - DNA, 18 bp, Homo sapiens
tctggggcaggctgggcc

SEQ ID NO: 4048713 - DNA, 21 bp, Homo sapiens
tctggggcaggctgggccatg

SEQ ID NO: 4048714 - DNA, 20 bp, Homo sapiens
tctggggccctgggcctcag

SEQ ID NO: 4048715 - DNA, 16 bp, Homo sapiens
tctggggcctttatca

SEQ ID NO: 4048716 - DNA, 15 bp, Homo sapiens
tctgggggaaaaagc

SEQ ID NO: 4048717 - DNA, 22 bp, Homo sapiens
tctgggtgcaggagcgctccct

SEQ ID NO: 4048718 - DNA, 18 bp, Homo sapiens
tctgggtttttcttgtgg

SEQ ID NO: 4048719 - DNA, 22 bp, Homo sapiens
tctggtaatattgacttgtata

SEQ ID NO: 4048720 - DNA, 16 bp, Homo sapiens
tctggtagatagaaat

SEQ ID NO: 4048721 - DNA, 14 bp, Homo sapiens
tctcacatgtggca

SEQ ID NO: 4048722 - DNA, 21 bp, Homo sapiens
tctcaccccatcccacaccct

SEQ ID NO: 4048723 - DNA, 22 bp, Homo sapiens
tctcacgggcatgggcactccc

SEQ ID NO: 4048724 - DNA, 23 bp, Homo sapiens
tctcacgggcatgggcactccct

SEQ ID NO: 4048725 - DNA, 12 bp, Homo sapiens
tctcactcccca

SEQ ID NO: 4048726 - DNA, 13 bp, Homo sapiens
tctcactccccat

SEQ ID NO: 4048727 - DNA, 16 bp, Homo sapiens
tctcactcctacctgg

SEQ ID NO: 4048728 - DNA, 17 bp, Homo sapiens
tctcactcctacctggt

SEQ ID NO: 4048729 - DNA, 15 bp, Homo sapiens
tctcactcctaggag

SEQ ID NO: 4048730 - DNA, 18 bp, Homo sapiens
tctcactgaactccaccg

SEQ ID NO: 4048731 - DNA, 21 bp, Homo sapiens
tctcactgagaagattgtgaa

SEQ ID NO: 4048732 - DNA, 15 bp, Homo sapiens
tctcactgttctgca

SEQ ID NO: 4048733 - DNA, 14 bp, Homo sapiens
tctcagaagcacag

SEQ ID NO: 4048734 - DNA, 15 bp, Homo sapiens
tctcagaagcacaga

SEQ ID NO: 4048735 - DNA, 17 bp, Homo sapiens
tctcagaatctcaaata

SEQ ID NO: 4048736 - DNA, 13 bp, Homo sapiens
tctcagagattct

SEQ ID NO: 4048737 - DNA, 18 bp, Homo sapiens
tctcagagcatctggctg

SEQ ID NO: 4048738 - DNA, 19 bp, Homo sapiens
tctcagagcatctggctgt

SEQ ID NO: 4048739 - DNA, 17 bp, Homo sapiens
tctcagagcatgtgtca

SEQ ID NO: 4048740 - DNA, 20 bp, Homo sapiens
tctcagaggcctgctgccag

SEQ ID NO: 4048741 - DNA, 19 bp, Homo sapiens
tctcagaggctcagagact

SEQ ID NO: 4048742 - DNA, 15 bp, Homo sapiens
tctcagatgcagttt

SEQ ID NO: 4048743 - DNA, 15 bp, Homo sapiens
tctcagcacagcctg

SEQ ID NO: 4048744 - DNA, 11 bp, Homo sapiens
tctcagcctcc

SEQ ID NO: 4048745 - DNA, 13 bp, Homo sapiens
tctcagcctccca

SEQ ID NO: 4048746 - DNA, 20 bp, Homo sapiens
tctcagcctcctgagcctgt

SEQ ID NO: 4048747 - DNA, 15 bp, Homo sapiens
tctcagccttacatt

SEQ ID NO: 4048748 - DNA, 20 bp, Homo sapiens
tctcagccttacatttgtga

SEQ ID NO: 4048749 - DNA, 13 bp, Homo sapiens
tctcagctccggg

SEQ ID NO: 4048750 - DNA, 20 bp, Homo sapiens
tctcagctccgggggtgagg

SEQ ID NO: 4048751 - DNA, 16 bp, Homo sapiens
tctcaggacagcatcc

SEQ ID NO: 4048752 - DNA, 22 bp, Homo sapiens
tctcaggacagcatcccttccc

SEQ ID NO: 4048753 - DNA, 23 bp, Homo sapiens
tctcaggacagcatcccttccca

SEQ ID NO: 4048754 - DNA, 15 bp, Homo sapiens
tctcaggagcacagg

SEQ ID NO: 4048755 - DNA, 16 bp, Homo sapiens
tctcaggagcttgggc

SEQ ID NO: 4048756 - DNA, 20 bp, Homo sapiens
tctcaggatcaagaaagtgt

SEQ ID NO: 4048757 - DNA, 17 bp, Homo sapiens
tctcagggcctggcagg

SEQ ID NO: 4048758 - DNA, 19 bp, Homo sapiens
tctcagggcctggcaggcc

SEQ ID NO: 4048759 - DNA, 22 bp, Homo sapiens
tctcagggcctggcaggccagt

SEQ ID NO: 4048760 - DNA, 22 bp, Homo sapiens
tctcaggtagaaggttgacaca

SEQ ID NO: 4048761 - DNA, 19 bp, Homo sapiens
tctcagtcatgcataaata

SEQ ID NO: 4048762 - DNA, 23 bp, Homo sapiens
tctcagtcatgcataaatatgca

SEQ ID NO: 4048763 - DNA, 15 bp, Homo sapiens
tctcagtgttttgga

SEQ ID NO: 4048764 - DNA, 23 bp, Homo sapiens
tctcagtgttttggactccatct

SEQ ID NO: 4048765 - DNA, 19 bp, Homo sapiens
tctcagtttgtgtgtctta

SEQ ID NO: 4048766 - DNA, 12 bp, Homo sapiens
tctcagttttca

SEQ ID NO: 4048767 - DNA, 16 bp, Homo sapiens
tctcagttttcagcta

SEQ ID NO: 4048768 - DNA, 13 bp, Homo sapiens
tctcataaattta

SEQ ID NO: 4048769 - DNA, 24 bp, Homo sapiens
tctcatagcattaactaatctatt

SEQ ID NO: 4048770 - DNA, 16 bp, Homo sapiens
tctcataggaaaagta

SEQ ID NO: 4048771 - DNA, 21 bp, Homo sapiens
tctcataggaaaagtacattt

SEQ ID NO: 4048772 - DNA, 15 bp, Homo sapiens
tctcatcagtgtcct

SEQ ID NO: 4048773 - DNA, 14 bp, Homo sapiens
tctcatccccaggg

SEQ ID NO: 4048774 - DNA, 15 bp, Homo sapiens
tctcatccccagggg

SEQ ID NO: 4048775 - DNA, 14 bp, Homo sapiens
tctcatcctccagt

SEQ ID NO: 4048776 - DNA, 21 bp, Homo sapiens
tctcatcctccagtaccttgc

SEQ ID NO: 4048777 - DNA, 13 bp, Homo sapiens
tctcatcctcctg

SEQ ID NO: 4048778 - DNA, 15 bp, Homo sapiens
tctcatcctcctgga

SEQ ID NO: 4048779 - DNA, 14 bp, Homo sapiens
tctcatctgccggc

SEQ ID NO: 4048780 - DNA, 20 bp, Homo sapiens
tctcatgaagctaataaaat

SEQ ID NO: 4048781 - DNA, 20 bp, Homo sapiens
tctcatgtaacacataaaca

SEQ ID NO: 4048782 - DNA, 22 bp, Homo sapiens
tctcatgtaacacataaacaat

SEQ ID NO: 4048783 - DNA, 12 bp, Homo sapiens
tctcatgtcctg

SEQ ID NO: 4048784 - DNA, 21 bp, Homo sapiens
tctcatgtcctgctggcttcc

SEQ ID NO: 4048785 - DNA, 16 bp, Homo sapiens
tctcattacccacccg

SEQ ID NO: 4048786 - DNA, 12 bp, Homo sapiens
tctcattcagta

SEQ ID NO: 4048787 - DNA, 20 bp, Homo sapiens
tctcccccacccttgttcca

SEQ ID NO: 4048788 - DNA, 23 bp, Homo sapiens
tctcccccacccttgttccagtt

SEQ ID NO: 4048789 - DNA, 23 bp, Homo sapiens
tctccccctcctccagggaaggt

SEQ ID NO: 4048790 - DNA, 21 bp, Homo sapiens
tctccccttccatttctgcct

SEQ ID NO: 4048791 - DNA, 21 bp, Homo sapiens
tctcccgagcaatggcgcctg

SEQ ID NO: 4048792 - DNA, 14 bp, Homo sapiens
tctcccgcaccagg

SEQ ID NO: 4048793 - DNA, 21 bp, Homo sapiens
tctcccgcaccaggccgggct

SEQ ID NO: 4048794 - DNA, 23 bp, Homo sapiens
tctccctcaacaagggagagacc

SEQ ID NO: 4048795 - DNA, 12 bp, Homo sapiens
tctccctcccct

SEQ ID NO: 4048796 - DNA, 15 bp, Homo sapiens
tctccctgccagagg

SEQ ID NO: 4048797 - DNA, 12 bp, Homo sapiens
tctccctgcctg

SEQ ID NO: 4048798 - DNA, 13 bp, Homo sapiens
tctccctgcctgg

SEQ ID NO: 4048799 - DNA, 14 bp, Homo sapiens
tctccctgcctggc

SEQ ID NO: 4048800 - DNA, 15 bp, Homo sapiens
tctccctggctccct

SEQ ID NO: 4048801 - DNA, 14 bp, Homo sapiens
tctccctgtacagt

SEQ ID NO: 4048802 - DNA, 18 bp, Homo sapiens
tctccctgtacagtgtta

SEQ ID NO: 4048803 - DNA, 14 bp, Homo sapiens
tctccgccagcctc

SEQ ID NO: 4048804 - DNA, 20 bp, Homo sapiens
tctccgccagcctcctctgg

SEQ ID NO: 4048805 - DNA, 15 bp, Homo sapiens
tctccgggtgtggcc

SEQ ID NO: 4048806 - DNA, 17 bp, Homo sapiens
tctccgggtgtggcctc

SEQ ID NO: 4048807 - DNA, 19 bp, Homo sapiens
tctccgggtgtggcctcag

SEQ ID NO: 4048808 - DNA, 14 bp, Homo sapiens
tctccgttccatct

SEQ ID NO: 4048809 - DNA, 15 bp, Homo sapiens
tctccgttccatctg

SEQ ID NO: 4048810 - DNA, 20 bp, Homo sapiens
tctccgtttattataaactg

SEQ ID NO: 4048811 - DNA, 14 bp, Homo sapiens
tctcctcatctcca

SEQ ID NO: 4048812 - DNA, 23 bp, Homo sapiens
tctcctcccgcccttccatgtgc

SEQ ID NO: 4048813 - DNA, 14 bp, Homo sapiens
tctcctcccttcct

SEQ ID NO: 4048814 - DNA, 23 bp, Homo sapiens
tctcctcccttccttttccctgc

SEQ ID NO: 4048815 - DNA, 17 bp, Homo sapiens
tctcctctccatctcta

SEQ ID NO: 4048816 - DNA, 14 bp, Homo sapiens
tctcctctctgaga

SEQ ID NO: 4048817 - DNA, 15 bp, Homo sapiens
tctcctctctgagac

SEQ ID NO: 4048818 - DNA, 12 bp, Homo sapiens
tctcctctctgg

SEQ ID NO: 4048819 - DNA, 14 bp, Homo sapiens
tctcctctctgggc

SEQ ID NO: 4048820 - DNA, 12 bp, Homo sapiens
tctcctctggct

SEQ ID NO: 4048821 - DNA, 14 bp, Homo sapiens
tctcctgcccagat

SEQ ID NO: 4048822 - DNA, 13 bp, Homo sapiens
tctcctgccctgt

SEQ ID NO: 4048823 - DNA, 13 bp, Homo sapiens
tctcctgcctcag

SEQ ID NO: 4048824 - DNA, 17 bp, Homo sapiens
tctcctgctcaccacct

SEQ ID NO: 4048825 - DNA, 22 bp, Homo sapiens
tctcctgctcaccacctgcctc

SEQ ID NO: 4048826 - DNA, 13 bp, Homo sapiens
tctcctggaggat

SEQ ID NO: 4048827 - DNA, 12 bp, Homo sapiens
tctcctggctgg

SEQ ID NO: 4048828 - DNA, 15 bp, Homo sapiens
tctcctggctgggcc

SEQ ID NO: 4048829 - DNA, 19 bp, Homo sapiens
tctcctgggggtggcaggc

SEQ ID NO: 4048830 - DNA, 22 bp, Homo sapiens
tctcctgtcttatggtccagaa

SEQ ID NO: 4048831 - DNA, 18 bp, Homo sapiens
tctcctgtgcccacatcc

SEQ ID NO: 4048832 - DNA, 17 bp, Homo sapiens
tctcctgtttttctggg

SEQ ID NO: 4048833 - DNA, 19 bp, Homo sapiens
tctcctgtttttctgggtg

SEQ ID NO: 4048834 - DNA, 14 bp, Homo sapiens
tctccttagtcttc

SEQ ID NO: 4048835 - DNA, 16 bp, Homo sapiens
tctcctttgcactgag

SEQ ID NO: 4048836 - DNA, 17 bp, Homo sapiens
tctcctttgcactgagg

SEQ ID NO: 4048837 - DNA, 21 bp, Homo sapiens
tctcgctgtcactggctggct

SEQ ID NO: 4048838 - DNA, 19 bp, Homo sapiens
tctcggactaagcctacct

SEQ ID NO: 4048839 - DNA, 12 bp, Homo sapiens
tctcggctcagg

SEQ ID NO: 4048840 - DNA, 14 bp, Homo sapiens
tctcggctcaggct

SEQ ID NO: 4048841 - DNA, 21 bp, Homo sapiens
tctcggctcaggctctgctgg

SEQ ID NO: 4048842 - DNA, 21 bp, Homo sapiens
tctcgggtgcatttgagagaa

SEQ ID NO: 4048843 - DNA, 23 bp, Homo sapiens
tctcgttttgttgccaaagctgg

SEQ ID NO: 4048844 - DNA, 20 bp, Homo sapiens
tctctaaatcttccttgtga

SEQ ID NO: 4048845 - DNA, 17 bp, Homo sapiens
tctctaatgcttgattt

SEQ ID NO: 4048846 - DNA, 13 bp, Homo sapiens
tctctagaatttt

SEQ ID NO: 4048847 - DNA, 18 bp, Homo sapiens
tctctaggcctctccagt

SEQ ID NO: 4048848 - DNA, 19 bp, Homo sapiens
tctctaggcctctccagtt

SEQ ID NO: 4048849 - DNA, 17 bp, Homo sapiens
tctctattggaggtgag

SEQ ID NO: 4048850 - DNA, 14 bp, Homo sapiens
tctctatttaatat

SEQ ID NO: 4048851 - DNA, 21 bp, Homo sapiens
tctgcacctatgtagctctgc

SEQ ID NO: 4048852 - DNA, 14 bp, Homo sapiens
tctgcactaagaga

SEQ ID NO: 4048853 - DNA, 18 bp, Homo sapiens
tctgcactactgacatgt

SEQ ID NO: 4048854 - DNA, 19 bp, Homo sapiens
tctgcactctaaactgcaa

SEQ ID NO: 4048855 - DNA, 19 bp, Homo sapiens
tctgcagacacgccttccc

SEQ ID NO: 4048856 - DNA, 18 bp, Homo sapiens
tctgcagacttcccagct

SEQ ID NO: 4048857 - DNA, 17 bp, Homo sapiens
tctgcagcccttgggca

SEQ ID NO: 4048858 - DNA, 12 bp, Homo sapiens
tctgcagctgcc

SEQ ID NO: 4048859 - DNA, 14 bp, Homo sapiens
tctgcagctgccgg

SEQ ID NO: 4048860 - DNA, 21 bp, Homo sapiens
tctgcatagcgaaataaaaat

SEQ ID NO: 4048861 - DNA, 16 bp, Homo sapiens
tctgcatatgttgaat

SEQ ID NO: 4048862 - DNA, 18 bp, Homo sapiens
tctgcatcatctgtagat

SEQ ID NO: 4048863 - DNA, 23 bp, Homo sapiens
tctgcatcccagcacctgcctcc

SEQ ID NO: 4048864 - DNA, 17 bp, Homo sapiens
tctgcatctcctgtctt

SEQ ID NO: 4048865 - DNA, 13 bp, Homo sapiens
tctgcattatcta

SEQ ID NO: 4048866 - DNA, 22 bp, Homo sapiens
tctgcattatctatgcagcatg

SEQ ID NO: 4048867 - DNA, 16 bp, Homo sapiens
tctgcattctagtact

SEQ ID NO: 4048868 - DNA, 16 bp, Homo sapiens
tctgcattttgctatt

SEQ ID NO: 4048869 - DNA, 19 bp, Homo sapiens
tctgcattttgctattgta

SEQ ID NO: 4048870 - DNA, 22 bp, Homo sapiens
tctgcattttgctattgtaaat

SEQ ID NO: 4048871 - DNA, 10 bp, Homo sapiens
tctgccacca

SEQ ID NO: 4048872 - DNA, 14 bp, Homo sapiens
tctgccacccactc

SEQ ID NO: 4048873 - DNA, 22 bp, Homo sapiens
tctgccagaagatcccctcagg

SEQ ID NO: 4048874 - DNA, 23 bp, Homo sapiens
tctgccagaagatcccctcagga

SEQ ID NO: 4048875 - DNA, 21 bp, Homo sapiens
tctgccagtgacagacaggct

SEQ ID NO: 4048876 - DNA, 12 bp, Homo sapiens
tctgccagtgga

SEQ ID NO: 4048877 - DNA, 15 bp, Homo sapiens
tctgccagtggatcc

SEQ ID NO: 4048878 - DNA, 19 bp, Homo sapiens
tctgccatgttgccccttt

SEQ ID NO: 4048879 - DNA, 18 bp, Homo sapiens
tctgcccaattggaggaa

SEQ ID NO: 4048880 - DNA, 13 bp, Homo sapiens
tctgcccagcttt

SEQ ID NO: 4048881 - DNA, 11 bp, Homo sapiens
tctgccccacc

SEQ ID NO: 4048882 - DNA, 18 bp, Homo sapiens
tctgccccacccaagccc

SEQ ID NO: 4048883 - DNA, 15 bp, Homo sapiens
tctgcccctccccca

SEQ ID NO: 4048884 - DNA, 22 bp, Homo sapiens
tctgcccctcccccaaccccca

SEQ ID NO: 4048885 - DNA, 12 bp, Homo sapiens
tctgccctggat

SEQ ID NO: 4048886 - DNA, 13 bp, Homo sapiens
tctgccctggatt

SEQ ID NO: 4048887 - DNA, 13 bp, Homo sapiens
tctgccctggctg

SEQ ID NO: 4048888 - DNA, 15 bp, Homo sapiens
tctgccctggctgct

SEQ ID NO: 4048889 - DNA, 17 bp, Homo sapiens
tctgccctggctgctgc

SEQ ID NO: 4048890 - DNA, 19 bp, Homo sapiens
tctgcccttatggagctca

SEQ ID NO: 4048891 - DNA, 22 bp, Homo sapiens
tctgccctttcctaggcccagg

SEQ ID NO: 4048892 - DNA, 19 bp, Homo sapiens
tctgccgctacctccctcc

SEQ ID NO: 4048893 - DNA, 15 bp, Homo sapiens
tctgccggcccccag

SEQ ID NO: 4048894 - DNA, 21 bp, Homo sapiens
tctgcctacagaacttcagaa

SEQ ID NO: 4048895 - DNA, 15 bp, Homo sapiens
tctgcctacagccag

SEQ ID NO: 4048896 - DNA, 16 bp, Homo sapiens
tctgcctacagccagg

SEQ ID NO: 4048897 - DNA, 23 bp, Homo sapiens
tctgcctcagacgttgcctgaga

SEQ ID NO: 4048898 - DNA, 17 bp, Homo sapiens
tctgcctccaccctcct

SEQ ID NO: 4048899 - DNA, 13 bp, Homo sapiens
tctgcctctctgg

SEQ ID NO: 4048900 - DNA, 18 bp, Homo sapiens
tctgcctgccagctgcac

SEQ ID NO: 4048901 - DNA, 12 bp, Homo sapiens
tctgcctggagt

SEQ ID NO: 4048902 - DNA, 17 bp, Homo sapiens
tctgcctgttctgagga

SEQ ID NO: 4048903 - DNA, 17 bp, Homo sapiens
tctgccttaaaaccaaa

SEQ ID NO: 4048904 - DNA, 19 bp, Homo sapiens
tctgccttagtctcagttt

SEQ ID NO: 4048905 - DNA, 20 bp, Homo sapiens
tctgccttggcttggacaaa

SEQ ID NO: 4048906 - DNA, 21 bp, Homo sapiens
tctgccttttgttcatttcat

SEQ ID NO: 4048907 - DNA, 16 bp, Homo sapiens
tctgcgtgacaataaa

SEQ ID NO: 4048908 - DNA, 19 bp, Homo sapiens
tctgctacgttcctattgt

SEQ ID NO: 4048909 - DNA, 21 bp, Homo sapiens
tctgctacgttcctattgtca

SEQ ID NO: 4048910 - DNA, 14 bp, Homo sapiens
tctgctaggcgctg

SEQ ID NO: 4048911 - DNA, 17 bp, Homo sapiens
tctacccatgagcctgc

SEQ ID NO: 4048912 - DNA, 12 bp, Homo sapiens
tctacccctgct

SEQ ID NO: 4048913 - DNA, 17 bp, Homo sapiens
tctaccctgctccctgc

SEQ ID NO: 4048914 - DNA, 16 bp, Homo sapiens
tctacctgaggccagg

SEQ ID NO: 4048915 - DNA, 12 bp, Homo sapiens
tctaccttcctg

SEQ ID NO: 4048916 - DNA, 17 bp, Homo sapiens
tctaccttgaggtcttt

SEQ ID NO: 4048917 - DNA, 13 bp, Homo sapiens
tctaccttttctg

SEQ ID NO: 4048918 - DNA, 15 bp, Homo sapiens
tctactaattccaca

SEQ ID NO: 4048919 - DNA, 21 bp, Homo sapiens
tctactcagaaatttttattt

SEQ ID NO: 4048920 - DNA, 15 bp, Homo sapiens
tctactcctgcctca

SEQ ID NO: 4048921 - DNA, 19 bp, Homo sapiens
tctactgaggtgctatgtt

SEQ ID NO: 4048922 - DNA, 16 bp, Homo sapiens
tctactttaagcacta

SEQ ID NO: 4048923 - DNA, 14 bp, Homo sapiens
tctactttattaat

SEQ ID NO: 4048924 - DNA, 21 bp, Homo sapiens
tctactttattaattgttttg

SEQ ID NO: 4048925 - DNA, 20 bp, Homo sapiens
tctagaagactgtcagcttc

SEQ ID NO: 4048926 - DNA, 20 bp, Homo sapiens
tctagaagccaagggaaagg

SEQ ID NO: 4048927 - DNA, 21 bp, Homo sapiens
tctagaagccaagggaaaggg

SEQ ID NO: 4048928 - DNA, 22 bp, Homo sapiens
tctagaatgtggatttgattca

SEQ ID NO: 4048929 - DNA, 14 bp, Homo sapiens
tctagacaagatat

SEQ ID NO: 4048930 - DNA, 21 bp, Homo sapiens
tctagacaagatattgtacat

SEQ ID NO: 4048931 - DNA, 23 bp, Homo sapiens
tctagacaatatacaagccaaag

SEQ ID NO: 4048932 - DNA, 16 bp, Homo sapiens
tctagagaagaggctg

SEQ ID NO: 4048933 - DNA, 19 bp, Homo sapiens
tctagatgaagttttacat

SEQ ID NO: 4048934 - DNA, 20 bp, Homo sapiens
tctagatgaagttttacatt

SEQ ID NO: 4048935 - DNA, 23 bp, Homo sapiens
tctagattaccccctcattgttt

SEQ ID NO: 4048936 - DNA, 18 bp, Homo sapiens
tctagcacttccttgcca

SEQ ID NO: 4048937 - DNA, 16 bp, Homo sapiens
tctagcagcacctcct

SEQ ID NO: 4048938 - DNA, 21 bp, Homo sapiens
tctagccagcccctcttcccc

SEQ ID NO: 4048939 - DNA, 14 bp, Homo sapiens
tctagccctgcccg

SEQ ID NO: 4048940 - DNA, 15 bp, Homo sapiens
tctagctctctaggc

SEQ ID NO: 4048941 - DNA, 11 bp, Homo sapiens
tctagctgttg

SEQ ID NO: 4048942 - DNA, 19 bp, Homo sapiens
tctagctgttgagctgttt

SEQ ID NO: 4048943 - DNA, 19 bp, Homo sapiens
tctaggagggagacactgg

SEQ ID NO: 4048944 - DNA, 15 bp, Homo sapiens
tctaggcaagcagga

SEQ ID NO: 4048945 - DNA, 16 bp, Homo sapiens
tctaggcaagcaggac

SEQ ID NO: 4048946 - DNA, 20 bp, Homo sapiens
tctaggtaggggcccacttc

SEQ ID NO: 4048947 - DNA, 16 bp, Homo sapiens
tctaggtctcctcagg

SEQ ID NO: 4048948 - DNA, 17 bp, Homo sapiens
tctaggtctcctcaggg

SEQ ID NO: 4048949 - DNA, 14 bp, Homo sapiens
tctagtgcagctga

SEQ ID NO: 4048950 - DNA, 15 bp, Homo sapiens
tctagtggtctttgt

SEQ ID NO: 4048951 - DNA, 16 bp, Homo sapiens
tctagtggtctttgta

SEQ ID NO: 4048952 - DNA, 17 bp, Homo sapiens
tctagtggtctttgtaa

SEQ ID NO: 4048953 - DNA, 18 bp, Homo sapiens
tctagtggtctttgtaag

SEQ ID NO: 4048954 - DNA, 22 bp, Homo sapiens
tctagtggtctttgtaagagtg

SEQ ID NO: 4048955 - DNA, 15 bp, Homo sapiens
tctagttctttcctc

SEQ ID NO: 4048956 - DNA, 14 bp, Homo sapiens
tctagtttcttgtg

SEQ ID NO: 4048957 - DNA, 16 bp, Homo sapiens
tctataaaagaaacac

SEQ ID NO: 4048958 - DNA, 13 bp, Homo sapiens
tctataaataacc

SEQ ID NO: 4048959 - DNA, 14 bp, Homo sapiens
tctataaggccata

SEQ ID NO: 4048960 - DNA, 22 bp, Homo sapiens
tctataaggccataaaacaggt

SEQ ID NO: 4048961 - DNA, 21 bp, Homo sapiens
tctataatcccagcactttgg

SEQ ID NO: 4048962 - DNA, 15 bp, Homo sapiens
tctatacatatcttt

SEQ ID NO: 4048963 - DNA, 13 bp, Homo sapiens
tctatagactcta

SEQ ID NO: 4048964 - DNA, 16 bp, Homo sapiens
tctatagactctagga

SEQ ID NO: 4048965 - DNA, 20 bp, Homo sapiens
tctataggaacatatgaaaa

SEQ ID NO: 4048966 - DNA, 12 bp, Homo sapiens
tctatatctgaa

SEQ ID NO: 4048967 - DNA, 21 bp, Homo sapiens
tctatatgaatttaaatataa

SEQ ID NO: 4048968 - DNA, 23 bp, Homo sapiens
tctatcaagtcaatcatttctca

SEQ ID NO: 4048969 - DNA, 14 bp, Homo sapiens
tctatcagagaaaa

SEQ ID NO: 4048970 - DNA, 23 bp, Homo sapiens
tctatcaggggtgcattctggcc

SEQ ID NO: 4048971 - DNA, 13 bp, Homo sapiens
tctatcagtactt

SEQ ID NO: 4048972 - DNA, 19 bp, Homo sapiens
tctatcgagtttgcaatgt

SEQ ID NO: 4048973 - DNA, 16 bp, Homo sapiens
tctatcgttattataa

SEQ ID NO: 4048974 - DNA, 18 bp, Homo sapiens
tctatcgttattataaat

SEQ ID NO: 4048975 - DNA, 19 bp, Homo sapiens
tctatcgttattataaatg

SEQ ID NO: 4048976 - DNA, 20 bp, Homo sapiens
tctatcgttattataaatgt

SEQ ID NO: 4048977 - DNA, 13 bp, Homo sapiens
tctatctaaatga

SEQ ID NO: 4048978 - DNA, 16 bp, Homo sapiens
tctaactcagaattat

SEQ ID NO: 4048979 - DNA, 19 bp, Homo sapiens
tctaagatgattcaaagta

SEQ ID NO: 4048980 - DNA, 22 bp, Homo sapiens
tctaagatgattcaaagtagtt

SEQ ID NO: 4048981 - DNA, 19 bp, Homo sapiens
tctaaggataatgaaataa

SEQ ID NO: 4048982 - DNA, 18 bp, Homo sapiens
tctaaggttctcatagga

SEQ ID NO: 4048983 - DNA, 11 bp, Homo sapiens
tctaataaact

SEQ ID NO: 4048984 - DNA, 22 bp, Homo sapiens
tctaataaacttggattctcta

SEQ ID NO: 4048985 - DNA, 15 bp, Homo sapiens
tctaatatatatgaa

SEQ ID NO: 4048986 - DNA, 14 bp, Homo sapiens
tctaatatcattca

SEQ ID NO: 4048987 - DNA, 14 bp, Homo sapiens
tctaatatggccac

SEQ ID NO: 4048988 - DNA, 22 bp, Homo sapiens
tctaatccttttccttatttgc

SEQ ID NO: 4048989 - DNA, 21 bp, Homo sapiens
tctaatctgagctgcagcctg

SEQ ID NO: 4048990 - DNA, 23 bp, Homo sapiens
tctaatcttaaatcagaataaat

SEQ ID NO: 4048991 - DNA, 17 bp, Homo sapiens
tctaatgcttgatttag

SEQ ID NO: 4048992 - DNA, 19 bp, Homo sapiens
tctaatgtggttatttctc

SEQ ID NO: 4048993 - DNA, 21 bp, Homo sapiens
tctaattccatccataaatcc

SEQ ID NO: 4048994 - DNA, 14 bp, Homo sapiens
tctaatttgaactg

SEQ ID NO: 4048995 - DNA, 15 bp, Homo sapiens
tctaatttgaactgg

SEQ ID NO: 4048996 - DNA, 15 bp, Homo sapiens
tctaatttttaagaa

SEQ ID NO: 4048997 - DNA, 13 bp, Homo sapiens
tctacaagccaaa

SEQ ID NO: 4048998 - DNA, 17 bp, Homo sapiens
tctacaatgtgaacttt

SEQ ID NO: 4048999 - DNA, 20 bp, Homo sapiens
tctacaatgtgaactttatt

SEQ ID NO: 4049000 - DNA, 11 bp, Homo sapiens
tctacacagcc

SEQ ID NO: 4049001 - DNA, 12 bp, Homo sapiens
tctacagaataa

SEQ ID NO: 4049002 - DNA, 16 bp, Homo sapiens
tctacagatccttttt

SEQ ID NO: 4049003 - DNA, 22 bp, Homo sapiens
tctacagatcctttttccatca

SEQ ID NO: 4049004 - DNA, 23 bp, Homo sapiens
tctacagatcctttttccatcat

SEQ ID NO: 4049005 - DNA, 19 bp, Homo sapiens
tctacagccttgtccccct

SEQ ID NO: 4049006 - DNA, 21 bp, Homo sapiens
tctacagtggttttatactga

SEQ ID NO: 4049007 - DNA, 17 bp, Homo sapiens
tctacataagtaattca

SEQ ID NO: 4049008 - DNA, 16 bp, Homo sapiens
tctacatcttctgcct

SEQ ID NO: 4049009 - DNA, 17 bp, Homo sapiens
tctacatcttctgcctt

SEQ ID NO: 4049010 - DNA, 17 bp, Homo sapiens
tctacatgactgggcct

SEQ ID NO: 4049011 - DNA, 17 bp, Homo sapiens
tctaccaaataatttca

SEQ ID NO: 4049012 - DNA, 21 bp, Homo sapiens
tctaccagttggcagacagcc

SEQ ID NO: 4049013 - DNA, 18 bp, Homo sapiens
tcctggagcagaccaccc

SEQ ID NO: 4049014 - DNA, 19 bp, Homo sapiens
tcctggagcagaccacccc

SEQ ID NO: 4049015 - DNA, 18 bp, Homo sapiens
tcctggagttttgatttg

SEQ ID NO: 4049016 - DNA, 18 bp, Homo sapiens
tcctggatgttgtgtgta

SEQ ID NO: 4049017 - DNA, 23 bp, Homo sapiens
tcctggcaatagtgtgttctgat

SEQ ID NO: 4049018 - DNA, 17 bp, Homo sapiens
tcctggcagtttaaaaa

SEQ ID NO: 4049019 - DNA, 18 bp, Homo sapiens
tcctggccagacgctgcc

SEQ ID NO: 4049020 - DNA, 14 bp, Homo sapiens
tcctggctacatcc

SEQ ID NO: 4049021 - DNA, 18 bp, Homo sapiens
tcctggctacatcccagc

SEQ ID NO: 4049022 - DNA, 20 bp, Homo sapiens
tcctggctacatcccagcct

SEQ ID NO: 4049023 - DNA, 23 bp, Homo sapiens
tcctggctcttgatacccccctc

SEQ ID NO: 4049024 - DNA, 22 bp, Homo sapiens
tcctggctgcggcgtctgtctg

SEQ ID NO: 4049025 - DNA, 18 bp, Homo sapiens
tcctgggaagatgaggtt

SEQ ID NO: 4049026 - DNA, 23 bp, Homo sapiens
tcctgggccgttacatctgtgca

SEQ ID NO: 4049027 - DNA, 16 bp, Homo sapiens
tcctgggcctgcagaa

SEQ ID NO: 4049028 - DNA, 14 bp, Homo sapiens
tcctgggcctgccc

SEQ ID NO: 4049029 - DNA, 18 bp, Homo sapiens
tcctgggcctttgcaaga

SEQ ID NO: 4049030 - DNA, 22 bp, Homo sapiens
tcctgggctggggccaccatcc

SEQ ID NO: 4049031 - DNA, 15 bp, Homo sapiens
tcctggttcccgttt

SEQ ID NO: 4049032 - DNA, 23 bp, Homo sapiens
tcctggttcccgtttctccacct

SEQ ID NO: 4049033 - DNA, 21 bp, Homo sapiens
tcctggtttaattcagcagag

SEQ ID NO: 4049034 - DNA, 22 bp, Homo sapiens
tcctggtttcataacttcctgt

SEQ ID NO: 4049035 - DNA, 19 bp, Homo sapiens
tcctgtaaatggtgtacat

SEQ ID NO: 4049036 - DNA, 15 bp, Homo sapiens
tcctgtaacaggtgt

SEQ ID NO: 4049037 - DNA, 17 bp, Homo sapiens
tcctgtacactgaatat

SEQ ID NO: 4049038 - DNA, 14 bp, Homo sapiens
tcctgtacattgtg

SEQ ID NO: 4049039 - DNA, 22 bp, Homo sapiens
tcctgtataagcactgaaaaac

SEQ ID NO: 4049040 - DNA, 17 bp, Homo sapiens
tcctgtccagctccaac

SEQ ID NO: 4049041 - DNA, 12 bp, Homo sapiens
tcctgtccctga

SEQ ID NO: 4049042 - DNA, 21 bp, Homo sapiens
tcctgtcccttctcttaattt

SEQ ID NO: 4049043 - DNA, 14 bp, Homo sapiens
tcctgtcccttttc

SEQ ID NO: 4049044 - DNA, 14 bp, Homo sapiens
tcctgtcctttctt

SEQ ID NO: 4049045 - DNA, 15 bp, Homo sapiens
tcctgtcctttcttg

SEQ ID NO: 4049046 - DNA, 19 bp, Homo sapiens
tcctgtcctttcttgcaga

SEQ ID NO: 4049047 - DNA, 20 bp, Homo sapiens
tcctgtcttatggtccagaa

SEQ ID NO: 4049048 - DNA, 23 bp, Homo sapiens
tcctgtcttatggtccagaaact

SEQ ID NO: 4049049 - DNA, 17 bp, Homo sapiens
tcctgtctttaaggaaa

SEQ ID NO: 4049050 - DNA, 14 bp, Homo sapiens
tcctgtgacatgta

SEQ ID NO: 4049051 - DNA, 16 bp, Homo sapiens
tcctgtgcatgggtga

SEQ ID NO: 4049052 - DNA, 13 bp, Homo sapiens
tcctgtgcctggc

SEQ ID NO: 4049053 - DNA, 14 bp, Homo sapiens
tcctgtgcctggcc

SEQ ID NO: 4049054 - DNA, 16 bp, Homo sapiens
tcctgtgcctggcccc

SEQ ID NO: 4049055 - DNA, 19 bp, Homo sapiens
tcctgtggctttgttttct

SEQ ID NO: 4049056 - DNA, 20 bp, Homo sapiens
tcctgtgggtgttctttcct

SEQ ID NO: 4049057 - DNA, 21 bp, Homo sapiens
tcctgtgggtgttctttcctg

SEQ ID NO: 4049058 - DNA, 18 bp, Homo sapiens
tcctgtgtgtactctgtc

SEQ ID NO: 4049059 - DNA, 18 bp, Homo sapiens
tcctgttacttacctaaa

SEQ ID NO: 4049060 - DNA, 17 bp, Homo sapiens
tcctgtttataatctga

SEQ ID NO: 4049061 - DNA, 19 bp, Homo sapiens
tcctgtttataatctgaag

SEQ ID NO: 4049062 - DNA, 18 bp, Homo sapiens
tcctgtttattcccatct

SEQ ID NO: 4049063 - DNA, 18 bp, Homo sapiens
tcctgtttcagacccccc

SEQ ID NO: 4049064 - DNA, 23 bp, Homo sapiens
tccttaaactgtgtggactgtga

SEQ ID NO: 4049065 - DNA, 15 bp, Homo sapiens
tccttaacccacctc

SEQ ID NO: 4049066 - DNA, 19 bp, Homo sapiens
tccttaacccacctctcct

SEQ ID NO: 4049067 - DNA, 20 bp, Homo sapiens
tccttaacccacctctcctg

SEQ ID NO: 4049068 - DNA, 11 bp, Homo sapiens
tccttaagtat

SEQ ID NO: 4049069 - DNA, 15 bp, Homo sapiens
tccttacagtcacta

SEQ ID NO: 4049070 - DNA, 21 bp, Homo sapiens
tccttaccagagacgcccagc

SEQ ID NO: 4049071 - DNA, 23 bp, Homo sapiens
tccttaccagagacgcccagccc

SEQ ID NO: 4049072 - DNA, 18 bp, Homo sapiens
tccttagactcttttcct

SEQ ID NO: 4049073 - DNA, 15 bp, Homo sapiens
tccttagtcttctca

SEQ ID NO: 4049074 - DNA, 16 bp, Homo sapiens
tccttagtcttctcat

SEQ ID NO: 4049075 - DNA, 21 bp, Homo sapiens
tccttataggcctgtcccttg

SEQ ID NO: 4049076 - DNA, 22 bp, Homo sapiens
tccttatcagagctaagggtgg

SEQ ID NO: 4049077 - DNA, 13 bp, Homo sapiens
tccttatccctct

SEQ ID NO: 4049078 - DNA, 15 bp, Homo sapiens
tccttatccctctct

SEQ ID NO: 4049079 - DNA, 22 bp, Homo sapiens
tccttatccctctcttcccctt

SEQ ID NO: 4049080 - DNA, 14 bp, Homo sapiens
tccttatctagctg

SEQ ID NO: 4049081 - DNA, 15 bp, Homo sapiens
tccttatctagctgc

SEQ ID NO: 4049082 - DNA, 21 bp, Homo sapiens
tccttatgggtagggctctga

SEQ ID NO: 4049083 - DNA, 21 bp, Homo sapiens
tccttatgtatcagtgtcctt

SEQ ID NO: 4049084 - DNA, 15 bp, Homo sapiens
tccttatgtcctgtc

SEQ ID NO: 4049085 - DNA, 13 bp, Homo sapiens
tccttatttgcct

SEQ ID NO: 4049086 - DNA, 20 bp, Homo sapiens
tccttatttgcttcattgta

SEQ ID NO: 4049087 - DNA, 19 bp, Homo sapiens
tccttcaacaaggcttgct

SEQ ID NO: 4049088 - DNA, 21 bp, Homo sapiens
tccttcaacaaggcttgctgc

SEQ ID NO: 4049089 - DNA, 19 bp, Homo sapiens
tccttcaagaactctgggc

SEQ ID NO: 4049090 - DNA, 21 bp, Homo sapiens
tccttcaagaactctgggctg

SEQ ID NO: 4049091 - DNA, 23 bp, Homo sapiens
tccttcaagaactctgggctgct

SEQ ID NO: 4049092 - DNA, 12 bp, Homo sapiens
tccttcagacac

SEQ ID NO: 4049093 - DNA, 18 bp, Homo sapiens
tccttcagggtttaatag

SEQ ID NO: 4049094 - DNA, 17 bp, Homo sapiens
tccatttccttatgctg

SEQ ID NO: 4049095 - DNA, 13 bp, Homo sapiens
tccatttgagaaa

SEQ ID NO: 4049096 - DNA, 14 bp, Homo sapiens
tccatttgagaaaa

SEQ ID NO: 4049097 - DNA, 13 bp, Homo sapiens
tccatttgccttt

SEQ ID NO: 4049098 - DNA, 14 bp, Homo sapiens
tccatttgttcctg

SEQ ID NO: 4049099 - DNA, 21 bp, Homo sapiens
tccattttcccccactactgc

SEQ ID NO: 4049100 - DNA, 20 bp, Homo sapiens
tccattttggtgtctttctc

SEQ ID NO: 4049101 - DNA, 21 bp, Homo sapiens
tcccaaagtgctgggattaca

SEQ ID NO: 4049102 - DNA, 15 bp, Homo sapiens
tcccaacagccatgc

SEQ ID NO: 4049103 - DNA, 13 bp, Homo sapiens
tcccaacagcctt

SEQ ID NO: 4049104 - DNA, 15 bp, Homo sapiens
tcccaaccctggctt

SEQ ID NO: 4049105 - DNA, 20 bp, Homo sapiens
tcccaacctctttttcctcc

SEQ ID NO: 4049106 - DNA, 21 bp, Homo sapiens
tcccaacttctcttgctttct

SEQ ID NO: 4049107 - DNA, 18 bp, Homo sapiens
tcccaagctagtgagcaa

SEQ ID NO: 4049108 - DNA, 20 bp, Homo sapiens
tcccaagctatctaaagttt

SEQ ID NO: 4049109 - DNA, 20 bp, Homo sapiens
tcccaagggtgccctttggg

SEQ ID NO: 4049110 - DNA, 21 bp, Homo sapiens
tcccaagtaactgggattaca

SEQ ID NO: 4049111 - DNA, 17 bp, Homo sapiens
tcccaagtcacacccac

SEQ ID NO: 4049112 - DNA, 21 bp, Homo sapiens
tcccaagtttccatagcaaca

SEQ ID NO: 4049113 - DNA, 16 bp, Homo sapiens
tcccaattgagaaaaa

SEQ ID NO: 4049114 - DNA, 17 bp, Homo sapiens
tcccaatttcagactcc

SEQ ID NO: 4049115 - DNA, 23 bp, Homo sapiens
tcccaatttcagactcccattcc

SEQ ID NO: 4049116 - DNA, 11 bp, Homo sapiens
tcccacacagg

SEQ ID NO: 4049117 - DNA, 13 bp, Homo sapiens
tcccacaccctgg

SEQ ID NO: 4049118 - DNA, 18 bp, Homo sapiens
tcccacaccgtgtaaacc

SEQ ID NO: 4049119 - DNA, 21 bp, Homo sapiens
tcccacaggcccttcctctcc

SEQ ID NO: 4049120 - DNA, 19 bp, Homo sapiens
tcccacatgaggccatctc

SEQ ID NO: 4049121 - DNA, 18 bp, Homo sapiens
tcccaccaaggtcttcag

SEQ ID NO: 4049122 - DNA, 15 bp, Homo sapiens
tcccaccagcttcac

SEQ ID NO: 4049123 - DNA, 23 bp, Homo sapiens
tcccacccacacagctgccctag

SEQ ID NO: 4049124 - DNA, 18 bp, Homo sapiens
tcccacccccacccccag

SEQ ID NO: 4049125 - DNA, 20 bp, Homo sapiens
tcccacccccacccccagct

SEQ ID NO: 4049126 - DNA, 22 bp, Homo sapiens
tcccacccccacccccagctca

SEQ ID NO: 4049127 - DNA, 20 bp, Homo sapiens
tcccacccccatctctccct

SEQ ID NO: 4049128 - DNA, 17 bp, Homo sapiens
tcccacccccttctctg

SEQ ID NO: 4049129 - DNA, 19 bp, Homo sapiens
tcccacccccttctctgct

SEQ ID NO: 4049130 - DNA, 21 bp, Homo sapiens
tcccacccccttctctgctcc

SEQ ID NO: 4049131 - DNA, 19 bp, Homo sapiens
tcccacccctacacacaca

SEQ ID NO: 4049132 - DNA, 21 bp, Homo sapiens
tcccacccctacacacacact

SEQ ID NO: 4049133 - DNA, 14 bp, Homo sapiens
tcccacccctagcc

SEQ ID NO: 4049134 - DNA, 15 bp, Homo sapiens
tcccacccctagcca

SEQ ID NO: 4049135 - DNA, 20 bp, Homo sapiens
tcccacccctagccaccagt

SEQ ID NO: 4049136 - DNA, 23 bp, Homo sapiens
tcccacccctagccaccagtgtc

SEQ ID NO: 4049137 - DNA, 21 bp, Homo sapiens
tcccaccctcctgccccacac

SEQ ID NO: 4049138 - DNA, 23 bp, Homo sapiens
tcccacctctccttttgaggctt

SEQ ID NO: 4049139 - DNA, 19 bp, Homo sapiens
tcccacctgcatctggggc

SEQ ID NO: 4049140 - DNA, 15 bp, Homo sapiens
tcccaccttcccacc

SEQ ID NO: 4049141 - DNA, 20 bp, Homo sapiens
tcccacgaatttgctgggga

SEQ ID NO: 4049142 - DNA, 14 bp, Homo sapiens
tcccacgtctggcc

SEQ ID NO: 4049143 - DNA, 16 bp, Homo sapiens
tcccacgtctggccag

SEQ ID NO: 4049144 - DNA, 15 bp, Homo sapiens
tcccacgtgtcttcc

SEQ ID NO: 4049145 - DNA, 12 bp, Homo sapiens
tcccactccaag

SEQ ID NO: 4049146 - DNA, 23 bp, Homo sapiens
tcccagactaaaggatccagaga

SEQ ID NO: 4049147 - DNA, 14 bp, Homo sapiens
tcccagaggcaggc

SEQ ID NO: 4049148 - DNA, 16 bp, Homo sapiens
tcccagagggagcagg

SEQ ID NO: 4049149 - DNA, 13 bp, Homo sapiens
tcccagcagccct

SEQ ID NO: 4049150 - DNA, 21 bp, Homo sapiens
tcccagcagccctaaggatct

SEQ ID NO: 4049151 - DNA, 18 bp, Homo sapiens
tcccagcatccctggagc

SEQ ID NO: 4049152 - DNA, 13 bp, Homo sapiens
tcccagccacccc

SEQ ID NO: 4049153 - DNA, 20 bp, Homo sapiens
tcccagccactcgggaggct

SEQ ID NO: 4049154 - DNA, 22 bp, Homo sapiens
tcccagccactcgggaggctga

SEQ ID NO: 4049155 - DNA, 23 bp, Homo sapiens
tcccagccccggcaagccacagg

SEQ ID NO: 4049156 - DNA, 14 bp, Homo sapiens
tcccagcctgctga

SEQ ID NO: 4049157 - DNA, 22 bp, Homo sapiens
tcccagcctgctgagagccccc

SEQ ID NO: 4049158 - DNA, 23 bp, Homo sapiens
tcccagcctgctgagagccccca

SEQ ID NO: 4049159 - DNA, 21 bp, Homo sapiens
tcccagcctgggggccagtgg

SEQ ID NO: 4049160 - DNA, 22 bp, Homo sapiens
tcccagcctgggggccagtggg

SEQ ID NO: 4049161 - DNA, 17 bp, Homo sapiens
tcccagctacttgggag

SEQ ID NO: 4049162 - DNA, 18 bp, Homo sapiens
tcccagctacttgggagg

SEQ ID NO: 4049163 - DNA, 16 bp, Homo sapiens
tcccagctaggaagag

SEQ ID NO: 4049164 - DNA, 11 bp, Homo sapiens
tcccaggaccc

SEQ ID NO: 4049165 - DNA, 12 bp, Homo sapiens
tcccaggaccct

SEQ ID NO: 4049166 - DNA, 13 bp, Homo sapiens
tcccaggaccctg

SEQ ID NO: 4049167 - DNA, 14 bp, Homo sapiens
tcccaggaccctga

SEQ ID NO: 4049168 - DNA, 21 bp, Homo sapiens
tcccaggagatgggtccaggg

SEQ ID NO: 4049169 - DNA, 23 bp, Homo sapiens
tcccaggcagcacagtgtgtgaa

SEQ ID NO: 4049170 - DNA, 16 bp, Homo sapiens
tcccaggcgccccttc

SEQ ID NO: 4049171 - DNA, 15 bp, Homo sapiens
tcccaggcttcaccc

SEQ ID NO: 4049172 - DNA, 16 bp, Homo sapiens
tcccagggaaggactt

SEQ ID NO: 4049173 - DNA, 11 bp, Homo sapiens
tcccagggctg

SEQ ID NO: 4049174 - DNA, 13 bp, Homo sapiens
tcccagggctggc

SEQ ID NO: 4049175 - DNA, 21 bp, Homo sapiens
tcccaggggcccaaggcggcc

SEQ ID NO: 4049176 - DNA, 22 bp, Homo sapiens
tcccaggggcccaaggcggccc

SEQ ID NO: 4049177 - DNA, 22 bp, Homo sapiens
tcccaggggtctccctggctcc

SEQ ID NO: 4049178 - DNA, 22 bp, Homo sapiens
tcccagtaagtttcccctctgg

SEQ ID NO: 4049179 - DNA, 15 bp, Homo sapiens
tcccagtcctccaga

SEQ ID NO: 4049180 - DNA, 16 bp, Homo sapiens
tcccagtctctggcag

SEQ ID NO: 4049181 - DNA, 15 bp, Homo sapiens
tcccagtgaattctt

SEQ ID NO: 4049182 - DNA, 22 bp, Homo sapiens
tcccagtgctcaccagccctgc

SEQ ID NO: 4049183 - DNA, 20 bp, Homo sapiens
tcccagttcaggagtcccaa

SEQ ID NO: 4049184 - DNA, 15 bp, Homo sapiens
tcccataataaagca

SEQ ID NO: 4049185 - DNA, 22 bp, Homo sapiens
tcccataattttcttcatgcaa

SEQ ID NO: 4049186 - DNA, 17 bp, Homo sapiens
tcccatagccaggaaac

SEQ ID NO: 4049187 - DNA, 20 bp, Homo sapiens
tcccatatcaaaagacacag

SEQ ID NO: 4049188 - DNA, 14 bp, Homo sapiens
tcccatccagggcc

SEQ ID NO: 4049189 - DNA, 18 bp, Homo sapiens
tcccatccatcagctccc

SEQ ID NO: 4049190 - DNA, 15 bp, Homo sapiens
tcccatcccctggac

SEQ ID NO: 4049191 - DNA, 15 bp, Homo sapiens
tcccatgactgcacc

SEQ ID NO: 4049192 - DNA, 21 bp, Homo sapiens
tcccatgactgcacccagctc

SEQ ID NO: 4049193 - DNA, 13 bp, Homo sapiens
tcccatgtagccc

SEQ ID NO: 4049194 - DNA, 22 bp, Homo sapiens
tcccatgtagccccctggcctc

SEQ ID NO: 4049195 - DNA, 18 bp, Homo sapiens
tccccttccccttccttc

SEQ ID NO: 4049196 - DNA, 13 bp, Homo sapiens
tccccttccctta

SEQ ID NO: 4049197 - DNA, 12 bp, Homo sapiens
tccccttcctgt

SEQ ID NO: 4049198 - DNA, 23 bp, Homo sapiens
tccccttggcaggtcctggccag

SEQ ID NO: 4049199 - DNA, 13 bp, Homo sapiens
tcccctttcctgt

SEQ ID NO: 4049200 - DNA, 19 bp, Homo sapiens
tcccgcccaaacctttccc

SEQ ID NO: 4049201 - DNA, 16 bp, Homo sapiens
tcccgcctcagggcca

SEQ ID NO: 4049202 - DNA, 21 bp, Homo sapiens
tcccgcctcagggccaggccc

SEQ ID NO: 4049203 - DNA, 18 bp, Homo sapiens
tcccgcctccctctcaga

SEQ ID NO: 4049204 - DNA, 19 bp, Homo sapiens
tcccgcctcttcttcttca

SEQ ID NO: 4049205 - DNA, 13 bp, Homo sapiens
tcccgctcagccc

SEQ ID NO: 4049206 - DNA, 14 bp, Homo sapiens
tcccgctcagccct

SEQ ID NO: 4049207 - DNA, 15 bp, Homo sapiens
tcccgctcagccctc

SEQ ID NO: 4049208 - DNA, 16 bp, Homo sapiens
tcccgctcagccctcc

SEQ ID NO: 4049209 - DNA, 15 bp, Homo sapiens
tcccgctgctgctgc

SEQ ID NO: 4049210 - DNA, 19 bp, Homo sapiens
tcccggagcctgtgcagcc

SEQ ID NO: 4049211 - DNA, 14 bp, Homo sapiens
tcccgggccacgcc

SEQ ID NO: 4049212 - DNA, 20 bp, Homo sapiens
tcccggttcagacccctgcc

SEQ ID NO: 4049213 - DNA, 18 bp, Homo sapiens
tcccgtctggacctgggg

SEQ ID NO: 4049214 - DNA, 19 bp, Homo sapiens
tcccgtgaaagaattattt

SEQ ID NO: 4049215 - DNA, 20 bp, Homo sapiens
tcccgtgcatcccccctgct

SEQ ID NO: 4049216 - DNA, 15 bp, Homo sapiens
tcccgtgttctcctt

SEQ ID NO: 4049217 - DNA, 18 bp, Homo sapiens
tccctaaactttggcctt

SEQ ID NO: 4049218 - DNA, 13 bp, Homo sapiens
tccctacacacac

SEQ ID NO: 4049219 - DNA, 16 bp, Homo sapiens
tccctacacacacaca

SEQ ID NO: 4049220 - DNA, 24 bp, Homo sapiens
tccctacatgtattgcacattgta

SEQ ID NO: 4049221 - DNA, 22 bp, Homo sapiens
tccctaccccagggccctggcc

SEQ ID NO: 4049222 - DNA, 19 bp, Homo sapiens
tccctaccccctaagagcc

SEQ ID NO: 4049223 - DNA, 20 bp, Homo sapiens
tccctaccccctaagagcca

SEQ ID NO: 4049224 - DNA, 13 bp, Homo sapiens
tccctacctcagg

SEQ ID NO: 4049225 - DNA, 18 bp, Homo sapiens
tccctagactgcatcccg

SEQ ID NO: 4049226 - DNA, 15 bp, Homo sapiens
tccctaggagaccaa

SEQ ID NO: 4049227 - DNA, 19 bp, Homo sapiens
tccctatctattaaagtga

SEQ ID NO: 4049228 - DNA, 22 bp, Homo sapiens
tccctatctattaaagtgactt

SEQ ID NO: 4049229 - DNA, 16 bp, Homo sapiens
tccctatcttgtgaag

SEQ ID NO: 4049230 - DNA, 17 bp, Homo sapiens
tccctcaaagaggcctt

SEQ ID NO: 4049231 - DNA, 22 bp, Homo sapiens
tccctcaacaagggagagacct

SEQ ID NO: 4049232 - DNA, 23 bp, Homo sapiens
tccctcaacaagggagagacctc

SEQ ID NO: 4049233 - DNA, 20 bp, Homo sapiens
tccctcacctgtagcagcca

SEQ ID NO: 4049234 - DNA, 13 bp, Homo sapiens
tccctcagcctca

SEQ ID NO: 4049235 - DNA, 19 bp, Homo sapiens
tccctcagcctcagaggag

SEQ ID NO: 4049236 - DNA, 19 bp, Homo sapiens
tccctcaggttctattttc

SEQ ID NO: 4049237 - DNA, 21 bp, Homo sapiens
tccctcaggttctattttctt

SEQ ID NO: 4049238 - DNA, 23 bp, Homo sapiens
tccctccagtattgccccctctc

SEQ ID NO: 4049239 - DNA, 13 bp, Homo sapiens
tccctccatcccc

SEQ ID NO: 4049240 - DNA, 16 bp, Homo sapiens
tccctccattcatcct

SEQ ID NO: 4049241 - DNA, 21 bp, Homo sapiens
tccctcccccccatgcactgt

SEQ ID NO: 4049242 - DNA, 16 bp, Homo sapiens
tccctcccctgccatt

SEQ ID NO: 4049243 - DNA, 16 bp, Homo sapiens
tccctcccctgccctg

SEQ ID NO: 4049244 - DNA, 17 bp, Homo sapiens
tccctcccctgccctgg

SEQ ID NO: 4049245 - DNA, 22 bp, Homo sapiens
tccctcccggcatgggaaagcc

SEQ ID NO: 4049246 - DNA, 12 bp, Homo sapiens
tccctcctagct

SEQ ID NO: 4049247 - DNA, 13 bp, Homo sapiens
tccctcctagctc

SEQ ID NO: 4049248 - DNA, 17 bp, Homo sapiens
tccctcctcacctctgg

SEQ ID NO: 4049249 - DNA, 21 bp, Homo sapiens
tccctcctccaggcctgcctc

SEQ ID NO: 4049250 - DNA, 15 bp, Homo sapiens
tccctccttgggtca

SEQ ID NO: 4049251 - DNA, 22 bp, Homo sapiens
tccctccttgggtcattgacct

SEQ ID NO: 4049252 - DNA, 18 bp, Homo sapiens
tccctcgggaagcagcca

SEQ ID NO: 4049253 - DNA, 19 bp, Homo sapiens
tccctcgggaagcagccag

SEQ ID NO: 4049254 - DNA, 14 bp, Homo sapiens
tccctctaatttat

SEQ ID NO: 4049255 - DNA, 16 bp, Homo sapiens
tccctctaatttatct

SEQ ID NO: 4049256 - DNA, 13 bp, Homo sapiens
tccctctagtgcc

SEQ ID NO: 4049257 - DNA, 15 bp, Homo sapiens
tccctctcagaggcc

SEQ ID NO: 4049258 - DNA, 17 bp, Homo sapiens
tccctctctcagcacag

SEQ ID NO: 4049259 - DNA, 20 bp, Homo sapiens
tccctctctcagcacagcct

SEQ ID NO: 4049260 - DNA, 12 bp, Homo sapiens
tccctctctctt

SEQ ID NO: 4049261 - DNA, 16 bp, Homo sapiens
tccctctcttcccctt

SEQ ID NO: 4049262 - DNA, 19 bp, Homo sapiens
tccctctcttccccttccc

SEQ ID NO: 4049263 - DNA, 15 bp, Homo sapiens
tccctctgccttcag

SEQ ID NO: 4049264 - DNA, 15 bp, Homo sapiens
tccctctgctcagcc

SEQ ID NO: 4049265 - DNA, 16 bp, Homo sapiens
tccctctgctcagcca

SEQ ID NO: 4049266 - DNA, 17 bp, Homo sapiens
tccctctgggcacgcct

SEQ ID NO: 4049267 - DNA, 23 bp, Homo sapiens
tccctctgggcacgcctgctggc

SEQ ID NO: 4049268 - DNA, 23 bp, Homo sapiens
tccctctttggctcccctgtacc

SEQ ID NO: 4049269 - DNA, 17 bp, Homo sapiens
tccctgaatctgtgcct

SEQ ID NO: 4049270 - DNA, 21 bp, Homo sapiens
tccctgacctccctctaattt

SEQ ID NO: 4049271 - DNA, 15 bp, Homo sapiens
tccctgagacaggga

SEQ ID NO: 4049272 - DNA, 14 bp, Homo sapiens
tccctgaggatggg

SEQ ID NO: 4049273 - DNA, 15 bp, Homo sapiens
tccctgatccctgat

SEQ ID NO: 4049274 - DNA, 14 bp, Homo sapiens
tccctgatcccttc

SEQ ID NO: 4049275 - DNA, 15 bp, Homo sapiens
tccctgatcccttcc

SEQ ID NO: 4049276 - DNA, 19 bp, Homo sapiens
tccctgatgacacccaccc

SEQ ID NO: 4049277 - DNA, 20 bp, Homo sapiens
tccctgatgacacccaccct

SEQ ID NO: 4049278 - DNA, 14 bp, Homo sapiens
tccctgatggcaga

SEQ ID NO: 4049279 - DNA, 16 bp, Homo sapiens
tccctgattgacctgc

SEQ ID NO: 4049280 - DNA, 19 bp, Homo sapiens
tccctgattgacctgctcc

SEQ ID NO: 4049281 - DNA, 20 bp, Homo sapiens
tccctgattgacctgctccg

SEQ ID NO: 4049282 - DNA, 15 bp, Homo sapiens
tccctgcagacctca

SEQ ID NO: 4049283 - DNA, 19 bp, Homo sapiens
tccctgcagacctcaagcc

SEQ ID NO: 4049284 - DNA, 20 bp, Homo sapiens
tccctgcagacctcaagcca

SEQ ID NO: 4049285 - DNA, 14 bp, Homo sapiens
tccctgcatttctg

SEQ ID NO: 4049286 - DNA, 21 bp, Homo sapiens
tccctgccacatacaggtgct

SEQ ID NO: 4049287 - DNA, 20 bp, Homo sapiens
tccctgcccctcccttcaac

SEQ ID NO: 4049288 - DNA, 14 bp, Homo sapiens
tccctgcctgaggg

SEQ ID NO: 4049289 - DNA, 15 bp, Homo sapiens
tccctgcgagacgca

SEQ ID NO: 4049290 - DNA, 19 bp, Homo sapiens
tccctgcgagacgcacaca

SEQ ID NO: 4049291 - DNA, 18 bp, Homo sapiens
tccaccttggctctgcca

SEQ ID NO: 4049292 - DNA, 14 bp, Homo sapiens
tccacctttcccaa

SEQ ID NO: 4049293 - DNA, 17 bp, Homo sapiens
tccacgagagcgcagca

SEQ ID NO: 4049294 - DNA, 19 bp, Homo sapiens
tccacgcctcctggccaga

SEQ ID NO: 4049295 - DNA, 20 bp, Homo sapiens
tccacgcctcctggccagac

SEQ ID NO: 4049296 - DNA, 14 bp, Homo sapiens
tccactaaaaatat

SEQ ID NO: 4049297 - DNA, 17 bp, Homo sapiens
tccactaaaaatattgt

SEQ ID NO: 4049298 - DNA, 18 bp, Homo sapiens
tccactacacctggctga

SEQ ID NO: 4049299 - DNA, 21 bp, Homo sapiens
tccactaccccacaccagcct

SEQ ID NO: 4049300 - DNA, 21 bp, Homo sapiens
tccactccatgtttgcaatgc

SEQ ID NO: 4049301 - DNA, 18 bp, Homo sapiens
tccactccctgctccacg

SEQ ID NO: 4049302 - DNA, 16 bp, Homo sapiens
tccactcgacccagaa

SEQ ID NO: 4049303 - DNA, 20 bp, Homo sapiens
tccactctaccctcccaccc

SEQ ID NO: 4049304 - DNA, 15 bp, Homo sapiens
tccactgataagact

SEQ ID NO: 4049305 - DNA, 13 bp, Homo sapiens
tccactgccttcg

SEQ ID NO: 4049306 - DNA, 22 bp, Homo sapiens
tccactgccttcgatacaccgg

SEQ ID NO: 4049307 - DNA, 18 bp, Homo sapiens
tccactgtaattaaaact

SEQ ID NO: 4049308 - DNA, 19 bp, Homo sapiens
tccactgtaattaaaacta

SEQ ID NO: 4049309 - DNA, 19 bp, Homo sapiens
tccactgtcaccctccacc

SEQ ID NO: 4049310 - DNA, 19 bp, Homo sapiens
tccactgtcactgtttctc

SEQ ID NO: 4049311 - DNA, 22 bp, Homo sapiens
tccactgtcactgtttctctgc

SEQ ID NO: 4049312 - DNA, 21 bp, Homo sapiens
tccacttagaaattgcatttc

SEQ ID NO: 4049313 - DNA, 23 bp, Homo sapiens
tccacttagaaattgcatttcct

SEQ ID NO: 4049314 - DNA, 16 bp, Homo sapiens
tccactttgttcttta

SEQ ID NO: 4049315 - DNA, 20 bp, Homo sapiens
tccagaaacttgttcttcca

SEQ ID NO: 4049316 - DNA, 17 bp, Homo sapiens
tccagaaaggatattta

SEQ ID NO: 4049317 - DNA, 19 bp, Homo sapiens
tccagaaatacaattttag

SEQ ID NO: 4049318 - DNA, 16 bp, Homo sapiens
tccagaactcttcctc

SEQ ID NO: 4049319 - DNA, 18 bp, Homo sapiens
tccagaactcttcctcca

SEQ ID NO: 4049320 - DNA, 17 bp, Homo sapiens
tccagaagaagagaagc

SEQ ID NO: 4049321 - DNA, 21 bp, Homo sapiens
tccagaagaatattcaggact

SEQ ID NO: 4049322 - DNA, 19 bp, Homo sapiens
tccagaagatgccagcttc

SEQ ID NO: 4049323 - DNA, 19 bp, Homo sapiens
tccagaagcctctggctag

SEQ ID NO: 4049324 - DNA, 23 bp, Homo sapiens
tccagaatgctgaactccttgtt

SEQ ID NO: 4049325 - DNA, 15 bp, Homo sapiens
tccagaatgctgtac

SEQ ID NO: 4049326 - DNA, 16 bp, Homo sapiens
tccagaatgctgtaca

SEQ ID NO: 4049327 - DNA, 13 bp, Homo sapiens
tccagaatgtaag

SEQ ID NO: 4049328 - DNA, 22 bp, Homo sapiens
tccagaatgtaagaaaacaaaa

SEQ ID NO: 4049329 - DNA, 16 bp, Homo sapiens
tccagacccctggctt

SEQ ID NO: 4049330 - DNA, 23 bp, Homo sapiens
tccagacccctggcttttcactg

SEQ ID NO: 4049331 - DNA, 18 bp, Homo sapiens
tccagacctgatcctgga

SEQ ID NO: 4049332 - DNA, 19 bp, Homo sapiens
tccagacctgatcctggag

SEQ ID NO: 4049333 - DNA, 19 bp, Homo sapiens
tccagagaaacccagggag

SEQ ID NO: 4049334 - DNA, 18 bp, Homo sapiens
tccagagagcagctccct

SEQ ID NO: 4049335 - DNA, 19 bp, Homo sapiens
tccagagagtggctcctcc

SEQ ID NO: 4049336 - DNA, 23 bp, Homo sapiens
tccagagcggaggctgtgtgcct

SEQ ID NO: 4049337 - DNA, 15 bp, Homo sapiens
tccagagctgccagt

SEQ ID NO: 4049338 - DNA, 20 bp, Homo sapiens
tccagagggttgtgattttg

SEQ ID NO: 4049339 - DNA, 13 bp, Homo sapiens
tccagagtgctga

SEQ ID NO: 4049340 - DNA, 15 bp, Homo sapiens
tccagatgcagggca

SEQ ID NO: 4049341 - DNA, 19 bp, Homo sapiens
tccagatgcagggcagtca

SEQ ID NO: 4049342 - DNA, 19 bp, Homo sapiens
tccagatgtttccagactt

SEQ ID NO: 4049343 - DNA, 19 bp, Homo sapiens
tccagatttttcggaggcc

SEQ ID NO: 4049344 - DNA, 14 bp, Homo sapiens
tccagcaataagaa

SEQ ID NO: 4049345 - DNA, 16 bp, Homo sapiens
tccagcaataagaaat

SEQ ID NO: 4049346 - DNA, 17 bp, Homo sapiens
tccagcaataagaaatg

SEQ ID NO: 4049347 - DNA, 18 bp, Homo sapiens
tccagcaataagaaatga

SEQ ID NO: 4049348 - DNA, 22 bp, Homo sapiens
tccagcaataagaaatgaacaa

SEQ ID NO: 4049349 - DNA, 19 bp, Homo sapiens
tccagcaattctcctgcct

SEQ ID NO: 4049350 - DNA, 21 bp, Homo sapiens
tccagcaattctcctgcctca

SEQ ID NO: 4049351 - DNA, 23 bp, Homo sapiens
tccagcacagaaggaatctgtgc

SEQ ID NO: 4049352 - DNA, 20 bp, Homo sapiens
tccagcagtctgataaactg

SEQ ID NO: 4049353 - DNA, 20 bp, Homo sapiens
tccagcagtgttgctcagct

SEQ ID NO: 4049354 - DNA, 23 bp, Homo sapiens
tccagcagtgttgctcagctcct

SEQ ID NO: 4049355 - DNA, 14 bp, Homo sapiens
tccagcccctgtcc

SEQ ID NO: 4049356 - DNA, 18 bp, Homo sapiens
tccagccgccattgccac

SEQ ID NO: 4049357 - DNA, 20 bp, Homo sapiens
tccagccgccattgccacca

SEQ ID NO: 4049358 - DNA, 17 bp, Homo sapiens
tccagcctccctgtctc

SEQ ID NO: 4049359 - DNA, 20 bp, Homo sapiens
tccagcctgcccaagcccag

SEQ ID NO: 4049360 - DNA, 22 bp, Homo sapiens
tccagcctggaaacctgtctga

SEQ ID NO: 4049361 - DNA, 12 bp, Homo sapiens
tccagctccaac

SEQ ID NO: 4049362 - DNA, 18 bp, Homo sapiens
tccagctccaacctgcaa

SEQ ID NO: 4049363 - DNA, 19 bp, Homo sapiens
tccagctccctagactgca

SEQ ID NO: 4049364 - DNA, 22 bp, Homo sapiens
tccagctctaataaaacagctg

SEQ ID NO: 4049365 - DNA, 13 bp, Homo sapiens
tccagctcttggc

SEQ ID NO: 4049366 - DNA, 22 bp, Homo sapiens
tccagctgccccggcccctccc

SEQ ID NO: 4049367 - DNA, 11 bp, Homo sapiens
tccagctgcct

SEQ ID NO: 4049368 - DNA, 14 bp, Homo sapiens
tccagctgcctggg

SEQ ID NO: 4049369 - DNA, 16 bp, Homo sapiens
tccagctgcctgggcc

SEQ ID NO: 4049370 - DNA, 17 bp, Homo sapiens
tccagctgctgtcttct

SEQ ID NO: 4049371 - DNA, 20 bp, Homo sapiens
tccagctggggccagaggct

SEQ ID NO: 4049372 - DNA, 22 bp, Homo sapiens
tccagctggggccagaggctgg

SEQ ID NO: 4049373 - DNA, 16 bp, Homo sapiens
tccagcttcaggcacc

SEQ ID NO: 4049374 - DNA, 18 bp, Homo sapiens
tccagcttcaggcaccag

SEQ ID NO: 4049375 - DNA, 23 bp, Homo sapiens
tccagcttcaggcaccagcatcc

SEQ ID NO: 4049376 - DNA, 16 bp, Homo sapiens
tccagcttcggagggc

SEQ ID NO: 4049377 - DNA, 23 bp, Homo sapiens
tccagcttcggagggcccctgcg

SEQ ID NO: 4049378 - DNA, 21 bp, Homo sapiens
tccaggaaactccacatctgc

SEQ ID NO: 4049379 - DNA, 20 bp, Homo sapiens
tccaggaaagagcagtcaga

SEQ ID NO: 4049380 - DNA, 22 bp, Homo sapiens
tccaggaaggtagcccagcact

SEQ ID NO: 4049381 - DNA, 23 bp, Homo sapiens
tccaggaaggtagcccagcactg

SEQ ID NO: 4049382 - DNA, 18 bp, Homo sapiens
tccaggataaggagactg

SEQ ID NO: 4049383 - DNA, 19 bp, Homo sapiens
tccaggataaggagactga

SEQ ID NO: 4049384 - DNA, 22 bp, Homo sapiens
tccaggatctccactgataaga

SEQ ID NO: 4049385 - DNA, 19 bp, Homo sapiens
tccaggattgaagagcatt

SEQ ID NO: 4049386 - DNA, 16 bp, Homo sapiens
tccaggccatgatggc

SEQ ID NO: 4049387 - DNA, 17 bp, Homo sapiens
tccaggcccaactgtga

SEQ ID NO: 4049388 - DNA, 17 bp, Homo sapiens
tccaggcccaaggctcc

SEQ ID NO: 4049389 - DNA, 19 bp, Homo sapiens
tccaggcccaaggctcccg

SEQ ID NO: 4049390 - DNA, 13 bp, Homo sapiens
tccaggcctgcct

SEQ ID NO: 4049391 - DNA, 22 bp, Homo sapiens
tccaggctctttggggtcagcc

SEQ ID NO: 4049392 - DNA, 23 bp, Homo sapiens
tccaggctctttggggtcagcca

SEQ ID NO: 4049393 - DNA, 23 bp, Homo sapiens
tccaggcttcacagtctggtgct

SEQ ID NO: 4049394 - DNA, 20 bp, Homo sapiens
tccaggctttgtacagagtg

SEQ ID NO: 4049395 - DNA, 12 bp, Homo sapiens
tccagggaagct

SEQ ID NO: 4049396 - DNA, 14 bp, Homo sapiens
tccagggaagctgg

SEQ ID NO: 4049397 - DNA, 15 bp, Homo sapiens
tccagggacagaggc

SEQ ID NO: 4049398 - DNA, 17 bp, Homo sapiens
tccagggagcaagacag

SEQ ID NO: 4049399 - DNA, 14 bp, Homo sapiens
tccagggcccaggt

SEQ ID NO: 4049400 - DNA, 14 bp, Homo sapiens
tccagggcctgaca

SEQ ID NO: 4049401 - DNA, 17 bp, Homo sapiens
tccagggcctgacaccc

SEQ ID NO: 4049402 - DNA, 21 bp, Homo sapiens
tccaggggcccttgggacagc

SEQ ID NO: 4049403 - DNA, 14 bp, Homo sapiens
tccagggtttctct

SEQ ID NO: 4049404 - DNA, 15 bp, Homo sapiens
tccagggtttctctg

SEQ ID NO: 4049405 - DNA, 16 bp, Homo sapiens
tccagggtttctctgc

SEQ ID NO: 4049406 - DNA, 16 bp, Homo sapiens
tccaggtcttgactca

SEQ ID NO: 4049407 - DNA, 12 bp, Homo sapiens
tccaggtgctca

SEQ ID NO: 4049408 - DNA, 23 bp, Homo sapiens
tccaggttcaacccacagctact

SEQ ID NO: 4049409 - DNA, 15 bp, Homo sapiens
tccagtaatctaata

SEQ ID NO: 4049410 - DNA, 15 bp, Homo sapiens
tccagtaccttgctt

SEQ ID NO: 4049411 - DNA, 14 bp, Homo sapiens
tccagtattgctga

SEQ ID NO: 4049412 - DNA, 12 bp, Homo sapiens
tccagtcaggct

SEQ ID NO: 4049413 - DNA, 15 bp, Homo sapiens
tccagtccccagaac

SEQ ID NO: 4049414 - DNA, 21 bp, Homo sapiens
tccagtccccagaactctgcc

SEQ ID NO: 4049415 - DNA, 16 bp, Homo sapiens
tccagtgctctgcctc

SEQ ID NO: 4049416 - DNA, 17 bp, Homo sapiens
tccagtgctctgcctca

SEQ ID NO: 4049417 - DNA, 17 bp, Homo sapiens
tccagtggaggtttgtc

SEQ ID NO: 4049418 - DNA, 16 bp, Homo sapiens
tccagtggcagacaaa

SEQ ID NO: 4049419 - DNA, 19 bp, Homo sapiens
tccagtggcagacaaacag

SEQ ID NO: 4049420 - DNA, 19 bp, Homo sapiens
tccagtggtgaagaaaact

SEQ ID NO: 4049421 - DNA, 13 bp, Homo sapiens
tccagtgtacata

SEQ ID NO: 4049422 - DNA, 15 bp, Homo sapiens
tccagtgtcacctct

SEQ ID NO: 4049423 - DNA, 17 bp, Homo sapiens
tccagtgtcacctctct

SEQ ID NO: 4049424 - DNA, 23 bp, Homo sapiens
tccagtgtcacctctctcagagc

SEQ ID NO: 4049425 - DNA, 20 bp, Homo sapiens
tccagtgtccttagaacatt

SEQ ID NO: 4049426 - DNA, 20 bp, Homo sapiens
tccagttcatcgattttcta

SEQ ID NO: 4049427 - DNA, 18 bp, Homo sapiens
tccagttgggactcagga

SEQ ID NO: 4049428 - DNA, 14 bp, Homo sapiens
tccagtttgttctc

SEQ ID NO: 4049429 - DNA, 18 bp, Homo sapiens
tccagtttgttctccggg

SEQ ID NO: 4049430 - DNA, 19 bp, Homo sapiens
tccagtttgttctccgggt

SEQ ID NO: 4049431 - DNA, 18 bp, Homo sapiens
tccataatgcattcttct

SEQ ID NO: 4049432 - DNA, 19 bp, Homo sapiens
tccataattatgacagtta

SEQ ID NO: 4049433 - DNA, 21 bp, Homo sapiens
tccataattatgacagttata

SEQ ID NO: 4049434 - DNA, 14 bp, Homo sapiens
tccatacacagagg

SEQ ID NO: 4049435 - DNA, 18 bp, Homo sapiens
tccatacacagaggagtg

SEQ ID NO: 4049436 - DNA, 22 bp, Homo sapiens
tccataccttttctcttttctt

SEQ ID NO: 4049437 - DNA, 21 bp, Homo sapiens
tccatagcctaatccctgggc

SEQ ID NO: 4049438 - DNA, 23 bp, Homo sapiens
tccatcaataaatgctctatttt

SEQ ID NO: 4049439 - DNA, 13 bp, Homo sapiens
tccatcagctccc

SEQ ID NO: 4049440 - DNA, 21 bp, Homo sapiens
tccatcatatgcctgacccct

SEQ ID NO: 4049441 - DNA, 13 bp, Homo sapiens
tccatcattttac

SEQ ID NO: 4049442 - DNA, 16 bp, Homo sapiens
tccatcattttacagt

SEQ ID NO: 4049443 - DNA, 18 bp, Homo sapiens
tccatccacctttcccaa

SEQ ID NO: 4049444 - DNA, 14 bp, Homo sapiens
tccatccatccttc

SEQ ID NO: 4049445 - DNA, 15 bp, Homo sapiens
tccatccatctccag

SEQ ID NO: 4049446 - DNA, 16 bp, Homo sapiens
tccatccatctttcca

SEQ ID NO: 4049447 - DNA, 17 bp, Homo sapiens
tccatcccaacagccat

SEQ ID NO: 4049448 - DNA, 16 bp, Homo sapiens
tccatcctcctccttc

SEQ ID NO: 4049449 - DNA, 13 bp, Homo sapiens
tccatctccaggg

SEQ ID NO: 4049450 - DNA, 23 bp, Homo sapiens
tccatctcccgaattcgctgtta

SEQ ID NO: 4049451 - DNA, 14 bp, Homo sapiens
tccatctcttctgc

SEQ ID NO: 4049452 - DNA, 20 bp, Homo sapiens
tccatgaagaccacatccac

SEQ ID NO: 4049453 - DNA, 20 bp, Homo sapiens
tccatgaagagcttgtgtcc

SEQ ID NO: 4049454 - DNA, 15 bp, Homo sapiens
tccatgaaggcagag

SEQ ID NO: 4049455 - DNA, 13 bp, Homo sapiens
tccatgagcaccc

SEQ ID NO: 4049456 - DNA, 18 bp, Homo sapiens
tccatgagtgtctgtgag

SEQ ID NO: 4049457 - DNA, 12 bp, Homo sapiens
tccatgattcta

SEQ ID NO: 4049458 - DNA, 21 bp, Homo sapiens
tccatgcaactggagttcctt

SEQ ID NO: 4049459 - DNA, 15 bp, Homo sapiens
tccatgcccactgct

SEQ ID NO: 4049460 - DNA, 20 bp, Homo sapiens
tccatgcccactgctggtgc

SEQ ID NO: 4049461 - DNA, 16 bp, Homo sapiens
tccatgcctgagggtg

SEQ ID NO: 4049462 - DNA, 21 bp, Homo sapiens
tccatgctcctcacctgtcta

SEQ ID NO: 4049463 - DNA, 18 bp, Homo sapiens
tccatggccctgtcccag

SEQ ID NO: 4049464 - DNA, 17 bp, Homo sapiens
tccatgggaaagatggt

SEQ ID NO: 4049465 - DNA, 20 bp, Homo sapiens
tccatgggagccagctgctt

SEQ ID NO: 4049466 - DNA, 22 bp, Homo sapiens
tccatgggagccagctgctttt

SEQ ID NO: 4049467 - DNA, 23 bp, Homo sapiens
tccatgggagccagctgcttttt

SEQ ID NO: 4049468 - DNA, 14 bp, Homo sapiens
tccatgtactgtag

SEQ ID NO: 4049469 - DNA, 16 bp, Homo sapiens
tccatgtactgtagtt

SEQ ID NO: 4049470 - DNA, 21 bp, Homo sapiens
tccatgtactgtagtttttct

SEQ ID NO: 4049471 - DNA, 17 bp, Homo sapiens
tccatgtgcacccggcc

SEQ ID NO: 4049472 - DNA, 13 bp, Homo sapiens
tccatgtgccttt

SEQ ID NO: 4049473 - DNA, 14 bp, Homo sapiens
tccatgtgcctttc

SEQ ID NO: 4049474 - DNA, 15 bp, Homo sapiens
tccatgttctatttt

SEQ ID NO: 4049475 - DNA, 17 bp, Homo sapiens
tccattacctccatcca

SEQ ID NO: 4049476 - DNA, 15 bp, Homo sapiens
tccattaggccagca

SEQ ID NO: 4049477 - DNA, 15 bp, Homo sapiens
tccattatttatatt

SEQ ID NO: 4049478 - DNA, 22 bp, Homo sapiens
tccattcacagttctttgggcc

SEQ ID NO: 4049479 - DNA, 12 bp, Homo sapiens
tccattccagaa

SEQ ID NO: 4049480 - DNA, 12 bp, Homo sapiens
tccattctcatt

SEQ ID NO: 4049481 - DNA, 14 bp, Homo sapiens
tccattctcccagg

SEQ ID NO: 4049482 - DNA, 16 bp, Homo sapiens
tccattctcccaggta

SEQ ID NO: 4049483 - DNA, 14 bp, Homo sapiens
tccattgtttaaag

SEQ ID NO: 4049484 - DNA, 15 bp, Homo sapiens
tccattgtttaaaga

SEQ ID NO: 4049485 - DNA, 14 bp, Homo sapiens
tccatttagttctt

SEQ ID NO: 4049486 - DNA, 20 bp, Homo sapiens
tccatttagttctttgttat

SEQ ID NO: 4049487 - DNA, 15 bp, Homo sapiens
tcccattcctccctc

SEQ ID NO: 4049488 - DNA, 13 bp, Homo sapiens
tcccattcctgaa

SEQ ID NO: 4049489 - DNA, 13 bp, Homo sapiens
tcccatttcagga

SEQ ID NO: 4049490 - DNA, 14 bp, Homo sapiens
tcccatttcaggaa

SEQ ID NO: 4049491 - DNA, 14 bp, Homo sapiens
tcccatttccttgg

SEQ ID NO: 4049492 - DNA, 22 bp, Homo sapiens
tcccattttgcaaaatttccag

SEQ ID NO: 4049493 - DNA, 19 bp, Homo sapiens
tcccattttggaagttttc

SEQ ID NO: 4049494 - DNA, 18 bp, Homo sapiens
tccccaaaggacgcctgc

SEQ ID NO: 4049495 - DNA, 18 bp, Homo sapiens
tccccaaatcaatacact

SEQ ID NO: 4049496 - DNA, 23 bp, Homo sapiens
tccccaaatcaatacactagttg

SEQ ID NO: 4049497 - DNA, 13 bp, Homo sapiens
tccccaaccacag

SEQ ID NO: 4049498 - DNA, 20 bp, Homo sapiens
tccccaaccctaggttccct

SEQ ID NO: 4049499 - DNA, 21 bp, Homo sapiens
tccccaaggccccctgcctgc

SEQ ID NO: 4049500 - DNA, 14 bp, Homo sapiens
tccccaatcagctc

SEQ ID NO: 4049501 - DNA, 22 bp, Homo sapiens
tccccacaccttccagggccct

SEQ ID NO: 4049502 - DNA, 20 bp, Homo sapiens
tccccacagcgtccctggcg

SEQ ID NO: 4049503 - DNA, 12 bp, Homo sapiens
tccccaccagct

SEQ ID NO: 4049504 - DNA, 16 bp, Homo sapiens
tccccaccagctcgtt

SEQ ID NO: 4049505 - DNA, 14 bp, Homo sapiens
tccccaccctccac

SEQ ID NO: 4049506 - DNA, 16 bp, Homo sapiens
tccccaccctccactc

SEQ ID NO: 4049507 - DNA, 17 bp, Homo sapiens
tccccaccctccccttc

SEQ ID NO: 4049508 - DNA, 20 bp, Homo sapiens
tccccacgagggctggctgg

SEQ ID NO: 4049509 - DNA, 14 bp, Homo sapiens
tccccactgtccta

SEQ ID NO: 4049510 - DNA, 17 bp, Homo sapiens
tccccagaaaggagact

SEQ ID NO: 4049511 - DNA, 17 bp, Homo sapiens
tccccagaactctgcct

SEQ ID NO: 4049512 - DNA, 21 bp, Homo sapiens
tccccagaactctgcctgccc

SEQ ID NO: 4049513 - DNA, 18 bp, Homo sapiens
tccccagcatcactcccc

SEQ ID NO: 4049514 - DNA, 15 bp, Homo sapiens
tccccagccctggct

SEQ ID NO: 4049515 - DNA, 22 bp, Homo sapiens
tccccagcccttcctctgctcc

SEQ ID NO: 4049516 - DNA, 12 bp, Homo sapiens
tccccaggccag

SEQ ID NO: 4049517 - DNA, 22 bp, Homo sapiens
tccccaggccaggccaccagga

SEQ ID NO: 4049518 - DNA, 20 bp, Homo sapiens
tccccaggctggagaccccc

SEQ ID NO: 4049519 - DNA, 13 bp, Homo sapiens
tccccagggagct

SEQ ID NO: 4049520 - DNA, 18 bp, Homo sapiens
tccccaggggaaaatgaa

SEQ ID NO: 4049521 - DNA, 19 bp, Homo sapiens
tccccaggggaaaatgaag

SEQ ID NO: 4049522 - DNA, 23 bp, Homo sapiens
tccccaggggtcccagccacccc

SEQ ID NO: 4049523 - DNA, 11 bp, Homo sapiens
tccccaggtgt

SEQ ID NO: 4049524 - DNA, 14 bp, Homo sapiens
tccccaggtgtgtg

SEQ ID NO: 4049525 - DNA, 16 bp, Homo sapiens
tccccaggtgtgtgct

SEQ ID NO: 4049526 - DNA, 17 bp, Homo sapiens
tccccaggtgtgtgctt

SEQ ID NO: 4049527 - DNA, 15 bp, Homo sapiens
tccccatcctccaga

SEQ ID NO: 4049528 - DNA, 14 bp, Homo sapiens
tccccatctccctg

SEQ ID NO: 4049529 - DNA, 15 bp, Homo sapiens
tccccatctccctgc

SEQ ID NO: 4049530 - DNA, 16 bp, Homo sapiens
tccccatctccctgcc

SEQ ID NO: 4049531 - DNA, 20 bp, Homo sapiens
tccccatctccctgcctggc

SEQ ID NO: 4049532 - DNA, 14 bp, Homo sapiens
tccccatctgtcca

SEQ ID NO: 4049533 - DNA, 17 bp, Homo sapiens
tccccatctgtccagct

SEQ ID NO: 4049534 - DNA, 14 bp, Homo sapiens
tccccatcttctaa

SEQ ID NO: 4049535 - DNA, 22 bp, Homo sapiens
tccccatgccacgttccacagt

SEQ ID NO: 4049536 - DNA, 21 bp, Homo sapiens
tccccatgcctagcagagtgc

SEQ ID NO: 4049537 - DNA, 15 bp, Homo sapiens
tccccatggagccag

SEQ ID NO: 4049538 - DNA, 18 bp, Homo sapiens
tccccatttcccatctgc

SEQ ID NO: 4049539 - DNA, 15 bp, Homo sapiens
tccccatttctgcct

SEQ ID NO: 4049540 - DNA, 16 bp, Homo sapiens
tccccatttctgcctc

SEQ ID NO: 4049541 - DNA, 11 bp, Homo sapiens
tcccccaaagg

SEQ ID NO: 4049542 - DNA, 15 bp, Homo sapiens
tcccccaaaggcatc

SEQ ID NO: 4049543 - DNA, 14 bp, Homo sapiens
tcccccaaccccca

SEQ ID NO: 4049544 - DNA, 22 bp, Homo sapiens
tcccccaacccccaccccacac

SEQ ID NO: 4049545 - DNA, 17 bp, Homo sapiens
tcccccaacctcagact

SEQ ID NO: 4049546 - DNA, 22 bp, Homo sapiens
tcccccaccagctaaggacatt

SEQ ID NO: 4049547 - DNA, 15 bp, Homo sapiens
tcccccaccagctgc

SEQ ID NO: 4049548 - DNA, 20 bp, Homo sapiens
tcccccacctcggtcactcc

SEQ ID NO: 4049549 - DNA, 18 bp, Homo sapiens
tcccccactactgcagca

SEQ ID NO: 4049550 - DNA, 24 bp, Homo sapiens
tcccccactactgcagcacctcca

SEQ ID NO: 4049551 - DNA, 14 bp, Homo sapiens
tcccccagtacctc

SEQ ID NO: 4049552 - DNA, 16 bp, Homo sapiens
tcccccagtccccttc

SEQ ID NO: 4049553 - DNA, 15 bp, Homo sapiens
tcccccatctcccac

SEQ ID NO: 4049554 - DNA, 18 bp, Homo sapiens
tcccccattccctccatt

SEQ ID NO: 4049555 - DNA, 17 bp, Homo sapiens
tcccccccatgcactgt

SEQ ID NO: 4049556 - DNA, 19 bp, Homo sapiens
tcccccgagctcttggcct

SEQ ID NO: 4049557 - DNA, 20 bp, Homo sapiens
tcccccgagctcttggcctt

SEQ ID NO: 4049558 - DNA, 21 bp, Homo sapiens
tcccccgagctcttggccttt

SEQ ID NO: 4049559 - DNA, 24 bp, Homo sapiens
tcccccgagctcttggcctttgca

SEQ ID NO: 4049560 - DNA, 12 bp, Homo sapiens
tccccctaccca

SEQ ID NO: 4049561 - DNA, 16 bp, Homo sapiens
tccccctacccaccga

SEQ ID NO: 4049562 - DNA, 17 bp, Homo sapiens
tccccctcaacctcacc

SEQ ID NO: 4049563 - DNA, 17 bp, Homo sapiens
tccccctcccctcccag

SEQ ID NO: 4049564 - DNA, 14 bp, Homo sapiens
tcccccttgccacc

SEQ ID NO: 4049565 - DNA, 21 bp, Homo sapiens
tccccctttcttcctcattcc

SEQ ID NO: 4049566 - DNA, 13 bp, Homo sapiens
tccccgcccctgt

SEQ ID NO: 4049567 - DNA, 23 bp, Homo sapiens
tccccgccttagagcctcgtccc

SEQ ID NO: 4049568 - DNA, 22 bp, Homo sapiens
tccccggacatactctctgcct

SEQ ID NO: 4049569 - DNA, 14 bp, Homo sapiens
tcccctacagaatt

SEQ ID NO: 4049570 - DNA, 19 bp, Homo sapiens
tcccctatggggatggtcc

SEQ ID NO: 4049571 - DNA, 15 bp, Homo sapiens
tcccctcacctcctc

SEQ ID NO: 4049572 - DNA, 19 bp, Homo sapiens
tcccctccacatcccagca

SEQ ID NO: 4049573 - DNA, 12 bp, Homo sapiens
tcccctccactg

SEQ ID NO: 4049574 - DNA, 12 bp, Homo sapiens
tcccctccagcc

SEQ ID NO: 4049575 - DNA, 12 bp, Homo sapiens
tcccctccagga

SEQ ID NO: 4049576 - DNA, 15 bp, Homo sapiens
tcccctccaggaggg

SEQ ID NO: 4049577 - DNA, 13 bp, Homo sapiens
tcccctcccagtc

SEQ ID NO: 4049578 - DNA, 14 bp, Homo sapiens
tcccctccctgtca

SEQ ID NO: 4049579 - DNA, 17 bp, Homo sapiens
tcccctccggactggtg

SEQ ID NO: 4049580 - DNA, 18 bp, Homo sapiens
tcccctccttccctcacc

SEQ ID NO: 4049581 - DNA, 13 bp, Homo sapiens
tcccctctgctgc

SEQ ID NO: 4049582 - DNA, 20 bp, Homo sapiens
tcccctctggaatgcactga

SEQ ID NO: 4049583 - DNA, 14 bp, Homo sapiens
tcccctctggcttg

SEQ ID NO: 4049584 - DNA, 18 bp, Homo sapiens
tcccctctggcttgacag

SEQ ID NO: 4049585 - DNA, 23 bp, Homo sapiens
tcccctcttttgttaaataatat

SEQ ID NO: 4049586 - DNA, 19 bp, Homo sapiens
tcccctgccccttccttta

SEQ ID NO: 4049587 - DNA, 15 bp, Homo sapiens
tcccctgccctggtc

SEQ ID NO: 4049588 - DNA, 16 bp, Homo sapiens
tcccctggactgggag

SEQ ID NO: 4049589 - DNA, 12 bp, Homo sapiens
tcccctggagcc

SEQ ID NO: 4049590 - DNA, 20 bp, Homo sapiens
tcccctgtgccagcccagag

SEQ ID NO: 4049591 - DNA, 23 bp, Homo sapiens
taaatcatgtatgttatgatatt

SEQ ID NO: 4049592 - DNA, 16 bp, Homo sapiens
taaatcatttcagtat

SEQ ID NO: 4049593 - DNA, 19 bp, Homo sapiens
taaatcatttcagtatcat

SEQ ID NO: 4049594 - DNA, 17 bp, Homo sapiens
taaatcctttttcttta

SEQ ID NO: 4049595 - DNA, 19 bp, Homo sapiens
taaatctaaatctatttat

SEQ ID NO: 4049596 - DNA, 21 bp, Homo sapiens
taaatctgtccaactgagaag

SEQ ID NO: 4049597 - DNA, 14 bp, Homo sapiens
taaatcttccttgt

SEQ ID NO: 4049598 - DNA, 15 bp, Homo sapiens
taaatgaaatttgca

SEQ ID NO: 4049599 - DNA, 17 bp, Homo sapiens
taaatgaaatttgcaaa

SEQ ID NO: 4049600 - DNA, 16 bp, Homo sapiens
taaatgaagcagcttt

SEQ ID NO: 4049601 - DNA, 17 bp, Homo sapiens
taaatgaagcagcttta

SEQ ID NO: 4049602 - DNA, 23 bp, Homo sapiens
taaatgaagcagctttaaacaaa

SEQ ID NO: 4049603 - DNA, 16 bp, Homo sapiens
taaatgaatctggtgt

SEQ ID NO: 4049604 - DNA, 14 bp, Homo sapiens
taaatgagctcctg

SEQ ID NO: 4049605 - DNA, 12 bp, Homo sapiens
taaatgatttta

SEQ ID NO: 4049606 - DNA, 19 bp, Homo sapiens
taaatgcaccaagaaagct

SEQ ID NO: 4049607 - DNA, 21 bp, Homo sapiens
taaatgcaccaagaaagcttc

SEQ ID NO: 4049608 - DNA, 17 bp, Homo sapiens
taaatgcagttttaaga

SEQ ID NO: 4049609 - DNA, 21 bp, Homo sapiens
taaatgcatatcctgagccat

SEQ ID NO: 4049610 - DNA, 15 bp, Homo sapiens
taaatgccctcttct

SEQ ID NO: 4049611 - DNA, 14 bp, Homo sapiens
taaatgctattttt

SEQ ID NO: 4049612 - DNA, 15 bp, Homo sapiens
taaatgctctatttt

SEQ ID NO: 4049613 - DNA, 18 bp, Homo sapiens
taaatggcagtatttcat

SEQ ID NO: 4049614 - DNA, 19 bp, Homo sapiens
taaatggcagtatttcatt

SEQ ID NO: 4049615 - DNA, 14 bp, Homo sapiens
taaatggggcccat

SEQ ID NO: 4049616 - DNA, 17 bp, Homo sapiens
taaatggtttctgaaaa

SEQ ID NO: 4049617 - DNA, 13 bp, Homo sapiens
taaatgtatacta

SEQ ID NO: 4049618 - DNA, 18 bp, Homo sapiens
taaatgtctattattatg

SEQ ID NO: 4049619 - DNA, 17 bp, Homo sapiens
taaatgtctttgtaagt

SEQ ID NO: 4049620 - DNA, 17 bp, Homo sapiens
taaatgttagttctagc

SEQ ID NO: 4049621 - DNA, 19 bp, Homo sapiens
taaatgttatgactatgta

SEQ ID NO: 4049622 - DNA, 22 bp, Homo sapiens
taaatgttatgactatgtaaac

SEQ ID NO: 4049623 - DNA, 22 bp, Homo sapiens
taaattaatattgtattgctgc

SEQ ID NO: 4049624 - DNA, 17 bp, Homo sapiens
taaattaggaataaata

SEQ ID NO: 4049625 - DNA, 13 bp, Homo sapiens
taaattatgtata

SEQ ID NO: 4049626 - DNA, 18 bp, Homo sapiens
taaattatgttttaaaca

SEQ ID NO: 4049627 - DNA, 15 bp, Homo sapiens
taaattatttgctaa

SEQ ID NO: 4049628 - DNA, 11 bp, Homo sapiens
taaattatttt

SEQ ID NO: 4049629 - DNA, 18 bp, Homo sapiens
taaattcacaaactttta

SEQ ID NO: 4049630 - DNA, 23 bp, Homo sapiens
taaattcagatatatttttcaca

SEQ ID NO: 4049631 - DNA, 16 bp, Homo sapiens
taaattctatgttaaa

SEQ ID NO: 4049632 - DNA, 21 bp, Homo sapiens
taaattctatgttaaatactg

SEQ ID NO: 4049633 - DNA, 22 bp, Homo sapiens
taaattctatgttaaatactgt

SEQ ID NO: 4049634 - DNA, 13 bp, Homo sapiens
taaattctgattc

SEQ ID NO: 4049635 - DNA, 13 bp, Homo sapiens
taaattgaaattg

SEQ ID NO: 4049636 - DNA, 17 bp, Homo sapiens
taaattgcataaagcat

SEQ ID NO: 4049637 - DNA, 16 bp, Homo sapiens
taaattgcctgatttg

SEQ ID NO: 4049638 - DNA, 19 bp, Homo sapiens
taaattgcctgatttgttt

SEQ ID NO: 4049639 - DNA, 15 bp, Homo sapiens
taaattgtcattatt

SEQ ID NO: 4049640 - DNA, 18 bp, Homo sapiens
taaattgtcattattttg

SEQ ID NO: 4049641 - DNA, 17 bp, Homo sapiens
taaattgtttcatatct

SEQ ID NO: 4049642 - DNA, 14 bp, Homo sapiens
taaatttaaagata

SEQ ID NO: 4049643 - DNA, 21 bp, Homo sapiens
taaatttccatatccttctgg

SEQ ID NO: 4049644 - DNA, 15 bp, Homo sapiens
taaatttcttatgtg

SEQ ID NO: 4049645 - DNA, 16 bp, Homo sapiens
taaatttcttatgtga

SEQ ID NO: 4049646 - DNA, 22 bp, Homo sapiens
taaatttcttatgtgacattaa

SEQ ID NO: 4049647 - DNA, 20 bp, Homo sapiens
taaatttgatttacatatat

SEQ ID NO: 4049648 - DNA, 14 bp, Homo sapiens
taaatttgctagca

SEQ ID NO: 4049649 - DNA, 13 bp, Homo sapiens
taaatttgtaagt

SEQ ID NO: 4049650 - DNA, 17 bp, Homo sapiens
taaatttgtttaattaa

SEQ ID NO: 4049651 - DNA, 15 bp, Homo sapiens
taaattttctgaaac

SEQ ID NO: 4049652 - DNA, 17 bp, Homo sapiens
taaattttgagttctac

SEQ ID NO: 4049653 - DNA, 20 bp, Homo sapiens
taacaaaaaaatatatttaa

SEQ ID NO: 4049654 - DNA, 23 bp, Homo sapiens
taacaaaaaaatatatttaatga

SEQ ID NO: 4049655 - DNA, 12 bp, Homo sapiens
taacaaaatgga

SEQ ID NO: 4049656 - DNA, 15 bp, Homo sapiens
taacaaaatggacat

SEQ ID NO: 4049657 - DNA, 20 bp, Homo sapiens
taacaaaccaacatctttgc

SEQ ID NO: 4049658 - DNA, 12 bp, Homo sapiens
taacaaataaaa

SEQ ID NO: 4049659 - DNA, 20 bp, Homo sapiens
taatcactctaattaattgt

SEQ ID NO: 4049660 - DNA, 21 bp, Homo sapiens
taatcagtgactgaaaccatt

SEQ ID NO: 4049661 - DNA, 18 bp, Homo sapiens
taatcagtgtgtctaaat

SEQ ID NO: 4049662 - DNA, 20 bp, Homo sapiens
taatcatataataaatgtac

SEQ ID NO: 4049663 - DNA, 16 bp, Homo sapiens
taatcatttccccata

SEQ ID NO: 4049664 - DNA, 18 bp, Homo sapiens
taatccaggcacagctga

SEQ ID NO: 4049665 - DNA, 19 bp, Homo sapiens
taatccaggcagatccagg

SEQ ID NO: 4049666 - DNA, 16 bp, Homo sapiens
taatcccagcactttg

SEQ ID NO: 4049667 - DNA, 21 bp, Homo sapiens
taatcccagcactttgggagg

SEQ ID NO: 4049668 - DNA, 23 bp, Homo sapiens
taatcccagcactttgggaggcc

SEQ ID NO: 4049669 - DNA, 20 bp, Homo sapiens
taatcccagctacttgggaa

SEQ ID NO: 4049670 - DNA, 14 bp, Homo sapiens
taatccctgtaata

SEQ ID NO: 4049671 - DNA, 21 bp, Homo sapiens
taatcctattaaaacacagct

SEQ ID NO: 4049672 - DNA, 18 bp, Homo sapiens
taatcctcaagagaaaat

SEQ ID NO: 4049673 - DNA, 23 bp, Homo sapiens
taatcctcaagagaaaatgtgta

SEQ ID NO: 4049674 - DNA, 18 bp, Homo sapiens
taatcctgtaccaaatct

SEQ ID NO: 4049675 - DNA, 19 bp, Homo sapiens
taatcctgtaccaaatctg

SEQ ID NO: 4049676 - DNA, 23 bp, Homo sapiens
taatcctgtaccaaatctgacat

SEQ ID NO: 4049677 - DNA, 16 bp, Homo sapiens
taatcctttgttttct

SEQ ID NO: 4049678 - DNA, 22 bp, Homo sapiens
taatctactccttgtaaagact

SEQ ID NO: 4049679 - DNA, 18 bp, Homo sapiens
taatctcctcttttatct

SEQ ID NO: 4049680 - DNA, 18 bp, Homo sapiens
taatctctctgcagctgc

SEQ ID NO: 4049681 - DNA, 19 bp, Homo sapiens
taatctctctgcagctgcc

SEQ ID NO: 4049682 - DNA, 16 bp, Homo sapiens
taatctgaaattctaa

SEQ ID NO: 4049683 - DNA, 22 bp, Homo sapiens
taatctgaaattctaaagagca

SEQ ID NO: 4049684 - DNA, 20 bp, Homo sapiens
taatctgaataaagtgtaac

SEQ ID NO: 4049685 - DNA, 20 bp, Homo sapiens
taatctgagctgcagcctgg

SEQ ID NO: 4049686 - DNA, 13 bp, Homo sapiens
taatctgttatgt

SEQ ID NO: 4049687 - DNA, 15 bp, Homo sapiens
taatcttatttagga

SEQ ID NO: 4049688 - DNA, 20 bp, Homo sapiens
taatcttcagttttatcttt

SEQ ID NO: 4049689 - DNA, 20 bp, Homo sapiens
taatctttcacttgaaagat

SEQ ID NO: 4049690 - DNA, 23 bp, Homo sapiens
taatctttcacttgaaagatttt

SEQ ID NO: 4049691 - DNA, 23 bp, Homo sapiens
taatctttctttacctgagacca

SEQ ID NO: 4049692 - DNA, 14 bp, Homo sapiens
taatgaaaatgtca

SEQ ID NO: 4049693 - DNA, 14 bp, Homo sapiens
taatgaaagactgt

SEQ ID NO: 4049694 - DNA, 17 bp, Homo sapiens
taatgaaagactgtaca

SEQ ID NO: 4049695 - DNA, 23 bp, Homo sapiens
taatgaaagactgtacaaagtag

SEQ ID NO: 4049696 - DNA, 15 bp, Homo sapiens
taatgaaataatcag

SEQ ID NO: 4049697 - DNA, 14 bp, Homo sapiens
taatgaagacaatg

SEQ ID NO: 4049698 - DNA, 21 bp, Homo sapiens
taatgaatttttatgatattc

SEQ ID NO: 4049699 - DNA, 15 bp, Homo sapiens
taatgagggactgga

SEQ ID NO: 4049700 - DNA, 20 bp, Homo sapiens
taatgataaaataaataatt

SEQ ID NO: 4049701 - DNA, 19 bp, Homo sapiens
taatgataagtaaatgcta

SEQ ID NO: 4049702 - DNA, 15 bp, Homo sapiens
taatgccccaaggac

SEQ ID NO: 4049703 - DNA, 20 bp, Homo sapiens
taatgcttcattcaatattg

SEQ ID NO: 4049704 - DNA, 23 bp, Homo sapiens
taatgcttccaatcttgctttgt

SEQ ID NO: 4049705 - DNA, 15 bp, Homo sapiens
taatgcttgatttag

SEQ ID NO: 4049706 - DNA, 16 bp, Homo sapiens
taatgcttggaatggc

SEQ ID NO: 4049707 - DNA, 21 bp, Homo sapiens
taatgcttgtaatttaaacat

SEQ ID NO: 4049708 - DNA, 11 bp, Homo sapiens
taatggaaaca

SEQ ID NO: 4049709 - DNA, 18 bp, Homo sapiens
taatggaaacattacagt

SEQ ID NO: 4049710 - DNA, 22 bp, Homo sapiens
taatggattaaatttaattctt

SEQ ID NO: 4049711 - DNA, 15 bp, Homo sapiens
taatggatttcagaa

SEQ ID NO: 4049712 - DNA, 19 bp, Homo sapiens
taatggcagctagtgcctt

SEQ ID NO: 4049713 - DNA, 16 bp, Homo sapiens
taatggcatgtcagac

SEQ ID NO: 4049714 - DNA, 19 bp, Homo sapiens
taatggtgtagaacactaa

SEQ ID NO: 4049715 - DNA, 14 bp, Homo sapiens
taatggtgttttaa

SEQ ID NO: 4049716 - DNA, 22 bp, Homo sapiens
taatggtttttatttctcgggt

SEQ ID NO: 4049717 - DNA, 11 bp, Homo sapiens
taatgtaaact

SEQ ID NO: 4049718 - DNA, 19 bp, Homo sapiens
taatgtaaactttgtcatg

SEQ ID NO: 4049719 - DNA, 17 bp, Homo sapiens
taatgtaataactgtga

SEQ ID NO: 4049720 - DNA, 22 bp, Homo sapiens
tcattttggtaaaatacttctt

SEQ ID NO: 4049721 - DNA, 14 bp, Homo sapiens
tcatttttatagca

SEQ ID NO: 4049722 - DNA, 12 bp, Homo sapiens
tcatttttgctg

SEQ ID NO: 4049723 - DNA, 17 bp, Homo sapiens
tccaaaaaaaggaaaaa

SEQ ID NO: 4049724 - DNA, 13 bp, Homo sapiens
tccaaaaattatt

SEQ ID NO: 4049725 - DNA, 15 bp, Homo sapiens
tccaaaacttctctt

SEQ ID NO: 4049726 - DNA, 13 bp, Homo sapiens
tccaaaagaaaaa

SEQ ID NO: 4049727 - DNA, 17 bp, Homo sapiens
tccaaaagcgccctcac

SEQ ID NO: 4049728 - DNA, 19 bp, Homo sapiens
tccaaaatgtgtatttctt

SEQ ID NO: 4049729 - DNA, 13 bp, Homo sapiens
tccaaacctccag

SEQ ID NO: 4049730 - DNA, 21 bp, Homo sapiens
tccaaacctccagcctccctg

SEQ ID NO: 4049731 - DNA, 18 bp, Homo sapiens
tccaaacttggatttttg

SEQ ID NO: 4049732 - DNA, 21 bp, Homo sapiens
tccaaagaacttgatttgcat

SEQ ID NO: 4049733 - DNA, 14 bp, Homo sapiens
tccaaagaggctgc

SEQ ID NO: 4049734 - DNA, 16 bp, Homo sapiens
tccaaagaggctgccc

SEQ ID NO: 4049735 - DNA, 18 bp, Homo sapiens
tccaaagaggctgcccct

SEQ ID NO: 4049736 - DNA, 20 bp, Homo sapiens
tccaaagagtagaattgcat

SEQ ID NO: 4049737 - DNA, 22 bp, Homo sapiens
tccaaagagtagaattgcattg

SEQ ID NO: 4049738 - DNA, 23 bp, Homo sapiens
tccaaagagtagaattgcattga

SEQ ID NO: 4049739 - DNA, 12 bp, Homo sapiens
tccaaagccagt

SEQ ID NO: 4049740 - DNA, 15 bp, Homo sapiens
tccaaagccagtgaa

SEQ ID NO: 4049741 - DNA, 17 bp, Homo sapiens
tccaaatataagacatt

SEQ ID NO: 4049742 - DNA, 22 bp, Homo sapiens
tccaaatctcttgcttgtcatt

SEQ ID NO: 4049743 - DNA, 17 bp, Homo sapiens
tccaacaagaagaaata

SEQ ID NO: 4049744 - DNA, 20 bp, Homo sapiens
tccaacaagaagaaatatga

SEQ ID NO: 4049745 - DNA, 17 bp, Homo sapiens
tccaacaccaagcacag

SEQ ID NO: 4049746 - DNA, 18 bp, Homo sapiens
tccaacaccacagacaca

SEQ ID NO: 4049747 - DNA, 20 bp, Homo sapiens
tccaacaccacagacacaca

SEQ ID NO: 4049748 - DNA, 22 bp, Homo sapiens
tccaacaccacagacacacaca

SEQ ID NO: 4049749 - DNA, 17 bp, Homo sapiens
tccaacagaagaactgt

SEQ ID NO: 4049750 - DNA, 15 bp, Homo sapiens
tccaactagctggga

SEQ ID NO: 4049751 - DNA, 19 bp, Homo sapiens
tccaactcgaatctgtgtg

SEQ ID NO: 4049752 - DNA, 23 bp, Homo sapiens
tccaactgagaagtaccttatca

SEQ ID NO: 4049753 - DNA, 18 bp, Homo sapiens
tccaacttatgtttttaa

SEQ ID NO: 4049754 - DNA, 15 bp, Homo sapiens
tccaacttcatttga

SEQ ID NO: 4049755 - DNA, 17 bp, Homo sapiens
tccaagacattgtcaat

SEQ ID NO: 4049756 - DNA, 13 bp, Homo sapiens
tccaagaggctgt

SEQ ID NO: 4049757 - DNA, 11 bp, Homo sapiens
tccaagcaaag

SEQ ID NO: 4049758 - DNA, 23 bp, Homo sapiens
tccaagcaagtagctttccacat

SEQ ID NO: 4049759 - DNA, 18 bp, Homo sapiens
tccaagcacagagcctgg

SEQ ID NO: 4049760 - DNA, 16 bp, Homo sapiens
tccaaggacagaaggc

SEQ ID NO: 4049761 - DNA, 18 bp, Homo sapiens
tccaaggagaccaagtcc

SEQ ID NO: 4049762 - DNA, 21 bp, Homo sapiens
tccaaggagttccatgaagac

SEQ ID NO: 4049763 - DNA, 12 bp, Homo sapiens
tccaaggatcct

SEQ ID NO: 4049764 - DNA, 16 bp, Homo sapiens
tccaaggccagtcccc

SEQ ID NO: 4049765 - DNA, 20 bp, Homo sapiens
tccaagggttgagagccagt

SEQ ID NO: 4049766 - DNA, 14 bp, Homo sapiens
tccaagtcactgca

SEQ ID NO: 4049767 - DNA, 17 bp, Homo sapiens
tccaagtccaataagac

SEQ ID NO: 4049768 - DNA, 15 bp, Homo sapiens
tccaagtgccccctc

SEQ ID NO: 4049769 - DNA, 20 bp, Homo sapiens
tccaagttcttcacctctat

SEQ ID NO: 4049770 - DNA, 21 bp, Homo sapiens
tccaagttcttcacctctatc

SEQ ID NO: 4049771 - DNA, 18 bp, Homo sapiens
tccaatcccaccaaccct

SEQ ID NO: 4049772 - DNA, 15 bp, Homo sapiens
tccaatcctcactgg

SEQ ID NO: 4049773 - DNA, 15 bp, Homo sapiens
tccaatcttgctttg

SEQ ID NO: 4049774 - DNA, 21 bp, Homo sapiens
tccaattaattagtaaggatt

SEQ ID NO: 4049775 - DNA, 13 bp, Homo sapiens
tccaattctcctt

SEQ ID NO: 4049776 - DNA, 19 bp, Homo sapiens
tccaattgatgtatatgtt

SEQ ID NO: 4049777 - DNA, 22 bp, Homo sapiens
tccaattgatgtatatgtttat

SEQ ID NO: 4049778 - DNA, 18 bp, Homo sapiens
tccaatttacatactctg

SEQ ID NO: 4049779 - DNA, 22 bp, Homo sapiens
tccaatttgtaaaaacagcatt

SEQ ID NO: 4049780 - DNA, 22 bp, Homo sapiens
tccacaaatgatgttttcaggt

SEQ ID NO: 4049781 - DNA, 18 bp, Homo sapiens
tccacacacacaaaaaaa

SEQ ID NO: 4049782 - DNA, 18 bp, Homo sapiens
tccacaccagtggcctcg

SEQ ID NO: 4049783 - DNA, 16 bp, Homo sapiens
tccacacccgtgagaa

SEQ ID NO: 4049784 - DNA, 21 bp, Homo sapiens
tccacaccttttattgacaca

SEQ ID NO: 4049785 - DNA, 23 bp, Homo sapiens
tccacagagagggagagcagaga

SEQ ID NO: 4049786 - DNA, 17 bp, Homo sapiens
tccacagcaaccccagg

SEQ ID NO: 4049787 - DNA, 20 bp, Homo sapiens
tccacagttgccaccacctc

SEQ ID NO: 4049788 - DNA, 14 bp, Homo sapiens
tccacatcccagca

SEQ ID NO: 4049789 - DNA, 18 bp, Homo sapiens
tccacatcccagcagccc

SEQ ID NO: 4049790 - DNA, 19 bp, Homo sapiens
tccacatcccagcagccca

SEQ ID NO: 4049791 - DNA, 17 bp, Homo sapiens
tccaccacatctgccag

SEQ ID NO: 4049792 - DNA, 16 bp, Homo sapiens
tccaccacctccctca

SEQ ID NO: 4049793 - DNA, 17 bp, Homo sapiens
tccaccacctccctcac

SEQ ID NO: 4049794 - DNA, 22 bp, Homo sapiens
tccaccacctccctcaccaaca

SEQ ID NO: 4049795 - DNA, 17 bp, Homo sapiens
tccaccaggccgtgcct

SEQ ID NO: 4049796 - DNA, 19 bp, Homo sapiens
tccaccaggccgtgccttg

SEQ ID NO: 4049797 - DNA, 12 bp, Homo sapiens
tccacccagccc

SEQ ID NO: 4049798 - DNA, 13 bp, Homo sapiens
tccacccagcccc

SEQ ID NO: 4049799 - DNA, 17 bp, Homo sapiens
tccacccagcccctggc

SEQ ID NO: 4049800 - DNA, 12 bp, Homo sapiens
tccaccccatcc

SEQ ID NO: 4049801 - DNA, 20 bp, Homo sapiens
tccaccccatccctccccag

SEQ ID NO: 4049802 - DNA, 21 bp, Homo sapiens
tccaccccccacacacactat

SEQ ID NO: 4049803 - DNA, 19 bp, Homo sapiens
tccacccgggggagcccag

SEQ ID NO: 4049804 - DNA, 17 bp, Homo sapiens
tccaccgaccaactgcc

SEQ ID NO: 4049805 - DNA, 18 bp, Homo sapiens
tccaccgaccaactgccc

SEQ ID NO: 4049806 - DNA, 10 bp, Homo sapiens
aaaaaaagaa

SEQ ID NO: 4049807 - DNA, 12 bp, Homo sapiens
aaaaaaagcaaa

SEQ ID NO: 4049808 - DNA, 12 bp, Homo sapiens
aaaaaaataata

SEQ ID NO: 4049809 - DNA, 13 bp, Homo sapiens
aaaaaaatacttg

SEQ ID NO: 4049810 - DNA, 12 bp, Homo sapiens
aaaaaaatgaca

SEQ ID NO: 4049811 - DNA, 20 bp, Homo sapiens
aaaaaacagaaaaacagaca

SEQ ID NO: 4049812 - DNA, 10 bp, Homo sapiens
aaaaaactac

SEQ ID NO: 4049813 - DNA, 20 bp, Homo sapiens
aaaaaagaagttactttgta

SEQ ID NO: 4049814 - DNA, 12 bp, Homo sapiens
aaaaaagcacat

SEQ ID NO: 4049815 - DNA, 12 bp, Homo sapiens
aaaaaaggaaaa

SEQ ID NO: 4049816 - DNA, 9 bp, Homo sapiens
aaaaaatag

SEQ ID NO: 4049817 - DNA, 22 bp, Homo sapiens
aaaaaattagaaattggctgga

SEQ ID NO: 4049818 - DNA, 21 bp, Homo sapiens
aaaaaatttaaaattacgttt

SEQ ID NO: 4049819 - DNA, 12 bp, Homo sapiens
aaaaacagaaaa

SEQ ID NO: 4049820 - DNA, 17 bp, Homo sapiens
aaaaacagcattgcttt

SEQ ID NO: 4049821 - DNA, 21 bp, Homo sapiens
aaaaacagcattgctttctga

SEQ ID NO: 4049822 - DNA, 20 bp, Homo sapiens
aaaaacatgtatgtgcattt

SEQ ID NO: 4049823 - DNA, 13 bp, Homo sapiens
aaaaactacacat

SEQ ID NO: 4049824 - DNA, 14 bp, Homo sapiens
aaaaactccttttg

SEQ ID NO: 4049825 - DNA, 20 bp, Homo sapiens
aaaaactgtctttaaaagag

SEQ ID NO: 4049826 - DNA, 18 bp, Homo sapiens
aaaaacttgtaaatgctg

SEQ ID NO: 4049827 - DNA, 18 bp, Homo sapiens
aaaaagaagttactttgt

SEQ ID NO: 4049828 - DNA, 20 bp, Homo sapiens
aaaaagaagttactttgtaa

SEQ ID NO: 4049829 - DNA, 17 bp, Homo sapiens
aaaaagaatgaagcctc

SEQ ID NO: 4049830 - DNA, 13 bp, Homo sapiens
aaaaagacaaaca

SEQ ID NO: 4049831 - DNA, 20 bp, Homo sapiens
aaaaagacttgagacaatgt

SEQ ID NO: 4049832 - DNA, 13 bp, Homo sapiens
aaaaagatttgtt

SEQ ID NO: 4049833 - DNA, 11 bp, Homo sapiens
aaaaagcacat

SEQ ID NO: 4049834 - DNA, 14 bp, Homo sapiens
aaaaagcacataca

SEQ ID NO: 4049835 - DNA, 13 bp, Homo sapiens
aaaaagcagctac

SEQ ID NO: 4049836 - DNA, 20 bp, Homo sapiens
aaaaagcctgcaatttcata

SEQ ID NO: 4049837 - DNA, 18 bp, Homo sapiens
aaaaagcctggtttttct

SEQ ID NO: 4049838 - DNA, 19 bp, Homo sapiens
aaaaagcttccatgattct

SEQ ID NO: 4049839 - DNA, 14 bp, Homo sapiens
aaaaagctttttcc

SEQ ID NO: 4049840 - DNA, 11 bp, Homo sapiens
aaaaaggaaaa

SEQ ID NO: 4049841 - DNA, 12 bp, Homo sapiens
aaaaaggaaaaa

SEQ ID NO: 4049842 - DNA, 19 bp, Homo sapiens
aaaaaggcatattgctttt

SEQ ID NO: 4049843 - DNA, 18 bp, Homo sapiens
aaaaaggtggtatgtaat

SEQ ID NO: 4049844 - DNA, 19 bp, Homo sapiens
aaaaagtaagttaataatg

SEQ ID NO: 4049845 - DNA, 16 bp, Homo sapiens
aaaaagttttagtttt

SEQ ID NO: 4049846 - DNA, 21 bp, Homo sapiens
aaaaataaatttggttctaat

SEQ ID NO: 4049847 - DNA, 16 bp, Homo sapiens
aaaaataataataatg

SEQ ID NO: 4049848 - DNA, 18 bp, Homo sapiens
aaaaataatcaagatttt

SEQ ID NO: 4049849 - DNA, 14 bp, Homo sapiens
aaaaatacatgcat

SEQ ID NO: 4049850 - DNA, 10 bp, Homo sapiens
aaaaatactt

SEQ ID NO: 4049851 - DNA, 15 bp, Homo sapiens
aaaaatacttgtcaa

SEQ ID NO: 4049852 - DNA, 22 bp, Homo sapiens
aaaaatacttgtcaatatttaa

SEQ ID NO: 4049853 - DNA, 14 bp, Homo sapiens
aaaaatataactta

SEQ ID NO: 4049854 - DNA, 15 bp, Homo sapiens
aaaaatatatttaat

SEQ ID NO: 4049855 - DNA, 18 bp, Homo sapiens
aaaaatattcctccaaat

SEQ ID NO: 4049856 - DNA, 23 bp, Homo sapiens
aaaaatattgtttctgcattcat

SEQ ID NO: 4049857 - DNA, 18 bp, Homo sapiens
aaaaatatttttttttct

SEQ ID NO: 4049858 - DNA, 22 bp, Homo sapiens
aaaaatctgaccaaaacaaaca

SEQ ID NO: 4049859 - DNA, 16 bp, Homo sapiens
aaaaatcttctccaga

SEQ ID NO: 4049860 - DNA, 12 bp, Homo sapiens
aaaaatgaaagc

SEQ ID NO: 4049861 - DNA, 20 bp, Homo sapiens
aaaaatgactaaaaatatta

SEQ ID NO: 4049862 - DNA, 15 bp, Homo sapiens
aaaaatgcctttgag

SEQ ID NO: 4049863 - DNA, 20 bp, Homo sapiens
aaaaatgcctttgagacagt

SEQ ID NO: 4049864 - DNA, 21 bp, Homo sapiens
aaaaatgcctttgagacagtt

SEQ ID NO: 4049865 - DNA, 24 bp, Homo sapiens
aaaaatgcctttgagacagtttct

SEQ ID NO: 4049866 - DNA, 15 bp, Homo sapiens
aaaaatggatattat

SEQ ID NO: 4049867 - DNA, 22 bp, Homo sapiens
aaaaatgggagacagcctctta

SEQ ID NO: 4049868 - DNA, 19 bp, Homo sapiens
aaaaatggttgatggaaaa

SEQ ID NO: 4049869 - DNA, 22 bp, Homo sapiens
aaaaatggttgatggaaaataa

SEQ ID NO: 4049870 - DNA, 16 bp, Homo sapiens
aaaaatgtaatttaga

SEQ ID NO: 4049871 - DNA, 18 bp, Homo sapiens
aaaaatgtcctgcctttt

SEQ ID NO: 4049872 - DNA, 23 bp, Homo sapiens
aaaaatgttagtattttaatcct

SEQ ID NO: 4049873 - DNA, 13 bp, Homo sapiens
aaaattttacttc

SEQ ID NO: 4049874 - DNA, 15 bp, Homo sapiens
aaaattttctcattt

SEQ ID NO: 4049875 - DNA, 17 bp, Homo sapiens
aaaattttgcttttaat

SEQ ID NO: 4049876 - DNA, 15 bp, Homo sapiens
aaaatttttcttttc

SEQ ID NO: 4049877 - DNA, 21 bp, Homo sapiens
aaacaaaaattaggtattttg

SEQ ID NO: 4049878 - DNA, 14 bp, Homo sapiens
aaacaaaatctgaa

SEQ ID NO: 4049879 - DNA, 16 bp, Homo sapiens
aaacaacaacacaata

SEQ ID NO: 4049880 - DNA, 12 bp, Homo sapiens
aaacaagggaga

SEQ ID NO: 4049881 - DNA, 15 bp, Homo sapiens
aaacaataaatgtgc

SEQ ID NO: 4049882 - DNA, 18 bp, Homo sapiens
aaacaatctggaagaaaa

SEQ ID NO: 4049883 - DNA, 20 bp, Homo sapiens
aaacaatgtggagtctccct

SEQ ID NO: 4049884 - DNA, 15 bp, Homo sapiens
aaacaattcatgcct

SEQ ID NO: 4049885 - DNA, 11 bp, Homo sapiens
aaacacacaca

SEQ ID NO: 4049886 - DNA, 14 bp, Homo sapiens
aaacacacacacta

SEQ ID NO: 4049887 - DNA, 17 bp, Homo sapiens
aaacacaccaggctgtg

SEQ ID NO: 4049888 - DNA, 18 bp, Homo sapiens
aaacacaccaggctgtgg

SEQ ID NO: 4049889 - DNA, 23 bp, Homo sapiens
aaacacaccaggctgtgggcctc

SEQ ID NO: 4049890 - DNA, 17 bp, Homo sapiens
aaacacactgaaagctc

SEQ ID NO: 4049891 - DNA, 12 bp, Homo sapiens
aaacacagctgt

SEQ ID NO: 4049892 - DNA, 16 bp, Homo sapiens
aaacacatcttcccta

SEQ ID NO: 4049893 - DNA, 18 bp, Homo sapiens
aaacacattatgtatctt

SEQ ID NO: 4049894 - DNA, 21 bp, Homo sapiens
aaacacattgaatgcgcttta

SEQ ID NO: 4049895 - DNA, 23 bp, Homo sapiens
aaacacctgacagcccctccctc

SEQ ID NO: 4049896 - DNA, 13 bp, Homo sapiens
aaacactgaaaaa

SEQ ID NO: 4049897 - DNA, 18 bp, Homo sapiens
aaacactgaggcagcctt

SEQ ID NO: 4049898 - DNA, 15 bp, Homo sapiens
aaacactgcaaattt

SEQ ID NO: 4049899 - DNA, 14 bp, Homo sapiens
aaacactttcaaaa

SEQ ID NO: 4049900 - DNA, 21 bp, Homo sapiens
aaacagaaatcaggtgtttta

SEQ ID NO: 4049901 - DNA, 14 bp, Homo sapiens
aaacagacaatatg

SEQ ID NO: 4049902 - DNA, 18 bp, Homo sapiens
aaacagagtggcctccct

SEQ ID NO: 4049903 - DNA, 14 bp, Homo sapiens
aaacagatctgaat

SEQ ID NO: 4049904 - DNA, 22 bp, Homo sapiens
aaacagatgatgagaatttcta

SEQ ID NO: 4049905 - DNA, 14 bp, Homo sapiens
aaacagatgctctg

SEQ ID NO: 4049906 - DNA, 19 bp, Homo sapiens
aaacagatttttacaaatg

SEQ ID NO: 4049907 - DNA, 14 bp, Homo sapiens
aaacagccatgtcc

SEQ ID NO: 4049908 - DNA, 18 bp, Homo sapiens
aaacagctgcattagaaa

SEQ ID NO: 4049909 - DNA, 18 bp, Homo sapiens
aaacagcttcatgccttt

SEQ ID NO: 4049910 - DNA, 21 bp, Homo sapiens
aaacagcttcatgcctttgta

SEQ ID NO: 4049911 - DNA, 23 bp, Homo sapiens
aaacaggtatatactttgaaagg

SEQ ID NO: 4049912 - DNA, 19 bp, Homo sapiens
aaacagtagttgtattctt

SEQ ID NO: 4049913 - DNA, 20 bp, Homo sapiens
aaacagtatttattttgtaa

SEQ ID NO: 4049914 - DNA, 18 bp, Homo sapiens
aaacagtatttcattgcc

SEQ ID NO: 4049915 - DNA, 16 bp, Homo sapiens
aaacagtctcccttcc

SEQ ID NO: 4049916 - DNA, 23 bp, Homo sapiens
aaacagttaactttcagaagaga

SEQ ID NO: 4049917 - DNA, 20 bp, Homo sapiens
aaacataaaaagcagaattt

SEQ ID NO: 4049918 - DNA, 13 bp, Homo sapiens
aaacataattctt

SEQ ID NO: 4049919 - DNA, 21 bp, Homo sapiens
aaacataattcttgtatatta

SEQ ID NO: 4049920 - DNA, 15 bp, Homo sapiens
aaacatatacagaaa

SEQ ID NO: 4049921 - DNA, 18 bp, Homo sapiens
aaacatatacagaaaaat

SEQ ID NO: 4049922 - DNA, 13 bp, Homo sapiens
aaacatatgattt

SEQ ID NO: 4049923 - DNA, 17 bp, Homo sapiens
aaacatatgatttcact

SEQ ID NO: 4049924 - DNA, 14 bp, Homo sapiens
aaacatcaacctgg

SEQ ID NO: 4049925 - DNA, 14 bp, Homo sapiens
aaacatcacacaca

SEQ ID NO: 4049926 - DNA, 17 bp, Homo sapiens
aaacatcagacctgtct

SEQ ID NO: 4049927 - DNA, 18 bp, Homo sapiens
aaacatcagacctgtctt

SEQ ID NO: 4049928 - DNA, 17 bp, Homo sapiens
aaacatccaatattttc

SEQ ID NO: 4049929 - DNA, 18 bp, Homo sapiens
aaacatccttcaagaact

SEQ ID NO: 4049930 - DNA, 13 bp, Homo sapiens
aaacatctcctta

SEQ ID NO: 4049931 - DNA, 12 bp, Homo sapiens
aaacatgtatgt

SEQ ID NO: 4049932 - DNA, 13 bp, Homo sapiens
aaacatgtatgtg

SEQ ID NO: 4049933 - DNA, 15 bp, Homo sapiens
aaacattaagattga

SEQ ID NO: 4049934 - DNA, 18 bp, Homo sapiens
aaacattacagttcataa

SEQ ID NO: 4049935 - DNA, 20 bp, Homo sapiens
aaacattgaagtaatgaatt

SEQ ID NO: 4049936 - DNA, 15 bp, Homo sapiens
aaacatttgttcctg

SEQ ID NO: 4049937 - DNA, 14 bp, Homo sapiens
aaacattttatttt

SEQ ID NO: 4049938 - DNA, 17 bp, Homo sapiens
aaacattttttcttctg

SEQ ID NO: 4049939 - DNA, 20 bp, Homo sapiens
aaaccaaagagggcttcctc

SEQ ID NO: 4049940 - DNA, 14 bp, Homo sapiens
aaaccaacatcttt

SEQ ID NO: 4049941 - DNA, 14 bp, Homo sapiens
aaaccaacctttaa

SEQ ID NO: 4049942 - DNA, 18 bp, Homo sapiens
aaaccaacctttaaaatt

SEQ ID NO: 4049943 - DNA, 20 bp, Homo sapiens
aaaccaacctttaaaattgt

SEQ ID NO: 4049944 - DNA, 14 bp, Homo sapiens
aaaccaagccgtgg

SEQ ID NO: 4049945 - DNA, 21 bp, Homo sapiens
aaaccaagtcggaacagcaga

SEQ ID NO: 4049946 - DNA, 12 bp, Homo sapiens
aaaccaggcctc

SEQ ID NO: 4049947 - DNA, 12 bp, Homo sapiens
aaaccagggagc

SEQ ID NO: 4049948 - DNA, 15 bp, Homo sapiens
aaaccattgctctta

SEQ ID NO: 4049949 - DNA, 20 bp, Homo sapiens
aaaccattttcccatcatcc

SEQ ID NO: 4049950 - DNA, 15 bp, Homo sapiens
aaacccaatccaaat

SEQ ID NO: 4049951 - DNA, 17 bp, Homo sapiens
aaacccagttgccatct

SEQ ID NO: 4049952 - DNA, 21 bp, Homo sapiens
aaacccccaaaatccaaaact

SEQ ID NO: 4049953 - DNA, 13 bp, Homo sapiens
aaaccctagcctt

SEQ ID NO: 4049954 - DNA, 16 bp, Homo sapiens
aaaccctagccttgct

SEQ ID NO: 4049955 - DNA, 19 bp, Homo sapiens
aaaccgagcagggctgtgt

SEQ ID NO: 4049956 - DNA, 14 bp, Homo sapiens
aaaccgataatgca

SEQ ID NO: 4049957 - DNA, 15 bp, Homo sapiens
aaaccgataatgcat

SEQ ID NO: 4049958 - DNA, 23 bp, Homo sapiens
aaaccgataatgcatgaagcaac

SEQ ID NO: 4049959 - DNA, 14 bp, Homo sapiens
aaacctagccggaa

SEQ ID NO: 4049960 - DNA, 19 bp, Homo sapiens
aaacctcagggctgtccca

SEQ ID NO: 4049961 - DNA, 18 bp, Homo sapiens
aaacctccagcctccctg

SEQ ID NO: 4049962 - DNA, 22 bp, Homo sapiens
aaacctgactcaattatttgca

SEQ ID NO: 4049963 - DNA, 14 bp, Homo sapiens
aaacctgatgttaa

SEQ ID NO: 4049964 - DNA, 17 bp, Homo sapiens
aaaccttgctctcctca

SEQ ID NO: 4049965 - DNA, 20 bp, Homo sapiens
aaaccttgctctcctcatct

SEQ ID NO: 4049966 - DNA, 12 bp, Homo sapiens
aaacctttcccc

SEQ ID NO: 4049967 - DNA, 18 bp, Homo sapiens
aaaccttttttaagattt

SEQ ID NO: 4049968 - DNA, 21 bp, Homo sapiens
aaaccttttttaagatttttc

SEQ ID NO: 4049969 - DNA, 23 bp, Homo sapiens
aaaccttttttaagatttttctc

SEQ ID NO: 4049970 - DNA, 16 bp, Homo sapiens
aaacgaaaataaagta

SEQ ID NO: 4049971 - DNA, 18 bp, Homo sapiens
aaacgacaaatctgtctg

SEQ ID NO: 4049972 - DNA, 23 bp, Homo sapiens
aaacgagggctgatggaggaaaa

SEQ ID NO: 4049973 - DNA, 19 bp, Homo sapiens
aaacgcaaagggctgaaag

SEQ ID NO: 4049974 - DNA, 20 bp, Homo sapiens
aaacgcatggagtgtgtatt

SEQ ID NO: 4049975 - DNA, 12 bp, Homo sapiens
aaacgctacctc

SEQ ID NO: 4049976 - DNA, 22 bp, Homo sapiens
aaaggtgaccttgcaacttcat

SEQ ID NO: 4049977 - DNA, 20 bp, Homo sapiens
aaaggtgagtttgagctgcc

SEQ ID NO: 4049978 - DNA, 22 bp, Homo sapiens
aaaggtgagtttgagctgcctt

SEQ ID NO: 4049979 - DNA, 19 bp, Homo sapiens
aaaggtggagtttctctgt

SEQ ID NO: 4049980 - DNA, 16 bp, Homo sapiens
aaaggtggcaatgctt

SEQ ID NO: 4049981 - DNA, 14 bp, Homo sapiens
aaaggtgtatttaa

SEQ ID NO: 4049982 - DNA, 17 bp, Homo sapiens
aaaggtgtgagactggg

SEQ ID NO: 4049983 - DNA, 17 bp, Homo sapiens
aaaggttcactaaagca

SEQ ID NO: 4049984 - DNA, 19 bp, Homo sapiens
aaaggttgctgtttcacaa

SEQ ID NO: 4049985 - DNA, 16 bp, Homo sapiens
aaaggttttgtatttt

SEQ ID NO: 4049986 - DNA, 12 bp, Homo sapiens
aaaggttttttt

SEQ ID NO: 4049987 - DNA, 11 bp, Homo sapiens
aaagtaaatgg

SEQ ID NO: 4049988 - DNA, 22 bp, Homo sapiens
aaagtaagttaataatgtattg

SEQ ID NO: 4049989 - DNA, 15 bp, Homo sapiens
aaagtacactctgct

SEQ ID NO: 4049990 - DNA, 20 bp, Homo sapiens
aaagtagaagagggttttag

SEQ ID NO: 4049991 - DNA, 20 bp, Homo sapiens
aaagtagaagtcttagatgt

SEQ ID NO: 4049992 - DNA, 15 bp, Homo sapiens
aaagtagacaaatgg

SEQ ID NO: 4049993 - DNA, 17 bp, Homo sapiens
aaagtatatatagaatc

SEQ ID NO: 4049994 - DNA, 15 bp, Homo sapiens
aaagtatatatttat

SEQ ID NO: 4049995 - DNA, 14 bp, Homo sapiens
aaagtatatgttag

SEQ ID NO: 4049996 - DNA, 17 bp, Homo sapiens
aaagtatcactctaaaa

SEQ ID NO: 4049997 - DNA, 22 bp, Homo sapiens
aaagtatcactctaaaaaacat

SEQ ID NO: 4049998 - DNA, 13 bp, Homo sapiens
aaagtattctgat

SEQ ID NO: 4049999 - DNA, 15 bp, Homo sapiens
aaagtatttactttt

SEQ ID NO: 4050000 - DNA, 12 bp, Homo sapiens
aaagtattttga

SEQ ID NO: 4050001 - DNA, 15 bp, Homo sapiens
aaagtattttgaagt

SEQ ID NO: 4050002 - DNA, 21 bp, Homo sapiens
aaagtattttgaagtttacat

SEQ ID NO: 4050003 - DNA, 22 bp, Homo sapiens
aaagtattttgaagtttacatt

SEQ ID NO: 4050004 - DNA, 16 bp, Homo sapiens
aaagtcaggtccaatt

SEQ ID NO: 4050005 - DNA, 14 bp, Homo sapiens
aaagtccctccctg

SEQ ID NO: 4050006 - DNA, 18 bp, Homo sapiens
aaagtcctttttttccat

SEQ ID NO: 4050007 - DNA, 12 bp, Homo sapiens
aaagtctatttt

SEQ ID NO: 4050008 - DNA, 19 bp, Homo sapiens
aaagtctatttttttaact

SEQ ID NO: 4050009 - DNA, 21 bp, Homo sapiens
aaagtctatttttttaactga

SEQ ID NO: 4050010 - DNA, 18 bp, Homo sapiens
aaagtctgtctttcctga

SEQ ID NO: 4050011 - DNA, 13 bp, Homo sapiens
aaagtgaagcaaa

SEQ ID NO: 4050012 - DNA, 16 bp, Homo sapiens
aaagtgaatgaaagat

SEQ ID NO: 4050013 - DNA, 12 bp, Homo sapiens
aaagtgaatttg

SEQ ID NO: 4050014 - DNA, 17 bp, Homo sapiens
aaagtgaatttgaatga

SEQ ID NO: 4050015 - DNA, 14 bp, Homo sapiens
aaagtgacacagca

SEQ ID NO: 4050016 - DNA, 20 bp, Homo sapiens
aaagtgactgtttggcttat

SEQ ID NO: 4050017 - DNA, 23 bp, Homo sapiens
aaagtgcagctccgtttggcagt

SEQ ID NO: 4050018 - DNA, 18 bp, Homo sapiens
aaagtgcatatttatcca

SEQ ID NO: 4050019 - DNA, 22 bp, Homo sapiens
aaagtggcacctgtctgctcca

SEQ ID NO: 4050020 - DNA, 22 bp, Homo sapiens
aaagtggcgtgggagccagcct

SEQ ID NO: 4050021 - DNA, 20 bp, Homo sapiens
aaagtgtgttgttgctttag

SEQ ID NO: 4050022 - DNA, 14 bp, Homo sapiens
aaagtgttactttt

SEQ ID NO: 4050023 - DNA, 19 bp, Homo sapiens
aaagtgttggctaatgaag

SEQ ID NO: 4050024 - DNA, 16 bp, Homo sapiens
aaagtgttgtgttcct

SEQ ID NO: 4050025 - DNA, 19 bp, Homo sapiens
aaagtgttgtgttcctggc

SEQ ID NO: 4050026 - DNA, 22 bp, Homo sapiens
aaagtgttgtgttcctggctga

SEQ ID NO: 4050027 - DNA, 15 bp, Homo sapiens
aaagtgtttcagcta

SEQ ID NO: 4050028 - DNA, 13 bp, Homo sapiens
aaagtgtttgcct

SEQ ID NO: 4050029 - DNA, 16 bp, Homo sapiens
aaagttaatcttcatg

SEQ ID NO: 4050030 - DNA, 19 bp, Homo sapiens
aaagttactacctgtcaag

SEQ ID NO: 4050031 - DNA, 12 bp, Homo sapiens
aaagttactagg

SEQ ID NO: 4050032 - DNA, 15 bp, Homo sapiens
aaagttactaggtaa

SEQ ID NO: 4050033 - DNA, 22 bp, Homo sapiens
aaagttacttgaatttcaaaca

SEQ ID NO: 4050034 - DNA, 14 bp, Homo sapiens
aaagttagctgagc

SEQ ID NO: 4050035 - DNA, 18 bp, Homo sapiens
aaagttagggggttctta

SEQ ID NO: 4050036 - DNA, 13 bp, Homo sapiens
aaagttgcagatg

SEQ ID NO: 4050037 - DNA, 17 bp, Homo sapiens
aaagttgcagatgtatt

SEQ ID NO: 4050038 - DNA, 14 bp, Homo sapiens
aaagttgtcttaaa

SEQ ID NO: 4050039 - DNA, 20 bp, Homo sapiens
aaagtttaaaacagaagcct

SEQ ID NO: 4050040 - DNA, 18 bp, Homo sapiens
aaagtttacaacttgatt

SEQ ID NO: 4050041 - DNA, 21 bp, Homo sapiens
aaagtttacaacttgattttt

SEQ ID NO: 4050042 - DNA, 20 bp, Homo sapiens
aaagtttcctaatcagaaat

SEQ ID NO: 4050043 - DNA, 16 bp, Homo sapiens
aaagtttgcttagaaa

SEQ ID NO: 4050044 - DNA, 13 bp, Homo sapiens
aaagttttatcaa

SEQ ID NO: 4050045 - DNA, 14 bp, Homo sapiens
aaagttttgaaaag

SEQ ID NO: 4050046 - DNA, 16 bp, Homo sapiens
aaagttttgaaaagct

SEQ ID NO: 4050047 - DNA, 18 bp, Homo sapiens
aaataaaaaaagaaaaaa

SEQ ID NO: 4050048 - DNA, 13 bp, Homo sapiens
aaataaaaagaaa

SEQ ID NO: 4050049 - DNA, 14 bp, Homo sapiens
aaataaaaagtgac

SEQ ID NO: 4050050 - DNA, 15 bp, Homo sapiens
aaataaaaagtgaca

SEQ ID NO: 4050051 - DNA, 19 bp, Homo sapiens
aaataaaaagtgacacagc

SEQ ID NO: 4050052 - DNA, 21 bp, Homo sapiens
aaataaaaagtgacacagcag

SEQ ID NO: 4050053 - DNA, 20 bp, Homo sapiens
aaataaaaatattgtgttgt

SEQ ID NO: 4050054 - DNA, 22 bp, Homo sapiens
aaataaaaatggcaaatgcact

SEQ ID NO: 4050055 - DNA, 19 bp, Homo sapiens
aaataaaagcagcatctgc

SEQ ID NO: 4050056 - DNA, 14 bp, Homo sapiens
aaataaaatgaaaa

SEQ ID NO: 4050057 - DNA, 15 bp, Homo sapiens
aaataaaatgaaaat

SEQ ID NO: 4050058 - DNA, 23 bp, Homo sapiens
aaataaaatgaaaattgtattat

SEQ ID NO: 4050059 - DNA, 13 bp, Homo sapiens
aaataaaccactg

SEQ ID NO: 4050060 - DNA, 19 bp, Homo sapiens
aaataaacctcaaaatgtc

SEQ ID NO: 4050061 - DNA, 14 bp, Homo sapiens
aaataaactgttgc

SEQ ID NO: 4050062 - DNA, 22 bp, Homo sapiens
aaataaagaacaattgttagat

SEQ ID NO: 4050063 - DNA, 11 bp, Homo sapiens
aaataaagaag

SEQ ID NO: 4050064 - DNA, 23 bp, Homo sapiens
aaataaaggatgtgattgtggaa

SEQ ID NO: 4050065 - DNA, 15 bp, Homo sapiens
aaataaagtatatat

SEQ ID NO: 4050066 - DNA, 16 bp, Homo sapiens
aaataaagtatatata

SEQ ID NO: 4050067 - DNA, 17 bp, Homo sapiens
aaataaataattttaat

SEQ ID NO: 4050068 - DNA, 12 bp, Homo sapiens
aaataaatatca

SEQ ID NO: 4050069 - DNA, 16 bp, Homo sapiens
aaataaattcctacaa

SEQ ID NO: 4050070 - DNA, 19 bp, Homo sapiens
aaataaattctgattcttc

SEQ ID NO: 4050071 - DNA, 22 bp, Homo sapiens
aaataacaagtaccaaagtttt

SEQ ID NO: 4050072 - DNA, 14 bp, Homo sapiens
aaataacaatgtta

SEQ ID NO: 4050073 - DNA, 16 bp, Homo sapiens
aaataacaatgttaag

SEQ ID NO: 4050074 - DNA, 17 bp, Homo sapiens
aaataacaatgttaagg

SEQ ID NO: 4050075 - DNA, 23 bp, Homo sapiens
aaataacacagagagacagactt

SEQ ID NO: 4050076 - DNA, 14 bp, Homo sapiens
aaataacctatttt

SEQ ID NO: 4050077 - DNA, 14 bp, Homo sapiens
aaataagaatagaa

SEQ ID NO: 4050078 - DNA, 12 bp, Homo sapiens
aaataagagatt

SEQ ID NO: 4050079 - DNA, 19 bp, Homo sapiens
aagtcttagatgtatatat

SEQ ID NO: 4050080 - DNA, 15 bp, Homo sapiens
aagtcttttctgtca

SEQ ID NO: 4050081 - DNA, 14 bp, Homo sapiens
aagtgaaaatctta

SEQ ID NO: 4050082 - DNA, 17 bp, Homo sapiens
aagtgaaatggatacta

SEQ ID NO: 4050083 - DNA, 13 bp, Homo sapiens
aagtgaatttata

SEQ ID NO: 4050084 - DNA, 14 bp, Homo sapiens
aagtgaatttgaat

SEQ ID NO: 4050085 - DNA, 16 bp, Homo sapiens
aagtgaatttgaatga

SEQ ID NO: 4050086 - DNA, 23 bp, Homo sapiens
aagtgaatttgaatgaaaaattt

SEQ ID NO: 4050087 - DNA, 15 bp, Homo sapiens
aagtgactctcagcg

SEQ ID NO: 4050088 - DNA, 15 bp, Homo sapiens
aagtgagaagatggt

SEQ ID NO: 4050089 - DNA, 22 bp, Homo sapiens
aagtgcaataaatctgacccag

SEQ ID NO: 4050090 - DNA, 23 bp, Homo sapiens
aagtgcaataaatctgacccagt

SEQ ID NO: 4050091 - DNA, 19 bp, Homo sapiens
aagtgcatccaaaggtgct

SEQ ID NO: 4050092 - DNA, 22 bp, Homo sapiens
aagtgccactgcccgagctggt

SEQ ID NO: 4050093 - DNA, 21 bp, Homo sapiens
aagtgccccctcacctctcca

SEQ ID NO: 4050094 - DNA, 22 bp, Homo sapiens
aagtgccccctcacctctccag

SEQ ID NO: 4050095 - DNA, 13 bp, Homo sapiens
aagtgcctgagct

SEQ ID NO: 4050096 - DNA, 22 bp, Homo sapiens
aagtgccttctccttccccagg

SEQ ID NO: 4050097 - DNA, 15 bp, Homo sapiens
aagtgcgtgaatgta

SEQ ID NO: 4050098 - DNA, 16 bp, Homo sapiens
aagtgcgtgccgtgtg

SEQ ID NO: 4050099 - DNA, 17 bp, Homo sapiens
aagtgctcatctgttgt

SEQ ID NO: 4050100 - DNA, 11 bp, Homo sapiens
aagtgctcccc

SEQ ID NO: 4050101 - DNA, 22 bp, Homo sapiens
aagtgctggcaaccactaagaa

SEQ ID NO: 4050102 - DNA, 21 bp, Homo sapiens
aagtggacagagcgcccctcc

SEQ ID NO: 4050103 - DNA, 20 bp, Homo sapiens
aagtggactggcccctgggt

SEQ ID NO: 4050104 - DNA, 16 bp, Homo sapiens
aagtggaggcacttta

SEQ ID NO: 4050105 - DNA, 23 bp, Homo sapiens
aagtggcaaagctgttcttcctg

SEQ ID NO: 4050106 - DNA, 20 bp, Homo sapiens
aagtggcgtgggagccagcc

SEQ ID NO: 4050107 - DNA, 12 bp, Homo sapiens
aagtggctgcct

SEQ ID NO: 4050108 - DNA, 14 bp, Homo sapiens
aagtggggtgttct

SEQ ID NO: 4050109 - DNA, 15 bp, Homo sapiens
aagtggggtgttctt

SEQ ID NO: 4050110 - DNA, 20 bp, Homo sapiens
aagtgggttattctggagtt

SEQ ID NO: 4050111 - DNA, 17 bp, Homo sapiens
aagtggtgtttattgca

SEQ ID NO: 4050112 - DNA, 16 bp, Homo sapiens
aagtgtaacagctgag

SEQ ID NO: 4050113 - DNA, 17 bp, Homo sapiens
aagtgtaacagctgagg

SEQ ID NO: 4050114 - DNA, 21 bp, Homo sapiens
aagtgtaacagctgaggtctc

SEQ ID NO: 4050115 - DNA, 15 bp, Homo sapiens
aagtgtatttttcaa

SEQ ID NO: 4050116 - DNA, 17 bp, Homo sapiens
aagtgtcaactctttgt

SEQ ID NO: 4050117 - DNA, 17 bp, Homo sapiens
aagtgtccgagaactaa

SEQ ID NO: 4050118 - DNA, 17 bp, Homo sapiens
aagtgtgaccccactgc

SEQ ID NO: 4050119 - DNA, 14 bp, Homo sapiens
aagtgtgagcgcct

SEQ ID NO: 4050120 - DNA, 17 bp, Homo sapiens
aagtgtgagcgccttgg

SEQ ID NO: 4050121 - DNA, 19 bp, Homo sapiens
aagtgtgagcgccttggta

SEQ ID NO: 4050122 - DNA, 11 bp, Homo sapiens
aagtgtgagta

SEQ ID NO: 4050123 - DNA, 20 bp, Homo sapiens
aagtgtgagtaagagctggt

SEQ ID NO: 4050124 - DNA, 21 bp, Homo sapiens
aagtgtgagtaagagctggtg

SEQ ID NO: 4050125 - DNA, 21 bp, Homo sapiens
aagtgttatttttcaaggaag

SEQ ID NO: 4050126 - DNA, 22 bp, Homo sapiens
aagtgttatttttcaaggaagg

SEQ ID NO: 4050127 - DNA, 17 bp, Homo sapiens
aagtgttgtaaatattt

SEQ ID NO: 4050128 - DNA, 22 bp, Homo sapiens
aagtgttgtatcaaagtgtgat

SEQ ID NO: 4050129 - DNA, 17 bp, Homo sapiens
aagtgttgtgttcctgg

SEQ ID NO: 4050130 - DNA, 19 bp, Homo sapiens
aagttaagagaaactttat

SEQ ID NO: 4050131 - DNA, 21 bp, Homo sapiens
aagttaagagaaactttatac

SEQ ID NO: 4050132 - DNA, 24 bp, Homo sapiens
aagttaataatgtattgtaatctt

SEQ ID NO: 4050133 - DNA, 19 bp, Homo sapiens
aagttacagaaatactata

SEQ ID NO: 4050134 - DNA, 23 bp, Homo sapiens
aagttacatgcataaaagggtca

SEQ ID NO: 4050135 - DNA, 19 bp, Homo sapiens
aagttactaggtaacttca

SEQ ID NO: 4050136 - DNA, 12 bp, Homo sapiens
aagttactttgt

SEQ ID NO: 4050137 - DNA, 18 bp, Homo sapiens
aagttactttgtaatttt

SEQ ID NO: 4050138 - DNA, 19 bp, Homo sapiens
aagttactttgtaattttt

SEQ ID NO: 4050139 - DNA, 14 bp, Homo sapiens
aagttagctgagcg

SEQ ID NO: 4050140 - DNA, 21 bp, Homo sapiens
aagttagctgagcgtggtggc

SEQ ID NO: 4050141 - DNA, 17 bp, Homo sapiens
aagttagggggttctta

SEQ ID NO: 4050142 - DNA, 23 bp, Homo sapiens
aagttagtgcttgttctaagatt

SEQ ID NO: 4050143 - DNA, 18 bp, Homo sapiens
aagttatattagtgaaga

SEQ ID NO: 4050144 - DNA, 17 bp, Homo sapiens
aagttattaactttaat

SEQ ID NO: 4050145 - DNA, 13 bp, Homo sapiens
aagttatttactt

SEQ ID NO: 4050146 - DNA, 15 bp, Homo sapiens
aagttatttactttt

SEQ ID NO: 4050147 - DNA, 13 bp, Homo sapiens
aagttatttcttg

SEQ ID NO: 4050148 - DNA, 19 bp, Homo sapiens
aagttatttcttgtttgtt

SEQ ID NO: 4050149 - DNA, 10 bp, Homo sapiens
aagttatttt

SEQ ID NO: 4050150 - DNA, 18 bp, Homo sapiens
aagttatttttgtacatg

SEQ ID NO: 4050151 - DNA, 11 bp, Homo sapiens
aagttcacaaa

SEQ ID NO: 4050152 - DNA, 22 bp, Homo sapiens
aagttcatattccatatttatt

SEQ ID NO: 4050153 - DNA, 20 bp, Homo sapiens
aagttcccccatcagttccc

SEQ ID NO: 4050154 - DNA, 11 bp, Homo sapiens
aagttccttcc

SEQ ID NO: 4050155 - DNA, 12 bp, Homo sapiens
aagttcgtctgt

SEQ ID NO: 4050156 - DNA, 15 bp, Homo sapiens
aagttcgtctgttgt

SEQ ID NO: 4050157 - DNA, 20 bp, Homo sapiens
aagttctcaaagttaattca

SEQ ID NO: 4050158 - DNA, 15 bp, Homo sapiens
aagttctgagtgttt

SEQ ID NO: 4050159 - DNA, 11 bp, Homo sapiens
aagttcttatg

SEQ ID NO: 4050160 - DNA, 14 bp, Homo sapiens
aagttcttcacctc

SEQ ID NO: 4050161 - DNA, 15 bp, Homo sapiens
aagttcttcacctct

SEQ ID NO: 4050162 - DNA, 16 bp, Homo sapiens
aagttcttcacctcta

SEQ ID NO: 4050163 - DNA, 18 bp, Homo sapiens
aagttcttcacctctatc

SEQ ID NO: 4050164 - DNA, 23 bp, Homo sapiens
aagttgaattgaggggattaata

SEQ ID NO: 4050165 - DNA, 19 bp, Homo sapiens
aagttgacttatagtacat

SEQ ID NO: 4050166 - DNA, 20 bp, Homo sapiens
aagttgacttatagtacatg

SEQ ID NO: 4050167 - DNA, 23 bp, Homo sapiens
aagttgacttatagtacatgata

SEQ ID NO: 4050168 - DNA, 19 bp, Homo sapiens
aagttgagatttttaagaa

SEQ ID NO: 4050169 - DNA, 22 bp, Homo sapiens
aagttgcagtgagctgatatca

SEQ ID NO: 4050170 - DNA, 21 bp, Homo sapiens
aagttgcctttatttgctgtt

SEQ ID NO: 4050171 - DNA, 14 bp, Homo sapiens
aagttgcgacggag

SEQ ID NO: 4050172 - DNA, 13 bp, Homo sapiens
aagttggactggg

SEQ ID NO: 4050173 - DNA, 19 bp, Homo sapiens
aagttgtaacttatattga

SEQ ID NO: 4050174 - DNA, 14 bp, Homo sapiens
aagttgtacaaatg

SEQ ID NO: 4050175 - DNA, 15 bp, Homo sapiens
aagttgtacaaatgt

SEQ ID NO: 4050176 - DNA, 19 bp, Homo sapiens
aagttgtacaaatgtattt

SEQ ID NO: 4050177 - DNA, 23 bp, Homo sapiens
aagttgtacaaatgtattttgaa

SEQ ID NO: 4050178 - DNA, 16 bp, Homo sapiens
aagttgtagcagattg

SEQ ID NO: 4050179 - DNA, 14 bp, Homo sapiens
aagtttacaacttg

SEQ ID NO: 4050180 - DNA, 19 bp, Homo sapiens
aagtttacaatcaaaggaa

SEQ ID NO: 4050181 - DNA, 21 bp, Homo sapiens
aatgactatataatttatttc

SEQ ID NO: 4050182 - DNA, 19 bp, Homo sapiens
aatgactccactgtttttc

SEQ ID NO: 4050183 - DNA, 21 bp, Homo sapiens
aatgacttatttctgctctgg

SEQ ID NO: 4050184 - DNA, 13 bp, Homo sapiens
aatgagaatctac

SEQ ID NO: 4050185 - DNA, 13 bp, Homo sapiens
aatgagacagcag

SEQ ID NO: 4050186 - DNA, 18 bp, Homo sapiens
aatgagacttactgggtg

SEQ ID NO: 4050187 - DNA, 17 bp, Homo sapiens
aatgagaggttcctaag

SEQ ID NO: 4050188 - DNA, 18 bp, Homo sapiens
aatgagattatatgtgga

SEQ ID NO: 4050189 - DNA, 13 bp, Homo sapiens
aatgagcacctcc

SEQ ID NO: 4050190 - DNA, 18 bp, Homo sapiens
aatgagggccaagaaaga

SEQ ID NO: 4050191 - DNA, 16 bp, Homo sapiens
aatgaggtcccaggca

SEQ ID NO: 4050192 - DNA, 15 bp, Homo sapiens
aatgaggtctgttta

SEQ ID NO: 4050193 - DNA, 17 bp, Homo sapiens
aatgagtaacatttgct

SEQ ID NO: 4050194 - DNA, 20 bp, Homo sapiens
aatgataaaataaataattt

SEQ ID NO: 4050195 - DNA, 18 bp, Homo sapiens
aatgataagtaaatgcta

SEQ ID NO: 4050196 - DNA, 21 bp, Homo sapiens
aatgatagacaattgaggtaa

SEQ ID NO: 4050197 - DNA, 22 bp, Homo sapiens
aatgatctctctgaatcctaag

SEQ ID NO: 4050198 - DNA, 20 bp, Homo sapiens
aatgatctgcctctaaaagc

SEQ ID NO: 4050199 - DNA, 14 bp, Homo sapiens
aatgatgtccagaa

SEQ ID NO: 4050200 - DNA, 20 bp, Homo sapiens
aatgcaaacacacaaaggta

SEQ ID NO: 4050201 - DNA, 14 bp, Homo sapiens
aatgcaacaaatga

SEQ ID NO: 4050202 - DNA, 14 bp, Homo sapiens
aatgcaataatttt

SEQ ID NO: 4050203 - DNA, 16 bp, Homo sapiens
aatgcaataattttac

SEQ ID NO: 4050204 - DNA, 16 bp, Homo sapiens
aatgcaatttgattga

SEQ ID NO: 4050205 - DNA, 21 bp, Homo sapiens
aatgcacagttgccacattta

SEQ ID NO: 4050206 - DNA, 17 bp, Homo sapiens
aatgcaccaagaaagct

SEQ ID NO: 4050207 - DNA, 20 bp, Homo sapiens
aatgcagcaaggccctgctg

SEQ ID NO: 4050208 - DNA, 20 bp, Homo sapiens
aatgcagtcctgaggagagg

SEQ ID NO: 4050209 - DNA, 15 bp, Homo sapiens
aatgcagttttaaga

SEQ ID NO: 4050210 - DNA, 18 bp, Homo sapiens
aatgcatatcctgagcca

SEQ ID NO: 4050211 - DNA, 22 bp, Homo sapiens
aatgcatcacgtaccccactgg

SEQ ID NO: 4050212 - DNA, 23 bp, Homo sapiens
aatgcatcacgtaccccactggg

SEQ ID NO: 4050213 - DNA, 15 bp, Homo sapiens
aatgcatcaggtcct

SEQ ID NO: 4050214 - DNA, 15 bp, Homo sapiens
aatgcatgaagcaac

SEQ ID NO: 4050215 - DNA, 19 bp, Homo sapiens
aatgccatttctcacgccc

SEQ ID NO: 4050216 - DNA, 16 bp, Homo sapiens
aatgcccttaaatcat

SEQ ID NO: 4050217 - DNA, 14 bp, Homo sapiens
aatgcctgtgccaa

SEQ ID NO: 4050218 - DNA, 20 bp, Homo sapiens
aatgccttaaaatggaattg

SEQ ID NO: 4050219 - DNA, 16 bp, Homo sapiens
aatgcctttgagacag

SEQ ID NO: 4050220 - DNA, 20 bp, Homo sapiens
aatgcctttgagacagtttc

SEQ ID NO: 4050221 - DNA, 23 bp, Homo sapiens
aatgcctttgagacagtttctta

SEQ ID NO: 4050222 - DNA, 14 bp, Homo sapiens
aatgcgctttattg

SEQ ID NO: 4050223 - DNA, 22 bp, Homo sapiens
aatgcggttataaaaaatggtt

SEQ ID NO: 4050224 - DNA, 23 bp, Homo sapiens
aatgcggttataaaaaatggttc

SEQ ID NO: 4050225 - DNA, 19 bp, Homo sapiens
aatgctagaaaatcgagtt

SEQ ID NO: 4050226 - DNA, 17 bp, Homo sapiens
aatgctaggtctcggac

SEQ ID NO: 4050227 - DNA, 18 bp, Homo sapiens
aatgctaggttaattcca

SEQ ID NO: 4050228 - DNA, 15 bp, Homo sapiens
aatgctcattttctg

SEQ ID NO: 4050229 - DNA, 16 bp, Homo sapiens
aatgctcattttctgg

SEQ ID NO: 4050230 - DNA, 17 bp, Homo sapiens
aatgctcattttctggt

SEQ ID NO: 4050231 - DNA, 20 bp, Homo sapiens
aatgctcattttctggtttg

SEQ ID NO: 4050232 - DNA, 18 bp, Homo sapiens
aatgctgaaaaaacacct

SEQ ID NO: 4050233 - DNA, 18 bp, Homo sapiens
aatgctgaactccttgtt

SEQ ID NO: 4050234 - DNA, 17 bp, Homo sapiens
aatgctgctggccaaat

SEQ ID NO: 4050235 - DNA, 22 bp, Homo sapiens
aatgctggactggaggcccctg

SEQ ID NO: 4050236 - DNA, 19 bp, Homo sapiens
aatgctggttttcctaaat

SEQ ID NO: 4050237 - DNA, 21 bp, Homo sapiens
aatgctggttttcctaaatgc

SEQ ID NO: 4050238 - DNA, 23 bp, Homo sapiens
aatgctggttttcctaaatgcag

SEQ ID NO: 4050239 - DNA, 17 bp, Homo sapiens
aatgctgtacatctatt

SEQ ID NO: 4050240 - DNA, 17 bp, Homo sapiens
aatgctgtcaactatga

SEQ ID NO: 4050241 - DNA, 13 bp, Homo sapiens
aatgctgtgttaa

SEQ ID NO: 4050242 - DNA, 22 bp, Homo sapiens
aatgctgttagtaaatttctgt

SEQ ID NO: 4050243 - DNA, 16 bp, Homo sapiens
aatgcttcagatatta

SEQ ID NO: 4050244 - DNA, 21 bp, Homo sapiens
aatgcttcattcaatattgac

SEQ ID NO: 4050245 - DNA, 20 bp, Homo sapiens
aatgcttccaatcttgcttt

SEQ ID NO: 4050246 - DNA, 20 bp, Homo sapiens
aatgcttgtggattgagggt

SEQ ID NO: 4050247 - DNA, 23 bp, Homo sapiens
aatgcttttatatggcccagcct

SEQ ID NO: 4050248 - DNA, 18 bp, Homo sapiens
aatggaaacattacagtt

SEQ ID NO: 4050249 - DNA, 19 bp, Homo sapiens
aatggaaagtaactcattt

SEQ ID NO: 4050250 - DNA, 19 bp, Homo sapiens
aatggagtcagtttgcagt

SEQ ID NO: 4050251 - DNA, 17 bp, Homo sapiens
aatggatattattagaa

SEQ ID NO: 4050252 - DNA, 17 bp, Homo sapiens
aatggatcacaagatgg

SEQ ID NO: 4050253 - DNA, 18 bp, Homo sapiens
aatggatcacaagatgga

SEQ ID NO: 4050254 - DNA, 16 bp, Homo sapiens
aatggattggattatt

SEQ ID NO: 4050255 - DNA, 21 bp, Homo sapiens
aatggcaatagggtagaatga

SEQ ID NO: 4050256 - DNA, 13 bp, Homo sapiens
aatggcagctagt

SEQ ID NO: 4050257 - DNA, 16 bp, Homo sapiens
aatggctaattcccag

SEQ ID NO: 4050258 - DNA, 22 bp, Homo sapiens
aatgggactggagtcagatgag

SEQ ID NO: 4050259 - DNA, 16 bp, Homo sapiens
aatgggagctgagcag

SEQ ID NO: 4050260 - DNA, 16 bp, Homo sapiens
aatgggaggcctctga

SEQ ID NO: 4050261 - DNA, 20 bp, Homo sapiens
aatgggctcttccaacaagg

SEQ ID NO: 4050262 - DNA, 12 bp, Homo sapiens
aatggggccaga

SEQ ID NO: 4050263 - DNA, 14 bp, Homo sapiens
aatggggccagatc

SEQ ID NO: 4050264 - DNA, 16 bp, Homo sapiens
aatggtataaatttca

SEQ ID NO: 4050265 - DNA, 15 bp, Homo sapiens
aatggtatgagctga

SEQ ID NO: 4050266 - DNA, 20 bp, Homo sapiens
aatggtccaattagtttcct

SEQ ID NO: 4050267 - DNA, 16 bp, Homo sapiens
aatggtccagggttga

SEQ ID NO: 4050268 - DNA, 16 bp, Homo sapiens
aatggtgatcactcca

SEQ ID NO: 4050269 - DNA, 17 bp, Homo sapiens
aatggtgatcctctatt

SEQ ID NO: 4050270 - DNA, 22 bp, Homo sapiens
aatggtggggaactataaagaa

SEQ ID NO: 4050271 - DNA, 13 bp, Homo sapiens
aatggtgtacata

SEQ ID NO: 4050272 - DNA, 17 bp, Homo sapiens
aatggtgtttttttaat

SEQ ID NO: 4050273 - DNA, 22 bp, Homo sapiens
aatggttcagaattaaactttt

SEQ ID NO: 4050274 - DNA, 17 bp, Homo sapiens
aatggttgatggaaaat

SEQ ID NO: 4050275 - DNA, 20 bp, Homo sapiens
aatggttgatggaaaataaa

SEQ ID NO: 4050276 - DNA, 16 bp, Homo sapiens
aatggtttgtcctgat

SEQ ID NO: 4050277 - DNA, 16 bp, Homo sapiens
aatggttttcaaaata

SEQ ID NO: 4050278 - DNA, 22 bp, Homo sapiens
aatggtttttgcctaaaatata

SEQ ID NO: 4050279 - DNA, 14 bp, Homo sapiens
aatgtaaaatgatt

SEQ ID NO: 4050280 - DNA, 20 bp, Homo sapiens
aatgtaaagaacttaaatta

SEQ ID NO: 4050281 - DNA, 21 bp, Homo sapiens
aatgtaaagaacttaaattat

SEQ ID NO: 4050282 - DNA, 22 bp, Homo sapiens
aatgtaaagaacttaaattatg

SEQ ID NO: 4050283 - DNA, 16 bp, Homo sapiens
aatttttaggcaaaga

SEQ ID NO: 4050284 - DNA, 17 bp, Homo sapiens
aatttttattaaattat

SEQ ID NO: 4050285 - DNA, 18 bp, Homo sapiens
aatttttattaaattatg

SEQ ID NO: 4050286 - DNA, 13 bp, Homo sapiens
aattttttgactt

SEQ ID NO: 4050287 - DNA, 19 bp, Homo sapiens
aatttttttcaatatttat

SEQ ID NO: 4050288 - DNA, 16 bp, Homo sapiens
aatttttttgtaataa

SEQ ID NO: 4050289 - DNA, 19 bp, Homo sapiens
aattttttttaaaatagaa

SEQ ID NO: 4050290 - DNA, 21 bp, Homo sapiens
aattttttttttcctcttcag

SEQ ID NO: 4050291 - DNA, 23 bp, Homo sapiens
aattttttttttcctcttcagaa

SEQ ID NO: 4050292 - DNA, 20 bp, Homo sapiens
aattttttttttttaacttt

SEQ ID NO: 4050293 - DNA, 19 bp, Homo sapiens
acaaaaaaaaagttttatt

SEQ ID NO: 4050294 - DNA, 22 bp, Homo sapiens
acaaaaaaaaagttttattttt

SEQ ID NO: 4050295 - DNA, 17 bp, Homo sapiens
acaaaaaaatatattta

SEQ ID NO: 4050296 - DNA, 14 bp, Homo sapiens
acaaaaagaaaaga

SEQ ID NO: 4050297 - DNA, 18 bp, Homo sapiens
acaaaaagaaaagaaaat

SEQ ID NO: 4050298 - DNA, 15 bp, Homo sapiens
acaaaaagacaaaca

SEQ ID NO: 4050299 - DNA, 20 bp, Homo sapiens
acaaaaagccacaatgaaca

SEQ ID NO: 4050300 - DNA, 20 bp, Homo sapiens
acaaaaaggttctcaggtgt

SEQ ID NO: 4050301 - DNA, 23 bp, Homo sapiens
acaaaaatgaactgaagtttcac

SEQ ID NO: 4050302 - DNA, 23 bp, Homo sapiens
acaaaagaggagcacttccaaaa

SEQ ID NO: 4050303 - DNA, 19 bp, Homo sapiens
acaaaatacaatcctgttt

SEQ ID NO: 4050304 - DNA, 15 bp, Homo sapiens
acaaaatctgaactc

SEQ ID NO: 4050305 - DNA, 23 bp, Homo sapiens
acaaaatctgaactctcaaaagt

SEQ ID NO: 4050306 - DNA, 14 bp, Homo sapiens
acaaaatctgttta

SEQ ID NO: 4050307 - DNA, 22 bp, Homo sapiens
acaaaatgtagggttataataa

SEQ ID NO: 4050308 - DNA, 11 bp, Homo sapiens
acaaacaaaag

SEQ ID NO: 4050309 - DNA, 11 bp, Homo sapiens
acaaacacaca

SEQ ID NO: 4050310 - DNA, 16 bp, Homo sapiens
acaaacacacacacta

SEQ ID NO: 4050311 - DNA, 22 bp, Homo sapiens
acaaacactgcagaacagcatc

SEQ ID NO: 4050312 - DNA, 21 bp, Homo sapiens
acaaacactgcagtttcctgg

SEQ ID NO: 4050313 - DNA, 22 bp, Homo sapiens
acaaacatctaataagtatata

SEQ ID NO: 4050314 - DNA, 13 bp, Homo sapiens
acaaaccaacatc

SEQ ID NO: 4050315 - DNA, 16 bp, Homo sapiens
acaaaccaacatcttt

SEQ ID NO: 4050316 - DNA, 12 bp, Homo sapiens
acaaactaaaaa

SEQ ID NO: 4050317 - DNA, 14 bp, Homo sapiens
acaaactaaaaata

SEQ ID NO: 4050318 - DNA, 11 bp, Homo sapiens
acaaactgcaa

SEQ ID NO: 4050319 - DNA, 13 bp, Homo sapiens
acaaactgcaata

SEQ ID NO: 4050320 - DNA, 16 bp, Homo sapiens
acaaactgcaatagag

SEQ ID NO: 4050321 - DNA, 19 bp, Homo sapiens
acaaactgcaatagagact

SEQ ID NO: 4050322 - DNA, 20 bp, Homo sapiens
acaaactgcaatagagactg

SEQ ID NO: 4050323 - DNA, 13 bp, Homo sapiens
acaaacttttata

SEQ ID NO: 4050324 - DNA, 17 bp, Homo sapiens
acaaagacaaaagtctg

SEQ ID NO: 4050325 - DNA, 18 bp, Homo sapiens
acaaagacaaaagtctgt

SEQ ID NO: 4050326 - DNA, 15 bp, Homo sapiens
acaaagacattgatt

SEQ ID NO: 4050327 - DNA, 23 bp, Homo sapiens
acaaagagttctggaaaagaact

SEQ ID NO: 4050328 - DNA, 21 bp, Homo sapiens
acaaagcttctatcccaggag

SEQ ID NO: 4050329 - DNA, 23 bp, Homo sapiens
acaaagcttctatcccaggaggt

SEQ ID NO: 4050330 - DNA, 20 bp, Homo sapiens
acaaagtaatttctttgatc

SEQ ID NO: 4050331 - DNA, 21 bp, Homo sapiens
acaaagtgactgtttggctta

SEQ ID NO: 4050332 - DNA, 14 bp, Homo sapiens
acaaagtgctggga

SEQ ID NO: 4050333 - DNA, 23 bp, Homo sapiens
acaaatactcttaggaagagaaa

SEQ ID NO: 4050334 - DNA, 15 bp, Homo sapiens
acaaatagaaaatgg

SEQ ID NO: 4050335 - DNA, 14 bp, Homo sapiens
acaaatagattttt

SEQ ID NO: 4050336 - DNA, 14 bp, Homo sapiens
acaaatataagatt

SEQ ID NO: 4050337 - DNA, 11 bp, Homo sapiens
acaaatatgca

SEQ ID NO: 4050338 - DNA, 17 bp, Homo sapiens
acaaatatgctaatttg

SEQ ID NO: 4050339 - DNA, 18 bp, Homo sapiens
acaaatatgctaatttgg

SEQ ID NO: 4050340 - DNA, 18 bp, Homo sapiens
acaaatctgtataaatgt

SEQ ID NO: 4050341 - DNA, 14 bp, Homo sapiens
acaaatgtattttg

SEQ ID NO: 4050342 - DNA, 15 bp, Homo sapiens
acaaatgtattttga

SEQ ID NO: 4050343 - DNA, 14 bp, Homo sapiens
acaaatgtctatca

SEQ ID NO: 4050344 - DNA, 17 bp, Homo sapiens
acaaattttcagaaggt

SEQ ID NO: 4050345 - DNA, 19 bp, Homo sapiens
acaacaattggtaaaactc

SEQ ID NO: 4050346 - DNA, 22 bp, Homo sapiens
acaacagtgctttgtaaattgt

SEQ ID NO: 4050347 - DNA, 21 bp, Homo sapiens
acaaccacctaatcaggctga

SEQ ID NO: 4050348 - DNA, 17 bp, Homo sapiens
acaaccagagcccccca

SEQ ID NO: 4050349 - DNA, 15 bp, Homo sapiens
acaaccatccctgcc

SEQ ID NO: 4050350 - DNA, 17 bp, Homo sapiens
acaaccatccctgccac

SEQ ID NO: 4050351 - DNA, 15 bp, Homo sapiens
acaacctagaatgtc

SEQ ID NO: 4050352 - DNA, 16 bp, Homo sapiens
acaacctctctgatct

SEQ ID NO: 4050353 - DNA, 18 bp, Homo sapiens
acaaccttctgtggctca

SEQ ID NO: 4050354 - DNA, 17 bp, Homo sapiens
acaacgatgaatttctt

SEQ ID NO: 4050355 - DNA, 22 bp, Homo sapiens
acaacgatgaatttcttctaat

SEQ ID NO: 4050356 - DNA, 11 bp, Homo sapiens
acaactaaaat

SEQ ID NO: 4050357 - DNA, 16 bp, Homo sapiens
acaactatttttccaa

SEQ ID NO: 4050358 - DNA, 22 bp, Homo sapiens
acaactgcctcgaaacacagaa

SEQ ID NO: 4050359 - DNA, 15 bp, Homo sapiens
acaacttaaataata

SEQ ID NO: 4050360 - DNA, 16 bp, Homo sapiens
acaacttatttaaaaa

SEQ ID NO: 4050361 - DNA, 20 bp, Homo sapiens
acaacttatttaaaaatatt

SEQ ID NO: 4050362 - DNA, 21 bp, Homo sapiens
acaacttatttaaaaatattt

SEQ ID NO: 4050363 - DNA, 22 bp, Homo sapiens
acaacttatttaaaaatatttc

SEQ ID NO: 4050364 - DNA, 17 bp, Homo sapiens
acaacttgattttttca

SEQ ID NO: 4050365 - DNA, 14 bp, Homo sapiens
acaacttgggttct

SEQ ID NO: 4050366 - DNA, 22 bp, Homo sapiens
acaacttgtacttgtttcatct

SEQ ID NO: 4050367 - DNA, 21 bp, Homo sapiens
acaagaaatccctgtttaata

SEQ ID NO: 4050368 - DNA, 14 bp, Homo sapiens
acaagaagaagggc

SEQ ID NO: 4050369 - DNA, 21 bp, Homo sapiens
acaagaagtttattctcattt

SEQ ID NO: 4050370 - DNA, 21 bp, Homo sapiens
acaagagcactacattcattt

SEQ ID NO: 4050371 - DNA, 14 bp, Homo sapiens
acaagagcagcctg

SEQ ID NO: 4050372 - DNA, 15 bp, Homo sapiens
acaagagcagcctgt

SEQ ID NO: 4050373 - DNA, 16 bp, Homo sapiens
acaagagcagcctgtg

SEQ ID NO: 4050374 - DNA, 20 bp, Homo sapiens
acaagagcagcctgtggcat

SEQ ID NO: 4050375 - DNA, 13 bp, Homo sapiens
acaagagcccagc

SEQ ID NO: 4050376 - DNA, 16 bp, Homo sapiens
acaagaggtacagggt

SEQ ID NO: 4050377 - DNA, 19 bp, Homo sapiens
acaagaggtacagggtttt

SEQ ID NO: 4050378 - DNA, 17 bp, Homo sapiens
acaagatattgatgata

SEQ ID NO: 4050379 - DNA, 14 bp, Homo sapiens
acaagatctttcag

SEQ ID NO: 4050380 - DNA, 18 bp, Homo sapiens
acaagatggaatttatca

SEQ ID NO: 4050381 - DNA, 15 bp, Homo sapiens
acaagatgtgggcct

SEQ ID NO: 4050382 - DNA, 18 bp, Homo sapiens
acaagccaaaagtccctc

SEQ ID NO: 4050383 - DNA, 22 bp, Homo sapiens
acaagcccgttagccccaggga

SEQ ID NO: 4050384 - DNA, 14 bp, Homo sapiens
acaagctaaaatta

SEQ ID NO: 4050385 - DNA, 14 bp, Homo sapiens
acaggaggaggaga

SEQ ID NO: 4050386 - DNA, 13 bp, Homo sapiens
acaggaggcggcc

SEQ ID NO: 4050387 - DNA, 22 bp, Homo sapiens
acaggaggcggcccggccagcg

SEQ ID NO: 4050388 - DNA, 18 bp, Homo sapiens
acaggagggcaagggcca

SEQ ID NO: 4050389 - DNA, 21 bp, Homo sapiens
acaggagtgtcctcttccctc

SEQ ID NO: 4050390 - DNA, 19 bp, Homo sapiens
acaggataaagatatcaat

SEQ ID NO: 4050391 - DNA, 18 bp, Homo sapiens
acaggatgacctggataa

SEQ ID NO: 4050392 - DNA, 13 bp, Homo sapiens
acaggcacgggtc

SEQ ID NO: 4050393 - DNA, 18 bp, Homo sapiens
acaggcagctttctagaa

SEQ ID NO: 4050394 - DNA, 18 bp, Homo sapiens
acaggcatctacacagcc

SEQ ID NO: 4050395 - DNA, 19 bp, Homo sapiens
acaggcatctacacagcct

SEQ ID NO: 4050396 - DNA, 20 bp, Homo sapiens
acaggcatctacacagcctg

SEQ ID NO: 4050397 - DNA, 22 bp, Homo sapiens
acaggcatctacacagcctgga

SEQ ID NO: 4050398 - DNA, 17 bp, Homo sapiens
acaggcatttgttcact

SEQ ID NO: 4050399 - DNA, 12 bp, Homo sapiens
acaggcccagcg

SEQ ID NO: 4050400 - DNA, 19 bp, Homo sapiens
acaggcccagcgcggccag

SEQ ID NO: 4050401 - DNA, 21 bp, Homo sapiens
acaggcccccttgagtggggt

SEQ ID NO: 4050402 - DNA, 23 bp, Homo sapiens
acaggccctccctgttccccaga

SEQ ID NO: 4050403 - DNA, 14 bp, Homo sapiens
acaggccctgctcc

SEQ ID NO: 4050404 - DNA, 17 bp, Homo sapiens
acaggccctgctcctgc

SEQ ID NO: 4050405 - DNA, 19 bp, Homo sapiens
acaggccctgctcctgcag

SEQ ID NO: 4050406 - DNA, 22 bp, Homo sapiens
acaggccctggagaagcagcta

SEQ ID NO: 4050407 - DNA, 13 bp, Homo sapiens
acaggcccttcct

SEQ ID NO: 4050408 - DNA, 22 bp, Homo sapiens
acaggcccttcctctccactgc

SEQ ID NO: 4050409 - DNA, 14 bp, Homo sapiens
acaggcgagagagg

SEQ ID NO: 4050410 - DNA, 13 bp, Homo sapiens
acaggctcttagc

SEQ ID NO: 4050411 - DNA, 15 bp, Homo sapiens
acagggaagagcaga

SEQ ID NO: 4050412 - DNA, 22 bp, Homo sapiens
acagggaagggcttggccagcg

SEQ ID NO: 4050413 - DNA, 17 bp, Homo sapiens
acagggaggccacacgc

SEQ ID NO: 4050414 - DNA, 19 bp, Homo sapiens
acagggaggccacacgcac

SEQ ID NO: 4050415 - DNA, 13 bp, Homo sapiens
acagggcaccaga

SEQ ID NO: 4050416 - DNA, 20 bp, Homo sapiens
acagggcagagcaggaagga

SEQ ID NO: 4050417 - DNA, 20 bp, Homo sapiens
acagggccagtggggcctgt

SEQ ID NO: 4050418 - DNA, 12 bp, Homo sapiens
acagggcccgca

SEQ ID NO: 4050419 - DNA, 18 bp, Homo sapiens
acagggcccgcagtgctg

SEQ ID NO: 4050420 - DNA, 18 bp, Homo sapiens
acagggggattctgagca

SEQ ID NO: 4050421 - DNA, 15 bp, Homo sapiens
acagggtaggaaagg

SEQ ID NO: 4050422 - DNA, 14 bp, Homo sapiens
acagggtctgctct

SEQ ID NO: 4050423 - DNA, 24 bp, Homo sapiens
acagggtctgctctttctctgcca

SEQ ID NO: 4050424 - DNA, 17 bp, Homo sapiens
acaggtaccagttcttt

SEQ ID NO: 4050425 - DNA, 16 bp, Homo sapiens
acaggtatatactttg

SEQ ID NO: 4050426 - DNA, 19 bp, Homo sapiens
acaggtatatactttgaaa

SEQ ID NO: 4050427 - DNA, 23 bp, Homo sapiens
acaggtgcgcgccaccgtgcctg

SEQ ID NO: 4050428 - DNA, 16 bp, Homo sapiens
acaggtggcaggacca

SEQ ID NO: 4050429 - DNA, 11 bp, Homo sapiens
acaggtgggga

SEQ ID NO: 4050430 - DNA, 20 bp, Homo sapiens
acaggtggggactgggcaca

SEQ ID NO: 4050431 - DNA, 19 bp, Homo sapiens
acaggtgtggggacacagc

SEQ ID NO: 4050432 - DNA, 21 bp, Homo sapiens
acaggttcttaaaaaggaaca

SEQ ID NO: 4050433 - DNA, 12 bp, Homo sapiens
acagtaaacatt

SEQ ID NO: 4050434 - DNA, 21 bp, Homo sapiens
acagtaatctaggtgtggctg

SEQ ID NO: 4050435 - DNA, 18 bp, Homo sapiens
acagtagaactgtctgtg

SEQ ID NO: 4050436 - DNA, 23 bp, Homo sapiens
acagtagtcttgatgaccaaagt

SEQ ID NO: 4050437 - DNA, 17 bp, Homo sapiens
acagtattatctgtgtt

SEQ ID NO: 4050438 - DNA, 18 bp, Homo sapiens
acagtatttattttgtaa

SEQ ID NO: 4050439 - DNA, 15 bp, Homo sapiens
acagtatttcattgc

SEQ ID NO: 4050440 - DNA, 16 bp, Homo sapiens
acagtcaaaacagaga

SEQ ID NO: 4050441 - DNA, 14 bp, Homo sapiens
acagtcaaaataat

SEQ ID NO: 4050442 - DNA, 17 bp, Homo sapiens
acagtcatcatcagggc

SEQ ID NO: 4050443 - DNA, 14 bp, Homo sapiens
acagtccagaccca

SEQ ID NO: 4050444 - DNA, 18 bp, Homo sapiens
acagtccctatggaaaga

SEQ ID NO: 4050445 - DNA, 15 bp, Homo sapiens
acagtcgtaaaagag

SEQ ID NO: 4050446 - DNA, 18 bp, Homo sapiens
acagtcgtaaaagagata

SEQ ID NO: 4050447 - DNA, 20 bp, Homo sapiens
acagtctctttaatcttcag

SEQ ID NO: 4050448 - DNA, 19 bp, Homo sapiens
acagtgaatgtgtctggac

SEQ ID NO: 4050449 - DNA, 16 bp, Homo sapiens
acagtgaccttttctt

SEQ ID NO: 4050450 - DNA, 19 bp, Homo sapiens
acagtgaccttttcttcat

SEQ ID NO: 4050451 - DNA, 21 bp, Homo sapiens
acagtgaccttttcttcattt

SEQ ID NO: 4050452 - DNA, 19 bp, Homo sapiens
acagtgatctccatatgtt

SEQ ID NO: 4050453 - DNA, 21 bp, Homo sapiens
acagtgatctccatatgttac

SEQ ID NO: 4050454 - DNA, 22 bp, Homo sapiens
acagtgatctccatatgttaca

SEQ ID NO: 4050455 - DNA, 24 bp, Homo sapiens
acagtgatgctgtgctatgaattt

SEQ ID NO: 4050456 - DNA, 17 bp, Homo sapiens
acagtgcagacaggcca

SEQ ID NO: 4050457 - DNA, 20 bp, Homo sapiens
acagtgcagagccttctcag

SEQ ID NO: 4050458 - DNA, 21 bp, Homo sapiens
acagtgcagagccttctcaga

SEQ ID NO: 4050459 - DNA, 22 bp, Homo sapiens
acagtgcagagccttctcagaa

SEQ ID NO: 4050460 - DNA, 16 bp, Homo sapiens
acagtgcagaggctct

SEQ ID NO: 4050461 - DNA, 15 bp, Homo sapiens
acagtgcatctcagc

SEQ ID NO: 4050462 - DNA, 20 bp, Homo sapiens
acagtgcctgggaatgtatt

SEQ ID NO: 4050463 - DNA, 14 bp, Homo sapiens
acagtgccttctct

SEQ ID NO: 4050464 - DNA, 13 bp, Homo sapiens
acagtgccttgct

SEQ ID NO: 4050465 - DNA, 14 bp, Homo sapiens
acagtgccttgctc

SEQ ID NO: 4050466 - DNA, 19 bp, Homo sapiens
acagtggactcagcagtga

SEQ ID NO: 4050467 - DNA, 21 bp, Homo sapiens
acagtggactcagcagtgacc

SEQ ID NO: 4050468 - DNA, 19 bp, Homo sapiens
acagtggagtgcaaaaggc

SEQ ID NO: 4050469 - DNA, 16 bp, Homo sapiens
acagtgggcatcagca

SEQ ID NO: 4050470 - DNA, 19 bp, Homo sapiens
acagtgggcgttgggagcc

SEQ ID NO: 4050471 - DNA, 22 bp, Homo sapiens
acagtgggcgttgggagcctag

SEQ ID NO: 4050472 - DNA, 23 bp, Homo sapiens
acagtgtgtgaactgctttcaag

SEQ ID NO: 4050473 - DNA, 20 bp, Homo sapiens
acagtgttattttctttgaa

SEQ ID NO: 4050474 - DNA, 16 bp, Homo sapiens
acagtgttgagaacta

SEQ ID NO: 4050475 - DNA, 18 bp, Homo sapiens
acagtgtttcccataatt

SEQ ID NO: 4050476 - DNA, 23 bp, Homo sapiens
acagtgtttcccataattttctt

SEQ ID NO: 4050477 - DNA, 22 bp, Homo sapiens
acagttagggttgagttacttc

SEQ ID NO: 4050478 - DNA, 18 bp, Homo sapiens
acagttagggttttgcaa

SEQ ID NO: 4050479 - DNA, 21 bp, Homo sapiens
acagttagggttttgcaataa

SEQ ID NO: 4050480 - DNA, 15 bp, Homo sapiens
acagttattttggat

SEQ ID NO: 4050481 - DNA, 21 bp, Homo sapiens
acagttcaataaacttaactt

SEQ ID NO: 4050482 - DNA, 16 bp, Homo sapiens
acagttctgctctggt

SEQ ID NO: 4050483 - DNA, 17 bp, Homo sapiens
acagttctttgggccag

SEQ ID NO: 4050484 - DNA, 20 bp, Homo sapiens
acagttctttgggccagaca

SEQ ID NO: 4050485 - DNA, 21 bp, Homo sapiens
acagttgctgtcataagaatg

SEQ ID NO: 4050486 - DNA, 17 bp, Homo sapiens
acagttgtctagagata

SEQ ID NO: 4050487 - DNA, 21 bp, Homo sapiens
accagccattggctatttaaa

SEQ ID NO: 4050488 - DNA, 16 bp, Homo sapiens
accagccccaccctgt

SEQ ID NO: 4050489 - DNA, 18 bp, Homo sapiens
accagcccccgccccaga

SEQ ID NO: 4050490 - DNA, 15 bp, Homo sapiens
accagcccggcctgc

SEQ ID NO: 4050491 - DNA, 21 bp, Homo sapiens
accagcccggcctgctcccag

SEQ ID NO: 4050492 - DNA, 18 bp, Homo sapiens
accagccttggtgccacc

SEQ ID NO: 4050493 - DNA, 19 bp, Homo sapiens
accagccttggtgccacca

SEQ ID NO: 4050494 - DNA, 19 bp, Homo sapiens
accagcgctctaaaagcac

SEQ ID NO: 4050495 - DNA, 15 bp, Homo sapiens
accagctatctgtca

SEQ ID NO: 4050496 - DNA, 16 bp, Homo sapiens
accagctcaggacaga

SEQ ID NO: 4050497 - DNA, 15 bp, Homo sapiens
accagctcatctcca

SEQ ID NO: 4050498 - DNA, 23 bp, Homo sapiens
accagctcgtttttcagcacccc

SEQ ID NO: 4050499 - DNA, 13 bp, Homo sapiens
accagctgcagcc

SEQ ID NO: 4050500 - DNA, 18 bp, Homo sapiens
accagctgcgcttgcttt

SEQ ID NO: 4050501 - DNA, 18 bp, Homo sapiens
accagctgtgtccggccc

SEQ ID NO: 4050502 - DNA, 17 bp, Homo sapiens
accagcttaaaggcagt

SEQ ID NO: 4050503 - DNA, 16 bp, Homo sapiens
accagcttagatttta

SEQ ID NO: 4050504 - DNA, 16 bp, Homo sapiens
accagcttctccaggc

SEQ ID NO: 4050505 - DNA, 18 bp, Homo sapiens
accagcttctccaggctc

SEQ ID NO: 4050506 - DNA, 21 bp, Homo sapiens
accagcttgtatgcaatggat

SEQ ID NO: 4050507 - DNA, 19 bp, Homo sapiens
accagcttgttctgggctc

SEQ ID NO: 4050508 - DNA, 15 bp, Homo sapiens
accaggactccctcc

SEQ ID NO: 4050509 - DNA, 19 bp, Homo sapiens
accaggacttggggtcagg

SEQ ID NO: 4050510 - DNA, 14 bp, Homo sapiens
accaggagaaccac

SEQ ID NO: 4050511 - DNA, 20 bp, Homo sapiens
accaggagaaccactacatg

SEQ ID NO: 4050512 - DNA, 20 bp, Homo sapiens
accaggagctgatggcagct

SEQ ID NO: 4050513 - DNA, 18 bp, Homo sapiens
accaggatactggacgct

SEQ ID NO: 4050514 - DNA, 14 bp, Homo sapiens
accaggatggccct

SEQ ID NO: 4050515 - DNA, 17 bp, Homo sapiens
accaggcacctcttcct

SEQ ID NO: 4050516 - DNA, 22 bp, Homo sapiens
accaggcttcttcctacatctt

SEQ ID NO: 4050517 - DNA, 21 bp, Homo sapiens
accagggagaccgagcgcttt

SEQ ID NO: 4050518 - DNA, 19 bp, Homo sapiens
accagggatgctgggctgg

SEQ ID NO: 4050519 - DNA, 21 bp, Homo sapiens
accagggatgctgggctgggc

SEQ ID NO: 4050520 - DNA, 23 bp, Homo sapiens
accagggatgctgggctgggccc

SEQ ID NO: 4050521 - DNA, 22 bp, Homo sapiens
accagggcattcgggccacagg

SEQ ID NO: 4050522 - DNA, 15 bp, Homo sapiens
accaggtgcatgcat

SEQ ID NO: 4050523 - DNA, 22 bp, Homo sapiens
accaggtgggagcgttttgttg

SEQ ID NO: 4050524 - DNA, 18 bp, Homo sapiens
accaggtgtgcctggaag

SEQ ID NO: 4050525 - DNA, 20 bp, Homo sapiens
accaggtgttctacactcat

SEQ ID NO: 4050526 - DNA, 18 bp, Homo sapiens
accagtacctctgtatag

SEQ ID NO: 4050527 - DNA, 16 bp, Homo sapiens
accagtgaccccagaa

SEQ ID NO: 4050528 - DNA, 22 bp, Homo sapiens
accagtgaccccagaaaagcat

SEQ ID NO: 4050529 - DNA, 23 bp, Homo sapiens
accagtgataatgccccaaggac

SEQ ID NO: 4050530 - DNA, 23 bp, Homo sapiens
accagtggcgttgttgcatgttt

SEQ ID NO: 4050531 - DNA, 18 bp, Homo sapiens
accagtgggaattgctgg

SEQ ID NO: 4050532 - DNA, 23 bp, Homo sapiens
accagtgtatcaggtcagggact

SEQ ID NO: 4050533 - DNA, 18 bp, Homo sapiens
accagtgtcctccaagtg

SEQ ID NO: 4050534 - DNA, 19 bp, Homo sapiens
accagtgtcctccaagtgc

SEQ ID NO: 4050535 - DNA, 21 bp, Homo sapiens
accagtgtcctccaagtgccc

SEQ ID NO: 4050536 - DNA, 16 bp, Homo sapiens
accagttcagacacta

SEQ ID NO: 4050537 - DNA, 18 bp, Homo sapiens
accataaatgaatcatca

SEQ ID NO: 4050538 - DNA, 18 bp, Homo sapiens
accatactccttgcttcc

SEQ ID NO: 4050539 - DNA, 21 bp, Homo sapiens
accatagtaccatttatacaa

SEQ ID NO: 4050540 - DNA, 14 bp, Homo sapiens
accatagttgacag

SEQ ID NO: 4050541 - DNA, 19 bp, Homo sapiens
accatatgatctgttttgt

SEQ ID NO: 4050542 - DNA, 13 bp, Homo sapiens
accatcattttat

SEQ ID NO: 4050543 - DNA, 16 bp, Homo sapiens
accatcattttattat

SEQ ID NO: 4050544 - DNA, 23 bp, Homo sapiens
accatccactctaccctcccacc

SEQ ID NO: 4050545 - DNA, 13 bp, Homo sapiens
accatcctggcta

SEQ ID NO: 4050546 - DNA, 14 bp, Homo sapiens
accatgaaacaaag

SEQ ID NO: 4050547 - DNA, 18 bp, Homo sapiens
accatgaagtaaattatg

SEQ ID NO: 4050548 - DNA, 18 bp, Homo sapiens
accatgagaagagggcct

SEQ ID NO: 4050549 - DNA, 18 bp, Homo sapiens
accatgtaagcactctgg

SEQ ID NO: 4050550 - DNA, 11 bp, Homo sapiens
accatgtacat

SEQ ID NO: 4050551 - DNA, 18 bp, Homo sapiens
accatgtattcatccaga

SEQ ID NO: 4050552 - DNA, 12 bp, Homo sapiens
accatgtgccat

SEQ ID NO: 4050553 - DNA, 22 bp, Homo sapiens
accattaagtcatgtgtgaaca

SEQ ID NO: 4050554 - DNA, 14 bp, Homo sapiens
accattaataaaga

SEQ ID NO: 4050555 - DNA, 23 bp, Homo sapiens
accattcagatcactgaatttat

SEQ ID NO: 4050556 - DNA, 12 bp, Homo sapiens
accattccccat

SEQ ID NO: 4050557 - DNA, 15 bp, Homo sapiens
accatttaataaaga

SEQ ID NO: 4050558 - DNA, 19 bp, Homo sapiens
accatttaataaagaaata

SEQ ID NO: 4050559 - DNA, 11 bp, Homo sapiens
accatttataa

SEQ ID NO: 4050560 - DNA, 12 bp, Homo sapiens
accatttataat

SEQ ID NO: 4050561 - DNA, 19 bp, Homo sapiens
accatttatacaaattaga

SEQ ID NO: 4050562 - DNA, 22 bp, Homo sapiens
accatttatacaaattagaaaa

SEQ ID NO: 4050563 - DNA, 23 bp, Homo sapiens
accatttatacaaattagaaaat

SEQ ID NO: 4050564 - DNA, 17 bp, Homo sapiens
accatttctcactagtg

SEQ ID NO: 4050565 - DNA, 23 bp, Homo sapiens
accatttgaagtgtacctgtgta

SEQ ID NO: 4050566 - DNA, 14 bp, Homo sapiens
accatttgtaataa

SEQ ID NO: 4050567 - DNA, 21 bp, Homo sapiens
accatttgtaataaagtatat

SEQ ID NO: 4050568 - DNA, 14 bp, Homo sapiens
acccaaacccccaa

SEQ ID NO: 4050569 - DNA, 17 bp, Homo sapiens
acccaaagcggtccctg

SEQ ID NO: 4050570 - DNA, 20 bp, Homo sapiens
acccaaagcggtccctgtcc

SEQ ID NO: 4050571 - DNA, 22 bp, Homo sapiens
acccaaatcacatctcacctcc

SEQ ID NO: 4050572 - DNA, 15 bp, Homo sapiens
acccaactgacttgt

SEQ ID NO: 4050573 - DNA, 16 bp, Homo sapiens
acccaagcccaaactt

SEQ ID NO: 4050574 - DNA, 15 bp, Homo sapiens
acccaagcttagaac

SEQ ID NO: 4050575 - DNA, 24 bp, Homo sapiens
acccaatctgcacactccaggcct

SEQ ID NO: 4050576 - DNA, 12 bp, Homo sapiens
acccaatttccc

SEQ ID NO: 4050577 - DNA, 13 bp, Homo sapiens
acccacaagtgcc

SEQ ID NO: 4050578 - DNA, 17 bp, Homo sapiens
acccacacagctgccct

SEQ ID NO: 4050579 - DNA, 20 bp, Homo sapiens
acccacacagctgccctagc

SEQ ID NO: 4050580 - DNA, 17 bp, Homo sapiens
acccaccacccccttta

SEQ ID NO: 4050581 - DNA, 12 bp, Homo sapiens
acccacccctgc

SEQ ID NO: 4050582 - DNA, 16 bp, Homo sapiens
acccacccgacctggc

SEQ ID NO: 4050583 - DNA, 19 bp, Homo sapiens
acccacccgacctggctgc

SEQ ID NO: 4050584 - DNA, 14 bp, Homo sapiens
acccaccctgtgcc

SEQ ID NO: 4050585 - DNA, 15 bp, Homo sapiens
acccacctccaccca

SEQ ID NO: 4050586 - DNA, 20 bp, Homo sapiens
acccacctccacccagcccc

SEQ ID NO: 4050587 - DNA, 15 bp, Homo sapiens
acccactcaggattg

SEQ ID NO: 4050588 - DNA, 16 bp, Homo sapiens
acccactcccttcccc

SEQ ID NO: 4050589 - DNA, 22 bp, Homo sapiens
gctccacccttggcctgtctca

SEQ ID NO: 4050590 - DNA, 23 bp, Homo sapiens
gctccacccttggcctgtctcat

SEQ ID NO: 4050591 - DNA, 19 bp, Homo sapiens
gctccactcttgatctctc

SEQ ID NO: 4050592 - DNA, 20 bp, Homo sapiens
gctccagaaatgtctaaatg

SEQ ID NO: 4050593 - DNA, 15 bp, Homo sapiens
gctccagaagatgcc

SEQ ID NO: 4050594 - DNA, 22 bp, Homo sapiens
gctccagacctgatcctggagg

SEQ ID NO: 4050595 - DNA, 21 bp, Homo sapiens
gctccagatgcagggcagtca

SEQ ID NO: 4050596 - DNA, 22 bp, Homo sapiens
gctccagatgcagggcagtcat

SEQ ID NO: 4050597 - DNA, 11 bp, Homo sapiens
gctccagcctg

SEQ ID NO: 4050598 - DNA, 13 bp, Homo sapiens
gctccagctgccc

SEQ ID NO: 4050599 - DNA, 15 bp, Homo sapiens
gctccaggcacccag

SEQ ID NO: 4050600 - DNA, 22 bp, Homo sapiens
gctccaggcagcacccaggttt

SEQ ID NO: 4050601 - DNA, 15 bp, Homo sapiens
gctccaggcctgcag

SEQ ID NO: 4050602 - DNA, 16 bp, Homo sapiens
gctccaggcctgcagc

SEQ ID NO: 4050603 - DNA, 21 bp, Homo sapiens
gctccaggggcccttgggaca

SEQ ID NO: 4050604 - DNA, 23 bp, Homo sapiens
gctccaggggcccttgggacagc

SEQ ID NO: 4050605 - DNA, 22 bp, Homo sapiens
gctccataccttttctcttttc

SEQ ID NO: 4050606 - DNA, 20 bp, Homo sapiens
gctccatttataaccccagc

SEQ ID NO: 4050607 - DNA, 22 bp, Homo sapiens
gctccatttataaccccagcct

SEQ ID NO: 4050608 - DNA, 16 bp, Homo sapiens
gctcccacaggccctt

SEQ ID NO: 4050609 - DNA, 21 bp, Homo sapiens
gctcccacaggcccttcctct

SEQ ID NO: 4050610 - DNA, 19 bp, Homo sapiens
gctcccagcagccctaagg

SEQ ID NO: 4050611 - DNA, 17 bp, Homo sapiens
gctcccagcctgctgag

SEQ ID NO: 4050612 - DNA, 20 bp, Homo sapiens
gctcccaggggtctccctgg

SEQ ID NO: 4050613 - DNA, 21 bp, Homo sapiens
gctcccaggggtctccctggc

SEQ ID NO: 4050614 - DNA, 21 bp, Homo sapiens
gctcccaggttcccccagcaa

SEQ ID NO: 4050615 - DNA, 22 bp, Homo sapiens
gctcccaggttcccccagcaag

SEQ ID NO: 4050616 - DNA, 21 bp, Homo sapiens
gctcccatcattccttctggc

SEQ ID NO: 4050617 - DNA, 15 bp, Homo sapiens
gctcccattcctccc

SEQ ID NO: 4050618 - DNA, 16 bp, Homo sapiens
gctcccattcctccct

SEQ ID NO: 4050619 - DNA, 22 bp, Homo sapiens
gctccccacaccttccagggcc

SEQ ID NO: 4050620 - DNA, 23 bp, Homo sapiens
gctccccacaccttccagggccc

SEQ ID NO: 4050621 - DNA, 21 bp, Homo sapiens
gctccccacagcgtccctggc

SEQ ID NO: 4050622 - DNA, 22 bp, Homo sapiens
gctccccacagcgtccctggcg

SEQ ID NO: 4050623 - DNA, 15 bp, Homo sapiens
gctccccagccctgg

SEQ ID NO: 4050624 - DNA, 21 bp, Homo sapiens
gctccccagccctggctctgc

SEQ ID NO: 4050625 - DNA, 20 bp, Homo sapiens
gctcccccagctccccccac

SEQ ID NO: 4050626 - DNA, 20 bp, Homo sapiens
gctcccccaggctgttctcc

SEQ ID NO: 4050627 - DNA, 20 bp, Homo sapiens
gctccccctccccaggctgg

SEQ ID NO: 4050628 - DNA, 21 bp, Homo sapiens
gctccccctccccaggctgga

SEQ ID NO: 4050629 - DNA, 22 bp, Homo sapiens
gctccccggacatactctctgc

SEQ ID NO: 4050630 - DNA, 12 bp, Homo sapiens
aacagccttagc

SEQ ID NO: 4050631 - DNA, 17 bp, Homo sapiens
aacagccttagctgcca

SEQ ID NO: 4050632 - DNA, 23 bp, Homo sapiens
aacagccttagctgccagtgctg

SEQ ID NO: 4050633 - DNA, 19 bp, Homo sapiens
aacagctatgggagcccca

SEQ ID NO: 4050634 - DNA, 22 bp, Homo sapiens
aacagctatgggagccccaggg

SEQ ID NO: 4050635 - DNA, 20 bp, Homo sapiens
aacagctgaggtctcttgag

SEQ ID NO: 4050636 - DNA, 17 bp, Homo sapiens
aacagctgcattagaaa

SEQ ID NO: 4050637 - DNA, 22 bp, Homo sapiens
aacaggaaaggctcgaaataca

SEQ ID NO: 4050638 - DNA, 21 bp, Homo sapiens
aacaggacagagttcacagga

SEQ ID NO: 4050639 - DNA, 22 bp, Homo sapiens
aacaggacagagttcacaggag

SEQ ID NO: 4050640 - DNA, 14 bp, Homo sapiens
aacaggcccaggga

SEQ ID NO: 4050641 - DNA, 20 bp, Homo sapiens
aacaggcccagggagggaag

SEQ ID NO: 4050642 - DNA, 13 bp, Homo sapiens
aacaggtattttg

SEQ ID NO: 4050643 - DNA, 18 bp, Homo sapiens
aacaggtattttgtttct

SEQ ID NO: 4050644 - DNA, 19 bp, Homo sapiens
aacaggtggcaggaccagg

SEQ ID NO: 4050645 - DNA, 21 bp, Homo sapiens
aacaggtggcaggaccaggac

SEQ ID NO: 4050646 - DNA, 22 bp, Homo sapiens
aacaggtggcaggaccaggact

SEQ ID NO: 4050647 - DNA, 23 bp, Homo sapiens
aacaggtggcaggaccaggacta

SEQ ID NO: 4050648 - DNA, 19 bp, Homo sapiens
aacagtagttgtattcttc

SEQ ID NO: 4050649 - DNA, 11 bp, Homo sapiens
aacagtattta

SEQ ID NO: 4050650 - DNA, 15 bp, Homo sapiens
aacagtggaatataa

SEQ ID NO: 4050651 - DNA, 11 bp, Homo sapiens
aacagtggctg

SEQ ID NO: 4050652 - DNA, 17 bp, Homo sapiens
aacagtggctgggtggg

SEQ ID NO: 4050653 - DNA, 19 bp, Homo sapiens
aacagtggctgggtgggcc

SEQ ID NO: 4050654 - DNA, 19 bp, Homo sapiens
aacagtgggagccctgacc

SEQ ID NO: 4050655 - DNA, 18 bp, Homo sapiens
aacagttaactttcagaa

SEQ ID NO: 4050656 - DNA, 16 bp, Homo sapiens
aacagttcatgtttgc

SEQ ID NO: 4050657 - DNA, 16 bp, Homo sapiens
aacagtttggaaaagt

SEQ ID NO: 4050658 - DNA, 13 bp, Homo sapiens
aacagttttccat

SEQ ID NO: 4050659 - DNA, 21 bp, Homo sapiens
aacagttttttatgctaatca

SEQ ID NO: 4050660 - DNA, 15 bp, Homo sapiens
aacataaaaaggaca

SEQ ID NO: 4050661 - DNA, 20 bp, Homo sapiens
aacataaaaaggacatcagc

SEQ ID NO: 4050662 - DNA, 16 bp, Homo sapiens
aacataagttgcattt

SEQ ID NO: 4050663 - DNA, 13 bp, Homo sapiens
aacataataaatc

SEQ ID NO: 4050664 - DNA, 15 bp, Homo sapiens
aacataatgaaaata

SEQ ID NO: 4050665 - DNA, 17 bp, Homo sapiens
aacataattcttgtata

SEQ ID NO: 4050666 - DNA, 19 bp, Homo sapiens
aacatacttcaaaaataat

SEQ ID NO: 4050667 - DNA, 13 bp, Homo sapiens
aacatataatgtt

SEQ ID NO: 4050668 - DNA, 18 bp, Homo sapiens
aacatataatgttgttat

SEQ ID NO: 4050669 - DNA, 21 bp, Homo sapiens
aacatatgatttcactagaaa

SEQ ID NO: 4050670 - DNA, 16 bp, Homo sapiens
aacatatgtacataaa

SEQ ID NO: 4050671 - DNA, 14 bp, Homo sapiens
aacatcaacatctt

SEQ ID NO: 4050672 - DNA, 13 bp, Homo sapiens
aacatcaatgttc

SEQ ID NO: 4050673 - DNA, 15 bp, Homo sapiens
aacatcagacctgtc

SEQ ID NO: 4050674 - DNA, 17 bp, Homo sapiens
aacatcagacctgtctt

SEQ ID NO: 4050675 - DNA, 21 bp, Homo sapiens
aacatcatagaaactgtctag

SEQ ID NO: 4050676 - DNA, 15 bp, Homo sapiens
aacatccaatatttt

SEQ ID NO: 4050677 - DNA, 17 bp, Homo sapiens
aacatccctttttcaat

SEQ ID NO: 4050678 - DNA, 22 bp, Homo sapiens
aacatcctatcaacaacaaggt

SEQ ID NO: 4050679 - DNA, 19 bp, Homo sapiens
aacatcctttgcagggcag

SEQ ID NO: 4050680 - DNA, 14 bp, Homo sapiens
aacatcgatatgta

SEQ ID NO: 4050681 - DNA, 17 bp, Homo sapiens
aacatcgatatgtatat

SEQ ID NO: 4050682 - DNA, 18 bp, Homo sapiens
aacatcgatatgtatatc

SEQ ID NO: 4050683 - DNA, 12 bp, Homo sapiens
aacatctttaag

SEQ ID NO: 4050684 - DNA, 20 bp, Homo sapiens
aacatctttgcgaaaagata

SEQ ID NO: 4050685 - DNA, 18 bp, Homo sapiens
aacatgcagttcattatt

SEQ ID NO: 4050686 - DNA, 21 bp, Homo sapiens
aacatgcagttcattattttg

SEQ ID NO: 4050687 - DNA, 21 bp, Homo sapiens
aacatgcctgccccaaacaaa

SEQ ID NO: 4050688 - DNA, 20 bp, Homo sapiens
aacatggacttgtatatttg

SEQ ID NO: 4050689 - DNA, 17 bp, Homo sapiens
aacatggagctgtcatc

SEQ ID NO: 4050690 - DNA, 20 bp, Homo sapiens
aacatggttttgaaatgctt

SEQ ID NO: 4050691 - DNA, 14 bp, Homo sapiens
aacatgtaattaag

SEQ ID NO: 4050692 - DNA, 13 bp, Homo sapiens
aactcttatctca

SEQ ID NO: 4050693 - DNA, 14 bp, Homo sapiens
aactcttatctcag

SEQ ID NO: 4050694 - DNA, 21 bp, Homo sapiens
aactcttcaatctcttgcact

SEQ ID NO: 4050695 - DNA, 18 bp, Homo sapiens
aactcttcacaaaatctg

SEQ ID NO: 4050696 - DNA, 11 bp, Homo sapiens
aactcttgatt

SEQ ID NO: 4050697 - DNA, 13 bp, Homo sapiens
aactctttgctgc

SEQ ID NO: 4050698 - DNA, 23 bp, Homo sapiens
aactctttgctgctgcccatgtt

SEQ ID NO: 4050699 - DNA, 15 bp, Homo sapiens
aactctttgttattt

SEQ ID NO: 4050700 - DNA, 13 bp, Homo sapiens
aactgaagacaat

SEQ ID NO: 4050701 - DNA, 11 bp, Homo sapiens
aactgaagcat

SEQ ID NO: 4050702 - DNA, 15 bp, Homo sapiens
aactgaatattttgg

SEQ ID NO: 4050703 - DNA, 19 bp, Homo sapiens
aactgaatattttggaaac

SEQ ID NO: 4050704 - DNA, 15 bp, Homo sapiens
aactgactatcataa

SEQ ID NO: 4050705 - DNA, 22 bp, Homo sapiens
aactgactatcataaaatcaaa

SEQ ID NO: 4050706 - DNA, 13 bp, Homo sapiens
aactgactttatc

SEQ ID NO: 4050707 - DNA, 19 bp, Homo sapiens
aactgaggcttagagatag

SEQ ID NO: 4050708 - DNA, 18 bp, Homo sapiens
aactgatttcttcagaat

SEQ ID NO: 4050709 - DNA, 15 bp, Homo sapiens
aactgcaaacagaaa

SEQ ID NO: 4050710 - DNA, 18 bp, Homo sapiens
aactgcaatagagactgt

SEQ ID NO: 4050711 - DNA, 18 bp, Homo sapiens
aactgcaggagcagtttg

SEQ ID NO: 4050712 - DNA, 14 bp, Homo sapiens
aactgcattagaaa

SEQ ID NO: 4050713 - DNA, 22 bp, Homo sapiens
aactgcattgactttcagtaaa

SEQ ID NO: 4050714 - DNA, 18 bp, Homo sapiens
aactgccaggctgcctcc

SEQ ID NO: 4050715 - DNA, 14 bp, Homo sapiens
aactgcccccactg

SEQ ID NO: 4050716 - DNA, 15 bp, Homo sapiens
aactgcctctttcct

SEQ ID NO: 4050717 - DNA, 15 bp, Homo sapiens
aactgctaaattcta

SEQ ID NO: 4050718 - DNA, 15 bp, Homo sapiens
aactggaataagaag

SEQ ID NO: 4050719 - DNA, 14 bp, Homo sapiens
aactggagtctgga

SEQ ID NO: 4050720 - DNA, 20 bp, Homo sapiens
aactggagtctggagtgggc

SEQ ID NO: 4050721 - DNA, 14 bp, Homo sapiens
aactggattaaaac

SEQ ID NO: 4050722 - DNA, 22 bp, Homo sapiens
aactggccctatttagatgata

SEQ ID NO: 4050723 - DNA, 18 bp, Homo sapiens
aactggggctttgccttg

SEQ ID NO: 4050724 - DNA, 22 bp, Homo sapiens
aactggtattctgttctggagg

SEQ ID NO: 4050725 - DNA, 18 bp, Homo sapiens
aactgtacagaatttcca

SEQ ID NO: 4050726 - DNA, 16 bp, Homo sapiens
aactgtagaaatgatg

SEQ ID NO: 4050727 - DNA, 19 bp, Homo sapiens
aactgtagaaatgatgatg

SEQ ID NO: 4050728 - DNA, 22 bp, Homo sapiens
aactgtagtgtagtcaggtgct

SEQ ID NO: 4050729 - DNA, 16 bp, Homo sapiens
aactgtccagagagca

SEQ ID NO: 4050730 - DNA, 11 bp, Homo sapiens
aactgtcctgt

SEQ ID NO: 4050731 - DNA, 13 bp, Homo sapiens
aactgtcctgtcc

SEQ ID NO: 4050732 - DNA, 17 bp, Homo sapiens
aactgtgaagtttacat

SEQ ID NO: 4050733 - DNA, 15 bp, Homo sapiens
aactgtgccacaatg

SEQ ID NO: 4050734 - DNA, 15 bp, Homo sapiens
aactgtgtatgtaca

SEQ ID NO: 4050735 - DNA, 19 bp, Homo sapiens
aactgttaaatgtggtttc

SEQ ID NO: 4050736 - DNA, 21 bp, Homo sapiens
aactgttctctattagacttt

SEQ ID NO: 4050737 - DNA, 13 bp, Homo sapiens
aactgttttttaa

SEQ ID NO: 4050738 - DNA, 14 bp, Homo sapiens
aacttaaaatattt

SEQ ID NO: 4050739 - DNA, 21 bp, Homo sapiens
aacttaacattctgtaaaatg

SEQ ID NO: 4050740 - DNA, 18 bp, Homo sapiens
aacttaatagtatttatg

SEQ ID NO: 4050741 - DNA, 23 bp, Homo sapiens
aacttaatgttcttatgcaaaat

SEQ ID NO: 4050742 - DNA, 19 bp, Homo sapiens
aacttacattgttcaatta

SEQ ID NO: 4050743 - DNA, 15 bp, Homo sapiens
aacttactgattatt

SEQ ID NO: 4050744 - DNA, 14 bp, Homo sapiens
aacttagaggaaaa

SEQ ID NO: 4050745 - DNA, 16 bp, Homo sapiens
aacttagcatgtgttg

SEQ ID NO: 4050746 - DNA, 19 bp, Homo sapiens
aacttatattgaagacaat

SEQ ID NO: 4050747 - DNA, 12 bp, Homo sapiens
aacttatgtttt

SEQ ID NO: 4050748 - DNA, 13 bp, Homo sapiens
aacttattatttt

SEQ ID NO: 4050749 - DNA, 17 bp, Homo sapiens
aacttattttatttcca

SEQ ID NO: 4050750 - DNA, 11 bp, Homo sapiens
aacttcagcag

SEQ ID NO: 4050751 - DNA, 18 bp, Homo sapiens
aacttcagcagtacctat

SEQ ID NO: 4050752 - DNA, 21 bp, Homo sapiens
aacttcagttttatttttgcc

SEQ ID NO: 4050753 - DNA, 20 bp, Homo sapiens
aacttcatgtcaacttctgg

SEQ ID NO: 4050754 - DNA, 12 bp, Homo sapiens
aacttcatttga

SEQ ID NO: 4050755 - DNA, 17 bp, Homo sapiens
aacttccccatcttcta

SEQ ID NO: 4050756 - DNA, 11 bp, Homo sapiens
aacttcctgct

SEQ ID NO: 4050757 - DNA, 13 bp, Homo sapiens
aacttcctgctgc

SEQ ID NO: 4050758 - DNA, 14 bp, Homo sapiens
aacttcctgctgca

SEQ ID NO: 4050759 - DNA, 18 bp, Homo sapiens
aacttctatattttaata

SEQ ID NO: 4050760 - DNA, 22 bp, Homo sapiens
aacttctatattttaatagaaa

SEQ ID NO: 4050761 - DNA, 22 bp, Homo sapiens
aacttgaaaatatatgatggct

SEQ ID NO: 4050762 - DNA, 14 bp, Homo sapiens
aacttgaagcagtc

SEQ ID NO: 4050763 - DNA, 20 bp, Homo sapiens
aacttgacatgtagcttctt

SEQ ID NO: 4050764 - DNA, 19 bp, Homo sapiens
aacttgagggcccagagca

SEQ ID NO: 4050765 - DNA, 23 bp, Homo sapiens
aacttgatttgcatggattttgg

SEQ ID NO: 4050766 - DNA, 22 bp, Homo sapiens
aacttgcctggggtctgagcat

SEQ ID NO: 4050767 - DNA, 15 bp, Homo sapiens
aacttgcttaaattt

SEQ ID NO: 4050768 - DNA, 19 bp, Homo sapiens
aacttgcttaaatttctta

SEQ ID NO: 4050769 - DNA, 13 bp, Homo sapiens
aacttggattctc

SEQ ID NO: 4050770 - DNA, 21 bp, Homo sapiens
aacttggggagttaagacctg

SEQ ID NO: 4050771 - DNA, 22 bp, Homo sapiens
aacttgggttcttctcagcggg

SEQ ID NO: 4050772 - DNA, 18 bp, Homo sapiens
aacttgtaaatgctgtca

SEQ ID NO: 4050773 - DNA, 20 bp, Homo sapiens
aacttgtaatttttttaatt

SEQ ID NO: 4050774 - DNA, 17 bp, Homo sapiens
aacttgtattaaagaca

SEQ ID NO: 4050775 - DNA, 17 bp, Homo sapiens
aactttaaaaaatattt

SEQ ID NO: 4050776 - DNA, 19 bp, Homo sapiens
aactttaaaaaatatttat

SEQ ID NO: 4050777 - DNA, 19 bp, Homo sapiens
aactttaatgttttttgcc

SEQ ID NO: 4050778 - DNA, 17 bp, Homo sapiens
aactttacctatggaag

SEQ ID NO: 4050779 - DNA, 13 bp, Homo sapiens
aactttatacatt

SEQ ID NO: 4050780 - DNA, 16 bp, Homo sapiens
aactttatacattagt

SEQ ID NO: 4050781 - DNA, 12 bp, Homo sapiens
aactttcacttt

SEQ ID NO: 4050782 - DNA, 16 bp, Homo sapiens
aactttcactttgaaa

SEQ ID NO: 4050783 - DNA, 14 bp, Homo sapiens
aactttctgctttg

SEQ ID NO: 4050784 - DNA, 16 bp, Homo sapiens
aactttgccaaaaaaa

SEQ ID NO: 4050785 - DNA, 18 bp, Homo sapiens
aactttggagtcccctca

SEQ ID NO: 4050786 - DNA, 15 bp, Homo sapiens
aactttggcctttgt

SEQ ID NO: 4050787 - DNA, 17 bp, Homo sapiens
aacttttcaatgacatt

SEQ ID NO: 4050788 - DNA, 17 bp, Homo sapiens
aacttttgtactgaatt

SEQ ID NO: 4050789 - DNA, 18 bp, Homo sapiens
aacttttgtactgaattt

SEQ ID NO: 4050790 - DNA, 19 bp, Homo sapiens
aacttttgtactgaatttt

SEQ ID NO: 4050791 - DNA, 20 bp, Homo sapiens
aacttttgtactgaattttt

SEQ ID NO: 4050792 - DNA, 20 bp, Homo sapiens
aacttttgtgtaatgaaaat

SEQ ID NO: 4050793 - DNA, 18 bp, Homo sapiens
aacttttttatatctttt

SEQ ID NO: 4050794 - DNA, 19 bp, Homo sapiens
aagaaaaaaaaagaattac

SEQ ID NO: 4050795 - DNA, 16 bp, Homo sapiens
aagccagctgccctat

SEQ ID NO: 4050796 - DNA, 22 bp, Homo sapiens
aagccagctgccctatgggcct

SEQ ID NO: 4050797 - DNA, 23 bp, Homo sapiens
aagccaggaatttcccaggaccc

SEQ ID NO: 4050798 - DNA, 12 bp, Homo sapiens
aagccagggtct

SEQ ID NO: 4050799 - DNA, 19 bp, Homo sapiens
aagccagggtctctccctc

SEQ ID NO: 4050800 - DNA, 17 bp, Homo sapiens
aagccaggtgagctctg

SEQ ID NO: 4050801 - DNA, 18 bp, Homo sapiens
aagccaggtgagctctga

SEQ ID NO: 4050802 - DNA, 20 bp, Homo sapiens
aagccagtgaaatgtgaagg

SEQ ID NO: 4050803 - DNA, 23 bp, Homo sapiens
aagccagtttgggtaaaatactt

SEQ ID NO: 4050804 - DNA, 16 bp, Homo sapiens
aagccagttttcattt

SEQ ID NO: 4050805 - DNA, 14 bp, Homo sapiens
aagccataggccca

SEQ ID NO: 4050806 - DNA, 23 bp, Homo sapiens
aagccatatatgaccagaagcct

SEQ ID NO: 4050807 - DNA, 20 bp, Homo sapiens
aagccatgtataaatgtgat

SEQ ID NO: 4050808 - DNA, 15 bp, Homo sapiens
aagcccaccaggtgt

SEQ ID NO: 4050809 - DNA, 16 bp, Homo sapiens
aagcccccagctaaga

SEQ ID NO: 4050810 - DNA, 13 bp, Homo sapiens
aagccctggagac

SEQ ID NO: 4050811 - DNA, 15 bp, Homo sapiens
aagccgaccttccct

SEQ ID NO: 4050812 - DNA, 19 bp, Homo sapiens
aagccgactctggccctgg

SEQ ID NO: 4050813 - DNA, 21 bp, Homo sapiens
aagccgactctggccctggcc

SEQ ID NO: 4050814 - DNA, 17 bp, Homo sapiens
aagccgagagccttttg

SEQ ID NO: 4050815 - DNA, 22 bp, Homo sapiens
aagccggggtgtaacttcctgc

SEQ ID NO: 4050816 - DNA, 16 bp, Homo sapiens
aagcctacctgctctc

SEQ ID NO: 4050817 - DNA, 14 bp, Homo sapiens
aagcctcatattta

SEQ ID NO: 4050818 - DNA, 16 bp, Homo sapiens
aagcctcatgccaacc

SEQ ID NO: 4050819 - DNA, 12 bp, Homo sapiens
aagcctctggct

SEQ ID NO: 4050820 - DNA, 15 bp, Homo sapiens
aagcctgcctcccaa

SEQ ID NO: 4050821 - DNA, 16 bp, Homo sapiens
aagcctggactctgcc

SEQ ID NO: 4050822 - DNA, 17 bp, Homo sapiens
aagcctggactctgccc

SEQ ID NO: 4050823 - DNA, 19 bp, Homo sapiens
aagcctggtttttctcaat

SEQ ID NO: 4050824 - DNA, 12 bp, Homo sapiens
aagcctgtgcct

SEQ ID NO: 4050825 - DNA, 18 bp, Homo sapiens
aagcctgtgcctcccagc

SEQ ID NO: 4050826 - DNA, 17 bp, Homo sapiens
aagccttaagctgcagg

SEQ ID NO: 4050827 - DNA, 19 bp, Homo sapiens
aagccttgtgtatatttgt

SEQ ID NO: 4050828 - DNA, 14 bp, Homo sapiens
aagcctttccataa

SEQ ID NO: 4050829 - DNA, 16 bp, Homo sapiens
aagcgatatacagatg

SEQ ID NO: 4050830 - DNA, 21 bp, Homo sapiens
aagcggagttcctaacaggat

SEQ ID NO: 4050831 - DNA, 14 bp, Homo sapiens
aagctaaatcatat

SEQ ID NO: 4050832 - DNA, 14 bp, Homo sapiens
aagctaatttgcat

SEQ ID NO: 4050833 - DNA, 22 bp, Homo sapiens
aagctaatttgcattaaattca

SEQ ID NO: 4050834 - DNA, 19 bp, Homo sapiens
aagctactgtgtgtgtgaa

SEQ ID NO: 4050835 - DNA, 23 bp, Homo sapiens
aagctactgtgtgtgtgaatgaa

SEQ ID NO: 4050836 - DNA, 19 bp, Homo sapiens
aagctagtggcttcaaaat

SEQ ID NO: 4050837 - DNA, 13 bp, Homo sapiens
aagctagtgtttc

SEQ ID NO: 4050838 - DNA, 14 bp, Homo sapiens
aagctatctaaagt

SEQ ID NO: 4050839 - DNA, 19 bp, Homo sapiens
aagctattagccaggatca

SEQ ID NO: 4050840 - DNA, 14 bp, Homo sapiens
tatgacttaaaatt

SEQ ID NO: 4050841 - DNA, 23 bp, Homo sapiens
tatgacttaaaattggaaatgtc

SEQ ID NO: 4050842 - DNA, 16 bp, Homo sapiens
tatgagccagacaaat

SEQ ID NO: 4050843 - DNA, 18 bp, Homo sapiens
tatgagcttccttctgtg

SEQ ID NO: 4050844 - DNA, 13 bp, Homo sapiens
tatgaggaaaggt

SEQ ID NO: 4050845 - DNA, 16 bp, Homo sapiens
tatgagtcaatgtgca

SEQ ID NO: 4050846 - DNA, 23 bp, Homo sapiens
tatgagtttttgatagctttatt

SEQ ID NO: 4050847 - DNA, 15 bp, Homo sapiens
tatgatattgtttaa

SEQ ID NO: 4050848 - DNA, 16 bp, Homo sapiens
tatgatattgtttaaa

SEQ ID NO: 4050849 - DNA, 14 bp, Homo sapiens
tatgatcagtgttg

SEQ ID NO: 4050850 - DNA, 22 bp, Homo sapiens
tatgatcttgagtataagaaat

SEQ ID NO: 4050851 - DNA, 14 bp, Homo sapiens
tatgatttaataaa

SEQ ID NO: 4050852 - DNA, 18 bp, Homo sapiens
tatgatttaataaaataa

SEQ ID NO: 4050853 - DNA, 19 bp, Homo sapiens
tatgatttataaacagaca

SEQ ID NO: 4050854 - DNA, 20 bp, Homo sapiens
tatgatttataaacagacaa

SEQ ID NO: 4050855 - DNA, 20 bp, Homo sapiens
tatgcaaggaaggaaagaaa

SEQ ID NO: 4050856 - DNA, 21 bp, Homo sapiens
tatgcaaggtatttctccagt

SEQ ID NO: 4050857 - DNA, 17 bp, Homo sapiens
tatgcaatggattttca

SEQ ID NO: 4050858 - DNA, 20 bp, Homo sapiens
tatgcatggtgccccaggac

SEQ ID NO: 4050859 - DNA, 15 bp, Homo sapiens
tatgccacttccttt

SEQ ID NO: 4050860 - DNA, 14 bp, Homo sapiens
tatgccagctcagt

SEQ ID NO: 4050861 - DNA, 13 bp, Homo sapiens
tatgccatagaaa

SEQ ID NO: 4050862 - DNA, 14 bp, Homo sapiens
tatgccatgatgga

SEQ ID NO: 4050863 - DNA, 20 bp, Homo sapiens
tatgccgaatgccctcaggg

SEQ ID NO: 4050864 - DNA, 19 bp, Homo sapiens
tatgccttcttattgcttt

SEQ ID NO: 4050865 - DNA, 15 bp, Homo sapiens
tatgctgatcatcgc

SEQ ID NO: 4050866 - DNA, 13 bp, Homo sapiens
tatgctggccagc

SEQ ID NO: 4050867 - DNA, 16 bp, Homo sapiens
tatgctgtaaaagcaa

SEQ ID NO: 4050868 - DNA, 23 bp, Homo sapiens
tatggaaacactgattttgtaaa

SEQ ID NO: 4050869 - DNA, 13 bp, Homo sapiens
tatggaactctct

SEQ ID NO: 4050870 - DNA, 22 bp, Homo sapiens
tatggaagggtttgtggctggg

SEQ ID NO: 4050871 - DNA, 17 bp, Homo sapiens
tatggaatacagtgtta

SEQ ID NO: 4050872 - DNA, 24 bp, Homo sapiens
tatggaatacagtgttattttctt

SEQ ID NO: 4050873 - DNA, 22 bp, Homo sapiens
tatggaattacatgtaaaacat

SEQ ID NO: 4050874 - DNA, 19 bp, Homo sapiens
tatggaattgatttgcatt

SEQ ID NO: 4050875 - DNA, 22 bp, Homo sapiens
tatggagtgagtcacctgctcc

SEQ ID NO: 4050876 - DNA, 23 bp, Homo sapiens
tatggagtgagtcacctgctcca

SEQ ID NO: 4050877 - DNA, 21 bp, Homo sapiens
tatggatttaagagtatttta

SEQ ID NO: 4050878 - DNA, 14 bp, Homo sapiens
tatggcagaagaca

SEQ ID NO: 4050879 - DNA, 14 bp, Homo sapiens
tatggcccagcctt

SEQ ID NO: 4050880 - DNA, 15 bp, Homo sapiens
tatggcccagccttg

SEQ ID NO: 4050881 - DNA, 13 bp, Homo sapiens
tatggctgcccag

SEQ ID NO: 4050882 - DNA, 16 bp, Homo sapiens
tatgggagccccaggg

SEQ ID NO: 4050883 - DNA, 20 bp, Homo sapiens
tatgggatattcccaagccg

SEQ ID NO: 4050884 - DNA, 20 bp, Homo sapiens
tatgggggcatctcttcccc

SEQ ID NO: 4050885 - DNA, 22 bp, Homo sapiens
tatgggggcatctcttccccag

SEQ ID NO: 4050886 - DNA, 23 bp, Homo sapiens
tatgggggcatctcttccccaga

SEQ ID NO: 4050887 - DNA, 19 bp, Homo sapiens
tatgggtagggtaaatcag

SEQ ID NO: 4050888 - DNA, 18 bp, Homo sapiens
tatggtatgctggccagc

SEQ ID NO: 4050889 - DNA, 14 bp, Homo sapiens
tatggtatttgagt

SEQ ID NO: 4050890 - DNA, 19 bp, Homo sapiens
tatggttacttcttctctt

SEQ ID NO: 4050891 - DNA, 13 bp, Homo sapiens
tatggttatgaaa

SEQ ID NO: 4050892 - DNA, 14 bp, Homo sapiens
tatgtaaacataat

SEQ ID NO: 4050893 - DNA, 18 bp, Homo sapiens
tatgtaaacataattctt

SEQ ID NO: 4050894 - DNA, 19 bp, Homo sapiens
tatgtaaactgcattagaa

SEQ ID NO: 4050895 - DNA, 23 bp, Homo sapiens
tatgtaaactgcattagaaatta

SEQ ID NO: 4050896 - DNA, 16 bp, Homo sapiens
tatgtaagagcacctt

SEQ ID NO: 4050897 - DNA, 23 bp, Homo sapiens
tatgtaatgtgtggtggcctcag

SEQ ID NO: 4050898 - DNA, 17 bp, Homo sapiens
tatgtaatttatgcaag

SEQ ID NO: 4050899 - DNA, 21 bp, Homo sapiens
tatgtactcctctttacactg

SEQ ID NO: 4050900 - DNA, 19 bp, Homo sapiens
tatgtacttttattttttg

SEQ ID NO: 4050901 - DNA, 17 bp, Homo sapiens
tatgtagatgtgcattt

SEQ ID NO: 4050902 - DNA, 14 bp, Homo sapiens
tatgtagtaattga

SEQ ID NO: 4050903 - DNA, 17 bp, Homo sapiens
tatgtagtaattgacat

SEQ ID NO: 4050904 - DNA, 20 bp, Homo sapiens
tatgtagtaattgacatgtg

SEQ ID NO: 4050905 - DNA, 13 bp, Homo sapiens
tatgtataaacat

SEQ ID NO: 4050906 - DNA, 23 bp, Homo sapiens
tatgtatatttttttaatttaac

SEQ ID NO: 4050907 - DNA, 20 bp, Homo sapiens
tatgtatcagtgtcctttcc

SEQ ID NO: 4050908 - DNA, 15 bp, Homo sapiens
tatgtatcttagtta

SEQ ID NO: 4050909 - DNA, 12 bp, Homo sapiens
tatgtatgaagg

SEQ ID NO: 4050910 - DNA, 22 bp, Homo sapiens
tatgtatgggtagggtaaatca

SEQ ID NO: 4050911 - DNA, 23 bp, Homo sapiens
tatgtatgggtagggtaaatcag

SEQ ID NO: 4050912 - DNA, 15 bp, Homo sapiens
tatgtcactagaatg

SEQ ID NO: 4050913 - DNA, 16 bp, Homo sapiens
tatgtcgatgcacagt

SEQ ID NO: 4050914 - DNA, 12 bp, Homo sapiens
tatgtctattta

SEQ ID NO: 4050915 - DNA, 10 bp, Homo sapiens
tatgtctgtt

SEQ ID NO: 4050916 - DNA, 18 bp, Homo sapiens
tatgtgaaatgctttctg

SEQ ID NO: 4050917 - DNA, 22 bp, Homo sapiens
tatgtgaatgatctctctgaat

SEQ ID NO: 4050918 - DNA, 12 bp, Homo sapiens
tatgtgaatttt

SEQ ID NO: 4050919 - DNA, 20 bp, Homo sapiens
tatgtgacaccaaagccacc

SEQ ID NO: 4050920 - DNA, 18 bp, Homo sapiens
tatgtgacattttacatt

SEQ ID NO: 4050921 - DNA, 22 bp, Homo sapiens
tatgtgagagattctgtgatct

SEQ ID NO: 4050922 - DNA, 22 bp, Homo sapiens
tatgtgagattttttattgcta

SEQ ID NO: 4050923 - DNA, 13 bp, Homo sapiens
tatgtgattacaa

SEQ ID NO: 4050924 - DNA, 21 bp, Homo sapiens
tatgtgcactgtcactttgct

SEQ ID NO: 4050925 - DNA, 15 bp, Homo sapiens
tatgtgtgaggagct

SEQ ID NO: 4050926 - DNA, 21 bp, Homo sapiens
tatgtgtgaggagctgctggc

SEQ ID NO: 4050927 - DNA, 19 bp, Homo sapiens
tatgtgtgtgtatgtttgc

SEQ ID NO: 4050928 - DNA, 13 bp, Homo sapiens
tatgtgtttactt

SEQ ID NO: 4050929 - DNA, 15 bp, Homo sapiens
tatgttaaaagattt

SEQ ID NO: 4050930 - DNA, 14 bp, Homo sapiens
tatgttaaatactg

SEQ ID NO: 4050931 - DNA, 16 bp, Homo sapiens
tatgttaaatactgtg

SEQ ID NO: 4050932 - DNA, 18 bp, Homo sapiens
tatgttaaatactgtgca

SEQ ID NO: 4050933 - DNA, 19 bp, Homo sapiens
tatgttaaatactgtgcag

SEQ ID NO: 4050934 - DNA, 22 bp, Homo sapiens
tatgttaacctcagtgtcattt

SEQ ID NO: 4050935 - DNA, 17 bp, Homo sapiens
tatgttagattttgcat

SEQ ID NO: 4050936 - DNA, 14 bp, Homo sapiens
tatgttcatttgtt

SEQ ID NO: 4050937 - DNA, 13 bp, Homo sapiens
tatgttcttatag

SEQ ID NO: 4050938 - DNA, 19 bp, Homo sapiens
tatgttcttatagaataaa

SEQ ID NO: 4050939 - DNA, 18 bp, Homo sapiens
tatgttgaatacttttta

SEQ ID NO: 4050940 - DNA, 14 bp, Homo sapiens
tatgttgctcagtc

SEQ ID NO: 4050941 - DNA, 17 bp, Homo sapiens
tatgttgctcagtctcc

SEQ ID NO: 4050942 - DNA, 14 bp, Homo sapiens
tattttgtagatgt

SEQ ID NO: 4050943 - DNA, 19 bp, Homo sapiens
tattttgtgatgatgctgt

SEQ ID NO: 4050944 - DNA, 17 bp, Homo sapiens
tattttgtgctcattta

SEQ ID NO: 4050945 - DNA, 17 bp, Homo sapiens
tattttgtgtacaagtt

SEQ ID NO: 4050946 - DNA, 23 bp, Homo sapiens
tatttttaaaaaatgaaatcctt

SEQ ID NO: 4050947 - DNA, 21 bp, Homo sapiens
tatttttatatttcctttatg

SEQ ID NO: 4050948 - DNA, 17 bp, Homo sapiens
tatttttatcatgaatt

SEQ ID NO: 4050949 - DNA, 14 bp, Homo sapiens
tatttttcaaggaa

SEQ ID NO: 4050950 - DNA, 14 bp, Homo sapiens
tatttttctaaggt

SEQ ID NO: 4050951 - DNA, 13 bp, Homo sapiens
tatttttctgtga

SEQ ID NO: 4050952 - DNA, 13 bp, Homo sapiens
tatttttgtaatg

SEQ ID NO: 4050953 - DNA, 16 bp, Homo sapiens
tatttttgtaatgtga

SEQ ID NO: 4050954 - DNA, 20 bp, Homo sapiens
tatttttgtaattttaaata

SEQ ID NO: 4050955 - DNA, 14 bp, Homo sapiens
tatttttgtagtga

SEQ ID NO: 4050956 - DNA, 15 bp, Homo sapiens
tatttttgtgtttct

SEQ ID NO: 4050957 - DNA, 16 bp, Homo sapiens
tatttttgtgtttcta

SEQ ID NO: 4050958 - DNA, 20 bp, Homo sapiens
tatttttgtttcttccaaag

SEQ ID NO: 4050959 - DNA, 14 bp, Homo sapiens
tattttttaaaata

SEQ ID NO: 4050960 - DNA, 21 bp, Homo sapiens
tattttttaagtatttatata

SEQ ID NO: 4050961 - DNA, 11 bp, Homo sapiens
tattttttcaa

SEQ ID NO: 4050962 - DNA, 14 bp, Homo sapiens
tattttttcttttg

SEQ ID NO: 4050963 - DNA, 21 bp, Homo sapiens
tattttttcttttgtaattgt

SEQ ID NO: 4050964 - DNA, 18 bp, Homo sapiens
tatttttttaaagtgatt

SEQ ID NO: 4050965 - DNA, 14 bp, Homo sapiens
tatttttttctacc

SEQ ID NO: 4050966 - DNA, 15 bp, Homo sapiens
tatttttttctacct

SEQ ID NO: 4050967 - DNA, 23 bp, Homo sapiens
tatttttttctaccttgaggtct

SEQ ID NO: 4050968 - DNA, 15 bp, Homo sapiens
tatttttttctctat

SEQ ID NO: 4050969 - DNA, 19 bp, Homo sapiens
tcaaaaaaaaaaaaatgca

SEQ ID NO: 4050970 - DNA, 20 bp, Homo sapiens
tcaaaaaaaaaaaaatgcac

SEQ ID NO: 4050971 - DNA, 14 bp, Homo sapiens
tcaaaaaaacaaaa

SEQ ID NO: 4050972 - DNA, 19 bp, Homo sapiens
tcaaaaaaagactcagcca

SEQ ID NO: 4050973 - DNA, 17 bp, Homo sapiens
tcaaaaaataattagtt

SEQ ID NO: 4050974 - DNA, 13 bp, Homo sapiens
tcaaaaaatgagc

SEQ ID NO: 4050975 - DNA, 13 bp, Homo sapiens
tcaaaaactattt

SEQ ID NO: 4050976 - DNA, 22 bp, Homo sapiens
tcaaaaagagagattctccatt

SEQ ID NO: 4050977 - DNA, 21 bp, Homo sapiens
tcaaaaattgaagagagatat

SEQ ID NO: 4050978 - DNA, 20 bp, Homo sapiens
tcaaaacctttcaaatatca

SEQ ID NO: 4050979 - DNA, 17 bp, Homo sapiens
tcaaaacttggtatttt

SEQ ID NO: 4050980 - DNA, 18 bp, Homo sapiens
tcaaaagcaaatgagatc

SEQ ID NO: 4050981 - DNA, 17 bp, Homo sapiens
tcaaaataaagaagtat

SEQ ID NO: 4050982 - DNA, 18 bp, Homo sapiens
tcaaaatccttccaaaga

SEQ ID NO: 4050983 - DNA, 19 bp, Homo sapiens
tcaaaatccttccaaagaa

SEQ ID NO: 4050984 - DNA, 19 bp, Homo sapiens
tcaaaatgctttttatttc

SEQ ID NO: 4050985 - DNA, 14 bp, Homo sapiens
tcaaaatgtctgta

SEQ ID NO: 4050986 - DNA, 15 bp, Homo sapiens
tcaaacaacactggt

SEQ ID NO: 4050987 - DNA, 20 bp, Homo sapiens
tcaaacctgtagatgcagaa

SEQ ID NO: 4050988 - DNA, 21 bp, Homo sapiens
tcaaactaaaagacatttgtt

SEQ ID NO: 4050989 - DNA, 20 bp, Homo sapiens
tcaaactcctgacctcaggt

SEQ ID NO: 4050990 - DNA, 22 bp, Homo sapiens
tcaaactggggcctccagaact

SEQ ID NO: 4050991 - DNA, 20 bp, Homo sapiens
tcaaactgtagaaatgatga

SEQ ID NO: 4050992 - DNA, 15 bp, Homo sapiens
tcaaacttactattt

SEQ ID NO: 4050993 - DNA, 14 bp, Homo sapiens
tcaaacttccagtc

SEQ ID NO: 4050994 - DNA, 12 bp, Homo sapiens
tcaaacttggat

SEQ ID NO: 4050995 - DNA, 16 bp, Homo sapiens
tcaaacttgtggcctc

SEQ ID NO: 4050996 - DNA, 16 bp, Homo sapiens
tcaaactttcactttg

SEQ ID NO: 4050997 - DNA, 22 bp, Homo sapiens
tcaaagaaagaaagtttagaag

SEQ ID NO: 4050998 - DNA, 15 bp, Homo sapiens
tcaaagaacaaacat

SEQ ID NO: 4050999 - DNA, 14 bp, Homo sapiens
tcaaagaaggcatt

SEQ ID NO: 4051000 - DNA, 16 bp, Homo sapiens
tcaaagacagaatggt

SEQ ID NO: 4051001 - DNA, 15 bp, Homo sapiens
tcaaagagagaaaat

SEQ ID NO: 4051002 - DNA, 14 bp, Homo sapiens
tcaaagcatagatg

SEQ ID NO: 4051003 - DNA, 15 bp, Homo sapiens
tcaaagccacattat

SEQ ID NO: 4051004 - DNA, 19 bp, Homo sapiens
tcaaagctcacaccaaatt

SEQ ID NO: 4051005 - DNA, 20 bp, Homo sapiens
tcaaagcttgaagatcgtta

SEQ ID NO: 4051006 - DNA, 17 bp, Homo sapiens
tcaaaggtgatgtaatt

SEQ ID NO: 4051007 - DNA, 21 bp, Homo sapiens
tcaaagtagttttattttaat

SEQ ID NO: 4051008 - DNA, 22 bp, Homo sapiens
tcaaagtgagaaaatgcctcaa

SEQ ID NO: 4051009 - DNA, 19 bp, Homo sapiens
tcaaagtgttgtgttcctg

SEQ ID NO: 4051010 - DNA, 18 bp, Homo sapiens
tcaaagttaattcaccta

SEQ ID NO: 4051011 - DNA, 19 bp, Homo sapiens
tcaaagttaattcacctat

SEQ ID NO: 4051012 - DNA, 13 bp, Homo sapiens
tcaaagttttgaa

SEQ ID NO: 4051013 - DNA, 17 bp, Homo sapiens
tcaaataagtatttata

SEQ ID NO: 4051014 - DNA, 13 bp, Homo sapiens
tcaaatacaaagt

SEQ ID NO: 4051015 - DNA, 17 bp, Homo sapiens
tcaaatacaaagtaaat

SEQ ID NO: 4051016 - DNA, 20 bp, Homo sapiens
tcaaatcaatctgtaaaact

SEQ ID NO: 4051017 - DNA, 16 bp, Homo sapiens
tcaaatccttccaaaa

SEQ ID NO: 4051018 - DNA, 16 bp, Homo sapiens
tcaaatctattcagac

SEQ ID NO: 4051019 - DNA, 23 bp, Homo sapiens
tcaaatctggtccatatttacat

SEQ ID NO: 4051020 - DNA, 16 bp, Homo sapiens
tcaaatgagtaacatt

SEQ ID NO: 4051021 - DNA, 19 bp, Homo sapiens
tcaaatgctagaagctgtc

SEQ ID NO: 4051022 - DNA, 20 bp, Homo sapiens
tcaaatggggccagatccag

SEQ ID NO: 4051023 - DNA, 17 bp, Homo sapiens
tcaaattaataatctta

SEQ ID NO: 4051024 - DNA, 22 bp, Homo sapiens
tcaaattaataatcttattagg

SEQ ID NO: 4051025 - DNA, 13 bp, Homo sapiens
tcaaattgtatct

SEQ ID NO: 4051026 - DNA, 23 bp, Homo sapiens
tcaaatttattttaatgtaaaga

SEQ ID NO: 4051027 - DNA, 22 bp, Homo sapiens
tcaacaaatattcactggcccc

SEQ ID NO: 4051028 - DNA, 23 bp, Homo sapiens
tcaacacttaagggttttagaaa

SEQ ID NO: 4051029 - DNA, 20 bp, Homo sapiens
tcaacagaacatatgttgca

SEQ ID NO: 4051030 - DNA, 17 bp, Homo sapiens
tcaacagccaagtgtga

SEQ ID NO: 4051031 - DNA, 16 bp, Homo sapiens
tcaacaggcccaggga

SEQ ID NO: 4051032 - DNA, 20 bp, Homo sapiens
tcaacaggcccagggaggga

SEQ ID NO: 4051033 - DNA, 17 bp, Homo sapiens
tcaacatcaatgttcat

SEQ ID NO: 4051034 - DNA, 18 bp, Homo sapiens
tcaacatcaatgttcatt

SEQ ID NO: 4051035 - DNA, 21 bp, Homo sapiens
tcaacatcaatgttcattgta

SEQ ID NO: 4051036 - DNA, 23 bp, Homo sapiens
tcaacatcaatgttcattgtaat

SEQ ID NO: 4051037 - DNA, 15 bp, Homo sapiens
tcaacatcctgccag

SEQ ID NO: 4051038 - DNA, 22 bp, Homo sapiens
tcaacatgttactgaccagcaa

SEQ ID NO: 4051039 - DNA, 23 bp, Homo sapiens
tcaaccactgtggcgttctgctg

SEQ ID NO: 4051040 - DNA, 15 bp, Homo sapiens
tcaaccattccccat

SEQ ID NO: 4051041 - DNA, 20 bp, Homo sapiens
tcaaccccaccatatgaatt

SEQ ID NO: 4051042 - DNA, 19 bp, Homo sapiens
tcaaccctcaggggaaaac

SEQ ID NO: 4051043 - DNA, 18 bp, Homo sapiens
tcaacctcttctggctca

SEQ ID NO: 4051044 - DNA, 16 bp, Homo sapiens
tcagaattatttttaa

SEQ ID NO: 4051045 - DNA, 14 bp, Homo sapiens
tcagaatttagtgt

SEQ ID NO: 4051046 - DNA, 15 bp, Homo sapiens
tcagacaccctcaac

SEQ ID NO: 4051047 - DNA, 22 bp, Homo sapiens
tcagacaccctcaacctcttct

SEQ ID NO: 4051048 - DNA, 23 bp, Homo sapiens
tcagacaccctcaacctcttctg

SEQ ID NO: 4051049 - DNA, 19 bp, Homo sapiens
tcagacacctgttcacaga

SEQ ID NO: 4051050 - DNA, 22 bp, Homo sapiens
tcagacacctgttcacagaaaa

SEQ ID NO: 4051051 - DNA, 16 bp, Homo sapiens
tcagacactaccccat

SEQ ID NO: 4051052 - DNA, 16 bp, Homo sapiens
tcagacagaacttgaa

SEQ ID NO: 4051053 - DNA, 15 bp, Homo sapiens
tcagacatgttttcc

SEQ ID NO: 4051054 - DNA, 20 bp, Homo sapiens
tcagacatgttttccgtgaa

SEQ ID NO: 4051055 - DNA, 15 bp, Homo sapiens
tcagaccataatgtt

SEQ ID NO: 4051056 - DNA, 23 bp, Homo sapiens
tcagaccataatgttacattatt

SEQ ID NO: 4051057 - DNA, 16 bp, Homo sapiens
tcagacccctgcctgg

SEQ ID NO: 4051058 - DNA, 20 bp, Homo sapiens
tcagacctgtcttccaagga

SEQ ID NO: 4051059 - DNA, 22 bp, Homo sapiens
tcagacctgtcttccaaggaga

SEQ ID NO: 4051060 - DNA, 19 bp, Homo sapiens
tcagacggcggccaggcac

SEQ ID NO: 4051061 - DNA, 20 bp, Homo sapiens
tcagacggcggccaggcaca

SEQ ID NO: 4051062 - DNA, 19 bp, Homo sapiens
tcagactaagaaatattcc

SEQ ID NO: 4051063 - DNA, 14 bp, Homo sapiens
tcagactagtgaca

SEQ ID NO: 4051064 - DNA, 21 bp, Homo sapiens
tcagactcccattcctgaaga

SEQ ID NO: 4051065 - DNA, 15 bp, Homo sapiens
tcagagacagctgat

SEQ ID NO: 4051066 - DNA, 15 bp, Homo sapiens
tcagagactgcaagc

SEQ ID NO: 4051067 - DNA, 13 bp, Homo sapiens
tcagagagctggt

SEQ ID NO: 4051068 - DNA, 16 bp, Homo sapiens
tcagagagctggtagt

SEQ ID NO: 4051069 - DNA, 21 bp, Homo sapiens
tcagagatcgtgtattgagat

SEQ ID NO: 4051070 - DNA, 17 bp, Homo sapiens
tcagagatgtgcaccca

SEQ ID NO: 4051071 - DNA, 16 bp, Homo sapiens
tcagagcatctggctg

SEQ ID NO: 4051072 - DNA, 14 bp, Homo sapiens
tcagagccaagcct

SEQ ID NO: 4051073 - DNA, 12 bp, Homo sapiens
tcagagccaagt

SEQ ID NO: 4051074 - DNA, 20 bp, Homo sapiens
tcagagcccctacagcattg

SEQ ID NO: 4051075 - DNA, 11 bp, Homo sapiens
tcagagccctg

SEQ ID NO: 4051076 - DNA, 12 bp, Homo sapiens
tcagagccctgc

SEQ ID NO: 4051077 - DNA, 16 bp, Homo sapiens
tcagagccctggctgg

SEQ ID NO: 4051078 - DNA, 18 bp, Homo sapiens
tcagagccctggctgggt

SEQ ID NO: 4051079 - DNA, 18 bp, Homo sapiens
tcagagctaaactccttc

SEQ ID NO: 4051080 - DNA, 20 bp, Homo sapiens
tcagagctatggtgcttgct

SEQ ID NO: 4051081 - DNA, 22 bp, Homo sapiens
tcagaggagctctaccctgctc

SEQ ID NO: 4051082 - DNA, 14 bp, Homo sapiens
tcagaggtgtacac

SEQ ID NO: 4051083 - DNA, 15 bp, Homo sapiens
tcagaggtgtacact

SEQ ID NO: 4051084 - DNA, 18 bp, Homo sapiens
tcagagtacgtcctgcct

SEQ ID NO: 4051085 - DNA, 23 bp, Homo sapiens
tcagagtacgtcctgcctggcac

SEQ ID NO: 4051086 - DNA, 12 bp, Homo sapiens
tcagagtccagt

SEQ ID NO: 4051087 - DNA, 13 bp, Homo sapiens
tcagagtccagtg

SEQ ID NO: 4051088 - DNA, 22 bp, Homo sapiens
tcagagtccagtgctctgcctc

SEQ ID NO: 4051089 - DNA, 12 bp, Homo sapiens
tcagatacatca

SEQ ID NO: 4051090 - DNA, 15 bp, Homo sapiens
tcagatacatcactg

SEQ ID NO: 4051091 - DNA, 17 bp, Homo sapiens
tcagatacatcactgct

SEQ ID NO: 4051092 - DNA, 21 bp, Homo sapiens
tcagatacatcactgcttgat

SEQ ID NO: 4051093 - DNA, 23 bp, Homo sapiens
tcagatatatttttcacagtttt

SEQ ID NO: 4051094 - DNA, 19 bp, Homo sapiens
tcagatcactgaatttata

SEQ ID NO: 4051095 - DNA, 14 bp, Homo sapiens
tcagatccagggac

SEQ ID NO: 4051096 - DNA, 16 bp, Homo sapiens
tcagatctttctcctt

SEQ ID NO: 4051097 - DNA, 13 bp, Homo sapiens
tcagatgcttctg

SEQ ID NO: 4051098 - DNA, 18 bp, Homo sapiens
tcagatgggaagacatga

SEQ ID NO: 4051099 - DNA, 22 bp, Homo sapiens
tcagattagatgtgccaataac

SEQ ID NO: 4051100 - DNA, 16 bp, Homo sapiens
tcagattgtcttgcaa

SEQ ID NO: 4051101 - DNA, 12 bp, Homo sapiens
tcagatttctgg

SEQ ID NO: 4051102 - DNA, 13 bp, Homo sapiens
tcagatttctggt

SEQ ID NO: 4051103 - DNA, 13 bp, Homo sapiens
tcagcacaaggcc

SEQ ID NO: 4051104 - DNA, 13 bp, Homo sapiens
tcagcacagcctg

SEQ ID NO: 4051105 - DNA, 12 bp, Homo sapiens
tcagcaccaccc

SEQ ID NO: 4051106 - DNA, 13 bp, Homo sapiens
tcagcaccaccct

SEQ ID NO: 4051107 - DNA, 12 bp, Homo sapiens
tcagcaccccca

SEQ ID NO: 4051108 - DNA, 14 bp, Homo sapiens
tcagcacccccacc

SEQ ID NO: 4051109 - DNA, 18 bp, Homo sapiens
tcagcacccccacccacc

SEQ ID NO: 4051110 - DNA, 13 bp, Homo sapiens
tcagcactgtccc

SEQ ID NO: 4051111 - DNA, 14 bp, Homo sapiens
tcagcactgtccct

SEQ ID NO: 4051112 - DNA, 23 bp, Homo sapiens
tcagcactttgggaggctgaggc

SEQ ID NO: 4051113 - DNA, 13 bp, Homo sapiens
tcagcagacacac

SEQ ID NO: 4051114 - DNA, 17 bp, Homo sapiens
tcagcagacacacatgg

SEQ ID NO: 4051115 - DNA, 21 bp, Homo sapiens
tcagcagagaaggtaaggtgt

SEQ ID NO: 4051116 - DNA, 21 bp, Homo sapiens
tcagcagccgccttaagctga

SEQ ID NO: 4051117 - DNA, 22 bp, Homo sapiens
tcagcatctggctgtctagaat

SEQ ID NO: 4051118 - DNA, 15 bp, Homo sapiens
tcagcatctgtgatg

SEQ ID NO: 4051119 - DNA, 22 bp, Homo sapiens
tcagcatgcttcccagagggag

SEQ ID NO: 4051120 - DNA, 21 bp, Homo sapiens
tcagccagaagccacccaaag

SEQ ID NO: 4051121 - DNA, 14 bp, Homo sapiens
tcagccagcacttg

SEQ ID NO: 4051122 - DNA, 15 bp, Homo sapiens
tcagccagccgccct

SEQ ID NO: 4051123 - DNA, 19 bp, Homo sapiens
tcagccagccgccctgggc

SEQ ID NO: 4051124 - DNA, 14 bp, Homo sapiens
tcagccagggccag

SEQ ID NO: 4051125 - DNA, 18 bp, Homo sapiens
tcagccatcaacaagagt

SEQ ID NO: 4051126 - DNA, 21 bp, Homo sapiens
tcagcccaatccctgatccct

SEQ ID NO: 4051127 - DNA, 16 bp, Homo sapiens
tcagcccccagcccct

SEQ ID NO: 4051128 - DNA, 18 bp, Homo sapiens
tcagcccccagcccctcc

SEQ ID NO: 4051129 - DNA, 19 bp, Homo sapiens
tcagcccccagcccctccc

SEQ ID NO: 4051130 - DNA, 20 bp, Homo sapiens
tcagcccccagcccctcccc

SEQ ID NO: 4051131 - DNA, 24 bp, Homo sapiens
tcagccctcagttccttcatttcc

SEQ ID NO: 4051132 - DNA, 16 bp, Homo sapiens
tcagccctccctgccc

SEQ ID NO: 4051133 - DNA, 17 bp, Homo sapiens
tcagccctccctgcccc

SEQ ID NO: 4051134 - DNA, 19 bp, Homo sapiens
tcagccctccctgcccctc

SEQ ID NO: 4051135 - DNA, 13 bp, Homo sapiens
tcagccctgaggt

SEQ ID NO: 4051136 - DNA, 23 bp, Homo sapiens
tcagccctgaggtgaaagggagc

SEQ ID NO: 4051137 - DNA, 19 bp, Homo sapiens
tcagccgagccgggcctgg

SEQ ID NO: 4051138 - DNA, 20 bp, Homo sapiens
tcagccgagccgggcctggg

SEQ ID NO: 4051139 - DNA, 20 bp, Homo sapiens
tcagcctcccaagtagctgg

SEQ ID NO: 4051140 - DNA, 20 bp, Homo sapiens
tcagcctccctagtagctgg

SEQ ID NO: 4051141 - DNA, 15 bp, Homo sapiens
tcagcctcctgagcc

SEQ ID NO: 4051142 - DNA, 20 bp, Homo sapiens
tcagcctcctgagcctgtgg

SEQ ID NO: 4051143 - DNA, 10 bp, Homo sapiens
tcagcctgag

SEQ ID NO: 4051144 - DNA, 14 bp, Homo sapiens
tcagcctggcctgc

SEQ ID NO: 4051145 - DNA, 18 bp, Homo sapiens
tcagcctggcctgcccgt

SEQ ID NO: 4051146 - DNA, 17 bp, Homo sapiens
tcagccttaagaaccat

SEQ ID NO: 4051147 - DNA, 21 bp, Homo sapiens
tcatctccaaggatcctctcc

SEQ ID NO: 4051148 - DNA, 16 bp, Homo sapiens
tcatctccatcagctg

SEQ ID NO: 4051149 - DNA, 20 bp, Homo sapiens
tcatctccatcatatgcctg

SEQ ID NO: 4051150 - DNA, 12 bp, Homo sapiens
tcatctcccacc

SEQ ID NO: 4051151 - DNA, 21 bp, Homo sapiens
tcatctcggctgttcctgaga

SEQ ID NO: 4051152 - DNA, 21 bp, Homo sapiens
tcatctctctggggccctggg

SEQ ID NO: 4051153 - DNA, 22 bp, Homo sapiens
tcatctctctggggccctgggc

SEQ ID NO: 4051154 - DNA, 23 bp, Homo sapiens
tcatctgagaggctctccgtgca

SEQ ID NO: 4051155 - DNA, 18 bp, Homo sapiens
tcatctgccggcccccag

SEQ ID NO: 4051156 - DNA, 22 bp, Homo sapiens
tcatctggataggagcctgctg

SEQ ID NO: 4051157 - DNA, 23 bp, Homo sapiens
tcatctggataggagcctgctgg

SEQ ID NO: 4051158 - DNA, 16 bp, Homo sapiens
tcatctggttttatta

SEQ ID NO: 4051159 - DNA, 15 bp, Homo sapiens
tcatctgtcaagtgg

SEQ ID NO: 4051160 - DNA, 14 bp, Homo sapiens
tcatctgtccatgg

SEQ ID NO: 4051161 - DNA, 16 bp, Homo sapiens
tcatctgttagggcct

SEQ ID NO: 4051162 - DNA, 17 bp, Homo sapiens
tcatctgtttttctttt

SEQ ID NO: 4051163 - DNA, 13 bp, Homo sapiens
tcatcttcctgtg

SEQ ID NO: 4051164 - DNA, 15 bp, Homo sapiens
tcatcttcctgtgtc

SEQ ID NO: 4051165 - DNA, 22 bp, Homo sapiens
tcatcttggtactactagatgt

SEQ ID NO: 4051166 - DNA, 15 bp, Homo sapiens
tcatgaaaatgacat

SEQ ID NO: 4051167 - DNA, 14 bp, Homo sapiens
tcatgaattttaca

SEQ ID NO: 4051168 - DNA, 19 bp, Homo sapiens
tcatgaattttacatggta

SEQ ID NO: 4051169 - DNA, 20 bp, Homo sapiens
tcatgacccctcgtccaccc

SEQ ID NO: 4051170 - DNA, 14 bp, Homo sapiens
tcatgagcctgctg

SEQ ID NO: 4051171 - DNA, 16 bp, Homo sapiens
tcatgagcctgctgga

SEQ ID NO: 4051172 - DNA, 19 bp, Homo sapiens
tcatgaggagggtggggga

SEQ ID NO: 4051173 - DNA, 18 bp, Homo sapiens
tcatgatgctctttccca

SEQ ID NO: 4051174 - DNA, 14 bp, Homo sapiens
tcatgattagcaag

SEQ ID NO: 4051175 - DNA, 16 bp, Homo sapiens
tcatgattagcaagtt

SEQ ID NO: 4051176 - DNA, 23 bp, Homo sapiens
tcatgatttcatttcaactgttt

SEQ ID NO: 4051177 - DNA, 13 bp, Homo sapiens
tcatgcaatgaca

SEQ ID NO: 4051178 - DNA, 16 bp, Homo sapiens
tcatgcaatgacatct

SEQ ID NO: 4051179 - DNA, 14 bp, Homo sapiens
tcatgcataaatat

SEQ ID NO: 4051180 - DNA, 19 bp, Homo sapiens
tcatgcataaatatgcagt

SEQ ID NO: 4051181 - DNA, 22 bp, Homo sapiens
tcatgccaccatggccagccaa

SEQ ID NO: 4051182 - DNA, 15 bp, Homo sapiens
tcatgcccaccccct

SEQ ID NO: 4051183 - DNA, 16 bp, Homo sapiens
tcatgcccaccccctg

SEQ ID NO: 4051184 - DNA, 22 bp, Homo sapiens
tcatgcccaccccctgccctgc

SEQ ID NO: 4051185 - DNA, 13 bp, Homo sapiens
tcatgcccgccag

SEQ ID NO: 4051186 - DNA, 13 bp, Homo sapiens
tcatgcctttgta

SEQ ID NO: 4051187 - DNA, 16 bp, Homo sapiens
tcatgcctttgtaagt

SEQ ID NO: 4051188 - DNA, 16 bp, Homo sapiens
tcatgctaaaattcta

SEQ ID NO: 4051189 - DNA, 18 bp, Homo sapiens
tcatgctgcccctgcctt

SEQ ID NO: 4051190 - DNA, 20 bp, Homo sapiens
tcatgctgggatttccaact

SEQ ID NO: 4051191 - DNA, 17 bp, Homo sapiens
tcatggaatggacatcc

SEQ ID NO: 4051192 - DNA, 13 bp, Homo sapiens
tcatggcagctgt

SEQ ID NO: 4051193 - DNA, 20 bp, Homo sapiens
tcatggcagctgtttctcat

SEQ ID NO: 4051194 - DNA, 13 bp, Homo sapiens
tcatggcccctct

SEQ ID NO: 4051195 - DNA, 14 bp, Homo sapiens
tcatggcttaatgt

SEQ ID NO: 4051196 - DNA, 15 bp, Homo sapiens
tcatggcttaatgtt

SEQ ID NO: 4051197 - DNA, 18 bp, Homo sapiens
tcatgggcaccaacctgc

SEQ ID NO: 4051198 - DNA, 14 bp, Homo sapiens
tcatggggtccaag

SEQ ID NO: 4051199 - DNA, 14 bp, Homo sapiens
tcatgggtcctagc

SEQ ID NO: 4051200 - DNA, 21 bp, Homo sapiens
tcatgggtcctagcccttccc

SEQ ID NO: 4051201 - DNA, 23 bp, Homo sapiens
tcatgggtcctagcccttccctg

SEQ ID NO: 4051202 - DNA, 13 bp, Homo sapiens
tcatggtgtaata

SEQ ID NO: 4051203 - DNA, 17 bp, Homo sapiens
tcatggtgtaataagac

SEQ ID NO: 4051204 - DNA, 19 bp, Homo sapiens
tcatggtgtaataagacat

SEQ ID NO: 4051205 - DNA, 19 bp, Homo sapiens
tcatgtaaagaaatgtctt

SEQ ID NO: 4051206 - DNA, 18 bp, Homo sapiens
tcatgtcaacttctggct

SEQ ID NO: 4051207 - DNA, 22 bp, Homo sapiens
tcatgtcctgctggcttccagc

SEQ ID NO: 4051208 - DNA, 23 bp, Homo sapiens
tcatgtctgcttgtcaaaagaaa

SEQ ID NO: 4051209 - DNA, 17 bp, Homo sapiens
tcatgtgaccactctgt

SEQ ID NO: 4051210 - DNA, 17 bp, Homo sapiens
tcatgtgggtgagccag

SEQ ID NO: 4051211 - DNA, 22 bp, Homo sapiens
tcatgtgggtgagccagtggaa

SEQ ID NO: 4051212 - DNA, 19 bp, Homo sapiens
tcatgtggtttctatgcaa

SEQ ID NO: 4051213 - DNA, 17 bp, Homo sapiens
tcatgttcactgtgagt

SEQ ID NO: 4051214 - DNA, 23 bp, Homo sapiens
tcatgttgcttgtcgctttctca

SEQ ID NO: 4051215 - DNA, 20 bp, Homo sapiens
tcatgtttgcttcataaatg

SEQ ID NO: 4051216 - DNA, 12 bp, Homo sapiens
tcattaaaattg

SEQ ID NO: 4051217 - DNA, 17 bp, Homo sapiens
tcattaaacttttttaa

SEQ ID NO: 4051218 - DNA, 16 bp, Homo sapiens
tcattaatttttaatt

SEQ ID NO: 4051219 - DNA, 19 bp, Homo sapiens
tcattacccttccctgcac

SEQ ID NO: 4051220 - DNA, 21 bp, Homo sapiens
tcattacccttccctgcacta

SEQ ID NO: 4051221 - DNA, 18 bp, Homo sapiens
tcattagctgtgattttt

SEQ ID NO: 4051222 - DNA, 23 bp, Homo sapiens
tcattataaacgtgatgatcagc

SEQ ID NO: 4051223 - DNA, 17 bp, Homo sapiens
tcattatcatcaagcag

SEQ ID NO: 4051224 - DNA, 14 bp, Homo sapiens
tcattattggaatt

SEQ ID NO: 4051225 - DNA, 17 bp, Homo sapiens
tcattattggaattaac

SEQ ID NO: 4051226 - DNA, 21 bp, Homo sapiens
tcattattggaattaacctgg

SEQ ID NO: 4051227 - DNA, 21 bp, Homo sapiens
tcattattttgggaagaaaac

SEQ ID NO: 4051228 - DNA, 23 bp, Homo sapiens
tcattcaactctccaatgttcta

SEQ ID NO: 4051229 - DNA, 16 bp, Homo sapiens
tcattcaatattgaca

SEQ ID NO: 4051230 - DNA, 18 bp, Homo sapiens
tcattccagtgctagaaa

SEQ ID NO: 4051231 - DNA, 16 bp, Homo sapiens
tcattccgttgtctgt

SEQ ID NO: 4051232 - DNA, 17 bp, Homo sapiens
tcattccgttgtctgtg

SEQ ID NO: 4051233 - DNA, 18 bp, Homo sapiens
tcattcgggccccacctg

SEQ ID NO: 4051234 - DNA, 15 bp, Homo sapiens
tcattcgttctgtgg

SEQ ID NO: 4051235 - DNA, 15 bp, Homo sapiens
tcattctatcaagcc

SEQ ID NO: 4051236 - DNA, 12 bp, Homo sapiens
tcattctcctgc

SEQ ID NO: 4051237 - DNA, 15 bp, Homo sapiens
tcattcttgttttct

SEQ ID NO: 4051238 - DNA, 14 bp, Homo sapiens
tcattgaagtattt

SEQ ID NO: 4051239 - DNA, 16 bp, Homo sapiens
tcattgacctctcagg

SEQ ID NO: 4051240 - DNA, 22 bp, Homo sapiens
tcattgcctgtgtatggaaaaa

SEQ ID NO: 4051241 - DNA, 16 bp, Homo sapiens
tcattgctaaactgat

SEQ ID NO: 4051242 - DNA, 17 bp, Homo sapiens
tcattgctaaactgatg

SEQ ID NO: 4051243 - DNA, 14 bp, Homo sapiens
tcattgctgaaaat

SEQ ID NO: 4051244 - DNA, 17 bp, Homo sapiens
tcattgctgaaaatggt

SEQ ID NO: 4051245 - DNA, 15 bp, Homo sapiens
tcattgctgagcctc

SEQ ID NO: 4051246 - DNA, 22 bp, Homo sapiens
tcattgctgagcctctgctccc

SEQ ID NO: 4051247 - DNA, 17 bp, Homo sapiens
tcattgcttcttctgag

SEQ ID NO: 4051248 - DNA, 16 bp, Homo sapiens
tcattgtaatgttact

SEQ ID NO: 4051249 - DNA, 19 bp, Homo sapiens
tccatgttagtttttactt

SEQ ID NO: 4051250 - DNA, 16 bp, Homo sapiens
tccattacctccatcc

SEQ ID NO: 4051251 - DNA, 12 bp, Homo sapiens
tccattatctta

SEQ ID NO: 4051252 - DNA, 11 bp, Homo sapiens
tccattattta

SEQ ID NO: 4051253 - DNA, 12 bp, Homo sapiens
tccattatttat

SEQ ID NO: 4051254 - DNA, 21 bp, Homo sapiens
tccattgaagccgactctggc

SEQ ID NO: 4051255 - DNA, 16 bp, Homo sapiens
tccattgtttaaagat

SEQ ID NO: 4051256 - DNA, 17 bp, Homo sapiens
tccatttataaccccag

SEQ ID NO: 4051257 - DNA, 23 bp, Homo sapiens
tccatttataaccccagcctgac

SEQ ID NO: 4051258 - DNA, 18 bp, Homo sapiens
tccatttatatatgaaaa

SEQ ID NO: 4051259 - DNA, 17 bp, Homo sapiens
tccatttcccacatctt

SEQ ID NO: 4051260 - DNA, 18 bp, Homo sapiens
tccatttcccacatcttt

SEQ ID NO: 4051261 - DNA, 14 bp, Homo sapiens
tccatttgcctttc

SEQ ID NO: 4051262 - DNA, 17 bp, Homo sapiens
tccatttgcctttctgg

SEQ ID NO: 4051263 - DNA, 19 bp, Homo sapiens
tccatttgttcctgcttcc

SEQ ID NO: 4051264 - DNA, 14 bp, Homo sapiens
tccattttcaagct

SEQ ID NO: 4051265 - DNA, 22 bp, Homo sapiens
tccattttggcgctattacaaa

SEQ ID NO: 4051266 - DNA, 22 bp, Homo sapiens
tccattttggtgtctttctctt

SEQ ID NO: 4051267 - DNA, 22 bp, Homo sapiens
tcccaaacgccctttcctcctc

SEQ ID NO: 4051268 - DNA, 24 bp, Homo sapiens
tcccaaacgccctttcctcctcag

SEQ ID NO: 4051269 - DNA, 21 bp, Homo sapiens
tcccaaacgcctcccctgccc

SEQ ID NO: 4051270 - DNA, 17 bp, Homo sapiens
tcccaaatctgtcagca

SEQ ID NO: 4051271 - DNA, 17 bp, Homo sapiens
tcccaaatttgattgat

SEQ ID NO: 4051272 - DNA, 22 bp, Homo sapiens
tcccaaatttgattgatttgaa

SEQ ID NO: 4051273 - DNA, 16 bp, Homo sapiens
tcccaacagccatgcc

SEQ ID NO: 4051274 - DNA, 17 bp, Homo sapiens
tcccaacagccatgccc

SEQ ID NO: 4051275 - DNA, 15 bp, Homo sapiens
tcccaaccaggcacc

SEQ ID NO: 4051276 - DNA, 22 bp, Homo sapiens
tcccaacctctttttcctcctg

SEQ ID NO: 4051277 - DNA, 22 bp, Homo sapiens
tcccaacttcatactggcagga

SEQ ID NO: 4051278 - DNA, 15 bp, Homo sapiens
tcccaacttcttcct

SEQ ID NO: 4051279 - DNA, 17 bp, Homo sapiens
tcccaacttcttcctgt

SEQ ID NO: 4051280 - DNA, 12 bp, Homo sapiens
tcccaaggaaag

SEQ ID NO: 4051281 - DNA, 18 bp, Homo sapiens
tcccaaggaaagccccag

SEQ ID NO: 4051282 - DNA, 22 bp, Homo sapiens
tcccaaggaaagccccagcact

SEQ ID NO: 4051283 - DNA, 21 bp, Homo sapiens
tcccaaggttggagcccaggg

SEQ ID NO: 4051284 - DNA, 20 bp, Homo sapiens
tcccaagtaactgggattac

SEQ ID NO: 4051285 - DNA, 20 bp, Homo sapiens
tcccaagtagctgggattac

SEQ ID NO: 4051286 - DNA, 21 bp, Homo sapiens
tcccaagtagctgggattaca

SEQ ID NO: 4051287 - DNA, 11 bp, Homo sapiens
tcccaataaaa

SEQ ID NO: 4051288 - DNA, 13 bp, Homo sapiens
tcccaataaaagt

SEQ ID NO: 4051289 - DNA, 14 bp, Homo sapiens
tcccaataaaagtg

SEQ ID NO: 4051290 - DNA, 15 bp, Homo sapiens
tcccaataaaagtga

SEQ ID NO: 4051291 - DNA, 14 bp, Homo sapiens
tcccacactcgcca

SEQ ID NO: 4051292 - DNA, 18 bp, Homo sapiens
tcccacactggtgactgc

SEQ ID NO: 4051293 - DNA, 13 bp, Homo sapiens
tcccacatctttc

SEQ ID NO: 4051294 - DNA, 13 bp, Homo sapiens
tcccacatgaggc

SEQ ID NO: 4051295 - DNA, 22 bp, Homo sapiens
tcccacatgcctgcgcctgctg

SEQ ID NO: 4051296 - DNA, 15 bp, Homo sapiens
tcccacccagcctgg

SEQ ID NO: 4051297 - DNA, 20 bp, Homo sapiens
tcccacccccttctctgctc

SEQ ID NO: 4051298 - DNA, 13 bp, Homo sapiens
tcccacccctaca

SEQ ID NO: 4051299 - DNA, 22 bp, Homo sapiens
tcccacccctagccaccagtgt

SEQ ID NO: 4051300 - DNA, 22 bp, Homo sapiens
tcccaccctgacccccttcctg

SEQ ID NO: 4051301 - DNA, 11 bp, Homo sapiens
tcccaccctgt

SEQ ID NO: 4051302 - DNA, 20 bp, Homo sapiens
tcccacctcacccggcctct

SEQ ID NO: 4051303 - DNA, 13 bp, Homo sapiens
tcccaccttccca

SEQ ID NO: 4051304 - DNA, 20 bp, Homo sapiens
tcccacgcactccatgagca

SEQ ID NO: 4051305 - DNA, 21 bp, Homo sapiens
tcccacgtcttcttgctgcag

SEQ ID NO: 4051306 - DNA, 13 bp, Homo sapiens
tcccactcacccc

SEQ ID NO: 4051307 - DNA, 15 bp, Homo sapiens
tcccactcaccccgg

SEQ ID NO: 4051308 - DNA, 23 bp, Homo sapiens
tcccactcaccccggcagacgcc

SEQ ID NO: 4051309 - DNA, 14 bp, Homo sapiens
tcccactccaagcc

SEQ ID NO: 4051310 - DNA, 18 bp, Homo sapiens
tcccactccaagccagca

SEQ ID NO: 4051311 - DNA, 19 bp, Homo sapiens
tcccactccaagccagcaa

SEQ ID NO: 4051312 - DNA, 13 bp, Homo sapiens
tcccactcttctc

SEQ ID NO: 4051313 - DNA, 17 bp, Homo sapiens
tcccacttggaggcctt

SEQ ID NO: 4051314 - DNA, 22 bp, Homo sapiens
tcccactttcatctaccttttc

SEQ ID NO: 4051315 - DNA, 22 bp, Homo sapiens
tcccagaacctcagcatttcct

SEQ ID NO: 4051316 - DNA, 15 bp, Homo sapiens
tcccagaagtggcta

SEQ ID NO: 4051317 - DNA, 16 bp, Homo sapiens
tcccagaagtggctac

SEQ ID NO: 4051318 - DNA, 17 bp, Homo sapiens
tcccagagggagcaggc

SEQ ID NO: 4051319 - DNA, 12 bp, Homo sapiens
tcccagcacctg

SEQ ID NO: 4051320 - DNA, 18 bp, Homo sapiens
tcccagcactttgggagg

SEQ ID NO: 4051321 - DNA, 19 bp, Homo sapiens
tcccagcactttgggaggc

SEQ ID NO: 4051322 - DNA, 22 bp, Homo sapiens
tcccagcactttgggaggccta

SEQ ID NO: 4051323 - DNA, 22 bp, Homo sapiens
tcccagccccggcaagccacag

SEQ ID NO: 4051324 - DNA, 12 bp, Homo sapiens
tcccagcctgct

SEQ ID NO: 4051325 - DNA, 18 bp, Homo sapiens
tcccagcctgctgagagc

SEQ ID NO: 4051326 - DNA, 14 bp, Homo sapiens
tcccagcctggggg

SEQ ID NO: 4051327 - DNA, 20 bp, Homo sapiens
tcccagctaggaagagcagg

SEQ ID NO: 4051328 - DNA, 18 bp, Homo sapiens
tcccagctttaaaaagaa

SEQ ID NO: 4051329 - DNA, 22 bp, Homo sapiens
tcccagctttaaaaagaaaaaa

SEQ ID NO: 4051330 - DNA, 18 bp, Homo sapiens
tcccaggccccctgcatc

SEQ ID NO: 4051331 - DNA, 19 bp, Homo sapiens
tcccaggccccctgcatct

SEQ ID NO: 4051332 - DNA, 20 bp, Homo sapiens
tcccaggccccctgcatcta

SEQ ID NO: 4051333 - DNA, 21 bp, Homo sapiens
tcccaggcgccccttccccct

SEQ ID NO: 4051334 - DNA, 22 bp, Homo sapiens
tcccaggcttcaccctgaatgg

SEQ ID NO: 4051335 - DNA, 20 bp, Homo sapiens
tcccagggaaggacttggag

SEQ ID NO: 4051336 - DNA, 14 bp, Homo sapiens
tcccagggctggct

SEQ ID NO: 4051337 - DNA, 23 bp, Homo sapiens
tcccagggctggctctgcactaa

SEQ ID NO: 4051338 - DNA, 17 bp, Homo sapiens
tcccaggggtctccctg

SEQ ID NO: 4051339 - DNA, 18 bp, Homo sapiens
tcccaggggtctccctgg

SEQ ID NO: 4051340 - DNA, 19 bp, Homo sapiens
tcccaggggtctccctggc

SEQ ID NO: 4051341 - DNA, 21 bp, Homo sapiens
tcccaggggtctccctggctc

SEQ ID NO: 4051342 - DNA, 18 bp, Homo sapiens
tcccaggtaccagctgcg

SEQ ID NO: 4051343 - DNA, 19 bp, Homo sapiens
tcccaggtaccagctgcgc

SEQ ID NO: 4051344 - DNA, 16 bp, Homo sapiens
tcccaggttcccccag

SEQ ID NO: 4051345 - DNA, 22 bp, Homo sapiens
tcccagtgaactcctgccaggc

SEQ ID NO: 4051346 - DNA, 15 bp, Homo sapiens
tcccagtgagactgc

SEQ ID NO: 4051347 - DNA, 13 bp, Homo sapiens
tcccatccagggc

SEQ ID NO: 4051348 - DNA, 13 bp, Homo sapiens
tcccatcccctgg

SEQ ID NO: 4051349 - DNA, 16 bp, Homo sapiens
tcccatccttccctca

SEQ ID NO: 4051350 - DNA, 13 bp, Homo sapiens
tcccatcgctgtc

SEQ ID NO: 4051351 - DNA, 23 bp, Homo sapiens
tcctaccagttgccctagcccag

SEQ ID NO: 4051352 - DNA, 15 bp, Homo sapiens
tcctacctctgtgcc

SEQ ID NO: 4051353 - DNA, 23 bp, Homo sapiens
tcctacctctgtgccagggcagc

SEQ ID NO: 4051354 - DNA, 15 bp, Homo sapiens
tcctacctgccctgg

SEQ ID NO: 4051355 - DNA, 16 bp, Homo sapiens
tcctacctgccctgga

SEQ ID NO: 4051356 - DNA, 23 bp, Homo sapiens
tcctacgagtaattgcatttgct

SEQ ID NO: 4051357 - DNA, 17 bp, Homo sapiens
tcctagaattcgaaggc

SEQ ID NO: 4051358 - DNA, 12 bp, Homo sapiens
tcctagacccag

SEQ ID NO: 4051359 - DNA, 23 bp, Homo sapiens
tcctagagaacgcagccctagag

SEQ ID NO: 4051360 - DNA, 16 bp, Homo sapiens
tcctagataaaaagat

SEQ ID NO: 4051361 - DNA, 17 bp, Homo sapiens
tcctagataaaaagatg

SEQ ID NO: 4051362 - DNA, 12 bp, Homo sapiens
tcctagcccttc

SEQ ID NO: 4051363 - DNA, 15 bp, Homo sapiens
tcctagcccttccct

SEQ ID NO: 4051364 - DNA, 17 bp, Homo sapiens
tcctagcccttccctga

SEQ ID NO: 4051365 - DNA, 18 bp, Homo sapiens
tcctagcccttccctgag

SEQ ID NO: 4051366 - DNA, 13 bp, Homo sapiens
tcctagctctccc

SEQ ID NO: 4051367 - DNA, 15 bp, Homo sapiens
tcctagctctcccag

SEQ ID NO: 4051368 - DNA, 18 bp, Homo sapiens
tcctagctctcccagtga

SEQ ID NO: 4051369 - DNA, 23 bp, Homo sapiens
tcctaggagagccaacctcggct

SEQ ID NO: 4051370 - DNA, 22 bp, Homo sapiens
tcctaggggaacagaccagtga

SEQ ID NO: 4051371 - DNA, 17 bp, Homo sapiens
tcctagtcattcttccc

SEQ ID NO: 4051372 - DNA, 17 bp, Homo sapiens
tcctagtggatgactgt

SEQ ID NO: 4051373 - DNA, 19 bp, Homo sapiens
tcctagttcatcccttctc

SEQ ID NO: 4051374 - DNA, 20 bp, Homo sapiens
tcctatcaagccagtacgtg

SEQ ID NO: 4051375 - DNA, 17 bp, Homo sapiens
tcctatccactgggcac

SEQ ID NO: 4051376 - DNA, 21 bp, Homo sapiens
tcctatccactgggcacaact

SEQ ID NO: 4051377 - DNA, 17 bp, Homo sapiens
tcctatctatcttccaa

SEQ ID NO: 4051378 - DNA, 18 bp, Homo sapiens
tcctattaaaacacagct

SEQ ID NO: 4051379 - DNA, 20 bp, Homo sapiens
tcctattaaaacacagcttt

SEQ ID NO: 4051380 - DNA, 16 bp, Homo sapiens
tcctattctcaccagg

SEQ ID NO: 4051381 - DNA, 20 bp, Homo sapiens
tcctattctcaccaggaagg

SEQ ID NO: 4051382 - DNA, 18 bp, Homo sapiens
tcctcaaacgacagagga

SEQ ID NO: 4051383 - DNA, 23 bp, Homo sapiens
tcctcaactcacctaatgtttat

SEQ ID NO: 4051384 - DNA, 16 bp, Homo sapiens
tcctcacctcatgccc

SEQ ID NO: 4051385 - DNA, 21 bp, Homo sapiens
tcctcacctctggactggcta

SEQ ID NO: 4051386 - DNA, 12 bp, Homo sapiens
tcctcactccca

SEQ ID NO: 4051387 - DNA, 14 bp, Homo sapiens
tcctcactcccagt

SEQ ID NO: 4051388 - DNA, 13 bp, Homo sapiens
tcctcactgggtg

SEQ ID NO: 4051389 - DNA, 21 bp, Homo sapiens
tcctcagagcgccaggaagcc

SEQ ID NO: 4051390 - DNA, 22 bp, Homo sapiens
tcctcagagcgccaggaagcca

SEQ ID NO: 4051391 - DNA, 16 bp, Homo sapiens
tcctcagaggacagtt

SEQ ID NO: 4051392 - DNA, 16 bp, Homo sapiens
tcctcagatgatgttt

SEQ ID NO: 4051393 - DNA, 20 bp, Homo sapiens
tcctcagattagatgtgcca

SEQ ID NO: 4051394 - DNA, 18 bp, Homo sapiens
tcctcagccttgccagag

SEQ ID NO: 4051395 - DNA, 20 bp, Homo sapiens
tcctcagccttgccagagat

SEQ ID NO: 4051396 - DNA, 14 bp, Homo sapiens
tcctcagctgcctc

SEQ ID NO: 4051397 - DNA, 14 bp, Homo sapiens
tcctcagcttatct

SEQ ID NO: 4051398 - DNA, 15 bp, Homo sapiens
tcctcaggcacacag

SEQ ID NO: 4051399 - DNA, 21 bp, Homo sapiens
tcctcagggagcagggaaggc

SEQ ID NO: 4051400 - DNA, 18 bp, Homo sapiens
tcctcagtccatttatat

SEQ ID NO: 4051401 - DNA, 23 bp, Homo sapiens
tcctcagtccatttatatatgaa

SEQ ID NO: 4051402 - DNA, 16 bp, Homo sapiens
tcctcataaaaagcaa

SEQ ID NO: 4051403 - DNA, 18 bp, Homo sapiens
tcctcatctccaaggcag

SEQ ID NO: 4051404 - DNA, 18 bp, Homo sapiens
tcctccaaaggcccccta

SEQ ID NO: 4051405 - DNA, 23 bp, Homo sapiens
tcctccaaaggccccctacgcca

SEQ ID NO: 4051406 - DNA, 17 bp, Homo sapiens
tcctccaacaccaagca

SEQ ID NO: 4051407 - DNA, 18 bp, Homo sapiens
tcctccagaactcttcct

SEQ ID NO: 4051408 - DNA, 14 bp, Homo sapiens
tcctccagaagcct

SEQ ID NO: 4051409 - DNA, 22 bp, Homo sapiens
tcctccagaagcctctggctag

SEQ ID NO: 4051410 - DNA, 21 bp, Homo sapiens
tcctccagagaaacccaggga

SEQ ID NO: 4051411 - DNA, 13 bp, Homo sapiens
tcctccagctgca

SEQ ID NO: 4051412 - DNA, 15 bp, Homo sapiens
tcctccagctgcacc

SEQ ID NO: 4051413 - DNA, 21 bp, Homo sapiens
tcctccagctgcaccagagca

SEQ ID NO: 4051414 - DNA, 17 bp, Homo sapiens
tcctccaggagcttctt

SEQ ID NO: 4051415 - DNA, 19 bp, Homo sapiens
tcctccaggcctgcctccc

SEQ ID NO: 4051416 - DNA, 22 bp, Homo sapiens
tcctccagggaaggtggccaca

SEQ ID NO: 4051417 - DNA, 17 bp, Homo sapiens
tcctccagggtgatttt

SEQ ID NO: 4051418 - DNA, 18 bp, Homo sapiens
tcctccagtaccttgctt

SEQ ID NO: 4051419 - DNA, 22 bp, Homo sapiens
tcctccagtgtgggcttgacca

SEQ ID NO: 4051420 - DNA, 17 bp, Homo sapiens
tcctccatctttctaca

SEQ ID NO: 4051421 - DNA, 11 bp, Homo sapiens
tcctcccagtg

SEQ ID NO: 4051422 - DNA, 18 bp, Homo sapiens
tcctcccatcccctggac

SEQ ID NO: 4051423 - DNA, 23 bp, Homo sapiens
tcctcccatcccctggactggga

SEQ ID NO: 4051424 - DNA, 14 bp, Homo sapiens
tcctccctcccaca

SEQ ID NO: 4051425 - DNA, 13 bp, Homo sapiens
tcctcccttcctt

SEQ ID NO: 4051426 - DNA, 17 bp, Homo sapiens
tcctcccttccttttcc

SEQ ID NO: 4051427 - DNA, 19 bp, Homo sapiens
tcctcccttgggttctgat

SEQ ID NO: 4051428 - DNA, 20 bp, Homo sapiens
tcctcccttgggttctgata

SEQ ID NO: 4051429 - DNA, 12 bp, Homo sapiens
tcctcctcaggc

SEQ ID NO: 4051430 - DNA, 21 bp, Homo sapiens
tcctcctccaaaggcccccta

SEQ ID NO: 4051431 - DNA, 20 bp, Homo sapiens
tcctcctccatctttctaca

SEQ ID NO: 4051432 - DNA, 14 bp, Homo sapiens
tcctcctctgccta

SEQ ID NO: 4051433 - DNA, 15 bp, Homo sapiens
tcctcctgccctgtc

SEQ ID NO: 4051434 - DNA, 20 bp, Homo sapiens
tcctcctgcctcagccttcc

SEQ ID NO: 4051435 - DNA, 14 bp, Homo sapiens
tcctcctgctgcca

SEQ ID NO: 4051436 - DNA, 12 bp, Homo sapiens
tcctcctgggag

SEQ ID NO: 4051437 - DNA, 15 bp, Homo sapiens
tcctcgcttctttca

SEQ ID NO: 4051438 - DNA, 18 bp, Homo sapiens
tcctcggagagcagcagc

SEQ ID NO: 4051439 - DNA, 21 bp, Homo sapiens
tcctcggagagcagcagcacc

SEQ ID NO: 4051440 - DNA, 15 bp, Homo sapiens
tcctcgggccgaggc

SEQ ID NO: 4051441 - DNA, 20 bp, Homo sapiens
tcctcgggccgaggcccagc

SEQ ID NO: 4051442 - DNA, 15 bp, Homo sapiens
tcctcgttcctttct

SEQ ID NO: 4051443 - DNA, 17 bp, Homo sapiens
tcctcgttcctttctcc

SEQ ID NO: 4051444 - DNA, 21 bp, Homo sapiens
tcctctagctgtgggggtgag

SEQ ID NO: 4051445 - DNA, 21 bp, Homo sapiens
tcctctaggcaagcaggacct

SEQ ID NO: 4051446 - DNA, 16 bp, Homo sapiens
tcctctagtaagatgc

SEQ ID NO: 4051447 - DNA, 16 bp, Homo sapiens
tcctctatacatctct

SEQ ID NO: 4051448 - DNA, 20 bp, Homo sapiens
tcctctatacatctctcccc

SEQ ID NO: 4051449 - DNA, 14 bp, Homo sapiens
tcctctattttgtg

SEQ ID NO: 4051450 - DNA, 14 bp, Homo sapiens
tcctctccactgcc

SEQ ID NO: 4051451 - DNA, 15 bp, Homo sapiens
tcctctccactgcct

SEQ ID NO: 4051452 - DNA, 15 bp, Homo sapiens
tcctctccccagccc

SEQ ID NO: 4051453 - DNA, 22 bp, Homo sapiens
tcggatggaccaacctgctctg

SEQ ID NO: 4051454 - DNA, 14 bp, Homo sapiens
tcggattttttcca

SEQ ID NO: 4051455 - DNA, 16 bp, Homo sapiens
tcggattttttccaaa

SEQ ID NO: 4051456 - DNA, 17 bp, Homo sapiens
tcggattttttccaaaa

SEQ ID NO: 4051457 - DNA, 14 bp, Homo sapiens
tcggcacagcctgg

SEQ ID NO: 4051458 - DNA, 20 bp, Homo sapiens
tcggcagaggaacccccacc

SEQ ID NO: 4051459 - DNA, 22 bp, Homo sapiens
tcggccaagaatacttgaagaa

SEQ ID NO: 4051460 - DNA, 18 bp, Homo sapiens
tcggcctcccaaagtgct

SEQ ID NO: 4051461 - DNA, 23 bp, Homo sapiens
tcggcgcccaccaccccctcaag

SEQ ID NO: 4051462 - DNA, 19 bp, Homo sapiens
tcggctccccatgtgtcct

SEQ ID NO: 4051463 - DNA, 21 bp, Homo sapiens
tcgggaaaaggtagaggagtc

SEQ ID NO: 4051464 - DNA, 16 bp, Homo sapiens
tcgggacacctgccct

SEQ ID NO: 4051465 - DNA, 20 bp, Homo sapiens
tcgggacacctgccctgccc

SEQ ID NO: 4051466 - DNA, 16 bp, Homo sapiens
tcgggagcacccagag

SEQ ID NO: 4051467 - DNA, 15 bp, Homo sapiens
tcgggagcagggctg

SEQ ID NO: 4051468 - DNA, 16 bp, Homo sapiens
tcgggaggctgagaca

SEQ ID NO: 4051469 - DNA, 15 bp, Homo sapiens
tcgggccccacctgc

SEQ ID NO: 4051470 - DNA, 17 bp, Homo sapiens
tcgggccccacctgcag

SEQ ID NO: 4051471 - DNA, 22 bp, Homo sapiens
tcggggcgatgctccctcagcc

SEQ ID NO: 4051472 - DNA, 16 bp, Homo sapiens
tcggtagcagaggccc

SEQ ID NO: 4051473 - DNA, 20 bp, Homo sapiens
tcgtaaccagccagatcctc

SEQ ID NO: 4051474 - DNA, 16 bp, Homo sapiens
tcgtccttttggttta

SEQ ID NO: 4051475 - DNA, 16 bp, Homo sapiens
tcgtctccctcgacag

SEQ ID NO: 4051476 - DNA, 18 bp, Homo sapiens
tcgtgaaaccctgtctct

SEQ ID NO: 4051477 - DNA, 14 bp, Homo sapiens
tcgtgaacatcccc

SEQ ID NO: 4051478 - DNA, 14 bp, Homo sapiens
tcgtgagctgggga

SEQ ID NO: 4051479 - DNA, 18 bp, Homo sapiens
tcgtgagctggggactca

SEQ ID NO: 4051480 - DNA, 17 bp, Homo sapiens
tcgtgccatgatctgta

SEQ ID NO: 4051481 - DNA, 18 bp, Homo sapiens
tcgtgccatgatctgtat

SEQ ID NO: 4051482 - DNA, 23 bp, Homo sapiens
tcgtgcctccttccacctccctc

SEQ ID NO: 4051483 - DNA, 18 bp, Homo sapiens
tcgtgtggatcttgccac

SEQ ID NO: 4051484 - DNA, 16 bp, Homo sapiens
tcgttaaaaagttgtt

SEQ ID NO: 4051485 - DNA, 12 bp, Homo sapiens
tcgttaacattg

SEQ ID NO: 4051486 - DNA, 21 bp, Homo sapiens
tcgttaactgtgtatgtacat

SEQ ID NO: 4051487 - DNA, 20 bp, Homo sapiens
tcgttaattaatgtcatgtt

SEQ ID NO: 4051488 - DNA, 15 bp, Homo sapiens
tcgttattataaatg

SEQ ID NO: 4051489 - DNA, 11 bp, Homo sapiens
tcgttctgtgg

SEQ ID NO: 4051490 - DNA, 13 bp, Homo sapiens
tcgtttgtttgtt

SEQ ID NO: 4051491 - DNA, 18 bp, Homo sapiens
tcgtttttatattaatgt

SEQ ID NO: 4051492 - DNA, 13 bp, Homo sapiens
tctaaaaacttct

SEQ ID NO: 4051493 - DNA, 19 bp, Homo sapiens
tctaaaacaaaatctgaac

SEQ ID NO: 4051494 - DNA, 16 bp, Homo sapiens
tctaaaagcagaaaat

SEQ ID NO: 4051495 - DNA, 19 bp, Homo sapiens
tctaaacaaaattgcaatt

SEQ ID NO: 4051496 - DNA, 18 bp, Homo sapiens
tctaaactaggctccttc

SEQ ID NO: 4051497 - DNA, 13 bp, Homo sapiens
tctaaactgcaaa

SEQ ID NO: 4051498 - DNA, 18 bp, Homo sapiens
tctaaagataatattact

SEQ ID NO: 4051499 - DNA, 19 bp, Homo sapiens
tctaaagtgtgttgttgct

SEQ ID NO: 4051500 - DNA, 13 bp, Homo sapiens
tctaaatatttcc

SEQ ID NO: 4051501 - DNA, 21 bp, Homo sapiens
tctaaatctatttattaatat

SEQ ID NO: 4051502 - DNA, 14 bp, Homo sapiens
tctaaatctgtcca

SEQ ID NO: 4051503 - DNA, 21 bp, Homo sapiens
tctaaatctgtccaactgaga

SEQ ID NO: 4051504 - DNA, 13 bp, Homo sapiens
tctaaatgcagtt

SEQ ID NO: 4051505 - DNA, 18 bp, Homo sapiens
tctaaattaaagccttta

SEQ ID NO: 4051506 - DNA, 18 bp, Homo sapiens
tctaaatttccatatcct

SEQ ID NO: 4051507 - DNA, 13 bp, Homo sapiens
tctaaatttgaat

SEQ ID NO: 4051508 - DNA, 17 bp, Homo sapiens
tctaaatttgaatgtta

SEQ ID NO: 4051509 - DNA, 22 bp, Homo sapiens
tctaaatttgaatgttaagcag

SEQ ID NO: 4051510 - DNA, 23 bp, Homo sapiens
tctaaatttgaatgttaagcaga

SEQ ID NO: 4051511 - DNA, 19 bp, Homo sapiens
tctaacactggcatgttca

SEQ ID NO: 4051512 - DNA, 19 bp, Homo sapiens
tctaaccacagctcctttt

SEQ ID NO: 4051513 - DNA, 22 bp, Homo sapiens
tctaaccacagctccttttcca

SEQ ID NO: 4051514 - DNA, 17 bp, Homo sapiens
tctaaccttgaatgctg

SEQ ID NO: 4051515 - DNA, 18 bp, Homo sapiens
tctaaccttgaatgctgc

SEQ ID NO: 4051516 - DNA, 16 bp, Homo sapiens
tctaacgccagcacac

SEQ ID NO: 4051517 - DNA, 14 bp, Homo sapiens
tctaagatgattca

SEQ ID NO: 4051518 - DNA, 22 bp, Homo sapiens
tctaagatgccagcatatactg

SEQ ID NO: 4051519 - DNA, 16 bp, Homo sapiens
tctaagcaatttcttg

SEQ ID NO: 4051520 - DNA, 19 bp, Homo sapiens
tctaagccagttttcattt

SEQ ID NO: 4051521 - DNA, 18 bp, Homo sapiens
tctaagctcagtgctctc

SEQ ID NO: 4051522 - DNA, 21 bp, Homo sapiens
tctaagctcagtgctctctcc

SEQ ID NO: 4051523 - DNA, 20 bp, Homo sapiens
tctaaggatgtcacagggcc

SEQ ID NO: 4051524 - DNA, 23 bp, Homo sapiens
tctaaggatgtcacagggccaac

SEQ ID NO: 4051525 - DNA, 14 bp, Homo sapiens
tctaagggggaggg

SEQ ID NO: 4051526 - DNA, 14 bp, Homo sapiens
tctaaggttctcat

SEQ ID NO: 4051527 - DNA, 22 bp, Homo sapiens
tctaataaaacagctgtctcta

SEQ ID NO: 4051528 - DNA, 19 bp, Homo sapiens
tctaatagaactcagtttt

SEQ ID NO: 4051529 - DNA, 22 bp, Homo sapiens
tctaatagaactcagttttaac

SEQ ID NO: 4051530 - DNA, 19 bp, Homo sapiens
tctaatatatatgaataaa

SEQ ID NO: 4051531 - DNA, 12 bp, Homo sapiens
tctaatcaaaag

SEQ ID NO: 4051532 - DNA, 17 bp, Homo sapiens
tctaatccttttcctta

SEQ ID NO: 4051533 - DNA, 20 bp, Homo sapiens
tctaatgtggttatttctct

SEQ ID NO: 4051534 - DNA, 16 bp, Homo sapiens
tctaattaaaacactt

SEQ ID NO: 4051535 - DNA, 17 bp, Homo sapiens
tctaattaattgtaatc

SEQ ID NO: 4051536 - DNA, 23 bp, Homo sapiens
tctaattatttaaataaaatcac

SEQ ID NO: 4051537 - DNA, 17 bp, Homo sapiens
tctaattgcatctcaaa

SEQ ID NO: 4051538 - DNA, 22 bp, Homo sapiens
tctaatttatcttgtctctggg

SEQ ID NO: 4051539 - DNA, 16 bp, Homo sapiens
tctaattttggatgga

SEQ ID NO: 4051540 - DNA, 18 bp, Homo sapiens
tctacaaatataagattt

SEQ ID NO: 4051541 - DNA, 19 bp, Homo sapiens
tctacaaatataagatttt

SEQ ID NO: 4051542 - DNA, 15 bp, Homo sapiens
tctacaaccagagcc

SEQ ID NO: 4051543 - DNA, 16 bp, Homo sapiens
tctacaaccagagccc

SEQ ID NO: 4051544 - DNA, 17 bp, Homo sapiens
tctacaaccagagcccc

SEQ ID NO: 4051545 - DNA, 15 bp, Homo sapiens
tctacaagtatatgt

SEQ ID NO: 4051546 - DNA, 16 bp, Homo sapiens
tctacaagtatatgtg

SEQ ID NO: 4051547 - DNA, 19 bp, Homo sapiens
tctacaagtatatgtgaaa

SEQ ID NO: 4051548 - DNA, 21 bp, Homo sapiens
tctacaagtatatgtgaaaaa

SEQ ID NO: 4051549 - DNA, 16 bp, Homo sapiens
tctacaatgacacaca

SEQ ID NO: 4051550 - DNA, 16 bp, Homo sapiens
tctacacaatttaatt

SEQ ID NO: 4051551 - DNA, 21 bp, Homo sapiens
tctacacagcctggactttgg

SEQ ID NO: 4051552 - DNA, 18 bp, Homo sapiens
tctacagaataatccagt

SEQ ID NO: 4051553 - DNA, 16 bp, Homo sapiens
tctacagacttctcca

SEQ ID NO: 4051554 - DNA, 21 bp, Homo sapiens
tctacagatcctttttccatc

SEQ ID NO: 4051555 - DNA, 12 bp, Homo sapiens
tctcgtttttct

SEQ ID NO: 4051556 - DNA, 23 bp, Homo sapiens
tctctaaagcactaccgattctt

SEQ ID NO: 4051557 - DNA, 18 bp, Homo sapiens
tctctaacttattttatt

SEQ ID NO: 4051558 - DNA, 19 bp, Homo sapiens
tctctaattccatccataa

SEQ ID NO: 4051559 - DNA, 20 bp, Homo sapiens
tctctactaccacaaggaaa

SEQ ID NO: 4051560 - DNA, 12 bp, Homo sapiens
tctctactgctt

SEQ ID NO: 4051561 - DNA, 15 bp, Homo sapiens
tctctagctttgtca

SEQ ID NO: 4051562 - DNA, 14 bp, Homo sapiens
tctctatgtactat

SEQ ID NO: 4051563 - DNA, 14 bp, Homo sapiens
tctctattaaaatg

SEQ ID NO: 4051564 - DNA, 14 bp, Homo sapiens
tctctattccccac

SEQ ID NO: 4051565 - DNA, 17 bp, Homo sapiens
tctctatttaatattta

SEQ ID NO: 4051566 - DNA, 15 bp, Homo sapiens
tctctcaaattgtca

SEQ ID NO: 4051567 - DNA, 14 bp, Homo sapiens
tctctcagagcatc

SEQ ID NO: 4051568 - DNA, 18 bp, Homo sapiens
tctctcagagcatctggc

SEQ ID NO: 4051569 - DNA, 17 bp, Homo sapiens
tctctcagccttacatt

SEQ ID NO: 4051570 - DNA, 13 bp, Homo sapiens
tctctcaggagca

SEQ ID NO: 4051571 - DNA, 17 bp, Homo sapiens
tctctcaggagcacagg

SEQ ID NO: 4051572 - DNA, 19 bp, Homo sapiens
tctctcaggagcacaggca

SEQ ID NO: 4051573 - DNA, 21 bp, Homo sapiens
tctctcaggagcacaggcagc

SEQ ID NO: 4051574 - DNA, 16 bp, Homo sapiens
tctctccagatgtttc

SEQ ID NO: 4051575 - DNA, 14 bp, Homo sapiens
tctctcccttcctc

SEQ ID NO: 4051576 - DNA, 20 bp, Homo sapiens
tctctcccttcctctctcct

SEQ ID NO: 4051577 - DNA, 12 bp, Homo sapiens
tctctcctggcc

SEQ ID NO: 4051578 - DNA, 12 bp, Homo sapiens
tctctcctggct

SEQ ID NO: 4051579 - DNA, 14 bp, Homo sapiens
tctctcctggctgg

SEQ ID NO: 4051580 - DNA, 16 bp, Homo sapiens
tctctcctggctgggc

SEQ ID NO: 4051581 - DNA, 22 bp, Homo sapiens
tctctcctgtataaccccacct

SEQ ID NO: 4051582 - DNA, 12 bp, Homo sapiens
tctctctccaag

SEQ ID NO: 4051583 - DNA, 14 bp, Homo sapiens
tctctctccagggt

SEQ ID NO: 4051584 - DNA, 15 bp, Homo sapiens
tctctctccagggtg

SEQ ID NO: 4051585 - DNA, 14 bp, Homo sapiens
tctctctgcagctg

SEQ ID NO: 4051586 - DNA, 19 bp, Homo sapiens
tctctctggggccctgggc

SEQ ID NO: 4051587 - DNA, 14 bp, Homo sapiens
tctctctgtgaata

SEQ ID NO: 4051588 - DNA, 16 bp, Homo sapiens
tctctcttaaagttgg

SEQ ID NO: 4051589 - DNA, 20 bp, Homo sapiens
tctctcttctgctccaccct

SEQ ID NO: 4051590 - DNA, 13 bp, Homo sapiens
tctctcttgtcct

SEQ ID NO: 4051591 - DNA, 16 bp, Homo sapiens
tctctctttatacagc

SEQ ID NO: 4051592 - DNA, 15 bp, Homo sapiens
tctctctttcctcca

SEQ ID NO: 4051593 - DNA, 11 bp, Homo sapiens
tctctcttttg

SEQ ID NO: 4051594 - DNA, 15 bp, Homo sapiens
tctctgaacacaggc

SEQ ID NO: 4051595 - DNA, 19 bp, Homo sapiens
tctctgaacacaggcagct

SEQ ID NO: 4051596 - DNA, 14 bp, Homo sapiens
tctctgaatcctaa

SEQ ID NO: 4051597 - DNA, 13 bp, Homo sapiens
tctctgagactct

SEQ ID NO: 4051598 - DNA, 12 bp, Homo sapiens
tctctgaggcta

SEQ ID NO: 4051599 - DNA, 17 bp, Homo sapiens
tctctgagtctggactt

SEQ ID NO: 4051600 - DNA, 21 bp, Homo sapiens
tctctgcaatttgtttaaaga

SEQ ID NO: 4051601 - DNA, 14 bp, Homo sapiens
tctctgcagctgcc

SEQ ID NO: 4051602 - DNA, 12 bp, Homo sapiens
tctctgccaccc

SEQ ID NO: 4051603 - DNA, 14 bp, Homo sapiens
tctctgccacccac

SEQ ID NO: 4051604 - DNA, 15 bp, Homo sapiens
tctctgccacccact

SEQ ID NO: 4051605 - DNA, 18 bp, Homo sapiens
tctctgccacccactcag

SEQ ID NO: 4051606 - DNA, 14 bp, Homo sapiens
tctctgccagtgac

SEQ ID NO: 4051607 - DNA, 15 bp, Homo sapiens
tctctgccagtgaca

SEQ ID NO: 4051608 - DNA, 19 bp, Homo sapiens
tctctgcccagcttttcat

SEQ ID NO: 4051609 - DNA, 23 bp, Homo sapiens
tctctgccccacccaagcccaaa

SEQ ID NO: 4051610 - DNA, 12 bp, Homo sapiens
tctctgccctgt

SEQ ID NO: 4051611 - DNA, 14 bp, Homo sapiens
tctctgccctgtgt

SEQ ID NO: 4051612 - DNA, 16 bp, Homo sapiens
tctctgccgctacctc

SEQ ID NO: 4051613 - DNA, 22 bp, Homo sapiens
tctctgccgctacctccctccc

SEQ ID NO: 4051614 - DNA, 13 bp, Homo sapiens
tctctgctatata

SEQ ID NO: 4051615 - DNA, 11 bp, Homo sapiens
tctctgctcca

SEQ ID NO: 4051616 - DNA, 17 bp, Homo sapiens
tctctgctcgccctcct

SEQ ID NO: 4051617 - DNA, 22 bp, Homo sapiens
tctctgctcgccctcctttctg

SEQ ID NO: 4051618 - DNA, 12 bp, Homo sapiens
tctctgctggcc

SEQ ID NO: 4051619 - DNA, 15 bp, Homo sapiens
tctctgctggcccag

SEQ ID NO: 4051620 - DNA, 19 bp, Homo sapiens
tctctgctggcccagccaa

SEQ ID NO: 4051621 - DNA, 16 bp, Homo sapiens
tctctggacactgcca

SEQ ID NO: 4051622 - DNA, 17 bp, Homo sapiens
tctctgggacctcctta

SEQ ID NO: 4051623 - DNA, 14 bp, Homo sapiens
tctctggggccctg

SEQ ID NO: 4051624 - DNA, 20 bp, Homo sapiens
tctctggggccctgggcctc

SEQ ID NO: 4051625 - DNA, 17 bp, Homo sapiens
tctctggtaatattgac

SEQ ID NO: 4051626 - DNA, 19 bp, Homo sapiens
tctctgtcacccttgtcct

SEQ ID NO: 4051627 - DNA, 20 bp, Homo sapiens
tctctgtgtttgttcctaca

SEQ ID NO: 4051628 - DNA, 13 bp, Homo sapiens
tctctgttgtcgt

SEQ ID NO: 4051629 - DNA, 18 bp, Homo sapiens
tctctgttgtcgtaaaga

SEQ ID NO: 4051630 - DNA, 15 bp, Homo sapiens
tctcttagaaatact

SEQ ID NO: 4051631 - DNA, 16 bp, Homo sapiens
tctcttccaggcagcc

SEQ ID NO: 4051632 - DNA, 13 bp, Homo sapiens
tctcttccccaga

SEQ ID NO: 4051633 - DNA, 17 bp, Homo sapiens
tctcttccccagagagg

SEQ ID NO: 4051634 - DNA, 16 bp, Homo sapiens
tctcttccccttccct

SEQ ID NO: 4051635 - DNA, 23 bp, Homo sapiens
tctcttccctttccccagcatca

SEQ ID NO: 4051636 - DNA, 18 bp, Homo sapiens
tctcttctccccttccat

SEQ ID NO: 4051637 - DNA, 12 bp, Homo sapiens
tctcttctcctt

SEQ ID NO: 4051638 - DNA, 19 bp, Homo sapiens
tctcttctgctccaccctt

SEQ ID NO: 4051639 - DNA, 13 bp, Homo sapiens
tctcttctggtgt

SEQ ID NO: 4051640 - DNA, 13 bp, Homo sapiens
tctcttctgtgtt

SEQ ID NO: 4051641 - DNA, 13 bp, Homo sapiens
tctcttgagggag

SEQ ID NO: 4051642 - DNA, 16 bp, Homo sapiens
tctcttgggaactgaa

SEQ ID NO: 4051643 - DNA, 21 bp, Homo sapiens
tctctttaaaaggaaagaaaa

SEQ ID NO: 4051644 - DNA, 23 bp, Homo sapiens
tctctttagtataattgacctac

SEQ ID NO: 4051645 - DNA, 23 bp, Homo sapiens
tctctttctccttagtcttctca

SEQ ID NO: 4051646 - DNA, 13 bp, Homo sapiens
tctctttctctct

SEQ ID NO: 4051647 - DNA, 15 bp, Homo sapiens
tctctttctctcttc

SEQ ID NO: 4051648 - DNA, 19 bp, Homo sapiens
tctctttctctcttccctc

SEQ ID NO: 4051649 - DNA, 11 bp, Homo sapiens
tctctttgccc

SEQ ID NO: 4051650 - DNA, 20 bp, Homo sapiens
tctcttttatatttgtagga

SEQ ID NO: 4051651 - DNA, 21 bp, Homo sapiens
tctcttttcccctttcctgtc

SEQ ID NO: 4051652 - DNA, 21 bp, Homo sapiens
tctcttttctttctgtcttgt

SEQ ID NO: 4051653 - DNA, 14 bp, Homo sapiens
tctgaaaatataac

SEQ ID NO: 4051654 - DNA, 13 bp, Homo sapiens
tctgaaaatgtat

SEQ ID NO: 4051655 - DNA, 16 bp, Homo sapiens
tctgaaaatgtatgtg

SEQ ID NO: 4051656 - DNA, 23 bp, Homo sapiens
tctgaaaatgtatgtgtaagtat

SEQ ID NO: 4051657 - DNA, 22 bp, Homo sapiens
tctgaaaattccagaaaggata

SEQ ID NO: 4051658 - DNA, 23 bp, Homo sapiens
tctgaaaattccagaaaggatat

SEQ ID NO: 4051659 - DNA, 13 bp, Homo sapiens
ccagctgactgtg

SEQ ID NO: 4051660 - DNA, 16 bp, Homo sapiens
ccagctgactgtggcc

SEQ ID NO: 4051661 - DNA, 15 bp, Homo sapiens
ccagctgagcgccag

SEQ ID NO: 4051662 - DNA, 17 bp, Homo sapiens
ccagctgagcgccagga

SEQ ID NO: 4051663 - DNA, 17 bp, Homo sapiens
ccagctgcaccagagca

SEQ ID NO: 4051664 - DNA, 18 bp, Homo sapiens
ccagctgcactgatgctg

SEQ ID NO: 4051665 - DNA, 15 bp, Homo sapiens
ccagctgcagcccct

SEQ ID NO: 4051666 - DNA, 18 bp, Homo sapiens
ccagctgccccggcccct

SEQ ID NO: 4051667 - DNA, 21 bp, Homo sapiens
ccagctgccctatgggcctgc

SEQ ID NO: 4051668 - DNA, 12 bp, Homo sapiens
ccagctgcctgg

SEQ ID NO: 4051669 - DNA, 13 bp, Homo sapiens
ccagctgcctggg

SEQ ID NO: 4051670 - DNA, 14 bp, Homo sapiens
ccagctgcctgggc

SEQ ID NO: 4051671 - DNA, 15 bp, Homo sapiens
ccagctgcctgggcc

SEQ ID NO: 4051672 - DNA, 16 bp, Homo sapiens
ccagctgcgcttgctt

SEQ ID NO: 4051673 - DNA, 11 bp, Homo sapiens
ccagctgctgt

SEQ ID NO: 4051674 - DNA, 13 bp, Homo sapiens
ccagctgcttttt

SEQ ID NO: 4051675 - DNA, 17 bp, Homo sapiens
ccagctgggagcactgg

SEQ ID NO: 4051676 - DNA, 16 bp, Homo sapiens
ccagctgggctctgca

SEQ ID NO: 4051677 - DNA, 18 bp, Homo sapiens
ccagctgggctctgcaat

SEQ ID NO: 4051678 - DNA, 12 bp, Homo sapiens
ccagctggggcc

SEQ ID NO: 4051679 - DNA, 17 bp, Homo sapiens
ccagctgggtcaggcag

SEQ ID NO: 4051680 - DNA, 15 bp, Homo sapiens
ccagctgtgcacttt

SEQ ID NO: 4051681 - DNA, 12 bp, Homo sapiens
ccagctgtgtcc

SEQ ID NO: 4051682 - DNA, 18 bp, Homo sapiens
ccagctgtgtccttcggg

SEQ ID NO: 4051683 - DNA, 12 bp, Homo sapiens
ccagcttcactc

SEQ ID NO: 4051684 - DNA, 14 bp, Homo sapiens
ccagcttcacttct

SEQ ID NO: 4051685 - DNA, 15 bp, Homo sapiens
ccagcttcacttctg

SEQ ID NO: 4051686 - DNA, 20 bp, Homo sapiens
ccagcttcacttctgactct

SEQ ID NO: 4051687 - DNA, 17 bp, Homo sapiens
ccagcttcaggcaccag

SEQ ID NO: 4051688 - DNA, 22 bp, Homo sapiens
ccagcttcaggcaccagcatcc

SEQ ID NO: 4051689 - DNA, 15 bp, Homo sapiens
ccagcttctccaggc

SEQ ID NO: 4051690 - DNA, 14 bp, Homo sapiens
ccagcttctctctc

SEQ ID NO: 4051691 - DNA, 19 bp, Homo sapiens
ccagcttctctctccaggg

SEQ ID NO: 4051692 - DNA, 16 bp, Homo sapiens
ccagcttgttatttat

SEQ ID NO: 4051693 - DNA, 17 bp, Homo sapiens
ccagcttgttctgggct

SEQ ID NO: 4051694 - DNA, 18 bp, Homo sapiens
ccagcttgttctgggctc

SEQ ID NO: 4051695 - DNA, 19 bp, Homo sapiens
ccagcttgttctgggctca

SEQ ID NO: 4051696 - DNA, 16 bp, Homo sapiens
ccagcttttcctccct

SEQ ID NO: 4051697 - DNA, 20 bp, Homo sapiens
ccaggaaactccacatctgc

SEQ ID NO: 4051698 - DNA, 23 bp, Homo sapiens
ccaggaaactccacatctgcctt

SEQ ID NO: 4051699 - DNA, 22 bp, Homo sapiens
ccaggaacacccgactcctcaa

SEQ ID NO: 4051700 - DNA, 16 bp, Homo sapiens
ccaggaagaagcaggg

SEQ ID NO: 4051701 - DNA, 14 bp, Homo sapiens
ccaggaagccagag

SEQ ID NO: 4051702 - DNA, 16 bp, Homo sapiens
ccaggaagccagagcc

SEQ ID NO: 4051703 - DNA, 17 bp, Homo sapiens
ccaggaagccagagccc

SEQ ID NO: 4051704 - DNA, 22 bp, Homo sapiens
ccaggaaggtagcccagcactg

SEQ ID NO: 4051705 - DNA, 23 bp, Homo sapiens
ccaggaatcggagcgaagcagag

SEQ ID NO: 4051706 - DNA, 14 bp, Homo sapiens
ccaggaatttccca

SEQ ID NO: 4051707 - DNA, 21 bp, Homo sapiens
ccaggaatttcccaggaccct

SEQ ID NO: 4051708 - DNA, 22 bp, Homo sapiens
ccaggaatttcccaggaccctg

SEQ ID NO: 4051709 - DNA, 20 bp, Homo sapiens
ccaggacccccgaggggagg

SEQ ID NO: 4051710 - DNA, 19 bp, Homo sapiens
ccaggaccctgaaggggcc

SEQ ID NO: 4051711 - DNA, 23 bp, Homo sapiens
ccaggaccctgaaggggccatga

SEQ ID NO: 4051712 - DNA, 16 bp, Homo sapiens
ccaggacgaattgaga

SEQ ID NO: 4051713 - DNA, 23 bp, Homo sapiens
ccaggacgcttctgaatgctgct

SEQ ID NO: 4051714 - DNA, 20 bp, Homo sapiens
ccaggactatagcccaggtc

SEQ ID NO: 4051715 - DNA, 22 bp, Homo sapiens
ccaggactatagcccaggtcct

SEQ ID NO: 4051716 - DNA, 21 bp, Homo sapiens
ccaggactatatttgggcctg

SEQ ID NO: 4051717 - DNA, 17 bp, Homo sapiens
ccaggactccctcctca

SEQ ID NO: 4051718 - DNA, 18 bp, Homo sapiens
ccaggactccctcctcac

SEQ ID NO: 4051719 - DNA, 20 bp, Homo sapiens
ccaggacttggggtcaggaa

SEQ ID NO: 4051720 - DNA, 23 bp, Homo sapiens
ccaggagaaccactacatgcagc

SEQ ID NO: 4051721 - DNA, 22 bp, Homo sapiens
ccaggagacagaccacttgcca

SEQ ID NO: 4051722 - DNA, 12 bp, Homo sapiens
ccaggagatggg

SEQ ID NO: 4051723 - DNA, 16 bp, Homo sapiens
ccaggagcaatgggac

SEQ ID NO: 4051724 - DNA, 18 bp, Homo sapiens
ccaggagcaatgggactg

SEQ ID NO: 4051725 - DNA, 21 bp, Homo sapiens
ccaggagcaatgggactggag

SEQ ID NO: 4051726 - DNA, 18 bp, Homo sapiens
ccaggagcagatggacag

SEQ ID NO: 4051727 - DNA, 18 bp, Homo sapiens
ccaggagctgatggcagc

SEQ ID NO: 4051728 - DNA, 15 bp, Homo sapiens
ccaggagctgtcacc

SEQ ID NO: 4051729 - DNA, 22 bp, Homo sapiens
ccaggagcttcttgtttccttg

SEQ ID NO: 4051730 - DNA, 18 bp, Homo sapiens
ccaggagggaccaccctc

SEQ ID NO: 4051731 - DNA, 20 bp, Homo sapiens
ccaggagggcatccatacca

SEQ ID NO: 4051732 - DNA, 22 bp, Homo sapiens
ccaggaggtggctatggccacc

SEQ ID NO: 4051733 - DNA, 22 bp, Homo sapiens
ccaggataaggagactgaggct

SEQ ID NO: 4051734 - DNA, 23 bp, Homo sapiens
ccaggatcatggtgtaataagac

SEQ ID NO: 4051735 - DNA, 18 bp, Homo sapiens
ccaggatcccaagcctcc

SEQ ID NO: 4051736 - DNA, 18 bp, Homo sapiens
ccaggatcgttttttccc

SEQ ID NO: 4051737 - DNA, 20 bp, Homo sapiens
ccaggattttaacaaaagca

SEQ ID NO: 4051738 - DNA, 18 bp, Homo sapiens
ccaggcaagtgggaccag

SEQ ID NO: 4051739 - DNA, 15 bp, Homo sapiens
ccaggcacagctgag

SEQ ID NO: 4051740 - DNA, 19 bp, Homo sapiens
ccaggcacagggcccgcag

SEQ ID NO: 4051741 - DNA, 14 bp, Homo sapiens
ccaggcaccctcag

SEQ ID NO: 4051742 - DNA, 15 bp, Homo sapiens
ccaggcaccctcagg

SEQ ID NO: 4051743 - DNA, 13 bp, Homo sapiens
ccaggcactgcct

SEQ ID NO: 4051744 - DNA, 19 bp, Homo sapiens
ccaggcactgccttctcct

SEQ ID NO: 4051745 - DNA, 19 bp, Homo sapiens
ccaggcagatccaggacta

SEQ ID NO: 4051746 - DNA, 13 bp, Homo sapiens
ccaggcagatctg

SEQ ID NO: 4051747 - DNA, 15 bp, Homo sapiens
ccaggcaggggtggg

SEQ ID NO: 4051748 - DNA, 17 bp, Homo sapiens
ccaggcaggtgcctgga

SEQ ID NO: 4051749 - DNA, 19 bp, Homo sapiens
ccaggcaggtgcctggaca

SEQ ID NO: 4051750 - DNA, 13 bp, Homo sapiens
ccaggccaacagc

SEQ ID NO: 4051751 - DNA, 15 bp, Homo sapiens
ccaggccaccaggat

SEQ ID NO: 4051752 - DNA, 13 bp, Homo sapiens
ccaggccagcctc

SEQ ID NO: 4051753 - DNA, 14 bp, Homo sapiens
ccaggccagcctcc

SEQ ID NO: 4051754 - DNA, 12 bp, Homo sapiens
ccaggccaggcc

SEQ ID NO: 4051755 - DNA, 15 bp, Homo sapiens
ccaggcccaggcctc

SEQ ID NO: 4051756 - DNA, 18 bp, Homo sapiens
ccaggcccatgccaaggc

SEQ ID NO: 4051757 - DNA, 22 bp, Homo sapiens
ccaggcccatgccaaggcctcc

SEQ ID NO: 4051758 - DNA, 16 bp, Homo sapiens
ccaggccccagacagg

SEQ ID NO: 4051759 - DNA, 20 bp, Homo sapiens
ccaggccccagacagggtgg

SEQ ID NO: 4051760 - DNA, 15 bp, Homo sapiens
ccaggcccccctgtc

SEQ ID NO: 4051761 - DNA, 22 bp, Homo sapiens
ccaggcccgcaccccggcctca

SEQ ID NO: 4051762 - DNA, 18 bp, Homo sapiens
ccaggttttgcactcttg

SEQ ID NO: 4051763 - DNA, 12 bp, Homo sapiens
ccagtaacacag

SEQ ID NO: 4051764 - DNA, 21 bp, Homo sapiens
ccagtaacgcgtcttcctgag

SEQ ID NO: 4051765 - DNA, 15 bp, Homo sapiens
ccagtacctccaagc

SEQ ID NO: 4051766 - DNA, 16 bp, Homo sapiens
ccagtacctccaagca

SEQ ID NO: 4051767 - DNA, 16 bp, Homo sapiens
ccagtacctttgtcac

SEQ ID NO: 4051768 - DNA, 17 bp, Homo sapiens
ccagtacctttgtcaca

SEQ ID NO: 4051769 - DNA, 13 bp, Homo sapiens
ccagtattctcag

SEQ ID NO: 4051770 - DNA, 21 bp, Homo sapiens
ccagtattctcagagcatgtg

SEQ ID NO: 4051771 - DNA, 13 bp, Homo sapiens
ccagtattgctga

SEQ ID NO: 4051772 - DNA, 16 bp, Homo sapiens
ccagtcaagaagaaaa

SEQ ID NO: 4051773 - DNA, 14 bp, Homo sapiens
ccagtcacatgacc

SEQ ID NO: 4051774 - DNA, 21 bp, Homo sapiens
ccagtcacatgacctgatcac

SEQ ID NO: 4051775 - DNA, 15 bp, Homo sapiens
ccagtcacctcccca

SEQ ID NO: 4051776 - DNA, 19 bp, Homo sapiens
ccagtcaggtagttgcaat

SEQ ID NO: 4051777 - DNA, 21 bp, Homo sapiens
ccagtccaaatgtcctccaga

SEQ ID NO: 4051778 - DNA, 16 bp, Homo sapiens
ccagtccccagaactc

SEQ ID NO: 4051779 - DNA, 21 bp, Homo sapiens
ccagtccccagaactctgcct

SEQ ID NO: 4051780 - DNA, 18 bp, Homo sapiens
ccagtccccttcccgtga

SEQ ID NO: 4051781 - DNA, 13 bp, Homo sapiens
ccagtcctccact

SEQ ID NO: 4051782 - DNA, 21 bp, Homo sapiens
ccagtcctccactcgacccag

SEQ ID NO: 4051783 - DNA, 15 bp, Homo sapiens
ccagtcctcctggga

SEQ ID NO: 4051784 - DNA, 16 bp, Homo sapiens
ccagtcctcctgggag

SEQ ID NO: 4051785 - DNA, 14 bp, Homo sapiens
ccagtcctgcctgg

SEQ ID NO: 4051786 - DNA, 17 bp, Homo sapiens
ccagtcggccccatctc

SEQ ID NO: 4051787 - DNA, 14 bp, Homo sapiens
ccagtctcccaggc

SEQ ID NO: 4051788 - DNA, 19 bp, Homo sapiens
ccagtctcccaggccccct

SEQ ID NO: 4051789 - DNA, 21 bp, Homo sapiens
ccagtctcccaggccccctgc

SEQ ID NO: 4051790 - DNA, 14 bp, Homo sapiens
ccagtgaaatgtga

SEQ ID NO: 4051791 - DNA, 14 bp, Homo sapiens
ccagtgaactcctg

SEQ ID NO: 4051792 - DNA, 15 bp, Homo sapiens
ccagtgacagacagg

SEQ ID NO: 4051793 - DNA, 21 bp, Homo sapiens
ccagtgacagacaggctctta

SEQ ID NO: 4051794 - DNA, 18 bp, Homo sapiens
ccagtgacagtcagggaa

SEQ ID NO: 4051795 - DNA, 23 bp, Homo sapiens
ccagtgaccccagaaaagcataa

SEQ ID NO: 4051796 - DNA, 20 bp, Homo sapiens
ccagtgacctggaaggccca

SEQ ID NO: 4051797 - DNA, 21 bp, Homo sapiens
ccagtgagactgccccacgga

SEQ ID NO: 4051798 - DNA, 17 bp, Homo sapiens
ccagtgataatgcccca

SEQ ID NO: 4051799 - DNA, 20 bp, Homo sapiens
ccagtgataatgccccaagg

SEQ ID NO: 4051800 - DNA, 21 bp, Homo sapiens
ccagtgataatgccccaagga

SEQ ID NO: 4051801 - DNA, 23 bp, Homo sapiens
ccagtgataatgccccaaggaca

SEQ ID NO: 4051802 - DNA, 20 bp, Homo sapiens
ccagtgcacagggaagggct

SEQ ID NO: 4051803 - DNA, 14 bp, Homo sapiens
ccagtgccattcca

SEQ ID NO: 4051804 - DNA, 24 bp, Homo sapiens
ccagtgccattccactccactcag

SEQ ID NO: 4051805 - DNA, 16 bp, Homo sapiens
ccagtgcccccactga

SEQ ID NO: 4051806 - DNA, 18 bp, Homo sapiens
ccagtgcccccactgacc

SEQ ID NO: 4051807 - DNA, 15 bp, Homo sapiens
ccagtgctctgcctc

SEQ ID NO: 4051808 - DNA, 17 bp, Homo sapiens
ccagtgctctgcctcag

SEQ ID NO: 4051809 - DNA, 20 bp, Homo sapiens
ccagtgctctgcctcagacg

SEQ ID NO: 4051810 - DNA, 21 bp, Homo sapiens
ccagtggatgccacagcccag

SEQ ID NO: 4051811 - DNA, 15 bp, Homo sapiens
ccagtggccactcag

SEQ ID NO: 4051812 - DNA, 16 bp, Homo sapiens
ccagtggccactcagc

SEQ ID NO: 4051813 - DNA, 17 bp, Homo sapiens
ccagtggccactcagct

SEQ ID NO: 4051814 - DNA, 20 bp, Homo sapiens
ccagtggcgttgttgcatgt

SEQ ID NO: 4051815 - DNA, 21 bp, Homo sapiens
ccagtgggaccacatgccact

SEQ ID NO: 4051816 - DNA, 19 bp, Homo sapiens
ccagtgggatgggacaggg

SEQ ID NO: 4051817 - DNA, 19 bp, Homo sapiens
ccagtgggcgggccatgag

SEQ ID NO: 4051818 - DNA, 14 bp, Homo sapiens
ccagtggggcctgt

SEQ ID NO: 4051819 - DNA, 16 bp, Homo sapiens
ccagtggggcctgtgg

SEQ ID NO: 4051820 - DNA, 17 bp, Homo sapiens
ccagtggggcctgtgga

SEQ ID NO: 4051821 - DNA, 19 bp, Homo sapiens
ccagtgtcacctctctcag

SEQ ID NO: 4051822 - DNA, 20 bp, Homo sapiens
ccagtgtcacctctctcaga

SEQ ID NO: 4051823 - DNA, 21 bp, Homo sapiens
ccagtgtcacctctctcagag

SEQ ID NO: 4051824 - DNA, 23 bp, Homo sapiens
ccagtgtcacctctctcagagca

SEQ ID NO: 4051825 - DNA, 19 bp, Homo sapiens
ccagtgtcctccaagtgcc

SEQ ID NO: 4051826 - DNA, 20 bp, Homo sapiens
ccagtgtgggcttgaccagg

SEQ ID NO: 4051827 - DNA, 23 bp, Homo sapiens
ccagtgttgtttgtaaataagag

SEQ ID NO: 4051828 - DNA, 21 bp, Homo sapiens
ccagttagactagtccccggt

SEQ ID NO: 4051829 - DNA, 19 bp, Homo sapiens
ccagttcaatctcccgctg

SEQ ID NO: 4051830 - DNA, 14 bp, Homo sapiens
ccagttcagacact

SEQ ID NO: 4051831 - DNA, 22 bp, Homo sapiens
ccagttctaggggagaagagcc

SEQ ID NO: 4051832 - DNA, 12 bp, Homo sapiens
ccagttggcaga

SEQ ID NO: 4051833 - DNA, 15 bp, Homo sapiens
ccagttggcagacag

SEQ ID NO: 4051834 - DNA, 17 bp, Homo sapiens
ccagttgggagcactgg

SEQ ID NO: 4051835 - DNA, 23 bp, Homo sapiens
ccagttggggaagccaggtgagc

SEQ ID NO: 4051836 - DNA, 18 bp, Homo sapiens
ccagtttattccagagct

SEQ ID NO: 4051837 - DNA, 19 bp, Homo sapiens
ccagtttgaagcctgtgcc

SEQ ID NO: 4051838 - DNA, 17 bp, Homo sapiens
ccagtttgcacctgtcc

SEQ ID NO: 4051839 - DNA, 12 bp, Homo sapiens
ccagttttcatt

SEQ ID NO: 4051840 - DNA, 13 bp, Homo sapiens
ccagttttcattt

SEQ ID NO: 4051841 - DNA, 15 bp, Homo sapiens
ccagttttccctgga

SEQ ID NO: 4051842 - DNA, 16 bp, Homo sapiens
ccagttttccctggaa

SEQ ID NO: 4051843 - DNA, 17 bp, Homo sapiens
ccataaatccagttcta

SEQ ID NO: 4051844 - DNA, 15 bp, Homo sapiens
ccataacagccaaca

SEQ ID NO: 4051845 - DNA, 15 bp, Homo sapiens
ccataacctctgggg

SEQ ID NO: 4051846 - DNA, 12 bp, Homo sapiens
ccataataaagc

SEQ ID NO: 4051847 - DNA, 13 bp, Homo sapiens
ccataataaagca

SEQ ID NO: 4051848 - DNA, 15 bp, Homo sapiens
ccataataaagcaat

SEQ ID NO: 4051849 - DNA, 19 bp, Homo sapiens
ccataatgtataaagaaca

SEQ ID NO: 4051850 - DNA, 16 bp, Homo sapiens
ccatacacagaggagt

SEQ ID NO: 4051851 - DNA, 13 bp, Homo sapiens
ccataccttttct

SEQ ID NO: 4051852 - DNA, 15 bp, Homo sapiens
ccataccttttctct

SEQ ID NO: 4051853 - DNA, 13 bp, Homo sapiens
ccatactcagcct

SEQ ID NO: 4051854 - DNA, 14 bp, Homo sapiens
ccatactcagcctg

SEQ ID NO: 4051855 - DNA, 21 bp, Homo sapiens
ccatactcagcctgctgccca

SEQ ID NO: 4051856 - DNA, 20 bp, Homo sapiens
ccatactccttgcttcctga

SEQ ID NO: 4051857 - DNA, 17 bp, Homo sapiens
ccatacttttggctcct

SEQ ID NO: 4051858 - DNA, 20 bp, Homo sapiens
ccatagaaaacttgacatgt

SEQ ID NO: 4051859 - DNA, 16 bp, Homo sapiens
ccatagataggcccct

SEQ ID NO: 4051860 - DNA, 14 bp, Homo sapiens
ccatagcaacagga

SEQ ID NO: 4051861 - DNA, 15 bp, Homo sapiens
ccatagcttccatga

SEQ ID NO: 4051862 - DNA, 19 bp, Homo sapiens
ccataggtttctctccctc

SEQ ID NO: 4051863 - DNA, 20 bp, Homo sapiens
ccataggtttctctccctcc

SEQ ID NO: 4051864 - DNA, 15 bp, Homo sapiens
ccatatacacctgga

SEQ ID NO: 4051865 - DNA, 13 bp, Homo sapiens
ccatggccctgtc

SEQ ID NO: 4051866 - DNA, 18 bp, Homo sapiens
ccatggccctgtcccagg

SEQ ID NO: 4051867 - DNA, 13 bp, Homo sapiens
ccatggcctttct

SEQ ID NO: 4051868 - DNA, 14 bp, Homo sapiens
ccatggcctttcta

SEQ ID NO: 4051869 - DNA, 13 bp, Homo sapiens
ccatgggagccag

SEQ ID NO: 4051870 - DNA, 14 bp, Homo sapiens
ccatgggagccagc

SEQ ID NO: 4051871 - DNA, 19 bp, Homo sapiens
ccatgggagccagctgctt

SEQ ID NO: 4051872 - DNA, 14 bp, Homo sapiens
ccatgggatatgtg

SEQ ID NO: 4051873 - DNA, 14 bp, Homo sapiens
ccatgggcagagga

SEQ ID NO: 4051874 - DNA, 17 bp, Homo sapiens
ccatgggctcctgcccc

SEQ ID NO: 4051875 - DNA, 19 bp, Homo sapiens
ccatgggctcctgcccctt

SEQ ID NO: 4051876 - DNA, 16 bp, Homo sapiens
ccatgggcttcactgt

SEQ ID NO: 4051877 - DNA, 21 bp, Homo sapiens
ccatgggcttcactgtataaa

SEQ ID NO: 4051878 - DNA, 19 bp, Homo sapiens
ccatggggccctcccagaa

SEQ ID NO: 4051879 - DNA, 15 bp, Homo sapiens
ccatgtaagcactct

SEQ ID NO: 4051880 - DNA, 16 bp, Homo sapiens
ccatgtacatgaagaa

SEQ ID NO: 4051881 - DNA, 15 bp, Homo sapiens
ccatgtactgtagtt

SEQ ID NO: 4051882 - DNA, 15 bp, Homo sapiens
ccatgtattcatcca

SEQ ID NO: 4051883 - DNA, 17 bp, Homo sapiens
ccatgtattcatccaga

SEQ ID NO: 4051884 - DNA, 16 bp, Homo sapiens
ccatgtatttatctct

SEQ ID NO: 4051885 - DNA, 13 bp, Homo sapiens
ccatgtcatgtga

SEQ ID NO: 4051886 - DNA, 20 bp, Homo sapiens
ccatgtccaaagaggctgcc

SEQ ID NO: 4051887 - DNA, 23 bp, Homo sapiens
ccatgtccaagttcttcacctct

SEQ ID NO: 4051888 - DNA, 17 bp, Homo sapiens
ccatgtgagccaccgct

SEQ ID NO: 4051889 - DNA, 19 bp, Homo sapiens
ccatgtgagctgctgccat

SEQ ID NO: 4051890 - DNA, 20 bp, Homo sapiens
ccatgtgagctgctgccatg

SEQ ID NO: 4051891 - DNA, 22 bp, Homo sapiens
ccatgtgcacccggcctggatg

SEQ ID NO: 4051892 - DNA, 16 bp, Homo sapiens
ccatgtgcctttcttt

SEQ ID NO: 4051893 - DNA, 17 bp, Homo sapiens
ccatgtgcctttctttg

SEQ ID NO: 4051894 - DNA, 19 bp, Homo sapiens
ccatgtgtcacttgtgctt

SEQ ID NO: 4051895 - DNA, 17 bp, Homo sapiens
ccatgtgtcccctcact

SEQ ID NO: 4051896 - DNA, 18 bp, Homo sapiens
ccatgttagtttttactt

SEQ ID NO: 4051897 - DNA, 22 bp, Homo sapiens
ccatgttcacaccgctgcactc

SEQ ID NO: 4051898 - DNA, 14 bp, Homo sapiens
ccattaaagtctga

SEQ ID NO: 4051899 - DNA, 15 bp, Homo sapiens
ccattaaagtctgaa

SEQ ID NO: 4051900 - DNA, 15 bp, Homo sapiens
ccattaaagttctca

SEQ ID NO: 4051901 - DNA, 23 bp, Homo sapiens
ccattaagtcatgtgtgaacaca

SEQ ID NO: 4051902 - DNA, 13 bp, Homo sapiens
ccattaggccagc

SEQ ID NO: 4051903 - DNA, 14 bp, Homo sapiens
ccattccaaagctt

SEQ ID NO: 4051904 - DNA, 18 bp, Homo sapiens
ccattccactccactcag

SEQ ID NO: 4051905 - DNA, 15 bp, Homo sapiens
ccattccctccattt

SEQ ID NO: 4051906 - DNA, 16 bp, Homo sapiens
ccattcctgaagaacc

SEQ ID NO: 4051907 - DNA, 11 bp, Homo sapiens
ccattcctgat

SEQ ID NO: 4051908 - DNA, 13 bp, Homo sapiens
ccattctccacag

SEQ ID NO: 4051909 - DNA, 16 bp, Homo sapiens
ccattctccacagcaa

SEQ ID NO: 4051910 - DNA, 22 bp, Homo sapiens
ccattctcccaggtaccagctg

SEQ ID NO: 4051911 - DNA, 12 bp, Homo sapiens
ccattctgtttt

SEQ ID NO: 4051912 - DNA, 17 bp, Homo sapiens
ccattctgttttccccc

SEQ ID NO: 4051913 - DNA, 20 bp, Homo sapiens
ccattgaagccgactctggc

SEQ ID NO: 4051914 - DNA, 16 bp, Homo sapiens
ccattgccaccaggag

SEQ ID NO: 4051915 - DNA, 17 bp, Homo sapiens
ccattgccaccaggaga

SEQ ID NO: 4051916 - DNA, 17 bp, Homo sapiens
ccattgccccagacctg

SEQ ID NO: 4051917 - DNA, 21 bp, Homo sapiens
ccattggctatttaaaacttg

SEQ ID NO: 4051918 - DNA, 16 bp, Homo sapiens
ccattggttggaagct

SEQ ID NO: 4051919 - DNA, 19 bp, Homo sapiens
ccattgtgaagcacctact

SEQ ID NO: 4051920 - DNA, 20 bp, Homo sapiens
ccattgttggcgctgaggtg

SEQ ID NO: 4051921 - DNA, 20 bp, Homo sapiens
ccatttaataaagaaatatt

SEQ ID NO: 4051922 - DNA, 22 bp, Homo sapiens
ccatttacatgttttaaagaaa

SEQ ID NO: 4051923 - DNA, 16 bp, Homo sapiens
ccatttatatatgaaa

SEQ ID NO: 4051924 - DNA, 18 bp, Homo sapiens
ccatttatatatgaaaac

SEQ ID NO: 4051925 - DNA, 19 bp, Homo sapiens
ccatttcaggaatttaaaa

SEQ ID NO: 4051926 - DNA, 20 bp, Homo sapiens
ccatttcaggaatttaaaat

SEQ ID NO: 4051927 - DNA, 21 bp, Homo sapiens
ccatttcagtaaacctgtctg

SEQ ID NO: 4051928 - DNA, 22 bp, Homo sapiens
ccatttcagtaaacctgtctga

SEQ ID NO: 4051929 - DNA, 15 bp, Homo sapiens
ccatttcccacatct

SEQ ID NO: 4051930 - DNA, 16 bp, Homo sapiens
ccatttcccatctgca

SEQ ID NO: 4051931 - DNA, 18 bp, Homo sapiens
ccatttcccatctgcacc

SEQ ID NO: 4051932 - DNA, 18 bp, Homo sapiens
ccatttcccgcacatggt

SEQ ID NO: 4051933 - DNA, 22 bp, Homo sapiens
ccatttcccttctggacactga

SEQ ID NO: 4051934 - DNA, 13 bp, Homo sapiens
ccatttccttatg

SEQ ID NO: 4051935 - DNA, 17 bp, Homo sapiens
ccatttccttatgctgt

SEQ ID NO: 4051936 - DNA, 13 bp, Homo sapiens
ccatttccttgga

SEQ ID NO: 4051937 - DNA, 22 bp, Homo sapiens
ccatttccttggaggccaccgg

SEQ ID NO: 4051938 - DNA, 20 bp, Homo sapiens
ccatttccttttctctgccc

SEQ ID NO: 4051939 - DNA, 17 bp, Homo sapiens
ccatttctcactagtgt

SEQ ID NO: 4051940 - DNA, 16 bp, Homo sapiens
ccatttctcactgaga

SEQ ID NO: 4051941 - DNA, 17 bp, Homo sapiens
ccatttctctacactaa

SEQ ID NO: 4051942 - DNA, 13 bp, Homo sapiens
ccatttctgcctc

SEQ ID NO: 4051943 - DNA, 15 bp, Homo sapiens
ccatttcttcctcac

SEQ ID NO: 4051944 - DNA, 18 bp, Homo sapiens
ccatttcttcctcactat

SEQ ID NO: 4051945 - DNA, 13 bp, Homo sapiens
ccatttgaagtgt

SEQ ID NO: 4051946 - DNA, 19 bp, Homo sapiens
ccatttgcctttctgggag

SEQ ID NO: 4051947 - DNA, 12 bp, Homo sapiens
ccatttgtaata

SEQ ID NO: 4051948 - DNA, 14 bp, Homo sapiens
ccatttgtcccaga

SEQ ID NO: 4051949 - DNA, 17 bp, Homo sapiens
ccatttgtcccagacta

SEQ ID NO: 4051950 - DNA, 21 bp, Homo sapiens
ccatttgtgtacacagtcagc

SEQ ID NO: 4051951 - DNA, 22 bp, Homo sapiens
ccattttcccccactactgcag

SEQ ID NO: 4051952 - DNA, 14 bp, Homo sapiens
ccattttgcaaaat

SEQ ID NO: 4051953 - DNA, 17 bp, Homo sapiens
ccattttgcaaaatttc

SEQ ID NO: 4051954 - DNA, 19 bp, Homo sapiens
ccattttgcccttccatag

SEQ ID NO: 4051955 - DNA, 18 bp, Homo sapiens
ccattttggtgtctttct

SEQ ID NO: 4051956 - DNA, 19 bp, Homo sapiens
ccattttggtgtctttctc

SEQ ID NO: 4051957 - DNA, 21 bp, Homo sapiens
ccattttggtgtctttctctt

SEQ ID NO: 4051958 - DNA, 22 bp, Homo sapiens
ccattttggtgtctttctcttt

SEQ ID NO: 4051959 - DNA, 14 bp, Homo sapiens
cccaaaagattgct

SEQ ID NO: 4051960 - DNA, 17 bp, Homo sapiens
cccaaacaaatatgcaa

SEQ ID NO: 4051961 - DNA, 20 bp, Homo sapiens
cccaaacaaatatgcaaaag

SEQ ID NO: 4051962 - DNA, 16 bp, Homo sapiens
cccaaacaccttccag

SEQ ID NO: 4051963 - DNA, 19 bp, Homo sapiens
cccaaacaccttccagctc

SEQ ID NO: 4051964 - DNA, 19 bp, Homo sapiens
cccaaacccaagtgccttc

SEQ ID NO: 4051965 - DNA, 18 bp, Homo sapiens
cccaaagagcctggagaa

SEQ ID NO: 4051966 - DNA, 19 bp, Homo sapiens
cccaaagagcctggagaag

SEQ ID NO: 4051967 - DNA, 19 bp, Homo sapiens
cccaaagcggtccctgtcc

SEQ ID NO: 4051968 - DNA, 14 bp, Homo sapiens
cccacccctcactc

SEQ ID NO: 4051969 - DNA, 13 bp, Homo sapiens
cccacccctccat

SEQ ID NO: 4051970 - DNA, 15 bp, Homo sapiens
cccacccctggaaga

SEQ ID NO: 4051971 - DNA, 18 bp, Homo sapiens
cccacccgacctggctgc

SEQ ID NO: 4051972 - DNA, 13 bp, Homo sapiens
cccaccctccact

SEQ ID NO: 4051973 - DNA, 14 bp, Homo sapiens
cccaccctccctgg

SEQ ID NO: 4051974 - DNA, 18 bp, Homo sapiens
cccaccctccctggagtg

SEQ ID NO: 4051975 - DNA, 13 bp, Homo sapiens
cccaccctcctgc

SEQ ID NO: 4051976 - DNA, 18 bp, Homo sapiens
cccaccctggtgggccaa

SEQ ID NO: 4051977 - DNA, 19 bp, Homo sapiens
cccaccgtggaggaggaag

SEQ ID NO: 4051978 - DNA, 19 bp, Homo sapiens
cccaccgtgggcagggagc

SEQ ID NO: 4051979 - DNA, 20 bp, Homo sapiens
cccacctcacccggcctctt

SEQ ID NO: 4051980 - DNA, 18 bp, Homo sapiens
cccacctccactcccacc

SEQ ID NO: 4051981 - DNA, 18 bp, Homo sapiens
cccacctctcctgccctg

SEQ ID NO: 4051982 - DNA, 21 bp, Homo sapiens
cccacctctcctgccctgtga

SEQ ID NO: 4051983 - DNA, 16 bp, Homo sapiens
cccacctgcagctccc

SEQ ID NO: 4051984 - DNA, 13 bp, Homo sapiens
cccacctgcccat

SEQ ID NO: 4051985 - DNA, 20 bp, Homo sapiens
cccacctgcccatcacaggg

SEQ ID NO: 4051986 - DNA, 23 bp, Homo sapiens
cccacctgcccatcacagggttg

SEQ ID NO: 4051987 - DNA, 12 bp, Homo sapiens
cccaccttccca

SEQ ID NO: 4051988 - DNA, 16 bp, Homo sapiens
cccaccttgccaagct

SEQ ID NO: 4051989 - DNA, 15 bp, Homo sapiens
cccacctttcccaga

SEQ ID NO: 4051990 - DNA, 14 bp, Homo sapiens
cccacgagggctgg

SEQ ID NO: 4051991 - DNA, 15 bp, Homo sapiens
cccacgattggccac

SEQ ID NO: 4051992 - DNA, 18 bp, Homo sapiens
cccacgattggccacctg

SEQ ID NO: 4051993 - DNA, 16 bp, Homo sapiens
cccacgccctgttcac

SEQ ID NO: 4051994 - DNA, 13 bp, Homo sapiens
cccacggagacag

SEQ ID NO: 4051995 - DNA, 14 bp, Homo sapiens
cccacggagacaga

SEQ ID NO: 4051996 - DNA, 19 bp, Homo sapiens
cccacggggcctcgggacc

SEQ ID NO: 4051997 - DNA, 19 bp, Homo sapiens
cccacgtctggccaggcac

SEQ ID NO: 4051998 - DNA, 22 bp, Homo sapiens
cccacgtctggccaggcactgc

SEQ ID NO: 4051999 - DNA, 23 bp, Homo sapiens
cccacgtcttcttgctgcagcct

SEQ ID NO: 4052000 - DNA, 18 bp, Homo sapiens
cccacgtgtcttccactt

SEQ ID NO: 4052001 - DNA, 18 bp, Homo sapiens
cccactactgcagcacct

SEQ ID NO: 4052002 - DNA, 22 bp, Homo sapiens
cccactcccccgtttctccttt

SEQ ID NO: 4052003 - DNA, 13 bp, Homo sapiens
cccactcccgcct

SEQ ID NO: 4052004 - DNA, 21 bp, Homo sapiens
cccactctaggggtcaggctc

SEQ ID NO: 4052005 - DNA, 18 bp, Homo sapiens
cccactgcggggagacag

SEQ ID NO: 4052006 - DNA, 12 bp, Homo sapiens
cccactgctggt

SEQ ID NO: 4052007 - DNA, 13 bp, Homo sapiens
cccactgctggtg

SEQ ID NO: 4052008 - DNA, 14 bp, Homo sapiens
cccactgctggtgc

SEQ ID NO: 4052009 - DNA, 15 bp, Homo sapiens
cccactgctggtgcc

SEQ ID NO: 4052010 - DNA, 23 bp, Homo sapiens
cccactgggccagccctgcagcc

SEQ ID NO: 4052011 - DNA, 17 bp, Homo sapiens
cccagaaaggagactag

SEQ ID NO: 4052012 - DNA, 17 bp, Homo sapiens
cccagaactctgcctgc

SEQ ID NO: 4052013 - DNA, 21 bp, Homo sapiens
cccagaactctgcctgccctt

SEQ ID NO: 4052014 - DNA, 14 bp, Homo sapiens
cccagaactgcccc

SEQ ID NO: 4052015 - DNA, 16 bp, Homo sapiens
cccagaacttccctga

SEQ ID NO: 4052016 - DNA, 19 bp, Homo sapiens
cccagaacttccctgattg

SEQ ID NO: 4052017 - DNA, 18 bp, Homo sapiens
cccagacccctctggcca

SEQ ID NO: 4052018 - DNA, 20 bp, Homo sapiens
cccagacccctctggccagg

SEQ ID NO: 4052019 - DNA, 22 bp, Homo sapiens
cccagacccttcttgcctgctg

SEQ ID NO: 4052020 - DNA, 13 bp, Homo sapiens
cccagactacagg

SEQ ID NO: 4052021 - DNA, 22 bp, Homo sapiens
cccagactactattttcttttt

SEQ ID NO: 4052022 - DNA, 12 bp, Homo sapiens
cccagactcaga

SEQ ID NO: 4052023 - DNA, 15 bp, Homo sapiens
cccagactctgagct

SEQ ID NO: 4052024 - DNA, 22 bp, Homo sapiens
cccagagacatacttgaagggc

SEQ ID NO: 4052025 - DNA, 20 bp, Homo sapiens
cccagagaccaggctgtgtc

SEQ ID NO: 4052026 - DNA, 19 bp, Homo sapiens
cccagagcaccccctgctc

SEQ ID NO: 4052027 - DNA, 14 bp, Homo sapiens
cccagagcaggaag

SEQ ID NO: 4052028 - DNA, 12 bp, Homo sapiens
cccagagcccag

SEQ ID NO: 4052029 - DNA, 11 bp, Homo sapiens
cccagagctgt

SEQ ID NO: 4052030 - DNA, 13 bp, Homo sapiens
cccagagctgttt

SEQ ID NO: 4052031 - DNA, 20 bp, Homo sapiens
cccagaggccgagagctatg

SEQ ID NO: 4052032 - DNA, 13 bp, Homo sapiens
cccagaggtaaca

SEQ ID NO: 4052033 - DNA, 21 bp, Homo sapiens
cccagaggtgggatcctccct

SEQ ID NO: 4052034 - DNA, 15 bp, Homo sapiens
cccagagtggcccac

SEQ ID NO: 4052035 - DNA, 15 bp, Homo sapiens
cccagagtgtgaaac

SEQ ID NO: 4052036 - DNA, 19 bp, Homo sapiens
cccagatagagctgggtgg

SEQ ID NO: 4052037 - DNA, 20 bp, Homo sapiens
cccagatagagctgggtggc

SEQ ID NO: 4052038 - DNA, 15 bp, Homo sapiens
cccagatcagccaga

SEQ ID NO: 4052039 - DNA, 18 bp, Homo sapiens
cccagatgggccacggct

SEQ ID NO: 4052040 - DNA, 13 bp, Homo sapiens
cccagatgtgtcc

SEQ ID NO: 4052041 - DNA, 15 bp, Homo sapiens
cccagatgtgtcccc

SEQ ID NO: 4052042 - DNA, 21 bp, Homo sapiens
cccagatgtgtcccccccagg

SEQ ID NO: 4052043 - DNA, 17 bp, Homo sapiens
cccagattcccctgtgt

SEQ ID NO: 4052044 - DNA, 19 bp, Homo sapiens
cccagattcccctgtgtca

SEQ ID NO: 4052045 - DNA, 21 bp, Homo sapiens
cccagattttgctgtatattt

SEQ ID NO: 4052046 - DNA, 22 bp, Homo sapiens
cccagcaacacaagctggaagc

SEQ ID NO: 4052047 - DNA, 17 bp, Homo sapiens
cccagcaacgcccctcc

SEQ ID NO: 4052048 - DNA, 23 bp, Homo sapiens
cccagcaacgcccctccaaacct

SEQ ID NO: 4052049 - DNA, 15 bp, Homo sapiens
cccagcaagcgggag

SEQ ID NO: 4052050 - DNA, 20 bp, Homo sapiens
cccagcacaaagcagatcct

SEQ ID NO: 4052051 - DNA, 16 bp, Homo sapiens
cccagcacctgcctcc

SEQ ID NO: 4052052 - DNA, 17 bp, Homo sapiens
cccagcacctgcctcct

SEQ ID NO: 4052053 - DNA, 21 bp, Homo sapiens
cccagcactaaggccgtgtct

SEQ ID NO: 4052054 - DNA, 20 bp, Homo sapiens
cccagcactttgggaggcca

SEQ ID NO: 4052055 - DNA, 15 bp, Homo sapiens
cccagcagcccaagc

SEQ ID NO: 4052056 - DNA, 22 bp, Homo sapiens
cccagcagccctcaacaggccc

SEQ ID NO: 4052057 - DNA, 20 bp, Homo sapiens
cccagcaggaagccaggctg

SEQ ID NO: 4052058 - DNA, 13 bp, Homo sapiens
cccagcagggcct

SEQ ID NO: 4052059 - DNA, 19 bp, Homo sapiens
cccagcagggcctcaaagt

SEQ ID NO: 4052060 - DNA, 19 bp, Homo sapiens
cccagcatcactccccaag

SEQ ID NO: 4052061 - DNA, 15 bp, Homo sapiens
cccagcatccctgga

SEQ ID NO: 4052062 - DNA, 19 bp, Homo sapiens
cccagccaccccgggctct

SEQ ID NO: 4052063 - DNA, 14 bp, Homo sapiens
cccagccaggccaa

SEQ ID NO: 4052064 - DNA, 18 bp, Homo sapiens
cccagccaggccaacagc

SEQ ID NO: 4052065 - DNA, 10 bp, Homo sapiens
cccagcccag

SEQ ID NO: 4052066 - DNA, 11 bp, Homo sapiens
cccagcccaga

SEQ ID NO: 4052067 - DNA, 14 bp, Homo sapiens
cccagcccagagcc

SEQ ID NO: 4052068 - DNA, 22 bp, Homo sapiens
cccagcccatccattaggccag

SEQ ID NO: 4052069 - DNA, 12 bp, Homo sapiens
cccagccccatc

SEQ ID NO: 4052070 - DNA, 14 bp, Homo sapiens
cccagccccatccc

SEQ ID NO: 4052071 - DNA, 16 bp, Homo sapiens
cccagtgggacagagg

SEQ ID NO: 4052072 - DNA, 18 bp, Homo sapiens
cccagtgggaccacatgc

SEQ ID NO: 4052073 - DNA, 15 bp, Homo sapiens
cccagtgggatggga

SEQ ID NO: 4052074 - DNA, 22 bp, Homo sapiens
cccagtgggatgggacagggag

SEQ ID NO: 4052075 - DNA, 16 bp, Homo sapiens
cccagtgggtctggga

SEQ ID NO: 4052076 - DNA, 17 bp, Homo sapiens
cccagtgggtctgggat

SEQ ID NO: 4052077 - DNA, 14 bp, Homo sapiens
cccagttcaccctg

SEQ ID NO: 4052078 - DNA, 22 bp, Homo sapiens
cccagttcaggagtcccaagga

SEQ ID NO: 4052079 - DNA, 13 bp, Homo sapiens
cccataataaagc

SEQ ID NO: 4052080 - DNA, 16 bp, Homo sapiens
cccatactcagcctgc

SEQ ID NO: 4052081 - DNA, 22 bp, Homo sapiens
cccatactcagcctgctgccca

SEQ ID NO: 4052082 - DNA, 18 bp, Homo sapiens
cccataggccacccccta

SEQ ID NO: 4052083 - DNA, 22 bp, Homo sapiens
cccatcacagggttgggcccag

SEQ ID NO: 4052084 - DNA, 12 bp, Homo sapiens
cccatcagccca

SEQ ID NO: 4052085 - DNA, 14 bp, Homo sapiens
cccatcattccttc

SEQ ID NO: 4052086 - DNA, 22 bp, Homo sapiens
cccatccagacctggctccact

SEQ ID NO: 4052087 - DNA, 13 bp, Homo sapiens
cccatccagggcc

SEQ ID NO: 4052088 - DNA, 16 bp, Homo sapiens
cccatccatcagctcc

SEQ ID NO: 4052089 - DNA, 14 bp, Homo sapiens
cccatccattaggc

SEQ ID NO: 4052090 - DNA, 15 bp, Homo sapiens
cccatccattaggcc

SEQ ID NO: 4052091 - DNA, 13 bp, Homo sapiens
cccatcccacacc

SEQ ID NO: 4052092 - DNA, 15 bp, Homo sapiens
cccatcccacaccct

SEQ ID NO: 4052093 - DNA, 13 bp, Homo sapiens
cccatccccacca

SEQ ID NO: 4052094 - DNA, 14 bp, Homo sapiens
cccatccccaccag

SEQ ID NO: 4052095 - DNA, 13 bp, Homo sapiens
cccatccctcggg

SEQ ID NO: 4052096 - DNA, 15 bp, Homo sapiens
cccatccctgtcctc

SEQ ID NO: 4052097 - DNA, 16 bp, Homo sapiens
cccatcctcatccctg

SEQ ID NO: 4052098 - DNA, 13 bp, Homo sapiens
cccatcctccagg

SEQ ID NO: 4052099 - DNA, 19 bp, Homo sapiens
cccatcctctaaagcagag

SEQ ID NO: 4052100 - DNA, 12 bp, Homo sapiens
cccatcctgcca

SEQ ID NO: 4052101 - DNA, 17 bp, Homo sapiens
cccatcctgccatcctc

SEQ ID NO: 4052102 - DNA, 15 bp, Homo sapiens
cccatctcagcctcc

SEQ ID NO: 4052103 - DNA, 17 bp, Homo sapiens
cccatctcagcctcctg

SEQ ID NO: 4052104 - DNA, 14 bp, Homo sapiens
cccatctcatgccc

SEQ ID NO: 4052105 - DNA, 21 bp, Homo sapiens
cccatctcatgcccctggctg

SEQ ID NO: 4052106 - DNA, 15 bp, Homo sapiens
cccatctccctgcct

SEQ ID NO: 4052107 - DNA, 18 bp, Homo sapiens
cccatctccctgcctggc

SEQ ID NO: 4052108 - DNA, 20 bp, Homo sapiens
cccatctccctgcctggccc

SEQ ID NO: 4052109 - DNA, 13 bp, Homo sapiens
cccatctctccct

SEQ ID NO: 4052110 - DNA, 17 bp, Homo sapiens
cccatgactgcacccag

SEQ ID NO: 4052111 - DNA, 15 bp, Homo sapiens
cccatgagcctgccc

SEQ ID NO: 4052112 - DNA, 15 bp, Homo sapiens
cccatgatccctgtg

SEQ ID NO: 4052113 - DNA, 14 bp, Homo sapiens
cccatgcactgtga

SEQ ID NO: 4052114 - DNA, 19 bp, Homo sapiens
cccatgcactgtgaaggac

SEQ ID NO: 4052115 - DNA, 22 bp, Homo sapiens
cccatgcactgtgaaggaccct

SEQ ID NO: 4052116 - DNA, 14 bp, Homo sapiens
cccatgccaaggcc

SEQ ID NO: 4052117 - DNA, 17 bp, Homo sapiens
cccatgccacgttccac

SEQ ID NO: 4052118 - DNA, 18 bp, Homo sapiens
cccatgccacgttccaca

SEQ ID NO: 4052119 - DNA, 14 bp, Homo sapiens
cccatgcccacctg

SEQ ID NO: 4052120 - DNA, 14 bp, Homo sapiens
cccatgcctgtcca

SEQ ID NO: 4052121 - DNA, 16 bp, Homo sapiens
cccatgcctgtccagc

SEQ ID NO: 4052122 - DNA, 19 bp, Homo sapiens
cccatgcctgtccagcctg

SEQ ID NO: 4052123 - DNA, 20 bp, Homo sapiens
cccatgcctgtccagcctgg

SEQ ID NO: 4052124 - DNA, 20 bp, Homo sapiens
cccatgggatatgtggtgta

SEQ ID NO: 4052125 - DNA, 15 bp, Homo sapiens
cccatgtagccccct

SEQ ID NO: 4052126 - DNA, 23 bp, Homo sapiens
cccatgtatttatctctatttaa

SEQ ID NO: 4052127 - DNA, 22 bp, Homo sapiens
cccatgtgagctgctgccatga

SEQ ID NO: 4052128 - DNA, 17 bp, Homo sapiens
cccatgtgtcccctcac

SEQ ID NO: 4052129 - DNA, 22 bp, Homo sapiens
cccatgtgtcccctcactctgt

SEQ ID NO: 4052130 - DNA, 13 bp, Homo sapiens
cccattcctccct

SEQ ID NO: 4052131 - DNA, 12 bp, Homo sapiens
cccattcctgaa

SEQ ID NO: 4052132 - DNA, 13 bp, Homo sapiens
cccatttcaggaa

SEQ ID NO: 4052133 - DNA, 23 bp, Homo sapiens
cccatttcaggaatttaaaatta

SEQ ID NO: 4052134 - DNA, 16 bp, Homo sapiens
cccatttcccatctgc

SEQ ID NO: 4052135 - DNA, 18 bp, Homo sapiens
cccatttcctcacactaa

SEQ ID NO: 4052136 - DNA, 17 bp, Homo sapiens
cccatttctatttattt

SEQ ID NO: 4052137 - DNA, 15 bp, Homo sapiens
cccattttcctctga

SEQ ID NO: 4052138 - DNA, 19 bp, Homo sapiens
cccattttgcaaaatttcc

SEQ ID NO: 4052139 - DNA, 22 bp, Homo sapiens
cccattttggaagttttcagga

SEQ ID NO: 4052140 - DNA, 13 bp, Homo sapiens
ccccaaaatccaa

SEQ ID NO: 4052141 - DNA, 16 bp, Homo sapiens
ccccaaaatccaaaac

SEQ ID NO: 4052142 - DNA, 22 bp, Homo sapiens
ccccaaaatccaaaacttctct

SEQ ID NO: 4052143 - DNA, 14 bp, Homo sapiens
ccccaaagagcctg

SEQ ID NO: 4052144 - DNA, 15 bp, Homo sapiens
ccccaaagagcctgg

SEQ ID NO: 4052145 - DNA, 16 bp, Homo sapiens
ccccaaagctttcctg

SEQ ID NO: 4052146 - DNA, 15 bp, Homo sapiens
ccccaaaggacgcct

SEQ ID NO: 4052147 - DNA, 23 bp, Homo sapiens
ccccaaaggacgcctgcaggaga

SEQ ID NO: 4052148 - DNA, 15 bp, Homo sapiens
ccccaaatcaataca

SEQ ID NO: 4052149 - DNA, 13 bp, Homo sapiens
ccccaacctcaga

SEQ ID NO: 4052150 - DNA, 20 bp, Homo sapiens
ccccaacctcagggctccca

SEQ ID NO: 4052151 - DNA, 21 bp, Homo sapiens
ccccaacctcagggctcccag

SEQ ID NO: 4052152 - DNA, 14 bp, Homo sapiens
ccccaacctgctga

SEQ ID NO: 4052153 - DNA, 18 bp, Homo sapiens
ccccaagcccaccaggtg

SEQ ID NO: 4052154 - DNA, 12 bp, Homo sapiens
ccccacaacttt

SEQ ID NO: 4052155 - DNA, 23 bp, Homo sapiens
ccccacaccccagcccaccctgc

SEQ ID NO: 4052156 - DNA, 14 bp, Homo sapiens
ccccacacctcagt

SEQ ID NO: 4052157 - DNA, 16 bp, Homo sapiens
ccccacacctcagttc

SEQ ID NO: 4052158 - DNA, 19 bp, Homo sapiens
ccccacaccttccagggcc

SEQ ID NO: 4052159 - DNA, 22 bp, Homo sapiens
ccccacacttgttccagctctt

SEQ ID NO: 4052160 - DNA, 17 bp, Homo sapiens
ccccacagcgtccctgg

SEQ ID NO: 4052161 - DNA, 18 bp, Homo sapiens
ccccacagctacctgaga

SEQ ID NO: 4052162 - DNA, 12 bp, Homo sapiens
ccccacccacct

SEQ ID NO: 4052163 - DNA, 13 bp, Homo sapiens
ccccacccacctc

SEQ ID NO: 4052164 - DNA, 17 bp, Homo sapiens
ccccacccccagctcaa

SEQ ID NO: 4052165 - DNA, 20 bp, Homo sapiens
ccccacccccagctcaatgg

SEQ ID NO: 4052166 - DNA, 17 bp, Homo sapiens
ccccacccctgccccca

SEQ ID NO: 4052167 - DNA, 12 bp, Homo sapiens
ccccaccctcat

SEQ ID NO: 4052168 - DNA, 17 bp, Homo sapiens
ccccaccctccactcag

SEQ ID NO: 4052169 - DNA, 13 bp, Homo sapiens
ccccaccctccat

SEQ ID NO: 4052170 - DNA, 17 bp, Homo sapiens
ccccaccctccatgctc

SEQ ID NO: 4052171 - DNA, 15 bp, Homo sapiens
ccccaccctccctgg

SEQ ID NO: 4052172 - DNA, 16 bp, Homo sapiens
ccccaccctccctgga

SEQ ID NO: 4052173 - DNA, 11 bp, Homo sapiens
ccccacctggg

SEQ ID NO: 4052174 - DNA, 14 bp, Homo sapiens
ccccaccttgccaa

SEQ ID NO: 4052175 - DNA, 20 bp, Homo sapiens
cccctggctttgcctcttct

SEQ ID NO: 4052176 - DNA, 18 bp, Homo sapiens
cccctggcttttcactgc

SEQ ID NO: 4052177 - DNA, 22 bp, Homo sapiens
cccctggcttttcactgctggc

SEQ ID NO: 4052178 - DNA, 20 bp, Homo sapiens
cccctgggcttggcctgctg

SEQ ID NO: 4052179 - DNA, 22 bp, Homo sapiens
cccctgggcttggcctgctgtg

SEQ ID NO: 4052180 - DNA, 19 bp, Homo sapiens
cccctggggcccagcccct

SEQ ID NO: 4052181 - DNA, 22 bp, Homo sapiens
cccctgtgtgagttgagtctcc

SEQ ID NO: 4052182 - DNA, 11 bp, Homo sapiens
cccctgttcta

SEQ ID NO: 4052183 - DNA, 15 bp, Homo sapiens
ccccttatccaggac

SEQ ID NO: 4052184 - DNA, 16 bp, Homo sapiens
ccccttatccaggact

SEQ ID NO: 4052185 - DNA, 10 bp, Homo sapiens
ccccttccca

SEQ ID NO: 4052186 - DNA, 18 bp, Homo sapiens
ccccttcccgtgacctgg

SEQ ID NO: 4052187 - DNA, 12 bp, Homo sapiens
ccccttcctgtt

SEQ ID NO: 4052188 - DNA, 16 bp, Homo sapiens
ccccttctctccctgc

SEQ ID NO: 4052189 - DNA, 13 bp, Homo sapiens
ccccttctctgct

SEQ ID NO: 4052190 - DNA, 14 bp, Homo sapiens
ccccttctctgctc

SEQ ID NO: 4052191 - DNA, 19 bp, Homo sapiens
ccccttctgctcagctctg

SEQ ID NO: 4052192 - DNA, 20 bp, Homo sapiens
ccccttctgctcagctctgg

SEQ ID NO: 4052193 - DNA, 17 bp, Homo sapiens
ccccttctgtgtcacag

SEQ ID NO: 4052194 - DNA, 20 bp, Homo sapiens
ccccttcttgggccccagac

SEQ ID NO: 4052195 - DNA, 20 bp, Homo sapiens
ccccttgtttgtcccttcta

SEQ ID NO: 4052196 - DNA, 14 bp, Homo sapiens
cccctttcaggcct

SEQ ID NO: 4052197 - DNA, 13 bp, Homo sapiens
cccctttcctgtc

SEQ ID NO: 4052198 - DNA, 18 bp, Homo sapiens
ccccttttacttttttat

SEQ ID NO: 4052199 - DNA, 14 bp, Homo sapiens
cccgacctggctgc

SEQ ID NO: 4052200 - DNA, 19 bp, Homo sapiens
cccgacctggctgcccctc

SEQ ID NO: 4052201 - DNA, 23 bp, Homo sapiens
cccgacctggctgcccctcacct

SEQ ID NO: 4052202 - DNA, 16 bp, Homo sapiens
cccgagctcttggcct

SEQ ID NO: 4052203 - DNA, 17 bp, Homo sapiens
cccgagctcttggcctt

SEQ ID NO: 4052204 - DNA, 23 bp, Homo sapiens
cccgagctggggggttggcagcc

SEQ ID NO: 4052205 - DNA, 12 bp, Homo sapiens
cccgagctggtg

SEQ ID NO: 4052206 - DNA, 23 bp, Homo sapiens
cccgagtcattcgttctgtggag

SEQ ID NO: 4052207 - DNA, 19 bp, Homo sapiens
cccgcaccccggcctcagg

SEQ ID NO: 4052208 - DNA, 18 bp, Homo sapiens
cccgcagtgctgggacca

SEQ ID NO: 4052209 - DNA, 23 bp, Homo sapiens
cccgcagtgctgggaccagagcc

SEQ ID NO: 4052210 - DNA, 23 bp, Homo sapiens
cccgccacctatctcgtgggaga

SEQ ID NO: 4052211 - DNA, 13 bp, Homo sapiens
cccgccagggctg

SEQ ID NO: 4052212 - DNA, 19 bp, Homo sapiens
cccgcccaaacctttcccc

SEQ ID NO: 4052213 - DNA, 18 bp, Homo sapiens
cccgccccagagtggccc

SEQ ID NO: 4052214 - DNA, 15 bp, Homo sapiens
cccgcctccctctca

SEQ ID NO: 4052215 - DNA, 24 bp, Homo sapiens
cccgcctccctctcagaggcctgc

SEQ ID NO: 4052216 - DNA, 16 bp, Homo sapiens
cccgcctgagctcctg

SEQ ID NO: 4052217 - DNA, 14 bp, Homo sapiens
cccgcctgccctca

SEQ ID NO: 4052218 - DNA, 17 bp, Homo sapiens
cccgcctgccctcatgg

SEQ ID NO: 4052219 - DNA, 15 bp, Homo sapiens
cccgccttagagcct

SEQ ID NO: 4052220 - DNA, 13 bp, Homo sapiens
cccgcgcacccca

SEQ ID NO: 4052221 - DNA, 16 bp, Homo sapiens
cccgcgctcgcccagc

SEQ ID NO: 4052222 - DNA, 21 bp, Homo sapiens
cccgctctacatcttctgcct

SEQ ID NO: 4052223 - DNA, 19 bp, Homo sapiens
cccggaagggctttggttc

SEQ ID NO: 4052224 - DNA, 16 bp, Homo sapiens
cccggagcctgtgcag

SEQ ID NO: 4052225 - DNA, 15 bp, Homo sapiens
cccggatgctgcttc

SEQ ID NO: 4052226 - DNA, 13 bp, Homo sapiens
cccggcagacgcc

SEQ ID NO: 4052227 - DNA, 11 bp, Homo sapiens
cccggccagcg

SEQ ID NO: 4052228 - DNA, 14 bp, Homo sapiens
cccggccagcgggc

SEQ ID NO: 4052229 - DNA, 14 bp, Homo sapiens
cccggcctcagggc

SEQ ID NO: 4052230 - DNA, 22 bp, Homo sapiens
cccggcctcctcggagagcagc

SEQ ID NO: 4052231 - DNA, 18 bp, Homo sapiens
cccggcctgctcccagca

SEQ ID NO: 4052232 - DNA, 22 bp, Homo sapiens
cccggctcgagcagtcctgcct

SEQ ID NO: 4052233 - DNA, 23 bp, Homo sapiens
cccggctgggtcggccctgccca

SEQ ID NO: 4052234 - DNA, 17 bp, Homo sapiens
cccgggccacgccccag

SEQ ID NO: 4052235 - DNA, 15 bp, Homo sapiens
cccggggaccctgtg

SEQ ID NO: 4052236 - DNA, 17 bp, Homo sapiens
cccggggaccctgtgac

SEQ ID NO: 4052237 - DNA, 14 bp, Homo sapiens
cccggggccagcac

SEQ ID NO: 4052238 - DNA, 18 bp, Homo sapiens
cccgggggagcccagtga

SEQ ID NO: 4052239 - DNA, 21 bp, Homo sapiens
cccgggttcagcctggcctgc

SEQ ID NO: 4052240 - DNA, 18 bp, Homo sapiens
cccggtgcccaagaatag

SEQ ID NO: 4052241 - DNA, 14 bp, Homo sapiens
cccgtacctcttcc

SEQ ID NO: 4052242 - DNA, 18 bp, Homo sapiens
cccgtcatgttcctcaaa

SEQ ID NO: 4052243 - DNA, 13 bp, Homo sapiens
cccgtctgcccac

SEQ ID NO: 4052244 - DNA, 16 bp, Homo sapiens
cccgtgacctggtcag

SEQ ID NO: 4052245 - DNA, 22 bp, Homo sapiens
cccgtggtggcggtggctgccc

SEQ ID NO: 4052246 - DNA, 17 bp, Homo sapiens
cccgttctgctggcctg

SEQ ID NO: 4052247 - DNA, 19 bp, Homo sapiens
cccgttctgctggcctgga

SEQ ID NO: 4052248 - DNA, 15 bp, Homo sapiens
cccgttgccccactc

SEQ ID NO: 4052249 - DNA, 19 bp, Homo sapiens
cccgtttctccttttccta

SEQ ID NO: 4052250 - DNA, 17 bp, Homo sapiens
ccctaacctcttttctg

SEQ ID NO: 4052251 - DNA, 18 bp, Homo sapiens
ccctaagcccccagggcc

SEQ ID NO: 4052252 - DNA, 17 bp, Homo sapiens
ccctaagtggctgcctt

SEQ ID NO: 4052253 - DNA, 16 bp, Homo sapiens
ccctacacacacccag

SEQ ID NO: 4052254 - DNA, 17 bp, Homo sapiens
ccctacacacacccagg

SEQ ID NO: 4052255 - DNA, 18 bp, Homo sapiens
ccctacacacacccaggc

SEQ ID NO: 4052256 - DNA, 13 bp, Homo sapiens
ccctacagagctg

SEQ ID NO: 4052257 - DNA, 14 bp, Homo sapiens
ccctacccaccgat

SEQ ID NO: 4052258 - DNA, 23 bp, Homo sapiens
ccctaccccagggccctggccag

SEQ ID NO: 4052259 - DNA, 23 bp, Homo sapiens
ccctacctgattggtgcaaccct

SEQ ID NO: 4052260 - DNA, 14 bp, Homo sapiens
ccctacctgcttca

SEQ ID NO: 4052261 - DNA, 20 bp, Homo sapiens
ccctagagcctgcctggagc

SEQ ID NO: 4052262 - DNA, 21 bp, Homo sapiens
ccctagagcctgcctggagcg

SEQ ID NO: 4052263 - DNA, 13 bp, Homo sapiens
ccctagatagttt

SEQ ID NO: 4052264 - DNA, 18 bp, Homo sapiens
ccctagatagtttattat

SEQ ID NO: 4052265 - DNA, 14 bp, Homo sapiens
ccctagcccagact

SEQ ID NO: 4052266 - DNA, 17 bp, Homo sapiens
ccctagcccagactctg

SEQ ID NO: 4052267 - DNA, 19 bp, Homo sapiens
ccctagcccagactctgag

SEQ ID NO: 4052268 - DNA, 21 bp, Homo sapiens
ccctagcccagactctgagct

SEQ ID NO: 4052269 - DNA, 14 bp, Homo sapiens
ccctagccttgctt

SEQ ID NO: 4052270 - DNA, 21 bp, Homo sapiens
ccctagctttagaccctgggt

SEQ ID NO: 4052271 - DNA, 15 bp, Homo sapiens
ccctaggttccctgt

SEQ ID NO: 4052272 - DNA, 16 bp, Homo sapiens
ccctagtcccttcccc

SEQ ID NO: 4052273 - DNA, 17 bp, Homo sapiens
ccctagtcccttcccct

SEQ ID NO: 4052274 - DNA, 18 bp, Homo sapiens
ccctagttccctctgctc

SEQ ID NO: 4052275 - DNA, 21 bp, Homo sapiens
ccctagttccctctgctcagc

SEQ ID NO: 4052276 - DNA, 19 bp, Homo sapiens
ccctagttctacctcaggc

SEQ ID NO: 4052277 - DNA, 18 bp, Homo sapiens
ccctcaacaagggagaga

SEQ ID NO: 4052278 - DNA, 19 bp, Homo sapiens
ccctgctttgggctgccct

SEQ ID NO: 4052279 - DNA, 18 bp, Homo sapiens
ccctggaactcctggcct

SEQ ID NO: 4052280 - DNA, 17 bp, Homo sapiens
ccctggaagagcccagt

SEQ ID NO: 4052281 - DNA, 17 bp, Homo sapiens
ccctggacaagcagagg

SEQ ID NO: 4052282 - DNA, 18 bp, Homo sapiens
ccctggacacccctgctc

SEQ ID NO: 4052283 - DNA, 14 bp, Homo sapiens
ccctggagcaggag

SEQ ID NO: 4052284 - DNA, 12 bp, Homo sapiens
ccctggagccag

SEQ ID NO: 4052285 - DNA, 13 bp, Homo sapiens
ccctggagccaga

SEQ ID NO: 4052286 - DNA, 19 bp, Homo sapiens
ccctggaggaattcagctc

SEQ ID NO: 4052287 - DNA, 23 bp, Homo sapiens
ccctggagtgtggctgaggaggc

SEQ ID NO: 4052288 - DNA, 15 bp, Homo sapiens
ccctggccagccggg

SEQ ID NO: 4052289 - DNA, 15 bp, Homo sapiens
ccctggccgccccct

SEQ ID NO: 4052290 - DNA, 21 bp, Homo sapiens
ccctggcctctgtgccttctt

SEQ ID NO: 4052291 - DNA, 19 bp, Homo sapiens
ccctggcctgaactgagga

SEQ ID NO: 4052292 - DNA, 13 bp, Homo sapiens
ccctggctccctc

SEQ ID NO: 4052293 - DNA, 19 bp, Homo sapiens
ccctggctgaccccaaaga

SEQ ID NO: 4052294 - DNA, 23 bp, Homo sapiens
ccctggctgaccccaaagagcct

SEQ ID NO: 4052295 - DNA, 13 bp, Homo sapiens
ccctggctgctgc

SEQ ID NO: 4052296 - DNA, 15 bp, Homo sapiens
ccctggctgctgccc

SEQ ID NO: 4052297 - DNA, 23 bp, Homo sapiens
ccctggctgggacgtggctcagc

SEQ ID NO: 4052298 - DNA, 14 bp, Homo sapiens
ccctggctttgcct

SEQ ID NO: 4052299 - DNA, 22 bp, Homo sapiens
ccctggctttgcctcttctttg

SEQ ID NO: 4052300 - DNA, 13 bp, Homo sapiens
ccctggcttttca

SEQ ID NO: 4052301 - DNA, 18 bp, Homo sapiens
ccctgggacacagaccca

SEQ ID NO: 4052302 - DNA, 16 bp, Homo sapiens
ccctgggaggcccctt

SEQ ID NO: 4052303 - DNA, 11 bp, Homo sapiens
ccctgggcagg

SEQ ID NO: 4052304 - DNA, 13 bp, Homo sapiens
ccctgggcaggcg

SEQ ID NO: 4052305 - DNA, 21 bp, Homo sapiens
ccctgggccagcggggctgct

SEQ ID NO: 4052306 - DNA, 17 bp, Homo sapiens
ccctgggcccctccacg

SEQ ID NO: 4052307 - DNA, 23 bp, Homo sapiens
ccctgggcctcagttcaacctgg

SEQ ID NO: 4052308 - DNA, 17 bp, Homo sapiens
ccctgggctattgctgc

SEQ ID NO: 4052309 - DNA, 21 bp, Homo sapiens
ccctgggctattgctgctgcc

SEQ ID NO: 4052310 - DNA, 14 bp, Homo sapiens
ccctgggctggact

SEQ ID NO: 4052311 - DNA, 19 bp, Homo sapiens
ccctgggctgggtgctggg

SEQ ID NO: 4052312 - DNA, 18 bp, Homo sapiens
ccctgggcttggcctgct

SEQ ID NO: 4052313 - DNA, 19 bp, Homo sapiens
ccctggggaaggagccagt

SEQ ID NO: 4052314 - DNA, 19 bp, Homo sapiens
ccctggggactgttccaaa

SEQ ID NO: 4052315 - DNA, 13 bp, Homo sapiens
ccctggggcctgg

SEQ ID NO: 4052316 - DNA, 18 bp, Homo sapiens
ccctggggcctggacctg

SEQ ID NO: 4052317 - DNA, 16 bp, Homo sapiens
ccctggggctgtgcat

SEQ ID NO: 4052318 - DNA, 23 bp, Homo sapiens
ccctggggctgtgcattcccacg

SEQ ID NO: 4052319 - DNA, 21 bp, Homo sapiens
ccctgggggtttcacctgggc

SEQ ID NO: 4052320 - DNA, 17 bp, Homo sapiens
ccctgggtgggctctgt

SEQ ID NO: 4052321 - DNA, 15 bp, Homo sapiens
ccctggtaagaaaaa

SEQ ID NO: 4052322 - DNA, 23 bp, Homo sapiens
ccctggtgggccaacaaagaaca

SEQ ID NO: 4052323 - DNA, 13 bp, Homo sapiens
ccctgtacagtgt

SEQ ID NO: 4052324 - DNA, 18 bp, Homo sapiens
ccctgtactgttctgtgt

SEQ ID NO: 4052325 - DNA, 22 bp, Homo sapiens
ccctgtcaaatatcagttaccc

SEQ ID NO: 4052326 - DNA, 21 bp, Homo sapiens
ccctgtcaagttaacaaggaa

SEQ ID NO: 4052327 - DNA, 13 bp, Homo sapiens
ccctgtcccatgc

SEQ ID NO: 4052328 - DNA, 14 bp, Homo sapiens
ccctgtcccatgca

SEQ ID NO: 4052329 - DNA, 23 bp, Homo sapiens
ccctgtcccatgcaggccctttg

SEQ ID NO: 4052330 - DNA, 21 bp, Homo sapiens
ccctgtccccctcccctccca

SEQ ID NO: 4052331 - DNA, 15 bp, Homo sapiens
ccctgtcgagacact

SEQ ID NO: 4052332 - DNA, 12 bp, Homo sapiens
ccctgtctccag

SEQ ID NO: 4052333 - DNA, 15 bp, Homo sapiens
ccctgtctccagctg

SEQ ID NO: 4052334 - DNA, 17 bp, Homo sapiens
ccctgtctccagctgcc

SEQ ID NO: 4052335 - DNA, 19 bp, Homo sapiens
ccctgtctccagctgcctg

SEQ ID NO: 4052336 - DNA, 22 bp, Homo sapiens
ccctgtctccagctgcctgggc

SEQ ID NO: 4052337 - DNA, 19 bp, Homo sapiens
ccctgtctgctaggcgctg

SEQ ID NO: 4052338 - DNA, 17 bp, Homo sapiens
ccctgtcttctgggcac

SEQ ID NO: 4052339 - DNA, 22 bp, Homo sapiens
ccctgtcttctgggcacagtgg

SEQ ID NO: 4052340 - DNA, 21 bp, Homo sapiens
ccctgtgcagaagggagctgg

SEQ ID NO: 4052341 - DNA, 13 bp, Homo sapiens
ccctgtgccagcc

SEQ ID NO: 4052342 - DNA, 18 bp, Homo sapiens
ccctgtgggggtggccat

SEQ ID NO: 4052343 - DNA, 22 bp, Homo sapiens
ccctgtgggggtggccatccct

SEQ ID NO: 4052344 - DNA, 19 bp, Homo sapiens
ccctgtgtccacctgtggg

SEQ ID NO: 4052345 - DNA, 23 bp, Homo sapiens
ccctgtgtgagttgagtctcctc

SEQ ID NO: 4052346 - DNA, 17 bp, Homo sapiens
ccctgtgttgtctctag

SEQ ID NO: 4052347 - DNA, 18 bp, Homo sapiens
ccctgtgttgtctctaga

SEQ ID NO: 4052348 - DNA, 21 bp, Homo sapiens
ccctgtgttgtctctagagca

SEQ ID NO: 4052349 - DNA, 23 bp, Homo sapiens
ccctgtgttgtctctagagcagg

SEQ ID NO: 4052350 - DNA, 13 bp, Homo sapiens
ccctgttcactct

SEQ ID NO: 4052351 - DNA, 16 bp, Homo sapiens
ccctgttcatgtgcct

SEQ ID NO: 4052352 - DNA, 18 bp, Homo sapiens
ccctgttcatgtgcctct

SEQ ID NO: 4052353 - DNA, 19 bp, Homo sapiens
ccctgttcatgtgcctctg

SEQ ID NO: 4052354 - DNA, 20 bp, Homo sapiens
ccctgttcatgtgcctctgc

SEQ ID NO: 4052355 - DNA, 21 bp, Homo sapiens
ccctgttcatgtgcctctgcg

SEQ ID NO: 4052356 - DNA, 11 bp, Homo sapiens
ccctgttctaa

SEQ ID NO: 4052357 - DNA, 12 bp, Homo sapiens
ccctgttctaag

SEQ ID NO: 4052358 - DNA, 12 bp, Homo sapiens
ccctgttcttcc

SEQ ID NO: 4052359 - DNA, 14 bp, Homo sapiens
ccctgtttaatatt

SEQ ID NO: 4052360 - DNA, 18 bp, Homo sapiens
ccctgtttaatatttaaa

SEQ ID NO: 4052361 - DNA, 15 bp, Homo sapiens
cccttacacgtacct

SEQ ID NO: 4052362 - DNA, 14 bp, Homo sapiens
cccttagcctccct

SEQ ID NO: 4052363 - DNA, 17 bp, Homo sapiens
cccttagcctccctgaa

SEQ ID NO: 4052364 - DNA, 14 bp, Homo sapiens
cccttcaaccattc

SEQ ID NO: 4052365 - DNA, 18 bp, Homo sapiens
cccttcaaccattcccca

SEQ ID NO: 4052366 - DNA, 17 bp, Homo sapiens
cccttcagtaccctctc

SEQ ID NO: 4052367 - DNA, 19 bp, Homo sapiens
cccttcagtaccctctcag

SEQ ID NO: 4052368 - DNA, 20 bp, Homo sapiens
cccttcagtaccctctcagc

SEQ ID NO: 4052369 - DNA, 14 bp, Homo sapiens
cccttcatcttcct

SEQ ID NO: 4052370 - DNA, 17 bp, Homo sapiens
cccttcatcttcctgtg

SEQ ID NO: 4052371 - DNA, 20 bp, Homo sapiens
cccttcatcttcctgtgtcc

SEQ ID NO: 4052372 - DNA, 19 bp, Homo sapiens
cccttccacctgctctgct

SEQ ID NO: 4052373 - DNA, 20 bp, Homo sapiens
cccttccatgtgcctttctt

SEQ ID NO: 4052374 - DNA, 19 bp, Homo sapiens
cccttcccctccctggctc

SEQ ID NO: 4052375 - DNA, 12 bp, Homo sapiens
cccttccctgca

SEQ ID NO: 4052376 - DNA, 16 bp, Homo sapiens
cccttcctctccactg

SEQ ID NO: 4052377 - DNA, 21 bp, Homo sapiens
cccttcctctccactgccttc

SEQ ID NO: 4052378 - DNA, 21 bp, Homo sapiens
cccttcctggaggctgcctat

SEQ ID NO: 4052379 - DNA, 12 bp, Homo sapiens
cccttccttctt

SEQ ID NO: 4052380 - DNA, 15 bp, Homo sapiens
cctacctcaggcagg

SEQ ID NO: 4052381 - DNA, 13 bp, Homo sapiens
cctacctgatgga

SEQ ID NO: 4052382 - DNA, 21 bp, Homo sapiens
cctacctgattggtgcaaccc

SEQ ID NO: 4052383 - DNA, 12 bp, Homo sapiens
cctacctgcctt

SEQ ID NO: 4052384 - DNA, 13 bp, Homo sapiens
cctacctgctctc

SEQ ID NO: 4052385 - DNA, 12 bp, Homo sapiens
cctacctggtaa

SEQ ID NO: 4052386 - DNA, 19 bp, Homo sapiens
cctaccttcatttcaggag

SEQ ID NO: 4052387 - DNA, 16 bp, Homo sapiens
cctactatcactgaac

SEQ ID NO: 4052388 - DNA, 12 bp, Homo sapiens
cctactattggc

SEQ ID NO: 4052389 - DNA, 19 bp, Homo sapiens
cctactcttctctctgctc

SEQ ID NO: 4052390 - DNA, 18 bp, Homo sapiens
cctagaatgtcagatttc

SEQ ID NO: 4052391 - DNA, 15 bp, Homo sapiens
cctagacccaggtgg

SEQ ID NO: 4052392 - DNA, 19 bp, Homo sapiens
cctagacctaaacggctca

SEQ ID NO: 4052393 - DNA, 14 bp, Homo sapiens
cctagactgcatcc

SEQ ID NO: 4052394 - DNA, 18 bp, Homo sapiens
cctagagaacgcagccct

SEQ ID NO: 4052395 - DNA, 13 bp, Homo sapiens
cctagagcctgcc

SEQ ID NO: 4052396 - DNA, 20 bp, Homo sapiens
cctagattaggtagactttg

SEQ ID NO: 4052397 - DNA, 23 bp, Homo sapiens
cctagattaggtagactttgctt

SEQ ID NO: 4052398 - DNA, 14 bp, Homo sapiens
cctagcaagctggc

SEQ ID NO: 4052399 - DNA, 18 bp, Homo sapiens
cctagcagagtgctggca

SEQ ID NO: 4052400 - DNA, 19 bp, Homo sapiens
cctagcagagtgctggcac

SEQ ID NO: 4052401 - DNA, 16 bp, Homo sapiens
cctagcaggctgttcc

SEQ ID NO: 4052402 - DNA, 18 bp, Homo sapiens
cctagccaccagtgtcct

SEQ ID NO: 4052403 - DNA, 15 bp, Homo sapiens
cctagcccagactct

SEQ ID NO: 4052404 - DNA, 21 bp, Homo sapiens
cctagcccagactctgagctg

SEQ ID NO: 4052405 - DNA, 12 bp, Homo sapiens
cctagcccttcc

SEQ ID NO: 4052406 - DNA, 14 bp, Homo sapiens
cctagcccttccct

SEQ ID NO: 4052407 - DNA, 18 bp, Homo sapiens
cctagcccttccctgagt

SEQ ID NO: 4052408 - DNA, 10 bp, Homo sapiens
cctagccttg

SEQ ID NO: 4052409 - DNA, 14 bp, Homo sapiens
cctagccttgcttg

SEQ ID NO: 4052410 - DNA, 17 bp, Homo sapiens
cctagcgatctctcctg

SEQ ID NO: 4052411 - DNA, 21 bp, Homo sapiens
cctagcgatctctcctggcct

SEQ ID NO: 4052412 - DNA, 15 bp, Homo sapiens
cctagcggagcccag

SEQ ID NO: 4052413 - DNA, 15 bp, Homo sapiens
cctagctcctgccac

SEQ ID NO: 4052414 - DNA, 22 bp, Homo sapiens
cctagctcctgccacatggagc

SEQ ID NO: 4052415 - DNA, 17 bp, Homo sapiens
cctagctctcccagtga

SEQ ID NO: 4052416 - DNA, 13 bp, Homo sapiens
cctagctgacccc

SEQ ID NO: 4052417 - DNA, 21 bp, Homo sapiens
cctagcttgggaggcttcccc

SEQ ID NO: 4052418 - DNA, 22 bp, Homo sapiens
cctagctttagaccctgggtgg

SEQ ID NO: 4052419 - DNA, 13 bp, Homo sapiens
cctaggagagcca

SEQ ID NO: 4052420 - DNA, 14 bp, Homo sapiens
cctaggagagccaa

SEQ ID NO: 4052421 - DNA, 15 bp, Homo sapiens
cctaggagagccaac

SEQ ID NO: 4052422 - DNA, 15 bp, Homo sapiens
cctaggaggactggg

SEQ ID NO: 4052423 - DNA, 14 bp, Homo sapiens
cctaggcgggcggt

SEQ ID NO: 4052424 - DNA, 20 bp, Homo sapiens
cctagggtcttgggggtcag

SEQ ID NO: 4052425 - DNA, 14 bp, Homo sapiens
cctaggtctccagt

SEQ ID NO: 4052426 - DNA, 20 bp, Homo sapiens
cctaggttccctgttcttcc

SEQ ID NO: 4052427 - DNA, 14 bp, Homo sapiens
cctagtcccttccc

SEQ ID NO: 4052428 - DNA, 21 bp, Homo sapiens
cctagtcccttcccctccctg

SEQ ID NO: 4052429 - DNA, 18 bp, Homo sapiens
cctagttcatcccttctc

SEQ ID NO: 4052430 - DNA, 22 bp, Homo sapiens
cctagttcatcccttctcttcc

SEQ ID NO: 4052431 - DNA, 20 bp, Homo sapiens
cctagttccctctgctcagc

SEQ ID NO: 4052432 - DNA, 17 bp, Homo sapiens
cctataaagtaaagcta

SEQ ID NO: 4052433 - DNA, 15 bp, Homo sapiens
cctatcctcactgcc

SEQ ID NO: 4052434 - DNA, 16 bp, Homo sapiens
cctatctatcttccaa

SEQ ID NO: 4052435 - DNA, 14 bp, Homo sapiens
cctatctccttccc

SEQ ID NO: 4052436 - DNA, 16 bp, Homo sapiens
cctatctccttcccac

SEQ ID NO: 4052437 - DNA, 19 bp, Homo sapiens
cctatctccttcccacccc

SEQ ID NO: 4052438 - DNA, 20 bp, Homo sapiens
cctatgcccaggtaccaccc

SEQ ID NO: 4052439 - DNA, 21 bp, Homo sapiens
cctatgcccaggtaccaccct

SEQ ID NO: 4052440 - DNA, 17 bp, Homo sapiens
cctatggggatggtcca

SEQ ID NO: 4052441 - DNA, 14 bp, Homo sapiens
cctatgtcctaagg

SEQ ID NO: 4052442 - DNA, 20 bp, Homo sapiens
cctatgtcctaaggacacac

SEQ ID NO: 4052443 - DNA, 23 bp, Homo sapiens
cctatgttgggggggaccctgcc

SEQ ID NO: 4052444 - DNA, 11 bp, Homo sapiens
cctattctcac

SEQ ID NO: 4052445 - DNA, 15 bp, Homo sapiens
cctattgtcattaaa

SEQ ID NO: 4052446 - DNA, 18 bp, Homo sapiens
cctatttccattcaacaa

SEQ ID NO: 4052447 - DNA, 16 bp, Homo sapiens
cctcaaaagcaccctt

SEQ ID NO: 4052448 - DNA, 22 bp, Homo sapiens
cctcaaacagtaggttggcagt

SEQ ID NO: 4052449 - DNA, 20 bp, Homo sapiens
cctcaaacgacagaggagct

SEQ ID NO: 4052450 - DNA, 15 bp, Homo sapiens
cctcaaagaggcctt

SEQ ID NO: 4052451 - DNA, 15 bp, Homo sapiens
cctcaaatcgtccag

SEQ ID NO: 4052452 - DNA, 17 bp, Homo sapiens
cctcaaattttttgact

SEQ ID NO: 4052453 - DNA, 16 bp, Homo sapiens
cctcaacaagggagag

SEQ ID NO: 4052454 - DNA, 21 bp, Homo sapiens
cctcaacaggcccagggaggg

SEQ ID NO: 4052455 - DNA, 17 bp, Homo sapiens
cctcaacctcttctggc

SEQ ID NO: 4052456 - DNA, 20 bp, Homo sapiens
cctcaacctcttctggctca

SEQ ID NO: 4052457 - DNA, 20 bp, Homo sapiens
cctcaagcaatccacctgcc

SEQ ID NO: 4052458 - DNA, 22 bp, Homo sapiens
cctcaagcaatccacctgcctt

SEQ ID NO: 4052459 - DNA, 16 bp, Homo sapiens
cctcaagccccagcag

SEQ ID NO: 4052460 - DNA, 21 bp, Homo sapiens
cctcaaggacttgaaagcatc

SEQ ID NO: 4052461 - DNA, 19 bp, Homo sapiens
cctcaagggggactgtctt

SEQ ID NO: 4052462 - DNA, 21 bp, Homo sapiens
cctcaatccaccttcaggccc

SEQ ID NO: 4052463 - DNA, 22 bp, Homo sapiens
cctcaatccaccttcaggcccc

SEQ ID NO: 4052464 - DNA, 21 bp, Homo sapiens
cctcaatttttgtctcagaag

SEQ ID NO: 4052465 - DNA, 15 bp, Homo sapiens
cctcacacacacagc

SEQ ID NO: 4052466 - DNA, 16 bp, Homo sapiens
cctcacacacacagct

SEQ ID NO: 4052467 - DNA, 20 bp, Homo sapiens
cctcacacacacagctgggc

SEQ ID NO: 4052468 - DNA, 13 bp, Homo sapiens
cctcacacccctg

SEQ ID NO: 4052469 - DNA, 12 bp, Homo sapiens
cctcaccacctg

SEQ ID NO: 4052470 - DNA, 14 bp, Homo sapiens
cctcaccacctgac

SEQ ID NO: 4052471 - DNA, 19 bp, Homo sapiens
cctcacccacccctgcaca

SEQ ID NO: 4052472 - DNA, 15 bp, Homo sapiens
cctcacccggcctct

SEQ ID NO: 4052473 - DNA, 17 bp, Homo sapiens
cctcacccggcctcttc

SEQ ID NO: 4052474 - DNA, 15 bp, Homo sapiens
cctcaccctgcctta

SEQ ID NO: 4052475 - DNA, 22 bp, Homo sapiens
cctcaccctgccttatcttgca

SEQ ID NO: 4052476 - DNA, 17 bp, Homo sapiens
cctcacctcatgcccac

SEQ ID NO: 4052477 - DNA, 23 bp, Homo sapiens
cctcacctcatgcccaccccctg

SEQ ID NO: 4052478 - DNA, 14 bp, Homo sapiens
cctcacctctccag

SEQ ID NO: 4052479 - DNA, 15 bp, Homo sapiens
cctcacctctccagg

SEQ ID NO: 4052480 - DNA, 22 bp, Homo sapiens
cctcacctctggactggctaga

SEQ ID NO: 4052481 - DNA, 14 bp, Homo sapiens
cctcacctgtctag

SEQ ID NO: 4052482 - DNA, 12 bp, Homo sapiens
cctcaccttcct

SEQ ID NO: 4052483 - DNA, 13 bp, Homo sapiens
cctctgctcctgg

SEQ ID NO: 4052484 - DNA, 14 bp, Homo sapiens
cctctgctctgtcc

SEQ ID NO: 4052485 - DNA, 14 bp, Homo sapiens
cctctgcttctcat

SEQ ID NO: 4052486 - DNA, 22 bp, Homo sapiens
cctctggacagccagtgacctt

SEQ ID NO: 4052487 - DNA, 21 bp, Homo sapiens
cctctggacggcaggctcact

SEQ ID NO: 4052488 - DNA, 22 bp, Homo sapiens
cctctggacggcaggctcactg

SEQ ID NO: 4052489 - DNA, 23 bp, Homo sapiens
cctctggacggcaggctcactgc

SEQ ID NO: 4052490 - DNA, 15 bp, Homo sapiens
cctctggactggcta

SEQ ID NO: 4052491 - DNA, 16 bp, Homo sapiens
cctctggactggctag

SEQ ID NO: 4052492 - DNA, 17 bp, Homo sapiens
cctctggactggctaga

SEQ ID NO: 4052493 - DNA, 18 bp, Homo sapiens
cctctggactggctagag

SEQ ID NO: 4052494 - DNA, 17 bp, Homo sapiens
cctctggaggggtgtgg

SEQ ID NO: 4052495 - DNA, 12 bp, Homo sapiens
cctctggccagg

SEQ ID NO: 4052496 - DNA, 17 bp, Homo sapiens
cctctggccgcagaggt

SEQ ID NO: 4052497 - DNA, 20 bp, Homo sapiens
cctctggcttgacagcatga

SEQ ID NO: 4052498 - DNA, 19 bp, Homo sapiens
cctctggctttcccaggag

SEQ ID NO: 4052499 - DNA, 12 bp, Homo sapiens
cctctgggactg

SEQ ID NO: 4052500 - DNA, 18 bp, Homo sapiens
cctctgggcacgcctgct

SEQ ID NO: 4052501 - DNA, 17 bp, Homo sapiens
cctctggggaccccaac

SEQ ID NO: 4052502 - DNA, 21 bp, Homo sapiens
cctctggggaccccaacctca

SEQ ID NO: 4052503 - DNA, 23 bp, Homo sapiens
cctctggggaccccaacctcaga

SEQ ID NO: 4052504 - DNA, 18 bp, Homo sapiens
cctctggtgtgtggtgag

SEQ ID NO: 4052505 - DNA, 19 bp, Homo sapiens
cctctggtgtgtggtgagg

SEQ ID NO: 4052506 - DNA, 20 bp, Homo sapiens
cctctggtgtgtggtgaggg

SEQ ID NO: 4052507 - DNA, 15 bp, Homo sapiens
cctctgtaggcagca

SEQ ID NO: 4052508 - DNA, 16 bp, Homo sapiens
cctctgtatagaaatc

SEQ ID NO: 4052509 - DNA, 18 bp, Homo sapiens
cctctgtatagaaatcta

SEQ ID NO: 4052510 - DNA, 15 bp, Homo sapiens
cctctgtcagtcaca

SEQ ID NO: 4052511 - DNA, 18 bp, Homo sapiens
cctctgtcagtcacagcc

SEQ ID NO: 4052512 - DNA, 19 bp, Homo sapiens
cctctgtcagtcacagcca

SEQ ID NO: 4052513 - DNA, 18 bp, Homo sapiens
cctctgtcccacccctag

SEQ ID NO: 4052514 - DNA, 21 bp, Homo sapiens
cctctgtcccacccctagcca

SEQ ID NO: 4052515 - DNA, 23 bp, Homo sapiens
cctctgtctcatcctcctggaac

SEQ ID NO: 4052516 - DNA, 22 bp, Homo sapiens
cctctgtcttgtgaaggcaggg

SEQ ID NO: 4052517 - DNA, 22 bp, Homo sapiens
cctctgtgccagggcagcattt

SEQ ID NO: 4052518 - DNA, 23 bp, Homo sapiens
cctctgtggcattgaaatgagca

SEQ ID NO: 4052519 - DNA, 16 bp, Homo sapiens
cctcttactaatgtaa

SEQ ID NO: 4052520 - DNA, 17 bp, Homo sapiens
cctcttcaccccccact

SEQ ID NO: 4052521 - DNA, 13 bp, Homo sapiens
cctcttcactccc

SEQ ID NO: 4052522 - DNA, 13 bp, Homo sapiens
cctcttcagaact

SEQ ID NO: 4052523 - DNA, 17 bp, Homo sapiens
cctcttcccatgactgc

SEQ ID NO: 4052524 - DNA, 14 bp, Homo sapiens
cctcttccccagaa

SEQ ID NO: 4052525 - DNA, 21 bp, Homo sapiens
cctcttccctggtaagaaaaa

SEQ ID NO: 4052526 - DNA, 20 bp, Homo sapiens
cctcttctgctcttttcctg

SEQ ID NO: 4052527 - DNA, 18 bp, Homo sapiens
cctcttctttgtgccttt

SEQ ID NO: 4052528 - DNA, 14 bp, Homo sapiens
cctcttgagcagtg

SEQ ID NO: 4052529 - DNA, 19 bp, Homo sapiens
cctcttgagcagtggctgg

SEQ ID NO: 4052530 - DNA, 13 bp, Homo sapiens
cctcttgctgtct

SEQ ID NO: 4052531 - DNA, 14 bp, Homo sapiens
cctcttgctgtctc

SEQ ID NO: 4052532 - DNA, 15 bp, Homo sapiens
cctcttgctgtctct

SEQ ID NO: 4052533 - DNA, 22 bp, Homo sapiens
cctcttggtgtgattgcacaga

SEQ ID NO: 4052534 - DNA, 17 bp, Homo sapiens
cctcttgtaaagactgg

SEQ ID NO: 4052535 - DNA, 15 bp, Homo sapiens
cctctttccctagga

SEQ ID NO: 4052536 - DNA, 16 bp, Homo sapiens
cctctttccctgcgag

SEQ ID NO: 4052537 - DNA, 16 bp, Homo sapiens
cctctttcccttccag

SEQ ID NO: 4052538 - DNA, 18 bp, Homo sapiens
cctctttcccttccagtt

SEQ ID NO: 4052539 - DNA, 14 bp, Homo sapiens
cctctttggctccc

SEQ ID NO: 4052540 - DNA, 20 bp, Homo sapiens
cctctttggctcccctgtac

SEQ ID NO: 4052541 - DNA, 16 bp, Homo sapiens
cctctttttcctcctg

SEQ ID NO: 4052542 - DNA, 13 bp, Homo sapiens
cctcttttttcgt

SEQ ID NO: 4052543 - DNA, 19 bp, Homo sapiens
cctgaaagaggctgaggcc

SEQ ID NO: 4052544 - DNA, 14 bp, Homo sapiens
cctgaaatttcacc

SEQ ID NO: 4052545 - DNA, 14 bp, Homo sapiens
cctgaactgaggag

SEQ ID NO: 4052546 - DNA, 16 bp, Homo sapiens
cctgaagaaccagtcc

SEQ ID NO: 4052547 - DNA, 12 bp, Homo sapiens
cctgaagactga

SEQ ID NO: 4052548 - DNA, 14 bp, Homo sapiens
cctgaagactgagg

SEQ ID NO: 4052549 - DNA, 14 bp, Homo sapiens
cctgaatcatgagc

SEQ ID NO: 4052550 - DNA, 22 bp, Homo sapiens
cctgaatcccccttgccacccc

SEQ ID NO: 4052551 - DNA, 20 bp, Homo sapiens
cctgaatggttccatgcctg

SEQ ID NO: 4052552 - DNA, 21 bp, Homo sapiens
cctgaatgtttaaagatcatg

SEQ ID NO: 4052553 - DNA, 19 bp, Homo sapiens
cctgacaaccactggtctg

SEQ ID NO: 4052554 - DNA, 14 bp, Homo sapiens
cctgacacactaac

SEQ ID NO: 4052555 - DNA, 12 bp, Homo sapiens
cctgacaccccc

SEQ ID NO: 4052556 - DNA, 15 bp, Homo sapiens
cctgacaccccctcc

SEQ ID NO: 4052557 - DNA, 15 bp, Homo sapiens
cctgacactgagccc

SEQ ID NO: 4052558 - DNA, 16 bp, Homo sapiens
cctgacagaaggactc

SEQ ID NO: 4052559 - DNA, 19 bp, Homo sapiens
cctgacatcacagcagcct

SEQ ID NO: 4052560 - DNA, 21 bp, Homo sapiens
cctgacatcacagcagcctcc

SEQ ID NO: 4052561 - DNA, 23 bp, Homo sapiens
cctgaccaaacagccaactagcc

SEQ ID NO: 4052562 - DNA, 15 bp, Homo sapiens
cctgaccccttgctc

SEQ ID NO: 4052563 - DNA, 21 bp, Homo sapiens
cctgaccccttgctcccttca

SEQ ID NO: 4052564 - DNA, 16 bp, Homo sapiens
cctgacctccctctaa

SEQ ID NO: 4052565 - DNA, 17 bp, Homo sapiens
cctgacctccgcccctg

SEQ ID NO: 4052566 - DNA, 13 bp, Homo sapiens
cctgacctcttgc

SEQ ID NO: 4052567 - DNA, 14 bp, Homo sapiens
cctgacctcttgct

SEQ ID NO: 4052568 - DNA, 16 bp, Homo sapiens
cctgacctcttgctgt

SEQ ID NO: 4052569 - DNA, 23 bp, Homo sapiens
cctgacctcttgctgtctctgct

SEQ ID NO: 4052570 - DNA, 24 bp, Homo sapiens
cctgacctcttgctgtctctgctc

SEQ ID NO: 4052571 - DNA, 21 bp, Homo sapiens
cctgacctgtgagcccagctg

SEQ ID NO: 4052572 - DNA, 24 bp, Homo sapiens
cctgaccttggctgactggggctg

SEQ ID NO: 4052573 - DNA, 19 bp, Homo sapiens
cctgacggcgcccccagtg

SEQ ID NO: 4052574 - DNA, 13 bp, Homo sapiens
cctgactccccca

SEQ ID NO: 4052575 - DNA, 20 bp, Homo sapiens
cctgactcctctaagccact

SEQ ID NO: 4052576 - DNA, 17 bp, Homo sapiens
cctgactcctctggctt

SEQ ID NO: 4052577 - DNA, 19 bp, Homo sapiens
cctgactcctctggctttc

SEQ ID NO: 4052578 - DNA, 16 bp, Homo sapiens
cctgactctgccccct

SEQ ID NO: 4052579 - DNA, 13 bp, Homo sapiens
cctgactgctcag

SEQ ID NO: 4052580 - DNA, 12 bp, Homo sapiens
cctgactggcct

SEQ ID NO: 4052581 - DNA, 16 bp, Homo sapiens
cctgactgggctgggt

SEQ ID NO: 4052582 - DNA, 23 bp, Homo sapiens
cctgacttgagtgttccttttta

SEQ ID NO: 4052583 - DNA, 23 bp, Homo sapiens
cctgagaagaagtggctgccaca

SEQ ID NO: 4052584 - DNA, 16 bp, Homo sapiens
cctgagaagctgctcc

SEQ ID NO: 4052585 - DNA, 19 bp, Homo sapiens
cctgagaagctgctccagg

SEQ ID NO: 4052586 - DNA, 22 bp, Homo sapiens
cctgagaccagttgggagcact

SEQ ID NO: 4052587 - DNA, 23 bp, Homo sapiens
cctgagactgtcggagaggctgt

SEQ ID NO: 4052588 - DNA, 15 bp, Homo sapiens
cctgagagaattggc

SEQ ID NO: 4052589 - DNA, 18 bp, Homo sapiens
cctgagaggcaggcatag

SEQ ID NO: 4052590 - DNA, 23 bp, Homo sapiens
cctgagagtcagctctctgccct

SEQ ID NO: 4052591 - DNA, 15 bp, Homo sapiens
cctgagcaactcttg

SEQ ID NO: 4052592 - DNA, 18 bp, Homo sapiens
cctgagccaatgggacag

SEQ ID NO: 4052593 - DNA, 23 bp, Homo sapiens
cctgagccccagggtgcccagaa

SEQ ID NO: 4052594 - DNA, 23 bp, Homo sapiens
cctgagcctgtgggtccccactc

SEQ ID NO: 4052595 - DNA, 13 bp, Homo sapiens
cctgagctcactc

SEQ ID NO: 4052596 - DNA, 17 bp, Homo sapiens
cctgagctggggaagcc

SEQ ID NO: 4052597 - DNA, 20 bp, Homo sapiens
cctgaggacatggcttctga

SEQ ID NO: 4052598 - DNA, 21 bp, Homo sapiens
cctgaggccaggacgtctggg

SEQ ID NO: 4052599 - DNA, 22 bp, Homo sapiens
cctgaggcggaggctgtgctcc

SEQ ID NO: 4052600 - DNA, 22 bp, Homo sapiens
cctgagggcagaaaggttctgc

SEQ ID NO: 4052601 - DNA, 21 bp, Homo sapiens
cctgagggcagtaccctccat

SEQ ID NO: 4052602 - DNA, 17 bp, Homo sapiens
cctgaggggcagcctgc

SEQ ID NO: 4052603 - DNA, 20 bp, Homo sapiens
cctgaggggcagcctgcctt

SEQ ID NO: 4052604 - DNA, 23 bp, Homo sapiens
cctgaggggcatctgcccctccc

SEQ ID NO: 4052605 - DNA, 23 bp, Homo sapiens
cctgaggttaaacggtgcccatc

SEQ ID NO: 4052606 - DNA, 14 bp, Homo sapiens
cctgagtctcctgt

SEQ ID NO: 4052607 - DNA, 16 bp, Homo sapiens
cctgagtctcctgtgc

SEQ ID NO: 4052608 - DNA, 18 bp, Homo sapiens
cctgagtctcctgtgccc

SEQ ID NO: 4052609 - DNA, 14 bp, Homo sapiens
cctgagtgcgggct

SEQ ID NO: 4052610 - DNA, 21 bp, Homo sapiens
cctgagtgcgggctgaggcca

SEQ ID NO: 4052611 - DNA, 22 bp, Homo sapiens
cctgagtgcgggctgaggccag

SEQ ID NO: 4052612 - DNA, 17 bp, Homo sapiens
cctgagtttccagcctg

SEQ ID NO: 4052613 - DNA, 17 bp, Homo sapiens
cctgataataattgatc

SEQ ID NO: 4052614 - DNA, 17 bp, Homo sapiens
cctgatcactagcctgt

SEQ ID NO: 4052615 - DNA, 19 bp, Homo sapiens
cctgatcagaccacggctc

SEQ ID NO: 4052616 - DNA, 19 bp, Homo sapiens
cctgatcccttccacctgc

SEQ ID NO: 4052617 - DNA, 18 bp, Homo sapiens
cctgatcctggaggccca

SEQ ID NO: 4052618 - DNA, 19 bp, Homo sapiens
cctgatcctggaggcccag

SEQ ID NO: 4052619 - DNA, 16 bp, Homo sapiens
cctgatgctccctccc

SEQ ID NO: 4052620 - DNA, 23 bp, Homo sapiens
cctgatgctccctcccctgccct

SEQ ID NO: 4052621 - DNA, 19 bp, Homo sapiens
cctgatgcttttgtctaat

SEQ ID NO: 4052622 - DNA, 21 bp, Homo sapiens
cctgatggaagtaaagcctca

SEQ ID NO: 4052623 - DNA, 12 bp, Homo sapiens
cctgatggcaga

SEQ ID NO: 4052624 - DNA, 14 bp, Homo sapiens
cctgatggcagaac

SEQ ID NO: 4052625 - DNA, 23 bp, Homo sapiens
cctgatggcagaactcccacaac

SEQ ID NO: 4052626 - DNA, 18 bp, Homo sapiens
cctgatggggaagggact

SEQ ID NO: 4052627 - DNA, 16 bp, Homo sapiens
cctgattgacctgctc

SEQ ID NO: 4052628 - DNA, 20 bp, Homo sapiens
cctgattggtttctcttctc

SEQ ID NO: 4052629 - DNA, 22 bp, Homo sapiens
cctgatttaggagaagccagga

SEQ ID NO: 4052630 - DNA, 18 bp, Homo sapiens
cctgatttggtacttttg

SEQ ID NO: 4052631 - DNA, 22 bp, Homo sapiens
cctgcaaaaattcagagtcctt

SEQ ID NO: 4052632 - DNA, 22 bp, Homo sapiens
cctgcaaaatttgatgccagga

SEQ ID NO: 4052633 - DNA, 14 bp, Homo sapiens
cctgcaaaatttta

SEQ ID NO: 4052634 - DNA, 17 bp, Homo sapiens
cctgcaaacagaacagg

SEQ ID NO: 4052635 - DNA, 21 bp, Homo sapiens
cctgcaaacagaacagggtca

SEQ ID NO: 4052636 - DNA, 14 bp, Homo sapiens
cctgcaaactcact

SEQ ID NO: 4052637 - DNA, 22 bp, Homo sapiens
cctgcaaccaaactcccatcag

SEQ ID NO: 4052638 - DNA, 20 bp, Homo sapiens
cctgcaactcaaggactttg

SEQ ID NO: 4052639 - DNA, 12 bp, Homo sapiens
cctgcaaggact

SEQ ID NO: 4052640 - DNA, 22 bp, Homo sapiens
cctgcaatgaaaggtactatat

SEQ ID NO: 4052641 - DNA, 12 bp, Homo sapiens
cctgcacactcc

SEQ ID NO: 4052642 - DNA, 14 bp, Homo sapiens
cctgcacctgtgca

SEQ ID NO: 4052643 - DNA, 23 bp, Homo sapiens
cctgcacgtcatgggagggggct

SEQ ID NO: 4052644 - DNA, 15 bp, Homo sapiens
cctgcacgttcataa

SEQ ID NO: 4052645 - DNA, 19 bp, Homo sapiens
cctgcacgttcataaccaa

SEQ ID NO: 4052646 - DNA, 14 bp, Homo sapiens
cctgcagaaacagt

SEQ ID NO: 4052647 - DNA, 18 bp, Homo sapiens
cctgcagaaacagtactt

SEQ ID NO: 4052648 - DNA, 15 bp, Homo sapiens
cctgcagacctcaag

SEQ ID NO: 4052649 - DNA, 11 bp, Homo sapiens
cctgcagagag

SEQ ID NO: 4052650 - DNA, 13 bp, Homo sapiens
cctgcagagagaa

SEQ ID NO: 4052651 - DNA, 18 bp, Homo sapiens
cctgcagcaaacactcca

SEQ ID NO: 4052652 - DNA, 21 bp, Homo sapiens
cctgcagcaaacactccaccc

SEQ ID NO: 4052653 - DNA, 24 bp, Homo sapiens
cctgcagcaaacactccaccctcc

SEQ ID NO: 4052654 - DNA, 15 bp, Homo sapiens
cctgcagcaggcagc

SEQ ID NO: 4052655 - DNA, 20 bp, Homo sapiens
cctgcagcaggcagcttcta

SEQ ID NO: 4052656 - DNA, 13 bp, Homo sapiens
cctgcagcccacc

SEQ ID NO: 4052657 - DNA, 18 bp, Homo sapiens
cctgcagcccaccagacg

SEQ ID NO: 4052658 - DNA, 23 bp, Homo sapiens
cctgcagcccaccagacgtcagg

SEQ ID NO: 4052659 - DNA, 17 bp, Homo sapiens
cctgcagccccagaaga

SEQ ID NO: 4052660 - DNA, 12 bp, Homo sapiens
cctgcagctctc

SEQ ID NO: 4052661 - DNA, 15 bp, Homo sapiens
cctgcagctctcatg

SEQ ID NO: 4052662 - DNA, 18 bp, Homo sapiens
cctgcaggagagagcagc

SEQ ID NO: 4052663 - DNA, 20 bp, Homo sapiens
cctgcaggagagagcagcac

SEQ ID NO: 4052664 - DNA, 16 bp, Homo sapiens
cctgcaggcagagctg

SEQ ID NO: 4052665 - DNA, 21 bp, Homo sapiens
cctgcaggcagagctggagcc

SEQ ID NO: 4052666 - DNA, 21 bp, Homo sapiens
cctgcatccccttggctgtga

SEQ ID NO: 4052667 - DNA, 23 bp, Homo sapiens
cctgcatccccttggctgtgagg

SEQ ID NO: 4052668 - DNA, 11 bp, Homo sapiens
cctgccacagc

SEQ ID NO: 4052669 - DNA, 16 bp, Homo sapiens
cctgccacagccagag

SEQ ID NO: 4052670 - DNA, 18 bp, Homo sapiens
cctgccacagccagagga

SEQ ID NO: 4052671 - DNA, 17 bp, Homo sapiens
cctgccacatggagccc

SEQ ID NO: 4052672 - DNA, 13 bp, Homo sapiens
cctgccacctccc

SEQ ID NO: 4052673 - DNA, 14 bp, Homo sapiens
cctgccagagggga

SEQ ID NO: 4052674 - DNA, 18 bp, Homo sapiens
cctgccagctgcactgat

SEQ ID NO: 4052675 - DNA, 16 bp, Homo sapiens
cctgccatcatgcctg

SEQ ID NO: 4052676 - DNA, 19 bp, Homo sapiens
cctgccatgccaggaacct

SEQ ID NO: 4052677 - DNA, 23 bp, Homo sapiens
cctgcccaagggcctcccaccag

SEQ ID NO: 4052678 - DNA, 16 bp, Homo sapiens
cctgcccagcctgggg

SEQ ID NO: 4052679 - DNA, 19 bp, Homo sapiens
cctgcccatgtgtcccctc

SEQ ID NO: 4052680 - DNA, 21 bp, Homo sapiens
cctgccccacactccccgcct

SEQ ID NO: 4052681 - DNA, 18 bp, Homo sapiens
cctgccccaccccacctc

SEQ ID NO: 4052682 - DNA, 22 bp, Homo sapiens
cctgccccaccccacctccact

SEQ ID NO: 4052683 - DNA, 12 bp, Homo sapiens
cctgccccagcg

SEQ ID NO: 4052684 - DNA, 18 bp, Homo sapiens
cctgccccaggcctgaaa

SEQ ID NO: 4052685 - DNA, 14 bp, Homo sapiens
cctgcccccagccc

SEQ ID NO: 4052686 - DNA, 17 bp, Homo sapiens
cctgccccccagcctct

SEQ ID NO: 4052687 - DNA, 15 bp, Homo sapiens
cctgtatacagtgca

SEQ ID NO: 4052688 - DNA, 21 bp, Homo sapiens
cctgtatacagtgcagagcct

SEQ ID NO: 4052689 - DNA, 22 bp, Homo sapiens
cctgtatttttgttagtttaca

SEQ ID NO: 4052690 - DNA, 18 bp, Homo sapiens
cctgtcaagttaacaagg

SEQ ID NO: 4052691 - DNA, 14 bp, Homo sapiens
cctgtcacattgca

SEQ ID NO: 4052692 - DNA, 12 bp, Homo sapiens
cctgtcaccccc

SEQ ID NO: 4052693 - DNA, 15 bp, Homo sapiens
cctgtcacccccact

SEQ ID NO: 4052694 - DNA, 22 bp, Homo sapiens
cctgtcacccccactcccgcct

SEQ ID NO: 4052695 - DNA, 13 bp, Homo sapiens
cctgtcaggaggc

SEQ ID NO: 4052696 - DNA, 15 bp, Homo sapiens
cctgtccagctccaa

SEQ ID NO: 4052697 - DNA, 18 bp, Homo sapiens
cctgtcccaattctgccc

SEQ ID NO: 4052698 - DNA, 21 bp, Homo sapiens
cctgtcccacccacacagctg

SEQ ID NO: 4052699 - DNA, 16 bp, Homo sapiens
cctgtcccatgcaggc

SEQ ID NO: 4052700 - DNA, 19 bp, Homo sapiens
cctgtccccaccctccact

SEQ ID NO: 4052701 - DNA, 17 bp, Homo sapiens
cctgtccccctcccctc

SEQ ID NO: 4052702 - DNA, 14 bp, Homo sapiens
cctgtccctgaggt

SEQ ID NO: 4052703 - DNA, 15 bp, Homo sapiens
cctgtcccttgacct

SEQ ID NO: 4052704 - DNA, 15 bp, Homo sapiens
cctgtcccttgcctc

SEQ ID NO: 4052705 - DNA, 14 bp, Homo sapiens
cctgtcccttttcc

SEQ ID NO: 4052706 - DNA, 21 bp, Homo sapiens
cctgtcctaaggaaccttcct

SEQ ID NO: 4052707 - DNA, 13 bp, Homo sapiens
cctgtcctccaac

SEQ ID NO: 4052708 - DNA, 21 bp, Homo sapiens
cctgtcctccaacaccaagca

SEQ ID NO: 4052709 - DNA, 22 bp, Homo sapiens
cctgtcctccaacaccaagcac

SEQ ID NO: 4052710 - DNA, 17 bp, Homo sapiens
cctgtcgtgccagtcct

SEQ ID NO: 4052711 - DNA, 18 bp, Homo sapiens
cctgtcgtgccagtcctg

SEQ ID NO: 4052712 - DNA, 17 bp, Homo sapiens
cctgtctaggtctcctc

SEQ ID NO: 4052713 - DNA, 22 bp, Homo sapiens
cctgtctaggtctcctcagggt

SEQ ID NO: 4052714 - DNA, 20 bp, Homo sapiens
cctgtctataagagaattat

SEQ ID NO: 4052715 - DNA, 13 bp, Homo sapiens
cctgtctcagcct

SEQ ID NO: 4052716 - DNA, 16 bp, Homo sapiens
cctgtctcagcctccc

SEQ ID NO: 4052717 - DNA, 12 bp, Homo sapiens
cctgtctccagc

SEQ ID NO: 4052718 - DNA, 14 bp, Homo sapiens
cctgtctccagctg

SEQ ID NO: 4052719 - DNA, 17 bp, Homo sapiens
cctgtctgactactttg

SEQ ID NO: 4052720 - DNA, 19 bp, Homo sapiens
cctgtctgccccagcccag

SEQ ID NO: 4052721 - DNA, 20 bp, Homo sapiens
cctgtctgccccagcccaga

SEQ ID NO: 4052722 - DNA, 18 bp, Homo sapiens
cctgtctgctaggcgctg

SEQ ID NO: 4052723 - DNA, 14 bp, Homo sapiens
cctgtctgctccag

SEQ ID NO: 4052724 - DNA, 15 bp, Homo sapiens
cctgtctgctccagc

SEQ ID NO: 4052725 - DNA, 19 bp, Homo sapiens
cctgtctgtgaagagcaag

SEQ ID NO: 4052726 - DNA, 21 bp, Homo sapiens
cctgtcttatggtccagaaac

SEQ ID NO: 4052727 - DNA, 14 bp, Homo sapiens
cctgtcttccaagg

SEQ ID NO: 4052728 - DNA, 15 bp, Homo sapiens
cctgtcttccaagga

SEQ ID NO: 4052729 - DNA, 17 bp, Homo sapiens
cctgtcttcggccgagc

SEQ ID NO: 4052730 - DNA, 22 bp, Homo sapiens
cctgtcttcggccgagctggtt

SEQ ID NO: 4052731 - DNA, 14 bp, Homo sapiens
cctgtcttctgggc

SEQ ID NO: 4052732 - DNA, 17 bp, Homo sapiens
cctgtgacatggtgcct

SEQ ID NO: 4052733 - DNA, 13 bp, Homo sapiens
cctgtgagctgca

SEQ ID NO: 4052734 - DNA, 16 bp, Homo sapiens
cctgtgagctgcacca

SEQ ID NO: 4052735 - DNA, 16 bp, Homo sapiens
cctgtgagtaaatatt

SEQ ID NO: 4052736 - DNA, 16 bp, Homo sapiens
cctgtgatgctgggca

SEQ ID NO: 4052737 - DNA, 12 bp, Homo sapiens
cctgtgccaata

SEQ ID NO: 4052738 - DNA, 12 bp, Homo sapiens
cctgtgccaggt

SEQ ID NO: 4052739 - DNA, 14 bp, Homo sapiens
cctgtgccaggtga

SEQ ID NO: 4052740 - DNA, 21 bp, Homo sapiens
cctgtgccaggtgaaggaggc

SEQ ID NO: 4052741 - DNA, 13 bp, Homo sapiens
cctgtgccatcac

SEQ ID NO: 4052742 - DNA, 16 bp, Homo sapiens
cctgtgcccactccct

SEQ ID NO: 4052743 - DNA, 15 bp, Homo sapiens
cctgtgcctctggga

SEQ ID NO: 4052744 - DNA, 12 bp, Homo sapiens
cctgtgcctggc

SEQ ID NO: 4052745 - DNA, 14 bp, Homo sapiens
cctgtgcctggccc

SEQ ID NO: 4052746 - DNA, 20 bp, Homo sapiens
cctgtgcctggccccagcct

SEQ ID NO: 4052747 - DNA, 19 bp, Homo sapiens
cctgtgctagttttacaga

SEQ ID NO: 4052748 - DNA, 14 bp, Homo sapiens
cctgtgctggggga

SEQ ID NO: 4052749 - DNA, 21 bp, Homo sapiens
cctgtggaatgagtgtgcatg

SEQ ID NO: 4052750 - DNA, 18 bp, Homo sapiens
cctgtggagctcagcccc

SEQ ID NO: 4052751 - DNA, 19 bp, Homo sapiens
cctgtggagctcagccccg

SEQ ID NO: 4052752 - DNA, 19 bp, Homo sapiens
cctgtggcactcagggagc

SEQ ID NO: 4052753 - DNA, 18 bp, Homo sapiens
cctgtggcatctttgcct

SEQ ID NO: 4052754 - DNA, 14 bp, Homo sapiens
cctgtggccctggc

SEQ ID NO: 4052755 - DNA, 15 bp, Homo sapiens
cctgtggcctgccag

SEQ ID NO: 4052756 - DNA, 14 bp, Homo sapiens
cctgtgggagcctg

SEQ ID NO: 4052757 - DNA, 14 bp, Homo sapiens
cctgtgggggtggc

SEQ ID NO: 4052758 - DNA, 15 bp, Homo sapiens
cctgtgggtccccac

SEQ ID NO: 4052759 - DNA, 18 bp, Homo sapiens
cctgtgggtccccactca

SEQ ID NO: 4052760 - DNA, 19 bp, Homo sapiens
cctgtggttacagtgcaga

SEQ ID NO: 4052761 - DNA, 15 bp, Homo sapiens
cctgtgtgcttggtc

SEQ ID NO: 4052762 - DNA, 19 bp, Homo sapiens
cctgtgtgtactctgtcca

SEQ ID NO: 4052763 - DNA, 20 bp, Homo sapiens
cctgtgtgtactctgtccag

SEQ ID NO: 4052764 - DNA, 22 bp, Homo sapiens
cctgtgttgtctctagagcagg

SEQ ID NO: 4052765 - DNA, 14 bp, Homo sapiens
cctgttaaacagta

SEQ ID NO: 4052766 - DNA, 15 bp, Homo sapiens
cctgttacccagaga

SEQ ID NO: 4052767 - DNA, 15 bp, Homo sapiens
cctgttagcagacag

SEQ ID NO: 4052768 - DNA, 16 bp, Homo sapiens
cctgttcatgtgcctc

SEQ ID NO: 4052769 - DNA, 17 bp, Homo sapiens
cctgttcatgtgcctct

SEQ ID NO: 4052770 - DNA, 16 bp, Homo sapiens
cctgttccccagagaa

SEQ ID NO: 4052771 - DNA, 22 bp, Homo sapiens
cctgttcccctcactggatgaa

SEQ ID NO: 4052772 - DNA, 18 bp, Homo sapiens
cctgttcctccctcccac

SEQ ID NO: 4052773 - DNA, 17 bp, Homo sapiens
cctgttctgaaatgttc

SEQ ID NO: 4052774 - DNA, 15 bp, Homo sapiens
cctgtttaatattta

SEQ ID NO: 4052775 - DNA, 18 bp, Homo sapiens
cctgtttctgcagccctt

SEQ ID NO: 4052776 - DNA, 19 bp, Homo sapiens
cctgttttatactgtactt

SEQ ID NO: 4052777 - DNA, 19 bp, Homo sapiens
cctgttttctgtttcttct

SEQ ID NO: 4052778 - DNA, 17 bp, Homo sapiens
cctgtttttaagctgtt

SEQ ID NO: 4052779 - DNA, 19 bp, Homo sapiens
cctgtttttaagctgtttc

SEQ ID NO: 4052780 - DNA, 16 bp, Homo sapiens
cctgtttttctgggtg

SEQ ID NO: 4052781 - DNA, 17 bp, Homo sapiens
cctgtttttctgggtgg

SEQ ID NO: 4052782 - DNA, 16 bp, Homo sapiens
cctgtttttttttcat

SEQ ID NO: 4052783 - DNA, 23 bp, Homo sapiens
ccttaaaaactggcccgtggaga

SEQ ID NO: 4052784 - DNA, 17 bp, Homo sapiens
ccttaaaaccaaagagg

SEQ ID NO: 4052785 - DNA, 12 bp, Homo sapiens
ccttaaaatgga

SEQ ID NO: 4052786 - DNA, 18 bp, Homo sapiens
ccttaaaattaccagaca

SEQ ID NO: 4052787 - DNA, 15 bp, Homo sapiens
ccttaaacacaggct

SEQ ID NO: 4052788 - DNA, 17 bp, Homo sapiens
ccttaaactgtacagaa

SEQ ID NO: 4052789 - DNA, 22 bp, Homo sapiens
ccttaatgcttcatatgaggag

SEQ ID NO: 4052790 - DNA, 19 bp, Homo sapiens
cgaagtggactggcccctg

SEQ ID NO: 4052791 - DNA, 18 bp, Homo sapiens
cgaatcagctatttactg

SEQ ID NO: 4052792 - DNA, 18 bp, Homo sapiens
cgaatcccctccctgtca

SEQ ID NO: 4052793 - DNA, 19 bp, Homo sapiens
cgaatcccctccctgtcaa

SEQ ID NO: 4052794 - DNA, 13 bp, Homo sapiens
cgaatgtgcaggt

SEQ ID NO: 4052795 - DNA, 22 bp, Homo sapiens
cgacaatgtcgagtatattatt

SEQ ID NO: 4052796 - DNA, 16 bp, Homo sapiens
cgacagagcgagactt

SEQ ID NO: 4052797 - DNA, 14 bp, Homo sapiens
cgacagcctggcac

SEQ ID NO: 4052798 - DNA, 16 bp, Homo sapiens
cgacagggcctggagc

SEQ ID NO: 4052799 - DNA, 19 bp, Homo sapiens
cgacagggcctggagcccc

SEQ ID NO: 4052800 - DNA, 13 bp, Homo sapiens
cgaccatctgatt

SEQ ID NO: 4052801 - DNA, 19 bp, Homo sapiens
cgacccctagttccctctg

SEQ ID NO: 4052802 - DNA, 14 bp, Homo sapiens
cgaccctcatggcc

SEQ ID NO: 4052803 - DNA, 21 bp, Homo sapiens
cgaccctcatggcccccaggg

SEQ ID NO: 4052804 - DNA, 23 bp, Homo sapiens
cgacctggctgcccctcaccttg

SEQ ID NO: 4052805 - DNA, 15 bp, Homo sapiens
cgactagacacacaa

SEQ ID NO: 4052806 - DNA, 12 bp, Homo sapiens
cgactatagaaa

SEQ ID NO: 4052807 - DNA, 16 bp, Homo sapiens
cgactctggccctggc

SEQ ID NO: 4052808 - DNA, 19 bp, Homo sapiens
cgactgactggaggaggcc

SEQ ID NO: 4052809 - DNA, 14 bp, Homo sapiens
cgactggccagggc

SEQ ID NO: 4052810 - DNA, 24 bp, Homo sapiens
cgagaagggtggatgacagggcag

SEQ ID NO: 4052811 - DNA, 13 bp, Homo sapiens
cgagaagtgctct

SEQ ID NO: 4052812 - DNA, 18 bp, Homo sapiens
cgagaagtgctcttggct

SEQ ID NO: 4052813 - DNA, 22 bp, Homo sapiens
cgagacagtccagtgtcacctc

SEQ ID NO: 4052814 - DNA, 14 bp, Homo sapiens
cgagaccagcctgg

SEQ ID NO: 4052815 - DNA, 13 bp, Homo sapiens
cgagaccagtctg

SEQ ID NO: 4052816 - DNA, 14 bp, Homo sapiens
cgagactctgtctc

SEQ ID NO: 4052817 - DNA, 18 bp, Homo sapiens
cgagacttggtttcaaaa

SEQ ID NO: 4052818 - DNA, 20 bp, Homo sapiens
cgagagaggagccagacaga

SEQ ID NO: 4052819 - DNA, 19 bp, Homo sapiens
cgagaggccaaaggctggt

SEQ ID NO: 4052820 - DNA, 13 bp, Homo sapiens
cgagagggagaga

SEQ ID NO: 4052821 - DNA, 22 bp, Homo sapiens
cgagatccccagggcagcctgg

SEQ ID NO: 4052822 - DNA, 15 bp, Homo sapiens
cgagcaaagatcaaa

SEQ ID NO: 4052823 - DNA, 20 bp, Homo sapiens
cgagcaaagatcaaaataaa

SEQ ID NO: 4052824 - DNA, 13 bp, Homo sapiens
cgagcagggctgt

SEQ ID NO: 4052825 - DNA, 15 bp, Homo sapiens
cgagcagggctgtgt

SEQ ID NO: 4052826 - DNA, 15 bp, Homo sapiens
cgagcagtcctgcct

SEQ ID NO: 4052827 - DNA, 23 bp, Homo sapiens
cgagcagtcctgcctcagcctcc

SEQ ID NO: 4052828 - DNA, 12 bp, Homo sapiens
cgagcccagatg

SEQ ID NO: 4052829 - DNA, 22 bp, Homo sapiens
cgagcccttgcccatgctgggc

SEQ ID NO: 4052830 - DNA, 16 bp, Homo sapiens
cgagcgttcccagcag

SEQ ID NO: 4052831 - DNA, 19 bp, Homo sapiens
cgagcgttcccagcagggg

SEQ ID NO: 4052832 - DNA, 15 bp, Homo sapiens
cgagctccagagcaa

SEQ ID NO: 4052833 - DNA, 12 bp, Homo sapiens
cgagctggagcg

SEQ ID NO: 4052834 - DNA, 13 bp, Homo sapiens
cgagctggtgcat

SEQ ID NO: 4052835 - DNA, 15 bp, Homo sapiens
cgagctggtgcatta

SEQ ID NO: 4052836 - DNA, 16 bp, Homo sapiens
cgaggaggtgcctgga

SEQ ID NO: 4052837 - DNA, 23 bp, Homo sapiens
cgaggccctcaatccaccttcag

SEQ ID NO: 4052838 - DNA, 17 bp, Homo sapiens
cgaggcgatgccacgct

SEQ ID NO: 4052839 - DNA, 21 bp, Homo sapiens
cgagggctgatggaggaaaaa

SEQ ID NO: 4052840 - DNA, 19 bp, Homo sapiens
cgagggctggctggcctca

SEQ ID NO: 4052841 - DNA, 18 bp, Homo sapiens
cgaggggttggtgggagg

SEQ ID NO: 4052842 - DNA, 20 bp, Homo sapiens
cgaggggttggtgggagggt

SEQ ID NO: 4052843 - DNA, 20 bp, Homo sapiens
cgaggtagagtttgaaggag

SEQ ID NO: 4052844 - DNA, 13 bp, Homo sapiens
cgaggtcaggaga

SEQ ID NO: 4052845 - DNA, 20 bp, Homo sapiens
cgagtcattcgttctgtgga

SEQ ID NO: 4052846 - DNA, 13 bp, Homo sapiens
cgagtccaagctg

SEQ ID NO: 4052847 - DNA, 14 bp, Homo sapiens
cgagtccaagctgg

SEQ ID NO: 4052848 - DNA, 13 bp, Homo sapiens
cgagtccaaggcc

SEQ ID NO: 4052849 - DNA, 21 bp, Homo sapiens
cgagtctggggacctggcact

SEQ ID NO: 4052850 - DNA, 17 bp, Homo sapiens
cgagtgagacaaaattt

SEQ ID NO: 4052851 - DNA, 11 bp, Homo sapiens
cgagtgccagg

SEQ ID NO: 4052852 - DNA, 13 bp, Homo sapiens
cgagtgggaagga

SEQ ID NO: 4052853 - DNA, 16 bp, Homo sapiens
cgagttggcaaaatgg

SEQ ID NO: 4052854 - DNA, 21 bp, Homo sapiens
cgatacaccgggcctggagaa

SEQ ID NO: 4052855 - DNA, 15 bp, Homo sapiens
cgatatacagatgaa

SEQ ID NO: 4052856 - DNA, 20 bp, Homo sapiens
cgatccacctgtctcagcct

SEQ ID NO: 4052857 - DNA, 14 bp, Homo sapiens
cgatcccacacagg

SEQ ID NO: 4052858 - DNA, 16 bp, Homo sapiens
cgatctctcctggcct

SEQ ID NO: 4052859 - DNA, 17 bp, Homo sapiens
cgatctctcctggccta

SEQ ID NO: 4052860 - DNA, 23 bp, Homo sapiens
cgatgcagacagggggccagaac

SEQ ID NO: 4052861 - DNA, 15 bp, Homo sapiens
cgatgctccctcagc

SEQ ID NO: 4052862 - DNA, 23 bp, Homo sapiens
cgatgctccctcagcctcagagg

SEQ ID NO: 4052863 - DNA, 14 bp, Homo sapiens
cgatggagccccca

SEQ ID NO: 4052864 - DNA, 22 bp, Homo sapiens
cgatggggcaagacagaaaagt

SEQ ID NO: 4052865 - DNA, 19 bp, Homo sapiens
cgattggagaatactttgc

SEQ ID NO: 4052866 - DNA, 13 bp, Homo sapiens
cgcacaaacacac

SEQ ID NO: 4052867 - DNA, 16 bp, Homo sapiens
cgcacaaacacacaca

SEQ ID NO: 4052868 - DNA, 18 bp, Homo sapiens
cgcacaaacacacacact

SEQ ID NO: 4052869 - DNA, 17 bp, Homo sapiens
cgcacacagctgagcac

SEQ ID NO: 4052870 - DNA, 15 bp, Homo sapiens
cgcacactggggccc

SEQ ID NO: 4052871 - DNA, 16 bp, Homo sapiens
cgcacatggtgtgggg

SEQ ID NO: 4052872 - DNA, 18 bp, Homo sapiens
cgcaccaatgcccagcag

SEQ ID NO: 4052873 - DNA, 16 bp, Homo sapiens
cgcaccattctcctgc

SEQ ID NO: 4052874 - DNA, 15 bp, Homo sapiens
cgcaccccggcctca

SEQ ID NO: 4052875 - DNA, 16 bp, Homo sapiens
cgcaccccggcctcag

SEQ ID NO: 4052876 - DNA, 16 bp, Homo sapiens
cgcacctgcctcagga

SEQ ID NO: 4052877 - DNA, 15 bp, Homo sapiens
cgcacctgtgctgga

SEQ ID NO: 4052878 - DNA, 13 bp, Homo sapiens
cgcacgcacacac

SEQ ID NO: 4052879 - DNA, 14 bp, Homo sapiens
cgcacgcacacaca

SEQ ID NO: 4052880 - DNA, 16 bp, Homo sapiens
cgcacgcacacacaca

SEQ ID NO: 4052881 - DNA, 16 bp, Homo sapiens
cgcactgggccacgga

SEQ ID NO: 4052882 - DNA, 18 bp, Homo sapiens
cgcactgggccacggagg

SEQ ID NO: 4052883 - DNA, 19 bp, Homo sapiens
cgcactttccacttcttcc

SEQ ID NO: 4052884 - DNA, 13 bp, Homo sapiens
cgcagaagccctg

SEQ ID NO: 4052885 - DNA, 18 bp, Homo sapiens
cgcagacgggcacagaca

SEQ ID NO: 4052886 - DNA, 17 bp, Homo sapiens
cgcagccctagagcctg

SEQ ID NO: 4052887 - DNA, 18 bp, Homo sapiens
cgcagccctagagcctgc

SEQ ID NO: 4052888 - DNA, 10 bp, Homo sapiens
cgcagccctg

SEQ ID NO: 4052889 - DNA, 14 bp, Homo sapiens
cgcagcggggtagg

SEQ ID NO: 4052890 - DNA, 13 bp, Homo sapiens
cgcagctggactc

SEQ ID NO: 4052891 - DNA, 15 bp, Homo sapiens
cgcaggaactcccag

SEQ ID NO: 4052892 - DNA, 17 bp, Homo sapiens
cgcaggaactcccagca

SEQ ID NO: 4052893 - DNA, 13 bp, Homo sapiens
cgtaaccagccag

SEQ ID NO: 4052894 - DNA, 24 bp, Homo sapiens
cgtaagatacaagtttcagacagg

SEQ ID NO: 4052895 - DNA, 14 bp, Homo sapiens
cgtaataattatta

SEQ ID NO: 4052896 - DNA, 18 bp, Homo sapiens
cgtaatcatccccatcct

SEQ ID NO: 4052897 - DNA, 17 bp, Homo sapiens
cgtacattcaatgttta

SEQ ID NO: 4052898 - DNA, 21 bp, Homo sapiens
cgtacctcttcccatgactgc

SEQ ID NO: 4052899 - DNA, 14 bp, Homo sapiens
cgtacttataaaga

SEQ ID NO: 4052900 - DNA, 13 bp, Homo sapiens
cgtagctctctta

SEQ ID NO: 4052901 - DNA, 19 bp, Homo sapiens
cgtagtcggcacagcctgg

SEQ ID NO: 4052902 - DNA, 23 bp, Homo sapiens
cgtatctttaaaaagcagtcctc

SEQ ID NO: 4052903 - DNA, 17 bp, Homo sapiens
cgtcactttatttcatt

SEQ ID NO: 4052904 - DNA, 22 bp, Homo sapiens
cgtcaggccctgactcctctgg

SEQ ID NO: 4052905 - DNA, 18 bp, Homo sapiens
cgtcatcggaggctgggc

SEQ ID NO: 4052906 - DNA, 21 bp, Homo sapiens
cgtccaggttcaacccacagc

SEQ ID NO: 4052907 - DNA, 20 bp, Homo sapiens
cgtccatatcagaactgtgc

SEQ ID NO: 4052908 - DNA, 18 bp, Homo sapiens
cgtcccagcatccctgga

SEQ ID NO: 4052909 - DNA, 15 bp, Homo sapiens
cgtcccctccttccc

SEQ ID NO: 4052910 - DNA, 22 bp, Homo sapiens
cgtcccctccttccctcacccc

SEQ ID NO: 4052911 - DNA, 18 bp, Homo sapiens
cgtcctccgtccatatca

SEQ ID NO: 4052912 - DNA, 17 bp, Homo sapiens
cgtcctcctcacctcat

SEQ ID NO: 4052913 - DNA, 21 bp, Homo sapiens
cgtcctcctcacctcatgccc

SEQ ID NO: 4052914 - DNA, 19 bp, Homo sapiens
cgtcgggggctgaggggca

SEQ ID NO: 4052915 - DNA, 21 bp, Homo sapiens
cgtcgtctccctcgacagcgc

SEQ ID NO: 4052916 - DNA, 17 bp, Homo sapiens
cgtctaaccacagctcc

SEQ ID NO: 4052917 - DNA, 18 bp, Homo sapiens
cgtctaaccacagctcct

SEQ ID NO: 4052918 - DNA, 13 bp, Homo sapiens
cgtctacagctcc

SEQ ID NO: 4052919 - DNA, 17 bp, Homo sapiens
cgtctcaacccctcaca

SEQ ID NO: 4052920 - DNA, 11 bp, Homo sapiens
cgtctcagtgt

SEQ ID NO: 4052921 - DNA, 11 bp, Homo sapiens
cgtctccctcg

SEQ ID NO: 4052922 - DNA, 15 bp, Homo sapiens
cgtctgaagcttgac

SEQ ID NO: 4052923 - DNA, 18 bp, Homo sapiens
cgtctgaagcttgactcc

SEQ ID NO: 4052924 - DNA, 21 bp, Homo sapiens
cgtctgaagcttgactcccaa

SEQ ID NO: 4052925 - DNA, 15 bp, Homo sapiens
cgtctgcccaccatt

SEQ ID NO: 4052926 - DNA, 16 bp, Homo sapiens
cgtcttggtgtaattt

SEQ ID NO: 4052927 - DNA, 16 bp, Homo sapiens
cgtgaaaacggagctg

SEQ ID NO: 4052928 - DNA, 17 bp, Homo sapiens
cgtgaaaacggagctga

SEQ ID NO: 4052929 - DNA, 15 bp, Homo sapiens
cgtgaaacacaccag

SEQ ID NO: 4052930 - DNA, 16 bp, Homo sapiens
cgtgaaacacaccagg

SEQ ID NO: 4052931 - DNA, 18 bp, Homo sapiens
cgtgaaagaattattttt

SEQ ID NO: 4052932 - DNA, 19 bp, Homo sapiens
cgtgaaagaattatttttg

SEQ ID NO: 4052933 - DNA, 14 bp, Homo sapiens
cgtgaaccagaggg

SEQ ID NO: 4052934 - DNA, 17 bp, Homo sapiens
cgtgacaataaaacatt

SEQ ID NO: 4052935 - DNA, 19 bp, Homo sapiens
cgtgacaataaaacattaa

SEQ ID NO: 4052936 - DNA, 16 bp, Homo sapiens
cgtgacctggtcaggg

SEQ ID NO: 4052937 - DNA, 13 bp, Homo sapiens
cgtgagccaggta

SEQ ID NO: 4052938 - DNA, 16 bp, Homo sapiens
cgtgaggtcccaggaa

SEQ ID NO: 4052939 - DNA, 16 bp, Homo sapiens
cgtgagtcatttaaat

SEQ ID NO: 4052940 - DNA, 22 bp, Homo sapiens
cgtgcacgtggagagctggtgc

SEQ ID NO: 4052941 - DNA, 13 bp, Homo sapiens
cgtgcactctgct

SEQ ID NO: 4052942 - DNA, 18 bp, Homo sapiens
cgtgcactctgctaatca

SEQ ID NO: 4052943 - DNA, 21 bp, Homo sapiens
cgtgcatcccccctgctcagc

SEQ ID NO: 4052944 - DNA, 17 bp, Homo sapiens
cgtgcatccctgagaca

SEQ ID NO: 4052945 - DNA, 20 bp, Homo sapiens
cgtgcattaaaatttcttat

SEQ ID NO: 4052946 - DNA, 19 bp, Homo sapiens
cgtgccaggagcaatggga

SEQ ID NO: 4052947 - DNA, 18 bp, Homo sapiens
cgtgccgtgtatttttta

SEQ ID NO: 4052948 - DNA, 13 bp, Homo sapiens
cgtgcctggccag

SEQ ID NO: 4052949 - DNA, 17 bp, Homo sapiens
cgtggaacctctgtctc

SEQ ID NO: 4052950 - DNA, 17 bp, Homo sapiens
cgtggagagctggtgcc

SEQ ID NO: 4052951 - DNA, 21 bp, Homo sapiens
cgtggagcggggtatgaagag

SEQ ID NO: 4052952 - DNA, 22 bp, Homo sapiens
cgtggagcggggtatgaagagc

SEQ ID NO: 4052953 - DNA, 20 bp, Homo sapiens
cgtggcatgttttgatttgt

SEQ ID NO: 4052954 - DNA, 15 bp, Homo sapiens
cgtggcctcttgagc

SEQ ID NO: 4052955 - DNA, 16 bp, Homo sapiens
cgtggcctcttgagca

SEQ ID NO: 4052956 - DNA, 14 bp, Homo sapiens
cgtggctcagccag

SEQ ID NO: 4052957 - DNA, 18 bp, Homo sapiens
cgtggctcagccagcact

SEQ ID NO: 4052958 - DNA, 20 bp, Homo sapiens
cgtggcttcccgctcagccc

SEQ ID NO: 4052959 - DNA, 14 bp, Homo sapiens
cgtgggagccagcc

SEQ ID NO: 4052960 - DNA, 19 bp, Homo sapiens
cgtgggctgaccaggcttc

SEQ ID NO: 4052961 - DNA, 17 bp, Homo sapiens
cgtggggtaacatctgt

SEQ ID NO: 4052962 - DNA, 15 bp, Homo sapiens
cgtggtatgtctgcc

SEQ ID NO: 4052963 - DNA, 20 bp, Homo sapiens
cgtggtcactgtgcactgcc

SEQ ID NO: 4052964 - DNA, 19 bp, Homo sapiens
cgtggtccaaccaggagct

SEQ ID NO: 4052965 - DNA, 16 bp, Homo sapiens
cgtggtccctgaggat

SEQ ID NO: 4052966 - DNA, 15 bp, Homo sapiens
cgtgtaaaccaaagc

SEQ ID NO: 4052967 - DNA, 12 bp, Homo sapiens
cgtgtccagcac

SEQ ID NO: 4052968 - DNA, 14 bp, Homo sapiens
cgtgtccagcacag

SEQ ID NO: 4052969 - DNA, 12 bp, Homo sapiens
cgtgtctgaatc

SEQ ID NO: 4052970 - DNA, 20 bp, Homo sapiens
cgtgtcttccactttgcata

SEQ ID NO: 4052971 - DNA, 17 bp, Homo sapiens
cgtgtgagtgtgacagg

SEQ ID NO: 4052972 - DNA, 12 bp, Homo sapiens
cgtgtgctgtgt

SEQ ID NO: 4052973 - DNA, 16 bp, Homo sapiens
cgtgtggatcttgcca

SEQ ID NO: 4052974 - DNA, 23 bp, Homo sapiens
cgtgtggatcttgccacatttct

SEQ ID NO: 4052975 - DNA, 18 bp, Homo sapiens
cgtgtgtagagttaagaa

SEQ ID NO: 4052976 - DNA, 22 bp, Homo sapiens
cgttaacattgaccaagaactg

SEQ ID NO: 4052977 - DNA, 17 bp, Homo sapiens
cgttaactgtgtatgta

SEQ ID NO: 4052978 - DNA, 14 bp, Homo sapiens
cgttattataaatg

SEQ ID NO: 4052979 - DNA, 15 bp, Homo sapiens
cgttattataaatgt

SEQ ID NO: 4052980 - DNA, 15 bp, Homo sapiens
cgttattgttgactt

SEQ ID NO: 4052981 - DNA, 19 bp, Homo sapiens
cgttcagtgtcccaggcag

SEQ ID NO: 4052982 - DNA, 13 bp, Homo sapiens
cgttcataaccaa

SEQ ID NO: 4052983 - DNA, 12 bp, Homo sapiens
cgttccacagtt

SEQ ID NO: 4052984 - DNA, 14 bp, Homo sapiens
cgttccacagttgc

SEQ ID NO: 4052985 - DNA, 22 bp, Homo sapiens
cgttccacagttgccaccacct

SEQ ID NO: 4052986 - DNA, 13 bp, Homo sapiens
cgttccagttccc

SEQ ID NO: 4052987 - DNA, 14 bp, Homo sapiens
cgttcccagcaggg

SEQ ID NO: 4052988 - DNA, 17 bp, Homo sapiens
cgttcctattgtcatta

SEQ ID NO: 4052989 - DNA, 21 bp, Homo sapiens
cgttcctgacatcacagcagc

SEQ ID NO: 4052990 - DNA, 22 bp, Homo sapiens
cgttcctgacatcacagcagcc

SEQ ID NO: 4052991 - DNA, 15 bp, Homo sapiens
cgttctgctgcccct

SEQ ID NO: 4052992 - DNA, 19 bp, Homo sapiens
cgttctgctgcccctgcag

SEQ ID NO: 4052993 - DNA, 18 bp, Homo sapiens
cgttctgctggcctggat

SEQ ID NO: 4052994 - DNA, 15 bp, Homo sapiens
cgttctgttctgctg

SEQ ID NO: 4052995 - DNA, 18 bp, Homo sapiens
cgttgaagaggaagggca

SEQ ID NO: 4052996 - DNA, 17 bp, Homo sapiens
cgttgggagcctagctc

SEQ ID NO: 4052997 - DNA, 18 bp, Homo sapiens
cgttgtgttttttaagat

SEQ ID NO: 4052998 - DNA, 22 bp, Homo sapiens
cgtttcatttagtcatgtgacc

SEQ ID NO: 4052999 - DNA, 18 bp, Homo sapiens
cgtttctccacctagact

SEQ ID NO: 4053000 - DNA, 22 bp, Homo sapiens
cgtttctccacctagactgtaa

SEQ ID NO: 4053001 - DNA, 17 bp, Homo sapiens
cgtttctccttttccta

SEQ ID NO: 4053002 - DNA, 17 bp, Homo sapiens
cgtttgaccttttatgt

SEQ ID NO: 4053003 - DNA, 15 bp, Homo sapiens
cgttttggaagctct

SEQ ID NO: 4053004 - DNA, 13 bp, Homo sapiens
cgtttttccttta

SEQ ID NO: 4053005 - DNA, 17 bp, Homo sapiens
cgttttttaaatgtata

SEQ ID NO: 4053006 - DNA, 17 bp, Homo sapiens
ctaaaaaacagaggcca

SEQ ID NO: 4053007 - DNA, 11 bp, Homo sapiens
ctaaaaaacat

SEQ ID NO: 4053008 - DNA, 15 bp, Homo sapiens
ctaaaaagattagca

SEQ ID NO: 4053009 - DNA, 23 bp, Homo sapiens
ctaaaaatacaaaattagctggg

SEQ ID NO: 4053010 - DNA, 22 bp, Homo sapiens
ctaaaaatattataacttaaaa

SEQ ID NO: 4053011 - DNA, 18 bp, Homo sapiens
ctaaaacaaaatctgaac

SEQ ID NO: 4053012 - DNA, 17 bp, Homo sapiens
ctaaaaccattccattt

SEQ ID NO: 4053013 - DNA, 13 bp, Homo sapiens
ctaaaactatggt

SEQ ID NO: 4053014 - DNA, 22 bp, Homo sapiens
ctaaaactatggttcccaataa

SEQ ID NO: 4053015 - DNA, 14 bp, Homo sapiens
ctaaaagacatttg

SEQ ID NO: 4053016 - DNA, 17 bp, Homo sapiens
ctaaaagacatttgtta

SEQ ID NO: 4053017 - DNA, 15 bp, Homo sapiens
ctaaaagctctgttc

SEQ ID NO: 4053018 - DNA, 13 bp, Homo sapiens
ctaaaagtaaaca

SEQ ID NO: 4053019 - DNA, 19 bp, Homo sapiens
ctaaaagtgggcttgattc

SEQ ID NO: 4053020 - DNA, 20 bp, Homo sapiens
ctaaaagtgggcttgattct

SEQ ID NO: 4053021 - DNA, 23 bp, Homo sapiens
ctaaaagtgggcttgattctgca

SEQ ID NO: 4053022 - DNA, 14 bp, Homo sapiens
ctaaaatacattta

SEQ ID NO: 4053023 - DNA, 22 bp, Homo sapiens
ctaaaatacatttaaaacttac

SEQ ID NO: 4053024 - DNA, 16 bp, Homo sapiens
ctaaaatcttggaagt

SEQ ID NO: 4053025 - DNA, 13 bp, Homo sapiens
ctaaaatgcttca

SEQ ID NO: 4053026 - DNA, 13 bp, Homo sapiens
ctaaacagatata

SEQ ID NO: 4053027 - DNA, 18 bp, Homo sapiens
ctaaacatccaatatttt

SEQ ID NO: 4053028 - DNA, 15 bp, Homo sapiens
ctaaacccaatccaa

SEQ ID NO: 4053029 - DNA, 16 bp, Homo sapiens
ctaaacccaatccaaa

SEQ ID NO: 4053030 - DNA, 15 bp, Homo sapiens
ctaaacccctgtccc

SEQ ID NO: 4053031 - DNA, 17 bp, Homo sapiens
ctaaaccgataatgcat

SEQ ID NO: 4053032 - DNA, 14 bp, Homo sapiens
ctaaaccgtcccct

SEQ ID NO: 4053033 - DNA, 22 bp, Homo sapiens
ctaaaccgtcccctccttccct

SEQ ID NO: 4053034 - DNA, 19 bp, Homo sapiens
ctaaaccttacatgtgtaa

SEQ ID NO: 4053035 - DNA, 16 bp, Homo sapiens
ctaaacggattccaaa

SEQ ID NO: 4053036 - DNA, 17 bp, Homo sapiens
ctaaactaggctccttc

SEQ ID NO: 4053037 - DNA, 15 bp, Homo sapiens
ctaaactccttcctg

SEQ ID NO: 4053038 - DNA, 16 bp, Homo sapiens
ctaaactccttcctgg

SEQ ID NO: 4053039 - DNA, 18 bp, Homo sapiens
ctaaagagagaatgtaga

SEQ ID NO: 4053040 - DNA, 19 bp, Homo sapiens
ctaaagagagaatgtagat

SEQ ID NO: 4053041 - DNA, 16 bp, Homo sapiens
ctaaagagcccttgcc

SEQ ID NO: 4053042 - DNA, 13 bp, Homo sapiens
ctaaagcagaggc

SEQ ID NO: 4053043 - DNA, 22 bp, Homo sapiens
ctaaagctgaatgtcaaacagt

SEQ ID NO: 4053044 - DNA, 16 bp, Homo sapiens
ctaaaggaaaaaactt

SEQ ID NO: 4053045 - DNA, 14 bp, Homo sapiens
ctaaaggatccaga

SEQ ID NO: 4053046 - DNA, 23 bp, Homo sapiens
ctaaaggatccagagagcagctc

SEQ ID NO: 4053047 - DNA, 21 bp, Homo sapiens
ctaaagtacagcctggaccac

SEQ ID NO: 4053048 - DNA, 19 bp, Homo sapiens
ctaaagtgtgttgttgctt

SEQ ID NO: 4053049 - DNA, 17 bp, Homo sapiens
ctaaataaaaaaagaca

SEQ ID NO: 4053050 - DNA, 20 bp, Homo sapiens
ctaaataatgaataaactga

SEQ ID NO: 4053051 - DNA, 21 bp, Homo sapiens
ctaaatctatttattaatatt

SEQ ID NO: 4053052 - DNA, 17 bp, Homo sapiens
ctaaatcttccttgtga

SEQ ID NO: 4053053 - DNA, 23 bp, Homo sapiens
ctaaatgagctcctgcgggagta

SEQ ID NO: 4053054 - DNA, 15 bp, Homo sapiens
ctaaatggtgctgca

SEQ ID NO: 4053055 - DNA, 19 bp, Homo sapiens
ctaaatggtgctgcagatt

SEQ ID NO: 4053056 - DNA, 16 bp, Homo sapiens
ctaaatgttgaaagat

SEQ ID NO: 4053057 - DNA, 22 bp, Homo sapiens
ctaaattctatgttaaatactg

SEQ ID NO: 4053058 - DNA, 19 bp, Homo sapiens
ctaaatttaaatttaaaga

SEQ ID NO: 4053059 - DNA, 16 bp, Homo sapiens
ctaacaaaagatgaaa

SEQ ID NO: 4053060 - DNA, 23 bp, Homo sapiens
ctaacacggtgctcattttttct

SEQ ID NO: 4053061 - DNA, 22 bp, Homo sapiens
ctaacagcaacagcaagaaata

SEQ ID NO: 4053062 - DNA, 23 bp, Homo sapiens
ctaacagcaacagcaagaaataa

SEQ ID NO: 4053063 - DNA, 22 bp, Homo sapiens
ctaacatataatgttgttattt

SEQ ID NO: 4053064 - DNA, 20 bp, Homo sapiens
ctaacatgttatcaaatctg

SEQ ID NO: 4053065 - DNA, 21 bp, Homo sapiens
ctaacatttcccccgagctct

SEQ ID NO: 4053066 - DNA, 22 bp, Homo sapiens
ctaacatttcccccgagctctt

SEQ ID NO: 4053067 - DNA, 15 bp, Homo sapiens
ctaaccaagctgagt

SEQ ID NO: 4053068 - DNA, 20 bp, Homo sapiens
ctaaccaagctgagtttcct

SEQ ID NO: 4053069 - DNA, 12 bp, Homo sapiens
ctaaccagggcc

SEQ ID NO: 4053070 - DNA, 20 bp, Homo sapiens
ctaaccagtacctctgtata

SEQ ID NO: 4053071 - DNA, 15 bp, Homo sapiens
ctaacccccagctgg

SEQ ID NO: 4053072 - DNA, 19 bp, Homo sapiens
ctaacctcttttctgcatc

SEQ ID NO: 4053073 - DNA, 12 bp, Homo sapiens
ctaacctggaaa

SEQ ID NO: 4053074 - DNA, 17 bp, Homo sapiens
ctaaccttgaatgctgc

SEQ ID NO: 4053075 - DNA, 18 bp, Homo sapiens
ctaaccttgaatgctgcc

SEQ ID NO: 4053076 - DNA, 17 bp, Homo sapiens
ctaacgttgagcccctg

SEQ ID NO: 4053077 - DNA, 15 bp, Homo sapiens
ctaagaacctggaac

SEQ ID NO: 4053078 - DNA, 23 bp, Homo sapiens
ctaagacatgtgaggaggaaaag

SEQ ID NO: 4053079 - DNA, 22 bp, Homo sapiens
ctaagactgtgacaactgtcta

SEQ ID NO: 4053080 - DNA, 12 bp, Homo sapiens
ctaagcaatttc

SEQ ID NO: 4053081 - DNA, 23 bp, Homo sapiens
ctaagccaggcctggctggagga

SEQ ID NO: 4053082 - DNA, 21 bp, Homo sapiens
ctaagcccccagggcctccag

SEQ ID NO: 4053083 - DNA, 14 bp, Homo sapiens
ctaagcctacctgc

SEQ ID NO: 4053084 - DNA, 16 bp, Homo sapiens
ctaagcctttccataa

SEQ ID NO: 4053085 - DNA, 15 bp, Homo sapiens
ctaagctcagtgctc

SEQ ID NO: 4053086 - DNA, 19 bp, Homo sapiens
ctaagctttgccagctgct

SEQ ID NO: 4053087 - DNA, 16 bp, Homo sapiens
ctaaggacacactaat

SEQ ID NO: 4053088 - DNA, 17 bp, Homo sapiens
ctaaggacatttcccag

SEQ ID NO: 4053089 - DNA, 20 bp, Homo sapiens
ctaaggataatgaaataatc

SEQ ID NO: 4053090 - DNA, 12 bp, Homo sapiens
ctaaggatctct

SEQ ID NO: 4053091 - DNA, 15 bp, Homo sapiens
ctaaggatctctcag

SEQ ID NO: 4053092 - DNA, 18 bp, Homo sapiens
ctaaggatctctcaggag

SEQ ID NO: 4053093 - DNA, 16 bp, Homo sapiens
ctaaggctcctccttg

SEQ ID NO: 4053094 - DNA, 16 bp, Homo sapiens
ctaagggaagacattt

SEQ ID NO: 4053095 - DNA, 19 bp, Homo sapiens
ctaagggaagacatttctt

SEQ ID NO: 4053096 - DNA, 19 bp, Homo sapiens
ctaagggggaggggaagtc

SEQ ID NO: 4053097 - DNA, 20 bp, Homo sapiens
ctaagggtgggtgctcagaa

SEQ ID NO: 4053098 - DNA, 21 bp, Homo sapiens
ctatggtatgctggccagcac

SEQ ID NO: 4053099 - DNA, 22 bp, Homo sapiens
ctatggttcccaataaaagtga

SEQ ID NO: 4053100 - DNA, 18 bp, Homo sapiens
ctatgtcctaaggacaca

SEQ ID NO: 4053101 - DNA, 18 bp, Homo sapiens
ctatgtgccagttcctgt

SEQ ID NO: 4053102 - DNA, 19 bp, Homo sapiens
ctatgtgccagttcctgta

SEQ ID NO: 4053103 - DNA, 16 bp, Homo sapiens
ctatgtgctgggtgcc

SEQ ID NO: 4053104 - DNA, 19 bp, Homo sapiens
ctatgttaaatactgtgca

SEQ ID NO: 4053105 - DNA, 21 bp, Homo sapiens
ctatgttaaatactgtgcaga

SEQ ID NO: 4053106 - DNA, 15 bp, Homo sapiens
ctatgttactatttt

SEQ ID NO: 4053107 - DNA, 16 bp, Homo sapiens
ctatgttactattttc

SEQ ID NO: 4053108 - DNA, 12 bp, Homo sapiens
ctatgttggggg

SEQ ID NO: 4053109 - DNA, 14 bp, Homo sapiens
ctatgtttgcactt

SEQ ID NO: 4053110 - DNA, 16 bp, Homo sapiens
ctattaagcagtaaaa

SEQ ID NO: 4053111 - DNA, 21 bp, Homo sapiens
ctattaagcagtaaaaactgt

SEQ ID NO: 4053112 - DNA, 19 bp, Homo sapiens
ctattaaggtgatatattt

SEQ ID NO: 4053113 - DNA, 23 bp, Homo sapiens
ctattaaggtgatatatttaaaa

SEQ ID NO: 4053114 - DNA, 14 bp, Homo sapiens
ctattaatatatgt

SEQ ID NO: 4053115 - DNA, 21 bp, Homo sapiens
ctattaatatatgtattattt

SEQ ID NO: 4053116 - DNA, 17 bp, Homo sapiens
ctattaccatgagaaga

SEQ ID NO: 4053117 - DNA, 21 bp, Homo sapiens
ctattagactttagaaataaa

SEQ ID NO: 4053118 - DNA, 16 bp, Homo sapiens
ctattatggaaaactg

SEQ ID NO: 4053119 - DNA, 14 bp, Homo sapiens
ctattcagacaagc

SEQ ID NO: 4053120 - DNA, 15 bp, Homo sapiens
ctattcagacaagca

SEQ ID NO: 4053121 - DNA, 17 bp, Homo sapiens
ctattcagacaagcaac

SEQ ID NO: 4053122 - DNA, 23 bp, Homo sapiens
ctattcagtaataactctaccct

SEQ ID NO: 4053123 - DNA, 16 bp, Homo sapiens
ctattccttttctgta

SEQ ID NO: 4053124 - DNA, 18 bp, Homo sapiens
ctattccttttctgtata

SEQ ID NO: 4053125 - DNA, 15 bp, Homo sapiens
ctattctcaccagga

SEQ ID NO: 4053126 - DNA, 22 bp, Homo sapiens
ctattctctgcaatttgtttaa

SEQ ID NO: 4053127 - DNA, 17 bp, Homo sapiens
ctattgcatttatatgt

SEQ ID NO: 4053128 - DNA, 19 bp, Homo sapiens
ctattgcatttatatgtac

SEQ ID NO: 4053129 - DNA, 15 bp, Homo sapiens
ctattgccaaccagt

SEQ ID NO: 4053130 - DNA, 17 bp, Homo sapiens
ctattgcgctctcaaga

SEQ ID NO: 4053131 - DNA, 18 bp, Homo sapiens
ctattgctgctgcccctt

SEQ ID NO: 4053132 - DNA, 21 bp, Homo sapiens
ctattgcttcaccatggcctt

SEQ ID NO: 4053133 - DNA, 20 bp, Homo sapiens
ctattgggcacagcctaggg

SEQ ID NO: 4053134 - DNA, 14 bp, Homo sapiens
ctattgtaaatatg

SEQ ID NO: 4053135 - DNA, 22 bp, Homo sapiens
ctattgtcccctagcaaggcat

SEQ ID NO: 4053136 - DNA, 20 bp, Homo sapiens
ctattgttactctggttctt

SEQ ID NO: 4053137 - DNA, 21 bp, Homo sapiens
ctattgtttctttaagaaagt

SEQ ID NO: 4053138 - DNA, 18 bp, Homo sapiens
ctatttaaacttataaat

SEQ ID NO: 4053139 - DNA, 23 bp, Homo sapiens
ctatttacctgcaggctgagcca

SEQ ID NO: 4053140 - DNA, 19 bp, Homo sapiens
ctatttagtgttagttata

SEQ ID NO: 4053141 - DNA, 17 bp, Homo sapiens
ctatttatatgtacatg

SEQ ID NO: 4053142 - DNA, 21 bp, Homo sapiens
ctatttatctgtagtaaacta

SEQ ID NO: 4053143 - DNA, 16 bp, Homo sapiens
ctatttatctgtgttt

SEQ ID NO: 4053144 - DNA, 17 bp, Homo sapiens
ctatttcatgtttttga

SEQ ID NO: 4053145 - DNA, 14 bp, Homo sapiens
ctatttccattcca

SEQ ID NO: 4053146 - DNA, 17 bp, Homo sapiens
ctatttccattccagaa

SEQ ID NO: 4053147 - DNA, 22 bp, Homo sapiens
ctatttctgggtcttttgctac

SEQ ID NO: 4053148 - DNA, 13 bp, Homo sapiens
ctatttgaaatac

SEQ ID NO: 4053149 - DNA, 17 bp, Homo sapiens
ctatttgaaatactaaa

SEQ ID NO: 4053150 - DNA, 23 bp, Homo sapiens
ctatttgtggcaattttatgttt

SEQ ID NO: 4053151 - DNA, 14 bp, Homo sapiens
ctattttaaaataa

SEQ ID NO: 4053152 - DNA, 22 bp, Homo sapiens
ctattttaaaataaattagttg

SEQ ID NO: 4053153 - DNA, 14 bp, Homo sapiens
ctattttctacaat

SEQ ID NO: 4053154 - DNA, 17 bp, Homo sapiens
ctattttgggtattaat

SEQ ID NO: 4053155 - DNA, 12 bp, Homo sapiens
ctatttttatca

SEQ ID NO: 4053156 - DNA, 18 bp, Homo sapiens
ctatttttatttatattt

SEQ ID NO: 4053157 - DNA, 21 bp, Homo sapiens
ctatttttgactgtagccaca

SEQ ID NO: 4053158 - DNA, 18 bp, Homo sapiens
ctattttttattttactt

SEQ ID NO: 4053159 - DNA, 22 bp, Homo sapiens
ctatttttttaactgaaaatgt

SEQ ID NO: 4053160 - DNA, 23 bp, Homo sapiens
ctatttttttaactgaaaatgta

SEQ ID NO: 4053161 - DNA, 14 bp, Homo sapiens
ctatttttttctct

SEQ ID NO: 4053162 - DNA, 21 bp, Homo sapiens
ctcaaaaaaaaaaaaatgcac

SEQ ID NO: 4053163 - DNA, 22 bp, Homo sapiens
ctcaaaaaaacaaaaaagactt

SEQ ID NO: 4053164 - DNA, 14 bp, Homo sapiens
ctcaaaagcattta

SEQ ID NO: 4053165 - DNA, 21 bp, Homo sapiens
ctcaaaagcatttatcattct

SEQ ID NO: 4053166 - DNA, 12 bp, Homo sapiens
ctcaaaatgtgt

SEQ ID NO: 4053167 - DNA, 17 bp, Homo sapiens
ctcaaacaacactggtg

SEQ ID NO: 4053168 - DNA, 22 bp, Homo sapiens
ctcaaactaaaagacatttgtt

SEQ ID NO: 4053169 - DNA, 21 bp, Homo sapiens
ctcaaactcctgacctcaggt

SEQ ID NO: 4053170 - DNA, 23 bp, Homo sapiens
ctcaaagaaatctactatatccc

SEQ ID NO: 4053171 - DNA, 15 bp, Homo sapiens
ctcaaagttaattca

SEQ ID NO: 4053172 - DNA, 14 bp, Homo sapiens
ctcaaagttttgaa

SEQ ID NO: 4053173 - DNA, 18 bp, Homo sapiens
ctcaaagttttgaaaagc

SEQ ID NO: 4053174 - DNA, 23 bp, Homo sapiens
ctcaaagttttgaaaagctatta

SEQ ID NO: 4053175 - DNA, 16 bp, Homo sapiens
ctcaaatctattcaga

SEQ ID NO: 4053176 - DNA, 22 bp, Homo sapiens
ctcaaatctattcagacaagca

SEQ ID NO: 4053177 - DNA, 17 bp, Homo sapiens
ctcaaatggggccagat

SEQ ID NO: 4053178 - DNA, 21 bp, Homo sapiens
ctcaaatggggccagatccag

SEQ ID NO: 4053179 - DNA, 12 bp, Homo sapiens
ctcaaatttgga

SEQ ID NO: 4053180 - DNA, 22 bp, Homo sapiens
ctcaacaagggagagacctcat

SEQ ID NO: 4053181 - DNA, 15 bp, Homo sapiens
ctcaacaggcccagg

SEQ ID NO: 4053182 - DNA, 18 bp, Homo sapiens
ctcaacaggcccagggag

SEQ ID NO: 4053183 - DNA, 16 bp, Homo sapiens
ctcaacatgttactga

SEQ ID NO: 4053184 - DNA, 20 bp, Homo sapiens
ctcaacatgttactgaccag

SEQ ID NO: 4053185 - DNA, 14 bp, Homo sapiens
ctcaaccactgtgg

SEQ ID NO: 4053186 - DNA, 22 bp, Homo sapiens
ctcaacccccatttctatttat

SEQ ID NO: 4053187 - DNA, 13 bp, Homo sapiens
ctcaacctcttct

SEQ ID NO: 4053188 - DNA, 18 bp, Homo sapiens
ctcaacctcttctggctc

SEQ ID NO: 4053189 - DNA, 15 bp, Homo sapiens
ctcaacgtattgttt

SEQ ID NO: 4053190 - DNA, 16 bp, Homo sapiens
ctcaacgtattgtttc

SEQ ID NO: 4053191 - DNA, 21 bp, Homo sapiens
ctcaagaaataaaaggaagcc

SEQ ID NO: 4053192 - DNA, 23 bp, Homo sapiens
ctcaagaaataaaaggaagccaa

SEQ ID NO: 4053193 - DNA, 21 bp, Homo sapiens
ctcaagacccccatttgtccc

SEQ ID NO: 4053194 - DNA, 22 bp, Homo sapiens
ctcaagacccccatttgtccca

SEQ ID NO: 4053195 - DNA, 23 bp, Homo sapiens
ctcaagacccccatttgtcccag

SEQ ID NO: 4053196 - DNA, 17 bp, Homo sapiens
ctcaagagggcactggt

SEQ ID NO: 4053197 - DNA, 21 bp, Homo sapiens
ctcaagatactgctactgtaa

SEQ ID NO: 4053198 - DNA, 20 bp, Homo sapiens
ctcaagatgggggcagggct

SEQ ID NO: 4053199 - DNA, 14 bp, Homo sapiens
ctccagaatgtaag

SEQ ID NO: 4053200 - DNA, 16 bp, Homo sapiens
ctccagaatgtaagaa

SEQ ID NO: 4053201 - DNA, 14 bp, Homo sapiens
ctccagacccctgg

SEQ ID NO: 4053202 - DNA, 15 bp, Homo sapiens
ctccagatagagaaa

SEQ ID NO: 4053203 - DNA, 19 bp, Homo sapiens
ctccagatgtttccagact

SEQ ID NO: 4053204 - DNA, 13 bp, Homo sapiens
ctccagccagcaa

SEQ ID NO: 4053205 - DNA, 24 bp, Homo sapiens
ctccagccagcaatgatgtccaga

SEQ ID NO: 4053206 - DNA, 12 bp, Homo sapiens
ctccagcccctg

SEQ ID NO: 4053207 - DNA, 15 bp, Homo sapiens
ctccagcccctgtcc

SEQ ID NO: 4053208 - DNA, 17 bp, Homo sapiens
ctccagcccctgtccca

SEQ ID NO: 4053209 - DNA, 15 bp, Homo sapiens
ctccagcctccctgt

SEQ ID NO: 4053210 - DNA, 18 bp, Homo sapiens
ctccagcctccctgtctc

SEQ ID NO: 4053211 - DNA, 19 bp, Homo sapiens
ctccagcctccctgtctcc

SEQ ID NO: 4053212 - DNA, 20 bp, Homo sapiens
ctccagcctgaacagaagct

SEQ ID NO: 4053213 - DNA, 23 bp, Homo sapiens
ctccagcctgcccaagcccaggc

SEQ ID NO: 4053214 - DNA, 14 bp, Homo sapiens
ctccagcctgggca

SEQ ID NO: 4053215 - DNA, 21 bp, Homo sapiens
ctccagcctttggccttggct

SEQ ID NO: 4053216 - DNA, 22 bp, Homo sapiens
ctccagctctggcatggctagg

SEQ ID NO: 4053217 - DNA, 14 bp, Homo sapiens
ctccagctgcacca

SEQ ID NO: 4053218 - DNA, 14 bp, Homo sapiens
ctccagctgcctgg

SEQ ID NO: 4053219 - DNA, 15 bp, Homo sapiens
ctccagctgcctggg

SEQ ID NO: 4053220 - DNA, 18 bp, Homo sapiens
ctccagcttcggagggcc

SEQ ID NO: 4053221 - DNA, 22 bp, Homo sapiens
ctccaggaaagagcagtcagag

SEQ ID NO: 4053222 - DNA, 22 bp, Homo sapiens
ctccaggaaggtagcccagcac

SEQ ID NO: 4053223 - DNA, 11 bp, Homo sapiens
ctccaggacca

SEQ ID NO: 4053224 - DNA, 11 bp, Homo sapiens
ctccaggagct

SEQ ID NO: 4053225 - DNA, 16 bp, Homo sapiens
ctccaggcccaaggct

SEQ ID NO: 4053226 - DNA, 20 bp, Homo sapiens
ctccaggccctcctctccca

SEQ ID NO: 4053227 - DNA, 17 bp, Homo sapiens
ctccaggcctgcagcag

SEQ ID NO: 4053228 - DNA, 16 bp, Homo sapiens
ctccaggcctgcctcc

SEQ ID NO: 4053229 - DNA, 17 bp, Homo sapiens
ctccaggcctgcctccc

SEQ ID NO: 4053230 - DNA, 18 bp, Homo sapiens
ctccaggcctgcctccca

SEQ ID NO: 4053231 - DNA, 19 bp, Homo sapiens
ctccaggcctgcctcccac

SEQ ID NO: 4053232 - DNA, 13 bp, Homo sapiens
ctccaggcctgtt

SEQ ID NO: 4053233 - DNA, 14 bp, Homo sapiens
ctccaggcttcaca

SEQ ID NO: 4053234 - DNA, 17 bp, Homo sapiens
ctccaggcttcacagtc

SEQ ID NO: 4053235 - DNA, 20 bp, Homo sapiens
ctccaggcttcacagtctgg

SEQ ID NO: 4053236 - DNA, 21 bp, Homo sapiens
ctccagggaaggtggccacag

SEQ ID NO: 4053237 - DNA, 22 bp, Homo sapiens
ctccagggaaggtggccacagc

SEQ ID NO: 4053238 - DNA, 18 bp, Homo sapiens
ctccagggagcaagacag

SEQ ID NO: 4053239 - DNA, 20 bp, Homo sapiens
ctccagggagcaagacagag

SEQ ID NO: 4053240 - DNA, 13 bp, Homo sapiens
ctccaggtgctca

SEQ ID NO: 4053241 - DNA, 14 bp, Homo sapiens
ctccaggtggctct

SEQ ID NO: 4053242 - DNA, 14 bp, Homo sapiens
ctccagtgtacata

SEQ ID NO: 4053243 - DNA, 19 bp, Homo sapiens
ctccagttgggactcagga

SEQ ID NO: 4053244 - DNA, 20 bp, Homo sapiens
ctccagttgggactcaggat

SEQ ID NO: 4053245 - DNA, 18 bp, Homo sapiens
ctccagtttgcacctgtc

SEQ ID NO: 4053246 - DNA, 17 bp, Homo sapiens
ctccataccttttctct

SEQ ID NO: 4053247 - DNA, 18 bp, Homo sapiens
ctccataccttttctctt

SEQ ID NO: 4053248 - DNA, 20 bp, Homo sapiens
ctccataccttttctctttt

SEQ ID NO: 4053249 - DNA, 16 bp, Homo sapiens
ctccatcatatgcctg

SEQ ID NO: 4053250 - DNA, 17 bp, Homo sapiens
ctccatcccaacagcca

SEQ ID NO: 4053251 - DNA, 22 bp, Homo sapiens
ctccatcccaacagccatgccc

SEQ ID NO: 4053252 - DNA, 23 bp, Homo sapiens
ctccatctcatgtatcatctgga

SEQ ID NO: 4053253 - DNA, 17 bp, Homo sapiens
ctccatctcctgctcac

SEQ ID NO: 4053254 - DNA, 21 bp, Homo sapiens
ctccatctctcatcctccagt

SEQ ID NO: 4053255 - DNA, 12 bp, Homo sapiens
ctccatctcttc

SEQ ID NO: 4053256 - DNA, 14 bp, Homo sapiens
ctccatctcttctg

SEQ ID NO: 4053257 - DNA, 15 bp, Homo sapiens
ctccatctcttctgc

SEQ ID NO: 4053258 - DNA, 14 bp, Homo sapiens
ctccatggaaaagc

SEQ ID NO: 4053259 - DNA, 22 bp, Homo sapiens
ctccattaggatttgccccttc

SEQ ID NO: 4053260 - DNA, 13 bp, Homo sapiens
ctccattcatcct

SEQ ID NO: 4053261 - DNA, 14 bp, Homo sapiens
ctccattcatcctt

SEQ ID NO: 4053262 - DNA, 16 bp, Homo sapiens
ctccattcatccttcc

SEQ ID NO: 4053263 - DNA, 18 bp, Homo sapiens
ctccatttataaccccag

SEQ ID NO: 4053264 - DNA, 19 bp, Homo sapiens
ctccatttataaccccagc

SEQ ID NO: 4053265 - DNA, 22 bp, Homo sapiens
ctccatttgagaaaataaagct

SEQ ID NO: 4053266 - DNA, 20 bp, Homo sapiens
ctcccaaacgccctttcctc

SEQ ID NO: 4053267 - DNA, 22 bp, Homo sapiens
ctcccaaagtgctgggattaca

SEQ ID NO: 4053268 - DNA, 17 bp, Homo sapiens
ctcccaacccagccgtc

SEQ ID NO: 4053269 - DNA, 22 bp, Homo sapiens
ctcccaacccattcactacagg

SEQ ID NO: 4053270 - DNA, 14 bp, Homo sapiens
ctcccaaccctggc

SEQ ID NO: 4053271 - DNA, 14 bp, Homo sapiens
ctcccaacttcttc

SEQ ID NO: 4053272 - DNA, 14 bp, Homo sapiens
ctcccaagaaacct

SEQ ID NO: 4053273 - DNA, 21 bp, Homo sapiens
ctcccaagacttcattgtccc

SEQ ID NO: 4053274 - DNA, 20 bp, Homo sapiens
ctcccaagctatctaaagtt

SEQ ID NO: 4053275 - DNA, 21 bp, Homo sapiens
ctcccaaggggcccaaattct

SEQ ID NO: 4053276 - DNA, 22 bp, Homo sapiens
ctcccaagtagctgggattaca

SEQ ID NO: 4053277 - DNA, 14 bp, Homo sapiens
ctcccaagtcacac

SEQ ID NO: 4053278 - DNA, 19 bp, Homo sapiens
ctcccaagtttccatagca

SEQ ID NO: 4053279 - DNA, 19 bp, Homo sapiens
ctcccaatttcagactccc

SEQ ID NO: 4053280 - DNA, 15 bp, Homo sapiens
ctcccacacttgctg

SEQ ID NO: 4053281 - DNA, 22 bp, Homo sapiens
ctcccacccccttctctgctcc

SEQ ID NO: 4053282 - DNA, 18 bp, Homo sapiens
ctcccaccctgtacctca

SEQ ID NO: 4053283 - DNA, 14 bp, Homo sapiens
ctcccacctcaccc

SEQ ID NO: 4053284 - DNA, 15 bp, Homo sapiens
ctcccacctcacccg

SEQ ID NO: 4053285 - DNA, 15 bp, Homo sapiens
ctcccacctctcctt

SEQ ID NO: 4053286 - DNA, 23 bp, Homo sapiens
ctcccacctctccttttgaggct

SEQ ID NO: 4053287 - DNA, 14 bp, Homo sapiens
ctcccacgtgggag

SEQ ID NO: 4053288 - DNA, 14 bp, Homo sapiens
ctcccactgcgggg

SEQ ID NO: 4053289 - DNA, 19 bp, Homo sapiens
ctcccagcagccctaagga

SEQ ID NO: 4053290 - DNA, 11 bp, Homo sapiens
ctcccagcctg

SEQ ID NO: 4053291 - DNA, 13 bp, Homo sapiens
ctcccagcctgct

SEQ ID NO: 4053292 - DNA, 20 bp, Homo sapiens
ctcccagcttaaatcctagc

SEQ ID NO: 4053293 - DNA, 15 bp, Homo sapiens
ctcccaggccccctg

SEQ ID NO: 4053294 - DNA, 14 bp, Homo sapiens
ctcccaggcgcccc

SEQ ID NO: 4053295 - DNA, 17 bp, Homo sapiens
ctcccaggcgccccttc

SEQ ID NO: 4053296 - DNA, 21 bp, Homo sapiens
ctcccaggggtctccctggct

SEQ ID NO: 4053297 - DNA, 17 bp, Homo sapiens
ctcccaggtaccagctg

SEQ ID NO: 4053298 - DNA, 21 bp, Homo sapiens
ctcccaggtaccagctgcgct

SEQ ID NO: 4053299 - DNA, 20 bp, Homo sapiens
ctcccagtgaactcctgcca

SEQ ID NO: 4053300 - DNA, 22 bp, Homo sapiens
ctcccagtgaactcctgccagg

SEQ ID NO: 4053301 - DNA, 17 bp, Homo sapiens
ctcccagttatgaatca

SEQ ID NO: 4053302 - DNA, 20 bp, Homo sapiens
ctcgtggttattagcaaggc

SEQ ID NO: 4053303 - DNA, 23 bp, Homo sapiens
ctcgtggttattagcaaggctgg

SEQ ID NO: 4053304 - DNA, 17 bp, Homo sapiens
ctcgttcctttctcctg

SEQ ID NO: 4053305 - DNA, 23 bp, Homo sapiens
ctctaaaagcgttggatgtagca

SEQ ID NO: 4053306 - DNA, 13 bp, Homo sapiens
ctctaaactgcaa

SEQ ID NO: 4053307 - DNA, 15 bp, Homo sapiens
ctctaagctcagtgc

SEQ ID NO: 4053308 - DNA, 21 bp, Homo sapiens
ctctaatctgagctgcagcct

SEQ ID NO: 4053309 - DNA, 14 bp, Homo sapiens
ctctacactaaggg

SEQ ID NO: 4053310 - DNA, 21 bp, Homo sapiens
ctctacagctaatcagcattc

SEQ ID NO: 4053311 - DNA, 15 bp, Homo sapiens
ctctacatcttctgc

SEQ ID NO: 4053312 - DNA, 21 bp, Homo sapiens
ctctaccagttggcagacagc

SEQ ID NO: 4053313 - DNA, 16 bp, Homo sapiens
ctctacccatattaca

SEQ ID NO: 4053314 - DNA, 17 bp, Homo sapiens
ctctacccatgagcctg

SEQ ID NO: 4053315 - DNA, 16 bp, Homo sapiens
ctctacccctgctccc

SEQ ID NO: 4053316 - DNA, 22 bp, Homo sapiens
ctctacccctgctcccattcct

SEQ ID NO: 4053317 - DNA, 16 bp, Homo sapiens
ctctaccctcccaccc

SEQ ID NO: 4053318 - DNA, 17 bp, Homo sapiens
ctctaccctcccacccc

SEQ ID NO: 4053319 - DNA, 18 bp, Homo sapiens
ctctaccctcccaccccc

SEQ ID NO: 4053320 - DNA, 22 bp, Homo sapiens
ctctaccctcccacccccttct

SEQ ID NO: 4053321 - DNA, 21 bp, Homo sapiens
ctctaccttcctgtccctgag

SEQ ID NO: 4053322 - DNA, 22 bp, Homo sapiens
ctctactaaaaatacaaaaatt

SEQ ID NO: 4053323 - DNA, 16 bp, Homo sapiens
ctctactaaaaatgca

SEQ ID NO: 4053324 - DNA, 20 bp, Homo sapiens
ctctacttagcatgtcccta

SEQ ID NO: 4053325 - DNA, 18 bp, Homo sapiens
ctctagaagccaagggaa

SEQ ID NO: 4053326 - DNA, 22 bp, Homo sapiens
ctctagaagccaagggaaaggg

SEQ ID NO: 4053327 - DNA, 23 bp, Homo sapiens
ctctagaattttaagtgctttgt

SEQ ID NO: 4053328 - DNA, 21 bp, Homo sapiens
ctctagacaagatattgtaca

SEQ ID NO: 4053329 - DNA, 16 bp, Homo sapiens
ctctagagcagggatt

SEQ ID NO: 4053330 - DNA, 15 bp, Homo sapiens
ctctagatttattag

SEQ ID NO: 4053331 - DNA, 17 bp, Homo sapiens
ctctagcagcacctcct

SEQ ID NO: 4053332 - DNA, 17 bp, Homo sapiens
ctctagctctctaggcc

SEQ ID NO: 4053333 - DNA, 16 bp, Homo sapiens
ctctaggcctctccag

SEQ ID NO: 4053334 - DNA, 13 bp, Homo sapiens
ctctagtgggaca

SEQ ID NO: 4053335 - DNA, 23 bp, Homo sapiens
ctctagtgggacagcccagagcc

SEQ ID NO: 4053336 - DNA, 18 bp, Homo sapiens
ctctatacatctctcccc

SEQ ID NO: 4053337 - DNA, 15 bp, Homo sapiens
ctctatcctgggctt

SEQ ID NO: 4053338 - DNA, 21 bp, Homo sapiens
ctctatgccagctcagtccca

SEQ ID NO: 4053339 - DNA, 24 bp, Homo sapiens
ctctattagactttagaaataaat

SEQ ID NO: 4053340 - DNA, 12 bp, Homo sapiens
ctctatttaata

SEQ ID NO: 4053341 - DNA, 18 bp, Homo sapiens
ctctatttccccctttct

SEQ ID NO: 4053342 - DNA, 22 bp, Homo sapiens
ctctatttccccctttcttcct

SEQ ID NO: 4053343 - DNA, 13 bp, Homo sapiens
ctctatttctcta

SEQ ID NO: 4053344 - DNA, 21 bp, Homo sapiens
ctctcaagctagtgtttctag

SEQ ID NO: 4053345 - DNA, 23 bp, Homo sapiens
ctctcaattaaagtctattcaaa

SEQ ID NO: 4053346 - DNA, 15 bp, Homo sapiens
ctctcacccataaac

SEQ ID NO: 4053347 - DNA, 20 bp, Homo sapiens
ctctcacccataaacagtaa

SEQ ID NO: 4053348 - DNA, 21 bp, Homo sapiens
ctctcacccatcccacccctc

SEQ ID NO: 4053349 - DNA, 13 bp, Homo sapiens
ctctcacccccat

SEQ ID NO: 4053350 - DNA, 14 bp, Homo sapiens
ctctcacccccatc

SEQ ID NO: 4053351 - DNA, 16 bp, Homo sapiens
ctctcactagtgccaa

SEQ ID NO: 4053352 - DNA, 14 bp, Homo sapiens
ctctcactgcctcc

SEQ ID NO: 4053353 - DNA, 15 bp, Homo sapiens
ctctcagcacagcct

SEQ ID NO: 4053354 - DNA, 16 bp, Homo sapiens
ctctcagctcagcgcc

SEQ ID NO: 4053355 - DNA, 12 bp, Homo sapiens
ctctcagctgcc

SEQ ID NO: 4053356 - DNA, 21 bp, Homo sapiens
ctctcaggagcacaggcagct

SEQ ID NO: 4053357 - DNA, 20 bp, Homo sapiens
ctctccaagtctcagtggct

SEQ ID NO: 4053358 - DNA, 18 bp, Homo sapiens
ctctccaagtctctctgt

SEQ ID NO: 4053359 - DNA, 19 bp, Homo sapiens
ctctccaagtctctctgtg

SEQ ID NO: 4053360 - DNA, 22 bp, Homo sapiens
ctctccactaccccacaccagc

SEQ ID NO: 4053361 - DNA, 12 bp, Homo sapiens
ctctccactgcc

SEQ ID NO: 4053362 - DNA, 13 bp, Homo sapiens
ctctccaggtgct

SEQ ID NO: 4053363 - DNA, 15 bp, Homo sapiens
ctctccaggtgctca

SEQ ID NO: 4053364 - DNA, 19 bp, Homo sapiens
ctctccagtttgcacctgt

SEQ ID NO: 4053365 - DNA, 15 bp, Homo sapiens
ctctccccagcccag

SEQ ID NO: 4053366 - DNA, 17 bp, Homo sapiens
ctctccccagcccagag

SEQ ID NO: 4053367 - DNA, 19 bp, Homo sapiens
ctctccccagcccagagac

SEQ ID NO: 4053368 - DNA, 16 bp, Homo sapiens
ctctccccctcctcca

SEQ ID NO: 4053369 - DNA, 19 bp, Homo sapiens
ctctccccctcctccaggg

SEQ ID NO: 4053370 - DNA, 13 bp, Homo sapiens
ctctccgtgcagg

SEQ ID NO: 4053371 - DNA, 11 bp, Homo sapiens
ctctcctctgg

SEQ ID NO: 4053372 - DNA, 21 bp, Homo sapiens
ctctcctgacttttaatgtca

SEQ ID NO: 4053373 - DNA, 15 bp, Homo sapiens
ctctcctgccctgtg

SEQ ID NO: 4053374 - DNA, 13 bp, Homo sapiens
ctctcctggagga

SEQ ID NO: 4053375 - DNA, 12 bp, Homo sapiens
ctctcctggcct

SEQ ID NO: 4053376 - DNA, 12 bp, Homo sapiens
ctctcctggctg

SEQ ID NO: 4053377 - DNA, 14 bp, Homo sapiens
ctctcctggctggg

SEQ ID NO: 4053378 - DNA, 19 bp, Homo sapiens
ctctcctgggggtggcagg

SEQ ID NO: 4053379 - DNA, 12 bp, Homo sapiens
ctctcgagccca

SEQ ID NO: 4053380 - DNA, 17 bp, Homo sapiens
ctctcggctccccatgt

SEQ ID NO: 4053381 - DNA, 18 bp, Homo sapiens
ctctcggctccccatgtg

SEQ ID NO: 4053382 - DNA, 19 bp, Homo sapiens
ctctcgggttcaagcaatt

SEQ ID NO: 4053383 - DNA, 17 bp, Homo sapiens
ctctcgtaactggtttc

SEQ ID NO: 4053384 - DNA, 22 bp, Homo sapiens
ctctctatttccccctttcttc

SEQ ID NO: 4053385 - DNA, 15 bp, Homo sapiens
ctctctcagcacagc

SEQ ID NO: 4053386 - DNA, 14 bp, Homo sapiens
ctctctccacccta

SEQ ID NO: 4053387 - DNA, 13 bp, Homo sapiens
ctctctccagggt

SEQ ID NO: 4053388 - DNA, 14 bp, Homo sapiens
ctctctcccatttc

SEQ ID NO: 4053389 - DNA, 12 bp, Homo sapiens
ctctctcctgta

SEQ ID NO: 4053390 - DNA, 20 bp, Homo sapiens
ctctctgaagatgatcattt

SEQ ID NO: 4053391 - DNA, 23 bp, Homo sapiens
ctctctgagactctttagagcag

SEQ ID NO: 4053392 - DNA, 14 bp, Homo sapiens
ctctctgagtctgg

SEQ ID NO: 4053393 - DNA, 17 bp, Homo sapiens
ctctctgagtctggact

SEQ ID NO: 4053394 - DNA, 18 bp, Homo sapiens
ctctctgagtctggactt

SEQ ID NO: 4053395 - DNA, 21 bp, Homo sapiens
ctctctgatgtcccagtgctc

SEQ ID NO: 4053396 - DNA, 12 bp, Homo sapiens
ctctctgcagct

SEQ ID NO: 4053397 - DNA, 13 bp, Homo sapiens
ctctctgcagctg

SEQ ID NO: 4053398 - DNA, 16 bp, Homo sapiens
ctctctgcagctgccg

SEQ ID NO: 4053399 - DNA, 11 bp, Homo sapiens
ctctctgccct

SEQ ID NO: 4053400 - DNA, 13 bp, Homo sapiens
ctctctgccctgt

SEQ ID NO: 4053401 - DNA, 15 bp, Homo sapiens
ctctctgcctggtgg

SEQ ID NO: 4053402 - DNA, 14 bp, Homo sapiens
ctctctgctctgac

SEQ ID NO: 4053403 - DNA, 17 bp, Homo sapiens
ctctctggaaagaggct

SEQ ID NO: 4053404 - DNA, 19 bp, Homo sapiens
ctctctggaaagaggctct

SEQ ID NO: 4053405 - DNA, 14 bp, Homo sapiens
ctgactgtcctctc

SEQ ID NO: 4053406 - DNA, 16 bp, Homo sapiens
ctgactgtcctctccc

SEQ ID NO: 4053407 - DNA, 19 bp, Homo sapiens
ctgacttaagcaaaagaaa

SEQ ID NO: 4053408 - DNA, 23 bp, Homo sapiens
ctgacttcatctcccacctagca

SEQ ID NO: 4053409 - DNA, 20 bp, Homo sapiens
ctgacttcatggaatggaca

SEQ ID NO: 4053410 - DNA, 13 bp, Homo sapiens
ctgacttgagtgt

SEQ ID NO: 4053411 - DNA, 14 bp, Homo sapiens
ctgacttgagtgtt

SEQ ID NO: 4053412 - DNA, 13 bp, Homo sapiens
ctgacttggggga

SEQ ID NO: 4053413 - DNA, 21 bp, Homo sapiens
ctgacttttaatgtcatttgt

SEQ ID NO: 4053414 - DNA, 19 bp, Homo sapiens
ctgactttttgtttctttg

SEQ ID NO: 4053415 - DNA, 16 bp, Homo sapiens
ctgagaactcctgact

SEQ ID NO: 4053416 - DNA, 20 bp, Homo sapiens
ctgagaagaatgaaaatgca

SEQ ID NO: 4053417 - DNA, 15 bp, Homo sapiens
ctgagacaggagaat

SEQ ID NO: 4053418 - DNA, 24 bp, Homo sapiens
ctgagaccagtgtatcaggtcagg

SEQ ID NO: 4053419 - DNA, 14 bp, Homo sapiens
ctgagaccagttgg

SEQ ID NO: 4053420 - DNA, 22 bp, Homo sapiens
ctgagaccagttgggagcactg

SEQ ID NO: 4053421 - DNA, 15 bp, Homo sapiens
ctgagacccttttct

SEQ ID NO: 4053422 - DNA, 18 bp, Homo sapiens
ctgagacccttttctcag

SEQ ID NO: 4053423 - DNA, 20 bp, Homo sapiens
ctgagacctgacaagcactg

SEQ ID NO: 4053424 - DNA, 20 bp, Homo sapiens
ctgagactcacaggaaggag

SEQ ID NO: 4053425 - DNA, 19 bp, Homo sapiens
ctgagactgtcggagaggc

SEQ ID NO: 4053426 - DNA, 13 bp, Homo sapiens
ctgagagccccca

SEQ ID NO: 4053427 - DNA, 14 bp, Homo sapiens
ctgagaggcaggca

SEQ ID NO: 4053428 - DNA, 14 bp, Homo sapiens
ctgagaggctctcc

SEQ ID NO: 4053429 - DNA, 22 bp, Homo sapiens
ctgagaggctctccgtgcaggc

SEQ ID NO: 4053430 - DNA, 18 bp, Homo sapiens
ctgagagtcagctctctg

SEQ ID NO: 4053431 - DNA, 21 bp, Homo sapiens
ctgagagtctggtctgcgcct

SEQ ID NO: 4053432 - DNA, 15 bp, Homo sapiens
ctgagagtgtctctg

SEQ ID NO: 4053433 - DNA, 20 bp, Homo sapiens
ctgagatgcctggtgagcat

SEQ ID NO: 4053434 - DNA, 15 bp, Homo sapiens
ctgagatggaaaagt

SEQ ID NO: 4053435 - DNA, 14 bp, Homo sapiens
ctgagatgtggaga

SEQ ID NO: 4053436 - DNA, 13 bp, Homo sapiens
ctgagattcttca

SEQ ID NO: 4053437 - DNA, 21 bp, Homo sapiens
ctgagattgcagatgtgagcc

SEQ ID NO: 4053438 - DNA, 22 bp, Homo sapiens
ctgagatttttttgtgtatgtt

SEQ ID NO: 4053439 - DNA, 12 bp, Homo sapiens
ctgagcaagagc

SEQ ID NO: 4053440 - DNA, 14 bp, Homo sapiens
ctgagcaagagctg

SEQ ID NO: 4053441 - DNA, 15 bp, Homo sapiens
ctgagcaagagctgg

SEQ ID NO: 4053442 - DNA, 17 bp, Homo sapiens
ctgagcaagagctggca

SEQ ID NO: 4053443 - DNA, 15 bp, Homo sapiens
ctgagcaagatcttg

SEQ ID NO: 4053444 - DNA, 20 bp, Homo sapiens
ctgagcaagatcttgtctcc

SEQ ID NO: 4053445 - DNA, 21 bp, Homo sapiens
ctgagcaagatcttgtctcca

SEQ ID NO: 4053446 - DNA, 14 bp, Homo sapiens
ctgagcaccctctg

SEQ ID NO: 4053447 - DNA, 20 bp, Homo sapiens
ctgagcaccctctggattct

SEQ ID NO: 4053448 - DNA, 17 bp, Homo sapiens
ctgagcaccgtgtcaag

SEQ ID NO: 4053449 - DNA, 20 bp, Homo sapiens
ctgagcaccgtgtcaagctg

SEQ ID NO: 4053450 - DNA, 12 bp, Homo sapiens
ctgagcacttag

SEQ ID NO: 4053451 - DNA, 13 bp, Homo sapiens
ctgagcagccgcc

SEQ ID NO: 4053452 - DNA, 22 bp, Homo sapiens
ctgagcagccgccagctgggag

SEQ ID NO: 4053453 - DNA, 15 bp, Homo sapiens
ctgagcagcctctgg

SEQ ID NO: 4053454 - DNA, 15 bp, Homo sapiens
ctgagcagtgcctct

SEQ ID NO: 4053455 - DNA, 18 bp, Homo sapiens
ctgagcagtgcctcttgt

SEQ ID NO: 4053456 - DNA, 19 bp, Homo sapiens
ctgagcagtgcctcttgtc

SEQ ID NO: 4053457 - DNA, 17 bp, Homo sapiens
ctgagcagttcccctgg

SEQ ID NO: 4053458 - DNA, 20 bp, Homo sapiens
ctgagcagttcccctggagc

SEQ ID NO: 4053459 - DNA, 20 bp, Homo sapiens
ctgagcatgatgggaatagg

SEQ ID NO: 4053460 - DNA, 16 bp, Homo sapiens
ctgagcccagctgcct

SEQ ID NO: 4053461 - DNA, 18 bp, Homo sapiens
ctgagcccagctgcctgg

SEQ ID NO: 4053462 - DNA, 20 bp, Homo sapiens
ctgagcccagctgcctggag

SEQ ID NO: 4053463 - DNA, 23 bp, Homo sapiens
ctgagcccatacttttggctcct

SEQ ID NO: 4053464 - DNA, 17 bp, Homo sapiens
ctgagccccacctctcc

SEQ ID NO: 4053465 - DNA, 23 bp, Homo sapiens
ctgagccccacctctccaagtct

SEQ ID NO: 4053466 - DNA, 16 bp, Homo sapiens
ctgagcctctgctccc

SEQ ID NO: 4053467 - DNA, 16 bp, Homo sapiens
ctgagccttgtaattc

SEQ ID NO: 4053468 - DNA, 21 bp, Homo sapiens
ctgagccttgtaattctaaat

SEQ ID NO: 4053469 - DNA, 17 bp, Homo sapiens
ctgagcgattattatct

SEQ ID NO: 4053470 - DNA, 15 bp, Homo sapiens
ctgagcgccaggatg

SEQ ID NO: 4053471 - DNA, 13 bp, Homo sapiens
ctgagcgggaggc

SEQ ID NO: 4053472 - DNA, 16 bp, Homo sapiens
ctgagcgggaggcaga

SEQ ID NO: 4053473 - DNA, 20 bp, Homo sapiens
ctgagctattttcctctggc

SEQ ID NO: 4053474 - DNA, 22 bp, Homo sapiens
ctgagctcacatgggactggga

SEQ ID NO: 4053475 - DNA, 13 bp, Homo sapiens
ctgagctcactcg

SEQ ID NO: 4053476 - DNA, 21 bp, Homo sapiens
ctgagctccccagatctccca

SEQ ID NO: 4053477 - DNA, 13 bp, Homo sapiens
ctgagctcctgct

SEQ ID NO: 4053478 - DNA, 15 bp, Homo sapiens
ctgagctgagtggcc

SEQ ID NO: 4053479 - DNA, 14 bp, Homo sapiens
ctgagctgcagcct

SEQ ID NO: 4053480 - DNA, 13 bp, Homo sapiens
ctgagctgctcac

SEQ ID NO: 4053481 - DNA, 14 bp, Homo sapiens
ctgagctggcctct

SEQ ID NO: 4053482 - DNA, 16 bp, Homo sapiens
ctgagctggcctctca

SEQ ID NO: 4053483 - DNA, 14 bp, Homo sapiens
ctgagctggggaag

SEQ ID NO: 4053484 - DNA, 20 bp, Homo sapiens
ctgagcttcggttctccaga

SEQ ID NO: 4053485 - DNA, 16 bp, Homo sapiens
ctgagcttctctgtga

SEQ ID NO: 4053486 - DNA, 19 bp, Homo sapiens
ctgaggagatgaccaggga

SEQ ID NO: 4053487 - DNA, 22 bp, Homo sapiens
ctgaggagatgaccagggatgc

SEQ ID NO: 4053488 - DNA, 18 bp, Homo sapiens
ctgaggatgggtcagagc

SEQ ID NO: 4053489 - DNA, 21 bp, Homo sapiens
ctgaggattcaggggctgggg

SEQ ID NO: 4053490 - DNA, 11 bp, Homo sapiens
ctgaggcagcc

SEQ ID NO: 4053491 - DNA, 13 bp, Homo sapiens
ctgaggcagcctt

SEQ ID NO: 4053492 - DNA, 14 bp, Homo sapiens
ctgaggcagccttg

SEQ ID NO: 4053493 - DNA, 13 bp, Homo sapiens
ctgaggcaggaga

SEQ ID NO: 4053494 - DNA, 15 bp, Homo sapiens
ctgaggcaggagaac

SEQ ID NO: 4053495 - DNA, 21 bp, Homo sapiens
ctgaggcaggagaactacttg

SEQ ID NO: 4053496 - DNA, 15 bp, Homo sapiens
ctgaggcaggaggat

SEQ ID NO: 4053497 - DNA, 14 bp, Homo sapiens
ctgaggccacactc

SEQ ID NO: 4053498 - DNA, 14 bp, Homo sapiens
ctgaggccagagtc

SEQ ID NO: 4053499 - DNA, 18 bp, Homo sapiens
ctgaggccagagtcacct

SEQ ID NO: 4053500 - DNA, 15 bp, Homo sapiens
ctgaggccagggctg

SEQ ID NO: 4053501 - DNA, 16 bp, Homo sapiens
ctgaggccctgcccaa

SEQ ID NO: 4053502 - DNA, 17 bp, Homo sapiens
ctgaggccctgggctgg

SEQ ID NO: 4053503 - DNA, 21 bp, Homo sapiens
ctgaggcctaaaagtaaacat

SEQ ID NO: 4053504 - DNA, 15 bp, Homo sapiens
ctgaggcctggactt

SEQ ID NO: 4053505 - DNA, 22 bp, Homo sapiens
ctgaggcctggactttcctgca

SEQ ID NO: 4053506 - DNA, 15 bp, Homo sapiens
ctgaggcggaggctg

SEQ ID NO: 4053507 - DNA, 16 bp, Homo sapiens
ctgaggcggaggctgt

SEQ ID NO: 4053508 - DNA, 15 bp, Homo sapiens
ctgcccaccattccc

SEQ ID NO: 4053509 - DNA, 22 bp, Homo sapiens
ctgcccagacccctctggccag

SEQ ID NO: 4053510 - DNA, 16 bp, Homo sapiens
ctgcccaggaactcgc

SEQ ID NO: 4053511 - DNA, 18 bp, Homo sapiens
ctgcccaggctgtgcagc

SEQ ID NO: 4053512 - DNA, 20 bp, Homo sapiens
ctgcccatggacaggctggc

SEQ ID NO: 4053513 - DNA, 12 bp, Homo sapiens
ctgccccaactc

SEQ ID NO: 4053514 - DNA, 21 bp, Homo sapiens
ctgccccacacggactcccgg

SEQ ID NO: 4053515 - DNA, 11 bp, Homo sapiens
ctgccccaccc

SEQ ID NO: 4053516 - DNA, 13 bp, Homo sapiens
ctgccccacccca

SEQ ID NO: 4053517 - DNA, 18 bp, Homo sapiens
ctgccccacggagacaga

SEQ ID NO: 4053518 - DNA, 14 bp, Homo sapiens
ctgccccagcccag

SEQ ID NO: 4053519 - DNA, 15 bp, Homo sapiens
ctgccccagcccaga

SEQ ID NO: 4053520 - DNA, 16 bp, Homo sapiens
ctgccccagcccagat

SEQ ID NO: 4053521 - DNA, 19 bp, Homo sapiens
ctgccccagctactaaggt

SEQ ID NO: 4053522 - DNA, 22 bp, Homo sapiens
ctgccccagctactaaggtgct

SEQ ID NO: 4053523 - DNA, 21 bp, Homo sapiens
ctgccccagctgactgtggcc

SEQ ID NO: 4053524 - DNA, 13 bp, Homo sapiens
ctgccccaggcct

SEQ ID NO: 4053525 - DNA, 15 bp, Homo sapiens
ctgccccaggcctga

SEQ ID NO: 4053526 - DNA, 15 bp, Homo sapiens
ctgcccccaccccgg

SEQ ID NO: 4053527 - DNA, 12 bp, Homo sapiens
ctgcccccactg

SEQ ID NO: 4053528 - DNA, 23 bp, Homo sapiens
ctgcccccactgtccccctaccc

SEQ ID NO: 4053529 - DNA, 19 bp, Homo sapiens
ctgccccccagcctctggc

SEQ ID NO: 4053530 - DNA, 21 bp, Homo sapiens
ctgccccccagcctctggcat

SEQ ID NO: 4053531 - DNA, 22 bp, Homo sapiens
ctgcccccgctcccgctcccag

SEQ ID NO: 4053532 - DNA, 17 bp, Homo sapiens
ctgcccccggccccctg

SEQ ID NO: 4053533 - DNA, 17 bp, Homo sapiens
ctgccccctgctggctc

SEQ ID NO: 4053534 - DNA, 19 bp, Homo sapiens
ctgccccctgctggctctt

SEQ ID NO: 4053535 - DNA, 14 bp, Homo sapiens
ctgccccgccccca

SEQ ID NO: 4053536 - DNA, 22 bp, Homo sapiens
ctgccccggcccctccccctga

SEQ ID NO: 4053537 - DNA, 14 bp, Homo sapiens
ctgccccggcctcc

SEQ ID NO: 4053538 - DNA, 16 bp, Homo sapiens
ctgcccctcaccttgg

SEQ ID NO: 4053539 - DNA, 19 bp, Homo sapiens
ctgcccctcaccttgggct

SEQ ID NO: 4053540 - DNA, 21 bp, Homo sapiens
ctgcccctcaccttgggctgg

SEQ ID NO: 4053541 - DNA, 16 bp, Homo sapiens
ctgcccctcccaaccc

SEQ ID NO: 4053542 - DNA, 19 bp, Homo sapiens
ctgcccctcccaacccagc

SEQ ID NO: 4053543 - DNA, 13 bp, Homo sapiens
ctgcccctccccc

SEQ ID NO: 4053544 - DNA, 14 bp, Homo sapiens
ctgcccctccccca

SEQ ID NO: 4053545 - DNA, 17 bp, Homo sapiens
ctgcccctcccttcaac

SEQ ID NO: 4053546 - DNA, 22 bp, Homo sapiens
ctgcccctgccttggggtcagg

SEQ ID NO: 4053547 - DNA, 23 bp, Homo sapiens
ctgccccttaaacacaggctgtc

SEQ ID NO: 4053548 - DNA, 18 bp, Homo sapiens
ctgcccctttcaggccta

SEQ ID NO: 4053549 - DNA, 21 bp, Homo sapiens
ctgcccgctgcaatgcctaga

SEQ ID NO: 4053550 - DNA, 18 bp, Homo sapiens
ctgccctaagcccccagg

SEQ ID NO: 4053551 - DNA, 19 bp, Homo sapiens
ctgccctaagcccccaggg

SEQ ID NO: 4053552 - DNA, 13 bp, Homo sapiens
ctgccctagctga

SEQ ID NO: 4053553 - DNA, 20 bp, Homo sapiens
ctgccctatgggcctgccgg

SEQ ID NO: 4053554 - DNA, 23 bp, Homo sapiens
ctgccctcattactgggccttag

SEQ ID NO: 4053555 - DNA, 11 bp, Homo sapiens
ctgccctgaga

SEQ ID NO: 4053556 - DNA, 19 bp, Homo sapiens
ctgccctgagaagctgctc

SEQ ID NO: 4053557 - DNA, 17 bp, Homo sapiens
ctgccctggaacatcct

SEQ ID NO: 4053558 - DNA, 17 bp, Homo sapiens
ctgccctggcagggtca

SEQ ID NO: 4053559 - DNA, 17 bp, Homo sapiens
ctgccctggctgctgcc

SEQ ID NO: 4053560 - DNA, 21 bp, Homo sapiens
ctgccctggctgctgccccca

SEQ ID NO: 4053561 - DNA, 16 bp, Homo sapiens
ctgccctggtgctgcc

SEQ ID NO: 4053562 - DNA, 17 bp, Homo sapiens
ctgccctggtgctgcca

SEQ ID NO: 4053563 - DNA, 19 bp, Homo sapiens
ctgccctggtgctgccaca

SEQ ID NO: 4053564 - DNA, 17 bp, Homo sapiens
ctgccctgtcaggaggc

SEQ ID NO: 4053565 - DNA, 20 bp, Homo sapiens
ctgccctgtcaggaggcaga

SEQ ID NO: 4053566 - DNA, 17 bp, Homo sapiens
ctgccctgtccaaaagc

SEQ ID NO: 4053567 - DNA, 18 bp, Homo sapiens
ctgccctgtccctgtccc

SEQ ID NO: 4053568 - DNA, 13 bp, Homo sapiens
ctgccctgtgtac

SEQ ID NO: 4053569 - DNA, 17 bp, Homo sapiens
ctgcccttcaccccagt

SEQ ID NO: 4053570 - DNA, 21 bp, Homo sapiens
ctgcccttcaccccagtggcc

SEQ ID NO: 4053571 - DNA, 11 bp, Homo sapiens
ctgcccttccc

SEQ ID NO: 4053572 - DNA, 13 bp, Homo sapiens
ctgcccttccctc

SEQ ID NO: 4053573 - DNA, 17 bp, Homo sapiens
ctgcccttccctctggg

SEQ ID NO: 4053574 - DNA, 14 bp, Homo sapiens
ctgcccttctcaag

SEQ ID NO: 4053575 - DNA, 14 bp, Homo sapiens
ctgccctttgtcct

SEQ ID NO: 4053576 - DNA, 18 bp, Homo sapiens
ctgccctttgtcctcctg

SEQ ID NO: 4053577 - DNA, 19 bp, Homo sapiens
ctgccgcagacgggcacag

SEQ ID NO: 4053578 - DNA, 17 bp, Homo sapiens
ctgccgctacctccctc

SEQ ID NO: 4053579 - DNA, 16 bp, Homo sapiens
ctgccgctgcaccacg

SEQ ID NO: 4053580 - DNA, 19 bp, Homo sapiens
ctgccgctgccgctgcacc

SEQ ID NO: 4053581 - DNA, 20 bp, Homo sapiens
ctgccgctgccgctgcacca

SEQ ID NO: 4053582 - DNA, 15 bp, Homo sapiens
ctgccgggctgaggg

SEQ ID NO: 4053583 - DNA, 21 bp, Homo sapiens
ctgccgggctgagggcctgct

SEQ ID NO: 4053584 - DNA, 23 bp, Homo sapiens
ctgccgggctgagggcctgctgg

SEQ ID NO: 4053585 - DNA, 23 bp, Homo sapiens
ctgccgggttctagtctcctttg

SEQ ID NO: 4053586 - DNA, 16 bp, Homo sapiens
ctgccggtcgggcagc

SEQ ID NO: 4053587 - DNA, 23 bp, Homo sapiens
ctgccggttcttaaatccatcct

SEQ ID NO: 4053588 - DNA, 14 bp, Homo sapiens
ctgccggtttgaaa

SEQ ID NO: 4053589 - DNA, 23 bp, Homo sapiens
ctgccgtgggcctgtcgtgccag

SEQ ID NO: 4053590 - DNA, 16 bp, Homo sapiens
ctgcctacagccaggt

SEQ ID NO: 4053591 - DNA, 17 bp, Homo sapiens
ctgcctagctgcctagc

SEQ ID NO: 4053592 - DNA, 18 bp, Homo sapiens
ctgcctagctgcctagca

SEQ ID NO: 4053593 - DNA, 15 bp, Homo sapiens
ctgcctatgttgggg

SEQ ID NO: 4053594 - DNA, 22 bp, Homo sapiens
ctgcctatgttgggggggaccc

SEQ ID NO: 4053595 - DNA, 14 bp, Homo sapiens
ctgcctcacttcct

SEQ ID NO: 4053596 - DNA, 19 bp, Homo sapiens
ctgcctcagacgttgcctg

SEQ ID NO: 4053597 - DNA, 15 bp, Homo sapiens
ctgcctcagccttcc

SEQ ID NO: 4053598 - DNA, 16 bp, Homo sapiens
ctgcctcagccttcca

SEQ ID NO: 4053599 - DNA, 12 bp, Homo sapiens
ctgcctcagctg

SEQ ID NO: 4053600 - DNA, 16 bp, Homo sapiens
ctgcctcagctgaccc

SEQ ID NO: 4053601 - DNA, 10 bp, Homo sapiens
ctgcctcagg

SEQ ID NO: 4053602 - DNA, 15 bp, Homo sapiens
ctgcctccaccctcc

SEQ ID NO: 4053603 - DNA, 21 bp, Homo sapiens
ctgcctcccaaggtcctctca

SEQ ID NO: 4053604 - DNA, 14 bp, Homo sapiens
ctgcctcccacttc

SEQ ID NO: 4053605 - DNA, 15 bp, Homo sapiens
ctgcctcccacttca

SEQ ID NO: 4053606 - DNA, 13 bp, Homo sapiens
ctgcctcctgcct

SEQ ID NO: 4053607 - DNA, 15 bp, Homo sapiens
ctgcctcctgcctgc

SEQ ID NO: 4053608 - DNA, 13 bp, Homo sapiens
ctgcctcctggga

SEQ ID NO: 4053609 - DNA, 14 bp, Homo sapiens
ctgcctcctgggaa

SEQ ID NO: 4053610 - DNA, 16 bp, Homo sapiens
ctgcctcctgggaaga

SEQ ID NO: 4053611 - DNA, 17 bp, Homo sapiens
ctggcccttacacactc

SEQ ID NO: 4053612 - DNA, 17 bp, Homo sapiens
ctggccgacccactgac

SEQ ID NO: 4053613 - DNA, 21 bp, Homo sapiens
ctggccgagggtcctggctcc

SEQ ID NO: 4053614 - DNA, 18 bp, Homo sapiens
ctggccgggggaggtggg

SEQ ID NO: 4053615 - DNA, 16 bp, Homo sapiens
ctggcctaaaatcttg

SEQ ID NO: 4053616 - DNA, 16 bp, Homo sapiens
ctggcctcccaaatga

SEQ ID NO: 4053617 - DNA, 21 bp, Homo sapiens
ctggcctgaaccacaggagag

SEQ ID NO: 4053618 - DNA, 21 bp, Homo sapiens
ctggcctgaactgaggagatg

SEQ ID NO: 4053619 - DNA, 18 bp, Homo sapiens
ctggcctgacttggggga

SEQ ID NO: 4053620 - DNA, 19 bp, Homo sapiens
ctggcctgagaggggaagc

SEQ ID NO: 4053621 - DNA, 20 bp, Homo sapiens
ctggcctgagagtcagctct

SEQ ID NO: 4053622 - DNA, 23 bp, Homo sapiens
ctggcctgagagtcagctctctg

SEQ ID NO: 4053623 - DNA, 12 bp, Homo sapiens
ctggcctgagca

SEQ ID NO: 4053624 - DNA, 13 bp, Homo sapiens
ctggcctgaggtc

SEQ ID NO: 4053625 - DNA, 13 bp, Homo sapiens
ctggcctgcccgt

SEQ ID NO: 4053626 - DNA, 19 bp, Homo sapiens
ctggcctgcccgtgccctg

SEQ ID NO: 4053627 - DNA, 21 bp, Homo sapiens
ctggcctgcccgtgccctggt

SEQ ID NO: 4053628 - DNA, 22 bp, Homo sapiens
ctggcctgcccgtgccctggtg

SEQ ID NO: 4053629 - DNA, 14 bp, Homo sapiens
ctggcctggactgt

SEQ ID NO: 4053630 - DNA, 12 bp, Homo sapiens
ctggcctggatc

SEQ ID NO: 4053631 - DNA, 18 bp, Homo sapiens
ctggcctgtctgtgaaga

SEQ ID NO: 4053632 - DNA, 16 bp, Homo sapiens
ctggcgcccagtggag

SEQ ID NO: 4053633 - DNA, 12 bp, Homo sapiens
ctggctacatcc

SEQ ID NO: 4053634 - DNA, 21 bp, Homo sapiens
ctggctagaggccagccccac

SEQ ID NO: 4053635 - DNA, 22 bp, Homo sapiens
ctggctagaggccagccccacc

SEQ ID NO: 4053636 - DNA, 16 bp, Homo sapiens
ctggctagagtcctca

SEQ ID NO: 4053637 - DNA, 19 bp, Homo sapiens
ctggctagagtcctcactc

SEQ ID NO: 4053638 - DNA, 22 bp, Homo sapiens
ctggctagagtcctcactccca

SEQ ID NO: 4053639 - DNA, 15 bp, Homo sapiens
ctggctcacagtaca

SEQ ID NO: 4053640 - DNA, 16 bp, Homo sapiens
ctggctccactcttga

SEQ ID NO: 4053641 - DNA, 14 bp, Homo sapiens
ctggctccagatgc

SEQ ID NO: 4053642 - DNA, 21 bp, Homo sapiens
ctggctccagatgcagggcag

SEQ ID NO: 4053643 - DNA, 14 bp, Homo sapiens
ctggctccagcctg

SEQ ID NO: 4053644 - DNA, 21 bp, Homo sapiens
ctggctccccctccccaggct

SEQ ID NO: 4053645 - DNA, 18 bp, Homo sapiens
ctggctccctcctccagg

SEQ ID NO: 4053646 - DNA, 21 bp, Homo sapiens
ctggctccctcctccaggcct

SEQ ID NO: 4053647 - DNA, 23 bp, Homo sapiens
ctggctccctcctccaggcctgc

SEQ ID NO: 4053648 - DNA, 15 bp, Homo sapiens
ctggctcctgagggg

SEQ ID NO: 4053649 - DNA, 17 bp, Homo sapiens
ctggctcctttacaaaa

SEQ ID NO: 4053650 - DNA, 17 bp, Homo sapiens
ctggctctaccttcctg

SEQ ID NO: 4053651 - DNA, 21 bp, Homo sapiens
ctggctctaccttcctgtccc

SEQ ID NO: 4053652 - DNA, 14 bp, Homo sapiens
ctggctctgcacta

SEQ ID NO: 4053653 - DNA, 19 bp, Homo sapiens
ctggctctgcactaagaga

SEQ ID NO: 4053654 - DNA, 23 bp, Homo sapiens
ctggctctgcactaagagaaaat

SEQ ID NO: 4053655 - DNA, 16 bp, Homo sapiens
ctggctctgtttgatg

SEQ ID NO: 4053656 - DNA, 17 bp, Homo sapiens
ctggctcttctgcccaa

SEQ ID NO: 4053657 - DNA, 20 bp, Homo sapiens
ctggctcttgatacccccct

SEQ ID NO: 4053658 - DNA, 13 bp, Homo sapiens
ctggctgagcagt

SEQ ID NO: 4053659 - DNA, 21 bp, Homo sapiens
ctggctgagcagttcccctgg

SEQ ID NO: 4053660 - DNA, 21 bp, Homo sapiens
ctggctgaggttcctctgcct

SEQ ID NO: 4053661 - DNA, 18 bp, Homo sapiens
ctggctgatgatccagaa

SEQ ID NO: 4053662 - DNA, 19 bp, Homo sapiens
ctggctgatgatccagaac

SEQ ID NO: 4053663 - DNA, 11 bp, Homo sapiens
ctggctgcagc

SEQ ID NO: 4053664 - DNA, 12 bp, Homo sapiens
ctggctgcccag

SEQ ID NO: 4053665 - DNA, 18 bp, Homo sapiens
ctggctgccccaacctgc

SEQ ID NO: 4053666 - DNA, 19 bp, Homo sapiens
ctggctgccttagaacctt

SEQ ID NO: 4053667 - DNA, 12 bp, Homo sapiens
ctggctgctgcc

SEQ ID NO: 4053668 - DNA, 13 bp, Homo sapiens
ctggctgctgccc

SEQ ID NO: 4053669 - DNA, 18 bp, Homo sapiens
ctggctggaggagcagca

SEQ ID NO: 4053670 - DNA, 13 bp, Homo sapiens
ctggctggcctca

SEQ ID NO: 4053671 - DNA, 12 bp, Homo sapiens
ctggctggctcc

SEQ ID NO: 4053672 - DNA, 19 bp, Homo sapiens
ctggctgggacgtggctca

SEQ ID NO: 4053673 - DNA, 23 bp, Homo sapiens
ctggctgggacgtggctcagcca

SEQ ID NO: 4053674 - DNA, 12 bp, Homo sapiens
ctggctgggcca

SEQ ID NO: 4053675 - DNA, 15 bp, Homo sapiens
ctggctggtcctccc

SEQ ID NO: 4053676 - DNA, 16 bp, Homo sapiens
ctggctggtcctccca

SEQ ID NO: 4053677 - DNA, 18 bp, Homo sapiens
ctggctgtctagaatgtg

SEQ ID NO: 4053678 - DNA, 15 bp, Homo sapiens
ctggctgtttagcag

SEQ ID NO: 4053679 - DNA, 17 bp, Homo sapiens
ctggctgtttagcagaa

SEQ ID NO: 4053680 - DNA, 23 bp, Homo sapiens
ctggcttccagcttcaggcacca

SEQ ID NO: 4053681 - DNA, 14 bp, Homo sapiens
ctggcttccaggta

SEQ ID NO: 4053682 - DNA, 16 bp, Homo sapiens
ctggcttccaggtatc

SEQ ID NO: 4053683 - DNA, 22 bp, Homo sapiens
ctggcttccaggtatctccagg

SEQ ID NO: 4053684 - DNA, 23 bp, Homo sapiens
ctggcttccaggtatctccagga

SEQ ID NO: 4053685 - DNA, 19 bp, Homo sapiens
ctggcttgaattggtgaca

SEQ ID NO: 4053686 - DNA, 15 bp, Homo sapiens
ctggctttctccgac

SEQ ID NO: 4053687 - DNA, 22 bp, Homo sapiens
ctggctttctccgactgctagg

SEQ ID NO: 4053688 - DNA, 19 bp, Homo sapiens
ctggctttgaaacctcagg

SEQ ID NO: 4053689 - DNA, 12 bp, Homo sapiens
ctggctttgcct

SEQ ID NO: 4053690 - DNA, 13 bp, Homo sapiens
ctggctttgcctc

SEQ ID NO: 4053691 - DNA, 14 bp, Homo sapiens
ctggctttgcctct

SEQ ID NO: 4053692 - DNA, 17 bp, Homo sapiens
ctggctttgcctcttct

SEQ ID NO: 4053693 - DNA, 21 bp, Homo sapiens
ctggctttgcctcttctttgt

SEQ ID NO: 4053694 - DNA, 15 bp, Homo sapiens
ctggcttttacttta

SEQ ID NO: 4053695 - DNA, 15 bp, Homo sapiens
ctggcttttcactgc

SEQ ID NO: 4053696 - DNA, 23 bp, Homo sapiens
ctggcttttcactgctggctgcc

SEQ ID NO: 4053697 - DNA, 17 bp, Homo sapiens
ctgggaaataagagaga

SEQ ID NO: 4053698 - DNA, 22 bp, Homo sapiens
ctgggaaatgagaaggcagcca

SEQ ID NO: 4053699 - DNA, 17 bp, Homo sapiens
ctgggaactcatctggt

SEQ ID NO: 4053700 - DNA, 22 bp, Homo sapiens
ctgggaagagaagagggcccag

SEQ ID NO: 4053701 - DNA, 23 bp, Homo sapiens
ctgggaagagaagagggcccagc

SEQ ID NO: 4053702 - DNA, 22 bp, Homo sapiens
ctgggaagataggctctgcaca

SEQ ID NO: 4053703 - DNA, 18 bp, Homo sapiens
ctgggacacagacccagg

SEQ ID NO: 4053704 - DNA, 17 bp, Homo sapiens
ctgggaccagagccaga

SEQ ID NO: 4053705 - DNA, 20 bp, Homo sapiens
ctgggaccagagccagatgc

SEQ ID NO: 4053706 - DNA, 20 bp, Homo sapiens
ctgggacctgccaggcaggg

SEQ ID NO: 4053707 - DNA, 16 bp, Homo sapiens
ctgggacggaccagca

SEQ ID NO: 4053708 - DNA, 20 bp, Homo sapiens
ctgggacgtggctcagccag

SEQ ID NO: 4053709 - DNA, 21 bp, Homo sapiens
ctgggacgtggctcagccagc

SEQ ID NO: 4053710 - DNA, 16 bp, Homo sapiens
ctgggactacaggtgc

SEQ ID NO: 4053711 - DNA, 14 bp, Homo sapiens
ctgggacttccatg

SEQ ID NO: 4053712 - DNA, 14 bp, Homo sapiens
ctgggagacagacc

SEQ ID NO: 4053713 - DNA, 17 bp, Homo sapiens
ctgtcatctctctgggg

SEQ ID NO: 4053714 - DNA, 18 bp, Homo sapiens
ctgtcatctctctggggc

SEQ ID NO: 4053715 - DNA, 14 bp, Homo sapiens
ctgtcatctgtgca

SEQ ID NO: 4053716 - DNA, 15 bp, Homo sapiens
ctgtcatctgtgcac

SEQ ID NO: 4053717 - DNA, 20 bp, Homo sapiens
ctgtcatgaaatcagcaaga

SEQ ID NO: 4053718 - DNA, 21 bp, Homo sapiens
ctgtcatgaaatcagcaagag

SEQ ID NO: 4053719 - DNA, 14 bp, Homo sapiens
ctgtcatgcttcat

SEQ ID NO: 4053720 - DNA, 18 bp, Homo sapiens
ctgtcatttgttgtgatg

SEQ ID NO: 4053721 - DNA, 17 bp, Homo sapiens
ctgtccaaaggaggctg

SEQ ID NO: 4053722 - DNA, 18 bp, Homo sapiens
ctgtccaaaggaggctgg

SEQ ID NO: 4053723 - DNA, 19 bp, Homo sapiens
ctgtccaaaggaggctggc

SEQ ID NO: 4053724 - DNA, 11 bp, Homo sapiens
ctgtccaagga

SEQ ID NO: 4053725 - DNA, 11 bp, Homo sapiens
ctgtccagaga

SEQ ID NO: 4053726 - DNA, 19 bp, Homo sapiens
ctgtccagattattggctg

SEQ ID NO: 4053727 - DNA, 21 bp, Homo sapiens
ctgtccagctccaacctgcaa

SEQ ID NO: 4053728 - DNA, 22 bp, Homo sapiens
ctgtccagctggggccagaggc

SEQ ID NO: 4053729 - DNA, 20 bp, Homo sapiens
ctgtccagttcctttagaaa

SEQ ID NO: 4053730 - DNA, 15 bp, Homo sapiens
ctgtcccacccacac

SEQ ID NO: 4053731 - DNA, 19 bp, Homo sapiens
ctgtcccacccacacagct

SEQ ID NO: 4053732 - DNA, 20 bp, Homo sapiens
ctgtcccacccacacagctg

SEQ ID NO: 4053733 - DNA, 22 bp, Homo sapiens
ctgtcccaccgggagcctcccc

SEQ ID NO: 4053734 - DNA, 18 bp, Homo sapiens
ctgtcccactacatctgg

SEQ ID NO: 4053735 - DNA, 13 bp, Homo sapiens
ctgtcccagcccc

SEQ ID NO: 4053736 - DNA, 21 bp, Homo sapiens
ctgtcccaggccggcccagat

SEQ ID NO: 4053737 - DNA, 19 bp, Homo sapiens
ctgtcccatggacactcca

SEQ ID NO: 4053738 - DNA, 19 bp, Homo sapiens
ctgtccccaccctccactc

SEQ ID NO: 4053739 - DNA, 15 bp, Homo sapiens
ctgtcccccaggctg

SEQ ID NO: 4053740 - DNA, 17 bp, Homo sapiens
ctgtccccctacccacc

SEQ ID NO: 4053741 - DNA, 15 bp, Homo sapiens
ctgtccccttggcag

SEQ ID NO: 4053742 - DNA, 22 bp, Homo sapiens
ctgtccctatctattaaagtga

SEQ ID NO: 4053743 - DNA, 15 bp, Homo sapiens
ctgtcccttgcctca

SEQ ID NO: 4053744 - DNA, 16 bp, Homo sapiens
ctgtcccttgcctcaa

SEQ ID NO: 4053745 - DNA, 14 bp, Homo sapiens
ctgtcccttgctgt

SEQ ID NO: 4053746 - DNA, 22 bp, Homo sapiens
ctgtccgtggaaaatttcagtc

SEQ ID NO: 4053747 - DNA, 17 bp, Homo sapiens
ctgtcctaaaccgtccc

SEQ ID NO: 4053748 - DNA, 20 bp, Homo sapiens
ctgtcctaaaccgtcccctc

SEQ ID NO: 4053749 - DNA, 21 bp, Homo sapiens
ctgtcctaccagttgccctag

SEQ ID NO: 4053750 - DNA, 14 bp, Homo sapiens
ctgtcctcagcctt

SEQ ID NO: 4053751 - DNA, 21 bp, Homo sapiens
ctgtcctcccatcccctggac

SEQ ID NO: 4053752 - DNA, 19 bp, Homo sapiens
ctgtcctctcgagcccaga

SEQ ID NO: 4053753 - DNA, 15 bp, Homo sapiens
ctgtcctgcagcaaa

SEQ ID NO: 4053754 - DNA, 16 bp, Homo sapiens
ctgtcctgcagcaaac

SEQ ID NO: 4053755 - DNA, 18 bp, Homo sapiens
ctgtcctgggcctgcaga

SEQ ID NO: 4053756 - DNA, 14 bp, Homo sapiens
ctgtcctgtcctgc

SEQ ID NO: 4053757 - DNA, 19 bp, Homo sapiens
ctgtccttaacccacctct

SEQ ID NO: 4053758 - DNA, 20 bp, Homo sapiens
ctgtccttaacccacctctc

SEQ ID NO: 4053759 - DNA, 17 bp, Homo sapiens
ctgtccttcagatggaa

SEQ ID NO: 4053760 - DNA, 12 bp, Homo sapiens
ctgtcctttcct

SEQ ID NO: 4053761 - DNA, 23 bp, Homo sapiens
ctgtcgagcctgggggctggagc

SEQ ID NO: 4053762 - DNA, 16 bp, Homo sapiens
ctgtcgctctcagttc

SEQ ID NO: 4053763 - DNA, 16 bp, Homo sapiens
ctgtcggagaggctgt

SEQ ID NO: 4053764 - DNA, 23 bp, Homo sapiens
ctgtcggagaggctgtctggggc

SEQ ID NO: 4053765 - DNA, 13 bp, Homo sapiens
ctgtctaacttta

SEQ ID NO: 4053766 - DNA, 13 bp, Homo sapiens
ctgtctagaatgt

SEQ ID NO: 4053767 - DNA, 16 bp, Homo sapiens
ctgtctagaatgtgga

SEQ ID NO: 4053768 - DNA, 21 bp, Homo sapiens
ctgtctagcacttccttgcca

SEQ ID NO: 4053769 - DNA, 21 bp, Homo sapiens
ctgtctaggtctcctcagggt

SEQ ID NO: 4053770 - DNA, 23 bp, Homo sapiens
ctgtctcaagagggcactggtgg

SEQ ID NO: 4053771 - DNA, 16 bp, Homo sapiens
ctgtctcagtttcact

SEQ ID NO: 4053772 - DNA, 17 bp, Homo sapiens
ctgtctcagtttcactt

SEQ ID NO: 4053773 - DNA, 14 bp, Homo sapiens
ctgtctcatcccca

SEQ ID NO: 4053774 - DNA, 19 bp, Homo sapiens
ctgtctcatccccaggggt

SEQ ID NO: 4053775 - DNA, 17 bp, Homo sapiens
ctgtctcatcctcctgg

SEQ ID NO: 4053776 - DNA, 13 bp, Homo sapiens
ctgtctccagctg

SEQ ID NO: 4053777 - DNA, 14 bp, Homo sapiens
ctgtctccagctgc

SEQ ID NO: 4053778 - DNA, 15 bp, Homo sapiens
ctgtctccagctgcc

SEQ ID NO: 4053779 - DNA, 18 bp, Homo sapiens
ctgtctccagctgcctgg

SEQ ID NO: 4053780 - DNA, 20 bp, Homo sapiens
ctgtctccagctgcctgggc

SEQ ID NO: 4053781 - DNA, 15 bp, Homo sapiens
ctgtctcttgaaaaa

SEQ ID NO: 4053782 - DNA, 18 bp, Homo sapiens
ctgtctgaggttgggaga

SEQ ID NO: 4053783 - DNA, 16 bp, Homo sapiens
ctgtctgtctggtcca

SEQ ID NO: 4053784 - DNA, 14 bp, Homo sapiens
ctgtctgtgaacag

SEQ ID NO: 4053785 - DNA, 17 bp, Homo sapiens
ctgtctgtgaagagcaa

SEQ ID NO: 4053786 - DNA, 18 bp, Homo sapiens
ctgtcttatggtccagaa

SEQ ID NO: 4053787 - DNA, 19 bp, Homo sapiens
ctgtcttatggtccagaaa

SEQ ID NO: 4053788 - DNA, 21 bp, Homo sapiens
ctgtcttcaggctctgcccag

SEQ ID NO: 4053789 - DNA, 18 bp, Homo sapiens
ctgtcttcggccgagctg

SEQ ID NO: 4053790 - DNA, 22 bp, Homo sapiens
ctgtcttcggccgagctggttt

SEQ ID NO: 4053791 - DNA, 14 bp, Homo sapiens
ctgtcttctgggca

SEQ ID NO: 4053792 - DNA, 16 bp, Homo sapiens
ctgtcttctgggcaca

SEQ ID NO: 4053793 - DNA, 19 bp, Homo sapiens
ctgtcttgttaatgctttt

SEQ ID NO: 4053794 - DNA, 16 bp, Homo sapiens
ctgtctttaaaagaga

SEQ ID NO: 4053795 - DNA, 17 bp, Homo sapiens
ctgtctttaaaagagag

SEQ ID NO: 4053796 - DNA, 18 bp, Homo sapiens
ctgtctttaaaagagaga

SEQ ID NO: 4053797 - DNA, 20 bp, Homo sapiens
ctgtctttcagatacatggt

SEQ ID NO: 4053798 - DNA, 15 bp, Homo sapiens
ctgtgaaactggcac

SEQ ID NO: 4053799 - DNA, 18 bp, Homo sapiens
ctgtgaaagtacatttgg

SEQ ID NO: 4053800 - DNA, 16 bp, Homo sapiens
ctgtgaaatgctggca

SEQ ID NO: 4053801 - DNA, 20 bp, Homo sapiens
ctgtgaagacccagcaggaa

SEQ ID NO: 4053802 - DNA, 22 bp, Homo sapiens
ctgtgaagacccagcaggaagc

SEQ ID NO: 4053803 - DNA, 17 bp, Homo sapiens
ctgtgaagttacatgca

SEQ ID NO: 4053804 - DNA, 22 bp, Homo sapiens
ctgtgaagttacatgcataaaa

SEQ ID NO: 4053805 - DNA, 23 bp, Homo sapiens
ctgtgaagtttacattgtaaata

SEQ ID NO: 4053806 - DNA, 14 bp, Homo sapiens
ctgtgaatacaatt

SEQ ID NO: 4053807 - DNA, 15 bp, Homo sapiens
ctgtgaattcagatt

SEQ ID NO: 4053808 - DNA, 18 bp, Homo sapiens
ctgtgacaataagtttga

SEQ ID NO: 4053809 - DNA, 21 bp, Homo sapiens
ctgtgacatctctattcccca

SEQ ID NO: 4053810 - DNA, 19 bp, Homo sapiens
ctgtgaccaccttctgtcc

SEQ ID NO: 4053811 - DNA, 17 bp, Homo sapiens
ctgtgaccatttataat

SEQ ID NO: 4053812 - DNA, 17 bp, Homo sapiens
ctgtgacccccagctcc

SEQ ID NO: 4053813 - DNA, 21 bp, Homo sapiens
ctgtgacccccagctccggcc

SEQ ID NO: 4053814 - DNA, 21 bp, Homo sapiens
ctgtgacttctccaggtctca

SEQ ID NO: 4053815 - DNA, 18 bp, Homo sapiens
cttagcatgtgttgaaaa

SEQ ID NO: 4053816 - DNA, 14 bp, Homo sapiens
cttagcctccctga

SEQ ID NO: 4053817 - DNA, 12 bp, Homo sapiens
cttagctgccag

SEQ ID NO: 4053818 - DNA, 14 bp, Homo sapiens
cttagctgccagtg

SEQ ID NO: 4053819 - DNA, 14 bp, Homo sapiens
cttagctggagatg

SEQ ID NO: 4053820 - DNA, 11 bp, Homo sapiens
cttagcttgca

SEQ ID NO: 4053821 - DNA, 14 bp, Homo sapiens
cttagctttttaat

SEQ ID NO: 4053822 - DNA, 16 bp, Homo sapiens
cttagctttttaattg

SEQ ID NO: 4053823 - DNA, 17 bp, Homo sapiens
cttagctttttaattgt

SEQ ID NO: 4053824 - DNA, 17 bp, Homo sapiens
cttaggaagagaaacca

SEQ ID NO: 4053825 - DNA, 15 bp, Homo sapiens
cttaggagagaccga

SEQ ID NO: 4053826 - DNA, 17 bp, Homo sapiens
cttaggccttcctctct

SEQ ID NO: 4053827 - DNA, 14 bp, Homo sapiens
cttagggaaagatg

SEQ ID NO: 4053828 - DNA, 13 bp, Homo sapiens
cttagggaagctg

SEQ ID NO: 4053829 - DNA, 15 bp, Homo sapiens
cttaggtcagatgga

SEQ ID NO: 4053830 - DNA, 23 bp, Homo sapiens
cttagtaagcggctcaagcccag

SEQ ID NO: 4053831 - DNA, 18 bp, Homo sapiens
cttagtaggtcctcaata

SEQ ID NO: 4053832 - DNA, 12 bp, Homo sapiens
cttagtatttct

SEQ ID NO: 4053833 - DNA, 23 bp, Homo sapiens
cttagtctcagtttgtgtgtctt

SEQ ID NO: 4053834 - DNA, 13 bp, Homo sapiens
cttagtgggccag

SEQ ID NO: 4053835 - DNA, 17 bp, Homo sapiens
cttagttacatttctat

SEQ ID NO: 4053836 - DNA, 15 bp, Homo sapiens
cttagttctcactgt

SEQ ID NO: 4053837 - DNA, 20 bp, Homo sapiens
cttagttgacaacctagaat

SEQ ID NO: 4053838 - DNA, 22 bp, Homo sapiens
cttagttgacaacctagaatgt

SEQ ID NO: 4053839 - DNA, 13 bp, Homo sapiens
cttagttggctgg

SEQ ID NO: 4053840 - DNA, 19 bp, Homo sapiens
cttagttggctggaaactg

SEQ ID NO: 4053841 - DNA, 17 bp, Homo sapiens
cttataaacacattgaa

SEQ ID NO: 4053842 - DNA, 16 bp, Homo sapiens
cttataaaccaatctt

SEQ ID NO: 4053843 - DNA, 17 bp, Homo sapiens
cttataaaccaatctta

SEQ ID NO: 4053844 - DNA, 19 bp, Homo sapiens
cttataaaccaatcttaaa

SEQ ID NO: 4053845 - DNA, 13 bp, Homo sapiens
cttataaatcata

SEQ ID NO: 4053846 - DNA, 18 bp, Homo sapiens
cttataaatcatattgat

SEQ ID NO: 4053847 - DNA, 20 bp, Homo sapiens
cttataagtgaagtgatact

SEQ ID NO: 4053848 - DNA, 20 bp, Homo sapiens
cttataataaaggactgtaa

SEQ ID NO: 4053849 - DNA, 14 bp, Homo sapiens
cttatagaataaaa

SEQ ID NO: 4053850 - DNA, 19 bp, Homo sapiens
cttatagaataaaagctgt

SEQ ID NO: 4053851 - DNA, 23 bp, Homo sapiens
cttatagaataaaagctgtggaa

SEQ ID NO: 4053852 - DNA, 20 bp, Homo sapiens
cttatagaatatttattacc

SEQ ID NO: 4053853 - DNA, 19 bp, Homo sapiens
cttatagacacttgctccc

SEQ ID NO: 4053854 - DNA, 18 bp, Homo sapiens
cttataggcctgtccctt

SEQ ID NO: 4053855 - DNA, 22 bp, Homo sapiens
cttatagtgtttggacagctga

SEQ ID NO: 4053856 - DNA, 20 bp, Homo sapiens
cttatatctaaatctgtcca

SEQ ID NO: 4053857 - DNA, 12 bp, Homo sapiens
cttatatttaca

SEQ ID NO: 4053858 - DNA, 14 bp, Homo sapiens
cttatatttacaat

SEQ ID NO: 4053859 - DNA, 19 bp, Homo sapiens
cttatatttccctaaaata

SEQ ID NO: 4053860 - DNA, 19 bp, Homo sapiens
cttatcaaagtagcaaatg

SEQ ID NO: 4053861 - DNA, 21 bp, Homo sapiens
cttatcactgcattattctct

SEQ ID NO: 4053862 - DNA, 15 bp, Homo sapiens
cttatccaggactct

SEQ ID NO: 4053863 - DNA, 12 bp, Homo sapiens
cttatccctctc

SEQ ID NO: 4053864 - DNA, 13 bp, Homo sapiens
cttatccctctct

SEQ ID NO: 4053865 - DNA, 21 bp, Homo sapiens
cttatcctaaaacaaatagtt

SEQ ID NO: 4053866 - DNA, 16 bp, Homo sapiens
cttatcgggctccagc

SEQ ID NO: 4053867 - DNA, 18 bp, Homo sapiens
cttatcgggctccagcca

SEQ ID NO: 4053868 - DNA, 19 bp, Homo sapiens
cttatctcagtcatgcata

SEQ ID NO: 4053869 - DNA, 23 bp, Homo sapiens
cttatctcagtcatgcataaata

SEQ ID NO: 4053870 - DNA, 13 bp, Homo sapiens
cttatctctctgt

SEQ ID NO: 4053871 - DNA, 14 bp, Homo sapiens
cttatctctctgtg

SEQ ID NO: 4053872 - DNA, 21 bp, Homo sapiens
cttatctgtgcgtgaaacaca

SEQ ID NO: 4053873 - DNA, 23 bp, Homo sapiens
cttatgacgcggctcaaaaggaa

SEQ ID NO: 4053874 - DNA, 13 bp, Homo sapiens
cttatgagatggg

SEQ ID NO: 4053875 - DNA, 14 bp, Homo sapiens
cttatgaggagggg

SEQ ID NO: 4053876 - DNA, 15 bp, Homo sapiens
cttatgaggagggga

SEQ ID NO: 4053877 - DNA, 23 bp, Homo sapiens
cttatgattcagattgttatcta

SEQ ID NO: 4053878 - DNA, 12 bp, Homo sapiens
cttatgcttcca

SEQ ID NO: 4053879 - DNA, 14 bp, Homo sapiens
cttatgcttccaga

SEQ ID NO: 4053880 - DNA, 15 bp, Homo sapiens
cttatgcttccagaa

SEQ ID NO: 4053881 - DNA, 16 bp, Homo sapiens
cttatggaattgattt

SEQ ID NO: 4053882 - DNA, 19 bp, Homo sapiens
cttatggaattgatttgca

SEQ ID NO: 4053883 - DNA, 21 bp, Homo sapiens
cttatggaattgatttgcatt

SEQ ID NO: 4053884 - DNA, 21 bp, Homo sapiens
cttatgggtagggctctgaca

SEQ ID NO: 4053885 - DNA, 21 bp, Homo sapiens
cttatgggtccccctcagcaa

SEQ ID NO: 4053886 - DNA, 13 bp, Homo sapiens
cttattacaattt

SEQ ID NO: 4053887 - DNA, 22 bp, Homo sapiens
cttattaccctgattgaatgtg

SEQ ID NO: 4053888 - DNA, 17 bp, Homo sapiens
cttattagggagaaaat

SEQ ID NO: 4053889 - DNA, 15 bp, Homo sapiens
cttattattgaagga

SEQ ID NO: 4053890 - DNA, 16 bp, Homo sapiens
cttattcctctaggca

SEQ ID NO: 4053891 - DNA, 15 bp, Homo sapiens
cttattctcaaagca

SEQ ID NO: 4053892 - DNA, 13 bp, Homo sapiens
cttattgccaaaa

SEQ ID NO: 4053893 - DNA, 16 bp, Homo sapiens
cttattgcgctgctac

SEQ ID NO: 4053894 - DNA, 14 bp, Homo sapiens
cttattgtacctct

SEQ ID NO: 4053895 - DNA, 15 bp, Homo sapiens
cttattgtacctctc

SEQ ID NO: 4053896 - DNA, 18 bp, Homo sapiens
cttattgtacctctctta

SEQ ID NO: 4053897 - DNA, 13 bp, Homo sapiens
cttattgttccaa

SEQ ID NO: 4053898 - DNA, 21 bp, Homo sapiens
cttattgttccaagacattgt

SEQ ID NO: 4053899 - DNA, 15 bp, Homo sapiens
cttatttaaaaatat

SEQ ID NO: 4053900 - DNA, 21 bp, Homo sapiens
cttatttaaaaatatttcaga

SEQ ID NO: 4053901 - DNA, 17 bp, Homo sapiens
cttatttaatgaaagac

SEQ ID NO: 4053902 - DNA, 18 bp, Homo sapiens
cttatttacccttttccc

SEQ ID NO: 4053903 - DNA, 13 bp, Homo sapiens
cttatttagagat

SEQ ID NO: 4053904 - DNA, 11 bp, Homo sapiens
cttatttcact

SEQ ID NO: 4053905 - DNA, 17 bp, Homo sapiens
cttatttctgctctgga

SEQ ID NO: 4053906 - DNA, 14 bp, Homo sapiens
cttatttgccttct

SEQ ID NO: 4053907 - DNA, 19 bp, Homo sapiens
cttatttgccttctactcc

SEQ ID NO: 4053908 - DNA, 15 bp, Homo sapiens
cttatttgcttcatt

SEQ ID NO: 4053909 - DNA, 15 bp, Homo sapiens
cttattttatttcca

SEQ ID NO: 4053910 - DNA, 17 bp, Homo sapiens
cttattttctcaatctc

SEQ ID NO: 4053911 - DNA, 18 bp, Homo sapiens
cttattttgcattccaga

SEQ ID NO: 4053912 - DNA, 19 bp, Homo sapiens
cttcaaaacaaacagatgc

SEQ ID NO: 4053913 - DNA, 14 bp, Homo sapiens
cttcaaatgaaaat

SEQ ID NO: 4053914 - DNA, 22 bp, Homo sapiens
cttcaacaaggcttgctgcaga

SEQ ID NO: 4053915 - DNA, 18 bp, Homo sapiens
cttcaacatcctgccagc

SEQ ID NO: 4053916 - DNA, 21 bp, Homo sapiens
cttcaacatcctgccagcccc

SEQ ID NO: 4053917 - DNA, 14 bp, Homo sapiens
cttcaacccagtgg

SEQ ID NO: 4053918 - DNA, 18 bp, Homo sapiens
cttgccttcctcagctgc

SEQ ID NO: 4053919 - DNA, 20 bp, Homo sapiens
cttgccttcttcacccagct

SEQ ID NO: 4053920 - DNA, 17 bp, Homo sapiens
cttgcctttcgaggcct

SEQ ID NO: 4053921 - DNA, 21 bp, Homo sapiens
cttgcgcctcagccctcagtt

SEQ ID NO: 4053922 - DNA, 22 bp, Homo sapiens
cttgcgtgtcaatttccctcag

SEQ ID NO: 4053923 - DNA, 17 bp, Homo sapiens
cttgctaattttctcaa

SEQ ID NO: 4053924 - DNA, 16 bp, Homo sapiens
cttgctacctcaaggg

SEQ ID NO: 4053925 - DNA, 14 bp, Homo sapiens
cttgctcattaatt

SEQ ID NO: 4053926 - DNA, 16 bp, Homo sapiens
cttgctcattaatttt

SEQ ID NO: 4053927 - DNA, 16 bp, Homo sapiens
cttgctcattcttgag

SEQ ID NO: 4053928 - DNA, 21 bp, Homo sapiens
cttgctcattcttgaggagca

SEQ ID NO: 4053929 - DNA, 12 bp, Homo sapiens
cttgctcccaac

SEQ ID NO: 4053930 - DNA, 15 bp, Homo sapiens
cttgctccctgtgtc

SEQ ID NO: 4053931 - DNA, 17 bp, Homo sapiens
cttgctcccttcagccc

SEQ ID NO: 4053932 - DNA, 19 bp, Homo sapiens
cttgctcccttcagccccc

SEQ ID NO: 4053933 - DNA, 20 bp, Homo sapiens
cttgctcctagcagacagaa

SEQ ID NO: 4053934 - DNA, 23 bp, Homo sapiens
cttgctcctagcagacagaaact

SEQ ID NO: 4053935 - DNA, 14 bp, Homo sapiens
cttgctctcagctg

SEQ ID NO: 4053936 - DNA, 16 bp, Homo sapiens
cttgctctcagctgcc

SEQ ID NO: 4053937 - DNA, 13 bp, Homo sapiens
cttgctctgtccc

SEQ ID NO: 4053938 - DNA, 17 bp, Homo sapiens
cttgctctgtcccccag

SEQ ID NO: 4053939 - DNA, 19 bp, Homo sapiens
cttgctctgtcccccaggc

SEQ ID NO: 4053940 - DNA, 14 bp, Homo sapiens
cttgctgaacacac

SEQ ID NO: 4053941 - DNA, 12 bp, Homo sapiens
cttgctgagtgg

SEQ ID NO: 4053942 - DNA, 15 bp, Homo sapiens
cttgctgatggcttg

SEQ ID NO: 4053943 - DNA, 16 bp, Homo sapiens
cttgctgatggcttga

SEQ ID NO: 4053944 - DNA, 23 bp, Homo sapiens
cttgctgatggcttgacatgtgc

SEQ ID NO: 4053945 - DNA, 13 bp, Homo sapiens
cttgctgctgctg

SEQ ID NO: 4053946 - DNA, 22 bp, Homo sapiens
cttgctggacggggactgggga

SEQ ID NO: 4053947 - DNA, 20 bp, Homo sapiens
cttgctggtgcctgccacct

SEQ ID NO: 4053948 - DNA, 13 bp, Homo sapiens
cttgctgtatgct

SEQ ID NO: 4053949 - DNA, 18 bp, Homo sapiens
cttgctgtcctgatctgt

SEQ ID NO: 4053950 - DNA, 16 bp, Homo sapiens
cttgctgtctctgctc

SEQ ID NO: 4053951 - DNA, 13 bp, Homo sapiens
cttgcttaaattt

SEQ ID NO: 4053952 - DNA, 17 bp, Homo sapiens
cttgcttaaatttctta

SEQ ID NO: 4053953 - DNA, 23 bp, Homo sapiens
cttgcttaaatttcttatgtgac

SEQ ID NO: 4053954 - DNA, 20 bp, Homo sapiens
cttgcttcttactgataatt

SEQ ID NO: 4053955 - DNA, 13 bp, Homo sapiens
cttgcttgtcatt

SEQ ID NO: 4053956 - DNA, 16 bp, Homo sapiens
cttgctttcctgggcc

SEQ ID NO: 4053957 - DNA, 18 bp, Homo sapiens
cttgctttcctgggcctt

SEQ ID NO: 4053958 - DNA, 20 bp, Homo sapiens
cttgctttgatttacagcaa

SEQ ID NO: 4053959 - DNA, 21 bp, Homo sapiens
cttgctttgatttacagcaag

SEQ ID NO: 4053960 - DNA, 19 bp, Homo sapiens
cttgctttgtgtatctcat

SEQ ID NO: 4053961 - DNA, 20 bp, Homo sapiens
cttgctttgttttaataaac

SEQ ID NO: 4053962 - DNA, 17 bp, Homo sapiens
cttggaaatagaaagaa

SEQ ID NO: 4053963 - DNA, 20 bp, Homo sapiens
cttggaaatagaaagaagcc

SEQ ID NO: 4053964 - DNA, 23 bp, Homo sapiens
cttggaaatagaaagaagccata

SEQ ID NO: 4053965 - DNA, 15 bp, Homo sapiens
cttggaaccagcccc

SEQ ID NO: 4053966 - DNA, 22 bp, Homo sapiens
cttggaagtacatgaatacaaa

SEQ ID NO: 4053967 - DNA, 22 bp, Homo sapiens
cttggaatttgtaacctcagct

SEQ ID NO: 4053968 - DNA, 19 bp, Homo sapiens
cttggacaggagtcagtgt

SEQ ID NO: 4053969 - DNA, 21 bp, Homo sapiens
cttggacaggagtcagtgtct

SEQ ID NO: 4053970 - DNA, 23 bp, Homo sapiens
cttggacaggagtcagtgtctgg

SEQ ID NO: 4053971 - DNA, 13 bp, Homo sapiens
cttggagcaggca

SEQ ID NO: 4053972 - DNA, 23 bp, Homo sapiens
cttggagctgtgagttctccctg

SEQ ID NO: 4053973 - DNA, 21 bp, Homo sapiens
cttggagcttacatagtttta

SEQ ID NO: 4053974 - DNA, 21 bp, Homo sapiens
cttggaggtcacagctggatc

SEQ ID NO: 4053975 - DNA, 23 bp, Homo sapiens
cttggaggtcacagctggatctg

SEQ ID NO: 4053976 - DNA, 21 bp, Homo sapiens
cttggattattttaaatcatt

SEQ ID NO: 4053977 - DNA, 15 bp, Homo sapiens
cttggcaaaagcctt

SEQ ID NO: 4053978 - DNA, 18 bp, Homo sapiens
cttggcaatattccttag

SEQ ID NO: 4053979 - DNA, 16 bp, Homo sapiens
cttggcaccagacacc

SEQ ID NO: 4053980 - DNA, 14 bp, Homo sapiens
cttggcactttttc

SEQ ID NO: 4053981 - DNA, 16 bp, Homo sapiens
cttggcaggtgcctgt

SEQ ID NO: 4053982 - DNA, 15 bp, Homo sapiens
cttggcatagacatg

SEQ ID NO: 4053983 - DNA, 15 bp, Homo sapiens
cttggcccctgtgtg

SEQ ID NO: 4053984 - DNA, 21 bp, Homo sapiens
cttggcccggccggcctggca

SEQ ID NO: 4053985 - DNA, 23 bp, Homo sapiens
cttggcctcagaattcacaaaat

SEQ ID NO: 4053986 - DNA, 15 bp, Homo sapiens
cttggcctcccaaag

SEQ ID NO: 4053987 - DNA, 13 bp, Homo sapiens
cttggcctgctgt

SEQ ID NO: 4053988 - DNA, 16 bp, Homo sapiens
cttggcctgctgtgat

SEQ ID NO: 4053989 - DNA, 22 bp, Homo sapiens
cttggcctgtctcatccccagg

SEQ ID NO: 4053990 - DNA, 14 bp, Homo sapiens
cttggccttgggct

SEQ ID NO: 4053991 - DNA, 17 bp, Homo sapiens
cttggctctcctctggc

SEQ ID NO: 4053992 - DNA, 21 bp, Homo sapiens
cttggctctcctctggctaga

SEQ ID NO: 4053993 - DNA, 16 bp, Homo sapiens
cttggctgacccctct

SEQ ID NO: 4053994 - DNA, 19 bp, Homo sapiens
cttggctgacccctctggt

SEQ ID NO: 4053995 - DNA, 14 bp, Homo sapiens
cttggctgactggg

SEQ ID NO: 4053996 - DNA, 18 bp, Homo sapiens
cttggcttacctgacctc

SEQ ID NO: 4053997 - DNA, 16 bp, Homo sapiens
cttggcttcctttctt

SEQ ID NO: 4053998 - DNA, 18 bp, Homo sapiens
cttggcttcctttcttgg

SEQ ID NO: 4053999 - DNA, 21 bp, Homo sapiens
cttgggaaaaaaacttggcac

SEQ ID NO: 4054000 - DNA, 23 bp, Homo sapiens
cttgggaaaaaaacttggcactt

SEQ ID NO: 4054001 - DNA, 15 bp, Homo sapiens
cttgggacagccaga

SEQ ID NO: 4054002 - DNA, 18 bp, Homo sapiens
cttgggacagccagagct

SEQ ID NO: 4054003 - DNA, 15 bp, Homo sapiens
cttgggaggcttccc

SEQ ID NO: 4054004 - DNA, 21 bp, Homo sapiens
cttgggatagtgttctgctcc

SEQ ID NO: 4054005 - DNA, 23 bp, Homo sapiens
cttgggatagtgttctgctcctg

SEQ ID NO: 4054006 - DNA, 17 bp, Homo sapiens
cttgggcagtgccccag

SEQ ID NO: 4054007 - DNA, 21 bp, Homo sapiens
cttgggcagtgccccagggag

SEQ ID NO: 4054008 - DNA, 13 bp, Homo sapiens
cttgggcagttct

SEQ ID NO: 4054009 - DNA, 23 bp, Homo sapiens
cttgggcagttctcactcctagg

SEQ ID NO: 4054010 - DNA, 14 bp, Homo sapiens
cttgggccctgcac

SEQ ID NO: 4054011 - DNA, 19 bp, Homo sapiens
cttgggccttgctgctgct

SEQ ID NO: 4054012 - DNA, 12 bp, Homo sapiens
cttgggctgggg

SEQ ID NO: 4054013 - DNA, 23 bp, Homo sapiens
cttggggagagggatttccctgc

SEQ ID NO: 4054014 - DNA, 19 bp, Homo sapiens
cttggggagttaagacctg

SEQ ID NO: 4054015 - DNA, 18 bp, Homo sapiens
cttggggctggggggcac

SEQ ID NO: 4054016 - DNA, 21 bp, Homo sapiens
cttgggggaacgatgtgtctg

SEQ ID NO: 4054017 - DNA, 22 bp, Homo sapiens
cttggggggtttttactccagt

SEQ ID NO: 4054018 - DNA, 23 bp, Homo sapiens
cttggggggtttttactccagtg

SEQ ID NO: 4054019 - DNA, 13 bp, Homo sapiens
cttggggtcaggt

SEQ ID NO: 4054020 - DNA, 21 bp, Homo sapiens
gaatgcctcaatgtgaccagg

SEQ ID NO: 4054021 - DNA, 18 bp, Homo sapiens
gaatgcctcctgtgggga

SEQ ID NO: 4054022 - DNA, 13 bp, Homo sapiens
gaatgcctgtgcc

SEQ ID NO: 4054023 - DNA, 15 bp, Homo sapiens
gaatgcctgtgccaa

SEQ ID NO: 4054024 - DNA, 13 bp, Homo sapiens
gaatgccttggaa

SEQ ID NO: 4054025 - DNA, 16 bp, Homo sapiens
gaatgctctgtgccag

SEQ ID NO: 4054026 - DNA, 17 bp, Homo sapiens
gaatgctctgtgccaga

SEQ ID NO: 4054027 - DNA, 11 bp, Homo sapiens
gaatgctgcca

SEQ ID NO: 4054028 - DNA, 15 bp, Homo sapiens
gaatgctgccagtgt

SEQ ID NO: 4054029 - DNA, 18 bp, Homo sapiens
gaatgctggactggaggc

SEQ ID NO: 4054030 - DNA, 17 bp, Homo sapiens
gaatgctggttttccta

SEQ ID NO: 4054031 - DNA, 13 bp, Homo sapiens
gaatgctgtacat

SEQ ID NO: 4054032 - DNA, 14 bp, Homo sapiens
gaatgctgtacatc

SEQ ID NO: 4054033 - DNA, 20 bp, Homo sapiens
gaatgctgtacatctatttt

SEQ ID NO: 4054034 - DNA, 14 bp, Homo sapiens
gaatgctgtgttaa

SEQ ID NO: 4054035 - DNA, 15 bp, Homo sapiens
gaatggacatcctgt

SEQ ID NO: 4054036 - DNA, 19 bp, Homo sapiens
gaatggatcacaagatgga

SEQ ID NO: 4054037 - DNA, 19 bp, Homo sapiens
gaatggattggattattta

SEQ ID NO: 4054038 - DNA, 16 bp, Homo sapiens
gaatgggataagaagg

SEQ ID NO: 4054039 - DNA, 20 bp, Homo sapiens
gaatggtacatgtcttccat

SEQ ID NO: 4054040 - DNA, 22 bp, Homo sapiens
gaatggttccatgcctgagggt

SEQ ID NO: 4054041 - DNA, 17 bp, Homo sapiens
gaatgtaagaaaacaaa

SEQ ID NO: 4054042 - DNA, 23 bp, Homo sapiens
gaatgtaagaaaacaaaatctaa

SEQ ID NO: 4054043 - DNA, 11 bp, Homo sapiens
gaatgtaatca

SEQ ID NO: 4054044 - DNA, 17 bp, Homo sapiens
gaatgtattattctgca

SEQ ID NO: 4054045 - DNA, 21 bp, Homo sapiens
gaatgtattattctgcagcat

SEQ ID NO: 4054046 - DNA, 13 bp, Homo sapiens
gaatgtatttatt

SEQ ID NO: 4054047 - DNA, 23 bp, Homo sapiens
gaatgtatttatttgggagaccg

SEQ ID NO: 4054048 - DNA, 16 bp, Homo sapiens
gaatgtcagatttctg

SEQ ID NO: 4054049 - DNA, 18 bp, Homo sapiens
gaatgtcagatttctggt

SEQ ID NO: 4054050 - DNA, 22 bp, Homo sapiens
gaatgtctttgttggaaaagaa

SEQ ID NO: 4054051 - DNA, 13 bp, Homo sapiens
gaatgtgcccctg

SEQ ID NO: 4054052 - DNA, 16 bp, Homo sapiens
gaatgtgcccctggcc

SEQ ID NO: 4054053 - DNA, 20 bp, Homo sapiens
gaatgtggccacttatttca

SEQ ID NO: 4054054 - DNA, 22 bp, Homo sapiens
gaatgtggttacttcctactgt

SEQ ID NO: 4054055 - DNA, 21 bp, Homo sapiens
gaatgtgtgtgtgtggcaggg

SEQ ID NO: 4054056 - DNA, 17 bp, Homo sapiens
gaatgttacattgtttg

SEQ ID NO: 4054057 - DNA, 14 bp, Homo sapiens
gaatgttctcagat

SEQ ID NO: 4054058 - DNA, 11 bp, Homo sapiens
gaatgttctga

SEQ ID NO: 4054059 - DNA, 21 bp, Homo sapiens
gaatgtttaaagatcatgaca

SEQ ID NO: 4054060 - DNA, 15 bp, Homo sapiens
gaatgttttaaattc

SEQ ID NO: 4054061 - DNA, 17 bp, Homo sapiens
gaatgttttatttatca

SEQ ID NO: 4054062 - DNA, 18 bp, Homo sapiens
gaatgtttttccctcccc

SEQ ID NO: 4054063 - DNA, 22 bp, Homo sapiens
gaatgtttttccctccccagaa

SEQ ID NO: 4054064 - DNA, 22 bp, Homo sapiens
gaattaaaacttcttaaatatc

SEQ ID NO: 4054065 - DNA, 20 bp, Homo sapiens
gaattaaacttttaattcat

SEQ ID NO: 4054066 - DNA, 16 bp, Homo sapiens
gaattaaccatttaat

SEQ ID NO: 4054067 - DNA, 18 bp, Homo sapiens
gaattaaccatttaataa

SEQ ID NO: 4054068 - DNA, 15 bp, Homo sapiens
gaattaacctggtgc

SEQ ID NO: 4054069 - DNA, 22 bp, Homo sapiens
gaattaacctggtgctggatat

SEQ ID NO: 4054070 - DNA, 15 bp, Homo sapiens
gaattaagttatctt

SEQ ID NO: 4054071 - DNA, 22 bp, Homo sapiens
gaattaatatccctacatgtat

SEQ ID NO: 4054072 - DNA, 21 bp, Homo sapiens
gaattaatcatctataaagaa

SEQ ID NO: 4054073 - DNA, 15 bp, Homo sapiens
gaattaccaagagaa

SEQ ID NO: 4054074 - DNA, 17 bp, Homo sapiens
gaattaccaagagaagg

SEQ ID NO: 4054075 - DNA, 18 bp, Homo sapiens
gaattaccaagagaaggg

SEQ ID NO: 4054076 - DNA, 22 bp, Homo sapiens
gaattatatatttctaactata

SEQ ID NO: 4054077 - DNA, 14 bp, Homo sapiens
gaattattgacact

SEQ ID NO: 4054078 - DNA, 17 bp, Homo sapiens
gaattcaagaaaggaaa

SEQ ID NO: 4054079 - DNA, 22 bp, Homo sapiens
gaattcattttcatcactggga

SEQ ID NO: 4054080 - DNA, 14 bp, Homo sapiens
gaattcttctgcaa

SEQ ID NO: 4054081 - DNA, 17 bp, Homo sapiens
gaattgaccatctgctt

SEQ ID NO: 4054082 - DNA, 18 bp, Homo sapiens
gaattgaccatctgcttt

SEQ ID NO: 4054083 - DNA, 21 bp, Homo sapiens
gaattgatcattttcccccca

SEQ ID NO: 4054084 - DNA, 17 bp, Homo sapiens
gaattgatttgcattga

SEQ ID NO: 4054085 - DNA, 20 bp, Homo sapiens
gaattgcctgcagagagaag

SEQ ID NO: 4054086 - DNA, 21 bp, Homo sapiens
gaattggaagttacatgctgt

SEQ ID NO: 4054087 - DNA, 18 bp, Homo sapiens
gaattgtgaccaagttat

SEQ ID NO: 4054088 - DNA, 22 bp, Homo sapiens
gaattgtttttgaatttaaata

SEQ ID NO: 4054089 - DNA, 18 bp, Homo sapiens
gaatttaaaaataagaaa

SEQ ID NO: 4054090 - DNA, 20 bp, Homo sapiens
gaatttaaaattaagtagaa

SEQ ID NO: 4054091 - DNA, 12 bp, Homo sapiens
gaatttaaataa

SEQ ID NO: 4054092 - DNA, 17 bp, Homo sapiens
gaatttaaatataattc

SEQ ID NO: 4054093 - DNA, 23 bp, Homo sapiens
gaatttaaatataattctgtaaa

SEQ ID NO: 4054094 - DNA, 16 bp, Homo sapiens
gaatttactggacata

SEQ ID NO: 4054095 - DNA, 19 bp, Homo sapiens
gaatttagggagaaatgtt

SEQ ID NO: 4054096 - DNA, 16 bp, Homo sapiens
gaatttaggtttttat

SEQ ID NO: 4054097 - DNA, 23 bp, Homo sapiens
gaatttattcaattcctctggga

SEQ ID NO: 4054098 - DNA, 18 bp, Homo sapiens
gaatttcaaaccattgct

SEQ ID NO: 4054099 - DNA, 15 bp, Homo sapiens
gaatttcccaggacc

SEQ ID NO: 4054100 - DNA, 16 bp, Homo sapiens
gaatttcttgattttt

SEQ ID NO: 4054101 - DNA, 21 bp, Homo sapiens
gaatttcttggtaagaagccg

SEQ ID NO: 4054102 - DNA, 16 bp, Homo sapiens
gaatttgaatgaaaaa

SEQ ID NO: 4054103 - DNA, 22 bp, Homo sapiens
gaatttgatgattttcatttca

SEQ ID NO: 4054104 - DNA, 19 bp, Homo sapiens
gaattttaggaacttcaga

SEQ ID NO: 4054105 - DNA, 12 bp, Homo sapiens
gaatttttaagc

SEQ ID NO: 4054106 - DNA, 20 bp, Homo sapiens
gacaaaaaaatttaaaatta

SEQ ID NO: 4054107 - DNA, 19 bp, Homo sapiens
gacaaaacaatccccatca

SEQ ID NO: 4054108 - DNA, 13 bp, Homo sapiens
gacaaaagtaaat

SEQ ID NO: 4054109 - DNA, 17 bp, Homo sapiens
gacaaaagtctgtcttt

SEQ ID NO: 4054110 - DNA, 15 bp, Homo sapiens
gacaaatctgtctgc

SEQ ID NO: 4054111 - DNA, 17 bp, Homo sapiens
gacaaattcggatgtat

SEQ ID NO: 4054112 - DNA, 16 bp, Homo sapiens
gacaacacagcctata

SEQ ID NO: 4054113 - DNA, 12 bp, Homo sapiens
gacaacagaagt

SEQ ID NO: 4054114 - DNA, 22 bp, Homo sapiens
gacaacagaagtcatgaagccc

SEQ ID NO: 4054115 - DNA, 19 bp, Homo sapiens
gacaaccactggtctgtag

SEQ ID NO: 4054116 - DNA, 12 bp, Homo sapiens
gacaaccatgac

SEQ ID NO: 4054117 - DNA, 22 bp, Homo sapiens
gacaactaaaattaggactgta

SEQ ID NO: 4054118 - DNA, 12 bp, Homo sapiens
gacaactgtgac

SEQ ID NO: 4054119 - DNA, 15 bp, Homo sapiens
gacaacttatttaaa

SEQ ID NO: 4054120 - DNA, 16 bp, Homo sapiens
gacaagacccccagca

SEQ ID NO: 4054121 - DNA, 20 bp, Homo sapiens
gacaagagatgggaatgagg

SEQ ID NO: 4054122 - DNA, 20 bp, Homo sapiens
gactctaagctcagtgctct

SEQ ID NO: 4054123 - DNA, 15 bp, Homo sapiens
gactctgaagcctct

SEQ ID NO: 4054124 - DNA, 19 bp, Homo sapiens
gactctgaagcctctggga

SEQ ID NO: 4054125 - DNA, 19 bp, Homo sapiens
gactctgagcgggaggcag

SEQ ID NO: 4054126 - DNA, 22 bp, Homo sapiens
gactctgcatcccagcacctgc

SEQ ID NO: 4054127 - DNA, 14 bp, Homo sapiens
gactctgccccctg

SEQ ID NO: 4054128 - DNA, 13 bp, Homo sapiens
gactctggccctg

SEQ ID NO: 4054129 - DNA, 17 bp, Homo sapiens
gactctggccctggccc

SEQ ID NO: 4054130 - DNA, 16 bp, Homo sapiens
gactctttagagcagc

SEQ ID NO: 4054131 - DNA, 22 bp, Homo sapiens
gactctttagagcagctttggg

SEQ ID NO: 4054132 - DNA, 17 bp, Homo sapiens
gactcttttccttccct

SEQ ID NO: 4054133 - DNA, 19 bp, Homo sapiens
gactctttttagggccagg

SEQ ID NO: 4054134 - DNA, 14 bp, Homo sapiens
gactgaaaccattt

SEQ ID NO: 4054135 - DNA, 18 bp, Homo sapiens
gactgaagatgcagctca

SEQ ID NO: 4054136 - DNA, 21 bp, Homo sapiens
gactgacttgtttgtcttcca

SEQ ID NO: 4054137 - DNA, 16 bp, Homo sapiens
gactgagcaccctctg

SEQ ID NO: 4054138 - DNA, 17 bp, Homo sapiens
gactgagcaccctctgg

SEQ ID NO: 4054139 - DNA, 17 bp, Homo sapiens
gactgatggccaggcaa

SEQ ID NO: 4054140 - DNA, 18 bp, Homo sapiens
gactgcacagcggcccct

SEQ ID NO: 4054141 - DNA, 21 bp, Homo sapiens
gactgcatgtaccatttgcat

SEQ ID NO: 4054142 - DNA, 14 bp, Homo sapiens
gactgcattgccgc

SEQ ID NO: 4054143 - DNA, 22 bp, Homo sapiens
gactgccccacggagacagagg

SEQ ID NO: 4054144 - DNA, 20 bp, Homo sapiens
gactgctcagaacttgctgc

SEQ ID NO: 4054145 - DNA, 20 bp, Homo sapiens
gactgctccccagccctggc

SEQ ID NO: 4054146 - DNA, 15 bp, Homo sapiens
gactgcttggggtgg

SEQ ID NO: 4054147 - DNA, 17 bp, Homo sapiens
gactggaaccagggaga

SEQ ID NO: 4054148 - DNA, 20 bp, Homo sapiens
gactggaagctaatttgcat

SEQ ID NO: 4054149 - DNA, 17 bp, Homo sapiens
gactggacctggtggct

SEQ ID NO: 4054150 - DNA, 15 bp, Homo sapiens
gactggactgcttgg

SEQ ID NO: 4054151 - DNA, 16 bp, Homo sapiens
gactggaggaggcctg

SEQ ID NO: 4054152 - DNA, 18 bp, Homo sapiens
gactggaggtgggcatgc

SEQ ID NO: 4054153 - DNA, 13 bp, Homo sapiens
gactggcctggga

SEQ ID NO: 4054154 - DNA, 17 bp, Homo sapiens
gactggctagagtcctc

SEQ ID NO: 4054155 - DNA, 17 bp, Homo sapiens
gactgggagccacttct

SEQ ID NO: 4054156 - DNA, 14 bp, Homo sapiens
gactgggaggaggg

SEQ ID NO: 4054157 - DNA, 15 bp, Homo sapiens
gactgggagtcagag

SEQ ID NO: 4054158 - DNA, 16 bp, Homo sapiens
gactgggagtcagagc

SEQ ID NO: 4054159 - DNA, 23 bp, Homo sapiens
gactgggagtcagagccctggct

SEQ ID NO: 4054160 - DNA, 20 bp, Homo sapiens
gactgggatgggaacactgg

SEQ ID NO: 4054161 - DNA, 16 bp, Homo sapiens
gactgggccaggggag

SEQ ID NO: 4054162 - DNA, 22 bp, Homo sapiens
gactgggcctcccttgggctgg

SEQ ID NO: 4054163 - DNA, 18 bp, Homo sapiens
gactgggggactgggagt

SEQ ID NO: 4054164 - DNA, 18 bp, Homo sapiens
gactggggggccatttcc

SEQ ID NO: 4054165 - DNA, 22 bp, Homo sapiens
gactggggtaagcggaataaac

SEQ ID NO: 4054166 - DNA, 21 bp, Homo sapiens
gactgggtaggaaagaggaag

SEQ ID NO: 4054167 - DNA, 17 bp, Homo sapiens
gactggtttacaggccc

SEQ ID NO: 4054168 - DNA, 16 bp, Homo sapiens
gactgtaccacagaca

SEQ ID NO: 4054169 - DNA, 17 bp, Homo sapiens
gactgtactcctcccag

SEQ ID NO: 4054170 - DNA, 22 bp, Homo sapiens
gactgtagattgcttctgtagt

SEQ ID NO: 4054171 - DNA, 21 bp, Homo sapiens
gactgtagccacagctgctgt

SEQ ID NO: 4054172 - DNA, 22 bp, Homo sapiens
gactgtcacggggttccctcct

SEQ ID NO: 4054173 - DNA, 19 bp, Homo sapiens
gactgtcccaccgggagcc

SEQ ID NO: 4054174 - DNA, 19 bp, Homo sapiens
gactgtctcacttaatcct

SEQ ID NO: 4054175 - DNA, 13 bp, Homo sapiens
gactgtgatgcca

SEQ ID NO: 4054176 - DNA, 14 bp, Homo sapiens
gactgttccaaagc

SEQ ID NO: 4054177 - DNA, 13 bp, Homo sapiens
gacttaaagcaga

SEQ ID NO: 4054178 - DNA, 19 bp, Homo sapiens
gacttaaaggacaggagga

SEQ ID NO: 4054179 - DNA, 16 bp, Homo sapiens
gacttaactccttcca

SEQ ID NO: 4054180 - DNA, 20 bp, Homo sapiens
gacttaagcaaaagaaaaag

SEQ ID NO: 4054181 - DNA, 13 bp, Homo sapiens
gacttactgggtg

SEQ ID NO: 4054182 - DNA, 17 bp, Homo sapiens
gacttatttctgctctg

SEQ ID NO: 4054183 - DNA, 18 bp, Homo sapiens
gacttatttctgctctgg

SEQ ID NO: 4054184 - DNA, 18 bp, Homo sapiens
gacttatttcttcaaatc

SEQ ID NO: 4054185 - DNA, 16 bp, Homo sapiens
gacttcagctgcctga

SEQ ID NO: 4054186 - DNA, 17 bp, Homo sapiens
gacttcagctgcctgaa

SEQ ID NO: 4054187 - DNA, 14 bp, Homo sapiens
gacttcagggcagg

SEQ ID NO: 4054188 - DNA, 24 bp, Homo sapiens
gacttcatctcccacctagcagca

SEQ ID NO: 4054189 - DNA, 22 bp, Homo sapiens
gacttcctgattggtttctctt

SEQ ID NO: 4054190 - DNA, 13 bp, Homo sapiens
gacttctgtgggc

SEQ ID NO: 4054191 - DNA, 23 bp, Homo sapiens
gacttctgtgggcccctcaacag

SEQ ID NO: 4054192 - DNA, 14 bp, Homo sapiens
gacttgaaagcatc

SEQ ID NO: 4054193 - DNA, 21 bp, Homo sapiens
gacttgaaagcatccatgtgt

SEQ ID NO: 4054194 - DNA, 23 bp, Homo sapiens
gacttgccgtcccctaaggaaat

SEQ ID NO: 4054195 - DNA, 11 bp, Homo sapiens
gacttgcttta

SEQ ID NO: 4054196 - DNA, 21 bp, Homo sapiens
gacttggagagaatcatgctg

SEQ ID NO: 4054197 - DNA, 20 bp, Homo sapiens
gacttgggtctcatttagaa

SEQ ID NO: 4054198 - DNA, 15 bp, Homo sapiens
gacttggttggtagg

SEQ ID NO: 4054199 - DNA, 17 bp, Homo sapiens
gacttggttggtagggt

SEQ ID NO: 4054200 - DNA, 19 bp, Homo sapiens
gacttgtatatttgtacaa

SEQ ID NO: 4054201 - DNA, 18 bp, Homo sapiens
gacttgtgcacaggcaga

SEQ ID NO: 4054202 - DNA, 18 bp, Homo sapiens
gacttgtttgtcttccat

SEQ ID NO: 4054203 - DNA, 22 bp, Homo sapiens
gacttgtttgtcttccattcca

SEQ ID NO: 4054204 - DNA, 15 bp, Homo sapiens
gactttaaaagaaaa

SEQ ID NO: 4054205 - DNA, 13 bp, Homo sapiens
gactttagaaata

SEQ ID NO: 4054206 - DNA, 16 bp, Homo sapiens
gactttagcttttcct

SEQ ID NO: 4054207 - DNA, 17 bp, Homo sapiens
gactttagcttttcctt

SEQ ID NO: 4054208 - DNA, 17 bp, Homo sapiens
gactttatctcctgctc

SEQ ID NO: 4054209 - DNA, 13 bp, Homo sapiens
gactttatttatt

SEQ ID NO: 4054210 - DNA, 14 bp, Homo sapiens
gactttatttattt

SEQ ID NO: 4054211 - DNA, 19 bp, Homo sapiens
gactttattttctggtaga

SEQ ID NO: 4054212 - DNA, 21 bp, Homo sapiens
gactttcaaaattaaatctgt

SEQ ID NO: 4054213 - DNA, 11 bp, Homo sapiens
gactttcctgc

SEQ ID NO: 4054214 - DNA, 12 bp, Homo sapiens
gactttctgctg

SEQ ID NO: 4054215 - DNA, 18 bp, Homo sapiens
gactttggttctctccag

SEQ ID NO: 4054216 - DNA, 20 bp, Homo sapiens
gactttgtctctcctggctg

SEQ ID NO: 4054217 - DNA, 23 bp, Homo sapiens
gactttgtctctcctggctgggc

SEQ ID NO: 4054218 - DNA, 21 bp, Homo sapiens
gacttttaaatggcagtattt

SEQ ID NO: 4054219 - DNA, 18 bp, Homo sapiens
gacttttaatcagtgaag

SEQ ID NO: 4054220 - DNA, 21 bp, Homo sapiens
gacttttaatgtcatttgtta

SEQ ID NO: 4054221 - DNA, 17 bp, Homo sapiens
gacttttcgttaacatt

SEQ ID NO: 4054222 - DNA, 19 bp, Homo sapiens
gacttttcgttaacattga

SEQ ID NO: 4054223 - DNA, 18 bp, Homo sapiens
gacttttggtagagaagg

SEQ ID NO: 4054224 - DNA, 13 bp, Homo sapiens
gaggaccactcct

SEQ ID NO: 4054225 - DNA, 13 bp, Homo sapiens
gaggacctgcccg

SEQ ID NO: 4054226 - DNA, 19 bp, Homo sapiens
gaggaccttatctgtgcgt

SEQ ID NO: 4054227 - DNA, 17 bp, Homo sapiens
gaggacggtgcaaccca

SEQ ID NO: 4054228 - DNA, 20 bp, Homo sapiens
gaggacggtgcaacccaagg

SEQ ID NO: 4054229 - DNA, 20 bp, Homo sapiens
gaggactcccaaccctggct

SEQ ID NO: 4054230 - DNA, 14 bp, Homo sapiens
gaggagaccagctc

SEQ ID NO: 4054231 - DNA, 23 bp, Homo sapiens
gaggagacggaggggagtagaga

SEQ ID NO: 4054232 - DNA, 19 bp, Homo sapiens
gaggagatggaaacaatgt

SEQ ID NO: 4054233 - DNA, 18 bp, Homo sapiens
gaggagcagcagcttggg

SEQ ID NO: 4054234 - DNA, 15 bp, Homo sapiens
gaggagccccagcta

SEQ ID NO: 4054235 - DNA, 13 bp, Homo sapiens
gaggagctgcctg

SEQ ID NO: 4054236 - DNA, 18 bp, Homo sapiens
gaggaggaaaaggaaaaa

SEQ ID NO: 4054237 - DNA, 13 bp, Homo sapiens
gaggaggaaggca

SEQ ID NO: 4054238 - DNA, 16 bp, Homo sapiens
gaggaggagatggcca

SEQ ID NO: 4054239 - DNA, 19 bp, Homo sapiens
gaggaggatgtccctgggc

SEQ ID NO: 4054240 - DNA, 13 bp, Homo sapiens
gaggaggcctcca

SEQ ID NO: 4054241 - DNA, 17 bp, Homo sapiens
gaggagggagagggagg

SEQ ID NO: 4054242 - DNA, 14 bp, Homo sapiens
gaggagggatgctg

SEQ ID NO: 4054243 - DNA, 18 bp, Homo sapiens
gaggagggatgctgctcc

SEQ ID NO: 4054244 - DNA, 19 bp, Homo sapiens
gaggagggatgctgctccg

SEQ ID NO: 4054245 - DNA, 22 bp, Homo sapiens
gaggagggatgctgctccgccc

SEQ ID NO: 4054246 - DNA, 13 bp, Homo sapiens
gaggaggggaggg

SEQ ID NO: 4054247 - DNA, 17 bp, Homo sapiens
gaggaggtcgaatgggt

SEQ ID NO: 4054248 - DNA, 21 bp, Homo sapiens
gaggaggtgtgaggaggaggc

SEQ ID NO: 4054249 - DNA, 18 bp, Homo sapiens
gaggaggttcactgagct

SEQ ID NO: 4054250 - DNA, 14 bp, Homo sapiens
gaggagtgcagcct

SEQ ID NO: 4054251 - DNA, 16 bp, Homo sapiens
gaggagtgcagccttc

SEQ ID NO: 4054252 - DNA, 21 bp, Homo sapiens
gaggagtgcagccttctccat

SEQ ID NO: 4054253 - DNA, 16 bp, Homo sapiens
gaggagtttcgaggta

SEQ ID NO: 4054254 - DNA, 17 bp, Homo sapiens
gaggatgagagcccaga

SEQ ID NO: 4054255 - DNA, 20 bp, Homo sapiens
gaggatgagagcccagaggt

SEQ ID NO: 4054256 - DNA, 14 bp, Homo sapiens
gaggatggcccagg

SEQ ID NO: 4054257 - DNA, 18 bp, Homo sapiens
gaggatgtccctgggcca

SEQ ID NO: 4054258 - DNA, 19 bp, Homo sapiens
gaggatgtggaaagcactt

SEQ ID NO: 4054259 - DNA, 16 bp, Homo sapiens
gaggattcaggggctg

SEQ ID NO: 4054260 - DNA, 18 bp, Homo sapiens
gaggattgcttgagccca

SEQ ID NO: 4054261 - DNA, 22 bp, Homo sapiens
gaggattgcttgagcccaggag

SEQ ID NO: 4054262 - DNA, 17 bp, Homo sapiens
gaggatttttttctgag

SEQ ID NO: 4054263 - DNA, 15 bp, Homo sapiens
gaggcaagaaaagga

SEQ ID NO: 4054264 - DNA, 14 bp, Homo sapiens
gaggcaagagactg

SEQ ID NO: 4054265 - DNA, 21 bp, Homo sapiens
gaggcaatgtcaggaacagaa

SEQ ID NO: 4054266 - DNA, 21 bp, Homo sapiens
gaggcactcagtgagcctcct

SEQ ID NO: 4054267 - DNA, 17 bp, Homo sapiens
gaggcagccacttcggc

SEQ ID NO: 4054268 - DNA, 14 bp, Homo sapiens
gaggcaggctccag

SEQ ID NO: 4054269 - DNA, 13 bp, Homo sapiens
gaggcaggctggg

SEQ ID NO: 4054270 - DNA, 15 bp, Homo sapiens
gaggcagttgcccag

SEQ ID NO: 4054271 - DNA, 20 bp, Homo sapiens
gaggcagttgcccagcctct

SEQ ID NO: 4054272 - DNA, 18 bp, Homo sapiens
gaggcatacacacagcag

SEQ ID NO: 4054273 - DNA, 19 bp, Homo sapiens
gaggcatacacacagcagt

SEQ ID NO: 4054274 - DNA, 17 bp, Homo sapiens
gaggcatggccctgggg

SEQ ID NO: 4054275 - DNA, 18 bp, Homo sapiens
gaggccaaactgtccctc

SEQ ID NO: 4054276 - DNA, 17 bp, Homo sapiens
gaggccaaaggctggtg

SEQ ID NO: 4054277 - DNA, 12 bp, Homo sapiens
gaggccaaggtg

SEQ ID NO: 4054278 - DNA, 20 bp, Homo sapiens
gaggccacacgcactggtgc

SEQ ID NO: 4054279 - DNA, 18 bp, Homo sapiens
gaggccacactcagcaca

SEQ ID NO: 4054280 - DNA, 22 bp, Homo sapiens
gaggccaccgggacagacctgg

SEQ ID NO: 4054281 - DNA, 18 bp, Homo sapiens
gaggcccagcgggcagat

SEQ ID NO: 4054282 - DNA, 19 bp, Homo sapiens
gaggcccagcgggcagatg

SEQ ID NO: 4054283 - DNA, 20 bp, Homo sapiens
gaggcccagcgggcagatgg

SEQ ID NO: 4054284 - DNA, 15 bp, Homo sapiens
gaggcccaggctggg

SEQ ID NO: 4054285 - DNA, 23 bp, Homo sapiens
gaggcccaggctgggaactcatc

SEQ ID NO: 4054286 - DNA, 18 bp, Homo sapiens
gaggcccagttcaccctg

SEQ ID NO: 4054287 - DNA, 12 bp, Homo sapiens
gaggccccagcc

SEQ ID NO: 4054288 - DNA, 19 bp, Homo sapiens
gaggccccagcctccctga

SEQ ID NO: 4054289 - DNA, 23 bp, Homo sapiens
gaggccctcaatccaccttcagg

SEQ ID NO: 4054290 - DNA, 14 bp, Homo sapiens
gaggccctcctgtg

SEQ ID NO: 4054291 - DNA, 19 bp, Homo sapiens
gaggccctcctgtgctggg

SEQ ID NO: 4054292 - DNA, 20 bp, Homo sapiens
gaggccgaaggtgcctcaga

SEQ ID NO: 4054293 - DNA, 15 bp, Homo sapiens
gaggccgaatgggca

SEQ ID NO: 4054294 - DNA, 14 bp, Homo sapiens
gaggccgaggcggg

SEQ ID NO: 4054295 - DNA, 12 bp, Homo sapiens
gaggcctcaggt

SEQ ID NO: 4054296 - DNA, 22 bp, Homo sapiens
gaggcctcaggtgctgtccatg

SEQ ID NO: 4054297 - DNA, 13 bp, Homo sapiens
gaggcctgaagcc

SEQ ID NO: 4054298 - DNA, 13 bp, Homo sapiens
gaggcctgcccgg

SEQ ID NO: 4054299 - DNA, 20 bp, Homo sapiens
gaggcctgccctcagggatc

SEQ ID NO: 4054300 - DNA, 19 bp, Homo sapiens
gaggcctggactttcctgc

SEQ ID NO: 4054301 - DNA, 20 bp, Homo sapiens
gaggccttccagctgctgtc

SEQ ID NO: 4054302 - DNA, 19 bp, Homo sapiens
gaggcggagagtacagtga

SEQ ID NO: 4054303 - DNA, 21 bp, Homo sapiens
gaggcggcccggccagcgggc

SEQ ID NO: 4054304 - DNA, 20 bp, Homo sapiens
gaggcgggagaatcatgtga

SEQ ID NO: 4054305 - DNA, 10 bp, Homo sapiens
gaggctcagg

SEQ ID NO: 4054306 - DNA, 22 bp, Homo sapiens
gaggctctggacagcagaagcc

SEQ ID NO: 4054307 - DNA, 14 bp, Homo sapiens
gaggctgagacagg

SEQ ID NO: 4054308 - DNA, 13 bp, Homo sapiens
gaggctgaggcag

SEQ ID NO: 4054309 - DNA, 16 bp, Homo sapiens
gaggctgaggcaggag

SEQ ID NO: 4054310 - DNA, 18 bp, Homo sapiens
gaggctgaggcctggact

SEQ ID NO: 4054311 - DNA, 19 bp, Homo sapiens
gaggctgaggcctggactt

SEQ ID NO: 4054312 - DNA, 16 bp, Homo sapiens
gaggctgaggctggca

SEQ ID NO: 4054313 - DNA, 20 bp, Homo sapiens
gaggctgaggctggcacagg

SEQ ID NO: 4054314 - DNA, 19 bp, Homo sapiens
gaggctgcacccctgggcc

SEQ ID NO: 4054315 - DNA, 17 bp, Homo sapiens
gaggctgcccccggccc

SEQ ID NO: 4054316 - DNA, 20 bp, Homo sapiens
gaggctgcccccggccccct

SEQ ID NO: 4054317 - DNA, 18 bp, Homo sapiens
gaggctgcccctctcacc

SEQ ID NO: 4054318 - DNA, 14 bp, Homo sapiens
gaggctgcctctcc

SEQ ID NO: 4054319 - DNA, 13 bp, Homo sapiens
gaggctggcacag

SEQ ID NO: 4054320 - DNA, 13 bp, Homo sapiens
gaggctggcaggt

SEQ ID NO: 4054321 - DNA, 15 bp, Homo sapiens
gaggctgggagtccc

SEQ ID NO: 4054322 - DNA, 14 bp, Homo sapiens
gaggctgggcacag

SEQ ID NO: 4054323 - DNA, 15 bp, Homo sapiens
gaggctgggcacaga

SEQ ID NO: 4054324 - DNA, 15 bp, Homo sapiens
gaggctgggcccctg

SEQ ID NO: 4054325 - DNA, 17 bp, Homo sapiens
gaggctgggcccctggg

SEQ ID NO: 4054326 - DNA, 17 bp, Homo sapiens
gaggctgggggagagcc

SEQ ID NO: 4054327 - DNA, 16 bp, Homo sapiens
gatattgttttctgta

SEQ ID NO: 4054328 - DNA, 17 bp, Homo sapiens
gatattgttttctgtaa

SEQ ID NO: 4054329 - DNA, 13 bp, Homo sapiens
gatatttcttgct

SEQ ID NO: 4054330 - DNA, 22 bp, Homo sapiens
gatatttgtcatgctgggattt

SEQ ID NO: 4054331 - DNA, 19 bp, Homo sapiens
gatattttcaacgcagccc

SEQ ID NO: 4054332 - DNA, 22 bp, Homo sapiens
gatattttcaacgcagccctgc

SEQ ID NO: 4054333 - DNA, 22 bp, Homo sapiens
gatatttttaaagatctgtaag

SEQ ID NO: 4054334 - DNA, 21 bp, Homo sapiens
gatattttttcagaaatatgt

SEQ ID NO: 4054335 - DNA, 20 bp, Homo sapiens
gatcaaaaggttaataaagt

SEQ ID NO: 4054336 - DNA, 20 bp, Homo sapiens
gatcaaaataaaaagtgaca

SEQ ID NO: 4054337 - DNA, 19 bp, Homo sapiens
gatcaattccctctctcag

SEQ ID NO: 4054338 - DNA, 23 bp, Homo sapiens
gatcaattccctctctcagcaca

SEQ ID NO: 4054339 - DNA, 12 bp, Homo sapiens
gatcacaagatg

SEQ ID NO: 4054340 - DNA, 14 bp, Homo sapiens
gatcacaagatgga

SEQ ID NO: 4054341 - DNA, 11 bp, Homo sapiens
gatcacagcct

SEQ ID NO: 4054342 - DNA, 20 bp, Homo sapiens
gatcacagcctccagggccc

SEQ ID NO: 4054343 - DNA, 13 bp, Homo sapiens
gatcacagctgct

SEQ ID NO: 4054344 - DNA, 20 bp, Homo sapiens
gatcacagctgctttctgtt

SEQ ID NO: 4054345 - DNA, 18 bp, Homo sapiens
gatcactagcctgtcatc

SEQ ID NO: 4054346 - DNA, 13 bp, Homo sapiens
gatcactgaattt

SEQ ID NO: 4054347 - DNA, 16 bp, Homo sapiens
gatcactgaatttata

SEQ ID NO: 4054348 - DNA, 19 bp, Homo sapiens
gatcactggctggcctgag

SEQ ID NO: 4054349 - DNA, 15 bp, Homo sapiens
gatcagaggtgtaca

SEQ ID NO: 4054350 - DNA, 18 bp, Homo sapiens
gatcagaggtgtacacta

SEQ ID NO: 4054351 - DNA, 15 bp, Homo sapiens
gatcagccagaagcc

SEQ ID NO: 4054352 - DNA, 16 bp, Homo sapiens
gatcagctgtttgtca

SEQ ID NO: 4054353 - DNA, 18 bp, Homo sapiens
gatcagctgtttgtcata

SEQ ID NO: 4054354 - DNA, 20 bp, Homo sapiens
gatcagggaatccagctccc

SEQ ID NO: 4054355 - DNA, 11 bp, Homo sapiens
gatcagtgttg

SEQ ID NO: 4054356 - DNA, 14 bp, Homo sapiens
gatcagttaactat

SEQ ID NO: 4054357 - DNA, 15 bp, Homo sapiens
gatcataaactgact

SEQ ID NO: 4054358 - DNA, 21 bp, Homo sapiens
gatcatagctcactgcagcct

SEQ ID NO: 4054359 - DNA, 16 bp, Homo sapiens
gatcatcgccagaggt

SEQ ID NO: 4054360 - DNA, 21 bp, Homo sapiens
gatcatcgccagaggtgcttc

SEQ ID NO: 4054361 - DNA, 23 bp, Homo sapiens
gatcatcgccagaggtgcttcac

SEQ ID NO: 4054362 - DNA, 12 bp, Homo sapiens
gatcatgcattg

SEQ ID NO: 4054363 - DNA, 15 bp, Homo sapiens
gatcatggtgtaata

SEQ ID NO: 4054364 - DNA, 21 bp, Homo sapiens
gatcatttgcccttaaggaca

SEQ ID NO: 4054365 - DNA, 23 bp, Homo sapiens
gatcattttcttatcttctgcaa

SEQ ID NO: 4054366 - DNA, 20 bp, Homo sapiens
gatccaaaagaagcccccag

SEQ ID NO: 4054367 - DNA, 13 bp, Homo sapiens
gatccagaagagc

SEQ ID NO: 4054368 - DNA, 15 bp, Homo sapiens
gatccatccatctcc

SEQ ID NO: 4054369 - DNA, 18 bp, Homo sapiens
gatccatttgcctttctg

SEQ ID NO: 4054370 - DNA, 23 bp, Homo sapiens
gatcccaggggcccaaggcggcc

SEQ ID NO: 4054371 - DNA, 18 bp, Homo sapiens
gatcccatccatcagctc

SEQ ID NO: 4054372 - DNA, 20 bp, Homo sapiens
gatcccatccatcagctccc

SEQ ID NO: 4054373 - DNA, 17 bp, Homo sapiens
gatccccagggcagcct

SEQ ID NO: 4054374 - DNA, 13 bp, Homo sapiens
gatcccctgagcc

SEQ ID NO: 4054375 - DNA, 19 bp, Homo sapiens
gatccctcccccccatgca

SEQ ID NO: 4054376 - DNA, 14 bp, Homo sapiens
gatccctgtgttgt

SEQ ID NO: 4054377 - DNA, 18 bp, Homo sapiens
gatccctgtgttgtctct

SEQ ID NO: 4054378 - DNA, 20 bp, Homo sapiens
gatccctgtgttgtctctag

SEQ ID NO: 4054379 - DNA, 23 bp, Homo sapiens
gatcccttccacctgctctgctg

SEQ ID NO: 4054380 - DNA, 16 bp, Homo sapiens
gatcctccctcatggc

SEQ ID NO: 4054381 - DNA, 20 bp, Homo sapiens
gatcctctattttgtgatga

SEQ ID NO: 4054382 - DNA, 12 bp, Homo sapiens
gatcctggaggc

SEQ ID NO: 4054383 - DNA, 16 bp, Homo sapiens
gatcctggaggcccag

SEQ ID NO: 4054384 - DNA, 17 bp, Homo sapiens
gatcgagaccatcctgg

SEQ ID NO: 4054385 - DNA, 23 bp, Homo sapiens
gatcgcatcattgcactctagcc

SEQ ID NO: 4054386 - DNA, 16 bp, Homo sapiens
gatcggactctgcccc

SEQ ID NO: 4054387 - DNA, 17 bp, Homo sapiens
gatcggactctgcccct

SEQ ID NO: 4054388 - DNA, 22 bp, Homo sapiens
gatcgtgctactgcactccagc

SEQ ID NO: 4054389 - DNA, 18 bp, Homo sapiens
gatctaagcctttccata

SEQ ID NO: 4054390 - DNA, 20 bp, Homo sapiens
gatctacttcatagctcctt

SEQ ID NO: 4054391 - DNA, 13 bp, Homo sapiens
gatctataaagcg

SEQ ID NO: 4054392 - DNA, 21 bp, Homo sapiens
gatctatccctgcggcctcca

SEQ ID NO: 4054393 - DNA, 13 bp, Homo sapiens
gatctatttcatg

SEQ ID NO: 4054394 - DNA, 15 bp, Homo sapiens
gatctcattcagtat

SEQ ID NO: 4054395 - DNA, 20 bp, Homo sapiens
gatctcattcagtattaaag

SEQ ID NO: 4054396 - DNA, 21 bp, Homo sapiens
gatctcattcagtattaaagg

SEQ ID NO: 4054397 - DNA, 11 bp, Homo sapiens
gatctccagcg

SEQ ID NO: 4054398 - DNA, 21 bp, Homo sapiens
gatctcccactgcggggagac

SEQ ID NO: 4054399 - DNA, 21 bp, Homo sapiens
gatctctactaccacaaggaa

SEQ ID NO: 4054400 - DNA, 18 bp, Homo sapiens
gatctctcttgtcctctt

SEQ ID NO: 4054401 - DNA, 22 bp, Homo sapiens
gatctctcttgtcctcttctgc

SEQ ID NO: 4054402 - DNA, 16 bp, Homo sapiens
gatctgaattaaataa

SEQ ID NO: 4054403 - DNA, 12 bp, Homo sapiens
gatctggaaccc

SEQ ID NO: 4054404 - DNA, 16 bp, Homo sapiens
gatctggaacctcagc

SEQ ID NO: 4054405 - DNA, 17 bp, Homo sapiens
gatctggaacctcagcc

SEQ ID NO: 4054406 - DNA, 18 bp, Homo sapiens
gatctggggctctgggat

SEQ ID NO: 4054407 - DNA, 16 bp, Homo sapiens
gatctgtcacaccagc

SEQ ID NO: 4054408 - DNA, 18 bp, Homo sapiens
gatctgtcacaccagcca

SEQ ID NO: 4054409 - DNA, 20 bp, Homo sapiens
gatctgtcacaccagccata

SEQ ID NO: 4054410 - DNA, 13 bp, Homo sapiens
gatctgttttgaa

SEQ ID NO: 4054411 - DNA, 21 bp, Homo sapiens
gatcttcccataataaagcaa

SEQ ID NO: 4054412 - DNA, 22 bp, Homo sapiens
gatcttcttcatccaacttcca

SEQ ID NO: 4054413 - DNA, 14 bp, Homo sapiens
gatcttgaatgtgg

SEQ ID NO: 4054414 - DNA, 17 bp, Homo sapiens
gatcttgcattcatttt

SEQ ID NO: 4054415 - DNA, 16 bp, Homo sapiens
gatcttgccacatttc

SEQ ID NO: 4054416 - DNA, 14 bp, Homo sapiens
gatcttgtgctcag

SEQ ID NO: 4054417 - DNA, 15 bp, Homo sapiens
gatctttcaggaaag

SEQ ID NO: 4054418 - DNA, 17 bp, Homo sapiens
gatcttttaaagtgtta

SEQ ID NO: 4054419 - DNA, 20 bp, Homo sapiens
gatcttttaaagtgttactt

SEQ ID NO: 4054420 - DNA, 18 bp, Homo sapiens
gatcttttcgaagctgtt

SEQ ID NO: 4054421 - DNA, 13 bp, Homo sapiens
gatgaaaagattt

SEQ ID NO: 4054422 - DNA, 16 bp, Homo sapiens
gatgaaagttccccca

SEQ ID NO: 4054423 - DNA, 18 bp, Homo sapiens
gatgaaataactccttct

SEQ ID NO: 4054424 - DNA, 20 bp, Homo sapiens
gatgaaatctgctagaaagt

SEQ ID NO: 4054425 - DNA, 22 bp, Homo sapiens
gatgaacccaggacgcttctga

SEQ ID NO: 4054426 - DNA, 23 bp, Homo sapiens
gatgaacccaggacgcttctgaa

SEQ ID NO: 4054427 - DNA, 18 bp, Homo sapiens
gatgaactctgaactttg

SEQ ID NO: 4054428 - DNA, 20 bp, Homo sapiens
gatgaagcaaggaagatata

SEQ ID NO: 4054429 - DNA, 14 bp, Homo sapiens
gatgtgaagccaat

SEQ ID NO: 4054430 - DNA, 23 bp, Homo sapiens
gatgtgaagccaattcagacagg

SEQ ID NO: 4054431 - DNA, 20 bp, Homo sapiens
gatgtgaattattgacactg

SEQ ID NO: 4054432 - DNA, 21 bp, Homo sapiens
gatgtgaattgcctgcagaga

SEQ ID NO: 4054433 - DNA, 13 bp, Homo sapiens
gatgtgacttttt

SEQ ID NO: 4054434 - DNA, 18 bp, Homo sapiens
gatgtgattgtggaatgg

SEQ ID NO: 4054435 - DNA, 19 bp, Homo sapiens
gatgtgcaagcgacgacag

SEQ ID NO: 4054436 - DNA, 17 bp, Homo sapiens
gatgtgccaataaccaa

SEQ ID NO: 4054437 - DNA, 21 bp, Homo sapiens
gatgtgcggagcgggaggcgg

SEQ ID NO: 4054438 - DNA, 24 bp, Homo sapiens
gatgtggagctactgatgaaatct

SEQ ID NO: 4054439 - DNA, 23 bp, Homo sapiens
gatgtgggagggagcagacagga

SEQ ID NO: 4054440 - DNA, 15 bp, Homo sapiens
gatgtggtgcctgag

SEQ ID NO: 4054441 - DNA, 20 bp, Homo sapiens
gatgttacatcacagtgttt

SEQ ID NO: 4054442 - DNA, 17 bp, Homo sapiens
gatgttcagcactgtcc

SEQ ID NO: 4054443 - DNA, 19 bp, Homo sapiens
gatgttcagcactgtccct

SEQ ID NO: 4054444 - DNA, 20 bp, Homo sapiens
gatgttcagcactgtccctt

SEQ ID NO: 4054445 - DNA, 22 bp, Homo sapiens
gatgttttggtagattaaatat

SEQ ID NO: 4054446 - DNA, 20 bp, Homo sapiens
gatgttttgtcccatttcct

SEQ ID NO: 4054447 - DNA, 15 bp, Homo sapiens
gatgtttttcttacc

SEQ ID NO: 4054448 - DNA, 13 bp, Homo sapiens
gattaaacacctg

SEQ ID NO: 4054449 - DNA, 19 bp, Homo sapiens
gattaaacacctgacacat

SEQ ID NO: 4054450 - DNA, 19 bp, Homo sapiens
gattaaatatagattagaa

SEQ ID NO: 4054451 - DNA, 23 bp, Homo sapiens
gattaaatatagattagaaaaat

SEQ ID NO: 4054452 - DNA, 14 bp, Homo sapiens
gattaacaaatatg

SEQ ID NO: 4054453 - DNA, 20 bp, Homo sapiens
gattaactgaaataaaaaat

SEQ ID NO: 4054454 - DNA, 13 bp, Homo sapiens
gattaagaaacct

SEQ ID NO: 4054455 - DNA, 18 bp, Homo sapiens
gattaagattttacaaaa

SEQ ID NO: 4054456 - DNA, 14 bp, Homo sapiens
gattacacacgtga

SEQ ID NO: 4054457 - DNA, 23 bp, Homo sapiens
gattactctccatatcccttcct

SEQ ID NO: 4054458 - DNA, 14 bp, Homo sapiens
gattagagggaggt

SEQ ID NO: 4054459 - DNA, 20 bp, Homo sapiens
gattagagggaggtgtttaa

SEQ ID NO: 4054460 - DNA, 22 bp, Homo sapiens
gattagatgtgccaataaccaa

SEQ ID NO: 4054461 - DNA, 23 bp, Homo sapiens
gattagatgtgccaataaccaag

SEQ ID NO: 4054462 - DNA, 14 bp, Homo sapiens
gattagctttgtgt

SEQ ID NO: 4054463 - DNA, 15 bp, Homo sapiens
gattagctttgtgtt

SEQ ID NO: 4054464 - DNA, 15 bp, Homo sapiens
gattatgggtcctgc

SEQ ID NO: 4054465 - DNA, 17 bp, Homo sapiens
gattatgggtcctgcaa

SEQ ID NO: 4054466 - DNA, 16 bp, Homo sapiens
gattatggttttgtga

SEQ ID NO: 4054467 - DNA, 18 bp, Homo sapiens
gattatgtcttttatatt

SEQ ID NO: 4054468 - DNA, 20 bp, Homo sapiens
gattatgtcttttatatttg

SEQ ID NO: 4054469 - DNA, 14 bp, Homo sapiens
gattattatctaaa

SEQ ID NO: 4054470 - DNA, 13 bp, Homo sapiens
gattattcattta

SEQ ID NO: 4054471 - DNA, 14 bp, Homo sapiens
gattattcatttaa

SEQ ID NO: 4054472 - DNA, 15 bp, Homo sapiens
gattattcatttaaa

SEQ ID NO: 4054473 - DNA, 19 bp, Homo sapiens
gattattcatttaaaatga

SEQ ID NO: 4054474 - DNA, 23 bp, Homo sapiens
gattattggctgctttgcctcta

SEQ ID NO: 4054475 - DNA, 18 bp, Homo sapiens
gattatttaataacatta

SEQ ID NO: 4054476 - DNA, 21 bp, Homo sapiens
gattatttaataacattacct

SEQ ID NO: 4054477 - DNA, 22 bp, Homo sapiens
gattatttaataacattacctt

SEQ ID NO: 4054478 - DNA, 18 bp, Homo sapiens
gattatttgggagggaaa

SEQ ID NO: 4054479 - DNA, 14 bp, Homo sapiens
gattcacatctgca

SEQ ID NO: 4054480 - DNA, 18 bp, Homo sapiens
gattcagattgttatcta

SEQ ID NO: 4054481 - DNA, 13 bp, Homo sapiens
gattcaggaatgt

SEQ ID NO: 4054482 - DNA, 16 bp, Homo sapiens
gattcaggccagccca

SEQ ID NO: 4054483 - DNA, 18 bp, Homo sapiens
gattcaggccagcccagc

SEQ ID NO: 4054484 - DNA, 15 bp, Homo sapiens
gattcagttttcatt

SEQ ID NO: 4054485 - DNA, 17 bp, Homo sapiens
gattcatatttacttct

SEQ ID NO: 4054486 - DNA, 19 bp, Homo sapiens
gattcatatttacttctta

SEQ ID NO: 4054487 - DNA, 17 bp, Homo sapiens
gattccactacacctgg

SEQ ID NO: 4054488 - DNA, 21 bp, Homo sapiens
gattcccctaacctcattccc

SEQ ID NO: 4054489 - DNA, 20 bp, Homo sapiens
gattcctggtttgactcagt

SEQ ID NO: 4054490 - DNA, 15 bp, Homo sapiens
gattccttctctgaa

SEQ ID NO: 4054491 - DNA, 23 bp, Homo sapiens
gattctaccacacagcagcagtt

SEQ ID NO: 4054492 - DNA, 18 bp, Homo sapiens
gattctactttaagcact

SEQ ID NO: 4054493 - DNA, 13 bp, Homo sapiens
gattctaggacct

SEQ ID NO: 4054494 - DNA, 15 bp, Homo sapiens
gattctatttatatg

SEQ ID NO: 4054495 - DNA, 16 bp, Homo sapiens
gattctcctgtgctag

SEQ ID NO: 4054496 - DNA, 22 bp, Homo sapiens
gattctctccattttggtgtct

SEQ ID NO: 4054497 - DNA, 20 bp, Homo sapiens
gattctcttagctactgtat

SEQ ID NO: 4054498 - DNA, 16 bp, Homo sapiens
gattctgagcagtgcc

SEQ ID NO: 4054499 - DNA, 18 bp, Homo sapiens
gattctgagcagtgcctc

SEQ ID NO: 4054500 - DNA, 15 bp, Homo sapiens
gattctgcagtaaat

SEQ ID NO: 4054501 - DNA, 21 bp, Homo sapiens
gattctgcagtaaatctttta

SEQ ID NO: 4054502 - DNA, 14 bp, Homo sapiens
gattctgcctctct

SEQ ID NO: 4054503 - DNA, 17 bp, Homo sapiens
gattctgcctctctgga

SEQ ID NO: 4054504 - DNA, 22 bp, Homo sapiens
gattctgggaggcaagaaaagg

SEQ ID NO: 4054505 - DNA, 22 bp, Homo sapiens
gattctgtgtgttttcataata

SEQ ID NO: 4054506 - DNA, 22 bp, Homo sapiens
gattctgtttattcttccagaa

SEQ ID NO: 4054507 - DNA, 23 bp, Homo sapiens
gattctgtttattcttccagaat

SEQ ID NO: 4054508 - DNA, 21 bp, Homo sapiens
gattcttgttttgcttcccct

SEQ ID NO: 4054509 - DNA, 15 bp, Homo sapiens
gattgaattccatta

SEQ ID NO: 4054510 - DNA, 16 bp, Homo sapiens
gattgacacacagcac

SEQ ID NO: 4054511 - DNA, 14 bp, Homo sapiens
gattgagtgagggc

SEQ ID NO: 4054512 - DNA, 14 bp, Homo sapiens
gattgcacagaatt

SEQ ID NO: 4054513 - DNA, 15 bp, Homo sapiens
gattgcacagaattt

SEQ ID NO: 4054514 - DNA, 15 bp, Homo sapiens
gattgcacgtggcct

SEQ ID NO: 4054515 - DNA, 17 bp, Homo sapiens
gattgcacgtggcctct

SEQ ID NO: 4054516 - DNA, 19 bp, Homo sapiens
gattgcacgtggcctcttg

SEQ ID NO: 4054517 - DNA, 20 bp, Homo sapiens
gattgcacgtggcctcttga

SEQ ID NO: 4054518 - DNA, 23 bp, Homo sapiens
gattgcacgtggcctcttgagca

SEQ ID NO: 4054519 - DNA, 14 bp, Homo sapiens
gattgcccctggct

SEQ ID NO: 4054520 - DNA, 20 bp, Homo sapiens
gattgcccctggctttgcct

SEQ ID NO: 4054521 - DNA, 23 bp, Homo sapiens
gattgcccctggctttgcctctt

SEQ ID NO: 4054522 - DNA, 23 bp, Homo sapiens
gattggacggcctgatgctccct

SEQ ID NO: 4054523 - DNA, 14 bp, Homo sapiens
gattggagaatact

SEQ ID NO: 4054524 - DNA, 15 bp, Homo sapiens
gattggattattcat

SEQ ID NO: 4054525 - DNA, 13 bp, Homo sapiens
gattggattattt

SEQ ID NO: 4054526 - DNA, 11 bp, Homo sapiens
gattggcctgt

SEQ ID NO: 4054527 - DNA, 15 bp, Homo sapiens
gattggtttctcttc

SEQ ID NO: 4054528 - DNA, 21 bp, Homo sapiens
gattggtttctcttctcccct

SEQ ID NO: 4054529 - DNA, 20 bp, Homo sapiens
gattgtaggtgcaagatgga

SEQ ID NO: 4054530 - DNA, 12 bp, Homo sapiens
gattgtcttgca

SEQ ID NO: 4054531 - DNA, 20 bp, Homo sapiens
gcactgctaggcgagtgcca

SEQ ID NO: 4054532 - DNA, 21 bp, Homo sapiens
gcactgctaggcgagtgccag

SEQ ID NO: 4054533 - DNA, 23 bp, Homo sapiens
gcactgctaggcgagtgccagga

SEQ ID NO: 4054534 - DNA, 18 bp, Homo sapiens
gcactgctccctacccca

SEQ ID NO: 4054535 - DNA, 20 bp, Homo sapiens
gcactgctccctaccccagg

SEQ ID NO: 4054536 - DNA, 15 bp, Homo sapiens
gcactggagtgcagg

SEQ ID NO: 4054537 - DNA, 16 bp, Homo sapiens
gcactggagtgcaggg

SEQ ID NO: 4054538 - DNA, 15 bp, Homo sapiens
gcactgggaggcagg

SEQ ID NO: 4054539 - DNA, 14 bp, Homo sapiens
gcactgggccacgg

SEQ ID NO: 4054540 - DNA, 17 bp, Homo sapiens
gcactgggccacggagg

SEQ ID NO: 4054541 - DNA, 19 bp, Homo sapiens
gcactggggagcccgtctc

SEQ ID NO: 4054542 - DNA, 23 bp, Homo sapiens
gcactggggagcccgtctcagtg

SEQ ID NO: 4054543 - DNA, 19 bp, Homo sapiens
gcactggtaggttgggaca

SEQ ID NO: 4054544 - DNA, 22 bp, Homo sapiens
gcactggtaggttgggacacca

SEQ ID NO: 4054545 - DNA, 23 bp, Homo sapiens
gcactggtgccaaaaccaggcct

SEQ ID NO: 4054546 - DNA, 19 bp, Homo sapiens
gcactgtctcagtttcact

SEQ ID NO: 4054547 - DNA, 19 bp, Homo sapiens
gcactgtgaagacccagca

SEQ ID NO: 4054548 - DNA, 14 bp, Homo sapiens
gcactgtgaaggac

SEQ ID NO: 4054549 - DNA, 16 bp, Homo sapiens
gcactgtgaaggaccc

SEQ ID NO: 4054550 - DNA, 22 bp, Homo sapiens
gcacttagtaggtcctcaataa

SEQ ID NO: 4054551 - DNA, 18 bp, Homo sapiens
gcacttatttaatgccga

SEQ ID NO: 4054552 - DNA, 21 bp, Homo sapiens
gcacttccttttacctgccca

SEQ ID NO: 4054553 - DNA, 12 bp, Homo sapiens
gcacttgagttt

SEQ ID NO: 4054554 - DNA, 16 bp, Homo sapiens
gcacttgtccagctga

SEQ ID NO: 4054555 - DNA, 21 bp, Homo sapiens
gcacttgtgattatttattat

SEQ ID NO: 4054556 - DNA, 16 bp, Homo sapiens
gcactttaagctcctt

SEQ ID NO: 4054557 - DNA, 19 bp, Homo sapiens
gcactttccacttcttcct

SEQ ID NO: 4054558 - DNA, 20 bp, Homo sapiens
gcactttccacttcttcctt

SEQ ID NO: 4054559 - DNA, 23 bp, Homo sapiens
gcactttccacttcttcctttct

SEQ ID NO: 4054560 - DNA, 20 bp, Homo sapiens
gcactttcctccacctccca

SEQ ID NO: 4054561 - DNA, 17 bp, Homo sapiens
gcactttctaatgtttc

SEQ ID NO: 4054562 - DNA, 16 bp, Homo sapiens
gcactttgggaggcct

SEQ ID NO: 4054563 - DNA, 23 bp, Homo sapiens
gcacttttctaaactaggctcct

SEQ ID NO: 4054564 - DNA, 20 bp, Homo sapiens
gcactttttcgtgtggatct

SEQ ID NO: 4054565 - DNA, 13 bp, Homo sapiens
gcagaaaaagaaa

SEQ ID NO: 4054566 - DNA, 14 bp, Homo sapiens
gcagaaaaagaaaa

SEQ ID NO: 4054567 - DNA, 17 bp, Homo sapiens
gcagaaaattctgtgcc

SEQ ID NO: 4054568 - DNA, 14 bp, Homo sapiens
gcagaaacagccat

SEQ ID NO: 4054569 - DNA, 23 bp, Homo sapiens
gcagaaaggaaaacctgaagact

SEQ ID NO: 4054570 - DNA, 19 bp, Homo sapiens
gcagaaatcctgcaatgaa

SEQ ID NO: 4054571 - DNA, 14 bp, Homo sapiens
gcagaaatctagaa

SEQ ID NO: 4054572 - DNA, 22 bp, Homo sapiens
gcagaagaatgggaatatttta

SEQ ID NO: 4054573 - DNA, 14 bp, Homo sapiens
gcagaagacaccag

SEQ ID NO: 4054574 - DNA, 16 bp, Homo sapiens
gcagaagacaccagag

SEQ ID NO: 4054575 - DNA, 18 bp, Homo sapiens
gcagaagacaccagagca

SEQ ID NO: 4054576 - DNA, 15 bp, Homo sapiens
gcagaagggagaagg

SEQ ID NO: 4054577 - DNA, 22 bp, Homo sapiens
gcagaagggagctggctccagc

SEQ ID NO: 4054578 - DNA, 13 bp, Homo sapiens
gcagaattttaat

SEQ ID NO: 4054579 - DNA, 17 bp, Homo sapiens
gcagaattttaatgtga

SEQ ID NO: 4054580 - DNA, 19 bp, Homo sapiens
gcagaattttaatgtgaag

SEQ ID NO: 4054581 - DNA, 20 bp, Homo sapiens
gcagaattttaatgtgaaga

SEQ ID NO: 4054582 - DNA, 13 bp, Homo sapiens
gcagacacacatg

SEQ ID NO: 4054583 - DNA, 15 bp, Homo sapiens
gcagacacacatggg

SEQ ID NO: 4054584 - DNA, 19 bp, Homo sapiens
gcagacacacatgggcagc

SEQ ID NO: 4054585 - DNA, 22 bp, Homo sapiens
gcagacacacatgggcagccca

SEQ ID NO: 4054586 - DNA, 20 bp, Homo sapiens
gcagacacgccttcccctca

SEQ ID NO: 4054587 - DNA, 15 bp, Homo sapiens
gcagacagaaactgg

SEQ ID NO: 4054588 - DNA, 16 bp, Homo sapiens
gcagacagaaactgga

SEQ ID NO: 4054589 - DNA, 18 bp, Homo sapiens
gcagacagaaactggatt

SEQ ID NO: 4054590 - DNA, 17 bp, Homo sapiens
gcagacagaagtctcct

SEQ ID NO: 4054591 - DNA, 15 bp, Homo sapiens
gcagacagctccacc

SEQ ID NO: 4054592 - DNA, 14 bp, Homo sapiens
gcagacaggaggaa

SEQ ID NO: 4054593 - DNA, 20 bp, Homo sapiens
gcagacaggccatgtgagcc

SEQ ID NO: 4054594 - DNA, 20 bp, Homo sapiens
gcagacagggggccagaaca

SEQ ID NO: 4054595 - DNA, 20 bp, Homo sapiens
gcagacgggaggggaaaggc

SEQ ID NO: 4054596 - DNA, 22 bp, Homo sapiens
gcagacgggaggggaaaggctg

SEQ ID NO: 4054597 - DNA, 14 bp, Homo sapiens
gcagacgggcacag

SEQ ID NO: 4054598 - DNA, 15 bp, Homo sapiens
gcagacgggcacaga

SEQ ID NO: 4054599 - DNA, 16 bp, Homo sapiens
gcagacgggcacagac

SEQ ID NO: 4054600 - DNA, 18 bp, Homo sapiens
gcagactcagtttgtcag

SEQ ID NO: 4054601 - DNA, 20 bp, Homo sapiens
gcagactggggcatcctgtg

SEQ ID NO: 4054602 - DNA, 15 bp, Homo sapiens
gcagacttcccagct

SEQ ID NO: 4054603 - DNA, 17 bp, Homo sapiens
gcagactttctctgtgt

SEQ ID NO: 4054604 - DNA, 18 bp, Homo sapiens
gcagagaaagaagagaca

SEQ ID NO: 4054605 - DNA, 12 bp, Homo sapiens
gcagagagaagc

SEQ ID NO: 4054606 - DNA, 13 bp, Homo sapiens
gcagagagaagcc

SEQ ID NO: 4054607 - DNA, 14 bp, Homo sapiens
gcagagagaagcct

SEQ ID NO: 4054608 - DNA, 16 bp, Homo sapiens
gcagagagaagcctgt

SEQ ID NO: 4054609 - DNA, 10 bp, Homo sapiens
gcagagagag

SEQ ID NO: 4054610 - DNA, 17 bp, Homo sapiens
gcagagagagagaaaga

SEQ ID NO: 4054611 - DNA, 18 bp, Homo sapiens
gcagagagagaggacaga

SEQ ID NO: 4054612 - DNA, 23 bp, Homo sapiens
gcagagagatcttcccataataa

SEQ ID NO: 4054613 - DNA, 18 bp, Homo sapiens
gcagagagggatgggttc

SEQ ID NO: 4054614 - DNA, 18 bp, Homo sapiens
gcagagaggtggagaact

SEQ ID NO: 4054615 - DNA, 22 bp, Homo sapiens
gcagagaggtggagaactggga

SEQ ID NO: 4054616 - DNA, 13 bp, Homo sapiens
gcagagctggagc

SEQ ID NO: 4054617 - DNA, 14 bp, Homo sapiens
gcagagctggagcc

SEQ ID NO: 4054618 - DNA, 19 bp, Homo sapiens
gcagagctggagcccccag

SEQ ID NO: 4054619 - DNA, 18 bp, Homo sapiens
gcagaggaacccccacca

SEQ ID NO: 4054620 - DNA, 20 bp, Homo sapiens
gcagaggaacccccaccaga

SEQ ID NO: 4054621 - DNA, 16 bp, Homo sapiens
gcagaggatgttcata

SEQ ID NO: 4054622 - DNA, 14 bp, Homo sapiens
gcagagggctggag

SEQ ID NO: 4054623 - DNA, 16 bp, Homo sapiens
gcagagggctggaggc

SEQ ID NO: 4054624 - DNA, 19 bp, Homo sapiens
gcagagggctggaggccca

SEQ ID NO: 4054625 - DNA, 20 bp, Homo sapiens
gcagagggctggaggcccag

SEQ ID NO: 4054626 - DNA, 23 bp, Homo sapiens
gcagagggctggaggcccaggct

SEQ ID NO: 4054627 - DNA, 23 bp, Homo sapiens
gcagaggtaaaagtgtgagcagt

SEQ ID NO: 4054628 - DNA, 15 bp, Homo sapiens
gcagaggtggccaga

SEQ ID NO: 4054629 - DNA, 23 bp, Homo sapiens
gcagagtaaattgctctgttccc

SEQ ID NO: 4054630 - DNA, 14 bp, Homo sapiens
gcagagtctgggcc

SEQ ID NO: 4054631 - DNA, 18 bp, Homo sapiens
gcagagtctgggcctctg

SEQ ID NO: 4054632 - DNA, 24 bp, Homo sapiens
gcagatactactgaccagacaagc

SEQ ID NO: 4054633 - DNA, 17 bp, Homo sapiens
gcattatctatgcagca

SEQ ID NO: 4054634 - DNA, 21 bp, Homo sapiens
gcattattctcttttatctgt

SEQ ID NO: 4054635 - DNA, 11 bp, Homo sapiens
gcattcatttt

SEQ ID NO: 4054636 - DNA, 15 bp, Homo sapiens
gcattcatttttata

SEQ ID NO: 4054637 - DNA, 17 bp, Homo sapiens
gcattcatttttatagc

SEQ ID NO: 4054638 - DNA, 11 bp, Homo sapiens
gcattccagaa

SEQ ID NO: 4054639 - DNA, 22 bp, Homo sapiens
gcattccagctgtcactctgtg

SEQ ID NO: 4054640 - DNA, 16 bp, Homo sapiens
gcattcctacaaagat

SEQ ID NO: 4054641 - DNA, 19 bp, Homo sapiens
gcattcctacaaagatgtt

SEQ ID NO: 4054642 - DNA, 13 bp, Homo sapiens
gcattccttcttt

SEQ ID NO: 4054643 - DNA, 14 bp, Homo sapiens
gcattccttctttg

SEQ ID NO: 4054644 - DNA, 23 bp, Homo sapiens
gcattctatcgttattataaatg

SEQ ID NO: 4054645 - DNA, 15 bp, Homo sapiens
gcattctattgcctt

SEQ ID NO: 4054646 - DNA, 16 bp, Homo sapiens
gcattctattgccttc

SEQ ID NO: 4054647 - DNA, 22 bp, Homo sapiens
gcattctattgccttctttgaa

SEQ ID NO: 4054648 - DNA, 15 bp, Homo sapiens
gcattctcactccta

SEQ ID NO: 4054649 - DNA, 14 bp, Homo sapiens
gcattctctctcca

SEQ ID NO: 4054650 - DNA, 14 bp, Homo sapiens
gcattcttctctgt

SEQ ID NO: 4054651 - DNA, 21 bp, Homo sapiens
gcattcttgtcacaataaatg

SEQ ID NO: 4054652 - DNA, 21 bp, Homo sapiens
gcattgaaagaagagatgaga

SEQ ID NO: 4054653 - DNA, 17 bp, Homo sapiens
gcattgaaatgagcacc

SEQ ID NO: 4054654 - DNA, 11 bp, Homo sapiens
gcattgaaatt

SEQ ID NO: 4054655 - DNA, 23 bp, Homo sapiens
gcattgaacacaaactgtaaata

SEQ ID NO: 4054656 - DNA, 16 bp, Homo sapiens
gcattgaatatattat

SEQ ID NO: 4054657 - DNA, 23 bp, Homo sapiens
gcattgaccgcgactaatttcaa

SEQ ID NO: 4054658 - DNA, 13 bp, Homo sapiens
gcattgcatggac

SEQ ID NO: 4054659 - DNA, 17 bp, Homo sapiens
gcattgctagataaaag

SEQ ID NO: 4054660 - DNA, 18 bp, Homo sapiens
gcattgctagataaaagc

SEQ ID NO: 4054661 - DNA, 18 bp, Homo sapiens
gcattggggggccgggca

SEQ ID NO: 4054662 - DNA, 17 bp, Homo sapiens
gcattgtgattggcctg

SEQ ID NO: 4054663 - DNA, 14 bp, Homo sapiens
gcattgttggctat

SEQ ID NO: 4054664 - DNA, 20 bp, Homo sapiens
gcattgttggctatttgaaa

SEQ ID NO: 4054665 - DNA, 18 bp, Homo sapiens
gcattgtttgcttattgt

SEQ ID NO: 4054666 - DNA, 21 bp, Homo sapiens
gcattgtttgcttattgttcc

SEQ ID NO: 4054667 - DNA, 15 bp, Homo sapiens
gcatttagaaatcaa

SEQ ID NO: 4054668 - DNA, 23 bp, Homo sapiens
gcatttatttatacagtgccttg

SEQ ID NO: 4054669 - DNA, 23 bp, Homo sapiens
gcatttccaacaccacagacaca

SEQ ID NO: 4054670 - DNA, 10 bp, Homo sapiens
gcatttccta

SEQ ID NO: 4054671 - DNA, 13 bp, Homo sapiens
gcatttccttcca

SEQ ID NO: 4054672 - DNA, 18 bp, Homo sapiens
gcatttctgaatagaaat

SEQ ID NO: 4054673 - DNA, 23 bp, Homo sapiens
gcatttgctctttcatctctgct

SEQ ID NO: 4054674 - DNA, 14 bp, Homo sapiens
gcatttgcttttgt

SEQ ID NO: 4054675 - DNA, 18 bp, Homo sapiens
gcattttcctcctctgcc

SEQ ID NO: 4054676 - DNA, 23 bp, Homo sapiens
gcattttggagagtttcctgaaa

SEQ ID NO: 4054677 - DNA, 22 bp, Homo sapiens
gcattttgggggtttttaatct

SEQ ID NO: 4054678 - DNA, 18 bp, Homo sapiens
gcatttttattaaagcat

SEQ ID NO: 4054679 - DNA, 19 bp, Homo sapiens
gcatttttattaaagcatt

SEQ ID NO: 4054680 - DNA, 21 bp, Homo sapiens
gcatttttgtgaaatgaaaac

SEQ ID NO: 4054681 - DNA, 17 bp, Homo sapiens
gcatttttttattcagc

SEQ ID NO: 4054682 - DNA, 15 bp, Homo sapiens
gccaaaaaaaaaaga

SEQ ID NO: 4054683 - DNA, 18 bp, Homo sapiens
gccaaaaaaaaaagaagt

SEQ ID NO: 4054684 - DNA, 14 bp, Homo sapiens
gccaaaaccaggcc

SEQ ID NO: 4054685 - DNA, 16 bp, Homo sapiens
gccaaaaccaggcctc

SEQ ID NO: 4054686 - DNA, 18 bp, Homo sapiens
gccaaaaccaggcctctg

SEQ ID NO: 4054687 - DNA, 16 bp, Homo sapiens
gccaaaagctagacag

SEQ ID NO: 4054688 - DNA, 15 bp, Homo sapiens
gccaaaagcttccct

SEQ ID NO: 4054689 - DNA, 20 bp, Homo sapiens
gccaaacatcagacctgtct

SEQ ID NO: 4054690 - DNA, 22 bp, Homo sapiens
gccaaacccatgaggcaatgtc

SEQ ID NO: 4054691 - DNA, 15 bp, Homo sapiens
gccaaaccctgtctg

SEQ ID NO: 4054692 - DNA, 19 bp, Homo sapiens
gccaaacccttgctttcct

SEQ ID NO: 4054693 - DNA, 17 bp, Homo sapiens
gccaaacctgggacccc

SEQ ID NO: 4054694 - DNA, 18 bp, Homo sapiens
gccaaactgtccctccct

SEQ ID NO: 4054695 - DNA, 16 bp, Homo sapiens
gccaaagctagggtgg

SEQ ID NO: 4054696 - DNA, 17 bp, Homo sapiens
gccaaaggatgtgatat

SEQ ID NO: 4054697 - DNA, 20 bp, Homo sapiens
gccaaaggctggtggcaagt

SEQ ID NO: 4054698 - DNA, 15 bp, Homo sapiens
gccaaatagcaaaga

SEQ ID NO: 4054699 - DNA, 21 bp, Homo sapiens
gccaaatgcagggaggggagg

SEQ ID NO: 4054700 - DNA, 22 bp, Homo sapiens
gccaaatgctctctcaaattgt

SEQ ID NO: 4054701 - DNA, 13 bp, Homo sapiens
gccaaatgctggg

SEQ ID NO: 4054702 - DNA, 14 bp, Homo sapiens
gccaaatgctgggg

SEQ ID NO: 4054703 - DNA, 18 bp, Homo sapiens
gccaaatgtaattgaata

SEQ ID NO: 4054704 - DNA, 13 bp, Homo sapiens
gccaaatttatca

SEQ ID NO: 4054705 - DNA, 19 bp, Homo sapiens
gccaaatttatcaaagcat

SEQ ID NO: 4054706 - DNA, 17 bp, Homo sapiens
gccaacacgcacctgcc

SEQ ID NO: 4054707 - DNA, 20 bp, Homo sapiens
gccaacacgcacctgcctca

SEQ ID NO: 4054708 - DNA, 21 bp, Homo sapiens
gccaacacgcacctgcctcag

SEQ ID NO: 4054709 - DNA, 17 bp, Homo sapiens
gccaacagaagcttcca

SEQ ID NO: 4054710 - DNA, 15 bp, Homo sapiens
gccaacagcacctcc

SEQ ID NO: 4054711 - DNA, 19 bp, Homo sapiens
gccaacaggtggcaggacc

SEQ ID NO: 4054712 - DNA, 20 bp, Homo sapiens
gccaacagtcaaaacagaga

SEQ ID NO: 4054713 - DNA, 23 bp, Homo sapiens
gccaacatcgtgaaaccctgtct

SEQ ID NO: 4054714 - DNA, 14 bp, Homo sapiens
gccaacatggtgaa

SEQ ID NO: 4054715 - DNA, 21 bp, Homo sapiens
gccaacctcggcttgtgggct

SEQ ID NO: 4054716 - DNA, 16 bp, Homo sapiens
gccaactagcccctgg

SEQ ID NO: 4054717 - DNA, 17 bp, Homo sapiens
gccaactagcccctggg

SEQ ID NO: 4054718 - DNA, 20 bp, Homo sapiens
gccaactagcccctggggtg

SEQ ID NO: 4054719 - DNA, 22 bp, Homo sapiens
gccaactgccaggctgcctcct

SEQ ID NO: 4054720 - DNA, 17 bp, Homo sapiens
gccaacttgtaaataca

SEQ ID NO: 4054721 - DNA, 18 bp, Homo sapiens
gccaacttgtaaatacac

SEQ ID NO: 4054722 - DNA, 16 bp, Homo sapiens
gccaagaatacttgaa

SEQ ID NO: 4054723 - DNA, 13 bp, Homo sapiens
gccaagagaaggg

SEQ ID NO: 4054724 - DNA, 22 bp, Homo sapiens
gccaagcaaaccaatggtgatc

SEQ ID NO: 4054725 - DNA, 22 bp, Homo sapiens
gccaagccctccccatcccatg

SEQ ID NO: 4054726 - DNA, 17 bp, Homo sapiens
gccaagccttaaactgt

SEQ ID NO: 4054727 - DNA, 12 bp, Homo sapiens
gccaagggaaag

SEQ ID NO: 4054728 - DNA, 16 bp, Homo sapiens
gccaaggtcctgctca

SEQ ID NO: 4054729 - DNA, 22 bp, Homo sapiens
gccaagtataattttttgtaat

SEQ ID NO: 4054730 - DNA, 18 bp, Homo sapiens
gccaagtgccaaatgctc

SEQ ID NO: 4054731 - DNA, 18 bp, Homo sapiens
gccaagtgcgtgccgtgt

SEQ ID NO: 4054732 - DNA, 20 bp, Homo sapiens
gccaagtggggatggggcct

SEQ ID NO: 4054733 - DNA, 13 bp, Homo sapiens
gccaataaaaagt

SEQ ID NO: 4054734 - DNA, 19 bp, Homo sapiens
gccaataaccaagtttatt

SEQ ID NO: 4054735 - DNA, 14 bp, Homo sapiens
gcccagctgggtca

SEQ ID NO: 4054736 - DNA, 19 bp, Homo sapiens
gcccagctgggtcaggcag

SEQ ID NO: 4054737 - DNA, 20 bp, Homo sapiens
gcccagctgggtcaggcagg

SEQ ID NO: 4054738 - DNA, 23 bp, Homo sapiens
gcccagcttttcattgctgtgac

SEQ ID NO: 4054739 - DNA, 11 bp, Homo sapiens
gcccaggagac

SEQ ID NO: 4054740 - DNA, 22 bp, Homo sapiens
gcccaggagacagaccacttgc

SEQ ID NO: 4054741 - DNA, 24 bp, Homo sapiens
gcccaggatatttctgagagtgaa

SEQ ID NO: 4054742 - DNA, 15 bp, Homo sapiens
gcccaggcctcacca

SEQ ID NO: 4054743 - DNA, 16 bp, Homo sapiens
gcccaggcctcaccac

SEQ ID NO: 4054744 - DNA, 16 bp, Homo sapiens
gcccaggctggtttcg

SEQ ID NO: 4054745 - DNA, 22 bp, Homo sapiens
gcccaggctgtgcagcgcagct

SEQ ID NO: 4054746 - DNA, 21 bp, Homo sapiens
gcccagggagggaagtgtgag

SEQ ID NO: 4054747 - DNA, 21 bp, Homo sapiens
gcccagggcatcttgctggct

SEQ ID NO: 4054748 - DNA, 14 bp, Homo sapiens
gcccagggcccaga

SEQ ID NO: 4054749 - DNA, 15 bp, Homo sapiens
gcccagggcccagag

SEQ ID NO: 4054750 - DNA, 18 bp, Homo sapiens
gcccagggcccagagccc

SEQ ID NO: 4054751 - DNA, 20 bp, Homo sapiens
gcccaggggcccacagggaa

SEQ ID NO: 4054752 - DNA, 12 bp, Homo sapiens
gcccaggggctg

SEQ ID NO: 4054753 - DNA, 15 bp, Homo sapiens
gcccaggtaccaccc

SEQ ID NO: 4054754 - DNA, 23 bp, Homo sapiens
gcccaggtcaccaagcagtggcc

SEQ ID NO: 4054755 - DNA, 15 bp, Homo sapiens
gcccagtgaagcctc

SEQ ID NO: 4054756 - DNA, 16 bp, Homo sapiens
gcccatactcagcctg

SEQ ID NO: 4054757 - DNA, 16 bp, Homo sapiens
gcccatactggttggc

SEQ ID NO: 4054758 - DNA, 21 bp, Homo sapiens
gcccatcacagggttgggccc

SEQ ID NO: 4054759 - DNA, 17 bp, Homo sapiens
gcccatccaaacactga

SEQ ID NO: 4054760 - DNA, 20 bp, Homo sapiens
gcccatccaaacactgaggc

SEQ ID NO: 4054761 - DNA, 19 bp, Homo sapiens
gcccatccattaggccagc

SEQ ID NO: 4054762 - DNA, 22 bp, Homo sapiens
gcccatccattaggccagcaac

SEQ ID NO: 4054763 - DNA, 15 bp, Homo sapiens
gcccatcctgactga

SEQ ID NO: 4054764 - DNA, 23 bp, Homo sapiens
gcccatctcagcctcctgagcct

SEQ ID NO: 4054765 - DNA, 18 bp, Homo sapiens
gcccatgccaaggcctcc

SEQ ID NO: 4054766 - DNA, 15 bp, Homo sapiens
gcccatgcccacctg

SEQ ID NO: 4054767 - DNA, 21 bp, Homo sapiens
gcccatgctcaaccactgtgg

SEQ ID NO: 4054768 - DNA, 21 bp, Homo sapiens
gcccatggttgagaaatgaat

SEQ ID NO: 4054769 - DNA, 19 bp, Homo sapiens
gcccatgtgtcccctcact

SEQ ID NO: 4054770 - DNA, 13 bp, Homo sapiens
gcccattcccacc

SEQ ID NO: 4054771 - DNA, 13 bp, Homo sapiens
gccccaaggacaa

SEQ ID NO: 4054772 - DNA, 12 bp, Homo sapiens
gccccacactcc

SEQ ID NO: 4054773 - DNA, 14 bp, Homo sapiens
gccccacactcccc

SEQ ID NO: 4054774 - DNA, 18 bp, Homo sapiens
gccccacactccccgcct

SEQ ID NO: 4054775 - DNA, 15 bp, Homo sapiens
gccccacccaagccc

SEQ ID NO: 4054776 - DNA, 16 bp, Homo sapiens
gccccacccaagccca

SEQ ID NO: 4054777 - DNA, 15 bp, Homo sapiens
gccccacccaggagg

SEQ ID NO: 4054778 - DNA, 16 bp, Homo sapiens
gccccaccccacctcc

SEQ ID NO: 4054779 - DNA, 22 bp, Homo sapiens
gccccaccccacctccactccc

SEQ ID NO: 4054780 - DNA, 20 bp, Homo sapiens
gccccacggagacagaggaa

SEQ ID NO: 4054781 - DNA, 23 bp, Homo sapiens
gccccacggagacagaggaaagg

SEQ ID NO: 4054782 - DNA, 16 bp, Homo sapiens
gccccagacagggtgg

SEQ ID NO: 4054783 - DNA, 17 bp, Homo sapiens
gccccagaccccagggc

SEQ ID NO: 4054784 - DNA, 22 bp, Homo sapiens
gccccagagctgtttatggcct

SEQ ID NO: 4054785 - DNA, 23 bp, Homo sapiens
gccccagagctgtttatggcctc

SEQ ID NO: 4054786 - DNA, 15 bp, Homo sapiens
gccccagagtggccc

SEQ ID NO: 4054787 - DNA, 20 bp, Homo sapiens
gccccagatcaccagcccgg

SEQ ID NO: 4054788 - DNA, 14 bp, Homo sapiens
gccccagcccagat

SEQ ID NO: 4054789 - DNA, 16 bp, Homo sapiens
gccccagccccttctc

SEQ ID NO: 4054790 - DNA, 21 bp, Homo sapiens
gccccagccccttctcccagc

SEQ ID NO: 4054791 - DNA, 23 bp, Homo sapiens
gccccagccccttctcccagcac

SEQ ID NO: 4054792 - DNA, 11 bp, Homo sapiens
gccccaggacc

SEQ ID NO: 4054793 - DNA, 12 bp, Homo sapiens
gccccaggacca

SEQ ID NO: 4054794 - DNA, 14 bp, Homo sapiens
gccccaggaccagc

SEQ ID NO: 4054795 - DNA, 15 bp, Homo sapiens
gccccaggaccagct

SEQ ID NO: 4054796 - DNA, 17 bp, Homo sapiens
gccccaggaccagctca

SEQ ID NO: 4054797 - DNA, 23 bp, Homo sapiens
gccccaggaccagctcaggacag

SEQ ID NO: 4054798 - DNA, 15 bp, Homo sapiens
gccccaggccccaga

SEQ ID NO: 4054799 - DNA, 14 bp, Homo sapiens
gccccaggccctcc

SEQ ID NO: 4054800 - DNA, 16 bp, Homo sapiens
gccccaggccctccct

SEQ ID NO: 4054801 - DNA, 12 bp, Homo sapiens
gccccaggcctg

SEQ ID NO: 4054802 - DNA, 12 bp, Homo sapiens
gccccagggcac

SEQ ID NO: 4054803 - DNA, 19 bp, Homo sapiens
gccccagtgcggttcctca

SEQ ID NO: 4054804 - DNA, 18 bp, Homo sapiens
gccccagttcaatctccc

SEQ ID NO: 4054805 - DNA, 16 bp, Homo sapiens
gccccatcagaacctg

SEQ ID NO: 4054806 - DNA, 12 bp, Homo sapiens
gccccatccctg

SEQ ID NO: 4054807 - DNA, 14 bp, Homo sapiens
gccccatccctgtc

SEQ ID NO: 4054808 - DNA, 16 bp, Homo sapiens
gccccatccctgtcct

SEQ ID NO: 4054809 - DNA, 20 bp, Homo sapiens
gccccatgcctgtccagcct

SEQ ID NO: 4054810 - DNA, 17 bp, Homo sapiens
gcccccaccccggggac

SEQ ID NO: 4054811 - DNA, 12 bp, Homo sapiens
gcccccactgac

SEQ ID NO: 4054812 - DNA, 17 bp, Homo sapiens
gcccccagatagagctg

SEQ ID NO: 4054813 - DNA, 22 bp, Homo sapiens
gcccccagatagagctgggtgg

SEQ ID NO: 4054814 - DNA, 20 bp, Homo sapiens
gcccccagcccctcccccat

SEQ ID NO: 4054815 - DNA, 22 bp, Homo sapiens
gcccccagctaagaacctggaa

SEQ ID NO: 4054816 - DNA, 13 bp, Homo sapiens
gcccccaggacaa

SEQ ID NO: 4054817 - DNA, 19 bp, Homo sapiens
gcccccagggcctccaggg

SEQ ID NO: 4054818 - DNA, 22 bp, Homo sapiens
gcccccagggcctccagggccc

SEQ ID NO: 4054819 - DNA, 18 bp, Homo sapiens
gcccccagtccccacccc

SEQ ID NO: 4054820 - DNA, 23 bp, Homo sapiens
gcccccatgggctcctgcccctt

SEQ ID NO: 4054821 - DNA, 19 bp, Homo sapiens
gccccccacccctggaaga

SEQ ID NO: 4054822 - DNA, 19 bp, Homo sapiens
gccccccagccccggtggc

SEQ ID NO: 4054823 - DNA, 14 bp, Homo sapiens
gccccccgccctca

SEQ ID NO: 4054824 - DNA, 13 bp, Homo sapiens
gcccccgccccag

SEQ ID NO: 4054825 - DNA, 15 bp, Homo sapiens
gcccccgccccagag

SEQ ID NO: 4054826 - DNA, 16 bp, Homo sapiens
gcccccgccccagagt

SEQ ID NO: 4054827 - DNA, 15 bp, Homo sapiens
gccccctcacctctc

SEQ ID NO: 4054828 - DNA, 17 bp, Homo sapiens
gccccctcacctctcca

SEQ ID NO: 4054829 - DNA, 16 bp, Homo sapiens
gccccctcctctagct

SEQ ID NO: 4054830 - DNA, 21 bp, Homo sapiens
gccccctcctctagctgtggg

SEQ ID NO: 4054831 - DNA, 13 bp, Homo sapiens
gccccctgcctgc

SEQ ID NO: 4054832 - DNA, 19 bp, Homo sapiens
gccccctggcctctgtgcc

SEQ ID NO: 4054833 - DNA, 14 bp, Homo sapiens
gccccctggtctct

SEQ ID NO: 4054834 - DNA, 20 bp, Homo sapiens
gccccgcgcaccccacgccc

SEQ ID NO: 4054835 - DNA, 22 bp, Homo sapiens
gccccggcaagccacaggaagg

SEQ ID NO: 4054836 - DNA, 14 bp, Homo sapiens
gccccggccctggg

SEQ ID NO: 4054837 - DNA, 21 bp, Homo sapiens
gccccggccctgggctcggag

SEQ ID NO: 4054838 - DNA, 17 bp, Homo sapiens
gccctgactcctctggc

SEQ ID NO: 4054839 - DNA, 14 bp, Homo sapiens
gccctgagagtctg

SEQ ID NO: 4054840 - DNA, 23 bp, Homo sapiens
gccctgagagtctggtctgcgcc

SEQ ID NO: 4054841 - DNA, 16 bp, Homo sapiens
gccctgaggaggcctt

SEQ ID NO: 4054842 - DNA, 20 bp, Homo sapiens
gccctgaggcggaggctgtg

SEQ ID NO: 4054843 - DNA, 21 bp, Homo sapiens
gccctgagtggatctccaagg

SEQ ID NO: 4054844 - DNA, 16 bp, Homo sapiens
gccctgcacctgtgca

SEQ ID NO: 4054845 - DNA, 15 bp, Homo sapiens
gccctgccctggcag

SEQ ID NO: 4054846 - DNA, 18 bp, Homo sapiens
gccctgcggtagatggga

SEQ ID NO: 4054847 - DNA, 13 bp, Homo sapiens
gccctgctttgca

SEQ ID NO: 4054848 - DNA, 20 bp, Homo sapiens
gccctgctttgggctgccct

SEQ ID NO: 4054849 - DNA, 21 bp, Homo sapiens
gccctggcagggtcatcctgt

SEQ ID NO: 4054850 - DNA, 20 bp, Homo sapiens
gccctggccactaaagcttc

SEQ ID NO: 4054851 - DNA, 14 bp, Homo sapiens
gccctggccagccg

SEQ ID NO: 4054852 - DNA, 15 bp, Homo sapiens
gccctggccagccgg

SEQ ID NO: 4054853 - DNA, 15 bp, Homo sapiens
gccctggctcccaca

SEQ ID NO: 4054854 - DNA, 20 bp, Homo sapiens
gccctggctcccacaggccc

SEQ ID NO: 4054855 - DNA, 12 bp, Homo sapiens
gccctggctctg

SEQ ID NO: 4054856 - DNA, 12 bp, Homo sapiens
gccctggctgct

SEQ ID NO: 4054857 - DNA, 15 bp, Homo sapiens
gccctggctgggttc

SEQ ID NO: 4054858 - DNA, 23 bp, Homo sapiens
gccctggctgttctgtggttcct

SEQ ID NO: 4054859 - DNA, 17 bp, Homo sapiens
gccctgggccacactga

SEQ ID NO: 4054860 - DNA, 12 bp, Homo sapiens
gccctgggcctc

SEQ ID NO: 4054861 - DNA, 14 bp, Homo sapiens
gccctgggcctcag

SEQ ID NO: 4054862 - DNA, 21 bp, Homo sapiens
gccctgggctcggaggctgcc

SEQ ID NO: 4054863 - DNA, 13 bp, Homo sapiens
gccctgggctgga

SEQ ID NO: 4054864 - DNA, 18 bp, Homo sapiens
gccctggggactgttcca

SEQ ID NO: 4054865 - DNA, 23 bp, Homo sapiens
gccctggtgaatcacctggctga

SEQ ID NO: 4054866 - DNA, 16 bp, Homo sapiens
gccctggtgctgccac

SEQ ID NO: 4054867 - DNA, 20 bp, Homo sapiens
gccctgtccaaaagcgccct

SEQ ID NO: 4054868 - DNA, 23 bp, Homo sapiens
gccctgtccaaaagcgccctcac

SEQ ID NO: 4054869 - DNA, 12 bp, Homo sapiens
gccctgtcccag

SEQ ID NO: 4054870 - DNA, 13 bp, Homo sapiens
gccctgtcccagg

SEQ ID NO: 4054871 - DNA, 16 bp, Homo sapiens
gccctgtcccaggccg

SEQ ID NO: 4054872 - DNA, 22 bp, Homo sapiens
gccctgtcccaggccggcccag

SEQ ID NO: 4054873 - DNA, 23 bp, Homo sapiens
gccctgtcccaggccggcccaga

SEQ ID NO: 4054874 - DNA, 16 bp, Homo sapiens
gccctgtccctgtccc

SEQ ID NO: 4054875 - DNA, 16 bp, Homo sapiens
gccctgttcatgtgcc

SEQ ID NO: 4054876 - DNA, 20 bp, Homo sapiens
gccctgttcatgtgcctctg

SEQ ID NO: 4054877 - DNA, 23 bp, Homo sapiens
gccctgttcctccctcccacact

SEQ ID NO: 4054878 - DNA, 21 bp, Homo sapiens
gcccttacacactcaggcctg

SEQ ID NO: 4054879 - DNA, 16 bp, Homo sapiens
gcccttcacagtgttt

SEQ ID NO: 4054880 - DNA, 12 bp, Homo sapiens
gcccttcccact

SEQ ID NO: 4054881 - DNA, 18 bp, Homo sapiens
gcccttccctctgggcac

SEQ ID NO: 4054882 - DNA, 19 bp, Homo sapiens
gcccttccctctgggcacg

SEQ ID NO: 4054883 - DNA, 22 bp, Homo sapiens
gcccttccctgagtgcgggctg

SEQ ID NO: 4054884 - DNA, 12 bp, Homo sapiens
gcccttcctctc

SEQ ID NO: 4054885 - DNA, 19 bp, Homo sapiens
gcccttcctctccactgcc

SEQ ID NO: 4054886 - DNA, 21 bp, Homo sapiens
gcccttcctctccactgcctt

SEQ ID NO: 4054887 - DNA, 13 bp, Homo sapiens
gcccttcctctgc

SEQ ID NO: 4054888 - DNA, 15 bp, Homo sapiens
gcccttcctctgctc

SEQ ID NO: 4054889 - DNA, 17 bp, Homo sapiens
gcccttcctctgctccc

SEQ ID NO: 4054890 - DNA, 13 bp, Homo sapiens
gcccttcctggag

SEQ ID NO: 4054891 - DNA, 17 bp, Homo sapiens
gcccttcctggaggctg

SEQ ID NO: 4054892 - DNA, 21 bp, Homo sapiens
gcccttgcagttcagcaccac

SEQ ID NO: 4054893 - DNA, 13 bp, Homo sapiens
gcccttgcctccc

SEQ ID NO: 4054894 - DNA, 16 bp, Homo sapiens
gcccttgcctccccat

SEQ ID NO: 4054895 - DNA, 23 bp, Homo sapiens
gcccttgggacagccagagctgg

SEQ ID NO: 4054896 - DNA, 15 bp, Homo sapiens
gcccttgggcagttc

SEQ ID NO: 4054897 - DNA, 15 bp, Homo sapiens
gcccttggggctggg

SEQ ID NO: 4054898 - DNA, 17 bp, Homo sapiens
gcccttggggctggggg

SEQ ID NO: 4054899 - DNA, 20 bp, Homo sapiens
gccctttcctaggcccaggc

SEQ ID NO: 4054900 - DNA, 15 bp, Homo sapiens
gccctttcctcctca

SEQ ID NO: 4054901 - DNA, 17 bp, Homo sapiens
gccctttgaagcctcag

SEQ ID NO: 4054902 - DNA, 19 bp, Homo sapiens
gccctttgaagcctcagct

SEQ ID NO: 4054903 - DNA, 21 bp, Homo sapiens
gcccttttcaggaagctctct

SEQ ID NO: 4054904 - DNA, 20 bp, Homo sapiens
gccgaaggtgcctcagactc

SEQ ID NO: 4054905 - DNA, 21 bp, Homo sapiens
gccgaaggtgcctcagactcc

SEQ ID NO: 4054906 - DNA, 20 bp, Homo sapiens
gccgaatcccctccctgtca

SEQ ID NO: 4054907 - DNA, 15 bp, Homo sapiens
gccgactctggccct

SEQ ID NO: 4054908 - DNA, 16 bp, Homo sapiens
gccgactctggccctg

SEQ ID NO: 4054909 - DNA, 18 bp, Homo sapiens
gccgactctggccctggc

SEQ ID NO: 4054910 - DNA, 19 bp, Homo sapiens
gccgagctggtttcctgcc

SEQ ID NO: 4054911 - DNA, 15 bp, Homo sapiens
gccgaggcccagcgg

SEQ ID NO: 4054912 - DNA, 17 bp, Homo sapiens
gccgaggcccagcgggc

SEQ ID NO: 4054913 - DNA, 16 bp, Homo sapiens
gccgagggtcctggct

SEQ ID NO: 4054914 - DNA, 13 bp, Homo sapiens
gccgaggtcccat

SEQ ID NO: 4054915 - DNA, 17 bp, Homo sapiens
gccgatatactctagat

SEQ ID NO: 4054916 - DNA, 22 bp, Homo sapiens
gccgatatactctagatgaagt

SEQ ID NO: 4054917 - DNA, 13 bp, Homo sapiens
gccgatggagaca

SEQ ID NO: 4054918 - DNA, 21 bp, Homo sapiens
gccgatggagacaccaaccga

SEQ ID NO: 4054919 - DNA, 20 bp, Homo sapiens
gccgcagacgggcacagaca

SEQ ID NO: 4054920 - DNA, 22 bp, Homo sapiens
gccgcaggtgggtgctgccctg

SEQ ID NO: 4054921 - DNA, 12 bp, Homo sapiens
gccgcaggtgtt

SEQ ID NO: 4054922 - DNA, 20 bp, Homo sapiens
gccgcaggtgtttggcaccc

SEQ ID NO: 4054923 - DNA, 18 bp, Homo sapiens
gccgccattgccaccagg

SEQ ID NO: 4054924 - DNA, 19 bp, Homo sapiens
gccgcctgcgggctgcccc

SEQ ID NO: 4054925 - DNA, 15 bp, Homo sapiens
gccgctacctccctc

SEQ ID NO: 4054926 - DNA, 16 bp, Homo sapiens
gccgctacctccctcc

SEQ ID NO: 4054927 - DNA, 17 bp, Homo sapiens
gccgctgtgagcccctg

SEQ ID NO: 4054928 - DNA, 14 bp, Homo sapiens
gccggcccagatgt

SEQ ID NO: 4054929 - DNA, 15 bp, Homo sapiens
gccggcccagatgtg

SEQ ID NO: 4054930 - DNA, 16 bp, Homo sapiens
gccgggagcttggctc

SEQ ID NO: 4054931 - DNA, 14 bp, Homo sapiens
gccgggcagagcac

SEQ ID NO: 4054932 - DNA, 18 bp, Homo sapiens
gccgggcaggtcctgccc

SEQ ID NO: 4054933 - DNA, 13 bp, Homo sapiens
gccgggcgcagtg

SEQ ID NO: 4054934 - DNA, 13 bp, Homo sapiens
gccgggctgaggg

SEQ ID NO: 4054935 - DNA, 18 bp, Homo sapiens
gccgggcttgggccctgc

SEQ ID NO: 4054936 - DNA, 19 bp, Homo sapiens
gccgggcttgggccctgca

SEQ ID NO: 4054937 - DNA, 16 bp, Homo sapiens
gccggggaagctgcca

SEQ ID NO: 4054938 - DNA, 22 bp, Homo sapiens
gccggggaagctgccagcccag

SEQ ID NO: 4054939 - DNA, 16 bp, Homo sapiens
gccggggacagaggcc

SEQ ID NO: 4054940 - DNA, 19 bp, Homo sapiens
gccggggacagaggcctgc

SEQ ID NO: 4054941 - DNA, 23 bp, Homo sapiens
gccttctttccatcaactcccaa

SEQ ID NO: 4054942 - DNA, 11 bp, Homo sapiens
gccttctttga

SEQ ID NO: 4054943 - DNA, 14 bp, Homo sapiens
gccttgcagccaca

SEQ ID NO: 4054944 - DNA, 17 bp, Homo sapiens
gccttgccagagatcca

SEQ ID NO: 4054945 - DNA, 22 bp, Homo sapiens
gccttgcccactcctgctctgc

SEQ ID NO: 4054946 - DNA, 19 bp, Homo sapiens
gccttgctacctcaagggg

SEQ ID NO: 4054947 - DNA, 14 bp, Homo sapiens
gccttgctgctgct

SEQ ID NO: 4054948 - DNA, 19 bp, Homo sapiens
gccttgctgctgctgcacc

SEQ ID NO: 4054949 - DNA, 20 bp, Homo sapiens
gccttgctgctgctgcaccc

SEQ ID NO: 4054950 - DNA, 21 bp, Homo sapiens
gccttgcttctgtatttcctt

SEQ ID NO: 4054951 - DNA, 13 bp, Homo sapiens
gccttgcttgtta

SEQ ID NO: 4054952 - DNA, 23 bp, Homo sapiens
gccttggaaatagaaagaagcca

SEQ ID NO: 4054953 - DNA, 17 bp, Homo sapiens
gccttggaaccagcccc

SEQ ID NO: 4054954 - DNA, 18 bp, Homo sapiens
gccttggaaccagcccca

SEQ ID NO: 4054955 - DNA, 23 bp, Homo sapiens
gccttggatcgctaagctggctc

SEQ ID NO: 4054956 - DNA, 18 bp, Homo sapiens
gccttgggccttgctgct

SEQ ID NO: 4054957 - DNA, 17 bp, Homo sapiens
gccttgggctctgctga

SEQ ID NO: 4054958 - DNA, 14 bp, Homo sapiens
gccttgggctgctc

SEQ ID NO: 4054959 - DNA, 23 bp, Homo sapiens
gccttgtaaataaccacaaggtc

SEQ ID NO: 4054960 - DNA, 17 bp, Homo sapiens
gccttgtgctgttaata

SEQ ID NO: 4054961 - DNA, 12 bp, Homo sapiens
gccttgtgtaca

SEQ ID NO: 4054962 - DNA, 13 bp, Homo sapiens
gccttgtgtatat

SEQ ID NO: 4054963 - DNA, 14 bp, Homo sapiens
gcctttcccaccct

SEQ ID NO: 4054964 - DNA, 17 bp, Homo sapiens
gcctttcccaccctcct

SEQ ID NO: 4054965 - DNA, 16 bp, Homo sapiens
gcctttcgaggcctga

SEQ ID NO: 4054966 - DNA, 19 bp, Homo sapiens
gcctttcgaggcctgaagc

SEQ ID NO: 4054967 - DNA, 19 bp, Homo sapiens
gcctttctgggagcagaaa

SEQ ID NO: 4054968 - DNA, 16 bp, Homo sapiens
gcctttcttctgccct

SEQ ID NO: 4054969 - DNA, 14 bp, Homo sapiens
gcctttctttgcct

SEQ ID NO: 4054970 - DNA, 17 bp, Homo sapiens
gcctttctttgcctctg

SEQ ID NO: 4054971 - DNA, 14 bp, Homo sapiens
gcctttgagacagt

SEQ ID NO: 4054972 - DNA, 21 bp, Homo sapiens
gcctttgagacagtttcttag

SEQ ID NO: 4054973 - DNA, 18 bp, Homo sapiens
gcctttgcaagatgcttg

SEQ ID NO: 4054974 - DNA, 21 bp, Homo sapiens
gcctttgcagttggactctca

SEQ ID NO: 4054975 - DNA, 20 bp, Homo sapiens
gcctttggatgaccagaaca

SEQ ID NO: 4054976 - DNA, 22 bp, Homo sapiens
gcctttggcctggggtgcatct

SEQ ID NO: 4054977 - DNA, 13 bp, Homo sapiens
gccttttgctctc

SEQ ID NO: 4054978 - DNA, 12 bp, Homo sapiens
gccttttgctgc

SEQ ID NO: 4054979 - DNA, 17 bp, Homo sapiens
accctcagggagcctcc

SEQ ID NO: 4054980 - DNA, 18 bp, Homo sapiens
accctcagggagcctccc

SEQ ID NO: 4054981 - DNA, 17 bp, Homo sapiens
accctcatggcccccag

SEQ ID NO: 4054982 - DNA, 19 bp, Homo sapiens
accctcatggcccccaggg

SEQ ID NO: 4054983 - DNA, 15 bp, Homo sapiens
accctccaccttcca

SEQ ID NO: 4054984 - DNA, 13 bp, Homo sapiens
accctccatgctc

SEQ ID NO: 4054985 - DNA, 16 bp, Homo sapiens
accctccatgctcctc

SEQ ID NO: 4054986 - DNA, 14 bp, Homo sapiens
accctcccaccccc

SEQ ID NO: 4054987 - DNA, 23 bp, Homo sapiens
accctcccacccccttctctgct

SEQ ID NO: 4054988 - DNA, 21 bp, Homo sapiens
accctccccttcccagggcaa

SEQ ID NO: 4054989 - DNA, 15 bp, Homo sapiens
accctccctggagtg

SEQ ID NO: 4054990 - DNA, 20 bp, Homo sapiens
accctcctgccccacactcc

SEQ ID NO: 4054991 - DNA, 22 bp, Homo sapiens
accctcctgccccacactcccc

SEQ ID NO: 4054992 - DNA, 15 bp, Homo sapiens
accctctcagctcca

SEQ ID NO: 4054993 - DNA, 23 bp, Homo sapiens
accctctcctgggggtggcaggc

SEQ ID NO: 4054994 - DNA, 21 bp, Homo sapiens
accctctgaatggtccagggt

SEQ ID NO: 4054995 - DNA, 22 bp, Homo sapiens
accctctgaatggtccagggtt

SEQ ID NO: 4054996 - DNA, 19 bp, Homo sapiens
accctctggaaatatgtaa

SEQ ID NO: 4054997 - DNA, 20 bp, Homo sapiens
accctctggattctgaatct

SEQ ID NO: 4054998 - DNA, 17 bp, Homo sapiens
accctctgtcccacccc

SEQ ID NO: 4054999 - DNA, 17 bp, Homo sapiens
accctgaaggggccatg

SEQ ID NO: 4055000 - DNA, 21 bp, Homo sapiens
accctgaatggttccatgcct

SEQ ID NO: 4055001 - DNA, 17 bp, Homo sapiens
accctgacctccgcccc

SEQ ID NO: 4055002 - DNA, 18 bp, Homo sapiens
accctgaggccctgggct

SEQ ID NO: 4055003 - DNA, 22 bp, Homo sapiens
accctgaggtcagggagtgctg

SEQ ID NO: 4055004 - DNA, 16 bp, Homo sapiens
accctgagttcatcca

SEQ ID NO: 4055005 - DNA, 19 bp, Homo sapiens
accctgcaaacagaacagg

SEQ ID NO: 4055006 - DNA, 18 bp, Homo sapiens
accctgcattacatgtgt

SEQ ID NO: 4055007 - DNA, 19 bp, Homo sapiens
accctgccccaccccacct

SEQ ID NO: 4055008 - DNA, 20 bp, Homo sapiens
accctgccccaccccacctc

SEQ ID NO: 4055009 - DNA, 14 bp, Homo sapiens
accctgcctcagct

SEQ ID NO: 4055010 - DNA, 18 bp, Homo sapiens
accctgccttatcttgca

SEQ ID NO: 4055011 - DNA, 17 bp, Homo sapiens
accctgcgcctccagag

SEQ ID NO: 4055012 - DNA, 18 bp, Homo sapiens
accctgctcctcctgccc

SEQ ID NO: 4055013 - DNA, 21 bp, Homo sapiens
accctgggctattgctgctgc

SEQ ID NO: 4055014 - DNA, 15 bp, Homo sapiens
accctggggaaggag

SEQ ID NO: 4055015 - DNA, 15 bp, Homo sapiens
accttttttaagatt

SEQ ID NO: 4055016 - DNA, 16 bp, Homo sapiens
acctttttttttgaaa

SEQ ID NO: 4055017 - DNA, 17 bp, Homo sapiens
acctttttttttgaaac

SEQ ID NO: 4055018 - DNA, 19 bp, Homo sapiens
acctttttttttgaaacag

SEQ ID NO: 4055019 - DNA, 13 bp, Homo sapiens
acgaaatgttatt

SEQ ID NO: 4055020 - DNA, 23 bp, Homo sapiens
acgaaatgttattttttaattat

SEQ ID NO: 4055021 - DNA, 23 bp, Homo sapiens
acgaagccttaagccataggccc

SEQ ID NO: 4055022 - DNA, 14 bp, Homo sapiens
acgactaatcacct

SEQ ID NO: 4055023 - DNA, 15 bp, Homo sapiens
acgagaaagatcatt

SEQ ID NO: 4055024 - DNA, 16 bp, Homo sapiens
acgagggctggctggc

SEQ ID NO: 4055025 - DNA, 20 bp, Homo sapiens
acgagggctggctggcctca

SEQ ID NO: 4055026 - DNA, 22 bp, Homo sapiens
acgataaaattacaaaagagca

SEQ ID NO: 4055027 - DNA, 23 bp, Homo sapiens
acgatacgctactataaagagaa

SEQ ID NO: 4055028 - DNA, 16 bp, Homo sapiens
acgatcaggaggaagt

SEQ ID NO: 4055029 - DNA, 18 bp, Homo sapiens
acgatcaggaggaagtga

SEQ ID NO: 4055030 - DNA, 14 bp, Homo sapiens
acgatgaaaaactt

SEQ ID NO: 4055031 - DNA, 15 bp, Homo sapiens
acgatgaatttcttc

SEQ ID NO: 4055032 - DNA, 19 bp, Homo sapiens
acgatgaatttcttctaat

SEQ ID NO: 4055033 - DNA, 23 bp, Homo sapiens
acgatgtgtctgtatttcatgtg

SEQ ID NO: 4055034 - DNA, 12 bp, Homo sapiens
acgatgtttatg

SEQ ID NO: 4055035 - DNA, 12 bp, Homo sapiens
acgattggccac

SEQ ID NO: 4055036 - DNA, 18 bp, Homo sapiens
acgatttagaaagaagcc

SEQ ID NO: 4055037 - DNA, 14 bp, Homo sapiens
acgcacctgcctca

SEQ ID NO: 4055038 - DNA, 11 bp, Homo sapiens
acgcacgcaca

SEQ ID NO: 4055039 - DNA, 17 bp, Homo sapiens
acgcactgggccacgga

SEQ ID NO: 4055040 - DNA, 20 bp, Homo sapiens
acgcactgggccacggagga

SEQ ID NO: 4055041 - DNA, 15 bp, Homo sapiens
acgcactggtgccaa

SEQ ID NO: 4055042 - DNA, 17 bp, Homo sapiens
acgcactggtgccaaaa

SEQ ID NO: 4055043 - DNA, 21 bp, Homo sapiens
acgcagccctagagcctgcct

SEQ ID NO: 4055044 - DNA, 22 bp, Homo sapiens
acgcagccctagagcctgcctg

SEQ ID NO: 4055045 - DNA, 17 bp, Homo sapiens
acgcaggaactcccagc

SEQ ID NO: 4055046 - DNA, 16 bp, Homo sapiens
acgcaggctgagtcca

SEQ ID NO: 4055047 - DNA, 22 bp, Homo sapiens
acgcatggagtgtgtattgttc

SEQ ID NO: 4055048 - DNA, 18 bp, Homo sapiens
acgcatggtcaaccctca

SEQ ID NO: 4055049 - DNA, 19 bp, Homo sapiens
acgcatggtcaaccctcag

SEQ ID NO: 4055050 - DNA, 15 bp, Homo sapiens
acgccacatccccca

SEQ ID NO: 4055051 - DNA, 18 bp, Homo sapiens
acgccactccctgggaca

SEQ ID NO: 4055052 - DNA, 14 bp, Homo sapiens
acgccagtctccca

SEQ ID NO: 4055053 - DNA, 15 bp, Homo sapiens
acgcccatctcagga

SEQ ID NO: 4055054 - DNA, 12 bp, Homo sapiens
acgccccagccc

SEQ ID NO: 4055055 - DNA, 13 bp, Homo sapiens
acgccccagcccg

SEQ ID NO: 4055056 - DNA, 16 bp, Homo sapiens
acgcccctccaaacct

SEQ ID NO: 4055057 - DNA, 21 bp, Homo sapiens
acgcccctccaaacctccagc

SEQ ID NO: 4055058 - DNA, 17 bp, Homo sapiens
acgcccttggccatggg

SEQ ID NO: 4055059 - DNA, 17 bp, Homo sapiens
acgccctttcctcctca

SEQ ID NO: 4055060 - DNA, 23 bp, Homo sapiens
acgccggggacagaggcctgccc

SEQ ID NO: 4055061 - DNA, 18 bp, Homo sapiens
acgcctcttctgtccctg

SEQ ID NO: 4055062 - DNA, 23 bp, Homo sapiens
acgcctcttctgtccctgttaga

SEQ ID NO: 4055063 - DNA, 20 bp, Homo sapiens
acgcctgtaatcccagcact

SEQ ID NO: 4055064 - DNA, 21 bp, Homo sapiens
acgcctgtaatcccagcactt

SEQ ID NO: 4055065 - DNA, 16 bp, Homo sapiens
acgcctgtagtcctag

SEQ ID NO: 4055066 - DNA, 14 bp, Homo sapiens
acgccttcccctca

SEQ ID NO: 4055067 - DNA, 18 bp, Homo sapiens
acgcctttaaaggttttt

SEQ ID NO: 4055068 - DNA, 17 bp, Homo sapiens
acgctaaagagcccttg

SEQ ID NO: 4055069 - DNA, 18 bp, Homo sapiens
acgctaaagagcccttgc

SEQ ID NO: 4055070 - DNA, 15 bp, Homo sapiens
acgctacctctctgt

SEQ ID NO: 4055071 - DNA, 20 bp, Homo sapiens
acgctacctctctgtccctt

SEQ ID NO: 4055072 - DNA, 19 bp, Homo sapiens
acgctactataaagagaag

SEQ ID NO: 4055073 - DNA, 12 bp, Homo sapiens
acgctcacccag

SEQ ID NO: 4055074 - DNA, 14 bp, Homo sapiens
acgctccagctgcc

SEQ ID NO: 4055075 - DNA, 17 bp, Homo sapiens
acgctccagctgccccg

SEQ ID NO: 4055076 - DNA, 14 bp, Homo sapiens
acgctgcagagcac

SEQ ID NO: 4055077 - DNA, 21 bp, Homo sapiens
acgctgtcctctcgagcccag

SEQ ID NO: 4055078 - DNA, 21 bp, Homo sapiens
acgcttgtagaactcactctg

SEQ ID NO: 4055079 - DNA, 11 bp, Homo sapiens
acgctttgatt

SEQ ID NO: 4055080 - DNA, 16 bp, Homo sapiens
acgctttgattcatag

SEQ ID NO: 4055081 - DNA, 21 bp, Homo sapiens
acggaagtggtggctgtggaa

SEQ ID NO: 4055082 - DNA, 18 bp, Homo sapiens
acggagccccaggcctct

SEQ ID NO: 4055083 - DNA, 18 bp, Homo sapiens
acggaggagggatgctgc

SEQ ID NO: 4055084 - DNA, 19 bp, Homo sapiens
acggaggagggatgctgct

SEQ ID NO: 4055085 - DNA, 12 bp, Homo sapiens
acggattccaaa

SEQ ID NO: 4055086 - DNA, 15 bp, Homo sapiens
acggattttcagtta

SEQ ID NO: 4055087 - DNA, 17 bp, Homo sapiens
acggcaggctcactgcc

SEQ ID NO: 4055088 - DNA, 13 bp, Homo sapiens
acggccacatcaa

SEQ ID NO: 4055089 - DNA, 23 bp, Homo sapiens
acggccacccgccccgcgcaccc

SEQ ID NO: 4055090 - DNA, 18 bp, Homo sapiens
acggccagggagaagctc

SEQ ID NO: 4055091 - DNA, 15 bp, Homo sapiens
acggccatctctttg

SEQ ID NO: 4055092 - DNA, 13 bp, Homo sapiens
acggccccagctt

SEQ ID NO: 4055093 - DNA, 20 bp, Homo sapiens
acggccccagcttctcagct

SEQ ID NO: 4055094 - DNA, 18 bp, Homo sapiens
acggccctgcagccagct

SEQ ID NO: 4055095 - DNA, 19 bp, Homo sapiens
acggcctgatgctccctcc

SEQ ID NO: 4055096 - DNA, 12 bp, Homo sapiens
acggcggccagg

SEQ ID NO: 4055097 - DNA, 13 bp, Homo sapiens
acggcggccaggc

SEQ ID NO: 4055098 - DNA, 13 bp, Homo sapiens
acggcgttttttt

SEQ ID NO: 4055099 - DNA, 12 bp, Homo sapiens
acggctcctcag

SEQ ID NO: 4055100 - DNA, 14 bp, Homo sapiens
acggctcctcagag

SEQ ID NO: 4055101 - DNA, 15 bp, Homo sapiens
acggctcctcagagc

SEQ ID NO: 4055102 - DNA, 18 bp, Homo sapiens
acggctcctcagagcgcc

SEQ ID NO: 4055103 - DNA, 22 bp, Homo sapiens
acggctgcctgacactgagccc

SEQ ID NO: 4055104 - DNA, 23 bp, Homo sapiens
acggctgtggaccgtggacaggc

SEQ ID NO: 4055105 - DNA, 12 bp, Homo sapiens
acgggaggctgg

SEQ ID NO: 4055106 - DNA, 13 bp, Homo sapiens
acgggaggctggg

SEQ ID NO: 4055107 - DNA, 18 bp, Homo sapiens
acggggagcggcggaaag

SEQ ID NO: 4055108 - DNA, 19 bp, Homo sapiens
acggtcacacggccacccg

SEQ ID NO: 4055109 - DNA, 16 bp, Homo sapiens
acggtcgccacctggc

SEQ ID NO: 4055110 - DNA, 19 bp, Homo sapiens
acggtgctgtgagggaggg

SEQ ID NO: 4055111 - DNA, 14 bp, Homo sapiens
acggttaactgtaa

SEQ ID NO: 4055112 - DNA, 13 bp, Homo sapiens
acgtacatgttta

SEQ ID NO: 4055113 - DNA, 14 bp, Homo sapiens
acgtagctctctta

SEQ ID NO: 4055114 - DNA, 17 bp, Homo sapiens
acgtagctgaggccgga

SEQ ID NO: 4055115 - DNA, 16 bp, Homo sapiens
acgtagttgtgctttt

SEQ ID NO: 4055116 - DNA, 18 bp, Homo sapiens
acgtcaggccctgactcc

SEQ ID NO: 4055117 - DNA, 22 bp, Homo sapiens
acgtcaggccctgactcctctg

SEQ ID NO: 4055118 - DNA, 20 bp, Homo sapiens
acgtcccagcatccctggag

SEQ ID NO: 4055119 - DNA, 13 bp, Homo sapiens
acgtcctgcctgg

SEQ ID NO: 4055120 - DNA, 15 bp, Homo sapiens
acgtcctgcctggca

SEQ ID NO: 4055121 - DNA, 16 bp, Homo sapiens
acgtcctgcctggcac

SEQ ID NO: 4055122 - DNA, 22 bp, Homo sapiens
acgtcgcccgctgagctgagtg

SEQ ID NO: 4055123 - DNA, 16 bp, Homo sapiens
acgtctctttttggta

SEQ ID NO: 4055124 - DNA, 21 bp, Homo sapiens
acgtcttagagccttttatct

SEQ ID NO: 4055125 - DNA, 16 bp, Homo sapiens
acgtcttggtgccttt

SEQ ID NO: 4055126 - DNA, 21 bp, Homo sapiens
acgtcttggtgccttttgtgt

SEQ ID NO: 4055127 - DNA, 15 bp, Homo sapiens
acgtgagccaggtaa

SEQ ID NO: 4055128 - DNA, 14 bp, Homo sapiens
acgtggaacctctg

SEQ ID NO: 4055129 - DNA, 17 bp, Homo sapiens
acgtggacgtttttaat

SEQ ID NO: 4055130 - DNA, 13 bp, Homo sapiens
acgtggcactggt

SEQ ID NO: 4055131 - DNA, 11 bp, Homo sapiens
acgtgtttaaa

SEQ ID NO: 4055132 - DNA, 19 bp, Homo sapiens
acgttcataaccaacaata

SEQ ID NO: 4055133 - DNA, 21 bp, Homo sapiens
acgttggacttttcgttaaca

SEQ ID NO: 4055134 - DNA, 15 bp, Homo sapiens
acgttttattgtgtt

SEQ ID NO: 4055135 - DNA, 18 bp, Homo sapiens
acgttttattgtgttttt

SEQ ID NO: 4055136 - DNA, 19 bp, Homo sapiens
actaaaaatattcctccaa

SEQ ID NO: 4055137 - DNA, 13 bp, Homo sapiens
actaaaaatattg

SEQ ID NO: 4055138 - DNA, 17 bp, Homo sapiens
actaaaagacatttgtt

SEQ ID NO: 4055139 - DNA, 21 bp, Homo sapiens
actaaaagcagcgtcactcta

SEQ ID NO: 4055140 - DNA, 22 bp, Homo sapiens
actaaaattttaggcactctta

SEQ ID NO: 4055141 - DNA, 17 bp, Homo sapiens
actaaaccgataatgca

SEQ ID NO: 4055142 - DNA, 20 bp, Homo sapiens
actaaactacattgttctta

SEQ ID NO: 4055143 - DNA, 17 bp, Homo sapiens
actaaactcttaccata

SEQ ID NO: 4055144 - DNA, 23 bp, Homo sapiens
actaaactggtttgttgcagcca

SEQ ID NO: 4055145 - DNA, 12 bp, Homo sapiens
actaaagagaga

SEQ ID NO: 4055146 - DNA, 15 bp, Homo sapiens
actaaagccagcctg

SEQ ID NO: 4055147 - DNA, 16 bp, Homo sapiens
actaaagccagcctga

SEQ ID NO: 4055148 - DNA, 20 bp, Homo sapiens
actaaagcttcagactcaag

SEQ ID NO: 4055149 - DNA, 22 bp, Homo sapiens
actaaataatgaataaactgaa

SEQ ID NO: 4055150 - DNA, 14 bp, Homo sapiens
actaaatgagctcc

SEQ ID NO: 4055151 - DNA, 16 bp, Homo sapiens
actaaatgagctcctg

SEQ ID NO: 4055152 - DNA, 12 bp, Homo sapiens
actaaatttaaa

SEQ ID NO: 4055153 - DNA, 23 bp, Homo sapiens
actaaccagggaagctgtccctc

SEQ ID NO: 4055154 - DNA, 20 bp, Homo sapiens
actaagagaaaattgcacta

SEQ ID NO: 4055155 - DNA, 22 bp, Homo sapiens
actaagagaaaattgcactaaa

SEQ ID NO: 4055156 - DNA, 17 bp, Homo sapiens
actaagcaatttccccc

SEQ ID NO: 4055157 - DNA, 15 bp, Homo sapiens
actaagccaggcctg

SEQ ID NO: 4055158 - DNA, 18 bp, Homo sapiens
actaagccaggcctggct

SEQ ID NO: 4055159 - DNA, 18 bp, Homo sapiens
actaagccctgtcgagac

SEQ ID NO: 4055160 - DNA, 14 bp, Homo sapiens
actaagcctacctg

SEQ ID NO: 4055161 - DNA, 18 bp, Homo sapiens
actaagcctacctgctct

SEQ ID NO: 4055162 - DNA, 20 bp, Homo sapiens
actaagctttgccagctgct

SEQ ID NO: 4055163 - DNA, 21 bp, Homo sapiens
actaagctttgccagctgctg

SEQ ID NO: 4055164 - DNA, 17 bp, Homo sapiens
actaagttatagtatat

SEQ ID NO: 4055165 - DNA, 19 bp, Homo sapiens
actaatcgaactatgaact

SEQ ID NO: 4055166 - DNA, 20 bp, Homo sapiens
actaatctattgggttcatt

SEQ ID NO: 4055167 - DNA, 16 bp, Homo sapiens
actaatgtaaaatgat

SEQ ID NO: 4055168 - DNA, 18 bp, Homo sapiens
actaattcataatcactc

SEQ ID NO: 4055169 - DNA, 23 bp, Homo sapiens
actaattccacaccttttattga

SEQ ID NO: 4055170 - DNA, 20 bp, Homo sapiens
actaattggcctctttaaga

SEQ ID NO: 4055171 - DNA, 19 bp, Homo sapiens
actaatttcaaaatgcttt

SEQ ID NO: 4055172 - DNA, 20 bp, Homo sapiens
actaatttcaaaatgctttt

SEQ ID NO: 4055173 - DNA, 11 bp, Homo sapiens
actacaaatca

SEQ ID NO: 4055174 - DNA, 13 bp, Homo sapiens
actacacattttt

SEQ ID NO: 4055175 - DNA, 15 bp, Homo sapiens
actacacatttttaa

SEQ ID NO: 4055176 - DNA, 22 bp, Homo sapiens
actacacatttttaaattgtta

SEQ ID NO: 4055177 - DNA, 14 bp, Homo sapiens
actacacctggctg

SEQ ID NO: 4055178 - DNA, 18 bp, Homo sapiens
actacagagcagctcccc

SEQ ID NO: 4055179 - DNA, 19 bp, Homo sapiens
actacagagcagctcccca

SEQ ID NO: 4055180 - DNA, 13 bp, Homo sapiens
actacatctggga

SEQ ID NO: 4055181 - DNA, 15 bp, Homo sapiens
actacatctgggact

SEQ ID NO: 4055182 - DNA, 16 bp, Homo sapiens
actaccaatcccaact

SEQ ID NO: 4055183 - DNA, 18 bp, Homo sapiens
actaccctattctctctt

SEQ ID NO: 4055184 - DNA, 15 bp, Homo sapiens
actaccttatcactg

SEQ ID NO: 4055185 - DNA, 17 bp, Homo sapiens
actaccttgaaaataag

SEQ ID NO: 4055186 - DNA, 19 bp, Homo sapiens
actactagatgtctttagg

SEQ ID NO: 4055187 - DNA, 19 bp, Homo sapiens
actactagtttttactttt

SEQ ID NO: 4055188 - DNA, 12 bp, Homo sapiens
actactgcagca

SEQ ID NO: 4055189 - DNA, 13 bp, Homo sapiens
actactgcagcac

SEQ ID NO: 4055190 - DNA, 17 bp, Homo sapiens
actactgggtgtcattt

SEQ ID NO: 4055191 - DNA, 18 bp, Homo sapiens
actactgggtgtcatttc

SEQ ID NO: 4055192 - DNA, 19 bp, Homo sapiens
actactgggtgtcatttca

SEQ ID NO: 4055193 - DNA, 20 bp, Homo sapiens
actactgggtgtcatttcat

SEQ ID NO: 4055194 - DNA, 16 bp, Homo sapiens
actactgtgttcctgg

SEQ ID NO: 4055195 - DNA, 21 bp, Homo sapiens
actactgtgttcctggcaata

SEQ ID NO: 4055196 - DNA, 22 bp, Homo sapiens
actacttagcatcctaagaaat

SEQ ID NO: 4055197 - DNA, 23 bp, Homo sapiens
actacttcttttttcaaaagaaa

SEQ ID NO: 4055198 - DNA, 15 bp, Homo sapiens
actagaactctccat

SEQ ID NO: 4055199 - DNA, 23 bp, Homo sapiens
actagcaatctcttcattattct

SEQ ID NO: 4055200 - DNA, 15 bp, Homo sapiens
actagcctctccagg

SEQ ID NO: 4055201 - DNA, 15 bp, Homo sapiens
actaggaaggcactt

SEQ ID NO: 4055202 - DNA, 15 bp, Homo sapiens
actaggtaacttcat

SEQ ID NO: 4055203 - DNA, 14 bp, Homo sapiens
actaggtaatgttt

SEQ ID NO: 4055204 - DNA, 15 bp, Homo sapiens
actaggtaatgtttt

SEQ ID NO: 4055205 - DNA, 16 bp, Homo sapiens
actaggtaatgttttg

SEQ ID NO: 4055206 - DNA, 19 bp, Homo sapiens
actaggtaatgttttgtat

SEQ ID NO: 4055207 - DNA, 22 bp, Homo sapiens
actaggtaatgttttgtatata

SEQ ID NO: 4055208 - DNA, 23 bp, Homo sapiens
actaggtatttctaacgccagca

SEQ ID NO: 4055209 - DNA, 16 bp, Homo sapiens
actagtgacagcttgt

SEQ ID NO: 4055210 - DNA, 17 bp, Homo sapiens
actagtgccaatgatgt

SEQ ID NO: 4055211 - DNA, 13 bp, Homo sapiens
actagttacacat

SEQ ID NO: 4055212 - DNA, 14 bp, Homo sapiens
actataaatacaaa

SEQ ID NO: 4055213 - DNA, 18 bp, Homo sapiens
actataaatacaaatctg

SEQ ID NO: 4055214 - DNA, 19 bp, Homo sapiens
actataaatacaaatctgt

SEQ ID NO: 4055215 - DNA, 22 bp, Homo sapiens
actataaatacaaatctgtata

SEQ ID NO: 4055216 - DNA, 17 bp, Homo sapiens
actataacatatgtaca

SEQ ID NO: 4055217 - DNA, 12 bp, Homo sapiens
actataatgtaa

SEQ ID NO: 4055218 - DNA, 16 bp, Homo sapiens
actatagtttaaaaca

SEQ ID NO: 4055219 - DNA, 20 bp, Homo sapiens
actatataaccctaggaatt

SEQ ID NO: 4055220 - DNA, 19 bp, Homo sapiens
actatataatttatttcca

SEQ ID NO: 4055221 - DNA, 21 bp, Homo sapiens
actatataatttatttccact

SEQ ID NO: 4055222 - DNA, 21 bp, Homo sapiens
actatatgtgaaacatttttt

SEQ ID NO: 4055223 - DNA, 13 bp, Homo sapiens
actatatttgcta

SEQ ID NO: 4055224 - DNA, 15 bp, Homo sapiens
actatcctgacttct

SEQ ID NO: 4055225 - DNA, 21 bp, Homo sapiens
actatctaaatgttgaaagat

SEQ ID NO: 4055226 - DNA, 19 bp, Homo sapiens
actatcttcttcaaataca

SEQ ID NO: 4055227 - DNA, 23 bp, Homo sapiens
actatctttctgataacagaatt

SEQ ID NO: 4055228 - DNA, 16 bp, Homo sapiens
actatggctgagttct

SEQ ID NO: 4055229 - DNA, 15 bp, Homo sapiens
actatgggatgagaa

SEQ ID NO: 4055230 - DNA, 16 bp, Homo sapiens
actatgggatgagaaa

SEQ ID NO: 4055231 - DNA, 22 bp, Homo sapiens
actatggtagccagatgataaa

SEQ ID NO: 4055232 - DNA, 17 bp, Homo sapiens
actatggtgctgccttg

SEQ ID NO: 4055233 - DNA, 22 bp, Homo sapiens
actatggtgctgccttgcttct

SEQ ID NO: 4055234 - DNA, 21 bp, Homo sapiens
actatggttcccaataaaagt

SEQ ID NO: 4055235 - DNA, 18 bp, Homo sapiens
actatgtaggtaaattct

SEQ ID NO: 4055236 - DNA, 12 bp, Homo sapiens
actatgtatcaa

SEQ ID NO: 4055237 - DNA, 11 bp, Homo sapiens
actattattat

SEQ ID NO: 4055238 - DNA, 20 bp, Homo sapiens
actattattataggtaatca

SEQ ID NO: 4055239 - DNA, 14 bp, Homo sapiens
actattccctttga

SEQ ID NO: 4055240 - DNA, 23 bp, Homo sapiens
actattccctttgacttcagctg

SEQ ID NO: 4055241 - DNA, 18 bp, Homo sapiens
actattccttttctgtat

SEQ ID NO: 4055242 - DNA, 19 bp, Homo sapiens
actattccttttctgtata

SEQ ID NO: 4055243 - DNA, 15 bp, Homo sapiens
actattgcatttata

SEQ ID NO: 4055244 - DNA, 15 bp, Homo sapiens
actattgtgccaact

SEQ ID NO: 4055245 - DNA, 21 bp, Homo sapiens
actattgtgccaactgccagg

SEQ ID NO: 4055246 - DNA, 18 bp, Homo sapiens
actatttaaacttataaa

SEQ ID NO: 4055247 - DNA, 11 bp, Homo sapiens
actatttaaag

SEQ ID NO: 4055248 - DNA, 20 bp, Homo sapiens
actatttaaagcctcctcat

SEQ ID NO: 4055249 - DNA, 19 bp, Homo sapiens
actatttaagttatcaact

SEQ ID NO: 4055250 - DNA, 19 bp, Homo sapiens
actatttagtgttagttat

SEQ ID NO: 4055251 - DNA, 23 bp, Homo sapiens
actatttctgggtcttttgctac

SEQ ID NO: 4055252 - DNA, 18 bp, Homo sapiens
actatttttatttatatt

SEQ ID NO: 4055253 - DNA, 20 bp, Homo sapiens
actcaaatggggccagatcc

SEQ ID NO: 4055254 - DNA, 23 bp, Homo sapiens
actcaaatggggccagatccagc

SEQ ID NO: 4055255 - DNA, 22 bp, Homo sapiens
actcaacaaaaaaccgaggccc

SEQ ID NO: 4055256 - DNA, 21 bp, Homo sapiens
actcaacatgttactgaccag

SEQ ID NO: 4055257 - DNA, 17 bp, Homo sapiens
actcaagaagtgaagaa

SEQ ID NO: 4055258 - DNA, 21 bp, Homo sapiens
actcaagagaatttatgtgaa

SEQ ID NO: 4055259 - DNA, 15 bp, Homo sapiens
actcaagcactgata

SEQ ID NO: 4055260 - DNA, 17 bp, Homo sapiens
actcaagtacccattct

SEQ ID NO: 4055261 - DNA, 18 bp, Homo sapiens
actcaataaattgcaaca

SEQ ID NO: 4055262 - DNA, 23 bp, Homo sapiens
actcaataaattgcaacatatta

SEQ ID NO: 4055263 - DNA, 13 bp, Homo sapiens
actcacaaatgat

SEQ ID NO: 4055264 - DNA, 15 bp, Homo sapiens
actcacaggaaggag

SEQ ID NO: 4055265 - DNA, 21 bp, Homo sapiens
actcacccatgtgccaaggtg

SEQ ID NO: 4055266 - DNA, 19 bp, Homo sapiens
actcaccccggcagacgcc

SEQ ID NO: 4055267 - DNA, 14 bp, Homo sapiens
actcactgaagcct

SEQ ID NO: 4055268 - DNA, 16 bp, Homo sapiens
actcacttacatcttc

SEQ ID NO: 4055269 - DNA, 18 bp, Homo sapiens
actcagaattatttttaa

SEQ ID NO: 4055270 - DNA, 14 bp, Homo sapiens
actcagatccaggg

SEQ ID NO: 4055271 - DNA, 14 bp, Homo sapiens
actcagcagtgacc

SEQ ID NO: 4055272 - DNA, 14 bp, Homo sapiens
actcagccaagaca

SEQ ID NO: 4055273 - DNA, 15 bp, Homo sapiens
actcagccctgaggt

SEQ ID NO: 4055274 - DNA, 19 bp, Homo sapiens
actcagctgtcctgcagca

SEQ ID NO: 4055275 - DNA, 17 bp, Homo sapiens
actcagcttcctaccca

SEQ ID NO: 4055276 - DNA, 17 bp, Homo sapiens
actcaggaggctgaggc

SEQ ID NO: 4055277 - DNA, 19 bp, Homo sapiens
actcaggaggctgaggcag

SEQ ID NO: 4055278 - DNA, 18 bp, Homo sapiens
actcaggatccagtccct

SEQ ID NO: 4055279 - DNA, 16 bp, Homo sapiens
actcaggcctgtgccc

SEQ ID NO: 4055280 - DNA, 18 bp, Homo sapiens
actcaggcctgtgcccac

SEQ ID NO: 4055281 - DNA, 13 bp, Homo sapiens
actcagggacaga

SEQ ID NO: 4055282 - DNA, 15 bp, Homo sapiens
actcagggacagagc

SEQ ID NO: 4055283 - DNA, 17 bp, Homo sapiens
actcagggacagagcca

SEQ ID NO: 4055284 - DNA, 22 bp, Homo sapiens
actcagggaccggtgctgcagg

SEQ ID NO: 4055285 - DNA, 20 bp, Homo sapiens
actcagggcagcgccaggct

SEQ ID NO: 4055286 - DNA, 18 bp, Homo sapiens
actcagggccatgcctgc

SEQ ID NO: 4055287 - DNA, 16 bp, Homo sapiens
actcagggttcatctg

SEQ ID NO: 4055288 - DNA, 17 bp, Homo sapiens
actcagggttcatctgt

SEQ ID NO: 4055289 - DNA, 15 bp, Homo sapiens
actcaggtgggccct

SEQ ID NO: 4055290 - DNA, 23 bp, Homo sapiens
actcagtgagcctcctgtgcctg

SEQ ID NO: 4055291 - DNA, 20 bp, Homo sapiens
actcagtgttagagaaatcc

SEQ ID NO: 4055292 - DNA, 16 bp, Homo sapiens
actcagtttatgctgt

SEQ ID NO: 4055293 - DNA, 20 bp, Homo sapiens
actcagtttatgttgtacaa

SEQ ID NO: 4055294 - DNA, 23 bp, Homo sapiens
actcagtttatgttgtacaatgt

SEQ ID NO: 4055295 - DNA, 14 bp, Homo sapiens
actcagtttgtcag

SEQ ID NO: 4055296 - DNA, 15 bp, Homo sapiens
actcagtttgtcaga

SEQ ID NO: 4055297 - DNA, 15 bp, Homo sapiens
actcagttttaacta

SEQ ID NO: 4055298 - DNA, 22 bp, Homo sapiens
actcagttttaactagaattta

SEQ ID NO: 4055299 - DNA, 13 bp, Homo sapiens
actcatagttttt

SEQ ID NO: 4055300 - DNA, 20 bp, Homo sapiens
actcatattctgggctcctg

SEQ ID NO: 4055301 - DNA, 14 bp, Homo sapiens
actcatcataaaat

SEQ ID NO: 4055302 - DNA, 22 bp, Homo sapiens
actcatggcagctgtttctcat

SEQ ID NO: 4055303 - DNA, 13 bp, Homo sapiens
actcattcagtcc

SEQ ID NO: 4055304 - DNA, 15 bp, Homo sapiens
actcattgctgagcc

SEQ ID NO: 4055305 - DNA, 20 bp, Homo sapiens
actcattgctgagcctctgc

SEQ ID NO: 4055306 - DNA, 22 bp, Homo sapiens
actcattgctgagcctctgctc

SEQ ID NO: 4055307 - DNA, 15 bp, Homo sapiens
actcattttctataa

SEQ ID NO: 4055308 - DNA, 12 bp, Homo sapiens
actcattttgct

SEQ ID NO: 4055309 - DNA, 14 bp, Homo sapiens
actcattttgcttg

SEQ ID NO: 4055310 - DNA, 20 bp, Homo sapiens
actccaactcccttaaaata

SEQ ID NO: 4055311 - DNA, 19 bp, Homo sapiens
actccacaaatgatgtttt

SEQ ID NO: 4055312 - DNA, 15 bp, Homo sapiens
actccacatctgcct

SEQ ID NO: 4055313 - DNA, 17 bp, Homo sapiens
actccacatctgcctta

SEQ ID NO: 4055314 - DNA, 19 bp, Homo sapiens
actccaccagatagcagag

SEQ ID NO: 4055315 - DNA, 16 bp, Homo sapiens
actccaccctccacct

SEQ ID NO: 4055316 - DNA, 20 bp, Homo sapiens
actccaccgaccaactgccc

SEQ ID NO: 4055317 - DNA, 18 bp, Homo sapiens
actccagacccctggctt

SEQ ID NO: 4055318 - DNA, 19 bp, Homo sapiens
actccagcctggcgacaga

SEQ ID NO: 4055319 - DNA, 22 bp, Homo sapiens
actccaggaaagagcagtcaga

SEQ ID NO: 4055320 - DNA, 15 bp, Homo sapiens
actccaggccctcct

SEQ ID NO: 4055321 - DNA, 22 bp, Homo sapiens
actccaggcctctagttccaga

SEQ ID NO: 4055322 - DNA, 19 bp, Homo sapiens
actccagtgccagcaatga

SEQ ID NO: 4055323 - DNA, 16 bp, Homo sapiens
actccagtggtgaaga

SEQ ID NO: 4055324 - DNA, 18 bp, Homo sapiens
actccagtggtgaagaaa

SEQ ID NO: 4055325 - DNA, 14 bp, Homo sapiens
actccagtgtacat

SEQ ID NO: 4055326 - DNA, 14 bp, Homo sapiens
actccatctcctgc

SEQ ID NO: 4055327 - DNA, 23 bp, Homo sapiens
actccatctcctgctcaccacct

SEQ ID NO: 4055328 - DNA, 11 bp, Homo sapiens
actccatctct

SEQ ID NO: 4055329 - DNA, 14 bp, Homo sapiens
actccatctcttct

SEQ ID NO: 4055330 - DNA, 15 bp, Homo sapiens
actcccaacttcttc

SEQ ID NO: 4055331 - DNA, 17 bp, Homo sapiens
actcccaacttcttcct

SEQ ID NO: 4055332 - DNA, 11 bp, Homo sapiens
actcccacctc

SEQ ID NO: 4055333 - DNA, 15 bp, Homo sapiens
actcccatcagccca

SEQ ID NO: 4055334 - DNA, 20 bp, Homo sapiens
actcccattcctgaagaacc

SEQ ID NO: 4055335 - DNA, 19 bp, Homo sapiens
actccccaaggaagagcca

SEQ ID NO: 4055336 - DNA, 12 bp, Homo sapiens
actccccaggcc

SEQ ID NO: 4055337 - DNA, 19 bp, Homo sapiens
actccccaggccaggccac

SEQ ID NO: 4055338 - DNA, 11 bp, Homo sapiens
actccccaggg

SEQ ID NO: 4055339 - DNA, 21 bp, Homo sapiens
actccccctaaacccctgtcc

SEQ ID NO: 4055340 - DNA, 17 bp, Homo sapiens
actcccgcctcagggcc

SEQ ID NO: 4055341 - DNA, 19 bp, Homo sapiens
actcccgcctcagggccag

SEQ ID NO: 4055342 - DNA, 20 bp, Homo sapiens
actcccgcctcagggccagg

SEQ ID NO: 4055343 - DNA, 22 bp, Homo sapiens
actcccgcctcagggccaggcc

SEQ ID NO: 4055344 - DNA, 22 bp, Homo sapiens
actcccgggccacgccccagcc

SEQ ID NO: 4055345 - DNA, 23 bp, Homo sapiens
actcccgggccacgccccagccc

SEQ ID NO: 4055346 - DNA, 22 bp, Homo sapiens
actccctcctcacctctggact

SEQ ID NO: 4055347 - DNA, 15 bp, Homo sapiens
actccctctgccttc

SEQ ID NO: 4055348 - DNA, 16 bp, Homo sapiens
actccctctgccttca

SEQ ID NO: 4055349 - DNA, 17 bp, Homo sapiens
actccctggctctcaga

SEQ ID NO: 4055350 - DNA, 17 bp, Homo sapiens
actccgccctcctcggg

SEQ ID NO: 4055351 - DNA, 23 bp, Homo sapiens
actccgccctcctcgggccgagg

SEQ ID NO: 4055352 - DNA, 19 bp, Homo sapiens
actccggcctgatgacaga

SEQ ID NO: 4055353 - DNA, 23 bp, Homo sapiens
actccggcctgatgacagagcga

SEQ ID NO: 4055354 - DNA, 21 bp, Homo sapiens
actcctacatgatgttatgta

SEQ ID NO: 4055355 - DNA, 17 bp, Homo sapiens
actcctacctgccctgg

SEQ ID NO: 4055356 - DNA, 23 bp, Homo sapiens
actcctagagaacgcagccctag

SEQ ID NO: 4055357 - DNA, 14 bp, Homo sapiens
actcctaggagagc

SEQ ID NO: 4055358 - DNA, 21 bp, Homo sapiens
actcctaggagagccaacctc

SEQ ID NO: 4055359 - DNA, 11 bp, Homo sapiens
actcctccctc

SEQ ID NO: 4055360 - DNA, 16 bp, Homo sapiens
actcctcctttttcca

SEQ ID NO: 4055361 - DNA, 23 bp, Homo sapiens
actcctctaagccactcttccaa

SEQ ID NO: 4055362 - DNA, 14 bp, Homo sapiens
actcctctggcttt

SEQ ID NO: 4055363 - DNA, 21 bp, Homo sapiens
actcctctggctttcccagga

SEQ ID NO: 4055364 - DNA, 22 bp, Homo sapiens
actcctctggctttcccaggag

SEQ ID NO: 4055365 - DNA, 11 bp, Homo sapiens
actcctgactc

SEQ ID NO: 4055366 - DNA, 23 bp, Homo sapiens
actcctgccaggcacacacagcc

SEQ ID NO: 4055367 - DNA, 14 bp, Homo sapiens
actcctgcctcatg

SEQ ID NO: 4055368 - DNA, 10 bp, Homo sapiens
actcctgctc

SEQ ID NO: 4055369 - DNA, 13 bp, Homo sapiens
actcctgctctgc

SEQ ID NO: 4055370 - DNA, 13 bp, Homo sapiens
actcctgtacact

SEQ ID NO: 4055371 - DNA, 15 bp, Homo sapiens
actcctgtacactga

SEQ ID NO: 4055372 - DNA, 17 bp, Homo sapiens
actcctgtacactgaat

SEQ ID NO: 4055373 - DNA, 18 bp, Homo sapiens
actcctgtacactgaata

SEQ ID NO: 4055374 - DNA, 13 bp, Homo sapiens
actcctgtccctt

SEQ ID NO: 4055375 - DNA, 16 bp, Homo sapiens
actcctgttacttacc

SEQ ID NO: 4055376 - DNA, 14 bp, Homo sapiens
actccttcctggcc

SEQ ID NO: 4055377 - DNA, 22 bp, Homo sapiens
actccttgttagcccttcagat

SEQ ID NO: 4055378 - DNA, 17 bp, Homo sapiens
actcgagaccttttcaa

SEQ ID NO: 4055379 - DNA, 14 bp, Homo sapiens
actcgcacctgtgc

SEQ ID NO: 4055380 - DNA, 15 bp, Homo sapiens
actcgtgagcgccag

SEQ ID NO: 4055381 - DNA, 17 bp, Homo sapiens
actctaaaaaacatttt

SEQ ID NO: 4055382 - DNA, 18 bp, Homo sapiens
actctaaaaaacattttt

SEQ ID NO: 4055383 - DNA, 19 bp, Homo sapiens
actctaaaaaacattttta

SEQ ID NO: 4055384 - DNA, 13 bp, Homo sapiens
actctaaactgca

SEQ ID NO: 4055385 - DNA, 15 bp, Homo sapiens
actctaaactgcaaa

SEQ ID NO: 4055386 - DNA, 22 bp, Homo sapiens
actctaaactgcaaacagaaat

SEQ ID NO: 4055387 - DNA, 13 bp, Homo sapiens
actctaaatgcag

SEQ ID NO: 4055388 - DNA, 20 bp, Homo sapiens
actctaattcccattttgca

SEQ ID NO: 4055389 - DNA, 18 bp, Homo sapiens
actctaccaaataatttc

SEQ ID NO: 4055390 - DNA, 19 bp, Homo sapiens
actctacccatattacaga

SEQ ID NO: 4055391 - DNA, 15 bp, Homo sapiens
actctacccctgctc

SEQ ID NO: 4055392 - DNA, 23 bp, Homo sapiens
actctacctaatgtctcactgtt

SEQ ID NO: 4055393 - DNA, 13 bp, Homo sapiens
actctacctcata

SEQ ID NO: 4055394 - DNA, 21 bp, Homo sapiens
actctagatgaagttttacat

SEQ ID NO: 4055395 - DNA, 19 bp, Homo sapiens
actctcaggatcaagaaag

SEQ ID NO: 4055396 - DNA, 16 bp, Homo sapiens
actctccaatgttcta

SEQ ID NO: 4055397 - DNA, 19 bp, Homo sapiens
actctccaatgttctatta

SEQ ID NO: 4055398 - DNA, 14 bp, Homo sapiens
actctccccacact

SEQ ID NO: 4055399 - DNA, 19 bp, Homo sapiens
actctccccacgagggctg

SEQ ID NO: 4055400 - DNA, 18 bp, Homo sapiens
actctctaaatcttcctt

SEQ ID NO: 4055401 - DNA, 19 bp, Homo sapiens
actctctaaatcttccttg

SEQ ID NO: 4055402 - DNA, 13 bp, Homo sapiens
actctctgcctgg

SEQ ID NO: 4055403 - DNA, 21 bp, Homo sapiens
actctcttccctttccccagc

SEQ ID NO: 4055404 - DNA, 15 bp, Homo sapiens
actctgaagcctctg

SEQ ID NO: 4055405 - DNA, 13 bp, Homo sapiens
actctgagcccat

SEQ ID NO: 4055406 - DNA, 16 bp, Homo sapiens
actctgagctgctcac

SEQ ID NO: 4055407 - DNA, 20 bp, Homo sapiens
actctgccccacgctgtggc

SEQ ID NO: 4055408 - DNA, 19 bp, Homo sapiens
actctgccccctgctggct

SEQ ID NO: 4055409 - DNA, 19 bp, Homo sapiens
actctgcccctggacctgg

SEQ ID NO: 4055410 - DNA, 19 bp, Homo sapiens
actctgcctacagaacttc

SEQ ID NO: 4055411 - DNA, 15 bp, Homo sapiens
actctgcctttctaa

SEQ ID NO: 4055412 - DNA, 13 bp, Homo sapiens
actctggccctgg

SEQ ID NO: 4055413 - DNA, 15 bp, Homo sapiens
actctggccctggcc

SEQ ID NO: 4055414 - DNA, 17 bp, Homo sapiens
actctggccctggccct

SEQ ID NO: 4055415 - DNA, 11 bp, Homo sapiens
actctggcctc

SEQ ID NO: 4055416 - DNA, 14 bp, Homo sapiens
actctggcttccag

SEQ ID NO: 4055417 - DNA, 19 bp, Homo sapiens
actctgggaaataagagag

SEQ ID NO: 4055418 - DNA, 17 bp, Homo sapiens
actctggggtgctgcct

SEQ ID NO: 4055419 - DNA, 15 bp, Homo sapiens
actctggtgctcctg

SEQ ID NO: 4055420 - DNA, 15 bp, Homo sapiens
actctgtaaaaacac

SEQ ID NO: 4055421 - DNA, 23 bp, Homo sapiens
actctgtcaatttccctgactcc

SEQ ID NO: 4055422 - DNA, 11 bp, Homo sapiens
actctgtccag

SEQ ID NO: 4055423 - DNA, 22 bp, Homo sapiens
actctgtctcaataatataata

SEQ ID NO: 4055424 - DNA, 13 bp, Homo sapiens
actctgtgtttaa

SEQ ID NO: 4055425 - DNA, 22 bp, Homo sapiens
actctgttcccccaccctccat

SEQ ID NO: 4055426 - DNA, 20 bp, Homo sapiens
actctgttgcaagtgcaata

SEQ ID NO: 4055427 - DNA, 17 bp, Homo sapiens
actcttaaatgatctgc

SEQ ID NO: 4055428 - DNA, 20 bp, Homo sapiens
actcttaaatgatctgcctc

SEQ ID NO: 4055429 - DNA, 15 bp, Homo sapiens
actcttaatctgtgt

SEQ ID NO: 4055430 - DNA, 22 bp, Homo sapiens
actcttaccatatgtttggtaa

SEQ ID NO: 4055431 - DNA, 14 bp, Homo sapiens
actcttactcctta

SEQ ID NO: 4055432 - DNA, 17 bp, Homo sapiens
actcttcctccaaggac

SEQ ID NO: 4055433 - DNA, 20 bp, Homo sapiens
actcttcctccaaggacaga

SEQ ID NO: 4055434 - DNA, 15 bp, Homo sapiens
actcttcctgcaagg

SEQ ID NO: 4055435 - DNA, 14 bp, Homo sapiens
actcttctcggctc

SEQ ID NO: 4055436 - DNA, 16 bp, Homo sapiens
actcttctcggctcag

SEQ ID NO: 4055437 - DNA, 19 bp, Homo sapiens
actcttctctctgctctga

SEQ ID NO: 4055438 - DNA, 17 bp, Homo sapiens
actcttgaagtacttaa

SEQ ID NO: 4055439 - DNA, 21 bp, Homo sapiens
actcttgatctctcttgtcct

SEQ ID NO: 4055440 - DNA, 14 bp, Homo sapiens
actcttgatgtgaa

SEQ ID NO: 4055441 - DNA, 16 bp, Homo sapiens
actctttctaatgctg

SEQ ID NO: 4055442 - DNA, 14 bp, Homo sapiens
actctttctgtata

SEQ ID NO: 4055443 - DNA, 15 bp, Homo sapiens
actctttgctgctgc

SEQ ID NO: 4055444 - DNA, 12 bp, Homo sapiens
actcttttgctt

SEQ ID NO: 4055445 - DNA, 20 bp, Homo sapiens
actcttttgctttattccag

SEQ ID NO: 4055446 - DNA, 20 bp, Homo sapiens
actgaaaaggaggggtctgg

SEQ ID NO: 4055447 - DNA, 13 bp, Homo sapiens
actgaaacttccc

SEQ ID NO: 4055448 - DNA, 18 bp, Homo sapiens
actgaaagttttgtaaaa

SEQ ID NO: 4055449 - DNA, 18 bp, Homo sapiens
actgaactcactttcctc

SEQ ID NO: 4055450 - DNA, 15 bp, Homo sapiens
actgaagcctgcagg

SEQ ID NO: 4055451 - DNA, 19 bp, Homo sapiens
actgaagcctgcaggagtt

SEQ ID NO: 4055452 - DNA, 22 bp, Homo sapiens
actgaaggaaaaacacaagcaa

SEQ ID NO: 4055453 - DNA, 23 bp, Homo sapiens
actgaaggaaaaacacaagcaaa

SEQ ID NO: 4055454 - DNA, 15 bp, Homo sapiens
actgaagtcagttct

SEQ ID NO: 4055455 - DNA, 13 bp, Homo sapiens
actgaagtgctta

SEQ ID NO: 4055456 - DNA, 19 bp, Homo sapiens
actgaagtttcacatgagc

SEQ ID NO: 4055457 - DNA, 21 bp, Homo sapiens
actgaatataaagcttaataa

SEQ ID NO: 4055458 - DNA, 18 bp, Homo sapiens
actgaatattttggaaac

SEQ ID NO: 4055459 - DNA, 16 bp, Homo sapiens
actgaatgctctgtgc

SEQ ID NO: 4055460 - DNA, 20 bp, Homo sapiens
actgaatgttttatttatca

SEQ ID NO: 4055461 - DNA, 21 bp, Homo sapiens
actgaattaatcatctataaa

SEQ ID NO: 4055462 - DNA, 15 bp, Homo sapiens
actgaatttttttgt

SEQ ID NO: 4055463 - DNA, 18 bp, Homo sapiens
actgacagcctcccaccc

SEQ ID NO: 4055464 - DNA, 12 bp, Homo sapiens
actgacatgtgg

SEQ ID NO: 4055465 - DNA, 14 bp, Homo sapiens
actgaccagacaag

SEQ ID NO: 4055466 - DNA, 16 bp, Homo sapiens
actgaccatccactct

SEQ ID NO: 4055467 - DNA, 18 bp, Homo sapiens
actgactatcataaaatc

SEQ ID NO: 4055468 - DNA, 20 bp, Homo sapiens
actgactggaggaggcctgt

SEQ ID NO: 4055469 - DNA, 24 bp, Homo sapiens
actgacttgtttgtcttccattcc

SEQ ID NO: 4055470 - DNA, 17 bp, Homo sapiens
actgactttaagtaatc

SEQ ID NO: 4055471 - DNA, 15 bp, Homo sapiens
actgactttatcctc

SEQ ID NO: 4055472 - DNA, 13 bp, Homo sapiens
actgactttgctt

SEQ ID NO: 4055473 - DNA, 15 bp, Homo sapiens
actgactttgcttgc

SEQ ID NO: 4055474 - DNA, 17 bp, Homo sapiens
actgactttgcttgctt

SEQ ID NO: 4055475 - DNA, 23 bp, Homo sapiens
actgactttgcttgctttgaagt

SEQ ID NO: 4055476 - DNA, 22 bp, Homo sapiens
actgagcaagatcttgtctcca

SEQ ID NO: 4055477 - DNA, 12 bp, Homo sapiens
actgagcagccg

SEQ ID NO: 4055478 - DNA, 19 bp, Homo sapiens
actgagcgtagcatacagg

SEQ ID NO: 4055479 - DNA, 12 bp, Homo sapiens
actgagctgaga

SEQ ID NO: 4055480 - DNA, 18 bp, Homo sapiens
actgagcttctctgtgaa

SEQ ID NO: 4055481 - DNA, 21 bp, Homo sapiens
actgaggcctaaaagtaaaca

SEQ ID NO: 4055482 - DNA, 22 bp, Homo sapiens
actgagggaccaactgggccca

SEQ ID NO: 4055483 - DNA, 14 bp, Homo sapiens
actgagggactctg

SEQ ID NO: 4055484 - DNA, 18 bp, Homo sapiens
actgagggactctgaagc

SEQ ID NO: 4055485 - DNA, 12 bp, Homo sapiens
actgagggccac

SEQ ID NO: 4055486 - DNA, 22 bp, Homo sapiens
actgagggccacactattacca

SEQ ID NO: 4055487 - DNA, 17 bp, Homo sapiens
actgagtaccaggggct

SEQ ID NO: 4055488 - DNA, 22 bp, Homo sapiens
actgatatatcatgagtgaata

SEQ ID NO: 4055489 - DNA, 19 bp, Homo sapiens
actgatatatttaaaaaca

SEQ ID NO: 4055490 - DNA, 23 bp, Homo sapiens
actgatgaaatctgctagaaagt

SEQ ID NO: 4055491 - DNA, 17 bp, Homo sapiens
actgatgattttccttt

SEQ ID NO: 4055492 - DNA, 14 bp, Homo sapiens
actgatgctgcccc

SEQ ID NO: 4055493 - DNA, 22 bp, Homo sapiens
actgatggctaatgtactgcat

SEQ ID NO: 4055494 - DNA, 22 bp, Homo sapiens
actgatgttacatcacagtgtt

SEQ ID NO: 4055495 - DNA, 18 bp, Homo sapiens
actgattattttcttcat

SEQ ID NO: 4055496 - DNA, 13 bp, Homo sapiens
actgatttcacaa

SEQ ID NO: 4055497 - DNA, 12 bp, Homo sapiens
actgatttcttc

SEQ ID NO: 4055498 - DNA, 23 bp, Homo sapiens
actgcaaacttttttatatcttt

SEQ ID NO: 4055499 - DNA, 16 bp, Homo sapiens
actgcaagaaaatgat

SEQ ID NO: 4055500 - DNA, 14 bp, Homo sapiens
actgcaagctgctt

SEQ ID NO: 4055501 - DNA, 15 bp, Homo sapiens
actgcaagctgcttg

SEQ ID NO: 4055502 - DNA, 18 bp, Homo sapiens
actgcaataacttctgac

SEQ ID NO: 4055503 - DNA, 20 bp, Homo sapiens
actgcaataacttctgacct

SEQ ID NO: 4055504 - DNA, 15 bp, Homo sapiens
actgcaatagagact

SEQ ID NO: 4055505 - DNA, 17 bp, Homo sapiens
actgcaatagagactgt

SEQ ID NO: 4055506 - DNA, 18 bp, Homo sapiens
actgcaatagagactgta

SEQ ID NO: 4055507 - DNA, 22 bp, Homo sapiens
actgcacagtgcatctcagccc

SEQ ID NO: 4055508 - DNA, 13 bp, Homo sapiens
actgcacccagct

SEQ ID NO: 4055509 - DNA, 22 bp, Homo sapiens
actgcacccagctccaggggcc

SEQ ID NO: 4055510 - DNA, 16 bp, Homo sapiens
actgcactccagcctg

SEQ ID NO: 4055511 - DNA, 18 bp, Homo sapiens
actgcactccagcctggg

SEQ ID NO: 4055512 - DNA, 21 bp, Homo sapiens
actgcagaccatgaagtaaat

SEQ ID NO: 4055513 - DNA, 12 bp, Homo sapiens
actgcagcacct

SEQ ID NO: 4055514 - DNA, 21 bp, Homo sapiens
actgcagcacctccaggcctg

SEQ ID NO: 4055515 - DNA, 20 bp, Homo sapiens
actgcagcttgagtttttag

SEQ ID NO: 4055516 - DNA, 16 bp, Homo sapiens
actgcagtcttatttc

SEQ ID NO: 4055517 - DNA, 15 bp, Homo sapiens
actgcagtttcctgg

SEQ ID NO: 4055518 - DNA, 15 bp, Homo sapiens
actgcattattctct

SEQ ID NO: 4055519 - DNA, 20 bp, Homo sapiens
actgcattattctcttttat

SEQ ID NO: 4055520 - DNA, 16 bp, Homo sapiens
actgccaggccagcct

SEQ ID NO: 4055521 - DNA, 23 bp, Homo sapiens
actgccaggccagcctccgagag

SEQ ID NO: 4055522 - DNA, 15 bp, Homo sapiens
actgccaggctgcct

SEQ ID NO: 4055523 - DNA, 16 bp, Homo sapiens
actgcccatggacagg

SEQ ID NO: 4055524 - DNA, 22 bp, Homo sapiens
actgccccccatgaggaaggaa

SEQ ID NO: 4055525 - DNA, 14 bp, Homo sapiens
actgcccgagctgg

SEQ ID NO: 4055526 - DNA, 15 bp, Homo sapiens
actgcccgagctggt

SEQ ID NO: 4055527 - DNA, 14 bp, Homo sapiens
actgtatggaaaca

SEQ ID NO: 4055528 - DNA, 18 bp, Homo sapiens
actgtcaataaacagctt

SEQ ID NO: 4055529 - DNA, 23 bp, Homo sapiens
actgtcactcattgctgagcctc

SEQ ID NO: 4055530 - DNA, 19 bp, Homo sapiens
actgtcactttgctctggg

SEQ ID NO: 4055531 - DNA, 15 bp, Homo sapiens
actgtcatgcttcat

SEQ ID NO: 4055532 - DNA, 13 bp, Homo sapiens
actgtccagagag

SEQ ID NO: 4055533 - DNA, 16 bp, Homo sapiens
actgtccccctaccca

SEQ ID NO: 4055534 - DNA, 19 bp, Homo sapiens
actgtccctcccttgctga

SEQ ID NO: 4055535 - DNA, 12 bp, Homo sapiens
actgtccctctt

SEQ ID NO: 4055536 - DNA, 16 bp, Homo sapiens
actgtcccttgcctca

SEQ ID NO: 4055537 - DNA, 18 bp, Homo sapiens
actgtcctctcccctcca

SEQ ID NO: 4055538 - DNA, 13 bp, Homo sapiens
actgtcctgtcct

SEQ ID NO: 4055539 - DNA, 15 bp, Homo sapiens
actgtcctgtcctgc

SEQ ID NO: 4055540 - DNA, 17 bp, Homo sapiens
actgtcctgtcctgctc

SEQ ID NO: 4055541 - DNA, 21 bp, Homo sapiens
actgtctagcacttccttgcc

SEQ ID NO: 4055542 - DNA, 19 bp, Homo sapiens
actgtctcaagagggcact

SEQ ID NO: 4055543 - DNA, 19 bp, Homo sapiens
actgtctttaaaagagaga

SEQ ID NO: 4055544 - DNA, 22 bp, Homo sapiens
actgtgaacttgactgggtgag

SEQ ID NO: 4055545 - DNA, 17 bp, Homo sapiens
actgtgaagacccagca

SEQ ID NO: 4055546 - DNA, 21 bp, Homo sapiens
actgtgaagacccagcaggaa

SEQ ID NO: 4055547 - DNA, 15 bp, Homo sapiens
actgtgaaggaccct

SEQ ID NO: 4055548 - DNA, 22 bp, Homo sapiens
actgtgaagttacatgcataaa

SEQ ID NO: 4055549 - DNA, 23 bp, Homo sapiens
actgtgacaactgtctaacttta

SEQ ID NO: 4055550 - DNA, 14 bp, Homo sapiens
actgtgaccacctt

SEQ ID NO: 4055551 - DNA, 16 bp, Homo sapiens
actgtgaccaccttct

SEQ ID NO: 4055552 - DNA, 21 bp, Homo sapiens
actgtgaccaccttctgtccc

SEQ ID NO: 4055553 - DNA, 11 bp, Homo sapiens
actgtgactga

SEQ ID NO: 4055554 - DNA, 13 bp, Homo sapiens
actgtgatgccac

SEQ ID NO: 4055555 - DNA, 20 bp, Homo sapiens
actgtgatgccacacagagt

SEQ ID NO: 4055556 - DNA, 22 bp, Homo sapiens
actgtgatgccacacagagtgg

SEQ ID NO: 4055557 - DNA, 22 bp, Homo sapiens
actgtgattcagaaaatgttct

SEQ ID NO: 4055558 - DNA, 12 bp, Homo sapiens
actgtgcactgc

SEQ ID NO: 4055559 - DNA, 17 bp, Homo sapiens
actgtgcactgccctgt

SEQ ID NO: 4055560 - DNA, 14 bp, Homo sapiens
actgtgcagaataa

SEQ ID NO: 4055561 - DNA, 16 bp, Homo sapiens
actgtgcagaataatg

SEQ ID NO: 4055562 - DNA, 22 bp, Homo sapiens
actgtgcagaataatggaaaca

SEQ ID NO: 4055563 - DNA, 19 bp, Homo sapiens
actgtgcatagtgctggga

SEQ ID NO: 4055564 - DNA, 22 bp, Homo sapiens
actgtgcgcataggcctgcttt

SEQ ID NO: 4055565 - DNA, 18 bp, Homo sapiens
actgtggaaggcctccct

SEQ ID NO: 4055566 - DNA, 22 bp, Homo sapiens
actgtggaggaaggattgtaaa

SEQ ID NO: 4055567 - DNA, 16 bp, Homo sapiens
actgtggcgttctgct

SEQ ID NO: 4055568 - DNA, 17 bp, Homo sapiens
actgtgtaaatatatgt

SEQ ID NO: 4055569 - DNA, 14 bp, Homo sapiens
actgtgtactgttc

SEQ ID NO: 4055570 - DNA, 15 bp, Homo sapiens
actgtgtgtgtgaat

SEQ ID NO: 4055571 - DNA, 22 bp, Homo sapiens
actgtgtgtgtgaatgaacact

SEQ ID NO: 4055572 - DNA, 12 bp, Homo sapiens
actgtgttcctg

SEQ ID NO: 4055573 - DNA, 15 bp, Homo sapiens
actgtgttcctggca

SEQ ID NO: 4055574 - DNA, 20 bp, Homo sapiens
actgttacctaaagtatttt

SEQ ID NO: 4055575 - DNA, 16 bp, Homo sapiens
actgttactccacagc

SEQ ID NO: 4055576 - DNA, 18 bp, Homo sapiens
actgttaggaacagcagt

SEQ ID NO: 4055577 - DNA, 19 bp, Homo sapiens
actgttcaagtgtccccag

SEQ ID NO: 4055578 - DNA, 18 bp, Homo sapiens
actgttccctctgctcct

SEQ ID NO: 4055579 - DNA, 12 bp, Homo sapiens
actgttgcattt

SEQ ID NO: 4055580 - DNA, 15 bp, Homo sapiens
actgttgcatttact

SEQ ID NO: 4055581 - DNA, 16 bp, Homo sapiens
actgttgcatttactt

SEQ ID NO: 4055582 - DNA, 17 bp, Homo sapiens
actgttgcatttacttt

SEQ ID NO: 4055583 - DNA, 21 bp, Homo sapiens
actgttgcatttacttttaat

SEQ ID NO: 4055584 - DNA, 22 bp, Homo sapiens
actgtttatttctgtttctcat

SEQ ID NO: 4055585 - DNA, 20 bp, Homo sapiens
actgtttcactgaaatgttt

SEQ ID NO: 4055586 - DNA, 21 bp, Homo sapiens
actgtttgccttctactttta

SEQ ID NO: 4055587 - DNA, 22 bp, Homo sapiens
actgtttgccttctacttttaa

SEQ ID NO: 4055588 - DNA, 21 bp, Homo sapiens
actgtttggcttataaacaca

SEQ ID NO: 4055589 - DNA, 13 bp, Homo sapiens
actgttttcaaat

SEQ ID NO: 4055590 - DNA, 22 bp, Homo sapiens
actgttttctctcggctcccca

SEQ ID NO: 4055591 - DNA, 23 bp, Homo sapiens
actgttttctctcggctccccat

SEQ ID NO: 4055592 - DNA, 14 bp, Homo sapiens
actgtttttaagta

SEQ ID NO: 4055593 - DNA, 19 bp, Homo sapiens
actgtttttgaaaaattac

SEQ ID NO: 4055594 - DNA, 14 bp, Homo sapiens
acttaaaaaaatga

SEQ ID NO: 4055595 - DNA, 14 bp, Homo sapiens
acttaaaaaatgtc

SEQ ID NO: 4055596 - DNA, 19 bp, Homo sapiens
acttaaaaatgtaaatatt

SEQ ID NO: 4055597 - DNA, 23 bp, Homo sapiens
acttaaaaatgtaaatattctat

SEQ ID NO: 4055598 - DNA, 23 bp, Homo sapiens
acttaaaataggggatatttaag

SEQ ID NO: 4055599 - DNA, 13 bp, Homo sapiens
acttaaaatattt

SEQ ID NO: 4055600 - DNA, 17 bp, Homo sapiens
acttaacggctccagga

SEQ ID NO: 4055601 - DNA, 19 bp, Homo sapiens
acttaacggctccaggatt

SEQ ID NO: 4055602 - DNA, 19 bp, Homo sapiens
acttaagcaaaagaaaaag

SEQ ID NO: 4055603 - DNA, 13 bp, Homo sapiens
acttaataaattc

SEQ ID NO: 4055604 - DNA, 13 bp, Homo sapiens
acttaataactgt

SEQ ID NO: 4055605 - DNA, 17 bp, Homo sapiens
acttaataactgtgtac

SEQ ID NO: 4055606 - DNA, 16 bp, Homo sapiens
acttaatcaaaactca

SEQ ID NO: 4055607 - DNA, 18 bp, Homo sapiens
acttacatcttctgtgaa

SEQ ID NO: 4055608 - DNA, 19 bp, Homo sapiens
acttacctaaacagatata

SEQ ID NO: 4055609 - DNA, 13 bp, Homo sapiens
acttacctggcag

SEQ ID NO: 4055610 - DNA, 13 bp, Homo sapiens
acttactataatt

SEQ ID NO: 4055611 - DNA, 15 bp, Homo sapiens
acttacttttgtaaa

SEQ ID NO: 4055612 - DNA, 22 bp, Homo sapiens
acttagaaggattgaacttctt

SEQ ID NO: 4055613 - DNA, 22 bp, Homo sapiens
acttagagtttctgtttgattc

SEQ ID NO: 4055614 - DNA, 20 bp, Homo sapiens
acttaggactagaagattag

SEQ ID NO: 4055615 - DNA, 20 bp, Homo sapiens
acttagtaggtcctcaataa

SEQ ID NO: 4055616 - DNA, 17 bp, Homo sapiens
acttagtatattttctt

SEQ ID NO: 4055617 - DNA, 23 bp, Homo sapiens
acttataagtgaagtgatactat

SEQ ID NO: 4055618 - DNA, 12 bp, Homo sapiens
acttatattgaa

SEQ ID NO: 4055619 - DNA, 16 bp, Homo sapiens
acttatctctctgtgc

SEQ ID NO: 4055620 - DNA, 15 bp, Homo sapiens
acttatgtttttaaa

SEQ ID NO: 4055621 - DNA, 16 bp, Homo sapiens
acttatgtttttaaat

SEQ ID NO: 4055622 - DNA, 16 bp, Homo sapiens
acttattacaatttgt

SEQ ID NO: 4055623 - DNA, 15 bp, Homo sapiens
acttatttcttcaaa

SEQ ID NO: 4055624 - DNA, 16 bp, Homo sapiens
acttcaaaaataatgt

SEQ ID NO: 4055625 - DNA, 20 bp, Homo sapiens
acttcagctgcctgaaacag

SEQ ID NO: 4055626 - DNA, 20 bp, Homo sapiens
acttcaggctcttctccttt

SEQ ID NO: 4055627 - DNA, 20 bp, Homo sapiens
acttcagggcagggctctga

SEQ ID NO: 4055628 - DNA, 13 bp, Homo sapiens
acttcagttttat

SEQ ID NO: 4055629 - DNA, 19 bp, Homo sapiens
acttgtatatttgtacaaa

SEQ ID NO: 4055630 - DNA, 20 bp, Homo sapiens
acttgtatattttaagaaat

SEQ ID NO: 4055631 - DNA, 18 bp, Homo sapiens
acttgtattaaagacaga

SEQ ID NO: 4055632 - DNA, 13 bp, Homo sapiens
acttgtcaatatt

SEQ ID NO: 4055633 - DNA, 14 bp, Homo sapiens
acttgtcaatattt

SEQ ID NO: 4055634 - DNA, 16 bp, Homo sapiens
acttgtcaatatttaa

SEQ ID NO: 4055635 - DNA, 14 bp, Homo sapiens
acttgtctttctgg

SEQ ID NO: 4055636 - DNA, 16 bp, Homo sapiens
acttgtctttctgggg

SEQ ID NO: 4055637 - DNA, 20 bp, Homo sapiens
acttgtgaaacacagctgtt

SEQ ID NO: 4055638 - DNA, 16 bp, Homo sapiens
acttgtgattatttat

SEQ ID NO: 4055639 - DNA, 17 bp, Homo sapiens
acttgtgattatttatt

SEQ ID NO: 4055640 - DNA, 17 bp, Homo sapiens
acttgtgcacaggcaga

SEQ ID NO: 4055641 - DNA, 16 bp, Homo sapiens
acttgtggttttcaaa

SEQ ID NO: 4055642 - DNA, 23 bp, Homo sapiens
acttgtgtcccatgatccctgtg

SEQ ID NO: 4055643 - DNA, 21 bp, Homo sapiens
acttgtgtgtgggctgtgagt

SEQ ID NO: 4055644 - DNA, 15 bp, Homo sapiens
acttgtgtttgctta

SEQ ID NO: 4055645 - DNA, 16 bp, Homo sapiens
acttgttccagctctt

SEQ ID NO: 4055646 - DNA, 13 bp, Homo sapiens
acttgttcttcca

SEQ ID NO: 4055647 - DNA, 21 bp, Homo sapiens
acttgttcttccaaagcagag

SEQ ID NO: 4055648 - DNA, 17 bp, Homo sapiens
acttgtttcatctggtt

SEQ ID NO: 4055649 - DNA, 14 bp, Homo sapiens
actttaaaaaatat

SEQ ID NO: 4055650 - DNA, 17 bp, Homo sapiens
actttaaaagaaaatag

SEQ ID NO: 4055651 - DNA, 15 bp, Homo sapiens
actttaaaataaaat

SEQ ID NO: 4055652 - DNA, 17 bp, Homo sapiens
actttaagactgagcac

SEQ ID NO: 4055653 - DNA, 13 bp, Homo sapiens
actttaagcacta

SEQ ID NO: 4055654 - DNA, 14 bp, Homo sapiens
actttaagcactac

SEQ ID NO: 4055655 - DNA, 16 bp, Homo sapiens
actttaagcactacat

SEQ ID NO: 4055656 - DNA, 14 bp, Homo sapiens
actttaagctcctt

SEQ ID NO: 4055657 - DNA, 15 bp, Homo sapiens
actttacagaaatgg

SEQ ID NO: 4055658 - DNA, 19 bp, Homo sapiens
actttacagaaatggactg

SEQ ID NO: 4055659 - DNA, 15 bp, Homo sapiens
actttactctgtgtt

SEQ ID NO: 4055660 - DNA, 19 bp, Homo sapiens
actttactctgtgtttaaa

SEQ ID NO: 4055661 - DNA, 14 bp, Homo sapiens
actttagaaataaa

SEQ ID NO: 4055662 - DNA, 20 bp, Homo sapiens
actttagaagtgcatttctg

SEQ ID NO: 4055663 - DNA, 21 bp, Homo sapiens
actttagagtagcatgagaga

SEQ ID NO: 4055664 - DNA, 16 bp, Homo sapiens
actttagctagtatct

SEQ ID NO: 4055665 - DNA, 17 bp, Homo sapiens
actttagtatttttact

SEQ ID NO: 4055666 - DNA, 22 bp, Homo sapiens
actttataagtcattgtatgtt

SEQ ID NO: 4055667 - DNA, 22 bp, Homo sapiens
actttatacattagtaaatgtc

SEQ ID NO: 4055668 - DNA, 14 bp, Homo sapiens
actttatcacatta

SEQ ID NO: 4055669 - DNA, 21 bp, Homo sapiens
actttatcacattatttgcat

SEQ ID NO: 4055670 - DNA, 17 bp, Homo sapiens
actttatctcctgctct

SEQ ID NO: 4055671 - DNA, 14 bp, Homo sapiens
actttattaatatg

SEQ ID NO: 4055672 - DNA, 12 bp, Homo sapiens
actttattatcc

SEQ ID NO: 4055673 - DNA, 15 bp, Homo sapiens
actttatttatttct

SEQ ID NO: 4055674 - DNA, 24 bp, Homo sapiens
actttattttctggtagatagaaa

SEQ ID NO: 4055675 - DNA, 13 bp, Homo sapiens
actttcaaaatta

SEQ ID NO: 4055676 - DNA, 20 bp, Homo sapiens
actttcacatagatgtccct

SEQ ID NO: 4055677 - DNA, 16 bp, Homo sapiens
actttcagtaaacata

SEQ ID NO: 4055678 - DNA, 19 bp, Homo sapiens
actttcctcctgaggcttt

SEQ ID NO: 4055679 - DNA, 17 bp, Homo sapiens
actttctaatgtttctg

SEQ ID NO: 4055680 - DNA, 22 bp, Homo sapiens
actttctatgtgacatttctct

SEQ ID NO: 4055681 - DNA, 19 bp, Homo sapiens
actttctgttgccacaacc

SEQ ID NO: 4055682 - DNA, 14 bp, Homo sapiens
actttctgttttct

SEQ ID NO: 4055683 - DNA, 23 bp, Homo sapiens
actttctgttttctgtttgtaaa

SEQ ID NO: 4055684 - DNA, 17 bp, Homo sapiens
actttcttattctgtat

SEQ ID NO: 4055685 - DNA, 14 bp, Homo sapiens
actttcttctgaat

SEQ ID NO: 4055686 - DNA, 20 bp, Homo sapiens
actttcttctgaatatttta

SEQ ID NO: 4055687 - DNA, 19 bp, Homo sapiens
actttcttttctggaatgt

SEQ ID NO: 4055688 - DNA, 17 bp, Homo sapiens
actttgcactgatatat

SEQ ID NO: 4055689 - DNA, 19 bp, Homo sapiens
actttgcactgatatatca

SEQ ID NO: 4055690 - DNA, 14 bp, Homo sapiens
actttgctctgggt

SEQ ID NO: 4055691 - DNA, 22 bp, Homo sapiens
actttgcttagtattgacaact

SEQ ID NO: 4055692 - DNA, 12 bp, Homo sapiens
actttgcttcat

SEQ ID NO: 4055693 - DNA, 20 bp, Homo sapiens
actttgcttcatagtattgg

SEQ ID NO: 4055694 - DNA, 14 bp, Homo sapiens
actttgcttcccct

SEQ ID NO: 4055695 - DNA, 16 bp, Homo sapiens
actttgcttcccctcc

SEQ ID NO: 4055696 - DNA, 12 bp, Homo sapiens
actttgcttgag

SEQ ID NO: 4055697 - DNA, 14 bp, Homo sapiens
actttgcttgcttt

SEQ ID NO: 4055698 - DNA, 15 bp, Homo sapiens
actttgcttgctttg

SEQ ID NO: 4055699 - DNA, 22 bp, Homo sapiens
actttggagtcccctcacctcc

SEQ ID NO: 4055700 - DNA, 21 bp, Homo sapiens
actttggctgatttaaaaagt

SEQ ID NO: 4055701 - DNA, 15 bp, Homo sapiens
actttgggaggccaa

SEQ ID NO: 4055702 - DNA, 19 bp, Homo sapiens
actttgggattctttccat

SEQ ID NO: 4055703 - DNA, 16 bp, Homo sapiens
actttgggcttagtat

SEQ ID NO: 4055704 - DNA, 18 bp, Homo sapiens
actttggtttctgtctgt

SEQ ID NO: 4055705 - DNA, 23 bp, Homo sapiens
actttgtaaaatatcgtgtgtgt

SEQ ID NO: 4055706 - DNA, 15 bp, Homo sapiens
actttgtctctcctg

SEQ ID NO: 4055707 - DNA, 19 bp, Homo sapiens
actttgttctttaggagat

SEQ ID NO: 4055708 - DNA, 20 bp, Homo sapiens
actttgttgcaagatgtgaa

SEQ ID NO: 4055709 - DNA, 11 bp, Homo sapiens
acttttaataa

SEQ ID NO: 4055710 - DNA, 16 bp, Homo sapiens
acttttaccactattt

SEQ ID NO: 4055711 - DNA, 15 bp, Homo sapiens
acttttactctgcct

SEQ ID NO: 4055712 - DNA, 16 bp, Homo sapiens
acttttactctgccta

SEQ ID NO: 4055713 - DNA, 20 bp, Homo sapiens
acttttatgatgtatattta

SEQ ID NO: 4055714 - DNA, 11 bp, Homo sapiens
acttttattaa

SEQ ID NO: 4055715 - DNA, 15 bp, Homo sapiens
acttttatttgcaac

SEQ ID NO: 4055716 - DNA, 22 bp, Homo sapiens
acttttatttgcaacatttaca

SEQ ID NO: 4055717 - DNA, 20 bp, Homo sapiens
acttttcccctgttaaacag

SEQ ID NO: 4055718 - DNA, 22 bp, Homo sapiens
acttttcgttaacattgaccaa

SEQ ID NO: 4055719 - DNA, 20 bp, Homo sapiens
acttttgttattccatcaat

SEQ ID NO: 4055720 - DNA, 14 bp, Homo sapiens
acttttgttctgct

SEQ ID NO: 4055721 - DNA, 21 bp, Homo sapiens
acttttgttctgctttatctt

SEQ ID NO: 4055722 - DNA, 13 bp, Homo sapiens
actttttgtttct

SEQ ID NO: 4055723 - DNA, 19 bp, Homo sapiens
actttttttggtataatgt

SEQ ID NO: 4055724 - DNA, 13 bp, Homo sapiens
actttttttgtat

SEQ ID NO: 4055725 - DNA, 19 bp, Homo sapiens
agaaaaaaaataacacaga

SEQ ID NO: 4055726 - DNA, 12 bp, Homo sapiens
agaaaaaaacaa

SEQ ID NO: 4055727 - DNA, 14 bp, Homo sapiens
agaaaaaaatcttc

SEQ ID NO: 4055728 - DNA, 16 bp, Homo sapiens
agaaaaaaatcttctc

SEQ ID NO: 4055729 - DNA, 16 bp, Homo sapiens
agaaaaacagacaaaa

SEQ ID NO: 4055730 - DNA, 16 bp, Homo sapiens
agaaaaagcaaaaggc

SEQ ID NO: 4055731 - DNA, 20 bp, Homo sapiens
agaaaacaaaaaaacctcta

SEQ ID NO: 4055732 - DNA, 19 bp, Homo sapiens
agaacaagagtttgttctg

SEQ ID NO: 4055733 - DNA, 15 bp, Homo sapiens
agaacacaaagcggg

SEQ ID NO: 4055734 - DNA, 11 bp, Homo sapiens
agaacactaat

SEQ ID NO: 4055735 - DNA, 14 bp, Homo sapiens
agaacactaattca

SEQ ID NO: 4055736 - DNA, 19 bp, Homo sapiens
agaacactaattcataatc

SEQ ID NO: 4055737 - DNA, 23 bp, Homo sapiens
agaacagcagggtagtctggttt

SEQ ID NO: 4055738 - DNA, 16 bp, Homo sapiens
agaacagcttcaggtt

SEQ ID NO: 4055739 - DNA, 18 bp, Homo sapiens
agaacagcttcaggttat

SEQ ID NO: 4055740 - DNA, 17 bp, Homo sapiens
agaacaggtgggctgta

SEQ ID NO: 4055741 - DNA, 23 bp, Homo sapiens
agaacaggttcttaaaaaggaac

SEQ ID NO: 4055742 - DNA, 13 bp, Homo sapiens
agaacagtaaaca

SEQ ID NO: 4055743 - DNA, 14 bp, Homo sapiens
agaacagtaaacat

SEQ ID NO: 4055744 - DNA, 20 bp, Homo sapiens
agaacatctgtataccctct

SEQ ID NO: 4055745 - DNA, 22 bp, Homo sapiens
agaacatgtgagaggtttgact

SEQ ID NO: 4055746 - DNA, 13 bp, Homo sapiens
agaacattttaat

SEQ ID NO: 4055747 - DNA, 17 bp, Homo sapiens
agaaccaaagctcaaat

SEQ ID NO: 4055748 - DNA, 13 bp, Homo sapiens
agaaccacttcct

SEQ ID NO: 4055749 - DNA, 14 bp, Homo sapiens
agaaccacttcctg

SEQ ID NO: 4055750 - DNA, 15 bp, Homo sapiens
agaaccacttcctgc

SEQ ID NO: 4055751 - DNA, 19 bp, Homo sapiens
agaaccagtccccccaccc

SEQ ID NO: 4055752 - DNA, 20 bp, Homo sapiens
agaaccagtccccccaccct

SEQ ID NO: 4055753 - DNA, 12 bp, Homo sapiens
agaaccctctgt

SEQ ID NO: 4055754 - DNA, 14 bp, Homo sapiens
agaaccgagcaaag

SEQ ID NO: 4055755 - DNA, 15 bp, Homo sapiens
agaacctcttcccca

SEQ ID NO: 4055756 - DNA, 23 bp, Homo sapiens
agaacctggaaaaattccagaag

SEQ ID NO: 4055757 - DNA, 21 bp, Homo sapiens
agaacctggaacttggggagt

SEQ ID NO: 4055758 - DNA, 14 bp, Homo sapiens
agaacctttctgtg

SEQ ID NO: 4055759 - DNA, 22 bp, Homo sapiens
agaacgccagggaccccagaat

SEQ ID NO: 4055760 - DNA, 20 bp, Homo sapiens
agaacgccagtctcccaggc

SEQ ID NO: 4055761 - DNA, 18 bp, Homo sapiens
agaacggaggaggctgca

SEQ ID NO: 4055762 - DNA, 11 bp, Homo sapiens
agaactaaatg

SEQ ID NO: 4055763 - DNA, 12 bp, Homo sapiens
agaactaaatgt

SEQ ID NO: 4055764 - DNA, 17 bp, Homo sapiens
agaactatctgcattat

SEQ ID NO: 4055765 - DNA, 20 bp, Homo sapiens
agaactcaaatggggccaga

SEQ ID NO: 4055766 - DNA, 15 bp, Homo sapiens
agaactcactctggg

SEQ ID NO: 4055767 - DNA, 19 bp, Homo sapiens
agaactcactggggcctac

SEQ ID NO: 4055768 - DNA, 23 bp, Homo sapiens
agaactctccatcttattttcat

SEQ ID NO: 4055769 - DNA, 17 bp, Homo sapiens
agaactctgcctgccct

SEQ ID NO: 4055770 - DNA, 20 bp, Homo sapiens
agaactctgggctgctaccc

SEQ ID NO: 4055771 - DNA, 12 bp, Homo sapiens
agaactcttcct

SEQ ID NO: 4055772 - DNA, 16 bp, Homo sapiens
agaactgcatggacct

SEQ ID NO: 4055773 - DNA, 15 bp, Homo sapiens
agaactgggatttga

SEQ ID NO: 4055774 - DNA, 14 bp, Homo sapiens
agaactgtctgtga

SEQ ID NO: 4055775 - DNA, 20 bp, Homo sapiens
agaactgtgtttcaagttca

SEQ ID NO: 4055776 - DNA, 14 bp, Homo sapiens
agaacttcagaaag

SEQ ID NO: 4055777 - DNA, 16 bp, Homo sapiens
agaacttcatttttaa

SEQ ID NO: 4055778 - DNA, 22 bp, Homo sapiens
agaacttgaagcctgctccttc

SEQ ID NO: 4055779 - DNA, 16 bp, Homo sapiens
agaacttgctgctgtc

SEQ ID NO: 4055780 - DNA, 12 bp, Homo sapiens
agaagaaacttt

SEQ ID NO: 4055781 - DNA, 15 bp, Homo sapiens
agaagaaactttgcc

SEQ ID NO: 4055782 - DNA, 13 bp, Homo sapiens
agaagaaatatga

SEQ ID NO: 4055783 - DNA, 13 bp, Homo sapiens
agaagaaattagg

SEQ ID NO: 4055784 - DNA, 12 bp, Homo sapiens
agaagaacagta

SEQ ID NO: 4055785 - DNA, 21 bp, Homo sapiens
agaagaactgtgtttcaagtt

SEQ ID NO: 4055786 - DNA, 21 bp, Homo sapiens
agaagaacttgcatggagcag

SEQ ID NO: 4055787 - DNA, 12 bp, Homo sapiens
agaagacaaaat

SEQ ID NO: 4055788 - DNA, 19 bp, Homo sapiens
agaagacaccagagcagat

SEQ ID NO: 4055789 - DNA, 22 bp, Homo sapiens
agaagacaccagagcagatgca

SEQ ID NO: 4055790 - DNA, 18 bp, Homo sapiens
agaagacatactgcttga

SEQ ID NO: 4055791 - DNA, 12 bp, Homo sapiens
agaagacatgaa

SEQ ID NO: 4055792 - DNA, 16 bp, Homo sapiens
agaagacatgaaccaa

SEQ ID NO: 4055793 - DNA, 14 bp, Homo sapiens
agaagacatggaga

SEQ ID NO: 4055794 - DNA, 16 bp, Homo sapiens
agaagacatggagact

SEQ ID NO: 4055795 - DNA, 20 bp, Homo sapiens
agaagacatggagactcctg

SEQ ID NO: 4055796 - DNA, 18 bp, Homo sapiens
agaagagactctttgcat

SEQ ID NO: 4055797 - DNA, 23 bp, Homo sapiens
agaagagagggtgagtcctccag

SEQ ID NO: 4055798 - DNA, 19 bp, Homo sapiens
agaagagatgagaaatgat

SEQ ID NO: 4055799 - DNA, 22 bp, Homo sapiens
agaagagatgggcttgttttct

SEQ ID NO: 4055800 - DNA, 17 bp, Homo sapiens
agaagaggctggtgctg

SEQ ID NO: 4055801 - DNA, 18 bp, Homo sapiens
agaagagggcctgtggga

SEQ ID NO: 4055802 - DNA, 17 bp, Homo sapiens
agaagagtgccctgctt

SEQ ID NO: 4055803 - DNA, 19 bp, Homo sapiens
agaagagtgccctgctttg

SEQ ID NO: 4055804 - DNA, 13 bp, Homo sapiens
agaagatctttgg

SEQ ID NO: 4055805 - DNA, 16 bp, Homo sapiens
agaagatgccagcttc

SEQ ID NO: 4055806 - DNA, 23 bp, Homo sapiens
agaagatttgatgctggagaggt

SEQ ID NO: 4055807 - DNA, 16 bp, Homo sapiens
agaagcacagaatatt

SEQ ID NO: 4055808 - DNA, 16 bp, Homo sapiens
agaagcatgaaaaagc

SEQ ID NO: 4055809 - DNA, 17 bp, Homo sapiens
agaagcattccttcttt

SEQ ID NO: 4055810 - DNA, 24 bp, Homo sapiens
agaagcattccttctttgataatg

SEQ ID NO: 4055811 - DNA, 15 bp, Homo sapiens
agaagccaagggaaa

SEQ ID NO: 4055812 - DNA, 16 bp, Homo sapiens
agaagccaagggaaag

SEQ ID NO: 4055813 - DNA, 21 bp, Homo sapiens
agaagccaagggaaaggggtg

SEQ ID NO: 4055814 - DNA, 22 bp, Homo sapiens
agaagccaagggaaaggggtgc

SEQ ID NO: 4055815 - DNA, 20 bp, Homo sapiens
agaagccacgctgtcctctc

SEQ ID NO: 4055816 - DNA, 12 bp, Homo sapiens
agaagcccccag

SEQ ID NO: 4055817 - DNA, 19 bp, Homo sapiens
agaagcctccaagcacaga

SEQ ID NO: 4055818 - DNA, 16 bp, Homo sapiens
agaagcctctggctag

SEQ ID NO: 4055819 - DNA, 23 bp, Homo sapiens
agaagcctctggctagaggccag

SEQ ID NO: 4055820 - DNA, 16 bp, Homo sapiens
agaagcctgttttgtt

SEQ ID NO: 4055821 - DNA, 18 bp, Homo sapiens
agaagctgctccaggcct

SEQ ID NO: 4055822 - DNA, 23 bp, Homo sapiens
agaagctgctccaggcctgcagc

SEQ ID NO: 4055823 - DNA, 11 bp, Homo sapiens
agaagctgctg

SEQ ID NO: 4055824 - DNA, 13 bp, Homo sapiens
agaagctgctgac

SEQ ID NO: 4055825 - DNA, 13 bp, Homo sapiens
agaagctggactt

SEQ ID NO: 4055826 - DNA, 20 bp, Homo sapiens
agaagctgttgtacatttat

SEQ ID NO: 4055827 - DNA, 21 bp, Homo sapiens
agaagctgttgtacatttatg

SEQ ID NO: 4055828 - DNA, 23 bp, Homo sapiens
agaagctgttgtacatttatgat

SEQ ID NO: 4055829 - DNA, 18 bp, Homo sapiens
agaagcttccattccaag

SEQ ID NO: 4055830 - DNA, 14 bp, Homo sapiens
agaaggaagcaggt

SEQ ID NO: 4055831 - DNA, 22 bp, Homo sapiens
agaaggaggaatgctggactgg

SEQ ID NO: 4055832 - DNA, 13 bp, Homo sapiens
agaaggcaatatt

SEQ ID NO: 4055833 - DNA, 18 bp, Homo sapiens
agaaggcatttgcagggt

SEQ ID NO: 4055834 - DNA, 21 bp, Homo sapiens
agaagggataaccctacaccc

SEQ ID NO: 4055835 - DNA, 10 bp, Homo sapiens
agacacacac

SEQ ID NO: 4055836 - DNA, 11 bp, Homo sapiens
agacacacaca

SEQ ID NO: 4055837 - DNA, 14 bp, Homo sapiens
agacacacacacgc

SEQ ID NO: 4055838 - DNA, 14 bp, Homo sapiens
agacacagataata

SEQ ID NO: 4055839 - DNA, 12 bp, Homo sapiens
agacacaggccc

SEQ ID NO: 4055840 - DNA, 15 bp, Homo sapiens
agacaccagagcaga

SEQ ID NO: 4055841 - DNA, 20 bp, Homo sapiens
agacaccagagcagatgcag

SEQ ID NO: 4055842 - DNA, 16 bp, Homo sapiens
agacacccaggactta

SEQ ID NO: 4055843 - DNA, 17 bp, Homo sapiens
agacacctgttcacaga

SEQ ID NO: 4055844 - DNA, 22 bp, Homo sapiens
agacacgccttcccctcagcca

SEQ ID NO: 4055845 - DNA, 15 bp, Homo sapiens
agacactaagttata

SEQ ID NO: 4055846 - DNA, 13 bp, Homo sapiens
agacactggcccc

SEQ ID NO: 4055847 - DNA, 15 bp, Homo sapiens
agacactggcccctc

SEQ ID NO: 4055848 - DNA, 20 bp, Homo sapiens
agacacttccgtcacatccc

SEQ ID NO: 4055849 - DNA, 14 bp, Homo sapiens
agacacttgctccc

SEQ ID NO: 4055850 - DNA, 22 bp, Homo sapiens
agacactttttctttacaaaca

SEQ ID NO: 4055851 - DNA, 11 bp, Homo sapiens
agacagaaaag

SEQ ID NO: 4055852 - DNA, 18 bp, Homo sapiens
agacagaaaagtgcctga

SEQ ID NO: 4055853 - DNA, 21 bp, Homo sapiens
agacagaaaagtgcctgagct

SEQ ID NO: 4055854 - DNA, 13 bp, Homo sapiens
agacagaaactgg

SEQ ID NO: 4055855 - DNA, 18 bp, Homo sapiens
agacagaaactggattaa

SEQ ID NO: 4055856 - DNA, 18 bp, Homo sapiens
agacagaagctgaagtgc

SEQ ID NO: 4055857 - DNA, 17 bp, Homo sapiens
agacagaagtctcctca

SEQ ID NO: 4055858 - DNA, 16 bp, Homo sapiens
agacagacacacacac

SEQ ID NO: 4055859 - DNA, 19 bp, Homo sapiens
agacagagcgacagagcag

SEQ ID NO: 4055860 - DNA, 16 bp, Homo sapiens
agacagatgccccaga

SEQ ID NO: 4055861 - DNA, 16 bp, Homo sapiens
agacagccgtttgttc

SEQ ID NO: 4055862 - DNA, 23 bp, Homo sapiens
agacaggagggcaagggccatgc

SEQ ID NO: 4055863 - DNA, 16 bp, Homo sapiens
agacagggtaggaaag

SEQ ID NO: 4055864 - DNA, 18 bp, Homo sapiens
agacagggtcttgctctg

SEQ ID NO: 4055865 - DNA, 19 bp, Homo sapiens
agacagggtgggcttcctg

SEQ ID NO: 4055866 - DNA, 22 bp, Homo sapiens
agacagggtgggcttcctgccc

SEQ ID NO: 4055867 - DNA, 17 bp, Homo sapiens
agacagtatatttatag

SEQ ID NO: 4055868 - DNA, 22 bp, Homo sapiens
agacagtatgagtcaatgtgca

SEQ ID NO: 4055869 - DNA, 12 bp, Homo sapiens
agacagtgatct

SEQ ID NO: 4055870 - DNA, 17 bp, Homo sapiens
agacagtgatctccata

SEQ ID NO: 4055871 - DNA, 21 bp, Homo sapiens
agacagtgatctccatatgtt

SEQ ID NO: 4055872 - DNA, 20 bp, Homo sapiens
agacagtttcttagcttttt

SEQ ID NO: 4055873 - DNA, 17 bp, Homo sapiens
agacataacgtttttcc

SEQ ID NO: 4055874 - DNA, 17 bp, Homo sapiens
agacatacttgaagggc

SEQ ID NO: 4055875 - DNA, 23 bp, Homo sapiens
agacatacttgaagggccagagc

SEQ ID NO: 4055876 - DNA, 13 bp, Homo sapiens
agacatatctcta

SEQ ID NO: 4055877 - DNA, 17 bp, Homo sapiens
agacatgaatgcacact

SEQ ID NO: 4055878 - DNA, 23 bp, Homo sapiens
agacatgccacaaggacttcctg

SEQ ID NO: 4055879 - DNA, 13 bp, Homo sapiens
agacatggagact

SEQ ID NO: 4055880 - DNA, 18 bp, Homo sapiens
agacatggagactcctgc

SEQ ID NO: 4055881 - DNA, 19 bp, Homo sapiens
agacatggagactcctgcc

SEQ ID NO: 4055882 - DNA, 22 bp, Homo sapiens
agacatggagactcctgccctg

SEQ ID NO: 4055883 - DNA, 12 bp, Homo sapiens
agacatgtgaca

SEQ ID NO: 4055884 - DNA, 13 bp, Homo sapiens
agacatgtgacat

SEQ ID NO: 4055885 - DNA, 15 bp, Homo sapiens
agacatgtgacattt

SEQ ID NO: 4055886 - DNA, 16 bp, Homo sapiens
agacatgtgacattta

SEQ ID NO: 4055887 - DNA, 21 bp, Homo sapiens
agacatgtgaggaggaaaagg

SEQ ID NO: 4055888 - DNA, 15 bp, Homo sapiens
agacatgtgtcaaca

SEQ ID NO: 4055889 - DNA, 18 bp, Homo sapiens
agacatgttttccgtgaa

SEQ ID NO: 4055890 - DNA, 13 bp, Homo sapiens
agacattgtcaat

SEQ ID NO: 4055891 - DNA, 16 bp, Homo sapiens
agacattgtcaataaa

SEQ ID NO: 4055892 - DNA, 19 bp, Homo sapiens
agacatttctgctctcagc

SEQ ID NO: 4055893 - DNA, 21 bp, Homo sapiens
agacatttctgctctcagctc

SEQ ID NO: 4055894 - DNA, 16 bp, Homo sapiens
agacatttcttttctt

SEQ ID NO: 4055895 - DNA, 21 bp, Homo sapiens
agacatttcttttctttttac

SEQ ID NO: 4055896 - DNA, 22 bp, Homo sapiens
agacatttttccgtttgctttt

SEQ ID NO: 4055897 - DNA, 18 bp, Homo sapiens
agacattttttgctataa

SEQ ID NO: 4055898 - DNA, 22 bp, Homo sapiens
agacattttttgctataatcat

SEQ ID NO: 4055899 - DNA, 17 bp, Homo sapiens
agaccaagactctgaaa

SEQ ID NO: 4055900 - DNA, 23 bp, Homo sapiens
agaccaaggcgggagcatctctt

SEQ ID NO: 4055901 - DNA, 23 bp, Homo sapiens
agaccacatctttatctgttctt

SEQ ID NO: 4055902 - DNA, 16 bp, Homo sapiens
agaccaccacttcgaa

SEQ ID NO: 4055903 - DNA, 22 bp, Homo sapiens
agaccaccagccgccccagccc

SEQ ID NO: 4055904 - DNA, 17 bp, Homo sapiens
agaccacctgcttctga

SEQ ID NO: 4055905 - DNA, 18 bp, Homo sapiens
agaccagagctgtctgaa

SEQ ID NO: 4055906 - DNA, 12 bp, Homo sapiens
agaccagctcag

SEQ ID NO: 4055907 - DNA, 14 bp, Homo sapiens
agaccagctcagag

SEQ ID NO: 4055908 - DNA, 18 bp, Homo sapiens
agaccagtgaccccagaa

SEQ ID NO: 4055909 - DNA, 20 bp, Homo sapiens
agaccagttgggagcactgg

SEQ ID NO: 4055910 - DNA, 23 bp, Homo sapiens
agaccagttgggagcactggagt

SEQ ID NO: 4055911 - DNA, 17 bp, Homo sapiens
agaccatgtcttatctt

SEQ ID NO: 4055912 - DNA, 16 bp, Homo sapiens
agacccaggcctgtgg

SEQ ID NO: 4055913 - DNA, 21 bp, Homo sapiens
agacccaggtggagggcacag

SEQ ID NO: 4055914 - DNA, 17 bp, Homo sapiens
agaccccacctccttgg

SEQ ID NO: 4055915 - DNA, 13 bp, Homo sapiens
agaccccagggca

SEQ ID NO: 4055916 - DNA, 14 bp, Homo sapiens
agacccccacacct

SEQ ID NO: 4055917 - DNA, 17 bp, Homo sapiens
agacccccatttgtccc

SEQ ID NO: 4055918 - DNA, 22 bp, Homo sapiens
agacccccccatttcccgcaca

SEQ ID NO: 4055919 - DNA, 19 bp, Homo sapiens
agacccctctggccaggat

SEQ ID NO: 4055920 - DNA, 22 bp, Homo sapiens
agacccctctggccaggatgga

SEQ ID NO: 4055921 - DNA, 13 bp, Homo sapiens
agacccctgcctg

SEQ ID NO: 4055922 - DNA, 15 bp, Homo sapiens
agacccctggctttt

SEQ ID NO: 4055923 - DNA, 13 bp, Homo sapiens
agacccctttgag

SEQ ID NO: 4055924 - DNA, 17 bp, Homo sapiens
agacccggtcctgccct

SEQ ID NO: 4055925 - DNA, 19 bp, Homo sapiens
agaccctaagcctcctttt

SEQ ID NO: 4055926 - DNA, 15 bp, Homo sapiens
agaccctcttgccca

SEQ ID NO: 4055927 - DNA, 18 bp, Homo sapiens
agaccctcttgcccatcc

SEQ ID NO: 4055928 - DNA, 12 bp, Homo sapiens
agaccctgaggc

SEQ ID NO: 4055929 - DNA, 21 bp, Homo sapiens
agaccctgcaaacagaacagg

SEQ ID NO: 4055930 - DNA, 19 bp, Homo sapiens
agaccctgccacagccaga

SEQ ID NO: 4055931 - DNA, 19 bp, Homo sapiens
agaccctgggtgggctctg

SEQ ID NO: 4055932 - DNA, 18 bp, Homo sapiens
agaccctggtgcctggct

SEQ ID NO: 4055933 - DNA, 18 bp, Homo sapiens
agaccgtcgggggctgag

SEQ ID NO: 4055934 - DNA, 23 bp, Homo sapiens
agaccgtcgggggctgaggggca

SEQ ID NO: 4055935 - DNA, 18 bp, Homo sapiens
agacctagcaggctgttc

SEQ ID NO: 4055936 - DNA, 14 bp, Homo sapiens
agacctagggagga

SEQ ID NO: 4055937 - DNA, 15 bp, Homo sapiens
agacctcatcaggat

SEQ ID NO: 4055938 - DNA, 19 bp, Homo sapiens
agagagaaaaaaaaaatag

SEQ ID NO: 4055939 - DNA, 13 bp, Homo sapiens
agagagagagagg

SEQ ID NO: 4055940 - DNA, 22 bp, Homo sapiens
agagagatatatctgaaaactg

SEQ ID NO: 4055941 - DNA, 22 bp, Homo sapiens
agagagcagctccctttctcag

SEQ ID NO: 4055942 - DNA, 13 bp, Homo sapiens
agagagccatttt

SEQ ID NO: 4055943 - DNA, 19 bp, Homo sapiens
agagagccattttgtgaat

SEQ ID NO: 4055944 - DNA, 11 bp, Homo sapiens
agagagctggt

SEQ ID NO: 4055945 - DNA, 12 bp, Homo sapiens
agagagctggta

SEQ ID NO: 4055946 - DNA, 17 bp, Homo sapiens
agagagcttcctcccct

SEQ ID NO: 4055947 - DNA, 18 bp, Homo sapiens
agagaggagaaacacatc

SEQ ID NO: 4055948 - DNA, 13 bp, Homo sapiens
agagaggaggcag

SEQ ID NO: 4055949 - DNA, 23 bp, Homo sapiens
agagaggatgtggaaagcacttt

SEQ ID NO: 4055950 - DNA, 14 bp, Homo sapiens
agagaggctctggg

SEQ ID NO: 4055951 - DNA, 15 bp, Homo sapiens
agagagggcagaggg

SEQ ID NO: 4055952 - DNA, 17 bp, Homo sapiens
agagagtggctcctccc

SEQ ID NO: 4055953 - DNA, 21 bp, Homo sapiens
agagataaaccaataaatcca

SEQ ID NO: 4055954 - DNA, 14 bp, Homo sapiens
agagataattctta

SEQ ID NO: 4055955 - DNA, 16 bp, Homo sapiens
agagataggaaactga

SEQ ID NO: 4055956 - DNA, 18 bp, Homo sapiens
agagataggaaactgaag

SEQ ID NO: 4055957 - DNA, 16 bp, Homo sapiens
agagatatatctgaaa

SEQ ID NO: 4055958 - DNA, 17 bp, Homo sapiens
agagatattttaaaatg

SEQ ID NO: 4055959 - DNA, 20 bp, Homo sapiens
agagatattttaaaatgaga

SEQ ID NO: 4055960 - DNA, 12 bp, Homo sapiens
agagatgaatta

SEQ ID NO: 4055961 - DNA, 20 bp, Homo sapiens
agagatgggagctcctctcc

SEQ ID NO: 4055962 - DNA, 24 bp, Homo sapiens
agagatgggagctcctctcctgga

SEQ ID NO: 4055963 - DNA, 23 bp, Homo sapiens
agagatttatataaatgtaaaaa

SEQ ID NO: 4055964 - DNA, 14 bp, Homo sapiens
agagcaaaattgat

SEQ ID NO: 4055965 - DNA, 20 bp, Homo sapiens
agagcaagagagcagcaagg

SEQ ID NO: 4055966 - DNA, 22 bp, Homo sapiens
agagcaccccctgctccaccag

SEQ ID NO: 4055967 - DNA, 17 bp, Homo sapiens
agagcaccctcgagaag

SEQ ID NO: 4055968 - DNA, 15 bp, Homo sapiens
agagcagatgcagag

SEQ ID NO: 4055969 - DNA, 19 bp, Homo sapiens
agagcagcctgtggcatct

SEQ ID NO: 4055970 - DNA, 22 bp, Homo sapiens
agagcagctccctttctcagga

SEQ ID NO: 4055971 - DNA, 18 bp, Homo sapiens
agagcaggaagcattcag

SEQ ID NO: 4055972 - DNA, 20 bp, Homo sapiens
agagcaggaagcattcagag

SEQ ID NO: 4055973 - DNA, 17 bp, Homo sapiens
agagcaggactccaggc

SEQ ID NO: 4055974 - DNA, 22 bp, Homo sapiens
agagcaggggtccttggtgtga

SEQ ID NO: 4055975 - DNA, 19 bp, Homo sapiens
agagcagtcagagtccagt

SEQ ID NO: 4055976 - DNA, 18 bp, Homo sapiens
agagcatacaacagaggg

SEQ ID NO: 4055977 - DNA, 14 bp, Homo sapiens
agagcatgaaattt

SEQ ID NO: 4055978 - DNA, 17 bp, Homo sapiens
agagcattacgtgagcc

SEQ ID NO: 4055979 - DNA, 16 bp, Homo sapiens
agagcattagctggcg

SEQ ID NO: 4055980 - DNA, 17 bp, Homo sapiens
agagcattagctggcgc

SEQ ID NO: 4055981 - DNA, 23 bp, Homo sapiens
agagcattataatcaccagggcc

SEQ ID NO: 4055982 - DNA, 20 bp, Homo sapiens
agagcatttccaacaccaca

SEQ ID NO: 4055983 - DNA, 20 bp, Homo sapiens
agagccaacctcggcttgtg

SEQ ID NO: 4055984 - DNA, 12 bp, Homo sapiens
agagccaagcct

SEQ ID NO: 4055985 - DNA, 13 bp, Homo sapiens
agagccaagcctt

SEQ ID NO: 4055986 - DNA, 13 bp, Homo sapiens
agagccaagtcct

SEQ ID NO: 4055987 - DNA, 19 bp, Homo sapiens
agagccagatgcaggacag

SEQ ID NO: 4055988 - DNA, 16 bp, Homo sapiens
agagcccagaggtaac

SEQ ID NO: 4055989 - DNA, 21 bp, Homo sapiens
agagcccagcagggcctcaaa

SEQ ID NO: 4055990 - DNA, 13 bp, Homo sapiens
agagcccagctcc

SEQ ID NO: 4055991 - DNA, 14 bp, Homo sapiens
agagcccagctcca

SEQ ID NO: 4055992 - DNA, 15 bp, Homo sapiens
agagcccatgctcaa

SEQ ID NO: 4055993 - DNA, 12 bp, Homo sapiens
agagcccccagg

SEQ ID NO: 4055994 - DNA, 13 bp, Homo sapiens
agagcccccagga

SEQ ID NO: 4055995 - DNA, 14 bp, Homo sapiens
agagccccccacaa

SEQ ID NO: 4055996 - DNA, 16 bp, Homo sapiens
agagccctgccctgca

SEQ ID NO: 4055997 - DNA, 19 bp, Homo sapiens
agagccctggacacccctg

SEQ ID NO: 4055998 - DNA, 20 bp, Homo sapiens
agagccctggacacccctgc

SEQ ID NO: 4055999 - DNA, 22 bp, Homo sapiens
agagccctggacacccctgctc

SEQ ID NO: 4056000 - DNA, 13 bp, Homo sapiens
agagccctggctg

SEQ ID NO: 4056001 - DNA, 14 bp, Homo sapiens
agagccctggctgg

SEQ ID NO: 4056002 - DNA, 15 bp, Homo sapiens
agagccctggctggg

SEQ ID NO: 4056003 - DNA, 21 bp, Homo sapiens
agagcctcgtccctccctcac

SEQ ID NO: 4056004 - DNA, 19 bp, Homo sapiens
agagcctgccccagcgctg

SEQ ID NO: 4056005 - DNA, 12 bp, Homo sapiens
agagcctgctgc

SEQ ID NO: 4056006 - DNA, 19 bp, Homo sapiens
agagcctgctggcacccac

SEQ ID NO: 4056007 - DNA, 13 bp, Homo sapiens
agagcctggagaa

SEQ ID NO: 4056008 - DNA, 15 bp, Homo sapiens
agagcctggccccag

SEQ ID NO: 4056009 - DNA, 16 bp, Homo sapiens
agagcctggccccagg

SEQ ID NO: 4056010 - DNA, 17 bp, Homo sapiens
agagcctggccccaggc

SEQ ID NO: 4056011 - DNA, 13 bp, Homo sapiens
agagccttctcag

SEQ ID NO: 4056012 - DNA, 16 bp, Homo sapiens
agagccttctcagaag

SEQ ID NO: 4056013 - DNA, 23 bp, Homo sapiens
agagcctttggatgaccagaaca

SEQ ID NO: 4056014 - DNA, 15 bp, Homo sapiens
agagccttttgtgca

SEQ ID NO: 4056015 - DNA, 14 bp, Homo sapiens
agagcgcagcatcc

SEQ ID NO: 4056016 - DNA, 18 bp, Homo sapiens
agagcgccaggaagccag

SEQ ID NO: 4056017 - DNA, 17 bp, Homo sapiens
agagctaagggtgggtg

SEQ ID NO: 4056018 - DNA, 20 bp, Homo sapiens
agagctaataaatctcttct

SEQ ID NO: 4056019 - DNA, 14 bp, Homo sapiens
agagctattgccaa

SEQ ID NO: 4056020 - DNA, 12 bp, Homo sapiens
agagctgaacag

SEQ ID NO: 4056021 - DNA, 16 bp, Homo sapiens
agagctgagccagttg

SEQ ID NO: 4056022 - DNA, 17 bp, Homo sapiens
agagctgagccagttgt

SEQ ID NO: 4056023 - DNA, 21 bp, Homo sapiens
agagctgagccagttgtccta

SEQ ID NO: 4056024 - DNA, 12 bp, Homo sapiens
agagctgccagt

SEQ ID NO: 4056025 - DNA, 17 bp, Homo sapiens
agagctggagcccccag

SEQ ID NO: 4056026 - DNA, 22 bp, Homo sapiens
agagctggagcccccagcagag

SEQ ID NO: 4056027 - DNA, 23 bp, Homo sapiens
agagctgggaggcatggccctgg

SEQ ID NO: 4056028 - DNA, 16 bp, Homo sapiens
agagctgggtggcctg

SEQ ID NO: 4056029 - DNA, 14 bp, Homo sapiens
agagctgggtgggg

SEQ ID NO: 4056030 - DNA, 21 bp, Homo sapiens
agagctggtagttagtagcat

SEQ ID NO: 4056031 - DNA, 23 bp, Homo sapiens
agagctggtagttagtagcatgt

SEQ ID NO: 4056032 - DNA, 15 bp, Homo sapiens
agagctggtgcccgg

SEQ ID NO: 4056033 - DNA, 16 bp, Homo sapiens
agagctggtgcccgga

SEQ ID NO: 4056034 - DNA, 21 bp, Homo sapiens
agagctgtttatggcctcagc

SEQ ID NO: 4056035 - DNA, 17 bp, Homo sapiens
agagcttaaattgtcat

SEQ ID NO: 4056036 - DNA, 17 bp, Homo sapiens
agagcttgtaataaata

SEQ ID NO: 4056037 - DNA, 18 bp, Homo sapiens
agagcttgtgctcctctt

SEQ ID NO: 4056038 - DNA, 15 bp, Homo sapiens
agagcttgtgtcctg

SEQ ID NO: 4056039 - DNA, 16 bp, Homo sapiens
agagcttttaaaaatg

SEQ ID NO: 4056040 - DNA, 15 bp, Homo sapiens
agaggaaagggctgg

SEQ ID NO: 4056041 - DNA, 21 bp, Homo sapiens
agaggaacagcactggggagt

SEQ ID NO: 4056042 - DNA, 15 bp, Homo sapiens
agaggaacagtgtgg

SEQ ID NO: 4056043 - DNA, 17 bp, Homo sapiens
agaggaactgtccagag

SEQ ID NO: 4056044 - DNA, 18 bp, Homo sapiens
agaggaactgtccagaga

SEQ ID NO: 4056045 - DNA, 19 bp, Homo sapiens
agaggaactgtccagagag

SEQ ID NO: 4056046 - DNA, 13 bp, Homo sapiens
agaggaatttata

SEQ ID NO: 4056047 - DNA, 18 bp, Homo sapiens
agaggactcccaaccctg

SEQ ID NO: 4056048 - DNA, 21 bp, Homo sapiens
agaggactcccaaccctggct

SEQ ID NO: 4056049 - DNA, 14 bp, Homo sapiens
agaggagaaacaca

SEQ ID NO: 4056050 - DNA, 15 bp, Homo sapiens
agaggagcttttctg

SEQ ID NO: 4056051 - DNA, 13 bp, Homo sapiens
agaggaggcagcc

SEQ ID NO: 4056052 - DNA, 18 bp, Homo sapiens
agaggagggcagagggag

SEQ ID NO: 4056053 - DNA, 13 bp, Homo sapiens
agaggaggtgaga

SEQ ID NO: 4056054 - DNA, 22 bp, Homo sapiens
agaggatgaatgtatgtgcact

SEQ ID NO: 4056055 - DNA, 13 bp, Homo sapiens
agaggatgagagc

SEQ ID NO: 4056056 - DNA, 14 bp, Homo sapiens
agaggatgagagcc

SEQ ID NO: 4056057 - DNA, 18 bp, Homo sapiens
agaggatgagagcccaga

SEQ ID NO: 4056058 - DNA, 22 bp, Homo sapiens
agaggatgagagcccagaggta

SEQ ID NO: 4056059 - DNA, 13 bp, Homo sapiens
agaggatgtgcaa

SEQ ID NO: 4056060 - DNA, 20 bp, Homo sapiens
agaggatttttttctgagcg

SEQ ID NO: 4056061 - DNA, 13 bp, Homo sapiens
agaggcagagaaa

SEQ ID NO: 4056062 - DNA, 18 bp, Homo sapiens
agaggcagagaaagaaga

SEQ ID NO: 4056063 - DNA, 19 bp, Homo sapiens
agaggcagcttcaagtgcc

SEQ ID NO: 4056064 - DNA, 17 bp, Homo sapiens
agaggcaggctgggacg

SEQ ID NO: 4056065 - DNA, 18 bp, Homo sapiens
agaggcagttgcccagcc

SEQ ID NO: 4056066 - DNA, 22 bp, Homo sapiens
agaggcagttgcccagcctctt

SEQ ID NO: 4056067 - DNA, 16 bp, Homo sapiens
agaggcatacacacag

SEQ ID NO: 4056068 - DNA, 13 bp, Homo sapiens
agaggcatggctg

SEQ ID NO: 4056069 - DNA, 16 bp, Homo sapiens
agaggccagccccacc

SEQ ID NO: 4056070 - DNA, 23 bp, Homo sapiens
agaggccagccccacccaggagg

SEQ ID NO: 4056071 - DNA, 14 bp, Homo sapiens
agaggccatggcag

SEQ ID NO: 4056072 - DNA, 15 bp, Homo sapiens
agaggccatggcaga

SEQ ID NO: 4056073 - DNA, 16 bp, Homo sapiens
agaggccatggcagaa

SEQ ID NO: 4056074 - DNA, 12 bp, Homo sapiens
agaggccccagc

SEQ ID NO: 4056075 - DNA, 23 bp, Homo sapiens
agaggccgaaggtgcctcagact

SEQ ID NO: 4056076 - DNA, 23 bp, Homo sapiens
agaggcctcctgtggcctgccag

SEQ ID NO: 4056077 - DNA, 13 bp, Homo sapiens
agaggcctgcccg

SEQ ID NO: 4056078 - DNA, 16 bp, Homo sapiens
agaggcggcctcgtgc

SEQ ID NO: 4056079 - DNA, 16 bp, Homo sapiens
agaggctagcttctgc

SEQ ID NO: 4056080 - DNA, 16 bp, Homo sapiens
agaggctctccgtgca

SEQ ID NO: 4056081 - DNA, 19 bp, Homo sapiens
agaggctctggacagcaga

SEQ ID NO: 4056082 - DNA, 20 bp, Homo sapiens
agaggctctggacagcagaa

SEQ ID NO: 4056083 - DNA, 21 bp, Homo sapiens
agaggctctggacagcagaag

SEQ ID NO: 4056084 - DNA, 19 bp, Homo sapiens
agaggctgaaagaggccaa

SEQ ID NO: 4056085 - DNA, 16 bp, Homo sapiens
agaggctgaggctggc

SEQ ID NO: 4056086 - DNA, 20 bp, Homo sapiens
agaggctgcacccctgggcc

SEQ ID NO: 4056087 - DNA, 14 bp, Homo sapiens
agaggctgcccctc

SEQ ID NO: 4056088 - DNA, 18 bp, Homo sapiens
agaggctgcccctctcac

SEQ ID NO: 4056089 - DNA, 22 bp, Homo sapiens
agaggctgcctctcccatcact

SEQ ID NO: 4056090 - DNA, 22 bp, Homo sapiens
agaggctggtgctgtggccagg

SEQ ID NO: 4056091 - DNA, 19 bp, Homo sapiens
agaggcttctccgccagcc

SEQ ID NO: 4056092 - DNA, 17 bp, Homo sapiens
agagggaagagtgcatt

SEQ ID NO: 4056093 - DNA, 17 bp, Homo sapiens
agagggaccatgtgtca

SEQ ID NO: 4056094 - DNA, 19 bp, Homo sapiens
agagggagaagcatgaaaa

SEQ ID NO: 4056095 - DNA, 14 bp, Homo sapiens
agagggagaatcca

SEQ ID NO: 4056096 - DNA, 13 bp, Homo sapiens
agagggagagaga

SEQ ID NO: 4056097 - DNA, 12 bp, Homo sapiens
agagggagcagg

SEQ ID NO: 4056098 - DNA, 15 bp, Homo sapiens
agagggatttccctg

SEQ ID NO: 4056099 - DNA, 20 bp, Homo sapiens
agagggcaatctttgccttt

SEQ ID NO: 4056100 - DNA, 14 bp, Homo sapiens
agagggcccagccc

SEQ ID NO: 4056101 - DNA, 18 bp, Homo sapiens
agagggctggaggcccag

SEQ ID NO: 4056102 - DNA, 12 bp, Homo sapiens
agagggcttcct

SEQ ID NO: 4056103 - DNA, 13 bp, Homo sapiens
agagggcttcctc

SEQ ID NO: 4056104 - DNA, 14 bp, Homo sapiens
agagggcttgtgaa

SEQ ID NO: 4056105 - DNA, 16 bp, Homo sapiens
agaggggaagggccag

SEQ ID NO: 4056106 - DNA, 14 bp, Homo sapiens
agaggggactgggg

SEQ ID NO: 4056107 - DNA, 21 bp, Homo sapiens
agagggggcacccggggagga

SEQ ID NO: 4056108 - DNA, 19 bp, Homo sapiens
agagggggcctgggacttc

SEQ ID NO: 4056109 - DNA, 21 bp, Homo sapiens
agagggtaataaccagacaca

SEQ ID NO: 4056110 - DNA, 16 bp, Homo sapiens
agaggtaacagaacag

SEQ ID NO: 4056111 - DNA, 17 bp, Homo sapiens
agaggtaacagaacagc

SEQ ID NO: 4056112 - DNA, 20 bp, Homo sapiens
agaggtaacagaacagcttc

SEQ ID NO: 4056113 - DNA, 19 bp, Homo sapiens
agaggtacagggtttttac

SEQ ID NO: 4056114 - DNA, 21 bp, Homo sapiens
agaggtacagggtttttacct

SEQ ID NO: 4056115 - DNA, 18 bp, Homo sapiens
agaggtagccgggctctg

SEQ ID NO: 4056116 - DNA, 22 bp, Homo sapiens
agaggtgcacttggggcacagg

SEQ ID NO: 4056117 - DNA, 13 bp, Homo sapiens
agaggtgcttcac

SEQ ID NO: 4056118 - DNA, 20 bp, Homo sapiens
agaggtgcttctgcctgtgc

SEQ ID NO: 4056119 - DNA, 13 bp, Homo sapiens
agaggtggccaga

SEQ ID NO: 4056120 - DNA, 18 bp, Homo sapiens
agaggtggccagagctgg

SEQ ID NO: 4056121 - DNA, 17 bp, Homo sapiens
agaggtgggagggccct

SEQ ID NO: 4056122 - DNA, 20 bp, Homo sapiens
agaggtgggatcctccctca

SEQ ID NO: 4056123 - DNA, 18 bp, Homo sapiens
agaggtgtacactaacat

SEQ ID NO: 4056124 - DNA, 21 bp, Homo sapiens
agaggtgtacactaacatttc

SEQ ID NO: 4056125 - DNA, 17 bp, Homo sapiens
agagtaaattgctctgt

SEQ ID NO: 4056126 - DNA, 19 bp, Homo sapiens
agagtacagtgagccaaga

SEQ ID NO: 4056127 - DNA, 17 bp, Homo sapiens
agagtacgtcctgcctg

SEQ ID NO: 4056128 - DNA, 23 bp, Homo sapiens
agagtacgtcctgcctggcactt

SEQ ID NO: 4056129 - DNA, 14 bp, Homo sapiens
agagtactgggaga

SEQ ID NO: 4056130 - DNA, 17 bp, Homo sapiens
agagtagaattgcattg

SEQ ID NO: 4056131 - DNA, 23 bp, Homo sapiens
agagtagcaagttctagagaaga

SEQ ID NO: 4056132 - DNA, 21 bp, Homo sapiens
agagtatccttccttcagggt

SEQ ID NO: 4056133 - DNA, 21 bp, Homo sapiens
agagtattttaagaagacata

SEQ ID NO: 4056134 - DNA, 14 bp, Homo sapiens
agagtcagatcttt

SEQ ID NO: 4056135 - DNA, 13 bp, Homo sapiens
agagtcaggcagg

SEQ ID NO: 4056136 - DNA, 17 bp, Homo sapiens
agagtccagtgctctgc

SEQ ID NO: 4056137 - DNA, 19 bp, Homo sapiens
agagtccagtgctctgcct

SEQ ID NO: 4056138 - DNA, 22 bp, Homo sapiens
agagtccagtgctctgcctcag

SEQ ID NO: 4056139 - DNA, 17 bp, Homo sapiens
agagtccatttcccaca

SEQ ID NO: 4056140 - DNA, 22 bp, Homo sapiens
agagtccatttcccacatcttt

SEQ ID NO: 4056141 - DNA, 13 bp, Homo sapiens
agagtctgggcct

SEQ ID NO: 4056142 - DNA, 23 bp, Homo sapiens
agagtgaaaccatgactgtgacc

SEQ ID NO: 4056143 - DNA, 20 bp, Homo sapiens
agatcgagaccatcctggct

SEQ ID NO: 4056144 - DNA, 15 bp, Homo sapiens
agatcgcagtttgcc

SEQ ID NO: 4056145 - DNA, 23 bp, Homo sapiens
agatcgtgtattgagatttctta

SEQ ID NO: 4056146 - DNA, 16 bp, Homo sapiens
agatctataaagcgat

SEQ ID NO: 4056147 - DNA, 12 bp, Homo sapiens
agatctccagcg

SEQ ID NO: 4056148 - DNA, 15 bp, Homo sapiens
agatctggaacctca

SEQ ID NO: 4056149 - DNA, 14 bp, Homo sapiens
agatctgtcctcag

SEQ ID NO: 4056150 - DNA, 17 bp, Homo sapiens
agatctgtcctcagcct

SEQ ID NO: 4056151 - DNA, 18 bp, Homo sapiens
agatctgtcctcagcctt

SEQ ID NO: 4056152 - DNA, 12 bp, Homo sapiens
agatctgtgccc

SEQ ID NO: 4056153 - DNA, 14 bp, Homo sapiens
agatctgtgcccca

SEQ ID NO: 4056154 - DNA, 16 bp, Homo sapiens
agatctgtgccccatg

SEQ ID NO: 4056155 - DNA, 14 bp, Homo sapiens
agatctgttttgaa

SEQ ID NO: 4056156 - DNA, 18 bp, Homo sapiens
agatctgttttgaaggca

SEQ ID NO: 4056157 - DNA, 21 bp, Homo sapiens
agatctgttttgaaggcaaaa

SEQ ID NO: 4056158 - DNA, 18 bp, Homo sapiens
agatcttcccataataaa

SEQ ID NO: 4056159 - DNA, 22 bp, Homo sapiens
agatcttcccataataaagcaa

SEQ ID NO: 4056160 - DNA, 16 bp, Homo sapiens
agatcttgtctccact

SEQ ID NO: 4056161 - DNA, 16 bp, Homo sapiens
agatctttctccttga

SEQ ID NO: 4056162 - DNA, 21 bp, Homo sapiens
agatgaactctgaactttgga

SEQ ID NO: 4056163 - DNA, 12 bp, Homo sapiens
agatgacaacct

SEQ ID NO: 4056164 - DNA, 15 bp, Homo sapiens
agatgagcaaggaca

SEQ ID NO: 4056165 - DNA, 16 bp, Homo sapiens
agatgagcaaggacat

SEQ ID NO: 4056166 - DNA, 16 bp, Homo sapiens
agatgaggttctgaga

SEQ ID NO: 4056167 - DNA, 22 bp, Homo sapiens
agatgatctctccacggtagca

SEQ ID NO: 4056168 - DNA, 14 bp, Homo sapiens
agatgatgagaatt

SEQ ID NO: 4056169 - DNA, 18 bp, Homo sapiens
agatgatgagaatttcta

SEQ ID NO: 4056170 - DNA, 20 bp, Homo sapiens
agatgatgagaatttctaaa

SEQ ID NO: 4056171 - DNA, 19 bp, Homo sapiens
agatgatggatgccaatat

SEQ ID NO: 4056172 - DNA, 19 bp, Homo sapiens
agatgcaacctcactatgg

SEQ ID NO: 4056173 - DNA, 15 bp, Homo sapiens
agatgcaaggaccag

SEQ ID NO: 4056174 - DNA, 16 bp, Homo sapiens
agatgcagaaaaagaa

SEQ ID NO: 4056175 - DNA, 12 bp, Homo sapiens
agatgcagagag

SEQ ID NO: 4056176 - DNA, 14 bp, Homo sapiens
agatgcagctcttc

SEQ ID NO: 4056177 - DNA, 13 bp, Homo sapiens
agatgcagggcag

SEQ ID NO: 4056178 - DNA, 22 bp, Homo sapiens
agatgccagcttctctctccag

SEQ ID NO: 4056179 - DNA, 23 bp, Homo sapiens
agatgccagcttctctctccagg

SEQ ID NO: 4056180 - DNA, 14 bp, Homo sapiens
agatgccccattcc

SEQ ID NO: 4056181 - DNA, 15 bp, Homo sapiens
agatgccccattcct

SEQ ID NO: 4056182 - DNA, 17 bp, Homo sapiens
agatgccccattccttg

SEQ ID NO: 4056183 - DNA, 23 bp, Homo sapiens
agatgcctacaaccatccctgcc

SEQ ID NO: 4056184 - DNA, 22 bp, Homo sapiens
agatgccttttttgtagttttt

SEQ ID NO: 4056185 - DNA, 20 bp, Homo sapiens
agatgctaaaatccctggat

SEQ ID NO: 4056186 - DNA, 15 bp, Homo sapiens
agatgctaataaact

SEQ ID NO: 4056187 - DNA, 16 bp, Homo sapiens
agatgctagaaaaatg

SEQ ID NO: 4056188 - DNA, 15 bp, Homo sapiens
agatgctcactttat

SEQ ID NO: 4056189 - DNA, 23 bp, Homo sapiens
agatgctgactgtactcctccca

SEQ ID NO: 4056190 - DNA, 20 bp, Homo sapiens
agatgctggcccagggccca

SEQ ID NO: 4056191 - DNA, 21 bp, Homo sapiens
agatgctggcccagggcccag

SEQ ID NO: 4056192 - DNA, 22 bp, Homo sapiens
agatgctgtaacttaaaatagg

SEQ ID NO: 4056193 - DNA, 16 bp, Homo sapiens
agatgcttctctcctt

SEQ ID NO: 4056194 - DNA, 21 bp, Homo sapiens
agatgcttggttgtgttgagg

SEQ ID NO: 4056195 - DNA, 20 bp, Homo sapiens
agatggaaacaatgtggagt

SEQ ID NO: 4056196 - DNA, 22 bp, Homo sapiens
agatggaagttgcagtgagctg

SEQ ID NO: 4056197 - DNA, 23 bp, Homo sapiens
agatggaagttgcagtgagctga

SEQ ID NO: 4056198 - DNA, 15 bp, Homo sapiens
agatggaatgctgtg

SEQ ID NO: 4056199 - DNA, 12 bp, Homo sapiens
agatggactggg

SEQ ID NO: 4056200 - DNA, 18 bp, Homo sapiens
agatggactgggaggagg

SEQ ID NO: 4056201 - DNA, 14 bp, Homo sapiens
agatggagcccata

SEQ ID NO: 4056202 - DNA, 17 bp, Homo sapiens
agatggagggcttggcc

SEQ ID NO: 4056203 - DNA, 18 bp, Homo sapiens
agatggagggcttggccc

SEQ ID NO: 4056204 - DNA, 19 bp, Homo sapiens
agatggagggcttggccca

SEQ ID NO: 4056205 - DNA, 18 bp, Homo sapiens
agatggaggttctcagag

SEQ ID NO: 4056206 - DNA, 20 bp, Homo sapiens
agatggataaactgagcctc

SEQ ID NO: 4056207 - DNA, 11 bp, Homo sapiens
agatggattct

SEQ ID NO: 4056208 - DNA, 18 bp, Homo sapiens
agatggattctcagatat

SEQ ID NO: 4056209 - DNA, 15 bp, Homo sapiens
agatggatttgcctg

SEQ ID NO: 4056210 - DNA, 23 bp, Homo sapiens
agatggcctttgcttatgaatat

SEQ ID NO: 4056211 - DNA, 20 bp, Homo sapiens
agatggcgagcatcctggcc

SEQ ID NO: 4056212 - DNA, 18 bp, Homo sapiens
agatgggagctcctctcc

SEQ ID NO: 4056213 - DNA, 18 bp, Homo sapiens
agatgggcttgttttctt

SEQ ID NO: 4056214 - DNA, 19 bp, Homo sapiens
agatgggcttgttttcttg

SEQ ID NO: 4056215 - DNA, 16 bp, Homo sapiens
agatgggtccaggggt

SEQ ID NO: 4056216 - DNA, 23 bp, Homo sapiens
agatgggtccaggggtctgtctg

SEQ ID NO: 4056217 - DNA, 22 bp, Homo sapiens
agatgggtctggctgagctgaa

SEQ ID NO: 4056218 - DNA, 23 bp, Homo sapiens
agatgggtctggctgagctgaac

SEQ ID NO: 4056219 - DNA, 22 bp, Homo sapiens
agatggtgaagcattctcccca

SEQ ID NO: 4056220 - DNA, 18 bp, Homo sapiens
agatggtttcaattcaga

SEQ ID NO: 4056221 - DNA, 17 bp, Homo sapiens
agatggtttccacattt

SEQ ID NO: 4056222 - DNA, 16 bp, Homo sapiens
agatgtacctggtgga

SEQ ID NO: 4056223 - DNA, 20 bp, Homo sapiens
agatgtccctttcttggcca

SEQ ID NO: 4056224 - DNA, 21 bp, Homo sapiens
agatgtccctttcttggccag

SEQ ID NO: 4056225 - DNA, 22 bp, Homo sapiens
agatgtccctttcttggccagt

SEQ ID NO: 4056226 - DNA, 14 bp, Homo sapiens
agatgtcttccctg

SEQ ID NO: 4056227 - DNA, 13 bp, Homo sapiens
agatgtctttagg

SEQ ID NO: 4056228 - DNA, 21 bp, Homo sapiens
agatgtgaattattgacactg

SEQ ID NO: 4056229 - DNA, 23 bp, Homo sapiens
agatgtgaattattgacactgaa

SEQ ID NO: 4056230 - DNA, 21 bp, Homo sapiens
agatgtgagccaccgtgcctg

SEQ ID NO: 4056231 - DNA, 18 bp, Homo sapiens
agatgtgcaaatgcaagc

SEQ ID NO: 4056232 - DNA, 14 bp, Homo sapiens
agatgtgcaataga

SEQ ID NO: 4056233 - DNA, 15 bp, Homo sapiens
agatgtgcacccatg

SEQ ID NO: 4056234 - DNA, 14 bp, Homo sapiens
agatgtggagactg

SEQ ID NO: 4056235 - DNA, 21 bp, Homo sapiens
agatgtggccttccatttata

SEQ ID NO: 4056236 - DNA, 19 bp, Homo sapiens
agatgtgttgctatcctga

SEQ ID NO: 4056237 - DNA, 21 bp, Homo sapiens
agatgttgaagaatacagtta

SEQ ID NO: 4056238 - DNA, 21 bp, Homo sapiens
agatgtttccagacttccttg

SEQ ID NO: 4056239 - DNA, 15 bp, Homo sapiens
agatgtttgtcagat

SEQ ID NO: 4056240 - DNA, 22 bp, Homo sapiens
agatgttttaccgtaataatta

SEQ ID NO: 4056241 - DNA, 22 bp, Homo sapiens
agatgttttggtagattaaata

SEQ ID NO: 4056242 - DNA, 17 bp, Homo sapiens
agattaaacagatgatg

SEQ ID NO: 4056243 - DNA, 16 bp, Homo sapiens
agattaaatatagatt

SEQ ID NO: 4056244 - DNA, 17 bp, Homo sapiens
agattaaatatagatta

SEQ ID NO: 4056245 - DNA, 19 bp, Homo sapiens
agcaatttaaatgttatga

SEQ ID NO: 4056246 - DNA, 19 bp, Homo sapiens
agcaatttaactagacaca

SEQ ID NO: 4056247 - DNA, 20 bp, Homo sapiens
agcaatttatacaatatcat

SEQ ID NO: 4056248 - DNA, 21 bp, Homo sapiens
agcaatttcgccgttgaagag

SEQ ID NO: 4056249 - DNA, 14 bp, Homo sapiens
agcacaacccccag

SEQ ID NO: 4056250 - DNA, 14 bp, Homo sapiens
agcacacagggcag

SEQ ID NO: 4056251 - DNA, 15 bp, Homo sapiens
agcacagagcctggc

SEQ ID NO: 4056252 - DNA, 18 bp, Homo sapiens
agcacagaggcctcctgt

SEQ ID NO: 4056253 - DNA, 12 bp, Homo sapiens
agcacagccaac

SEQ ID NO: 4056254 - DNA, 18 bp, Homo sapiens
agcacagcttagatttca

SEQ ID NO: 4056255 - DNA, 22 bp, Homo sapiens
agcacagggggattctgagcag

SEQ ID NO: 4056256 - DNA, 12 bp, Homo sapiens
agcacagtgtgt

SEQ ID NO: 4056257 - DNA, 11 bp, Homo sapiens
agcacatacat

SEQ ID NO: 4056258 - DNA, 17 bp, Homo sapiens
agcacatacattaaaac

SEQ ID NO: 4056259 - DNA, 20 bp, Homo sapiens
agcacatgttactgcttcat

SEQ ID NO: 4056260 - DNA, 12 bp, Homo sapiens
agcaccacccta

SEQ ID NO: 4056261 - DNA, 14 bp, Homo sapiens
agcaccccaaggct

SEQ ID NO: 4056262 - DNA, 11 bp, Homo sapiens
agcacccccac

SEQ ID NO: 4056263 - DNA, 12 bp, Homo sapiens
agcacccccacc

SEQ ID NO: 4056264 - DNA, 16 bp, Homo sapiens
agcacccccacccacc

SEQ ID NO: 4056265 - DNA, 19 bp, Homo sapiens
agcacccccacccacctcc

SEQ ID NO: 4056266 - DNA, 20 bp, Homo sapiens
agcacccccacccacctcca

SEQ ID NO: 4056267 - DNA, 13 bp, Homo sapiens
agcaccccctgct

SEQ ID NO: 4056268 - DNA, 21 bp, Homo sapiens
agcaccccctgctccaccagc

SEQ ID NO: 4056269 - DNA, 15 bp, Homo sapiens
agcaccctcgagaag

SEQ ID NO: 4056270 - DNA, 15 bp, Homo sapiens
agcaccctctcctgg

SEQ ID NO: 4056271 - DNA, 18 bp, Homo sapiens
agcaccctctcctggggg

SEQ ID NO: 4056272 - DNA, 21 bp, Homo sapiens
agcaccgtgtcaagctgctct

SEQ ID NO: 4056273 - DNA, 22 bp, Homo sapiens
agcaccgtgtcaagctgctctg

SEQ ID NO: 4056274 - DNA, 16 bp, Homo sapiens
agcacctccagcctga

SEQ ID NO: 4056275 - DNA, 20 bp, Homo sapiens
agcacctccagcctgaacag

SEQ ID NO: 4056276 - DNA, 20 bp, Homo sapiens
agcacctgcttcatgctcag

SEQ ID NO: 4056277 - DNA, 21 bp, Homo sapiens
agcacctgcttcatgctcagc

SEQ ID NO: 4056278 - DNA, 14 bp, Homo sapiens
agcacctgtaagaa

SEQ ID NO: 4056279 - DNA, 14 bp, Homo sapiens
agcaccttcagggc

SEQ ID NO: 4056280 - DNA, 22 bp, Homo sapiens
agcaccttcagggctgagttct

SEQ ID NO: 4056281 - DNA, 15 bp, Homo sapiens
agcaccttcctcact

SEQ ID NO: 4056282 - DNA, 20 bp, Homo sapiens
agcaccttcctcacttccat

SEQ ID NO: 4056283 - DNA, 14 bp, Homo sapiens
agcactactgggtg

SEQ ID NO: 4056284 - DNA, 20 bp, Homo sapiens
agcactactgggtgtcattt

SEQ ID NO: 4056285 - DNA, 22 bp, Homo sapiens
agcactactgggtgtcatttca

SEQ ID NO: 4056286 - DNA, 23 bp, Homo sapiens
agcactactgggtgtcatttcat

SEQ ID NO: 4056287 - DNA, 19 bp, Homo sapiens
agcactccgcatcacctca

SEQ ID NO: 4056288 - DNA, 22 bp, Homo sapiens
agcactccgcatcacctcacca

SEQ ID NO: 4056289 - DNA, 20 bp, Homo sapiens
agcactctctaaatcttcct

SEQ ID NO: 4056290 - DNA, 23 bp, Homo sapiens
agcactctctaaatcttccttgt

SEQ ID NO: 4056291 - DNA, 19 bp, Homo sapiens
agcactctgagtttaccat

SEQ ID NO: 4056292 - DNA, 16 bp, Homo sapiens
agcactcttaaagcaa

SEQ ID NO: 4056293 - DNA, 13 bp, Homo sapiens
agcactgatttca

SEQ ID NO: 4056294 - DNA, 21 bp, Homo sapiens
agcactgctaggcgagtgcca

SEQ ID NO: 4056295 - DNA, 17 bp, Homo sapiens
agcactggagtgcaggg

SEQ ID NO: 4056296 - DNA, 12 bp, Homo sapiens
agcactgtccct

SEQ ID NO: 4056297 - DNA, 19 bp, Homo sapiens
agcactgtcccttgcctca

SEQ ID NO: 4056298 - DNA, 20 bp, Homo sapiens
agcactgtctcagtttcact

SEQ ID NO: 4056299 - DNA, 15 bp, Homo sapiens
agcactgtgaagacc

SEQ ID NO: 4056300 - DNA, 18 bp, Homo sapiens
agcactgtgaagacccag

SEQ ID NO: 4056301 - DNA, 12 bp, Homo sapiens
agcacttccaaa

SEQ ID NO: 4056302 - DNA, 18 bp, Homo sapiens
agcacttccttgccagtc

SEQ ID NO: 4056303 - DNA, 22 bp, Homo sapiens
agcactttctacaatgtgaact

SEQ ID NO: 4056304 - DNA, 15 bp, Homo sapiens
agcactttgggaggc

SEQ ID NO: 4056305 - DNA, 21 bp, Homo sapiens
agcactttgggaggccaaggt

SEQ ID NO: 4056306 - DNA, 22 bp, Homo sapiens
agcactttgggaggccaaggtg

SEQ ID NO: 4056307 - DNA, 21 bp, Homo sapiens
agcactttgggaggccgaggc

SEQ ID NO: 4056308 - DNA, 18 bp, Homo sapiens
agcacttttgttattcca

SEQ ID NO: 4056309 - DNA, 21 bp, Homo sapiens
agcacttttgttattccatca

SEQ ID NO: 4056310 - DNA, 23 bp, Homo sapiens
agcacttttgttattccatcaat

SEQ ID NO: 4056311 - DNA, 17 bp, Homo sapiens
agcactttttggctgac

SEQ ID NO: 4056312 - DNA, 22 bp, Homo sapiens
agcagaaaactggccctgccct

SEQ ID NO: 4056313 - DNA, 18 bp, Homo sapiens
agcagaaaataaaggaag

SEQ ID NO: 4056314 - DNA, 14 bp, Homo sapiens
agcagaaacagcca

SEQ ID NO: 4056315 - DNA, 16 bp, Homo sapiens
agcagaaacagccatt

SEQ ID NO: 4056316 - DNA, 18 bp, Homo sapiens
agcagaaagaagagaagt

SEQ ID NO: 4056317 - DNA, 21 bp, Homo sapiens
agcagaatggtgatcactcca

SEQ ID NO: 4056318 - DNA, 18 bp, Homo sapiens
agcagaattgaccgacag

SEQ ID NO: 4056319 - DNA, 14 bp, Homo sapiens
agcagaattttaat

SEQ ID NO: 4056320 - DNA, 13 bp, Homo sapiens
agcagacacacat

SEQ ID NO: 4056321 - DNA, 22 bp, Homo sapiens
agcagacacacatgggcagccc

SEQ ID NO: 4056322 - DNA, 18 bp, Homo sapiens
agcagacagaaactggat

SEQ ID NO: 4056323 - DNA, 12 bp, Homo sapiens
agcagacaggcc

SEQ ID NO: 4056324 - DNA, 21 bp, Homo sapiens
agcagacagtgttttctggga

SEQ ID NO: 4056325 - DNA, 22 bp, Homo sapiens
agcagaccaccccgcctgccct

SEQ ID NO: 4056326 - DNA, 18 bp, Homo sapiens
agcagactttctctgtgt

SEQ ID NO: 4056327 - DNA, 19 bp, Homo sapiens
agcagactttctctgtgta

SEQ ID NO: 4056328 - DNA, 15 bp, Homo sapiens
agcagagacactaac

SEQ ID NO: 4056329 - DNA, 19 bp, Homo sapiens
agcagagagagaggacaga

SEQ ID NO: 4056330 - DNA, 22 bp, Homo sapiens
agcagagagagaggacagaggg

SEQ ID NO: 4056331 - DNA, 19 bp, Homo sapiens
agcagagggggagtagcca

SEQ ID NO: 4056332 - DNA, 19 bp, Homo sapiens
agcagagtgcacagctgtc

SEQ ID NO: 4056333 - DNA, 23 bp, Homo sapiens
agcagagtgcacagctgtccact

SEQ ID NO: 4056334 - DNA, 16 bp, Homo sapiens
agcagagtgctggcac

SEQ ID NO: 4056335 - DNA, 18 bp, Homo sapiens
agcagagtgctggcactt

SEQ ID NO: 4056336 - DNA, 19 bp, Homo sapiens
agcagagtgctggcactta

SEQ ID NO: 4056337 - DNA, 22 bp, Homo sapiens
agcagatacatatgagtgtgga

SEQ ID NO: 4056338 - DNA, 12 bp, Homo sapiens
agcagatgcaga

SEQ ID NO: 4056339 - DNA, 22 bp, Homo sapiens
agcagattgtttcctcttccaa

SEQ ID NO: 4056340 - DNA, 18 bp, Homo sapiens
agcagatttaacaattcc

SEQ ID NO: 4056341 - DNA, 21 bp, Homo sapiens
agcagattttaattttgaata

SEQ ID NO: 4056342 - DNA, 15 bp, Homo sapiens
agcagcaactgaaga

SEQ ID NO: 4056343 - DNA, 18 bp, Homo sapiens
agcagcatctgctaataa

SEQ ID NO: 4056344 - DNA, 15 bp, Homo sapiens
agcagcatggaaaaa

SEQ ID NO: 4056345 - DNA, 22 bp, Homo sapiens
agcagcatggaaaaatggttga

SEQ ID NO: 4056346 - DNA, 17 bp, Homo sapiens
agcagcatggcatagcc

SEQ ID NO: 4056347 - DNA, 21 bp, Homo sapiens
agcatcgggagcacccagagc

SEQ ID NO: 4056348 - DNA, 22 bp, Homo sapiens
agcatcgggagcacccagagca

SEQ ID NO: 4056349 - DNA, 15 bp, Homo sapiens
agcatctatctcatc

SEQ ID NO: 4056350 - DNA, 20 bp, Homo sapiens
agcatctcagcctaccatga

SEQ ID NO: 4056351 - DNA, 19 bp, Homo sapiens
agcatctcttgaggccagg

SEQ ID NO: 4056352 - DNA, 21 bp, Homo sapiens
agcatctgcagtacagtctta

SEQ ID NO: 4056353 - DNA, 20 bp, Homo sapiens
agcatctggctgtctagaat

SEQ ID NO: 4056354 - DNA, 20 bp, Homo sapiens
agcatgacagcctgcagcag

SEQ ID NO: 4056355 - DNA, 16 bp, Homo sapiens
agcatgagactttctg

SEQ ID NO: 4056356 - DNA, 19 bp, Homo sapiens
agcatgccccttggctgga

SEQ ID NO: 4056357 - DNA, 19 bp, Homo sapiens
agcatgcttcccagaggga

SEQ ID NO: 4056358 - DNA, 11 bp, Homo sapiens
agcatgctttc

SEQ ID NO: 4056359 - DNA, 16 bp, Homo sapiens
agcatggaaaaatggt

SEQ ID NO: 4056360 - DNA, 19 bp, Homo sapiens
agcatggaaaaatggttga

SEQ ID NO: 4056361 - DNA, 22 bp, Homo sapiens
agcatggaaaaatggttgatgg

SEQ ID NO: 4056362 - DNA, 17 bp, Homo sapiens
agcatggcatagccccg

SEQ ID NO: 4056363 - DNA, 19 bp, Homo sapiens
agcatggcatagccccggc

SEQ ID NO: 4056364 - DNA, 18 bp, Homo sapiens
agcatggctcaaagtgca

SEQ ID NO: 4056365 - DNA, 14 bp, Homo sapiens
agcatgggcctggc

SEQ ID NO: 4056366 - DNA, 19 bp, Homo sapiens
agcatgggcctggccacct

SEQ ID NO: 4056367 - DNA, 13 bp, Homo sapiens
agcatgtaatggt

SEQ ID NO: 4056368 - DNA, 16 bp, Homo sapiens
agcatgtgccttaatg

SEQ ID NO: 4056369 - DNA, 18 bp, Homo sapiens
agcatgtgccttaatgct

SEQ ID NO: 4056370 - DNA, 18 bp, Homo sapiens
agcatgtggcatgttcat

SEQ ID NO: 4056371 - DNA, 13 bp, Homo sapiens
agcatgtggtctt

SEQ ID NO: 4056372 - DNA, 19 bp, Homo sapiens
agcatgtgtatttccagtg

SEQ ID NO: 4056373 - DNA, 17 bp, Homo sapiens
agcatgtgtcagagtgt

SEQ ID NO: 4056374 - DNA, 19 bp, Homo sapiens
agcatgttgagccaggcct

SEQ ID NO: 4056375 - DNA, 19 bp, Homo sapiens
agcattacgtgagccaggt

SEQ ID NO: 4056376 - DNA, 21 bp, Homo sapiens
agcattataatcaccagggcc

SEQ ID NO: 4056377 - DNA, 14 bp, Homo sapiens
agcattcagagagc

SEQ ID NO: 4056378 - DNA, 16 bp, Homo sapiens
agcattcagagagcag

SEQ ID NO: 4056379 - DNA, 18 bp, Homo sapiens
agcattcataattaaaat

SEQ ID NO: 4056380 - DNA, 14 bp, Homo sapiens
agcattccagtcag

SEQ ID NO: 4056381 - DNA, 19 bp, Homo sapiens
agcattccttctttgataa

SEQ ID NO: 4056382 - DNA, 22 bp, Homo sapiens
agcattctcactcctacctggt

SEQ ID NO: 4056383 - DNA, 17 bp, Homo sapiens
agcattctggaggggag

SEQ ID NO: 4056384 - DNA, 16 bp, Homo sapiens
agcattgaaattatag

SEQ ID NO: 4056385 - DNA, 17 bp, Homo sapiens
agcattgctgttatgtc

SEQ ID NO: 4056386 - DNA, 12 bp, Homo sapiens
agcattgctttc

SEQ ID NO: 4056387 - DNA, 15 bp, Homo sapiens
agcattgctttctga

SEQ ID NO: 4056388 - DNA, 16 bp, Homo sapiens
agcattgctttctgaa

SEQ ID NO: 4056389 - DNA, 18 bp, Homo sapiens
agcatttagtcttgccag

SEQ ID NO: 4056390 - DNA, 16 bp, Homo sapiens
agcatttatcattctt

SEQ ID NO: 4056391 - DNA, 13 bp, Homo sapiens
agcatttatgttt

SEQ ID NO: 4056392 - DNA, 14 bp, Homo sapiens
agcatttccaacac

SEQ ID NO: 4056393 - DNA, 19 bp, Homo sapiens
agcatttccaacaccacag

SEQ ID NO: 4056394 - DNA, 11 bp, Homo sapiens
agcatttccta

SEQ ID NO: 4056395 - DNA, 14 bp, Homo sapiens
agcatttccttcca

SEQ ID NO: 4056396 - DNA, 15 bp, Homo sapiens
agcatttccttccag

SEQ ID NO: 4056397 - DNA, 18 bp, Homo sapiens
agcatttccttccagccc

SEQ ID NO: 4056398 - DNA, 19 bp, Homo sapiens
agcatttccttccagccca

SEQ ID NO: 4056399 - DNA, 23 bp, Homo sapiens
agcatttggaccaatagcccaca

SEQ ID NO: 4056400 - DNA, 20 bp, Homo sapiens
agcatttttaattttcacaa

SEQ ID NO: 4056401 - DNA, 21 bp, Homo sapiens
agcatttttaattttcacaaa

SEQ ID NO: 4056402 - DNA, 20 bp, Homo sapiens
agcatttttcaatatattga

SEQ ID NO: 4056403 - DNA, 23 bp, Homo sapiens
agcatttttcaatatattgaact

SEQ ID NO: 4056404 - DNA, 17 bp, Homo sapiens
agcatttttttattcag

SEQ ID NO: 4056405 - DNA, 19 bp, Homo sapiens
agcatttttttattcagca

SEQ ID NO: 4056406 - DNA, 20 bp, Homo sapiens
agcatttttttattcagcag

SEQ ID NO: 4056407 - DNA, 15 bp, Homo sapiens
agccaaaagtccctc

SEQ ID NO: 4056408 - DNA, 21 bp, Homo sapiens
agccaaaagtccctccctgcc

SEQ ID NO: 4056409 - DNA, 19 bp, Homo sapiens
agccaaacccatgaggcaa

SEQ ID NO: 4056410 - DNA, 13 bp, Homo sapiens
agccaaacccttg

SEQ ID NO: 4056411 - DNA, 19 bp, Homo sapiens
agccaaacccttgtcagtg

SEQ ID NO: 4056412 - DNA, 20 bp, Homo sapiens
agccaaatgcagggagggga

SEQ ID NO: 4056413 - DNA, 23 bp, Homo sapiens
agccaacaccctgtctaaaaaac

SEQ ID NO: 4056414 - DNA, 18 bp, Homo sapiens
agccaacacgcacctgcc

SEQ ID NO: 4056415 - DNA, 15 bp, Homo sapiens
agccaacaggtggca

SEQ ID NO: 4056416 - DNA, 16 bp, Homo sapiens
agccaactagcccctg

SEQ ID NO: 4056417 - DNA, 17 bp, Homo sapiens
agccaactagcccctgg

SEQ ID NO: 4056418 - DNA, 19 bp, Homo sapiens
agccaacttgtaaatacac

SEQ ID NO: 4056419 - DNA, 19 bp, Homo sapiens
agccaagatcgcgccactg

SEQ ID NO: 4056420 - DNA, 22 bp, Homo sapiens
agccaagattttcctcttgtga

SEQ ID NO: 4056421 - DNA, 14 bp, Homo sapiens
agccaagggaaagg

SEQ ID NO: 4056422 - DNA, 17 bp, Homo sapiens
agccaagtcctccctct

SEQ ID NO: 4056423 - DNA, 13 bp, Homo sapiens
agccaagtggggt

SEQ ID NO: 4056424 - DNA, 20 bp, Homo sapiens
agccaagtggggtgctggga

SEQ ID NO: 4056425 - DNA, 14 bp, Homo sapiens
agccaagtgtgacc

SEQ ID NO: 4056426 - DNA, 19 bp, Homo sapiens
agccacaaggctggccagc

SEQ ID NO: 4056427 - DNA, 15 bp, Homo sapiens
agccacaagtcttcc

SEQ ID NO: 4056428 - DNA, 17 bp, Homo sapiens
agccacagaccacctgc

SEQ ID NO: 4056429 - DNA, 19 bp, Homo sapiens
agccacagctgctgttctc

SEQ ID NO: 4056430 - DNA, 23 bp, Homo sapiens
agccacagctgctgttctcagga

SEQ ID NO: 4056431 - DNA, 22 bp, Homo sapiens
agccacaggaaggaggggagag

SEQ ID NO: 4056432 - DNA, 13 bp, Homo sapiens
agccacagtggga

SEQ ID NO: 4056433 - DNA, 15 bp, Homo sapiens
agccacatccccaag

SEQ ID NO: 4056434 - DNA, 14 bp, Homo sapiens
agccacattatttc

SEQ ID NO: 4056435 - DNA, 21 bp, Homo sapiens
agccacatttggaatactttt

SEQ ID NO: 4056436 - DNA, 17 bp, Homo sapiens
agccaccacgtccagct

SEQ ID NO: 4056437 - DNA, 14 bp, Homo sapiens
agccaccagatgtg

SEQ ID NO: 4056438 - DNA, 22 bp, Homo sapiens
agccaccagatgtgacagtgtt

SEQ ID NO: 4056439 - DNA, 13 bp, Homo sapiens
agccaccagtgtc

SEQ ID NO: 4056440 - DNA, 20 bp, Homo sapiens
agccaccagtgtcctccaag

SEQ ID NO: 4056441 - DNA, 16 bp, Homo sapiens
agccaccgctgccagc

SEQ ID NO: 4056442 - DNA, 21 bp, Homo sapiens
agccaccgctgccagcacaga

SEQ ID NO: 4056443 - DNA, 16 bp, Homo sapiens
agccacctctccctca

SEQ ID NO: 4056444 - DNA, 22 bp, Homo sapiens
agccacctctccctcaacaagg

SEQ ID NO: 4056445 - DNA, 16 bp, Homo sapiens
agccacctctgtcatt

SEQ ID NO: 4056446 - DNA, 22 bp, Homo sapiens
agccactagactcttcactgtt

SEQ ID NO: 4056447 - DNA, 16 bp, Homo sapiens
agccactctcttccct

SEQ ID NO: 4056448 - DNA, 19 bp, Homo sapiens
agccactctcttccctttc

SEQ ID NO: 4056449 - DNA, 21 bp, Homo sapiens
agcctcaagtcttatttcctc

SEQ ID NO: 4056450 - DNA, 22 bp, Homo sapiens
agcctcacttgaatgtgtcact

SEQ ID NO: 4056451 - DNA, 17 bp, Homo sapiens
agcctcagaggagctct

SEQ ID NO: 4056452 - DNA, 16 bp, Homo sapiens
agcctcatactcctgg

SEQ ID NO: 4056453 - DNA, 17 bp, Homo sapiens
agcctcatactcctggg

SEQ ID NO: 4056454 - DNA, 18 bp, Homo sapiens
agcctcatactcctgggc

SEQ ID NO: 4056455 - DNA, 18 bp, Homo sapiens
agcctccaagcctgcctc

SEQ ID NO: 4056456 - DNA, 12 bp, Homo sapiens
agcctccagggc

SEQ ID NO: 4056457 - DNA, 14 bp, Homo sapiens
agcctccagggccc

SEQ ID NO: 4056458 - DNA, 15 bp, Homo sapiens
agcctccatttagtt

SEQ ID NO: 4056459 - DNA, 21 bp, Homo sapiens
agcctccatttagttctttgt

SEQ ID NO: 4056460 - DNA, 17 bp, Homo sapiens
agcctcccatccagggc

SEQ ID NO: 4056461 - DNA, 13 bp, Homo sapiens
agcctccccaccc

SEQ ID NO: 4056462 - DNA, 14 bp, Homo sapiens
agcctccccctcag

SEQ ID NO: 4056463 - DNA, 17 bp, Homo sapiens
agcctccctgtctccag

SEQ ID NO: 4056464 - DNA, 18 bp, Homo sapiens
agcctccctgtctccagc

SEQ ID NO: 4056465 - DNA, 13 bp, Homo sapiens
agcctccggaagc

SEQ ID NO: 4056466 - DNA, 23 bp, Homo sapiens
agcctccggagtagctgggacca

SEQ ID NO: 4056467 - DNA, 13 bp, Homo sapiens
agcctcctctgga

SEQ ID NO: 4056468 - DNA, 15 bp, Homo sapiens
agcctcctctgtctg

SEQ ID NO: 4056469 - DNA, 19 bp, Homo sapiens
agcctcctctgtctgccct

SEQ ID NO: 4056470 - DNA, 14 bp, Homo sapiens
agcctcctgagcct

SEQ ID NO: 4056471 - DNA, 17 bp, Homo sapiens
agcctcctgtgcctggc

SEQ ID NO: 4056472 - DNA, 20 bp, Homo sapiens
agcctcgcaggcctccctgc

SEQ ID NO: 4056473 - DNA, 12 bp, Homo sapiens
agcctcgcctgt

SEQ ID NO: 4056474 - DNA, 13 bp, Homo sapiens
agcctcgcctgtc

SEQ ID NO: 4056475 - DNA, 16 bp, Homo sapiens
agcctcgcctgtcacc

SEQ ID NO: 4056476 - DNA, 12 bp, Homo sapiens
agcctctggcta

SEQ ID NO: 4056477 - DNA, 13 bp, Homo sapiens
agcctctggctag

SEQ ID NO: 4056478 - DNA, 15 bp, Homo sapiens
agcctctggctagag

SEQ ID NO: 4056479 - DNA, 13 bp, Homo sapiens
agcctctgggccc

SEQ ID NO: 4056480 - DNA, 19 bp, Homo sapiens
agcctcttgcgtattggct

SEQ ID NO: 4056481 - DNA, 16 bp, Homo sapiens
agcctgaccttccttc

SEQ ID NO: 4056482 - DNA, 21 bp, Homo sapiens
agcctgaccttccttcctgtt

SEQ ID NO: 4056483 - DNA, 16 bp, Homo sapiens
agcctgagcaactctt

SEQ ID NO: 4056484 - DNA, 16 bp, Homo sapiens
agcctgagtctcctgt

SEQ ID NO: 4056485 - DNA, 18 bp, Homo sapiens
agcctgcaaactcactgc

SEQ ID NO: 4056486 - DNA, 19 bp, Homo sapiens
agcctgcaaactcactgct

SEQ ID NO: 4056487 - DNA, 14 bp, Homo sapiens
agcctgcagcagga

SEQ ID NO: 4056488 - DNA, 21 bp, Homo sapiens
agcctgcccaagcccaggcca

SEQ ID NO: 4056489 - DNA, 22 bp, Homo sapiens
agcctgcccaagcccaggccac

SEQ ID NO: 4056490 - DNA, 14 bp, Homo sapiens
agcctgccccagcg

SEQ ID NO: 4056491 - DNA, 14 bp, Homo sapiens
agcctgcctggagc

SEQ ID NO: 4056492 - DNA, 11 bp, Homo sapiens
agcctgctcct

SEQ ID NO: 4056493 - DNA, 16 bp, Homo sapiens
agcctgctccttccct

SEQ ID NO: 4056494 - DNA, 15 bp, Homo sapiens
agcctgctgagagcc

SEQ ID NO: 4056495 - DNA, 11 bp, Homo sapiens
agcctgctgca

SEQ ID NO: 4056496 - DNA, 17 bp, Homo sapiens
agcctgctgcccaggct

SEQ ID NO: 4056497 - DNA, 12 bp, Homo sapiens
agcctgctggaa

SEQ ID NO: 4056498 - DNA, 11 bp, Homo sapiens
agcctgctggc

SEQ ID NO: 4056499 - DNA, 18 bp, Homo sapiens
agcctgctggcacccacc

SEQ ID NO: 4056500 - DNA, 21 bp, Homo sapiens
agcctgctggtcacagcctcc

SEQ ID NO: 4056501 - DNA, 22 bp, Homo sapiens
agcctgctggtcacagcctcct

SEQ ID NO: 4056502 - DNA, 13 bp, Homo sapiens
agcctggactctg

SEQ ID NO: 4056503 - DNA, 21 bp, Homo sapiens
agcctggactttggttctctc

SEQ ID NO: 4056504 - DNA, 21 bp, Homo sapiens
agcctggccaccagccatcct

SEQ ID NO: 4056505 - DNA, 12 bp, Homo sapiens
agcctggccaga

SEQ ID NO: 4056506 - DNA, 21 bp, Homo sapiens
agcctggccagacacaggccc

SEQ ID NO: 4056507 - DNA, 21 bp, Homo sapiens
agcctggccccaggccccaga

SEQ ID NO: 4056508 - DNA, 19 bp, Homo sapiens
agcctgggagcccagaggg

SEQ ID NO: 4056509 - DNA, 18 bp, Homo sapiens
agcctgggcaacagagca

SEQ ID NO: 4056510 - DNA, 20 bp, Homo sapiens
agcctgggcagccaggctgc

SEQ ID NO: 4056511 - DNA, 14 bp, Homo sapiens
agcctgggggccag

SEQ ID NO: 4056512 - DNA, 16 bp, Homo sapiens
agcctgtcatccttgg

SEQ ID NO: 4056513 - DNA, 22 bp, Homo sapiens
agcctgtcatccttggtctttg

SEQ ID NO: 4056514 - DNA, 19 bp, Homo sapiens
agcctgtcccatggacact

SEQ ID NO: 4056515 - DNA, 15 bp, Homo sapiens
agcctgtgcagcctt

SEQ ID NO: 4056516 - DNA, 11 bp, Homo sapiens
agcctgtgcct

SEQ ID NO: 4056517 - DNA, 13 bp, Homo sapiens
agcctgtgcctcc

SEQ ID NO: 4056518 - DNA, 18 bp, Homo sapiens
agcctgtgcctcccagct

SEQ ID NO: 4056519 - DNA, 17 bp, Homo sapiens
agcctgtgcctctggga

SEQ ID NO: 4056520 - DNA, 19 bp, Homo sapiens
agcctgtgcctctgggact

SEQ ID NO: 4056521 - DNA, 21 bp, Homo sapiens
agcctgtgcctctgggactgg

SEQ ID NO: 4056522 - DNA, 11 bp, Homo sapiens
agcctgtggca

SEQ ID NO: 4056523 - DNA, 14 bp, Homo sapiens
agcctgtggcatct

SEQ ID NO: 4056524 - DNA, 14 bp, Homo sapiens
agcctgttcccctc

SEQ ID NO: 4056525 - DNA, 18 bp, Homo sapiens
agcctgttcccctcactg

SEQ ID NO: 4056526 - DNA, 22 bp, Homo sapiens
agcctgttcccctcactggatg

SEQ ID NO: 4056527 - DNA, 13 bp, Homo sapiens
agccttaaactgt

SEQ ID NO: 4056528 - DNA, 19 bp, Homo sapiens
agccttaaactgtacagaa

SEQ ID NO: 4056529 - DNA, 14 bp, Homo sapiens
agccttaagctgca

SEQ ID NO: 4056530 - DNA, 14 bp, Homo sapiens
agccttacacaggg

SEQ ID NO: 4056531 - DNA, 13 bp, Homo sapiens
agccttagctgcc

SEQ ID NO: 4056532 - DNA, 20 bp, Homo sapiens
agccttagctgccagtgctg

SEQ ID NO: 4056533 - DNA, 22 bp, Homo sapiens
agccttagggaagctggcctga

SEQ ID NO: 4056534 - DNA, 21 bp, Homo sapiens
agccttataaaccaatcttaa

SEQ ID NO: 4056535 - DNA, 14 bp, Homo sapiens
agccttatttctag

SEQ ID NO: 4056536 - DNA, 22 bp, Homo sapiens
agccttatttctagaagcacat

SEQ ID NO: 4056537 - DNA, 21 bp, Homo sapiens
agccttcagagtacgtcctgc

SEQ ID NO: 4056538 - DNA, 17 bp, Homo sapiens
agccttccaactagctg

SEQ ID NO: 4056539 - DNA, 24 bp, Homo sapiens
agccttctccatatctccatggcc

SEQ ID NO: 4056540 - DNA, 13 bp, Homo sapiens
agccttgccagag

SEQ ID NO: 4056541 - DNA, 15 bp, Homo sapiens
agccttgccagagat

SEQ ID NO: 4056542 - DNA, 19 bp, Homo sapiens
agccttggaaccagcccca

SEQ ID NO: 4056543 - DNA, 20 bp, Homo sapiens
agccttggaaccagccccat

SEQ ID NO: 4056544 - DNA, 23 bp, Homo sapiens
agccttggaaccagccccatcag

SEQ ID NO: 4056545 - DNA, 18 bp, Homo sapiens
agccttgtaattctaaat

SEQ ID NO: 4056546 - DNA, 10 bp, Homo sapiens
agccttgtgt

SEQ ID NO: 4056547 - DNA, 14 bp, Homo sapiens
agccttgtgtatat

SEQ ID NO: 4056548 - DNA, 19 bp, Homo sapiens
agccttgtgtatatttgta

SEQ ID NO: 4056549 - DNA, 13 bp, Homo sapiens
agcctttaatgca

SEQ ID NO: 4056550 - DNA, 15 bp, Homo sapiens
agcctttaatgcatc

SEQ ID NO: 4056551 - DNA, 22 bp, Homo sapiens
agcctttccataaggaatgtag

SEQ ID NO: 4056552 - DNA, 13 bp, Homo sapiens
agctcaggacaga

SEQ ID NO: 4056553 - DNA, 19 bp, Homo sapiens
agctcagtttatccaaggt

SEQ ID NO: 4056554 - DNA, 23 bp, Homo sapiens
agctcatctccaaggatcctctc

SEQ ID NO: 4056555 - DNA, 16 bp, Homo sapiens
agctcatctgcaaaag

SEQ ID NO: 4056556 - DNA, 15 bp, Homo sapiens
agctccaccctggcc

SEQ ID NO: 4056557 - DNA, 22 bp, Homo sapiens
agctccccacaccttccagggc

SEQ ID NO: 4056558 - DNA, 14 bp, Homo sapiens
agctccccagatct

SEQ ID NO: 4056559 - DNA, 21 bp, Homo sapiens
agctcccccaggctgttctcc

SEQ ID NO: 4056560 - DNA, 20 bp, Homo sapiens
agctccccccacctccccca

SEQ ID NO: 4056561 - DNA, 18 bp, Homo sapiens
agctcccgctccgggctc

SEQ ID NO: 4056562 - DNA, 16 bp, Homo sapiens
agctccctttctcagg

SEQ ID NO: 4056563 - DNA, 19 bp, Homo sapiens
agctcccttttctttttcc

SEQ ID NO: 4056564 - DNA, 12 bp, Homo sapiens
agctcctcccac

SEQ ID NO: 4056565 - DNA, 16 bp, Homo sapiens
agctcctctccccagc

SEQ ID NO: 4056566 - DNA, 15 bp, Homo sapiens
agctcctctcctgga

SEQ ID NO: 4056567 - DNA, 20 bp, Homo sapiens
agctcctgccacatggagcc

SEQ ID NO: 4056568 - DNA, 18 bp, Homo sapiens
agctcctgctgcggagga

SEQ ID NO: 4056569 - DNA, 19 bp, Homo sapiens
agctcctgctgcggaggag

SEQ ID NO: 4056570 - DNA, 22 bp, Homo sapiens
agctcctgctgcggaggagctg

SEQ ID NO: 4056571 - DNA, 11 bp, Homo sapiens
agctcctgtaa

SEQ ID NO: 4056572 - DNA, 13 bp, Homo sapiens
agctcctgtcctc

SEQ ID NO: 4056573 - DNA, 15 bp, Homo sapiens
agctcctgtcctccc

SEQ ID NO: 4056574 - DNA, 16 bp, Homo sapiens
agctcctgtcctccca

SEQ ID NO: 4056575 - DNA, 19 bp, Homo sapiens
agctccttgagtaaaaagg

SEQ ID NO: 4056576 - DNA, 14 bp, Homo sapiens
agctccttttccag

SEQ ID NO: 4056577 - DNA, 19 bp, Homo sapiens
agctccttttccagagcat

SEQ ID NO: 4056578 - DNA, 23 bp, Homo sapiens
agctccttttccgttctgttctg

SEQ ID NO: 4056579 - DNA, 19 bp, Homo sapiens
agctcgcacccccctgttc

SEQ ID NO: 4056580 - DNA, 21 bp, Homo sapiens
agctcgcacccccctgttcta

SEQ ID NO: 4056581 - DNA, 14 bp, Homo sapiens
agctcgtttttcag

SEQ ID NO: 4056582 - DNA, 19 bp, Homo sapiens
agctcgtttttcagcaccc

SEQ ID NO: 4056583 - DNA, 22 bp, Homo sapiens
agctcgtttttcagcaccccca

SEQ ID NO: 4056584 - DNA, 16 bp, Homo sapiens
agctctaccctgctcc

SEQ ID NO: 4056585 - DNA, 13 bp, Homo sapiens
agctctctaggcc

SEQ ID NO: 4056586 - DNA, 18 bp, Homo sapiens
agctctctaggcctctcc

SEQ ID NO: 4056587 - DNA, 13 bp, Homo sapiens
agctctctgccct

SEQ ID NO: 4056588 - DNA, 15 bp, Homo sapiens
agctctgacccttgg

SEQ ID NO: 4056589 - DNA, 21 bp, Homo sapiens
agctctgagacccttttctca

SEQ ID NO: 4056590 - DNA, 12 bp, Homo sapiens
agctctgcatta

SEQ ID NO: 4056591 - DNA, 21 bp, Homo sapiens
agctctggacagccccaccct

SEQ ID NO: 4056592 - DNA, 15 bp, Homo sapiens
agctctgggagagga

SEQ ID NO: 4056593 - DNA, 18 bp, Homo sapiens
agctctgggagaggattt

SEQ ID NO: 4056594 - DNA, 12 bp, Homo sapiens
agctctggggac

SEQ ID NO: 4056595 - DNA, 20 bp, Homo sapiens
agctctggggacagcttcct

SEQ ID NO: 4056596 - DNA, 23 bp, Homo sapiens
agctctggggacagcttcctcac

SEQ ID NO: 4056597 - DNA, 22 bp, Homo sapiens
agctctgggttgtgcacatttc

SEQ ID NO: 4056598 - DNA, 18 bp, Homo sapiens
agctcttactctttccta

SEQ ID NO: 4056599 - DNA, 20 bp, Homo sapiens
agctcttcaatagctaagca

SEQ ID NO: 4056600 - DNA, 18 bp, Homo sapiens
agctcttcacaccattca

SEQ ID NO: 4056601 - DNA, 13 bp, Homo sapiens
agctcttcaggcc

SEQ ID NO: 4056602 - DNA, 18 bp, Homo sapiens
agctcttcaggcctccct

SEQ ID NO: 4056603 - DNA, 20 bp, Homo sapiens
agctcttcctggacaggcca

SEQ ID NO: 4056604 - DNA, 22 bp, Homo sapiens
agctcttcctggacaggccagg

SEQ ID NO: 4056605 - DNA, 17 bp, Homo sapiens
agctcttggcccctgtg

SEQ ID NO: 4056606 - DNA, 14 bp, Homo sapiens
agctcttggccttt

SEQ ID NO: 4056607 - DNA, 23 bp, Homo sapiens
agctcttggcctttgcatttatt

SEQ ID NO: 4056608 - DNA, 23 bp, Homo sapiens
agctcttgtcctcagtccattta

SEQ ID NO: 4056609 - DNA, 21 bp, Homo sapiens
agctgaacaataggctgttcc

SEQ ID NO: 4056610 - DNA, 22 bp, Homo sapiens
agctgaacaataggctgttccc

SEQ ID NO: 4056611 - DNA, 23 bp, Homo sapiens
agctgaacaataggctgttccca

SEQ ID NO: 4056612 - DNA, 22 bp, Homo sapiens
agctgaacagatgacccctgcc

SEQ ID NO: 4056613 - DNA, 21 bp, Homo sapiens
agctgaatgcctcctgtgggg

SEQ ID NO: 4056614 - DNA, 17 bp, Homo sapiens
agctgaccccgagaagt

SEQ ID NO: 4056615 - DNA, 17 bp, Homo sapiens
agctgacccggcctctc

SEQ ID NO: 4056616 - DNA, 22 bp, Homo sapiens
agctgacccggcctctctgccc

SEQ ID NO: 4056617 - DNA, 10 bp, Homo sapiens
agctgagccc

SEQ ID NO: 4056618 - DNA, 12 bp, Homo sapiens
agctgagccctg

SEQ ID NO: 4056619 - DNA, 17 bp, Homo sapiens
agctgagccctggggac

SEQ ID NO: 4056620 - DNA, 21 bp, Homo sapiens
agctgagccctggggactgtt

SEQ ID NO: 4056621 - DNA, 12 bp, Homo sapiens
agctgagcgcca

SEQ ID NO: 4056622 - DNA, 15 bp, Homo sapiens
agctgagcgccagga

SEQ ID NO: 4056623 - DNA, 23 bp, Homo sapiens
agctgagcttcggttctccagaa

SEQ ID NO: 4056624 - DNA, 13 bp, Homo sapiens
agctgaggccaca

SEQ ID NO: 4056625 - DNA, 21 bp, Homo sapiens
agctgaggccacactcagcac

SEQ ID NO: 4056626 - DNA, 23 bp, Homo sapiens
agctgaggtctcttgagggagct

SEQ ID NO: 4056627 - DNA, 14 bp, Homo sapiens
agctgagtggccag

SEQ ID NO: 4056628 - DNA, 17 bp, Homo sapiens
agctgagtggccagcca

SEQ ID NO: 4056629 - DNA, 16 bp, Homo sapiens
agctgatacttcattt

SEQ ID NO: 4056630 - DNA, 15 bp, Homo sapiens
agctgatataaattc

SEQ ID NO: 4056631 - DNA, 18 bp, Homo sapiens
agctgatataaattctgt

SEQ ID NO: 4056632 - DNA, 20 bp, Homo sapiens
agctgatcataagtgaattt

SEQ ID NO: 4056633 - DNA, 13 bp, Homo sapiens
agctgatgaaact

SEQ ID NO: 4056634 - DNA, 20 bp, Homo sapiens
agctgatgtgttgccacttt

SEQ ID NO: 4056635 - DNA, 15 bp, Homo sapiens
agctgcaccagagca

SEQ ID NO: 4056636 - DNA, 11 bp, Homo sapiens
agctgcactga

SEQ ID NO: 4056637 - DNA, 20 bp, Homo sapiens
agctgcactgatgctgcccc

SEQ ID NO: 4056638 - DNA, 13 bp, Homo sapiens
agctgcagcctgg

SEQ ID NO: 4056639 - DNA, 15 bp, Homo sapiens
agctgcagcctggct

SEQ ID NO: 4056640 - DNA, 16 bp, Homo sapiens
agctgcagcctggctg

SEQ ID NO: 4056641 - DNA, 17 bp, Homo sapiens
agctgcagctgagcctg

SEQ ID NO: 4056642 - DNA, 16 bp, Homo sapiens
agctgcaggaatcaaa

SEQ ID NO: 4056643 - DNA, 22 bp, Homo sapiens
agctgcaggtgccagggcccac

SEQ ID NO: 4056644 - DNA, 17 bp, Homo sapiens
agctgcatatcttcatc

SEQ ID NO: 4056645 - DNA, 23 bp, Homo sapiens
agctgcatcatccttgcaggtgg

SEQ ID NO: 4056646 - DNA, 17 bp, Homo sapiens
agctgccaaccctcccg

SEQ ID NO: 4056647 - DNA, 18 bp, Homo sapiens
agctgccaaccctcccgg

SEQ ID NO: 4056648 - DNA, 14 bp, Homo sapiens
agctgccagcccag

SEQ ID NO: 4056649 - DNA, 18 bp, Homo sapiens
agctgccagcccagaaca

SEQ ID NO: 4056650 - DNA, 19 bp, Homo sapiens
agctgccagcccagaacac

SEQ ID NO: 4056651 - DNA, 20 bp, Homo sapiens
agctgccagcccagaacacc

SEQ ID NO: 4056652 - DNA, 15 bp, Homo sapiens
agctgccagtgctgg

SEQ ID NO: 4056653 - DNA, 19 bp, Homo sapiens
agctgccagtgctggtcac

SEQ ID NO: 4056654 - DNA, 17 bp, Homo sapiens
aggacagagttcacagg

SEQ ID NO: 4056655 - DNA, 13 bp, Homo sapiens
aggacatcagcaa

SEQ ID NO: 4056656 - DNA, 14 bp, Homo sapiens
aggacatcagcaaa

SEQ ID NO: 4056657 - DNA, 23 bp, Homo sapiens
aggaccaataaaatttctaagag

SEQ ID NO: 4056658 - DNA, 22 bp, Homo sapiens
aggaccactcctgtacactgaa

SEQ ID NO: 4056659 - DNA, 12 bp, Homo sapiens
aggaccagctca

SEQ ID NO: 4056660 - DNA, 13 bp, Homo sapiens
aggaccagctcag

SEQ ID NO: 4056661 - DNA, 14 bp, Homo sapiens
aggaccagctcagg

SEQ ID NO: 4056662 - DNA, 17 bp, Homo sapiens
aggaccaggactccctc

SEQ ID NO: 4056663 - DNA, 12 bp, Homo sapiens
aggaccagggct

SEQ ID NO: 4056664 - DNA, 20 bp, Homo sapiens
aggacccggaggggcctggc

SEQ ID NO: 4056665 - DNA, 14 bp, Homo sapiens
aggaccctgcacct

SEQ ID NO: 4056666 - DNA, 20 bp, Homo sapiens
aggacctctgtaggcagcag

SEQ ID NO: 4056667 - DNA, 18 bp, Homo sapiens
aggacctgagctggccag

SEQ ID NO: 4056668 - DNA, 23 bp, Homo sapiens
aggacctgagctggccaggccct

SEQ ID NO: 4056669 - DNA, 13 bp, Homo sapiens
aggacctggctgc

SEQ ID NO: 4056670 - DNA, 15 bp, Homo sapiens
aggaccttatctgtg

SEQ ID NO: 4056671 - DNA, 21 bp, Homo sapiens
aggacctttgggtctacaagt

SEQ ID NO: 4056672 - DNA, 17 bp, Homo sapiens
aggacgcctgcaggaga

SEQ ID NO: 4056673 - DNA, 17 bp, Homo sapiens
aggacgcttcacaggac

SEQ ID NO: 4056674 - DNA, 19 bp, Homo sapiens
aggacgcttcacaggacag

SEQ ID NO: 4056675 - DNA, 23 bp, Homo sapiens
aggacggctcctcagagcgccag

SEQ ID NO: 4056676 - DNA, 22 bp, Homo sapiens
aggacgtggatgaccctcccct

SEQ ID NO: 4056677 - DNA, 16 bp, Homo sapiens
aggactccaggcccaa

SEQ ID NO: 4056678 - DNA, 18 bp, Homo sapiens
aggactcccaaccctggc

SEQ ID NO: 4056679 - DNA, 20 bp, Homo sapiens
aggactcccaaccctggctt

SEQ ID NO: 4056680 - DNA, 18 bp, Homo sapiens
aggactccccaggccagg

SEQ ID NO: 4056681 - DNA, 21 bp, Homo sapiens
aggactcccggagcctgtgca

SEQ ID NO: 4056682 - DNA, 13 bp, Homo sapiens
aggactccctcct

SEQ ID NO: 4056683 - DNA, 15 bp, Homo sapiens
aggactccctcctca

SEQ ID NO: 4056684 - DNA, 16 bp, Homo sapiens
aggactccctcctcac

SEQ ID NO: 4056685 - DNA, 20 bp, Homo sapiens
aggactgagcaccctctgga

SEQ ID NO: 4056686 - DNA, 22 bp, Homo sapiens
aggactgagtcccctccaggaa

SEQ ID NO: 4056687 - DNA, 17 bp, Homo sapiens
aggacttaacggctcca

SEQ ID NO: 4056688 - DNA, 20 bp, Homo sapiens
aggacttcctgtccagctcc

SEQ ID NO: 4056689 - DNA, 21 bp, Homo sapiens
aggacttgaaagcatccatgt

SEQ ID NO: 4056690 - DNA, 17 bp, Homo sapiens
aggacttggggtcagga

SEQ ID NO: 4056691 - DNA, 20 bp, Homo sapiens
aggacttggtctgatttcag

SEQ ID NO: 4056692 - DNA, 23 bp, Homo sapiens
aggacttggtctgatttcaggat

SEQ ID NO: 4056693 - DNA, 11 bp, Homo sapiens
aggactttgca

SEQ ID NO: 4056694 - DNA, 22 bp, Homo sapiens
aggacttttaaatggcagtatt

SEQ ID NO: 4056695 - DNA, 18 bp, Homo sapiens
aggagaaacacattctta

SEQ ID NO: 4056696 - DNA, 19 bp, Homo sapiens
aggagaaacacattcttat

SEQ ID NO: 4056697 - DNA, 14 bp, Homo sapiens
aggagaaccactac

SEQ ID NO: 4056698 - DNA, 13 bp, Homo sapiens
aggagaagaaaat

SEQ ID NO: 4056699 - DNA, 11 bp, Homo sapiens
aggagaagcca

SEQ ID NO: 4056700 - DNA, 20 bp, Homo sapiens
aggagaatcgcttgaaccca

SEQ ID NO: 4056701 - DNA, 20 bp, Homo sapiens
aggagaattgcttgaacctg

SEQ ID NO: 4056702 - DNA, 17 bp, Homo sapiens
aggagaccaaggcggga

SEQ ID NO: 4056703 - DNA, 15 bp, Homo sapiens
aggagaccagctcag

SEQ ID NO: 4056704 - DNA, 16 bp, Homo sapiens
aggagaccagctcaga

SEQ ID NO: 4056705 - DNA, 16 bp, Homo sapiens
aggagacggaggggag

SEQ ID NO: 4056706 - DNA, 13 bp, Homo sapiens
aggagactgaggc

SEQ ID NO: 4056707 - DNA, 18 bp, Homo sapiens
aggagagactgagcagcc

SEQ ID NO: 4056708 - DNA, 18 bp, Homo sapiens
aggagagccaacctcggc

SEQ ID NO: 4056709 - DNA, 12 bp, Homo sapiens
aggagagcctgc

SEQ ID NO: 4056710 - DNA, 16 bp, Homo sapiens
aggagagcctgctgca

SEQ ID NO: 4056711 - DNA, 20 bp, Homo sapiens
aggagagcctgctgcatggg

SEQ ID NO: 4056712 - DNA, 13 bp, Homo sapiens
aggagaggagggt

SEQ ID NO: 4056713 - DNA, 18 bp, Homo sapiens
aggagaggatgagagccc

SEQ ID NO: 4056714 - DNA, 19 bp, Homo sapiens
aggagaggatgagagccca

SEQ ID NO: 4056715 - DNA, 20 bp, Homo sapiens
aggagaggcaacatccaaaa

SEQ ID NO: 4056716 - DNA, 21 bp, Homo sapiens
aggagaggcaacatccaaaat

SEQ ID NO: 4056717 - DNA, 19 bp, Homo sapiens
aggagaggggaagggccag

SEQ ID NO: 4056718 - DNA, 23 bp, Homo sapiens
aggagatcgagaccatcctggct

SEQ ID NO: 4056719 - DNA, 17 bp, Homo sapiens
aggagatgaccagggat

SEQ ID NO: 4056720 - DNA, 21 bp, Homo sapiens
aggagatggaaacaatgtgga

SEQ ID NO: 4056721 - DNA, 14 bp, Homo sapiens
aggagatgggcctt

SEQ ID NO: 4056722 - DNA, 16 bp, Homo sapiens
aggagatgggtccagg

SEQ ID NO: 4056723 - DNA, 14 bp, Homo sapiens
aggagcaatgggac

SEQ ID NO: 4056724 - DNA, 18 bp, Homo sapiens
aggagcaatgggactgga

SEQ ID NO: 4056725 - DNA, 21 bp, Homo sapiens
aggagcaatgggactggagtc

SEQ ID NO: 4056726 - DNA, 16 bp, Homo sapiens
aggagccagacagacc

SEQ ID NO: 4056727 - DNA, 14 bp, Homo sapiens
aggagccccgccac

SEQ ID NO: 4056728 - DNA, 21 bp, Homo sapiens
aggagcctagcggagcccagc

SEQ ID NO: 4056729 - DNA, 14 bp, Homo sapiens
aggagcctgctggt

SEQ ID NO: 4056730 - DNA, 14 bp, Homo sapiens
aggagcgctccctt

SEQ ID NO: 4056731 - DNA, 18 bp, Homo sapiens
aggagctagtaggaatgt

SEQ ID NO: 4056732 - DNA, 15 bp, Homo sapiens
aggagctcaggtggg

SEQ ID NO: 4056733 - DNA, 19 bp, Homo sapiens
aggagctctaccctgctcc

SEQ ID NO: 4056734 - DNA, 21 bp, Homo sapiens
aggagctctaccctgctccct

SEQ ID NO: 4056735 - DNA, 17 bp, Homo sapiens
aggagctcttcaggcct

SEQ ID NO: 4056736 - DNA, 21 bp, Homo sapiens
aggagctcttcaggcctccct

SEQ ID NO: 4056737 - DNA, 18 bp, Homo sapiens
aggagctgatggcagctg

SEQ ID NO: 4056738 - DNA, 15 bp, Homo sapiens
aggagctgcactgat

SEQ ID NO: 4056739 - DNA, 19 bp, Homo sapiens
aggagctgccttggctcag

SEQ ID NO: 4056740 - DNA, 23 bp, Homo sapiens
aggagctgccttggctcagacat

SEQ ID NO: 4056741 - DNA, 21 bp, Homo sapiens
aggagctgctggcttgcagtg

SEQ ID NO: 4056742 - DNA, 13 bp, Homo sapiens
aggagctgggccc

SEQ ID NO: 4056743 - DNA, 12 bp, Homo sapiens
aggagctgggga

SEQ ID NO: 4056744 - DNA, 20 bp, Homo sapiens
aggagctggggatccctccc

SEQ ID NO: 4056745 - DNA, 20 bp, Homo sapiens
aggagctgtcaccaaggaaa

SEQ ID NO: 4056746 - DNA, 20 bp, Homo sapiens
aggagcttcttgtttccttg

SEQ ID NO: 4056747 - DNA, 19 bp, Homo sapiens
aggagcttgggcagtgccc

SEQ ID NO: 4056748 - DNA, 13 bp, Homo sapiens
aggagcttttctg

SEQ ID NO: 4056749 - DNA, 14 bp, Homo sapiens
aggaggaaaaggaa

SEQ ID NO: 4056750 - DNA, 16 bp, Homo sapiens
aggaggaaaaggaaaa

SEQ ID NO: 4056751 - DNA, 23 bp, Homo sapiens
aggaggaatcatgtcaggcctgt

SEQ ID NO: 4056752 - DNA, 19 bp, Homo sapiens
aggaggaatgctggactgg

SEQ ID NO: 4056753 - DNA, 20 bp, Homo sapiens
aggaggcagccccctccaca

SEQ ID NO: 4056754 - DNA, 22 bp, Homo sapiens
aggaggccaaactgtccctccc

SEQ ID NO: 4056755 - DNA, 17 bp, Homo sapiens
aggaggcctccatctca

SEQ ID NO: 4056756 - DNA, 20 bp, Homo sapiens
aggcccagcgcggccagcgt

SEQ ID NO: 4056757 - DNA, 13 bp, Homo sapiens
aggcccaggcctc

SEQ ID NO: 4056758 - DNA, 16 bp, Homo sapiens
aggcccaggctgggaa

SEQ ID NO: 4056759 - DNA, 22 bp, Homo sapiens
aggcccagggagggaagtgtga

SEQ ID NO: 4056760 - DNA, 18 bp, Homo sapiens
aggcccatggttgagaaa

SEQ ID NO: 4056761 - DNA, 13 bp, Homo sapiens
aggccccactgat

SEQ ID NO: 4056762 - DNA, 15 bp, Homo sapiens
aggcccccagtggga

SEQ ID NO: 4056763 - DNA, 15 bp, Homo sapiens
aggccccctgcctgc

SEQ ID NO: 4056764 - DNA, 18 bp, Homo sapiens
aggccccctgcctgccct

SEQ ID NO: 4056765 - DNA, 19 bp, Homo sapiens
aggccccttctctccctgc

SEQ ID NO: 4056766 - DNA, 20 bp, Homo sapiens
aggccccttctctccctgcc

SEQ ID NO: 4056767 - DNA, 20 bp, Homo sapiens
aggccctcaatccaccttca

SEQ ID NO: 4056768 - DNA, 10 bp, Homo sapiens
aggccctccc

SEQ ID NO: 4056769 - DNA, 17 bp, Homo sapiens
aggccctcctgtgctgg

SEQ ID NO: 4056770 - DNA, 15 bp, Homo sapiens
aggccctgagacagg

SEQ ID NO: 4056771 - DNA, 21 bp, Homo sapiens
aggccctgaggcggaggctgt

SEQ ID NO: 4056772 - DNA, 18 bp, Homo sapiens
aggccctgctcctgcagc

SEQ ID NO: 4056773 - DNA, 19 bp, Homo sapiens
aggccctgctcctgcagca

SEQ ID NO: 4056774 - DNA, 15 bp, Homo sapiens
aggccctgctgccca

SEQ ID NO: 4056775 - DNA, 15 bp, Homo sapiens
aggcccttcctctcc

SEQ ID NO: 4056776 - DNA, 19 bp, Homo sapiens
aggcccttcctctccactg

SEQ ID NO: 4056777 - DNA, 21 bp, Homo sapiens
aggccctttgaagcctcagct

SEQ ID NO: 4056778 - DNA, 19 bp, Homo sapiens
aggccgaaggtgcctcaga

SEQ ID NO: 4056779 - DNA, 15 bp, Homo sapiens
aggccgaggtcccat

SEQ ID NO: 4056780 - DNA, 20 bp, Homo sapiens
aggccgcagctccattttct

SEQ ID NO: 4056781 - DNA, 20 bp, Homo sapiens
aggccggaaccacagggcca

SEQ ID NO: 4056782 - DNA, 23 bp, Homo sapiens
aggccggaaccacagggccagag

SEQ ID NO: 4056783 - DNA, 12 bp, Homo sapiens
aggccggcccag

SEQ ID NO: 4056784 - DNA, 13 bp, Homo sapiens
aggccggcccaga

SEQ ID NO: 4056785 - DNA, 15 bp, Homo sapiens
aggccggcccagatg

SEQ ID NO: 4056786 - DNA, 19 bp, Homo sapiens
aggccgggcagagcacagc

SEQ ID NO: 4056787 - DNA, 17 bp, Homo sapiens
aggccgggcttgggccc

SEQ ID NO: 4056788 - DNA, 21 bp, Homo sapiens
aggccgggcttgggccctgca

SEQ ID NO: 4056789 - DNA, 13 bp, Homo sapiens
aggccgtgtctct

SEQ ID NO: 4056790 - DNA, 16 bp, Homo sapiens
aggcctataaccccag

SEQ ID NO: 4056791 - DNA, 16 bp, Homo sapiens
aggcctcaccacctga

SEQ ID NO: 4056792 - DNA, 19 bp, Homo sapiens
aggcctcaggtgctgtcca

SEQ ID NO: 4056793 - DNA, 13 bp, Homo sapiens
aggcctccctcag

SEQ ID NO: 4056794 - DNA, 14 bp, Homo sapiens
aggcctccctcagg

SEQ ID NO: 4056795 - DNA, 20 bp, Homo sapiens
aggcctccctcaggctctgt

SEQ ID NO: 4056796 - DNA, 23 bp, Homo sapiens
aggcctccctcaggctctgtgga

SEQ ID NO: 4056797 - DNA, 24 bp, Homo sapiens
aggcctctccagtttgcacctgtc

SEQ ID NO: 4056798 - DNA, 12 bp, Homo sapiens
aggcctctgctg

SEQ ID NO: 4056799 - DNA, 13 bp, Homo sapiens
aggcctctgtgtc

SEQ ID NO: 4056800 - DNA, 15 bp, Homo sapiens
aggcctctgtgtcct

SEQ ID NO: 4056801 - DNA, 16 bp, Homo sapiens
aggcctctgtgtcctt

SEQ ID NO: 4056802 - DNA, 23 bp, Homo sapiens
aggcctgaaagaggctgaggcct

SEQ ID NO: 4056803 - DNA, 19 bp, Homo sapiens
aggcctgaagccagctgcc

SEQ ID NO: 4056804 - DNA, 21 bp, Homo sapiens
aggcctgaagccagctgccct

SEQ ID NO: 4056805 - DNA, 19 bp, Homo sapiens
aggcctgaatcatgagcct

SEQ ID NO: 4056806 - DNA, 20 bp, Homo sapiens
aggcctgaatcatgagcctg

SEQ ID NO: 4056807 - DNA, 20 bp, Homo sapiens
aggcctgatcttgcctgtct

SEQ ID NO: 4056808 - DNA, 23 bp, Homo sapiens
aggcctgatcttgcctgtctggc

SEQ ID NO: 4056809 - DNA, 22 bp, Homo sapiens
aggcctgctgccagtgcagcca

SEQ ID NO: 4056810 - DNA, 19 bp, Homo sapiens
aggcctgctttgtctcctc

SEQ ID NO: 4056811 - DNA, 18 bp, Homo sapiens
aggcctggactttcctgc

SEQ ID NO: 4056812 - DNA, 13 bp, Homo sapiens
aggcctggccagg

SEQ ID NO: 4056813 - DNA, 14 bp, Homo sapiens
aggcctggccaggc

SEQ ID NO: 4056814 - DNA, 16 bp, Homo sapiens
aggcctggccaggcac

SEQ ID NO: 4056815 - DNA, 13 bp, Homo sapiens
aggcctggctgga

SEQ ID NO: 4056816 - DNA, 22 bp, Homo sapiens
aggcctggctggaggagcagca

SEQ ID NO: 4056817 - DNA, 19 bp, Homo sapiens
aggcctgggtctgtgtctc

SEQ ID NO: 4056818 - DNA, 12 bp, Homo sapiens
aggcctgggtgc

SEQ ID NO: 4056819 - DNA, 16 bp, Homo sapiens
aggcctgggtgctggc

SEQ ID NO: 4056820 - DNA, 23 bp, Homo sapiens
aggcctgggtttgtacttccacc

SEQ ID NO: 4056821 - DNA, 12 bp, Homo sapiens
aggcctgtgccc

SEQ ID NO: 4056822 - DNA, 13 bp, Homo sapiens
aggcctgtgccca

SEQ ID NO: 4056823 - DNA, 16 bp, Homo sapiens
aggcctgtgcccactc

SEQ ID NO: 4056824 - DNA, 19 bp, Homo sapiens
aggcctgtgcccactccct

SEQ ID NO: 4056825 - DNA, 18 bp, Homo sapiens
aggccttccagctgctgt

SEQ ID NO: 4056826 - DNA, 18 bp, Homo sapiens
aggccttcctctctccag

SEQ ID NO: 4056827 - DNA, 13 bp, Homo sapiens
aggccttctcctc

SEQ ID NO: 4056828 - DNA, 22 bp, Homo sapiens
aggccttctcctccccacccgc

SEQ ID NO: 4056829 - DNA, 19 bp, Homo sapiens
aggccttgggctctgctga

SEQ ID NO: 4056830 - DNA, 13 bp, Homo sapiens
aggccttgtccta

SEQ ID NO: 4056831 - DNA, 19 bp, Homo sapiens
aggcgagagaggagccaga

SEQ ID NO: 4056832 - DNA, 22 bp, Homo sapiens
aggcgaggaggccgttgccgct

SEQ ID NO: 4056833 - DNA, 15 bp, Homo sapiens
aggcgagtgccagga

SEQ ID NO: 4056834 - DNA, 18 bp, Homo sapiens
aggcgagtgccaggactc

SEQ ID NO: 4056835 - DNA, 24 bp, Homo sapiens
aggcgagtgccaggactccccagg

SEQ ID NO: 4056836 - DNA, 14 bp, Homo sapiens
aggcgccccttccc

SEQ ID NO: 4056837 - DNA, 19 bp, Homo sapiens
aggcgctagcacagctccc

SEQ ID NO: 4056838 - DNA, 13 bp, Homo sapiens
aggcggcccggcc

SEQ ID NO: 4056839 - DNA, 15 bp, Homo sapiens
aggcggcccggccag

SEQ ID NO: 4056840 - DNA, 17 bp, Homo sapiens
aggcggcccggccagcg

SEQ ID NO: 4056841 - DNA, 22 bp, Homo sapiens
aggcgtgggctgaccaggcttc

SEQ ID NO: 4056842 - DNA, 18 bp, Homo sapiens
aggctactagaattctgt

SEQ ID NO: 4056843 - DNA, 18 bp, Homo sapiens
aggctagcttctgctttt

SEQ ID NO: 4056844 - DNA, 22 bp, Homo sapiens
aggctatggggtaggagaaaag

SEQ ID NO: 4056845 - DNA, 14 bp, Homo sapiens
aggctatgtgatta

SEQ ID NO: 4056846 - DNA, 17 bp, Homo sapiens
aggctatttgtaaatct

SEQ ID NO: 4056847 - DNA, 12 bp, Homo sapiens
aggctcactgcc

SEQ ID NO: 4056848 - DNA, 14 bp, Homo sapiens
aggctcactgccag

SEQ ID NO: 4056849 - DNA, 22 bp, Homo sapiens
aggctcactgccaggccagcct

SEQ ID NO: 4056850 - DNA, 24 bp, Homo sapiens
aggctcactgccaggccagcctcc

SEQ ID NO: 4056851 - DNA, 21 bp, Homo sapiens
aggctcagagactgcaagctg

SEQ ID NO: 4056852 - DNA, 23 bp, Homo sapiens
aggctcagagactgcaagctgct

SEQ ID NO: 4056853 - DNA, 16 bp, Homo sapiens
aggctcaggtccctgg

SEQ ID NO: 4056854 - DNA, 14 bp, Homo sapiens
aggctccattagga

SEQ ID NO: 4056855 - DNA, 20 bp, Homo sapiens
aggctcccgaggggaagggg

SEQ ID NO: 4056856 - DNA, 12 bp, Homo sapiens
aggctcctcctt

SEQ ID NO: 4056857 - DNA, 15 bp, Homo sapiens
aggctctgcacagat

SEQ ID NO: 4056858 - DNA, 18 bp, Homo sapiens
agggtctcgctgtcactg

SEQ ID NO: 4056859 - DNA, 21 bp, Homo sapiens
agggtctcgctgtcactggct

SEQ ID NO: 4056860 - DNA, 22 bp, Homo sapiens
agggtctcgctgtcactggctg

SEQ ID NO: 4056861 - DNA, 17 bp, Homo sapiens
agggtctctccctcagg

SEQ ID NO: 4056862 - DNA, 17 bp, Homo sapiens
agggtctgctctttctc

SEQ ID NO: 4056863 - DNA, 17 bp, Homo sapiens
agggtctgtttggactg

SEQ ID NO: 4056864 - DNA, 15 bp, Homo sapiens
agggtcttccctacc

SEQ ID NO: 4056865 - DNA, 17 bp, Homo sapiens
agggtcttccctacctc

SEQ ID NO: 4056866 - DNA, 18 bp, Homo sapiens
agggtcttgactctaaat

SEQ ID NO: 4056867 - DNA, 14 bp, Homo sapiens
agggtcttgctctg

SEQ ID NO: 4056868 - DNA, 18 bp, Homo sapiens
agggtcttgctctgtccc

SEQ ID NO: 4056869 - DNA, 20 bp, Homo sapiens
agggtcttttttcatttctt

SEQ ID NO: 4056870 - DNA, 21 bp, Homo sapiens
agggtgatgcattaattaatg

SEQ ID NO: 4056871 - DNA, 14 bp, Homo sapiens
agggtgcccagaac

SEQ ID NO: 4056872 - DNA, 18 bp, Homo sapiens
agggtgggcttcctgccc

SEQ ID NO: 4056873 - DNA, 15 bp, Homo sapiens
agggtgggtgctcag

SEQ ID NO: 4056874 - DNA, 20 bp, Homo sapiens
agggtgggtgctcagaataa

SEQ ID NO: 4056875 - DNA, 16 bp, Homo sapiens
agggtgtggctttcca

SEQ ID NO: 4056876 - DNA, 21 bp, Homo sapiens
agggtgtggctttccaggcac

SEQ ID NO: 4056877 - DNA, 13 bp, Homo sapiens
agggttaagaaaa

SEQ ID NO: 4056878 - DNA, 18 bp, Homo sapiens
agggttactatgcacaat

SEQ ID NO: 4056879 - DNA, 14 bp, Homo sapiens
agggttcaaaatgt

SEQ ID NO: 4056880 - DNA, 13 bp, Homo sapiens
agggttcatctgt

SEQ ID NO: 4056881 - DNA, 18 bp, Homo sapiens
agggttcctcttaggtca

SEQ ID NO: 4056882 - DNA, 14 bp, Homo sapiens
agggttctggctgc

SEQ ID NO: 4056883 - DNA, 14 bp, Homo sapiens
agggttgagagcca

SEQ ID NO: 4056884 - DNA, 19 bp, Homo sapiens
agggttgtgattttgtctg

SEQ ID NO: 4056885 - DNA, 22 bp, Homo sapiens
agggttgtgattttgtctgctt

SEQ ID NO: 4056886 - DNA, 18 bp, Homo sapiens
agggtttacccagtggga

SEQ ID NO: 4056887 - DNA, 16 bp, Homo sapiens
agggtttctctgcaga

SEQ ID NO: 4056888 - DNA, 14 bp, Homo sapiens
agggtttgtggctg

SEQ ID NO: 4056889 - DNA, 22 bp, Homo sapiens
aggtaaatttttaggcaaagat

SEQ ID NO: 4056890 - DNA, 18 bp, Homo sapiens
aggtaaccttatatttac

SEQ ID NO: 4056891 - DNA, 21 bp, Homo sapiens
aggtaaccttatatttacaat

SEQ ID NO: 4056892 - DNA, 18 bp, Homo sapiens
aggtaatataaaaagctt

SEQ ID NO: 4056893 - DNA, 14 bp, Homo sapiens
aggtaatgagggac

SEQ ID NO: 4056894 - DNA, 17 bp, Homo sapiens
aggtaatgagggactgg

SEQ ID NO: 4056895 - DNA, 12 bp, Homo sapiens
aggtaatgtttt

SEQ ID NO: 4056896 - DNA, 15 bp, Homo sapiens
aggtaatgttttgta

SEQ ID NO: 4056897 - DNA, 20 bp, Homo sapiens
aggtaatgttttgtatatac

SEQ ID NO: 4056898 - DNA, 21 bp, Homo sapiens
aggtaatttttaccctaatgt

SEQ ID NO: 4056899 - DNA, 15 bp, Homo sapiens
aggtacctcatggga

SEQ ID NO: 4056900 - DNA, 13 bp, Homo sapiens
aggtactctcctg

SEQ ID NO: 4056901 - DNA, 19 bp, Homo sapiens
aggtagaaatatctgaaaa

SEQ ID NO: 4056902 - DNA, 17 bp, Homo sapiens
aggtagaacgccaggga

SEQ ID NO: 4056903 - DNA, 23 bp, Homo sapiens
aggtagagtttgaaggaggtgag

SEQ ID NO: 4056904 - DNA, 19 bp, Homo sapiens
aggtagccttgtgttctga

SEQ ID NO: 4056905 - DNA, 13 bp, Homo sapiens
aggtagcttcagc

SEQ ID NO: 4056906 - DNA, 14 bp, Homo sapiens
aggtagtttggata

SEQ ID NO: 4056907 - DNA, 13 bp, Homo sapiens
aggtatctccagg

SEQ ID NO: 4056908 - DNA, 13 bp, Homo sapiens
aggtatgaataag

SEQ ID NO: 4056909 - DNA, 20 bp, Homo sapiens
aggtatggaagggtttgtgg

SEQ ID NO: 4056910 - DNA, 18 bp, Homo sapiens
aggtattattatctttaa

SEQ ID NO: 4056911 - DNA, 18 bp, Homo sapiens
aggtattttgtagatgtg

SEQ ID NO: 4056912 - DNA, 19 bp, Homo sapiens
aggtattttgtttctttta

SEQ ID NO: 4056913 - DNA, 14 bp, Homo sapiens
aggtcaagggaaaa

SEQ ID NO: 4056914 - DNA, 17 bp, Homo sapiens
aggtcaagtaagaagac

SEQ ID NO: 4056915 - DNA, 13 bp, Homo sapiens
aggtcacagctgg

SEQ ID NO: 4056916 - DNA, 23 bp, Homo sapiens
aggtcacagctggatctgcttgt

SEQ ID NO: 4056917 - DNA, 12 bp, Homo sapiens
aggtcaccagca

SEQ ID NO: 4056918 - DNA, 15 bp, Homo sapiens
aggtcactcctgggg

SEQ ID NO: 4056919 - DNA, 23 bp, Homo sapiens
aggtcactcttcctgcaaggact

SEQ ID NO: 4056920 - DNA, 20 bp, Homo sapiens
aggtcactggaaaggggaga

SEQ ID NO: 4056921 - DNA, 19 bp, Homo sapiens
aggtcagactaagaaatat

SEQ ID NO: 4056922 - DNA, 14 bp, Homo sapiens
aggtcaggaagcag

SEQ ID NO: 4056923 - DNA, 17 bp, Homo sapiens
aggtccaagccccccac

SEQ ID NO: 4056924 - DNA, 19 bp, Homo sapiens
aggtccactccctgctcca

SEQ ID NO: 4056925 - DNA, 14 bp, Homo sapiens
aggtcccacgtctg

SEQ ID NO: 4056926 - DNA, 14 bp, Homo sapiens
aggtcccaggcaga

SEQ ID NO: 4056927 - DNA, 22 bp, Homo sapiens
aggtcccctccacatcccagca

SEQ ID NO: 4056928 - DNA, 21 bp, Homo sapiens
aggtccctgtgtgtaggctgg

SEQ ID NO: 4056929 - DNA, 13 bp, Homo sapiens
aggtcctcaataa

SEQ ID NO: 4056930 - DNA, 19 bp, Homo sapiens
aggtcctcaataaatattt

SEQ ID NO: 4056931 - DNA, 21 bp, Homo sapiens
aggtcctctacttaatgagat

SEQ ID NO: 4056932 - DNA, 17 bp, Homo sapiens
aggtcctgcccatgtgt

SEQ ID NO: 4056933 - DNA, 23 bp, Homo sapiens
aggtcctgcccatgtgtcccctc

SEQ ID NO: 4056934 - DNA, 20 bp, Homo sapiens
aggtctcctcagggtggggg

SEQ ID NO: 4056935 - DNA, 13 bp, Homo sapiens
aggtctgaaatgg

SEQ ID NO: 4056936 - DNA, 20 bp, Homo sapiens
aggtctgacacgtctgccta

SEQ ID NO: 4056937 - DNA, 12 bp, Homo sapiens
aggtctgtttaa

SEQ ID NO: 4056938 - DNA, 17 bp, Homo sapiens
aggtcttacattgcctg

SEQ ID NO: 4056939 - DNA, 14 bp, Homo sapiens
aggtcttttgacat

SEQ ID NO: 4056940 - DNA, 15 bp, Homo sapiens
aggtcttttgacatg

SEQ ID NO: 4056941 - DNA, 18 bp, Homo sapiens
aggtgaaggaggctccag

SEQ ID NO: 4056942 - DNA, 19 bp, Homo sapiens
aggtgaaggaggctccagg

SEQ ID NO: 4056943 - DNA, 22 bp, Homo sapiens
aggtgaaggctctcacccccat

SEQ ID NO: 4056944 - DNA, 15 bp, Homo sapiens
aggtgacactatagt

SEQ ID NO: 4056945 - DNA, 15 bp, Homo sapiens
aggtgacatgtgaaa

SEQ ID NO: 4056946 - DNA, 18 bp, Homo sapiens
aggtgaccctgatgaaaa

SEQ ID NO: 4056947 - DNA, 13 bp, Homo sapiens
aggtgagaaactg

SEQ ID NO: 4056948 - DNA, 19 bp, Homo sapiens
aggtgagatcacagcctcc

SEQ ID NO: 4056949 - DNA, 20 bp, Homo sapiens
aggtgagatcacagcctcca

SEQ ID NO: 4056950 - DNA, 20 bp, Homo sapiens
aggtgagtttgagctgcctt

SEQ ID NO: 4056951 - DNA, 19 bp, Homo sapiens
aggtgataggtaaattttt

SEQ ID NO: 4056952 - DNA, 23 bp, Homo sapiens
aggtgcagttcccccaacctcag

SEQ ID NO: 4056953 - DNA, 23 bp, Homo sapiens
aggtgcatctggggaactagagg

SEQ ID NO: 4056954 - DNA, 21 bp, Homo sapiens
aggtgccagggcccaccccag

SEQ ID NO: 4056955 - DNA, 16 bp, Homo sapiens
aggtgcctcagactcc

SEQ ID NO: 4056956 - DNA, 19 bp, Homo sapiens
aggtgcctcagactccgcc

SEQ ID NO: 4056957 - DNA, 13 bp, Homo sapiens
aggtgcctggagt

SEQ ID NO: 4056958 - DNA, 21 bp, Homo sapiens
aggtgcgaatgacagtagcat

SEQ ID NO: 4056959 - DNA, 16 bp, Homo sapiens
aggtggaagaagggag

SEQ ID NO: 4056960 - DNA, 17 bp, Homo sapiens
aggtggaagaagggaga

SEQ ID NO: 4056961 - DNA, 19 bp, Homo sapiens
agtaagagctggtgtctga

SEQ ID NO: 4056962 - DNA, 14 bp, Homo sapiens
agtaagaggtgtta

SEQ ID NO: 4056963 - DNA, 16 bp, Homo sapiens
agtaagatgcactgaa

SEQ ID NO: 4056964 - DNA, 21 bp, Homo sapiens
agtaaggctggtaagagaagt

SEQ ID NO: 4056965 - DNA, 23 bp, Homo sapiens
agtaaggctggtaagagaagtga

SEQ ID NO: 4056966 - DNA, 23 bp, Homo sapiens
agtaagtggggttgcaaccactg

SEQ ID NO: 4056967 - DNA, 17 bp, Homo sapiens
agtaagtgtgtcttcct

SEQ ID NO: 4056968 - DNA, 20 bp, Homo sapiens
agtaagtttcccctctggct

SEQ ID NO: 4056969 - DNA, 16 bp, Homo sapiens
agtaataaactgtgtt

SEQ ID NO: 4056970 - DNA, 13 bp, Homo sapiens
agtaatatattct

SEQ ID NO: 4056971 - DNA, 15 bp, Homo sapiens
agtaatatattctga

SEQ ID NO: 4056972 - DNA, 18 bp, Homo sapiens
agtaatcaataaagaaaa

SEQ ID NO: 4056973 - DNA, 16 bp, Homo sapiens
agtaatctaggtgtgg

SEQ ID NO: 4056974 - DNA, 12 bp, Homo sapiens
agtaatgaattt

SEQ ID NO: 4056975 - DNA, 19 bp, Homo sapiens
agtaatgtgactaaaggaa

SEQ ID NO: 4056976 - DNA, 13 bp, Homo sapiens
agtaattatcggg

SEQ ID NO: 4056977 - DNA, 18 bp, Homo sapiens
agtaattgacatgtgcca

SEQ ID NO: 4056978 - DNA, 22 bp, Homo sapiens
agtaattggtccgatctttgac

SEQ ID NO: 4056979 - DNA, 18 bp, Homo sapiens
agtaattgttccagagac

SEQ ID NO: 4056980 - DNA, 16 bp, Homo sapiens
agtacaaatgccttaa

SEQ ID NO: 4056981 - DNA, 18 bp, Homo sapiens
agtacacaataagcaaaa

SEQ ID NO: 4056982 - DNA, 19 bp, Homo sapiens
agtacacaattgttttacc

SEQ ID NO: 4056983 - DNA, 15 bp, Homo sapiens
agtacagtcttatca

SEQ ID NO: 4056984 - DNA, 17 bp, Homo sapiens
agtacatattaggaaaa

SEQ ID NO: 4056985 - DNA, 17 bp, Homo sapiens
agtacatatttattttc

SEQ ID NO: 4056986 - DNA, 21 bp, Homo sapiens
agtacatatttattttctttt

SEQ ID NO: 4056987 - DNA, 12 bp, Homo sapiens
agtacatttaat

SEQ ID NO: 4056988 - DNA, 16 bp, Homo sapiens
agtaccagccccaccc

SEQ ID NO: 4056989 - DNA, 21 bp, Homo sapiens
agtaccagcgctctaaaagca

SEQ ID NO: 4056990 - DNA, 22 bp, Homo sapiens
agtaccagcgctctaaaagcac

SEQ ID NO: 4056991 - DNA, 21 bp, Homo sapiens
agtaccatagtaccatttata

SEQ ID NO: 4056992 - DNA, 16 bp, Homo sapiens
agtaccctctcagctc

SEQ ID NO: 4056993 - DNA, 17 bp, Homo sapiens
agtacctccaagcaagt

SEQ ID NO: 4056994 - DNA, 21 bp, Homo sapiens
agtacctctcaagctagtgtt

SEQ ID NO: 4056995 - DNA, 19 bp, Homo sapiens
agtacctctgtatagaaat

SEQ ID NO: 4056996 - DNA, 20 bp, Homo sapiens
agtacctctgtatagaaatc

SEQ ID NO: 4056997 - DNA, 22 bp, Homo sapiens
agtacctctgtatagaaatcta

SEQ ID NO: 4056998 - DNA, 12 bp, Homo sapiens
agtacctgctgc

SEQ ID NO: 4056999 - DNA, 22 bp, Homo sapiens
agtacctgggtccccagccctt

SEQ ID NO: 4057000 - DNA, 14 bp, Homo sapiens
agtaccttgaactc

SEQ ID NO: 4057001 - DNA, 15 bp, Homo sapiens
agtacctttgtcaca

SEQ ID NO: 4057002 - DNA, 15 bp, Homo sapiens
agtacgttattgttg

SEQ ID NO: 4057003 - DNA, 16 bp, Homo sapiens
agtactacacattttt

SEQ ID NO: 4057004 - DNA, 22 bp, Homo sapiens
agtactacacatttttaaattg

SEQ ID NO: 4057005 - DNA, 14 bp, Homo sapiens
agtactatgtatca

SEQ ID NO: 4057006 - DNA, 18 bp, Homo sapiens
agtactcctgcaaaattt

SEQ ID NO: 4057007 - DNA, 19 bp, Homo sapiens
agtactcctgcaaaatttt

SEQ ID NO: 4057008 - DNA, 19 bp, Homo sapiens
agtactccttaagaacaca

SEQ ID NO: 4057009 - DNA, 16 bp, Homo sapiens
agtacttgaaaaagta

SEQ ID NO: 4057010 - DNA, 19 bp, Homo sapiens
agtacttgaaatctaggat

SEQ ID NO: 4057011 - DNA, 22 bp, Homo sapiens
agtacttgagtgtaatgtttgt

SEQ ID NO: 4057012 - DNA, 18 bp, Homo sapiens
agtacttgtgaaacacag

SEQ ID NO: 4057013 - DNA, 22 bp, Homo sapiens
agtacttgtgaaacacagctgt

SEQ ID NO: 4057014 - DNA, 15 bp, Homo sapiens
agtagaaataaaagt

SEQ ID NO: 4057015 - DNA, 18 bp, Homo sapiens
agtagaaataatatgcat

SEQ ID NO: 4057016 - DNA, 14 bp, Homo sapiens
agtagaaattttac

SEQ ID NO: 4057017 - DNA, 13 bp, Homo sapiens
agtagaacagata

SEQ ID NO: 4057018 - DNA, 18 bp, Homo sapiens
agtagagcttgtaataaa

SEQ ID NO: 4057019 - DNA, 17 bp, Homo sapiens
agtagagtcatctccat

SEQ ID NO: 4057020 - DNA, 23 bp, Homo sapiens
agtagcatgagagaattgtatca

SEQ ID NO: 4057021 - DNA, 19 bp, Homo sapiens
agtagcggtaccaatgcag

SEQ ID NO: 4057022 - DNA, 20 bp, Homo sapiens
agtagcgttttttaaatgta

SEQ ID NO: 4057023 - DNA, 22 bp, Homo sapiens
agtagcgttttttaaatgtata

SEQ ID NO: 4057024 - DNA, 21 bp, Homo sapiens
agtagctgggatgacaggcgc

SEQ ID NO: 4057025 - DNA, 13 bp, Homo sapiens
agtagcttgctcc

SEQ ID NO: 4057026 - DNA, 14 bp, Homo sapiens
agtagctttccaca

SEQ ID NO: 4057027 - DNA, 15 bp, Homo sapiens
agtagctttccacat

SEQ ID NO: 4057028 - DNA, 20 bp, Homo sapiens
agtagctttgcacttttcta

SEQ ID NO: 4057029 - DNA, 13 bp, Homo sapiens
agtaggcatgtta

SEQ ID NO: 4057030 - DNA, 20 bp, Homo sapiens
agtaggtcctcaataaatat

SEQ ID NO: 4057031 - DNA, 19 bp, Homo sapiens
agtagtgaagactccagaa

SEQ ID NO: 4057032 - DNA, 16 bp, Homo sapiens
agtagttttattttaa

SEQ ID NO: 4057033 - DNA, 16 bp, Homo sapiens
agtataaacaaagtta

SEQ ID NO: 4057034 - DNA, 19 bp, Homo sapiens
agtataaccatatgatact

SEQ ID NO: 4057035 - DNA, 10 bp, Homo sapiens
agtataattg

SEQ ID NO: 4057036 - DNA, 21 bp, Homo sapiens
agtatatcatgtaaagaaatg

SEQ ID NO: 4057037 - DNA, 20 bp, Homo sapiens
agtatatcccaagtgcactt

SEQ ID NO: 4057038 - DNA, 15 bp, Homo sapiens
agtatatctggacaa

SEQ ID NO: 4057039 - DNA, 14 bp, Homo sapiens
agtatatttatagt

SEQ ID NO: 4057040 - DNA, 18 bp, Homo sapiens
agtatatttatagtcaca

SEQ ID NO: 4057041 - DNA, 19 bp, Homo sapiens
agtatattttcttttcctc

SEQ ID NO: 4057042 - DNA, 15 bp, Homo sapiens
agtatcaggtctccc

SEQ ID NO: 4057043 - DNA, 18 bp, Homo sapiens
agtatcaggtctcccacg

SEQ ID NO: 4057044 - DNA, 18 bp, Homo sapiens
agtatcagtgttttaaat

SEQ ID NO: 4057045 - DNA, 20 bp, Homo sapiens
agtatcagtgttttaaattc

SEQ ID NO: 4057046 - DNA, 15 bp, Homo sapiens
agtatcatgccctgt

SEQ ID NO: 4057047 - DNA, 23 bp, Homo sapiens
agtatccaggctttgtacagagt

SEQ ID NO: 4057048 - DNA, 10 bp, Homo sapiens
agtatctcat

SEQ ID NO: 4057049 - DNA, 22 bp, Homo sapiens
agtatctcatcaacaaagaaat

SEQ ID NO: 4057050 - DNA, 14 bp, Homo sapiens
agtatgtgtaaaat

SEQ ID NO: 4057051 - DNA, 15 bp, Homo sapiens
agtattaaagggggg

SEQ ID NO: 4057052 - DNA, 20 bp, Homo sapiens
agtattaaaggggggagggg

SEQ ID NO: 4057053 - DNA, 23 bp, Homo sapiens
agtattatccacaattattggca

SEQ ID NO: 4057054 - DNA, 23 bp, Homo sapiens
agtattatctgtgttaaaatggt

SEQ ID NO: 4057055 - DNA, 18 bp, Homo sapiens
agtattatgcatatataa

SEQ ID NO: 4057056 - DNA, 23 bp, Homo sapiens
agtattctcagagcatgtgtcag

SEQ ID NO: 4057057 - DNA, 23 bp, Homo sapiens
agtattgacaactgcacatgaaa

SEQ ID NO: 4057058 - DNA, 13 bp, Homo sapiens
agtattggagcac

SEQ ID NO: 4057059 - DNA, 18 bp, Homo sapiens
agtattggagcacatgtt

SEQ ID NO: 4057060 - DNA, 13 bp, Homo sapiens
agtatttactttt

SEQ ID NO: 4057061 - DNA, 16 bp, Homo sapiens
agtatttataatagca

SEQ ID NO: 4057062 - DNA, 14 bp, Homo sapiens
agtatttatatatt

SEQ ID NO: 4057063 - DNA, 20 bp, Homo sapiens
agtgacataatatattctat

SEQ ID NO: 4057064 - DNA, 22 bp, Homo sapiens
agtgacataatatattctattt

SEQ ID NO: 4057065 - DNA, 14 bp, Homo sapiens
agtgaccccagaaa

SEQ ID NO: 4057066 - DNA, 22 bp, Homo sapiens
agtgacctggaaggcccagcac

SEQ ID NO: 4057067 - DNA, 18 bp, Homo sapiens
agtgaccttttcttcatt

SEQ ID NO: 4057068 - DNA, 16 bp, Homo sapiens
agtgactagtacaaat

SEQ ID NO: 4057069 - DNA, 19 bp, Homo sapiens
agtgactttaaaagaaaat

SEQ ID NO: 4057070 - DNA, 16 bp, Homo sapiens
agtgagacaaaatttt

SEQ ID NO: 4057071 - DNA, 19 bp, Homo sapiens
agtgagacaaaattttagt

SEQ ID NO: 4057072 - DNA, 12 bp, Homo sapiens
agtgagacagaa

SEQ ID NO: 4057073 - DNA, 14 bp, Homo sapiens
agtgagagcagatg

SEQ ID NO: 4057074 - DNA, 18 bp, Homo sapiens
agtgagcagtcgcctgcc

SEQ ID NO: 4057075 - DNA, 13 bp, Homo sapiens
agtgagccacaga

SEQ ID NO: 4057076 - DNA, 17 bp, Homo sapiens
agtgagcctcctgtgcc

SEQ ID NO: 4057077 - DNA, 19 bp, Homo sapiens
agtgagcctcctgtgcctg

SEQ ID NO: 4057078 - DNA, 16 bp, Homo sapiens
agtgagctacagagcc

SEQ ID NO: 4057079 - DNA, 14 bp, Homo sapiens
agtgaggagaatga

SEQ ID NO: 4057080 - DNA, 16 bp, Homo sapiens
agtgaggtgtgtcaca

SEQ ID NO: 4057081 - DNA, 20 bp, Homo sapiens
agtgagtaattttggatttt

SEQ ID NO: 4057082 - DNA, 18 bp, Homo sapiens
agtgagtcacctgctcca

SEQ ID NO: 4057083 - DNA, 22 bp, Homo sapiens
agtgagttacagcgagaggcag

SEQ ID NO: 4057084 - DNA, 20 bp, Homo sapiens
agtgatactatccagttact

SEQ ID NO: 4057085 - DNA, 17 bp, Homo sapiens
agtgatatggcagaaga

SEQ ID NO: 4057086 - DNA, 19 bp, Homo sapiens
agtgatatggcagaagaca

SEQ ID NO: 4057087 - DNA, 15 bp, Homo sapiens
agtgatattggaact

SEQ ID NO: 4057088 - DNA, 16 bp, Homo sapiens
agtgatctcagggcag

SEQ ID NO: 4057089 - DNA, 16 bp, Homo sapiens
agtgattgacacacag

SEQ ID NO: 4057090 - DNA, 13 bp, Homo sapiens
agtgattgcagct

SEQ ID NO: 4057091 - DNA, 20 bp, Homo sapiens
agtgattgcagctttatgtt

SEQ ID NO: 4057092 - DNA, 12 bp, Homo sapiens
agtgcaaaaggc

SEQ ID NO: 4057093 - DNA, 21 bp, Homo sapiens
agtgcaataaatctgacccag

SEQ ID NO: 4057094 - DNA, 22 bp, Homo sapiens
agtgcaataaatctgacccagt

SEQ ID NO: 4057095 - DNA, 12 bp, Homo sapiens
agtgcacagctg

SEQ ID NO: 4057096 - DNA, 14 bp, Homo sapiens
agtgcacagctgtc

SEQ ID NO: 4057097 - DNA, 15 bp, Homo sapiens
agtgcacagggaagg

SEQ ID NO: 4057098 - DNA, 21 bp, Homo sapiens
agtgcacagggaagggcttgg

SEQ ID NO: 4057099 - DNA, 17 bp, Homo sapiens
agtgcagagccttctca

SEQ ID NO: 4057100 - DNA, 19 bp, Homo sapiens
agtgcagagccttctcaga

SEQ ID NO: 4057101 - DNA, 15 bp, Homo sapiens
agtgcagcagggcag

SEQ ID NO: 4057102 - DNA, 14 bp, Homo sapiens
agtgcagccttctc

SEQ ID NO: 4057103 - DNA, 14 bp, Homo sapiens
agtgcagctgattt

SEQ ID NO: 4057104 - DNA, 17 bp, Homo sapiens
agtgcagctgattttaa

SEQ ID NO: 4057105 - DNA, 18 bp, Homo sapiens
agtgcagctgattttaac

SEQ ID NO: 4057106 - DNA, 14 bp, Homo sapiens
agtgcatctcagcc

SEQ ID NO: 4057107 - DNA, 14 bp, Homo sapiens
agtgccaaatgctc

SEQ ID NO: 4057108 - DNA, 18 bp, Homo sapiens
agtgccaaatgctggggc

SEQ ID NO: 4057109 - DNA, 19 bp, Homo sapiens
agtgccaaatgctggggca

SEQ ID NO: 4057110 - DNA, 20 bp, Homo sapiens
agtgccactgcccgagctgg

SEQ ID NO: 4057111 - DNA, 23 bp, Homo sapiens
agtgccaggactccccaggccag

SEQ ID NO: 4057112 - DNA, 21 bp, Homo sapiens
agtgccattccactccactca

SEQ ID NO: 4057113 - DNA, 16 bp, Homo sapiens
agtgcccaccctggga

SEQ ID NO: 4057114 - DNA, 23 bp, Homo sapiens
agtgcccaccctgggagacagac

SEQ ID NO: 4057115 - DNA, 14 bp, Homo sapiens
agtgcccccactga

SEQ ID NO: 4057116 - DNA, 17 bp, Homo sapiens
agtgccccctcacctct

SEQ ID NO: 4057117 - DNA, 13 bp, Homo sapiens
agtgccggctgtg

SEQ ID NO: 4057118 - DNA, 22 bp, Homo sapiens
agtgccgtagggagtacctgct

SEQ ID NO: 4057119 - DNA, 18 bp, Homo sapiens
agtgcctgagctggggaa

SEQ ID NO: 4057120 - DNA, 13 bp, Homo sapiens
agtgcctgggaat

SEQ ID NO: 4057121 - DNA, 16 bp, Homo sapiens
agtgccttccataatt

SEQ ID NO: 4057122 - DNA, 21 bp, Homo sapiens
agtgccttctccttccccagg

SEQ ID NO: 4057123 - DNA, 12 bp, Homo sapiens
agtgccttctct

SEQ ID NO: 4057124 - DNA, 20 bp, Homo sapiens
agtgccttctttagaccctc

SEQ ID NO: 4057125 - DNA, 13 bp, Homo sapiens
agtgccttgctcg

SEQ ID NO: 4057126 - DNA, 13 bp, Homo sapiens
agtgcgtgaatgt

SEQ ID NO: 4057127 - DNA, 14 bp, Homo sapiens
agtgcgtgaatgta

SEQ ID NO: 4057128 - DNA, 17 bp, Homo sapiens
agtgcgtgaatgtatgt

SEQ ID NO: 4057129 - DNA, 16 bp, Homo sapiens
agtgctcaccagccct

SEQ ID NO: 4057130 - DNA, 17 bp, Homo sapiens
agtgctcaccagccctg

SEQ ID NO: 4057131 - DNA, 15 bp, Homo sapiens
agtgctctgcctcag

SEQ ID NO: 4057132 - DNA, 17 bp, Homo sapiens
agtgctctgcctcagac

SEQ ID NO: 4057133 - DNA, 16 bp, Homo sapiens
agtgctcttggctgac

SEQ ID NO: 4057134 - DNA, 22 bp, Homo sapiens
agtgctcttggctgacccctct

SEQ ID NO: 4057135 - DNA, 13 bp, Homo sapiens
agtgctggcactt

SEQ ID NO: 4057136 - DNA, 17 bp, Homo sapiens
agtgctggctcacagta

SEQ ID NO: 4057137 - DNA, 18 bp, Homo sapiens
agtgctggctcacagtac

SEQ ID NO: 4057138 - DNA, 19 bp, Homo sapiens
agtgctggctcacagtaca

SEQ ID NO: 4057139 - DNA, 15 bp, Homo sapiens
agtgctgggaccaga

SEQ ID NO: 4057140 - DNA, 19 bp, Homo sapiens
agtgctgggattacaggct

SEQ ID NO: 4057141 - DNA, 22 bp, Homo sapiens
agtgctgttgggatatagtcaa

SEQ ID NO: 4057142 - DNA, 12 bp, Homo sapiens
agtgcttgcttt

SEQ ID NO: 4057143 - DNA, 15 bp, Homo sapiens
agtggaaatgttcta

SEQ ID NO: 4057144 - DNA, 21 bp, Homo sapiens
agtggacagagcgcccctccc

SEQ ID NO: 4057145 - DNA, 19 bp, Homo sapiens
agtggaccttgagaccaca

SEQ ID NO: 4057146 - DNA, 17 bp, Homo sapiens
agtggactcagcagtga

SEQ ID NO: 4057147 - DNA, 15 bp, Homo sapiens
agtggactggcccct

SEQ ID NO: 4057148 - DNA, 20 bp, Homo sapiens
agtggagcctgacagccaga

SEQ ID NO: 4057149 - DNA, 23 bp, Homo sapiens
agtggaggtgggctgggccctct

SEQ ID NO: 4057150 - DNA, 17 bp, Homo sapiens
agtggcacctgtctgct

SEQ ID NO: 4057151 - DNA, 21 bp, Homo sapiens
agtggcccaacaggggctcca

SEQ ID NO: 4057152 - DNA, 12 bp, Homo sapiens
agtggcctccct

SEQ ID NO: 4057153 - DNA, 14 bp, Homo sapiens
agtggcctccctgc

SEQ ID NO: 4057154 - DNA, 17 bp, Homo sapiens
agtggcctccctgctgt

SEQ ID NO: 4057155 - DNA, 21 bp, Homo sapiens
agtggcctcgaactcctggca

SEQ ID NO: 4057156 - DNA, 19 bp, Homo sapiens
agtggcctggccaggagct

SEQ ID NO: 4057157 - DNA, 22 bp, Homo sapiens
agtggcctggccaggagctctt

SEQ ID NO: 4057158 - DNA, 21 bp, Homo sapiens
agtggctcctcccggtgccca

SEQ ID NO: 4057159 - DNA, 18 bp, Homo sapiens
agtggctgccacacccag

SEQ ID NO: 4057160 - DNA, 20 bp, Homo sapiens
agtggctgccacacccaggg

SEQ ID NO: 4057161 - DNA, 19 bp, Homo sapiens
agtggctgccttctttcca

SEQ ID NO: 4057162 - DNA, 12 bp, Homo sapiens
agtggctgggtg

SEQ ID NO: 4057163 - DNA, 23 bp, Homo sapiens
agtggctgggtgggcccagaact

SEQ ID NO: 4057164 - DNA, 17 bp, Homo sapiens
agtggctggtccagggc

SEQ ID NO: 4057165 - DNA, 15 bp, Homo sapiens
agtggcttcccagct

SEQ ID NO: 4057166 - DNA, 12 bp, Homo sapiens
agttacatgcat

SEQ ID NO: 4057167 - DNA, 18 bp, Homo sapiens
agttacatgcataaaagg

SEQ ID NO: 4057168 - DNA, 15 bp, Homo sapiens
agttacatttctatc

SEQ ID NO: 4057169 - DNA, 17 bp, Homo sapiens
agttaccacacatctat

SEQ ID NO: 4057170 - DNA, 16 bp, Homo sapiens
agttactaggtaactt

SEQ ID NO: 4057171 - DNA, 18 bp, Homo sapiens
agttactaggtaacttca

SEQ ID NO: 4057172 - DNA, 14 bp, Homo sapiens
agttacttcctatc

SEQ ID NO: 4057173 - DNA, 14 bp, Homo sapiens
agttacttgaattt

SEQ ID NO: 4057174 - DNA, 20 bp, Homo sapiens
agttactttatgtttgtctt

SEQ ID NO: 4057175 - DNA, 21 bp, Homo sapiens
agttactttccaattctcctt

SEQ ID NO: 4057176 - DNA, 19 bp, Homo sapiens
agttactttgtcagaggca

SEQ ID NO: 4057177 - DNA, 16 bp, Homo sapiens
agttagggtctatgta

SEQ ID NO: 4057178 - DNA, 14 bp, Homo sapiens
agttagtagcatgt

SEQ ID NO: 4057179 - DNA, 12 bp, Homo sapiens
agttataaatca

SEQ ID NO: 4057180 - DNA, 19 bp, Homo sapiens
agttatagtatatctggac

SEQ ID NO: 4057181 - DNA, 23 bp, Homo sapiens
agttatagtgaatactgctacag

SEQ ID NO: 4057182 - DNA, 22 bp, Homo sapiens
agttatattagtgaagatggtt

SEQ ID NO: 4057183 - DNA, 16 bp, Homo sapiens
agttatctaaaagaaa

SEQ ID NO: 4057184 - DNA, 17 bp, Homo sapiens
agttatctaaaagaaat

SEQ ID NO: 4057185 - DNA, 12 bp, Homo sapiens
agttatgaatca

SEQ ID NO: 4057186 - DNA, 14 bp, Homo sapiens
agttatgatgtaat

SEQ ID NO: 4057187 - DNA, 21 bp, Homo sapiens
agttatggcctatacactatt

SEQ ID NO: 4057188 - DNA, 14 bp, Homo sapiens
agttattaacttta

SEQ ID NO: 4057189 - DNA, 20 bp, Homo sapiens
agttattaactttaatgttt

SEQ ID NO: 4057190 - DNA, 14 bp, Homo sapiens
agttattatttaat

SEQ ID NO: 4057191 - DNA, 16 bp, Homo sapiens
agttattatttaattg

SEQ ID NO: 4057192 - DNA, 22 bp, Homo sapiens
agttatttatgcctctgtattt

SEQ ID NO: 4057193 - DNA, 18 bp, Homo sapiens
agttatttcttgtttgtt

SEQ ID NO: 4057194 - DNA, 16 bp, Homo sapiens
agttattttggatata

SEQ ID NO: 4057195 - DNA, 17 bp, Homo sapiens
agttattttggatatat

SEQ ID NO: 4057196 - DNA, 15 bp, Homo sapiens
agttatttttctctt

SEQ ID NO: 4057197 - DNA, 13 bp, Homo sapiens
agttcaaacaaga

SEQ ID NO: 4057198 - DNA, 13 bp, Homo sapiens
agttcaatcctac

SEQ ID NO: 4057199 - DNA, 17 bp, Homo sapiens
agttcagcaccacccta

SEQ ID NO: 4057200 - DNA, 13 bp, Homo sapiens
agttcagggaccg

SEQ ID NO: 4057201 - DNA, 16 bp, Homo sapiens
agttcagggaccgtcc

SEQ ID NO: 4057202 - DNA, 19 bp, Homo sapiens
agttcatattccatattta

SEQ ID NO: 4057203 - DNA, 16 bp, Homo sapiens
agttcatccaatcctc

SEQ ID NO: 4057204 - DNA, 18 bp, Homo sapiens
agttcatccaatcctcac

SEQ ID NO: 4057205 - DNA, 20 bp, Homo sapiens
agttcatccaatcctcactg

SEQ ID NO: 4057206 - DNA, 16 bp, Homo sapiens
agttcatcccttctct

SEQ ID NO: 4057207 - DNA, 17 bp, Homo sapiens
agttcatcgattttcta

SEQ ID NO: 4057208 - DNA, 17 bp, Homo sapiens
agttcatgtttgcttca

SEQ ID NO: 4057209 - DNA, 16 bp, Homo sapiens
agttcattattttgtg

SEQ ID NO: 4057210 - DNA, 17 bp, Homo sapiens
agttcattattttgtgg

SEQ ID NO: 4057211 - DNA, 16 bp, Homo sapiens
agttcattcagggccg

SEQ ID NO: 4057212 - DNA, 20 bp, Homo sapiens
agttccaagtccaataagac

SEQ ID NO: 4057213 - DNA, 17 bp, Homo sapiens
agttccaatcagtagct

SEQ ID NO: 4057214 - DNA, 22 bp, Homo sapiens
agttccatgaagaccacatcca

SEQ ID NO: 4057215 - DNA, 18 bp, Homo sapiens
agttcccccaacctcaga

SEQ ID NO: 4057216 - DNA, 22 bp, Homo sapiens
agttcccccagtacctccaagc

SEQ ID NO: 4057217 - DNA, 19 bp, Homo sapiens
agttccctcttctaaccca

SEQ ID NO: 4057218 - DNA, 20 bp, Homo sapiens
agttccctgtctcttgaaaa

SEQ ID NO: 4057219 - DNA, 18 bp, Homo sapiens
agttcccttggcctcaga

SEQ ID NO: 4057220 - DNA, 18 bp, Homo sapiens
agttcctaacaggatgaa

SEQ ID NO: 4057221 - DNA, 14 bp, Homo sapiens
agttcctttagaaa

SEQ ID NO: 4057222 - DNA, 16 bp, Homo sapiens
agttcctttgtgtgta

SEQ ID NO: 4057223 - DNA, 18 bp, Homo sapiens
agttcctttgtgtgtact

SEQ ID NO: 4057224 - DNA, 20 bp, Homo sapiens
agttcggtctgacagtcctt

SEQ ID NO: 4057225 - DNA, 23 bp, Homo sapiens
agttctacctcaggcagctcaag

SEQ ID NO: 4057226 - DNA, 21 bp, Homo sapiens
agttctagctctatttacttc

SEQ ID NO: 4057227 - DNA, 21 bp, Homo sapiens
agttctaggggagaagagccc

SEQ ID NO: 4057228 - DNA, 23 bp, Homo sapiens
agttctaggggagaagagccctg

SEQ ID NO: 4057229 - DNA, 20 bp, Homo sapiens
agttctatgaagagtattaa

SEQ ID NO: 4057230 - DNA, 22 bp, Homo sapiens
agttctatgaagagtattaatg

SEQ ID NO: 4057231 - DNA, 12 bp, Homo sapiens
agttctcactgt

SEQ ID NO: 4057232 - DNA, 19 bp, Homo sapiens
agttctcactgttccctct

SEQ ID NO: 4057233 - DNA, 20 bp, Homo sapiens
agttctcactgttccctctg

SEQ ID NO: 4057234 - DNA, 13 bp, Homo sapiens
agttctccctgta

SEQ ID NO: 4057235 - DNA, 22 bp, Homo sapiens
agttctccctgtacagtgttac

SEQ ID NO: 4057236 - DNA, 16 bp, Homo sapiens
agttctctcccttcct

SEQ ID NO: 4057237 - DNA, 22 bp, Homo sapiens
agttctctcccttcctctctcc

SEQ ID NO: 4057238 - DNA, 16 bp, Homo sapiens
agttctctcgtaactg

SEQ ID NO: 4057239 - DNA, 17 bp, Homo sapiens
agttctctcgtaactgg

SEQ ID NO: 4057240 - DNA, 22 bp, Homo sapiens
agttctgagtgtttttactaca

SEQ ID NO: 4057241 - DNA, 19 bp, Homo sapiens
agttcttctcaaaaaataa

SEQ ID NO: 4057242 - DNA, 22 bp, Homo sapiens
agttcttctcaaaaaataatta

SEQ ID NO: 4057243 - DNA, 13 bp, Homo sapiens
agttctttcctcc

SEQ ID NO: 4057244 - DNA, 15 bp, Homo sapiens
agttctttcctcccc

SEQ ID NO: 4057245 - DNA, 20 bp, Homo sapiens
agttctttcctccccctgca

SEQ ID NO: 4057246 - DNA, 22 bp, Homo sapiens
agttctttcctccccctgcaac

SEQ ID NO: 4057247 - DNA, 21 bp, Homo sapiens
agttctttgggccagacatgc

SEQ ID NO: 4057248 - DNA, 14 bp, Homo sapiens
agttctttttgcca

SEQ ID NO: 4057249 - DNA, 17 bp, Homo sapiens
agttgaagactttgttt

SEQ ID NO: 4057250 - DNA, 15 bp, Homo sapiens
agttgaagtcatgct

SEQ ID NO: 4057251 - DNA, 17 bp, Homo sapiens
agttgacttatagtaca

SEQ ID NO: 4057252 - DNA, 20 bp, Homo sapiens
agttgagatttttaagaact

SEQ ID NO: 4057253 - DNA, 18 bp, Homo sapiens
agttgagtctcctctctg

SEQ ID NO: 4057254 - DNA, 23 bp, Homo sapiens
agttgagtctcctctctgagact

SEQ ID NO: 4057255 - DNA, 13 bp, Homo sapiens
agttgatctggaa

SEQ ID NO: 4057256 - DNA, 15 bp, Homo sapiens
agttgatctggaacc

SEQ ID NO: 4057257 - DNA, 23 bp, Homo sapiens
agttgatctggaacccagactca

SEQ ID NO: 4057258 - DNA, 12 bp, Homo sapiens
agttgatcttct

SEQ ID NO: 4057259 - DNA, 16 bp, Homo sapiens
agttgatgactttctg

SEQ ID NO: 4057260 - DNA, 19 bp, Homo sapiens
agttgcaattgaattaaat

SEQ ID NO: 4057261 - DNA, 16 bp, Homo sapiens
agttgcacatgattgt

SEQ ID NO: 4057262 - DNA, 11 bp, Homo sapiens
agttgcagaaa

SEQ ID NO: 4057263 - DNA, 17 bp, Homo sapiens
agttgcagactcagttt

SEQ ID NO: 4057264 - DNA, 23 bp, Homo sapiens
agttgcagactcagtttgtcaga

SEQ ID NO: 4057265 - DNA, 15 bp, Homo sapiens
agttgcagatgtatt

SEQ ID NO: 4057266 - DNA, 21 bp, Homo sapiens
agttgcagatgtattgactgt

SEQ ID NO: 4057267 - DNA, 16 bp, Homo sapiens
agttgcattagtaact

SEQ ID NO: 4057268 - DNA, 12 bp, Homo sapiens
agtttttgtatc

SEQ ID NO: 4057269 - DNA, 16 bp, Homo sapiens
agttttttgttttaca

SEQ ID NO: 4057270 - DNA, 12 bp, Homo sapiens
agtttttttgct

SEQ ID NO: 4057271 - DNA, 20 bp, Homo sapiens
agttttttttttgtttgttt

SEQ ID NO: 4057272 - DNA, 13 bp, Homo sapiens
ataaaaaatggtt

SEQ ID NO: 4057273 - DNA, 13 bp, Homo sapiens
ataaaaacttgaa

SEQ ID NO: 4057274 - DNA, 22 bp, Homo sapiens
ataaaaagaaaagataaagatg

SEQ ID NO: 4057275 - DNA, 12 bp, Homo sapiens
ataaaaagcaaa

SEQ ID NO: 4057276 - DNA, 13 bp, Homo sapiens
ataaaaagcaaaa

SEQ ID NO: 4057277 - DNA, 11 bp, Homo sapiens
ataaaaaggac

SEQ ID NO: 4057278 - DNA, 19 bp, Homo sapiens
ataaaaaggacatcagcaa

SEQ ID NO: 4057279 - DNA, 23 bp, Homo sapiens
ataaaaagtttcacaggtcaata

SEQ ID NO: 4057280 - DNA, 13 bp, Homo sapiens
ataaaaataaatt

SEQ ID NO: 4057281 - DNA, 22 bp, Homo sapiens
ataaaaataaatttggttctaa

SEQ ID NO: 4057282 - DNA, 23 bp, Homo sapiens
ataaaaatattgtgttgtgaatg

SEQ ID NO: 4057283 - DNA, 19 bp, Homo sapiens
ataaaaatcatggcaacat

SEQ ID NO: 4057284 - DNA, 12 bp, Homo sapiens
ataaaaatggat

SEQ ID NO: 4057285 - DNA, 12 bp, Homo sapiens
ataaaacaggta

SEQ ID NO: 4057286 - DNA, 11 bp, Homo sapiens
ataaaactgaa

SEQ ID NO: 4057287 - DNA, 14 bp, Homo sapiens
ataaaactgaatct

SEQ ID NO: 4057288 - DNA, 17 bp, Homo sapiens
ataaaactttgctgcca

SEQ ID NO: 4057289 - DNA, 16 bp, Homo sapiens
ataaaagcagcatctg

SEQ ID NO: 4057290 - DNA, 15 bp, Homo sapiens
ataaaagcataaatg

SEQ ID NO: 4057291 - DNA, 14 bp, Homo sapiens
ataaaagccttggg

SEQ ID NO: 4057292 - DNA, 19 bp, Homo sapiens
ataaaagctgaagttactt

SEQ ID NO: 4057293 - DNA, 22 bp, Homo sapiens
ataaaagctgaagttactttat

SEQ ID NO: 4057294 - DNA, 19 bp, Homo sapiens
ataaaaggaagccaaagag

SEQ ID NO: 4057295 - DNA, 20 bp, Homo sapiens
ataaaagggggtccgtggaa

SEQ ID NO: 4057296 - DNA, 13 bp, Homo sapiens
ataaaagtgactc

SEQ ID NO: 4057297 - DNA, 13 bp, Homo sapiens
ataaaagtgatca

SEQ ID NO: 4057298 - DNA, 17 bp, Homo sapiens
ataaaagtgatcaataa

SEQ ID NO: 4057299 - DNA, 16 bp, Homo sapiens
ataaaataaagtatat

SEQ ID NO: 4057300 - DNA, 14 bp, Homo sapiens
ataaaataaataat

SEQ ID NO: 4057301 - DNA, 15 bp, Homo sapiens
ataaaataaataatt

SEQ ID NO: 4057302 - DNA, 16 bp, Homo sapiens
ataaaataaataattt

SEQ ID NO: 4057303 - DNA, 22 bp, Homo sapiens
ataaaataattttatctctttc

SEQ ID NO: 4057304 - DNA, 16 bp, Homo sapiens
ataaaatcaattttta

SEQ ID NO: 4057305 - DNA, 20 bp, Homo sapiens
ataaaatcaatttttaggaa

SEQ ID NO: 4057306 - DNA, 13 bp, Homo sapiens
ataaaatgaaaat

SEQ ID NO: 4057307 - DNA, 20 bp, Homo sapiens
ataaaatgtgatttttctga

SEQ ID NO: 4057308 - DNA, 19 bp, Homo sapiens
ataaaattcgctttctaaa

SEQ ID NO: 4057309 - DNA, 22 bp, Homo sapiens
ataaacaattcatgcctttcat

SEQ ID NO: 4057310 - DNA, 22 bp, Homo sapiens
ataaacagcttcatgcctttgt

SEQ ID NO: 4057311 - DNA, 21 bp, Homo sapiens
ataaacagtatattctttggt

SEQ ID NO: 4057312 - DNA, 22 bp, Homo sapiens
ataaacagtggaatataaggaa

SEQ ID NO: 4057313 - DNA, 18 bp, Homo sapiens
ataaacatatacagaaaa

SEQ ID NO: 4057314 - DNA, 16 bp, Homo sapiens
ataaacatcacacaca

SEQ ID NO: 4057315 - DNA, 21 bp, Homo sapiens
ataaaccaggtttagacagta

SEQ ID NO: 4057316 - DNA, 20 bp, Homo sapiens
ataaacgtgatgatcagctg

SEQ ID NO: 4057317 - DNA, 16 bp, Homo sapiens
ataaactactctttga

SEQ ID NO: 4057318 - DNA, 19 bp, Homo sapiens
ataaactactctttgattt

SEQ ID NO: 4057319 - DNA, 18 bp, Homo sapiens
ataaactattggaaagta

SEQ ID NO: 4057320 - DNA, 14 bp, Homo sapiens
ataaactgaatatt

SEQ ID NO: 4057321 - DNA, 20 bp, Homo sapiens
ataaactgaatattttggaa

SEQ ID NO: 4057322 - DNA, 22 bp, Homo sapiens
ataaactgaatattttggaaac

SEQ ID NO: 4057323 - DNA, 15 bp, Homo sapiens
ataaactgactttat

SEQ ID NO: 4057324 - DNA, 12 bp, Homo sapiens
ataaactgagcc

SEQ ID NO: 4057325 - DNA, 16 bp, Homo sapiens
ataaactgtgtttact

SEQ ID NO: 4057326 - DNA, 16 bp, Homo sapiens
ataaacttagaggaaa

SEQ ID NO: 4057327 - DNA, 18 bp, Homo sapiens
ataaacttagaggaaaat

SEQ ID NO: 4057328 - DNA, 18 bp, Homo sapiens
ataaagaaaacctttcta

SEQ ID NO: 4057329 - DNA, 14 bp, Homo sapiens
ataaagaaatattt

SEQ ID NO: 4057330 - DNA, 15 bp, Homo sapiens
ataaagaaatattta

SEQ ID NO: 4057331 - DNA, 15 bp, Homo sapiens
ataaagaacaaggta

SEQ ID NO: 4057332 - DNA, 21 bp, Homo sapiens
ataaagaacaaggtagttttt

SEQ ID NO: 4057333 - DNA, 21 bp, Homo sapiens
ataaagaatgccatttctcac

SEQ ID NO: 4057334 - DNA, 20 bp, Homo sapiens
ataaagacactggcagagag

SEQ ID NO: 4057335 - DNA, 14 bp, Homo sapiens
ataaagatgatcta

SEQ ID NO: 4057336 - DNA, 20 bp, Homo sapiens
ataaagatgatctactcaga

SEQ ID NO: 4057337 - DNA, 12 bp, Homo sapiens
ataaagcatgtg

SEQ ID NO: 4057338 - DNA, 14 bp, Homo sapiens
ataaagcatttata

SEQ ID NO: 4057339 - DNA, 14 bp, Homo sapiens
ataaaggactgtaa

SEQ ID NO: 4057340 - DNA, 13 bp, Homo sapiens
ataaaggatgtga

SEQ ID NO: 4057341 - DNA, 14 bp, Homo sapiens
ataaaggatgtgat

SEQ ID NO: 4057342 - DNA, 18 bp, Homo sapiens
ataaaggtcttaaataat

SEQ ID NO: 4057343 - DNA, 22 bp, Homo sapiens
ataaaggttgacaataaatgtg

SEQ ID NO: 4057344 - DNA, 19 bp, Homo sapiens
ataaagtgtaacaattgtg

SEQ ID NO: 4057345 - DNA, 17 bp, Homo sapiens
ataaagttacttgaatt

SEQ ID NO: 4057346 - DNA, 18 bp, Homo sapiens
ataaagttacttgaattt

SEQ ID NO: 4057347 - DNA, 12 bp, Homo sapiens
ataaataaatgt

SEQ ID NO: 4057348 - DNA, 18 bp, Homo sapiens
ataaataattgaaacaat

SEQ ID NO: 4057349 - DNA, 23 bp, Homo sapiens
ataaatacaaatctgtataaatg

SEQ ID NO: 4057350 - DNA, 21 bp, Homo sapiens
ataaatagctatatccatgta

SEQ ID NO: 4057351 - DNA, 22 bp, Homo sapiens
ataaatatggttaatttcatgt

SEQ ID NO: 4057352 - DNA, 19 bp, Homo sapiens
ataaatatttattaaatga

SEQ ID NO: 4057353 - DNA, 20 bp, Homo sapiens
ataaatatttgacttgcatg

SEQ ID NO: 4057354 - DNA, 14 bp, Homo sapiens
ataaatcaatgtca

SEQ ID NO: 4057355 - DNA, 18 bp, Homo sapiens
ataaatcagagagcaagg

SEQ ID NO: 4057356 - DNA, 15 bp, Homo sapiens
ataaatccagttcta

SEQ ID NO: 4057357 - DNA, 18 bp, Homo sapiens
ataaatctgacccagtgc

SEQ ID NO: 4057358 - DNA, 16 bp, Homo sapiens
ataaatgaaatttgca

SEQ ID NO: 4057359 - DNA, 16 bp, Homo sapiens
ataaatgaattttagt

SEQ ID NO: 4057360 - DNA, 17 bp, Homo sapiens
ataaatgaattttagtt

SEQ ID NO: 4057361 - DNA, 23 bp, Homo sapiens
ataaatgctattttttattttac

SEQ ID NO: 4057362 - DNA, 23 bp, Homo sapiens
ataaatgggtgtatataatttta

SEQ ID NO: 4057363 - DNA, 19 bp, Homo sapiens
ataaatgtaaaaataataa

SEQ ID NO: 4057364 - DNA, 18 bp, Homo sapiens
ataaatgtatcttattca

SEQ ID NO: 4057365 - DNA, 20 bp, Homo sapiens
ataaatgtctattattatga

SEQ ID NO: 4057366 - DNA, 15 bp, Homo sapiens
ataaattaatattgt

SEQ ID NO: 4057367 - DNA, 16 bp, Homo sapiens
ataaattaatattgta

SEQ ID NO: 4057368 - DNA, 13 bp, Homo sapiens
ataaattataagt

SEQ ID NO: 4057369 - DNA, 11 bp, Homo sapiens
ataaattattt

SEQ ID NO: 4057370 - DNA, 12 bp, Homo sapiens
ataaattcagat

SEQ ID NO: 4057371 - DNA, 19 bp, Homo sapiens
ataatgtttaatattgaga

SEQ ID NO: 4057372 - DNA, 22 bp, Homo sapiens
ataatgtttaatattgagaaag

SEQ ID NO: 4057373 - DNA, 20 bp, Homo sapiens
ataattaaaatttatcttaa

SEQ ID NO: 4057374 - DNA, 16 bp, Homo sapiens
ataattataatatact

SEQ ID NO: 4057375 - DNA, 20 bp, Homo sapiens
ataattatcggaagcagtgc

SEQ ID NO: 4057376 - DNA, 22 bp, Homo sapiens
ataattatcggaagcagtgcct

SEQ ID NO: 4057377 - DNA, 13 bp, Homo sapiens
ataattcactcaa

SEQ ID NO: 4057378 - DNA, 18 bp, Homo sapiens
ataattcactcaagcact

SEQ ID NO: 4057379 - DNA, 20 bp, Homo sapiens
ataattcactcaagcactga

SEQ ID NO: 4057380 - DNA, 16 bp, Homo sapiens
ataattcctacagcac

SEQ ID NO: 4057381 - DNA, 18 bp, Homo sapiens
ataattcctacagcacta

SEQ ID NO: 4057382 - DNA, 12 bp, Homo sapiens
ataattctaaag

SEQ ID NO: 4057383 - DNA, 12 bp, Homo sapiens
ataattctaaat

SEQ ID NO: 4057384 - DNA, 12 bp, Homo sapiens
ataattctgtaa

SEQ ID NO: 4057385 - DNA, 13 bp, Homo sapiens
ataattctgtaaa

SEQ ID NO: 4057386 - DNA, 19 bp, Homo sapiens
ataattcttgtatattatg

SEQ ID NO: 4057387 - DNA, 20 bp, Homo sapiens
ataattgctatttattttta

SEQ ID NO: 4057388 - DNA, 20 bp, Homo sapiens
ataattgttgaaattttgca

SEQ ID NO: 4057389 - DNA, 22 bp, Homo sapiens
ataattgttgaaattttgcaaa

SEQ ID NO: 4057390 - DNA, 17 bp, Homo sapiens
ataattgtttgagggga

SEQ ID NO: 4057391 - DNA, 15 bp, Homo sapiens
ataatttatttcaat

SEQ ID NO: 4057392 - DNA, 11 bp, Homo sapiens
ataatttccca

SEQ ID NO: 4057393 - DNA, 23 bp, Homo sapiens
ataatttctactctgtcttaaat

SEQ ID NO: 4057394 - DNA, 11 bp, Homo sapiens
ataatttgcat

SEQ ID NO: 4057395 - DNA, 16 bp, Homo sapiens
ataatttgcatattct

SEQ ID NO: 4057396 - DNA, 18 bp, Homo sapiens
ataatttgcatattctat

SEQ ID NO: 4057397 - DNA, 13 bp, Homo sapiens
ataatttgtaaat

SEQ ID NO: 4057398 - DNA, 21 bp, Homo sapiens
ataattttaaaaaagccttcc

SEQ ID NO: 4057399 - DNA, 14 bp, Homo sapiens
ataattttaagaaa

SEQ ID NO: 4057400 - DNA, 15 bp, Homo sapiens
ataattttaagaaat

SEQ ID NO: 4057401 - DNA, 21 bp, Homo sapiens
ataattttaagaaatcaaaga

SEQ ID NO: 4057402 - DNA, 18 bp, Homo sapiens
ataattttaatattcttt

SEQ ID NO: 4057403 - DNA, 15 bp, Homo sapiens
ataattttatgaatg

SEQ ID NO: 4057404 - DNA, 19 bp, Homo sapiens
ataattttatgaatgtctt

SEQ ID NO: 4057405 - DNA, 13 bp, Homo sapiens
ataattttcttca

SEQ ID NO: 4057406 - DNA, 18 bp, Homo sapiens
ataatttttaaagtatat

SEQ ID NO: 4057407 - DNA, 21 bp, Homo sapiens
ataatttttaaagtatatatt

SEQ ID NO: 4057408 - DNA, 12 bp, Homo sapiens
ataatttttaat

SEQ ID NO: 4057409 - DNA, 18 bp, Homo sapiens
ataattttttttaaaata

SEQ ID NO: 4057410 - DNA, 22 bp, Homo sapiens
ataattttttttaaaatagaaa

SEQ ID NO: 4057411 - DNA, 14 bp, Homo sapiens
atacaaagtaaata

SEQ ID NO: 4057412 - DNA, 21 bp, Homo sapiens
atacaaagtaaatacaagact

SEQ ID NO: 4057413 - DNA, 16 bp, Homo sapiens
atacaaatagattttt

SEQ ID NO: 4057414 - DNA, 12 bp, Homo sapiens
atacaaatctgt

SEQ ID NO: 4057415 - DNA, 17 bp, Homo sapiens
atacaaatctgtataaa

SEQ ID NO: 4057416 - DNA, 17 bp, Homo sapiens
atacaaatggattttgg

SEQ ID NO: 4057417 - DNA, 15 bp, Homo sapiens
atacaaattagaaaa

SEQ ID NO: 4057418 - DNA, 16 bp, Homo sapiens
atacaacttaaataat

SEQ ID NO: 4057419 - DNA, 17 bp, Homo sapiens
atacaagtttcagacag

SEQ ID NO: 4057420 - DNA, 19 bp, Homo sapiens
atacaagtttcagacaggg

SEQ ID NO: 4057421 - DNA, 10 bp, Homo sapiens
atacaataaa

SEQ ID NO: 4057422 - DNA, 21 bp, Homo sapiens
atacaataaactattggaaag

SEQ ID NO: 4057423 - DNA, 15 bp, Homo sapiens
atacaatatcatcca

SEQ ID NO: 4057424 - DNA, 19 bp, Homo sapiens
atacaatcctgtttataat

SEQ ID NO: 4057425 - DNA, 15 bp, Homo sapiens
atacacaacacacac

SEQ ID NO: 4057426 - DNA, 13 bp, Homo sapiens
atacacagaggag

SEQ ID NO: 4057427 - DNA, 14 bp, Homo sapiens
atacacctggaaca

SEQ ID NO: 4057428 - DNA, 23 bp, Homo sapiens
atacagaaagatggatgtgcttt

SEQ ID NO: 4057429 - DNA, 23 bp, Homo sapiens
atacagacactaagttatagtat

SEQ ID NO: 4057430 - DNA, 14 bp, Homo sapiens
atacagataacatt

SEQ ID NO: 4057431 - DNA, 16 bp, Homo sapiens
atacagatgaaaattt

SEQ ID NO: 4057432 - DNA, 20 bp, Homo sapiens
atacagctgtattgtctgaa

SEQ ID NO: 4057433 - DNA, 11 bp, Homo sapiens
atacaggtgct

SEQ ID NO: 4057434 - DNA, 20 bp, Homo sapiens
atacaggttaacctgcagaa

SEQ ID NO: 4057435 - DNA, 23 bp, Homo sapiens
atacagtgcagagccttctcaga

SEQ ID NO: 4057436 - DNA, 14 bp, Homo sapiens
atacagtgccttgc

SEQ ID NO: 4057437 - DNA, 12 bp, Homo sapiens
atacagttattt

SEQ ID NO: 4057438 - DNA, 22 bp, Homo sapiens
atacagttattttggatatatt

SEQ ID NO: 4057439 - DNA, 16 bp, Homo sapiens
atacatatcgctgact

SEQ ID NO: 4057440 - DNA, 13 bp, Homo sapiens
atacatatcttta

SEQ ID NO: 4057441 - DNA, 21 bp, Homo sapiens
atacatatctttattaatcac

SEQ ID NO: 4057442 - DNA, 17 bp, Homo sapiens
atacatcaattggaaat

SEQ ID NO: 4057443 - DNA, 12 bp, Homo sapiens
atacatcactgc

SEQ ID NO: 4057444 - DNA, 15 bp, Homo sapiens
atacatctctcccca

SEQ ID NO: 4057445 - DNA, 22 bp, Homo sapiens
atacatgaagaatagaaacaag

SEQ ID NO: 4057446 - DNA, 14 bp, Homo sapiens
atacatggataaca

SEQ ID NO: 4057447 - DNA, 20 bp, Homo sapiens
atacatggttgtgacctgag

SEQ ID NO: 4057448 - DNA, 22 bp, Homo sapiens
atacatgtaattctaccaaggt

SEQ ID NO: 4057449 - DNA, 15 bp, Homo sapiens
atacattaaaactag

SEQ ID NO: 4057450 - DNA, 22 bp, Homo sapiens
atacattaaaactaggtaatgt

SEQ ID NO: 4057451 - DNA, 20 bp, Homo sapiens
atacattgtatatatgtgta

SEQ ID NO: 4057452 - DNA, 23 bp, Homo sapiens
atacatttataatgtttgctatt

SEQ ID NO: 4057453 - DNA, 14 bp, Homo sapiens
ataccaggttgaaa

SEQ ID NO: 4057454 - DNA, 16 bp, Homo sapiens
ataccaggttgaaaga

SEQ ID NO: 4057455 - DNA, 18 bp, Homo sapiens
atacccatagcttccatg

SEQ ID NO: 4057456 - DNA, 13 bp, Homo sapiens
atacccccctctg

SEQ ID NO: 4057457 - DNA, 19 bp, Homo sapiens
ataccctggccgccccctg

SEQ ID NO: 4057458 - DNA, 16 bp, Homo sapiens
atacctcaaactatct

SEQ ID NO: 4057459 - DNA, 19 bp, Homo sapiens
atacctgcacgttcataac

SEQ ID NO: 4057460 - DNA, 17 bp, Homo sapiens
atacctgctatcagcag

SEQ ID NO: 4057461 - DNA, 13 bp, Homo sapiens
atacgactttatt

SEQ ID NO: 4057462 - DNA, 17 bp, Homo sapiens
atacgactttattttct

SEQ ID NO: 4057463 - DNA, 16 bp, Homo sapiens
atacgagagcagaggt

SEQ ID NO: 4057464 - DNA, 20 bp, Homo sapiens
atacgagagcagaggtctcc

SEQ ID NO: 4057465 - DNA, 21 bp, Homo sapiens
atacgcctgtagtcctagcca

SEQ ID NO: 4057466 - DNA, 15 bp, Homo sapiens
atacgcttttctttg

SEQ ID NO: 4057467 - DNA, 24 bp, Homo sapiens
atacgcttttctttgttataccat

SEQ ID NO: 4057468 - DNA, 14 bp, Homo sapiens
atactacatcttta

SEQ ID NO: 4057469 - DNA, 14 bp, Homo sapiens
atactaccttgaaa

SEQ ID NO: 4057470 - DNA, 15 bp, Homo sapiens
atactaccttgaaaa

SEQ ID NO: 4057471 - DNA, 14 bp, Homo sapiens
atactatagtacca

SEQ ID NO: 4057472 - DNA, 14 bp, Homo sapiens
atactattgcctca

SEQ ID NO: 4057473 - DNA, 16 bp, Homo sapiens
atactcagcctgctgc

SEQ ID NO: 4057474 - DNA, 22 bp, Homo sapiens
ataggtagtttggatatttttg

SEQ ID NO: 4057475 - DNA, 19 bp, Homo sapiens
ataggtgatgtttgctctt

SEQ ID NO: 4057476 - DNA, 19 bp, Homo sapiens
atagtaagacccccatctc

SEQ ID NO: 4057477 - DNA, 20 bp, Homo sapiens
atagtacatgataaatgata

SEQ ID NO: 4057478 - DNA, 15 bp, Homo sapiens
atagtagcatacatt

SEQ ID NO: 4057479 - DNA, 16 bp, Homo sapiens
atagtagcatacattt

SEQ ID NO: 4057480 - DNA, 17 bp, Homo sapiens
atagtaggcatgttatg

SEQ ID NO: 4057481 - DNA, 21 bp, Homo sapiens
atagtagttagcttaagtagt

SEQ ID NO: 4057482 - DNA, 21 bp, Homo sapiens
atagtatttgagagttctaaa

SEQ ID NO: 4057483 - DNA, 16 bp, Homo sapiens
atagtgaaataaattc

SEQ ID NO: 4057484 - DNA, 23 bp, Homo sapiens
atagtgaatacttactataattt

SEQ ID NO: 4057485 - DNA, 19 bp, Homo sapiens
atagtgatggggctcagat

SEQ ID NO: 4057486 - DNA, 20 bp, Homo sapiens
atagtgctgggatggagggg

SEQ ID NO: 4057487 - DNA, 18 bp, Homo sapiens
atagtgtaacttgcttaa

SEQ ID NO: 4057488 - DNA, 21 bp, Homo sapiens
atagtgtgttctgattagaaa

SEQ ID NO: 4057489 - DNA, 17 bp, Homo sapiens
atagtgttctgctcctg

SEQ ID NO: 4057490 - DNA, 19 bp, Homo sapiens
atagtgttctgctcctgct

SEQ ID NO: 4057491 - DNA, 14 bp, Homo sapiens
atagttcaccccct

SEQ ID NO: 4057492 - DNA, 18 bp, Homo sapiens
atagttcagaatttagtg

SEQ ID NO: 4057493 - DNA, 19 bp, Homo sapiens
atagttctgaggtccctgt

SEQ ID NO: 4057494 - DNA, 16 bp, Homo sapiens
atagttggtcatctag

SEQ ID NO: 4057495 - DNA, 16 bp, Homo sapiens
atagtttaggagaaac

SEQ ID NO: 4057496 - DNA, 17 bp, Homo sapiens
atagttttaaactcatt

SEQ ID NO: 4057497 - DNA, 20 bp, Homo sapiens
atagttttaaactcattttt

SEQ ID NO: 4057498 - DNA, 14 bp, Homo sapiens
atataaaatatgaa

SEQ ID NO: 4057499 - DNA, 13 bp, Homo sapiens
atataaaatgtgc

SEQ ID NO: 4057500 - DNA, 18 bp, Homo sapiens
atataaatggctggtttt

SEQ ID NO: 4057501 - DNA, 23 bp, Homo sapiens
atataaatggctggtttttagaa

SEQ ID NO: 4057502 - DNA, 19 bp, Homo sapiens
atataaccctaggaattta

SEQ ID NO: 4057503 - DNA, 15 bp, Homo sapiens
atataagacatttgt

SEQ ID NO: 4057504 - DNA, 12 bp, Homo sapiens
atataagatttt

SEQ ID NO: 4057505 - DNA, 15 bp, Homo sapiens
atataagtgtacata

SEQ ID NO: 4057506 - DNA, 18 bp, Homo sapiens
atataataaagctactga

SEQ ID NO: 4057507 - DNA, 21 bp, Homo sapiens
atataataaagctactgattt

SEQ ID NO: 4057508 - DNA, 12 bp, Homo sapiens
atataattttat

SEQ ID NO: 4057509 - DNA, 13 bp, Homo sapiens
atatacagaaaaa

SEQ ID NO: 4057510 - DNA, 14 bp, Homo sapiens
atatacagaggaaa

SEQ ID NO: 4057511 - DNA, 11 bp, Homo sapiens
atatacagtta

SEQ ID NO: 4057512 - DNA, 13 bp, Homo sapiens
atatacagttatt

SEQ ID NO: 4057513 - DNA, 23 bp, Homo sapiens
atatacatttttagcctgtgtca

SEQ ID NO: 4057514 - DNA, 14 bp, Homo sapiens
atataccatttatc

SEQ ID NO: 4057515 - DNA, 22 bp, Homo sapiens
atatactctagatgaagtttta

SEQ ID NO: 4057516 - DNA, 18 bp, Homo sapiens
atatactgggttcttgtt

SEQ ID NO: 4057517 - DNA, 18 bp, Homo sapiens
atatactgttcttcattt

SEQ ID NO: 4057518 - DNA, 22 bp, Homo sapiens
atatacttgtggttttcaaatt

SEQ ID NO: 4057519 - DNA, 20 bp, Homo sapiens
atatagacagtccttaaaaa

SEQ ID NO: 4057520 - DNA, 17 bp, Homo sapiens
atatagagattgtacat

SEQ ID NO: 4057521 - DNA, 13 bp, Homo sapiens
atatagattagaa

SEQ ID NO: 4057522 - DNA, 18 bp, Homo sapiens
atataggacaaaatgtta

SEQ ID NO: 4057523 - DNA, 21 bp, Homo sapiens
atatagtttttaccttttatg

SEQ ID NO: 4057524 - DNA, 17 bp, Homo sapiens
atatataatgttgccag

SEQ ID NO: 4057525 - DNA, 15 bp, Homo sapiens
atatataccccccca

SEQ ID NO: 4057526 - DNA, 15 bp, Homo sapiens
atatatacttgtggt

SEQ ID NO: 4057527 - DNA, 15 bp, Homo sapiens
atatatataaatata

SEQ ID NO: 4057528 - DNA, 16 bp, Homo sapiens
atatatatatctgtat

SEQ ID NO: 4057529 - DNA, 15 bp, Homo sapiens
atatatatgaataaa

SEQ ID NO: 4057530 - DNA, 16 bp, Homo sapiens
atatatatgccatgat

SEQ ID NO: 4057531 - DNA, 10 bp, Homo sapiens
atatatattt

SEQ ID NO: 4057532 - DNA, 15 bp, Homo sapiens
atatatcatgagtga

SEQ ID NO: 4057533 - DNA, 12 bp, Homo sapiens
atatatctgaaa

SEQ ID NO: 4057534 - DNA, 18 bp, Homo sapiens
atatatctgaaaactgga

SEQ ID NO: 4057535 - DNA, 16 bp, Homo sapiens
atatatgaaaactata

SEQ ID NO: 4057536 - DNA, 13 bp, Homo sapiens
atatatgtgtgcc

SEQ ID NO: 4057537 - DNA, 21 bp, Homo sapiens
atatatttataactcatcata

SEQ ID NO: 4057538 - DNA, 21 bp, Homo sapiens
atatatttattgagtacctac

SEQ ID NO: 4057539 - DNA, 22 bp, Homo sapiens
atatattttgtactttgtggag

SEQ ID NO: 4057540 - DNA, 22 bp, Homo sapiens
atatatttttaaaaaatgaaat

SEQ ID NO: 4057541 - DNA, 14 bp, Homo sapiens
atatatttttcaca

SEQ ID NO: 4057542 - DNA, 15 bp, Homo sapiens
atatatttttggttg

SEQ ID NO: 4057543 - DNA, 19 bp, Homo sapiens
atatattttttaatttgat

SEQ ID NO: 4057544 - DNA, 23 bp, Homo sapiens
atatattttttaatttgatgaaa

SEQ ID NO: 4057545 - DNA, 14 bp, Homo sapiens
atatcaaaattcta

SEQ ID NO: 4057546 - DNA, 16 bp, Homo sapiens
atatcacagtattatc

SEQ ID NO: 4057547 - DNA, 13 bp, Homo sapiens
atatcatatgtat

SEQ ID NO: 4057548 - DNA, 13 bp, Homo sapiens
atatcatgtaaag

SEQ ID NO: 4057549 - DNA, 18 bp, Homo sapiens
atatcatgtaaagaaatg

SEQ ID NO: 4057550 - DNA, 15 bp, Homo sapiens
atatcattctacaga

SEQ ID NO: 4057551 - DNA, 19 bp, Homo sapiens
atatcattctacagaataa

SEQ ID NO: 4057552 - DNA, 23 bp, Homo sapiens
atatccaagatcaattccctctc

SEQ ID NO: 4057553 - DNA, 13 bp, Homo sapiens
atatccatctttt

SEQ ID NO: 4057554 - DNA, 12 bp, Homo sapiens
atatccatgtac

SEQ ID NO: 4057555 - DNA, 14 bp, Homo sapiens
atatccatgtactg

SEQ ID NO: 4057556 - DNA, 16 bp, Homo sapiens
atatcccaagtgcact

SEQ ID NO: 4057557 - DNA, 15 bp, Homo sapiens
atatccctacatgta

SEQ ID NO: 4057558 - DNA, 16 bp, Homo sapiens
atatccctacatgtat

SEQ ID NO: 4057559 - DNA, 17 bp, Homo sapiens
atatccctacatgtatt

SEQ ID NO: 4057560 - DNA, 14 bp, Homo sapiens
atatccctcttgta

SEQ ID NO: 4057561 - DNA, 14 bp, Homo sapiens
atatcctgtgactg

SEQ ID NO: 4057562 - DNA, 17 bp, Homo sapiens
atatccttatcagagct

SEQ ID NO: 4057563 - DNA, 18 bp, Homo sapiens
atatccttatcagagcta

SEQ ID NO: 4057564 - DNA, 13 bp, Homo sapiens
atatctaatatat

SEQ ID NO: 4057565 - DNA, 13 bp, Homo sapiens
atatctattaata

SEQ ID NO: 4057566 - DNA, 22 bp, Homo sapiens
atatctccatggccctgtccca

SEQ ID NO: 4057567 - DNA, 17 bp, Homo sapiens
atatctgaaaatgtatg

SEQ ID NO: 4057568 - DNA, 21 bp, Homo sapiens
atatctggcctaaaatcttgg

SEQ ID NO: 4057569 - DNA, 21 bp, Homo sapiens
atatctgggattctactttaa

SEQ ID NO: 4057570 - DNA, 18 bp, Homo sapiens
atatctgtggtcttcaaa

SEQ ID NO: 4057571 - DNA, 15 bp, Homo sapiens
atatcttgtatggtt

SEQ ID NO: 4057572 - DNA, 21 bp, Homo sapiens
atatctttacaagcaggcact

SEQ ID NO: 4057573 - DNA, 23 bp, Homo sapiens
atatctttgtgataatttaagag

SEQ ID NO: 4057574 - DNA, 17 bp, Homo sapiens
atatcttttatgtttga

SEQ ID NO: 4057575 - DNA, 18 bp, Homo sapiens
atatcttttatgtttgaa

SEQ ID NO: 4057576 - DNA, 20 bp, Homo sapiens
atatcttttatgtttgaata

SEQ ID NO: 4057577 - DNA, 16 bp, Homo sapiens
atcaccataacctctg

SEQ ID NO: 4057578 - DNA, 18 bp, Homo sapiens
atcaccccctccctacac

SEQ ID NO: 4057579 - DNA, 21 bp, Homo sapiens
atcaccccctccctacacaca

SEQ ID NO: 4057580 - DNA, 22 bp, Homo sapiens
atcaccccctccctacacacac

SEQ ID NO: 4057581 - DNA, 22 bp, Homo sapiens
atcaccgacgcgtctcctgttt

SEQ ID NO: 4057582 - DNA, 22 bp, Homo sapiens
atcacctatttccattcaacaa

SEQ ID NO: 4057583 - DNA, 13 bp, Homo sapiens
atcacctctctgt

SEQ ID NO: 4057584 - DNA, 14 bp, Homo sapiens
atcacctggctgag

SEQ ID NO: 4057585 - DNA, 17 bp, Homo sapiens
atcacgtaccccactgg

SEQ ID NO: 4057586 - DNA, 22 bp, Homo sapiens
atcacgtaccccactgggccag

SEQ ID NO: 4057587 - DNA, 14 bp, Homo sapiens
atcactagcctgtc

SEQ ID NO: 4057588 - DNA, 16 bp, Homo sapiens
atcactatctttctga

SEQ ID NO: 4057589 - DNA, 15 bp, Homo sapiens
atcactctaaaaaac

SEQ ID NO: 4057590 - DNA, 16 bp, Homo sapiens
atcactctaaaaaaca

SEQ ID NO: 4057591 - DNA, 22 bp, Homo sapiens
atcactctaaaaaacattttta

SEQ ID NO: 4057592 - DNA, 21 bp, Homo sapiens
atcactctcagtgcttcttac

SEQ ID NO: 4057593 - DNA, 14 bp, Homo sapiens
atcactgcttgatg

SEQ ID NO: 4057594 - DNA, 21 bp, Homo sapiens
atcactgcttgatgaagcaag

SEQ ID NO: 4057595 - DNA, 13 bp, Homo sapiens
atcactggatgaa

SEQ ID NO: 4057596 - DNA, 16 bp, Homo sapiens
atcactggcaatgaaa

SEQ ID NO: 4057597 - DNA, 23 bp, Homo sapiens
atcactggcaatgaaaaattctc

SEQ ID NO: 4057598 - DNA, 21 bp, Homo sapiens
atcactggctggcctgagcaa

SEQ ID NO: 4057599 - DNA, 14 bp, Homo sapiens
atcacttccatgac

SEQ ID NO: 4057600 - DNA, 21 bp, Homo sapiens
atcactttgtctaactcagaa

SEQ ID NO: 4057601 - DNA, 15 bp, Homo sapiens
atcagaaatttttat

SEQ ID NO: 4057602 - DNA, 17 bp, Homo sapiens
atcagaatcatggagaa

SEQ ID NO: 4057603 - DNA, 16 bp, Homo sapiens
atcagacctgtcttcc

SEQ ID NO: 4057604 - DNA, 22 bp, Homo sapiens
atcagactagtgacaagctcct

SEQ ID NO: 4057605 - DNA, 12 bp, Homo sapiens
atcagaggtgta

SEQ ID NO: 4057606 - DNA, 16 bp, Homo sapiens
atcagaggtgtacact

SEQ ID NO: 4057607 - DNA, 23 bp, Homo sapiens
atcagagtagaaataaaagtgaa

SEQ ID NO: 4057608 - DNA, 22 bp, Homo sapiens
atcagataagacatatctctaa

SEQ ID NO: 4057609 - DNA, 12 bp, Homo sapiens
atcagatacatc

SEQ ID NO: 4057610 - DNA, 16 bp, Homo sapiens
atcagatacatcactg

SEQ ID NO: 4057611 - DNA, 21 bp, Homo sapiens
atcagatggaaatattttgat

SEQ ID NO: 4057612 - DNA, 21 bp, Homo sapiens
atcagcaaaccggggcctact

SEQ ID NO: 4057613 - DNA, 12 bp, Homo sapiens
atcagcctgagt

SEQ ID NO: 4057614 - DNA, 17 bp, Homo sapiens
atcagcctgagtctcct

SEQ ID NO: 4057615 - DNA, 22 bp, Homo sapiens
atcagcctgagtctcctgtgcc

SEQ ID NO: 4057616 - DNA, 15 bp, Homo sapiens
atcagctatttactg

SEQ ID NO: 4057617 - DNA, 12 bp, Homo sapiens
atcagctccttt

SEQ ID NO: 4057618 - DNA, 20 bp, Homo sapiens
atcaggaaatatatatgtgt

SEQ ID NO: 4057619 - DNA, 12 bp, Homo sapiens
atcaggatgaac

SEQ ID NO: 4057620 - DNA, 14 bp, Homo sapiens
atcagggaatccag

SEQ ID NO: 4057621 - DNA, 18 bp, Homo sapiens
atcagggaggtcattttg

SEQ ID NO: 4057622 - DNA, 11 bp, Homo sapiens
atcagggcctg

SEQ ID NO: 4057623 - DNA, 14 bp, Homo sapiens
atcagggcctgggg

SEQ ID NO: 4057624 - DNA, 15 bp, Homo sapiens
atcagggcctggggc

SEQ ID NO: 4057625 - DNA, 17 bp, Homo sapiens
atcagggcctggggcct

SEQ ID NO: 4057626 - DNA, 19 bp, Homo sapiens
atcagggcctggggcctga

SEQ ID NO: 4057627 - DNA, 21 bp, Homo sapiens
atcagggcctggggcctgaga

SEQ ID NO: 4057628 - DNA, 22 bp, Homo sapiens
atcagggcctggggcctgagag

SEQ ID NO: 4057629 - DNA, 13 bp, Homo sapiens
atcaggtcctgct

SEQ ID NO: 4057630 - DNA, 21 bp, Homo sapiens
atcaggtcctgctcagcagtg

SEQ ID NO: 4057631 - DNA, 15 bp, Homo sapiens
atcagtaatatttat

SEQ ID NO: 4057632 - DNA, 13 bp, Homo sapiens
atcagtcaatatt

SEQ ID NO: 4057633 - DNA, 18 bp, Homo sapiens
atcagtgggcaggataaa

SEQ ID NO: 4057634 - DNA, 20 bp, Homo sapiens
atcagtgggcaggataaact

SEQ ID NO: 4057635 - DNA, 21 bp, Homo sapiens
atcagtgggcaggataaactg

SEQ ID NO: 4057636 - DNA, 19 bp, Homo sapiens
atcagtgtaccatttgcct

SEQ ID NO: 4057637 - DNA, 17 bp, Homo sapiens
atcagtgtcctcttgct

SEQ ID NO: 4057638 - DNA, 23 bp, Homo sapiens
atcagtgtgtctaaatttgaatg

SEQ ID NO: 4057639 - DNA, 10 bp, Homo sapiens
atcagtgttg

SEQ ID NO: 4057640 - DNA, 21 bp, Homo sapiens
atcagtgttgttgctctagga

SEQ ID NO: 4057641 - DNA, 18 bp, Homo sapiens
atcagtgttttaaattct

SEQ ID NO: 4057642 - DNA, 19 bp, Homo sapiens
atcagtgttttaaattctg

SEQ ID NO: 4057643 - DNA, 12 bp, Homo sapiens
atcagttaacta

SEQ ID NO: 4057644 - DNA, 23 bp, Homo sapiens
atcagttacccactcggtcccag

SEQ ID NO: 4057645 - DNA, 23 bp, Homo sapiens
atcagttattaaataatgttcat

SEQ ID NO: 4057646 - DNA, 16 bp, Homo sapiens
atcagttattcattct

SEQ ID NO: 4057647 - DNA, 20 bp, Homo sapiens
atcagttcccccagtacctc

SEQ ID NO: 4057648 - DNA, 23 bp, Homo sapiens
atcagttggagtttgtgtctgtt

SEQ ID NO: 4057649 - DNA, 22 bp, Homo sapiens
atcagtttgctagcagaaatct

SEQ ID NO: 4057650 - DNA, 13 bp, Homo sapiens
atcagtttttaaa

SEQ ID NO: 4057651 - DNA, 15 bp, Homo sapiens
atcataaaacttgat

SEQ ID NO: 4057652 - DNA, 19 bp, Homo sapiens
atcataagtgaatttatac

SEQ ID NO: 4057653 - DNA, 20 bp, Homo sapiens
atcatataataaatgtacat

SEQ ID NO: 4057654 - DNA, 18 bp, Homo sapiens
atcatatcaattggcagt

SEQ ID NO: 4057655 - DNA, 14 bp, Homo sapiens
atcatcagggcctg

SEQ ID NO: 4057656 - DNA, 19 bp, Homo sapiens
atcatccccatcctccaga

SEQ ID NO: 4057657 - DNA, 20 bp, Homo sapiens
atcatcctttgttctgagca

SEQ ID NO: 4057658 - DNA, 15 bp, Homo sapiens
atcatctatagaaag

SEQ ID NO: 4057659 - DNA, 23 bp, Homo sapiens
atcatctccatcatatgcctgac

SEQ ID NO: 4057660 - DNA, 13 bp, Homo sapiens
atcatgagcctgc

SEQ ID NO: 4057661 - DNA, 16 bp, Homo sapiens
atcatgagcctgctgg

SEQ ID NO: 4057662 - DNA, 12 bp, Homo sapiens
atcatgcattgt

SEQ ID NO: 4057663 - DNA, 13 bp, Homo sapiens
atcatgcattgtt

SEQ ID NO: 4057664 - DNA, 21 bp, Homo sapiens
atcatgcggtgggtgctgcca

SEQ ID NO: 4057665 - DNA, 17 bp, Homo sapiens
atcatgctaaaattcta

SEQ ID NO: 4057666 - DNA, 19 bp, Homo sapiens
atcatggaatatttatagg

SEQ ID NO: 4057667 - DNA, 21 bp, Homo sapiens
atcatggtgtaataagacata

SEQ ID NO: 4057668 - DNA, 16 bp, Homo sapiens
atcatgtatgttatga

SEQ ID NO: 4057669 - DNA, 19 bp, Homo sapiens
atcatgtcaggcctgtgtg

SEQ ID NO: 4057670 - DNA, 18 bp, Homo sapiens
atcatgtgcgtcagtcca

SEQ ID NO: 4057671 - DNA, 18 bp, Homo sapiens
atcatgtgggtgagccag

SEQ ID NO: 4057672 - DNA, 11 bp, Homo sapiens
atcattaatac

SEQ ID NO: 4057673 - DNA, 14 bp, Homo sapiens
atcattagttttag

SEQ ID NO: 4057674 - DNA, 23 bp, Homo sapiens
atcattataaacgtgatgatcag

SEQ ID NO: 4057675 - DNA, 13 bp, Homo sapiens
atcattccctctc

SEQ ID NO: 4057676 - DNA, 17 bp, Homo sapiens
atcattctacagaataa

SEQ ID NO: 4057677 - DNA, 18 bp, Homo sapiens
atcattctacagaataat

SEQ ID NO: 4057678 - DNA, 21 bp, Homo sapiens
atcattgcactctagcctggg

SEQ ID NO: 4057679 - DNA, 21 bp, Homo sapiens
atccctgggcccctccacgcc

SEQ ID NO: 4057680 - DNA, 11 bp, Homo sapiens
atccctgtcct

SEQ ID NO: 4057681 - DNA, 18 bp, Homo sapiens
atccctgtgttgtctcta

SEQ ID NO: 4057682 - DNA, 14 bp, Homo sapiens
atccctgtttaata

SEQ ID NO: 4057683 - DNA, 20 bp, Homo sapiens
atccctgtttaatatttaaa

SEQ ID NO: 4057684 - DNA, 13 bp, Homo sapiens
atccctttattac

SEQ ID NO: 4057685 - DNA, 19 bp, Homo sapiens
atccgcctacctcagcctc

SEQ ID NO: 4057686 - DNA, 23 bp, Homo sapiens
atccgctggccgggggaggtggg

SEQ ID NO: 4057687 - DNA, 14 bp, Homo sapiens
atccggagaagctg

SEQ ID NO: 4057688 - DNA, 14 bp, Homo sapiens
atcctaagaaatat

SEQ ID NO: 4057689 - DNA, 21 bp, Homo sapiens
atcctaagaaatatgtgagat

SEQ ID NO: 4057690 - DNA, 22 bp, Homo sapiens
atcctaagaaatatgtgagatt

SEQ ID NO: 4057691 - DNA, 16 bp, Homo sapiens
atcctaatttctcctc

SEQ ID NO: 4057692 - DNA, 23 bp, Homo sapiens
atcctaatttctcctcccttcct

SEQ ID NO: 4057693 - DNA, 16 bp, Homo sapiens
atcctacctgttttgt

SEQ ID NO: 4057694 - DNA, 21 bp, Homo sapiens
atcctacgagtaattgcattt

SEQ ID NO: 4057695 - DNA, 19 bp, Homo sapiens
atcctagcaggagagaggc

SEQ ID NO: 4057696 - DNA, 19 bp, Homo sapiens
atcctatcaacaacaaggt

SEQ ID NO: 4057697 - DNA, 14 bp, Homo sapiens
atcctcactgggtg

SEQ ID NO: 4057698 - DNA, 15 bp, Homo sapiens
atcctcatccctgac

SEQ ID NO: 4057699 - DNA, 16 bp, Homo sapiens
atcctcatccctgact

SEQ ID NO: 4057700 - DNA, 23 bp, Homo sapiens
atcctccaacttcatttgatgct

SEQ ID NO: 4057701 - DNA, 13 bp, Homo sapiens
atcctccagagaa

SEQ ID NO: 4057702 - DNA, 13 bp, Homo sapiens
atcctccagggct

SEQ ID NO: 4057703 - DNA, 14 bp, Homo sapiens
atcctccctccacc

SEQ ID NO: 4057704 - DNA, 18 bp, Homo sapiens
atcctccctccacctcaa

SEQ ID NO: 4057705 - DNA, 20 bp, Homo sapiens
atcctccctccacctcaaga

SEQ ID NO: 4057706 - DNA, 15 bp, Homo sapiens
atcctccgtccagcc

SEQ ID NO: 4057707 - DNA, 18 bp, Homo sapiens
atcctcctccttcctagt

SEQ ID NO: 4057708 - DNA, 15 bp, Homo sapiens
atcctcctgcctcag

SEQ ID NO: 4057709 - DNA, 17 bp, Homo sapiens
atcctcctgcctcagcc

SEQ ID NO: 4057710 - DNA, 22 bp, Homo sapiens
atcctcctggaaccttgctgtc

SEQ ID NO: 4057711 - DNA, 19 bp, Homo sapiens
atcctctaaagcagaggca

SEQ ID NO: 4057712 - DNA, 14 bp, Homo sapiens
atcctctattttgt

SEQ ID NO: 4057713 - DNA, 16 bp, Homo sapiens
atcctctattttgtga

SEQ ID NO: 4057714 - DNA, 22 bp, Homo sapiens
atcctcttctgcttaggagaga

SEQ ID NO: 4057715 - DNA, 15 bp, Homo sapiens
atcctgactctgccc

SEQ ID NO: 4057716 - DNA, 17 bp, Homo sapiens
atcctgcaatgaaaggt

SEQ ID NO: 4057717 - DNA, 13 bp, Homo sapiens
atcctgccagccc

SEQ ID NO: 4057718 - DNA, 22 bp, Homo sapiens
atcctgccagccccacacagct

SEQ ID NO: 4057719 - DNA, 15 bp, Homo sapiens
atcctgcccagtgtt

SEQ ID NO: 4057720 - DNA, 21 bp, Homo sapiens
atcctgcccagtgttgtttgt

SEQ ID NO: 4057721 - DNA, 19 bp, Homo sapiens
atcctggaggcccagttca

SEQ ID NO: 4057722 - DNA, 20 bp, Homo sapiens
atcctggaggcccagttcac

SEQ ID NO: 4057723 - DNA, 17 bp, Homo sapiens
atcctggccaacatggt

SEQ ID NO: 4057724 - DNA, 21 bp, Homo sapiens
atcctgggcttttgttttgct

SEQ ID NO: 4057725 - DNA, 22 bp, Homo sapiens
atcctgggcttttgttttgctt

SEQ ID NO: 4057726 - DNA, 23 bp, Homo sapiens
atcctggtttcataacttcctgt

SEQ ID NO: 4057727 - DNA, 20 bp, Homo sapiens
atcctgtaccaaatctgaca

SEQ ID NO: 4057728 - DNA, 17 bp, Homo sapiens
atcctgtataagcactg

SEQ ID NO: 4057729 - DNA, 16 bp, Homo sapiens
atcctgtattcttcaa

SEQ ID NO: 4057730 - DNA, 21 bp, Homo sapiens
atcctgtattcttcaaccagt

SEQ ID NO: 4057731 - DNA, 19 bp, Homo sapiens
atcctgtctttaaggaaaa

SEQ ID NO: 4057732 - DNA, 21 bp, Homo sapiens
atcctgtctttaaggaaaaaa

SEQ ID NO: 4057733 - DNA, 23 bp, Homo sapiens
atcctgtctttaaggaaaaaaag

SEQ ID NO: 4057734 - DNA, 15 bp, Homo sapiens
atcctgtgacatgta

SEQ ID NO: 4057735 - DNA, 18 bp, Homo sapiens
atcctgtgacatgtaaca

SEQ ID NO: 4057736 - DNA, 19 bp, Homo sapiens
atcctgttaagagataatt

SEQ ID NO: 4057737 - DNA, 22 bp, Homo sapiens
atcctgtttataatctgaagat

SEQ ID NO: 4057738 - DNA, 19 bp, Homo sapiens
atccttataggcctgtccc

SEQ ID NO: 4057739 - DNA, 21 bp, Homo sapiens
atccttataggcctgtccctt

SEQ ID NO: 4057740 - DNA, 16 bp, Homo sapiens
atccttatcccaagct

SEQ ID NO: 4057741 - DNA, 17 bp, Homo sapiens
atccttcaccagagccc

SEQ ID NO: 4057742 - DNA, 19 bp, Homo sapiens
atccttccaaaaaattaaa

SEQ ID NO: 4057743 - DNA, 12 bp, Homo sapiens
atccttcccact

SEQ ID NO: 4057744 - DNA, 15 bp, Homo sapiens
atccttccctgctct

SEQ ID NO: 4057745 - DNA, 16 bp, Homo sapiens
atccttccctgctctt

SEQ ID NO: 4057746 - DNA, 12 bp, Homo sapiens
atccttccttca

SEQ ID NO: 4057747 - DNA, 20 bp, Homo sapiens
atccttcgtgaacatcccct

SEQ ID NO: 4057748 - DNA, 13 bp, Homo sapiens
atccttctggctg

SEQ ID NO: 4057749 - DNA, 17 bp, Homo sapiens
atcctttacgtgtttaa

SEQ ID NO: 4057750 - DNA, 19 bp, Homo sapiens
atcctttcacttctttccc

SEQ ID NO: 4057751 - DNA, 13 bp, Homo sapiens
atcctttctaaca

SEQ ID NO: 4057752 - DNA, 15 bp, Homo sapiens
atcctttctgccgac

SEQ ID NO: 4057753 - DNA, 14 bp, Homo sapiens
atcctttgttctga

SEQ ID NO: 4057754 - DNA, 19 bp, Homo sapiens
atcctttgttttctgacta

SEQ ID NO: 4057755 - DNA, 12 bp, Homo sapiens
atccttttcctt

SEQ ID NO: 4057756 - DNA, 13 bp, Homo sapiens
atccttttcctta

SEQ ID NO: 4057757 - DNA, 14 bp, Homo sapiens
atccttttccttat

SEQ ID NO: 4057758 - DNA, 22 bp, Homo sapiens
atccttttccttatttgccttc

SEQ ID NO: 4057759 - DNA, 19 bp, Homo sapiens
atcctttttccatcatttt

SEQ ID NO: 4057760 - DNA, 18 bp, Homo sapiens
atcgaaataacaatgtta

SEQ ID NO: 4057761 - DNA, 20 bp, Homo sapiens
atcgaaataacaatgttaag

SEQ ID NO: 4057762 - DNA, 15 bp, Homo sapiens
atcgaaccgttttga

SEQ ID NO: 4057763 - DNA, 20 bp, Homo sapiens
atcgaatctactaattccac

SEQ ID NO: 4057764 - DNA, 19 bp, Homo sapiens
atcgagaccatcctggcta

SEQ ID NO: 4057765 - DNA, 13 bp, Homo sapiens
atcgatgcagtgc

SEQ ID NO: 4057766 - DNA, 20 bp, Homo sapiens
atcgcaccactgtgtattta

SEQ ID NO: 4057767 - DNA, 19 bp, Homo sapiens
atcgccttgaacaaaaagt

SEQ ID NO: 4057768 - DNA, 18 bp, Homo sapiens
atcgctaagctggctctg

SEQ ID NO: 4057769 - DNA, 14 bp, Homo sapiens
atcggactctgccc

SEQ ID NO: 4057770 - DNA, 16 bp, Homo sapiens
atcggagcgaagcaga

SEQ ID NO: 4057771 - DNA, 21 bp, Homo sapiens
atcggatctggggctctggga

SEQ ID NO: 4057772 - DNA, 23 bp, Homo sapiens
atcggccaagaatacttgaagaa

SEQ ID NO: 4057773 - DNA, 15 bp, Homo sapiens
atcgggaacagtgtt

SEQ ID NO: 4057774 - DNA, 17 bp, Homo sapiens
atcgggaacagtgtttc

SEQ ID NO: 4057775 - DNA, 19 bp, Homo sapiens
atcgggagcacccagagca

SEQ ID NO: 4057776 - DNA, 14 bp, Homo sapiens
atcggtaggcaaag

SEQ ID NO: 4057777 - DNA, 16 bp, Homo sapiens
atcgtaaccagccaga

SEQ ID NO: 4057778 - DNA, 12 bp, Homo sapiens
atcgtgaaaccc

SEQ ID NO: 4057779 - DNA, 20 bp, Homo sapiens
atcgtgaaaccctgtctcta

SEQ ID NO: 4057780 - DNA, 17 bp, Homo sapiens
atcgtgctaaattttca

SEQ ID NO: 4057781 - DNA, 18 bp, Homo sapiens
atctcttctggtgttgac

SEQ ID NO: 4057782 - DNA, 13 bp, Homo sapiens
atctcttctgtgt

SEQ ID NO: 4057783 - DNA, 16 bp, Homo sapiens
atctcttgcttgtcat

SEQ ID NO: 4057784 - DNA, 17 bp, Homo sapiens
atctcttgcttgtcatt

SEQ ID NO: 4057785 - DNA, 18 bp, Homo sapiens
atctcttgcttgtcattg

SEQ ID NO: 4057786 - DNA, 17 bp, Homo sapiens
atctctttcacattgtt

SEQ ID NO: 4057787 - DNA, 19 bp, Homo sapiens
atctctttcacattgtttg

SEQ ID NO: 4057788 - DNA, 11 bp, Homo sapiens
atctcttttat

SEQ ID NO: 4057789 - DNA, 20 bp, Homo sapiens
atctcttttatatttgtagg

SEQ ID NO: 4057790 - DNA, 22 bp, Homo sapiens
atctgaaaatgtatgtgtaagt

SEQ ID NO: 4057791 - DNA, 21 bp, Homo sapiens
atctgaaacccacagatgtct

SEQ ID NO: 4057792 - DNA, 13 bp, Homo sapiens
atctgacatatta

SEQ ID NO: 4057793 - DNA, 20 bp, Homo sapiens
atctgacatattatgcctga

SEQ ID NO: 4057794 - DNA, 20 bp, Homo sapiens
atctgacccagtgcccccac

SEQ ID NO: 4057795 - DNA, 21 bp, Homo sapiens
atctgacccagtgcccccact

SEQ ID NO: 4057796 - DNA, 21 bp, Homo sapiens
atctgagatttttttgtgtat

SEQ ID NO: 4057797 - DNA, 17 bp, Homo sapiens
atctgagcaagagctgg

SEQ ID NO: 4057798 - DNA, 22 bp, Homo sapiens
atctgagcaagagctggcaaag

SEQ ID NO: 4057799 - DNA, 18 bp, Homo sapiens
atctgcacacacctccga

SEQ ID NO: 4057800 - DNA, 20 bp, Homo sapiens
atctgcaccccttctctcct

SEQ ID NO: 4057801 - DNA, 17 bp, Homo sapiens
atctgcactctaaactg

SEQ ID NO: 4057802 - DNA, 12 bp, Homo sapiens
atctgcattatc

SEQ ID NO: 4057803 - DNA, 13 bp, Homo sapiens
atctgcattatct

SEQ ID NO: 4057804 - DNA, 19 bp, Homo sapiens
atctgcattttcaccccac

SEQ ID NO: 4057805 - DNA, 17 bp, Homo sapiens
atctgccagaccttaat

SEQ ID NO: 4057806 - DNA, 16 bp, Homo sapiens
atctgcccctccccca

SEQ ID NO: 4057807 - DNA, 17 bp, Homo sapiens
atctgcccctcccccaa

SEQ ID NO: 4057808 - DNA, 21 bp, Homo sapiens
atctgccttaaaaccaaagag

SEQ ID NO: 4057809 - DNA, 16 bp, Homo sapiens
atctgcgtgacaataa

SEQ ID NO: 4057810 - DNA, 22 bp, Homo sapiens
atctgcgtgacaataaaacatt

SEQ ID NO: 4057811 - DNA, 18 bp, Homo sapiens
atctgctcactttaaacc

SEQ ID NO: 4057812 - DNA, 17 bp, Homo sapiens
atctgctgcatagctct

SEQ ID NO: 4057813 - DNA, 23 bp, Homo sapiens
atctgctgcatagctctatttta

SEQ ID NO: 4057814 - DNA, 14 bp, Homo sapiens
atctgcttttatta

SEQ ID NO: 4057815 - DNA, 16 bp, Homo sapiens
atctgcttttattaaa

SEQ ID NO: 4057816 - DNA, 16 bp, Homo sapiens
atctggaacccagact

SEQ ID NO: 4057817 - DNA, 18 bp, Homo sapiens
atctggaacccagactca

SEQ ID NO: 4057818 - DNA, 19 bp, Homo sapiens
atctggaacccagactcag

SEQ ID NO: 4057819 - DNA, 17 bp, Homo sapiens
atctggaacctcagcct

SEQ ID NO: 4057820 - DNA, 18 bp, Homo sapiens
atctggaacctcagcctg

SEQ ID NO: 4057821 - DNA, 21 bp, Homo sapiens
atctggaacctcagcctggcc

SEQ ID NO: 4057822 - DNA, 22 bp, Homo sapiens
atctggaacctcagcctggcca

SEQ ID NO: 4057823 - DNA, 17 bp, Homo sapiens
atctggaatattgtgat

SEQ ID NO: 4057824 - DNA, 17 bp, Homo sapiens
atctggataggagcctg

SEQ ID NO: 4057825 - DNA, 18 bp, Homo sapiens
atctggataggagcctgc

SEQ ID NO: 4057826 - DNA, 19 bp, Homo sapiens
atctggcccttacacactc

SEQ ID NO: 4057827 - DNA, 21 bp, Homo sapiens
atctggcccttacacactcag

SEQ ID NO: 4057828 - DNA, 17 bp, Homo sapiens
atctggcctaaaatctt

SEQ ID NO: 4057829 - DNA, 21 bp, Homo sapiens
atctggcctaaaatcttggaa

SEQ ID NO: 4057830 - DNA, 22 bp, Homo sapiens
atctggcctaaaatcttggaag

SEQ ID NO: 4057831 - DNA, 23 bp, Homo sapiens
atctggcctaaaatcttggaagt

SEQ ID NO: 4057832 - DNA, 17 bp, Homo sapiens
atctggctcctttacaa

SEQ ID NO: 4057833 - DNA, 19 bp, Homo sapiens
atctggctgtctagaatgt

SEQ ID NO: 4057834 - DNA, 22 bp, Homo sapiens
atctgggattcccaccaaggtc

SEQ ID NO: 4057835 - DNA, 20 bp, Homo sapiens
atctgggcattttcctcctc

SEQ ID NO: 4057836 - DNA, 21 bp, Homo sapiens
atctgggcattttcctcctct

SEQ ID NO: 4057837 - DNA, 16 bp, Homo sapiens
atctggggctctggga

SEQ ID NO: 4057838 - DNA, 23 bp, Homo sapiens
atctggggttggcaacaggacag

SEQ ID NO: 4057839 - DNA, 15 bp, Homo sapiens
atctgggtatctttc

SEQ ID NO: 4057840 - DNA, 14 bp, Homo sapiens
atctgggtccttgc

SEQ ID NO: 4057841 - DNA, 18 bp, Homo sapiens
atctgggtccttgcaccc

SEQ ID NO: 4057842 - DNA, 17 bp, Homo sapiens
atctggtccatatttac

SEQ ID NO: 4057843 - DNA, 19 bp, Homo sapiens
atctggtcttgttagaaaa

SEQ ID NO: 4057844 - DNA, 23 bp, Homo sapiens
atctgtaacaggtattttgtttc

SEQ ID NO: 4057845 - DNA, 19 bp, Homo sapiens
atctgtaagtaacttcaca

SEQ ID NO: 4057846 - DNA, 15 bp, Homo sapiens
atctgtacgtaagaa

SEQ ID NO: 4057847 - DNA, 14 bp, Homo sapiens
atctgtagggctgg

SEQ ID NO: 4057848 - DNA, 15 bp, Homo sapiens
atctgtagggctgga

SEQ ID NO: 4057849 - DNA, 18 bp, Homo sapiens
atctgtagggctggacct

SEQ ID NO: 4057850 - DNA, 14 bp, Homo sapiens
atctgtataaatgt

SEQ ID NO: 4057851 - DNA, 15 bp, Homo sapiens
atctgtataaatgtc

SEQ ID NO: 4057852 - DNA, 22 bp, Homo sapiens
atctgtatttaatggtttttat

SEQ ID NO: 4057853 - DNA, 23 bp, Homo sapiens
atctgtcaagtgggatctgtcac

SEQ ID NO: 4057854 - DNA, 21 bp, Homo sapiens
atctgtcagcatctggctgtc

SEQ ID NO: 4057855 - DNA, 16 bp, Homo sapiens
atctgtcatctctctg

SEQ ID NO: 4057856 - DNA, 17 bp, Homo sapiens
atctgtcatctctctgg

SEQ ID NO: 4057857 - DNA, 17 bp, Homo sapiens
atctgtccgtggaaaat

SEQ ID NO: 4057858 - DNA, 14 bp, Homo sapiens
atctgtcctcagcc

SEQ ID NO: 4057859 - DNA, 16 bp, Homo sapiens
atctgtcctcagcctt

SEQ ID NO: 4057860 - DNA, 17 bp, Homo sapiens
atctgtcctcagccttg

SEQ ID NO: 4057861 - DNA, 18 bp, Homo sapiens
atctgtcctcagccttgc

SEQ ID NO: 4057862 - DNA, 20 bp, Homo sapiens
atctgtctcccagttatgaa

SEQ ID NO: 4057863 - DNA, 14 bp, Homo sapiens
atctgtctgctggt

SEQ ID NO: 4057864 - DNA, 23 bp, Homo sapiens
atctgtctgctggtcacttcttc

SEQ ID NO: 4057865 - DNA, 21 bp, Homo sapiens
atctgtgaaatgctggcattt

SEQ ID NO: 4057866 - DNA, 19 bp, Homo sapiens
atctgtgatgacattccct

SEQ ID NO: 4057867 - DNA, 18 bp, Homo sapiens
atctgtgcagggctggtt

SEQ ID NO: 4057868 - DNA, 22 bp, Homo sapiens
atctgtgggcatggtcaaaggc

SEQ ID NO: 4057869 - DNA, 15 bp, Homo sapiens
atctgtgtgaaactt

SEQ ID NO: 4057870 - DNA, 20 bp, Homo sapiens
atctgtgtgaaactttcatt

SEQ ID NO: 4057871 - DNA, 15 bp, Homo sapiens
atctgtgtgtatatt

SEQ ID NO: 4057872 - DNA, 14 bp, Homo sapiens
atctgttagggcct

SEQ ID NO: 4057873 - DNA, 15 bp, Homo sapiens
atctgttagggcctt

SEQ ID NO: 4057874 - DNA, 16 bp, Homo sapiens
atctgttagggccttg

SEQ ID NO: 4057875 - DNA, 14 bp, Homo sapiens
atctgttctaacat

SEQ ID NO: 4057876 - DNA, 24 bp, Homo sapiens
atctgtttaaagcatatagagatg

SEQ ID NO: 4057877 - DNA, 22 bp, Homo sapiens
atctgttttaaatttatttcaa

SEQ ID NO: 4057878 - DNA, 17 bp, Homo sapiens
atctgttttgaaggcaa

SEQ ID NO: 4057879 - DNA, 22 bp, Homo sapiens
atcttaaatcagaataaattaa

SEQ ID NO: 4057880 - DNA, 21 bp, Homo sapiens
atcttacaacaggcttatgaa

SEQ ID NO: 4057881 - DNA, 22 bp, Homo sapiens
atcttacaacaggcttatgaat

SEQ ID NO: 4057882 - DNA, 15 bp, Homo sapiens
atcttagggtgaacc

SEQ ID NO: 4057883 - DNA, 18 bp, Homo sapiens
atcttagtgcctgagagt

SEQ ID NO: 4057884 - DNA, 18 bp, Homo sapiens
atcttatgaataagcact

SEQ ID NO: 4057885 - DNA, 16 bp, Homo sapiens
atcttattttcatgta

SEQ ID NO: 4057886 - DNA, 16 bp, Homo sapiens
atcttattttctcaat

SEQ ID NO: 4057887 - DNA, 16 bp, Homo sapiens
atcttcaaactttcac

SEQ ID NO: 4057888 - DNA, 19 bp, Homo sapiens
atcttcaaagcttgaagat

SEQ ID NO: 4057889 - DNA, 15 bp, Homo sapiens
atcttcaatggcttt

SEQ ID NO: 4057890 - DNA, 14 bp, Homo sapiens
atcttcagagcagg

SEQ ID NO: 4057891 - DNA, 14 bp, Homo sapiens
atcttccatatttg

SEQ ID NO: 4057892 - DNA, 19 bp, Homo sapiens
atcttccatatttggaaga

SEQ ID NO: 4057893 - DNA, 13 bp, Homo sapiens
atcttcccataat

SEQ ID NO: 4057894 - DNA, 22 bp, Homo sapiens
atcttccctagagggttcctgt

SEQ ID NO: 4057895 - DNA, 16 bp, Homo sapiens
atcttccttgtgagga

SEQ ID NO: 4057896 - DNA, 15 bp, Homo sapiens
atcttctatttttat

SEQ ID NO: 4057897 - DNA, 19 bp, Homo sapiens
atcttctatttttatcatg

SEQ ID NO: 4057898 - DNA, 13 bp, Homo sapiens
atcttctccagat

SEQ ID NO: 4057899 - DNA, 15 bp, Homo sapiens
atcttctgtgaaata

SEQ ID NO: 4057900 - DNA, 24 bp, Homo sapiens
atcttctgtgaaatataattgtac

SEQ ID NO: 4057901 - DNA, 17 bp, Homo sapiens
atcttcttcaaatacaa

SEQ ID NO: 4057902 - DNA, 21 bp, Homo sapiens
atcttcttcaaatacaaagta

SEQ ID NO: 4057903 - DNA, 13 bp, Homo sapiens
atcttcttcccag

SEQ ID NO: 4057904 - DNA, 17 bp, Homo sapiens
atcttctttataattct

SEQ ID NO: 4057905 - DNA, 21 bp, Homo sapiens
atcttgaatgtggtctcagga

SEQ ID NO: 4057906 - DNA, 11 bp, Homo sapiens
atcttgcattc

SEQ ID NO: 4057907 - DNA, 16 bp, Homo sapiens
atcttgcattcatttt

SEQ ID NO: 4057908 - DNA, 11 bp, Homo sapiens
atcttgccaca

SEQ ID NO: 4057909 - DNA, 17 bp, Homo sapiens
atcttgccacatttctg

SEQ ID NO: 4057910 - DNA, 18 bp, Homo sapiens
atcttgccacatttctga

SEQ ID NO: 4057911 - DNA, 21 bp, Homo sapiens
atcttggggcaagactgcaaa

SEQ ID NO: 4057912 - DNA, 23 bp, Homo sapiens
atcttgggtgggtgaaggcctgg

SEQ ID NO: 4057913 - DNA, 22 bp, Homo sapiens
atcttggtactactagatgtct

SEQ ID NO: 4057914 - DNA, 20 bp, Homo sapiens
atcttggtcagatttgaact

SEQ ID NO: 4057915 - DNA, 15 bp, Homo sapiens
atcttgtctctgggc

SEQ ID NO: 4057916 - DNA, 15 bp, Homo sapiens
atcttgttttaagca

SEQ ID NO: 4057917 - DNA, 16 bp, Homo sapiens
atctttagaaaaggca

SEQ ID NO: 4057918 - DNA, 15 bp, Homo sapiens
atctttcacttgaaa

SEQ ID NO: 4057919 - DNA, 16 bp, Homo sapiens
atctttcctcaagtat

SEQ ID NO: 4057920 - DNA, 20 bp, Homo sapiens
atctttcctcaagtatcttc

SEQ ID NO: 4057921 - DNA, 17 bp, Homo sapiens
atctttgcgaaaagata

SEQ ID NO: 4057922 - DNA, 20 bp, Homo sapiens
atctttgcgaaaagataaac

SEQ ID NO: 4057923 - DNA, 23 bp, Homo sapiens
atctttgcgaaaagataaacctg

SEQ ID NO: 4057924 - DNA, 14 bp, Homo sapiens
atctttgtgacagg

SEQ ID NO: 4057925 - DNA, 17 bp, Homo sapiens
atctttgtgataattta

SEQ ID NO: 4057926 - DNA, 16 bp, Homo sapiens
atctttgttacttcct

SEQ ID NO: 4057927 - DNA, 18 bp, Homo sapiens
atcttttatcctgggagc

SEQ ID NO: 4057928 - DNA, 14 bp, Homo sapiens
atcttttggttatt

SEQ ID NO: 4057929 - DNA, 18 bp, Homo sapiens
atctttttacctttcata

SEQ ID NO: 4057930 - DNA, 20 bp, Homo sapiens
atgaaaaacaaaaataacat

SEQ ID NO: 4057931 - DNA, 22 bp, Homo sapiens
atgaaaaatttaagcattgttt

SEQ ID NO: 4057932 - DNA, 15 bp, Homo sapiens
atgaaaagatttaag

SEQ ID NO: 4057933 - DNA, 21 bp, Homo sapiens
atgaaaaggttgcctgaaaaa

SEQ ID NO: 4057934 - DNA, 12 bp, Homo sapiens
atgaaaatgtca

SEQ ID NO: 4057935 - DNA, 15 bp, Homo sapiens
atgaaaatgtcagaa

SEQ ID NO: 4057936 - DNA, 19 bp, Homo sapiens
atgaaaatgtcagaaacca

SEQ ID NO: 4057937 - DNA, 15 bp, Homo sapiens
atgaaaattgtatta

SEQ ID NO: 4057938 - DNA, 19 bp, Homo sapiens
atgaaaatttgagactatt

SEQ ID NO: 4057939 - DNA, 17 bp, Homo sapiens
atgaaaattttaaaaat

SEQ ID NO: 4057940 - DNA, 20 bp, Homo sapiens
atgaaacactcagttgttca

SEQ ID NO: 4057941 - DNA, 16 bp, Homo sapiens
atgaaactcacaaatg

SEQ ID NO: 4057942 - DNA, 15 bp, Homo sapiens
atgaaagaatatatt

SEQ ID NO: 4057943 - DNA, 12 bp, Homo sapiens
atgaaagactgt

SEQ ID NO: 4057944 - DNA, 19 bp, Homo sapiens
atgaaagactgtacaaagt

SEQ ID NO: 4057945 - DNA, 20 bp, Homo sapiens
atgaaagactgtacaaagta

SEQ ID NO: 4057946 - DNA, 13 bp, Homo sapiens
atgaaagaggagg

SEQ ID NO: 4057947 - DNA, 15 bp, Homo sapiens
atgaaaggtactata

SEQ ID NO: 4057948 - DNA, 21 bp, Homo sapiens
atgaaaggtactatatttgct

SEQ ID NO: 4057949 - DNA, 13 bp, Homo sapiens
atgaaagttttgc

SEQ ID NO: 4057950 - DNA, 22 bp, Homo sapiens
atgaaataactccttcttgtag

SEQ ID NO: 4057951 - DNA, 20 bp, Homo sapiens
atgaaatacacaagtaaaca

SEQ ID NO: 4057952 - DNA, 19 bp, Homo sapiens
atgaaatatcagactagtg

SEQ ID NO: 4057953 - DNA, 21 bp, Homo sapiens
atgaaatctgctagaaagtta

SEQ ID NO: 4057954 - DNA, 13 bp, Homo sapiens
atgaaatgttctg

SEQ ID NO: 4057955 - DNA, 16 bp, Homo sapiens
atgaaattcttcctaa

SEQ ID NO: 4057956 - DNA, 14 bp, Homo sapiens
atgaaatttgcaaa

SEQ ID NO: 4057957 - DNA, 15 bp, Homo sapiens
atgaaatttgcaaaa

SEQ ID NO: 4057958 - DNA, 20 bp, Homo sapiens
atgaaatttgcaaaatcact

SEQ ID NO: 4057959 - DNA, 22 bp, Homo sapiens
atgaacccaggacgcttctgaa

SEQ ID NO: 4057960 - DNA, 17 bp, Homo sapiens
atgaactgaagtttcac

SEQ ID NO: 4057961 - DNA, 15 bp, Homo sapiens
atgaagaagtttcta

SEQ ID NO: 4057962 - DNA, 14 bp, Homo sapiens
atgaagaatagaaa

SEQ ID NO: 4057963 - DNA, 18 bp, Homo sapiens
atgaagaatagaaacaag

SEQ ID NO: 4057964 - DNA, 15 bp, Homo sapiens
atgaagagaagcaat

SEQ ID NO: 4057965 - DNA, 15 bp, Homo sapiens
atgaagagtattaat

SEQ ID NO: 4057966 - DNA, 19 bp, Homo sapiens
atgaagattctcctgtgct

SEQ ID NO: 4057967 - DNA, 13 bp, Homo sapiens
atgaagcagcttt

SEQ ID NO: 4057968 - DNA, 22 bp, Homo sapiens
atgaagctaataaaattcgctt

SEQ ID NO: 4057969 - DNA, 15 bp, Homo sapiens
atgaagctacctcaa

SEQ ID NO: 4057970 - DNA, 22 bp, Homo sapiens
atgaaggttaggatttaacagt

SEQ ID NO: 4057971 - DNA, 12 bp, Homo sapiens
atgaagtaaatt

SEQ ID NO: 4057972 - DNA, 15 bp, Homo sapiens
atgaagtaaattatg

SEQ ID NO: 4057973 - DNA, 18 bp, Homo sapiens
atgaagtgcgtgaatgta

SEQ ID NO: 4057974 - DNA, 15 bp, Homo sapiens
atgaagtttaaaaca

SEQ ID NO: 4057975 - DNA, 20 bp, Homo sapiens
atgaagtttaaaacagtatt

SEQ ID NO: 4057976 - DNA, 22 bp, Homo sapiens
atgaagtttgtagttgttttaa

SEQ ID NO: 4057977 - DNA, 15 bp, Homo sapiens
atgaataaagaatgc

SEQ ID NO: 4057978 - DNA, 15 bp, Homo sapiens
atgaatacaaatttt

SEQ ID NO: 4057979 - DNA, 17 bp, Homo sapiens
atgaatatctattaata

SEQ ID NO: 4057980 - DNA, 21 bp, Homo sapiens
atgaatatctattaatatatg

SEQ ID NO: 4057981 - DNA, 17 bp, Homo sapiens
atgaatattgaagtttc

SEQ ID NO: 4057982 - DNA, 12 bp, Homo sapiens
atgaatatttat

SEQ ID NO: 4057983 - DNA, 15 bp, Homo sapiens
atgaatatttataac

SEQ ID NO: 4057984 - DNA, 18 bp, Homo sapiens
atgaatatttataacagc

SEQ ID NO: 4057985 - DNA, 14 bp, Homo sapiens
atgccctcagggga

SEQ ID NO: 4057986 - DNA, 22 bp, Homo sapiens
atgccctctctgagtctggact

SEQ ID NO: 4057987 - DNA, 23 bp, Homo sapiens
atgcctagcagagtgctggcact

SEQ ID NO: 4057988 - DNA, 24 bp, Homo sapiens
atgcctagcagagtgctggcactt

SEQ ID NO: 4057989 - DNA, 15 bp, Homo sapiens
atgcctcaatgtgac

SEQ ID NO: 4057990 - DNA, 22 bp, Homo sapiens
atgcctccctatccctcacaca

SEQ ID NO: 4057991 - DNA, 15 bp, Homo sapiens
atgcctcctgtgggg

SEQ ID NO: 4057992 - DNA, 15 bp, Homo sapiens
atgcctctcccgcac

SEQ ID NO: 4057993 - DNA, 23 bp, Homo sapiens
atgcctctcccgcaccaggccgg

SEQ ID NO: 4057994 - DNA, 18 bp, Homo sapiens
atgcctctgccaaaggat

SEQ ID NO: 4057995 - DNA, 22 bp, Homo sapiens
atgcctctgccaaaggatgtga

SEQ ID NO: 4057996 - DNA, 17 bp, Homo sapiens
atgcctgagggtggaga

SEQ ID NO: 4057997 - DNA, 18 bp, Homo sapiens
atgcctgcgcctgctgcc

SEQ ID NO: 4057998 - DNA, 19 bp, Homo sapiens
atgcctgcgcctgctgcct

SEQ ID NO: 4057999 - DNA, 15 bp, Homo sapiens
atgccttaaaatgga

SEQ ID NO: 4058000 - DNA, 16 bp, Homo sapiens
atgcctttgagacagt

SEQ ID NO: 4058001 - DNA, 19 bp, Homo sapiens
atgcctttgagacagtttc

SEQ ID NO: 4058002 - DNA, 21 bp, Homo sapiens
atgcctttgagacagtttctt

SEQ ID NO: 4058003 - DNA, 22 bp, Homo sapiens
atgcctttgagacagtttctta

SEQ ID NO: 4058004 - DNA, 13 bp, Homo sapiens
atgcctttgtaag

SEQ ID NO: 4058005 - DNA, 16 bp, Homo sapiens
atgcctttgtaagtta

SEQ ID NO: 4058006 - DNA, 14 bp, Homo sapiens
atgcgatttcttcc

SEQ ID NO: 4058007 - DNA, 21 bp, Homo sapiens
atgcgatttcttccttgttgt

SEQ ID NO: 4058008 - DNA, 17 bp, Homo sapiens
atgcgctttattgccca

SEQ ID NO: 4058009 - DNA, 14 bp, Homo sapiens
atgcggtagccagc

SEQ ID NO: 4058010 - DNA, 15 bp, Homo sapiens
atgcggtagccagca

SEQ ID NO: 4058011 - DNA, 18 bp, Homo sapiens
atgcggtagccagcacac

SEQ ID NO: 4058012 - DNA, 21 bp, Homo sapiens
atgcggtagccagcacacagg

SEQ ID NO: 4058013 - DNA, 15 bp, Homo sapiens
atgcggtgggtgctg

SEQ ID NO: 4058014 - DNA, 18 bp, Homo sapiens
atgcggtgggtgctgcca

SEQ ID NO: 4058015 - DNA, 14 bp, Homo sapiens
atgcgttcactcca

SEQ ID NO: 4058016 - DNA, 14 bp, Homo sapiens
atgctaaaattcta

SEQ ID NO: 4058017 - DNA, 15 bp, Homo sapiens
atgctaacaaagaca

SEQ ID NO: 4058018 - DNA, 23 bp, Homo sapiens
atgctaacaaagacaaaagtctg

SEQ ID NO: 4058019 - DNA, 19 bp, Homo sapiens
atgctaacatctaaaaata

SEQ ID NO: 4058020 - DNA, 17 bp, Homo sapiens
atgctaatttaaagaga

SEQ ID NO: 4058021 - DNA, 19 bp, Homo sapiens
atgctagaaaaatgttctt

SEQ ID NO: 4058022 - DNA, 15 bp, Homo sapiens
atgctaggtctcgga

SEQ ID NO: 4058023 - DNA, 14 bp, Homo sapiens
atgctcaaagaaat

SEQ ID NO: 4058024 - DNA, 12 bp, Homo sapiens
atgctcacctct

SEQ ID NO: 4058025 - DNA, 14 bp, Homo sapiens
atgctcacctctag

SEQ ID NO: 4058026 - DNA, 14 bp, Homo sapiens
atgctcactttatt

SEQ ID NO: 4058027 - DNA, 13 bp, Homo sapiens
atgctcagccctg

SEQ ID NO: 4058028 - DNA, 15 bp, Homo sapiens
atgctccaaatataa

SEQ ID NO: 4058029 - DNA, 23 bp, Homo sapiens
atgctccccacagcgtccctggc

SEQ ID NO: 4058030 - DNA, 16 bp, Homo sapiens
atgctcccctgtgcca

SEQ ID NO: 4058031 - DNA, 13 bp, Homo sapiens
atgctccctcagc

SEQ ID NO: 4058032 - DNA, 14 bp, Homo sapiens
atgctccctcagcc

SEQ ID NO: 4058033 - DNA, 19 bp, Homo sapiens
atgctccctcagcctcaga

SEQ ID NO: 4058034 - DNA, 20 bp, Homo sapiens
atgctccctcagcctcagag

SEQ ID NO: 4058035 - DNA, 21 bp, Homo sapiens
atgctccctcagcctcagagg

SEQ ID NO: 4058036 - DNA, 18 bp, Homo sapiens
atgctccctcccctgccc

SEQ ID NO: 4058037 - DNA, 19 bp, Homo sapiens
atgctccctcccctgccct

SEQ ID NO: 4058038 - DNA, 17 bp, Homo sapiens
atgctctctcaaattgt

SEQ ID NO: 4058039 - DNA, 13 bp, Homo sapiens
atgctctgtgcca

SEQ ID NO: 4058040 - DNA, 14 bp, Homo sapiens
atgctctgtgccag

SEQ ID NO: 4058041 - DNA, 19 bp, Homo sapiens
atgctgatcatcgccagag

SEQ ID NO: 4058042 - DNA, 22 bp, Homo sapiens
atgctgatcatcgccagaggtg

SEQ ID NO: 4058043 - DNA, 24 bp, Homo sapiens
atgctgatcatcgccagaggtgct

SEQ ID NO: 4058044 - DNA, 13 bp, Homo sapiens
atgctgctactta

SEQ ID NO: 4058045 - DNA, 21 bp, Homo sapiens
atgctgctacttaattccttt

SEQ ID NO: 4058046 - DNA, 12 bp, Homo sapiens
atgctgctggcc

SEQ ID NO: 4058047 - DNA, 13 bp, Homo sapiens
atgctgctggcca

SEQ ID NO: 4058048 - DNA, 14 bp, Homo sapiens
atgctgctggccaa

SEQ ID NO: 4058049 - DNA, 12 bp, Homo sapiens
atgctggagagg

SEQ ID NO: 4058050 - DNA, 13 bp, Homo sapiens
atgctggagaggt

SEQ ID NO: 4058051 - DNA, 12 bp, Homo sapiens
atgctggccagc

SEQ ID NO: 4058052 - DNA, 18 bp, Homo sapiens
atgctggccagcaccctc

SEQ ID NO: 4058053 - DNA, 13 bp, Homo sapiens
atgctggcccagg

SEQ ID NO: 4058054 - DNA, 22 bp, Homo sapiens
atgctggcccagggcccagagc

SEQ ID NO: 4058055 - DNA, 18 bp, Homo sapiens
atgctggccgctcctccc

SEQ ID NO: 4058056 - DNA, 23 bp, Homo sapiens
atgctgggaagacgcctgagctc

SEQ ID NO: 4058057 - DNA, 14 bp, Homo sapiens
atgctgggctgggc

SEQ ID NO: 4058058 - DNA, 18 bp, Homo sapiens
atgctggtggaaagatag

SEQ ID NO: 4058059 - DNA, 21 bp, Homo sapiens
atgctggttttcctaaatgca

SEQ ID NO: 4058060 - DNA, 22 bp, Homo sapiens
atgctggttttcctaaatgcag

SEQ ID NO: 4058061 - DNA, 12 bp, Homo sapiens
atgctgtacatc

SEQ ID NO: 4058062 - DNA, 23 bp, Homo sapiens
atgctgtacatctattttggatt

SEQ ID NO: 4058063 - DNA, 20 bp, Homo sapiens
atgctgtcaactatgatatg

SEQ ID NO: 4058064 - DNA, 17 bp, Homo sapiens
atgctgtgctatgaatt

SEQ ID NO: 4058065 - DNA, 20 bp, Homo sapiens
atgctgttagtaaatttctg

SEQ ID NO: 4058066 - DNA, 17 bp, Homo sapiens
atgcttaaactaaataa

SEQ ID NO: 4058067 - DNA, 15 bp, Homo sapiens
atgcttacaaaaaag

SEQ ID NO: 4058068 - DNA, 19 bp, Homo sapiens
atgcttcatcattccctct

SEQ ID NO: 4058069 - DNA, 17 bp, Homo sapiens
atgcttcattcaatatt

SEQ ID NO: 4058070 - DNA, 20 bp, Homo sapiens
atgcttcattcaatattgac

SEQ ID NO: 4058071 - DNA, 21 bp, Homo sapiens
atgcttcattcaatattgaca

SEQ ID NO: 4058072 - DNA, 14 bp, Homo sapiens
atgcttccaatctt

SEQ ID NO: 4058073 - DNA, 18 bp, Homo sapiens
atgcttccaatcttgctt

SEQ ID NO: 4058074 - DNA, 13 bp, Homo sapiens
atgcttccagaaa

SEQ ID NO: 4058075 - DNA, 15 bp, Homo sapiens
atgcttcccagaggg

SEQ ID NO: 4058076 - DNA, 21 bp, Homo sapiens
atgcttcccagagggagcagg

SEQ ID NO: 4058077 - DNA, 15 bp, Homo sapiens
atgcttcctcccagc

SEQ ID NO: 4058078 - DNA, 14 bp, Homo sapiens
atgcttctgggaga

SEQ ID NO: 4058079 - DNA, 22 bp, Homo sapiens
atgcttgtaatttaaacatttg

SEQ ID NO: 4058080 - DNA, 12 bp, Homo sapiens
atgcttgtttat

SEQ ID NO: 4058081 - DNA, 19 bp, Homo sapiens
atgctttttatttctgcat

SEQ ID NO: 4058082 - DNA, 23 bp, Homo sapiens
atgctttttatttctgcatatgt

SEQ ID NO: 4058083 - DNA, 19 bp, Homo sapiens
atggaaaaaaacataaaaa

SEQ ID NO: 4058084 - DNA, 20 bp, Homo sapiens
atggaaaaaaacataaaaag

SEQ ID NO: 4058085 - DNA, 21 bp, Homo sapiens
atggaaaaaaacataaaaagc

SEQ ID NO: 4058086 - DNA, 20 bp, Homo sapiens
atggaaaaggaagactagag

SEQ ID NO: 4058087 - DNA, 20 bp, Homo sapiens
atgggcctggccacctctct

SEQ ID NO: 4058088 - DNA, 14 bp, Homo sapiens
atgggctcttccaa

SEQ ID NO: 4058089 - DNA, 15 bp, Homo sapiens
atgggctcttccaac

SEQ ID NO: 4058090 - DNA, 19 bp, Homo sapiens
atgggcttcactgtataaa

SEQ ID NO: 4058091 - DNA, 20 bp, Homo sapiens
atgggcttcactgtataaat

SEQ ID NO: 4058092 - DNA, 21 bp, Homo sapiens
atggggaggcaagtgtggggg

SEQ ID NO: 4058093 - DNA, 15 bp, Homo sapiens
atggggccagatcca

SEQ ID NO: 4058094 - DNA, 15 bp, Homo sapiens
atggggccctcccag

SEQ ID NO: 4058095 - DNA, 17 bp, Homo sapiens
atggggccctcccagaa

SEQ ID NO: 4058096 - DNA, 12 bp, Homo sapiens
atggggcctccc

SEQ ID NO: 4058097 - DNA, 21 bp, Homo sapiens
atggggctcagatggactggg

SEQ ID NO: 4058098 - DNA, 19 bp, Homo sapiens
atgggggaactcagatcca

SEQ ID NO: 4058099 - DNA, 17 bp, Homo sapiens
atgggtagggtaaatca

SEQ ID NO: 4058100 - DNA, 16 bp, Homo sapiens
atgggtatgctcaggt

SEQ ID NO: 4058101 - DNA, 13 bp, Homo sapiens
atgggtcctgcaa

SEQ ID NO: 4058102 - DNA, 19 bp, Homo sapiens
atgggtctgatattaatca

SEQ ID NO: 4058103 - DNA, 21 bp, Homo sapiens
atgggtgttgtatggggaggc

SEQ ID NO: 4058104 - DNA, 20 bp, Homo sapiens
atggtaatctttacctgtat

SEQ ID NO: 4058105 - DNA, 13 bp, Homo sapiens
atggtactattta

SEQ ID NO: 4058106 - DNA, 21 bp, Homo sapiens
atggtactgactttgcttgct

SEQ ID NO: 4058107 - DNA, 19 bp, Homo sapiens
atggtaggaagaagctctc

SEQ ID NO: 4058108 - DNA, 18 bp, Homo sapiens
atggtaggcatttcctat

SEQ ID NO: 4058109 - DNA, 14 bp, Homo sapiens
atggtatgagctga

SEQ ID NO: 4058110 - DNA, 22 bp, Homo sapiens
atggtatgctggccagcaccct

SEQ ID NO: 4058111 - DNA, 23 bp, Homo sapiens
atggtatgctggccagcaccctc

SEQ ID NO: 4058112 - DNA, 20 bp, Homo sapiens
atggtcaacacttaagggtt

SEQ ID NO: 4058113 - DNA, 14 bp, Homo sapiens
atggtcacacactg

SEQ ID NO: 4058114 - DNA, 16 bp, Homo sapiens
atggtcacacactgat

SEQ ID NO: 4058115 - DNA, 19 bp, Homo sapiens
atggtccatttgttcctgc

SEQ ID NO: 4058116 - DNA, 14 bp, Homo sapiens
atggtcgcccagga

SEQ ID NO: 4058117 - DNA, 16 bp, Homo sapiens
atggtcgcccaggaga

SEQ ID NO: 4058118 - DNA, 18 bp, Homo sapiens
atggtctcgatctcctga

SEQ ID NO: 4058119 - DNA, 15 bp, Homo sapiens
atggtgacagctgca

SEQ ID NO: 4058120 - DNA, 16 bp, Homo sapiens
atggtgacagctgcaa

SEQ ID NO: 4058121 - DNA, 18 bp, Homo sapiens
atggtgcagagaagctgg

SEQ ID NO: 4058122 - DNA, 17 bp, Homo sapiens
atggtgccccaggacca

SEQ ID NO: 4058123 - DNA, 16 bp, Homo sapiens
atggtgcctgagaggc

SEQ ID NO: 4058124 - DNA, 18 bp, Homo sapiens
atggtgcctgagaggcag

SEQ ID NO: 4058125 - DNA, 17 bp, Homo sapiens
atggtgctgcagatttg

SEQ ID NO: 4058126 - DNA, 16 bp, Homo sapiens
atggtggacccagcgg

SEQ ID NO: 4058127 - DNA, 17 bp, Homo sapiens
atggtggactaagcaat

SEQ ID NO: 4058128 - DNA, 18 bp, Homo sapiens
atggtgtaataagacata

SEQ ID NO: 4058129 - DNA, 18 bp, Homo sapiens
atggtgtacataatgtat

SEQ ID NO: 4058130 - DNA, 18 bp, Homo sapiens
atggtgtagaacactaat

SEQ ID NO: 4058131 - DNA, 22 bp, Homo sapiens
atggtgtagaacactaattcat

SEQ ID NO: 4058132 - DNA, 20 bp, Homo sapiens
atggtgttgccctgagtgga

SEQ ID NO: 4058133 - DNA, 18 bp, Homo sapiens
atggttacttcttctctt

SEQ ID NO: 4058134 - DNA, 16 bp, Homo sapiens
atggttatgaaagaat

SEQ ID NO: 4058135 - DNA, 19 bp, Homo sapiens
atggttatgaaagaatata

SEQ ID NO: 4058136 - DNA, 20 bp, Homo sapiens
atggttccatgcctgagggt

SEQ ID NO: 4058137 - DNA, 22 bp, Homo sapiens
atggttccatgcctgagggtgg

SEQ ID NO: 4058138 - DNA, 16 bp, Homo sapiens
atggttgagaaatgaa

SEQ ID NO: 4058139 - DNA, 14 bp, Homo sapiens
atggttgatggaaa

SEQ ID NO: 4058140 - DNA, 16 bp, Homo sapiens
atggttgatggaaaat

SEQ ID NO: 4058141 - DNA, 18 bp, Homo sapiens
atggttgatggaaaataa

SEQ ID NO: 4058142 - DNA, 13 bp, Homo sapiens
atggttggtttta

SEQ ID NO: 4058143 - DNA, 15 bp, Homo sapiens
atggtttctgaaaat

SEQ ID NO: 4058144 - DNA, 12 bp, Homo sapiens
atggtttggttt

SEQ ID NO: 4058145 - DNA, 14 bp, Homo sapiens
atggttttaaactt

SEQ ID NO: 4058146 - DNA, 15 bp, Homo sapiens
atggttttaaacttt

SEQ ID NO: 4058147 - DNA, 13 bp, Homo sapiens
atgtaaaatgatt

SEQ ID NO: 4058148 - DNA, 17 bp, Homo sapiens
atgtaaactatttgtgg

SEQ ID NO: 4058149 - DNA, 17 bp, Homo sapiens
atgtaaagaaatgtctt

SEQ ID NO: 4058150 - DNA, 17 bp, Homo sapiens
atgtaacacataaacaa

SEQ ID NO: 4058151 - DNA, 19 bp, Homo sapiens
atgtaacacataaacaatt

SEQ ID NO: 4058152 - DNA, 17 bp, Homo sapiens
atgtaactccagataga

SEQ ID NO: 4058153 - DNA, 20 bp, Homo sapiens
atgtaactccagatagagaa

SEQ ID NO: 4058154 - DNA, 19 bp, Homo sapiens
atgtaagaattcagaagac

SEQ ID NO: 4058155 - DNA, 20 bp, Homo sapiens
atgtaagagcaccttcctca

SEQ ID NO: 4058156 - DNA, 17 bp, Homo sapiens
atgtaataactgtgaag

SEQ ID NO: 4058157 - DNA, 21 bp, Homo sapiens
atgtaatactggaataatttg

SEQ ID NO: 4058158 - DNA, 16 bp, Homo sapiens
atgtaatcaatgtttc

SEQ ID NO: 4058159 - DNA, 18 bp, Homo sapiens
atgtaatgttaatgttat

SEQ ID NO: 4058160 - DNA, 23 bp, Homo sapiens
atgtaattaagtactatgtatca

SEQ ID NO: 4058161 - DNA, 15 bp, Homo sapiens
atgtaattgaataaa

SEQ ID NO: 4058162 - DNA, 14 bp, Homo sapiens
atgtaatttagaaa

SEQ ID NO: 4058163 - DNA, 15 bp, Homo sapiens
atgtaatttatgcaa

SEQ ID NO: 4058164 - DNA, 21 bp, Homo sapiens
atgtacatagttatttttctc

SEQ ID NO: 4058165 - DNA, 15 bp, Homo sapiens
atgtacatgagaagg

SEQ ID NO: 4058166 - DNA, 14 bp, Homo sapiens
atgtacattaatta

SEQ ID NO: 4058167 - DNA, 16 bp, Homo sapiens
atgtacatttgtcttt

SEQ ID NO: 4058168 - DNA, 15 bp, Homo sapiens
atgtaccatttgcat

SEQ ID NO: 4058169 - DNA, 18 bp, Homo sapiens
atgtacggattttcagtt

SEQ ID NO: 4058170 - DNA, 20 bp, Homo sapiens
atgtactcctctttacactg

SEQ ID NO: 4058171 - DNA, 18 bp, Homo sapiens
atgtactgagccttgtaa

SEQ ID NO: 4058172 - DNA, 16 bp, Homo sapiens
atgtactgtagttttt

SEQ ID NO: 4058173 - DNA, 19 bp, Homo sapiens
atgtactgtagtttttctt

SEQ ID NO: 4058174 - DNA, 17 bp, Homo sapiens
atgtagactgtgccaga

SEQ ID NO: 4058175 - DNA, 22 bp, Homo sapiens
atgtagatattgtgaagtacat

SEQ ID NO: 4058176 - DNA, 17 bp, Homo sapiens
atgtagcaaaacgcatg

SEQ ID NO: 4058177 - DNA, 18 bp, Homo sapiens
atgtagcattatgcaatt

SEQ ID NO: 4058178 - DNA, 21 bp, Homo sapiens
atgtagccccctggcctctgt

SEQ ID NO: 4058179 - DNA, 23 bp, Homo sapiens
atgtagccccctggcctctgtgc

SEQ ID NO: 4058180 - DNA, 16 bp, Homo sapiens
atgtagcgtgtttaca

SEQ ID NO: 4058181 - DNA, 21 bp, Homo sapiens
atgtagcgtgtttacatgtgt

SEQ ID NO: 4058182 - DNA, 15 bp, Homo sapiens
atgtagctggtttcc

SEQ ID NO: 4058183 - DNA, 18 bp, Homo sapiens
atgtagcttcttctgaaa

SEQ ID NO: 4058184 - DNA, 23 bp, Homo sapiens
atgtaggagctgccttggctcag

SEQ ID NO: 4058185 - DNA, 14 bp, Homo sapiens
atgtaggtaaattc

SEQ ID NO: 4058186 - DNA, 13 bp, Homo sapiens
atgtagtaattga

SEQ ID NO: 4058187 - DNA, 17 bp, Homo sapiens
atgtagtataaagaaaa

SEQ ID NO: 4058188 - DNA, 15 bp, Homo sapiens
atgtatataagtact

SEQ ID NO: 4058189 - DNA, 21 bp, Homo sapiens
atgtatatcattctacagaat

SEQ ID NO: 4058190 - DNA, 18 bp, Homo sapiens
atgtgaggaggaaaagga

SEQ ID NO: 4058191 - DNA, 18 bp, Homo sapiens
atgtgagtgccttttgca

SEQ ID NO: 4058192 - DNA, 21 bp, Homo sapiens
atgtgatacccatagcttcca

SEQ ID NO: 4058193 - DNA, 15 bp, Homo sapiens
atgtgatatataagt

SEQ ID NO: 4058194 - DNA, 16 bp, Homo sapiens
atgtgatatataagtg

SEQ ID NO: 4058195 - DNA, 19 bp, Homo sapiens
atgtgatatataagtgtac

SEQ ID NO: 4058196 - DNA, 21 bp, Homo sapiens
atgtgatatataagtgtacat

SEQ ID NO: 4058197 - DNA, 18 bp, Homo sapiens
atgtgatcacgcctggct

SEQ ID NO: 4058198 - DNA, 15 bp, Homo sapiens
atgtgattacaaggc

SEQ ID NO: 4058199 - DNA, 21 bp, Homo sapiens
atgtgattttcctttgtagct

SEQ ID NO: 4058200 - DNA, 14 bp, Homo sapiens
atgtgatttttctg

SEQ ID NO: 4058201 - DNA, 20 bp, Homo sapiens
atgtgcaagcgacgacagat

SEQ ID NO: 4058202 - DNA, 13 bp, Homo sapiens
atgtgcaattgtg

SEQ ID NO: 4058203 - DNA, 16 bp, Homo sapiens
atgtgcacccatgggc

SEQ ID NO: 4058204 - DNA, 19 bp, Homo sapiens
atgtgcacccggcctggat

SEQ ID NO: 4058205 - DNA, 22 bp, Homo sapiens
atgtgcactgtcactttgctct

SEQ ID NO: 4058206 - DNA, 17 bp, Homo sapiens
atgtgcaggtttgttac

SEQ ID NO: 4058207 - DNA, 23 bp, Homo sapiens
atgtgcagtgtagcccacacttg

SEQ ID NO: 4058208 - DNA, 16 bp, Homo sapiens
atgtgccaataaccaa

SEQ ID NO: 4058209 - DNA, 20 bp, Homo sapiens
atgtgccagggcaatgatga

SEQ ID NO: 4058210 - DNA, 22 bp, Homo sapiens
atgtgcctttctttgcctctgc

SEQ ID NO: 4058211 - DNA, 18 bp, Homo sapiens
atgtgctgggtgcctccc

SEQ ID NO: 4058212 - DNA, 18 bp, Homo sapiens
atgtggaccttagaatac

SEQ ID NO: 4058213 - DNA, 14 bp, Homo sapiens
atgtggccccaccc

SEQ ID NO: 4058214 - DNA, 15 bp, Homo sapiens
atgtgggcacggagg

SEQ ID NO: 4058215 - DNA, 18 bp, Homo sapiens
atgtgggcactggcccag

SEQ ID NO: 4058216 - DNA, 16 bp, Homo sapiens
atgtggggccaggtca

SEQ ID NO: 4058217 - DNA, 13 bp, Homo sapiens
atgtggtctcagg

SEQ ID NO: 4058218 - DNA, 13 bp, Homo sapiens
atgtggtgcctga

SEQ ID NO: 4058219 - DNA, 22 bp, Homo sapiens
atgtggtggcacaggccccctt

SEQ ID NO: 4058220 - DNA, 19 bp, Homo sapiens
atgtgtatgcacagtaaaa

SEQ ID NO: 4058221 - DNA, 20 bp, Homo sapiens
atgtgtatgcacagtaaaaa

SEQ ID NO: 4058222 - DNA, 14 bp, Homo sapiens
atgtgtatttatac

SEQ ID NO: 4058223 - DNA, 14 bp, Homo sapiens
atgtgtcacttgtg

SEQ ID NO: 4058224 - DNA, 15 bp, Homo sapiens
atgtgtcacttgtgc

SEQ ID NO: 4058225 - DNA, 17 bp, Homo sapiens
atgtgtcacttgtgctt

SEQ ID NO: 4058226 - DNA, 15 bp, Homo sapiens
atgtgtccatttcct

SEQ ID NO: 4058227 - DNA, 11 bp, Homo sapiens
atgtgtcccct

SEQ ID NO: 4058228 - DNA, 15 bp, Homo sapiens
atgtgtcccctcact

SEQ ID NO: 4058229 - DNA, 18 bp, Homo sapiens
atgtgtcccctcactctg

SEQ ID NO: 4058230 - DNA, 20 bp, Homo sapiens
atgtgtcccgaatccacagt

SEQ ID NO: 4058231 - DNA, 22 bp, Homo sapiens
atgtgtcctatctatcttccaa

SEQ ID NO: 4058232 - DNA, 18 bp, Homo sapiens
atgtgtcctcagggagca

SEQ ID NO: 4058233 - DNA, 21 bp, Homo sapiens
atgtgtctgtatttcatgtgg

SEQ ID NO: 4058234 - DNA, 19 bp, Homo sapiens
atgtgtctttatagatgta

SEQ ID NO: 4058235 - DNA, 15 bp, Homo sapiens
atgtgtgaggagctg

SEQ ID NO: 4058236 - DNA, 19 bp, Homo sapiens
atgtgtgaggagctgctgg

SEQ ID NO: 4058237 - DNA, 22 bp, Homo sapiens
atgtgtgaggagctgctggctt

SEQ ID NO: 4058238 - DNA, 17 bp, Homo sapiens
atgtgtggtggcctcag

SEQ ID NO: 4058239 - DNA, 21 bp, Homo sapiens
atgtgtgtgtatgtttgcaca

SEQ ID NO: 4058240 - DNA, 18 bp, Homo sapiens
atgtgtgtgtgtggcagg

SEQ ID NO: 4058241 - DNA, 14 bp, Homo sapiens
atgtgtgttttttc

SEQ ID NO: 4058242 - DNA, 14 bp, Homo sapiens
atgtgttgaaaaaa

SEQ ID NO: 4058243 - DNA, 13 bp, Homo sapiens
atgtgttgccact

SEQ ID NO: 4058244 - DNA, 19 bp, Homo sapiens
atgtgttgccactttccaa

SEQ ID NO: 4058245 - DNA, 15 bp, Homo sapiens
atgtgtttactttaa

SEQ ID NO: 4058246 - DNA, 14 bp, Homo sapiens
atgtgttttctgaa

SEQ ID NO: 4058247 - DNA, 13 bp, Homo sapiens
atgttaaatactg

SEQ ID NO: 4058248 - DNA, 21 bp, Homo sapiens
atgttaaatactgtgcagaat

SEQ ID NO: 4058249 - DNA, 14 bp, Homo sapiens
atgttaaatttgta

SEQ ID NO: 4058250 - DNA, 15 bp, Homo sapiens
atgttaaatttgtaa

SEQ ID NO: 4058251 - DNA, 20 bp, Homo sapiens
atgttaaatttgtaagtttc

SEQ ID NO: 4058252 - DNA, 22 bp, Homo sapiens
atgttaaatttgtaagtttcag

SEQ ID NO: 4058253 - DNA, 23 bp, Homo sapiens
atgttaaccagaataaagttctg

SEQ ID NO: 4058254 - DNA, 19 bp, Homo sapiens
atgttaaggaaactcttat

SEQ ID NO: 4058255 - DNA, 20 bp, Homo sapiens
atgttaatggatttcagaag

SEQ ID NO: 4058256 - DNA, 20 bp, Homo sapiens
atgttacatctgttttaaat

SEQ ID NO: 4058257 - DNA, 14 bp, Homo sapiens
atgttacattatta

SEQ ID NO: 4058258 - DNA, 21 bp, Homo sapiens
atgttaccatcttacttgagc

SEQ ID NO: 4058259 - DNA, 18 bp, Homo sapiens
atgttactcagtgttaga

SEQ ID NO: 4058260 - DNA, 23 bp, Homo sapiens
atgttactcagtgttagagaaat

SEQ ID NO: 4058261 - DNA, 13 bp, Homo sapiens
atgttactgatca

SEQ ID NO: 4058262 - DNA, 18 bp, Homo sapiens
atgttactgatcatgcat

SEQ ID NO: 4058263 - DNA, 21 bp, Homo sapiens
atgttactgatcatgcattgt

SEQ ID NO: 4058264 - DNA, 16 bp, Homo sapiens
atgttagggtgctctg

SEQ ID NO: 4058265 - DNA, 19 bp, Homo sapiens
atgttagtattttaatcct

SEQ ID NO: 4058266 - DNA, 11 bp, Homo sapiens
atgttagttct

SEQ ID NO: 4058267 - DNA, 16 bp, Homo sapiens
atgttatatcatatgt

SEQ ID NO: 4058268 - DNA, 18 bp, Homo sapiens
atgttatgactatgtaaa

SEQ ID NO: 4058269 - DNA, 18 bp, Homo sapiens
atgttatgatattgttta

SEQ ID NO: 4058270 - DNA, 18 bp, Homo sapiens
atgttattttctgttgaa

SEQ ID NO: 4058271 - DNA, 17 bp, Homo sapiens
atgttcaaagccacatt

SEQ ID NO: 4058272 - DNA, 19 bp, Homo sapiens
atgttcacgcaacttgaaa

SEQ ID NO: 4058273 - DNA, 15 bp, Homo sapiens
atgttcactgtgagt

SEQ ID NO: 4058274 - DNA, 21 bp, Homo sapiens
atgttcatcatcctaagctat

SEQ ID NO: 4058275 - DNA, 20 bp, Homo sapiens
atgttctatggttatgaaag

SEQ ID NO: 4058276 - DNA, 14 bp, Homo sapiens
atgttctattgtgg

SEQ ID NO: 4058277 - DNA, 20 bp, Homo sapiens
atgttctgacattaacagtt

SEQ ID NO: 4058278 - DNA, 21 bp, Homo sapiens
atgttctgtgcctgtaaacat

SEQ ID NO: 4058279 - DNA, 13 bp, Homo sapiens
atgttctgtttgc

SEQ ID NO: 4058280 - DNA, 18 bp, Homo sapiens
atgttcttatagaataaa

SEQ ID NO: 4058281 - DNA, 22 bp, Homo sapiens
atgttcttatagaataaaagct

SEQ ID NO: 4058282 - DNA, 20 bp, Homo sapiens
atgttcttatgcaaaatgga

SEQ ID NO: 4058283 - DNA, 13 bp, Homo sapiens
atgttcttccagt

SEQ ID NO: 4058284 - DNA, 16 bp, Homo sapiens
atgttgaaaagtaatt

SEQ ID NO: 4058285 - DNA, 18 bp, Homo sapiens
atgttgaaagatcaaaag

SEQ ID NO: 4058286 - DNA, 18 bp, Homo sapiens
atgttgaagaatacagtt

SEQ ID NO: 4058287 - DNA, 19 bp, Homo sapiens
atgttgaatactttttaca

SEQ ID NO: 4058288 - DNA, 22 bp, Homo sapiens
atgttgcccctttctcttttcc

SEQ ID NO: 4058289 - DNA, 17 bp, Homo sapiens
atgttgctataataaag

SEQ ID NO: 4058290 - DNA, 19 bp, Homo sapiens
atgttgctcagtctccctt

SEQ ID NO: 4058291 - DNA, 20 bp, Homo sapiens
atgttgctcagtctcccttt

SEQ ID NO: 4058292 - DNA, 15 bp, Homo sapiens
attacaggcttgagc

SEQ ID NO: 4058293 - DNA, 19 bp, Homo sapiens
attacattgctttttcttg

SEQ ID NO: 4058294 - DNA, 21 bp, Homo sapiens
attaccagtggcgttgttgca

SEQ ID NO: 4058295 - DNA, 19 bp, Homo sapiens
attacccacccgacctggc

SEQ ID NO: 4058296 - DNA, 21 bp, Homo sapiens
attacccacccgacctggctg

SEQ ID NO: 4058297 - DNA, 20 bp, Homo sapiens
attacctccatccatccttc

SEQ ID NO: 4058298 - DNA, 13 bp, Homo sapiens
attaccttactgt

SEQ ID NO: 4058299 - DNA, 17 bp, Homo sapiens
attactctcacccataa

SEQ ID NO: 4058300 - DNA, 13 bp, Homo sapiens
attactgggcctt

SEQ ID NO: 4058301 - DNA, 14 bp, Homo sapiens
attactgggcctta

SEQ ID NO: 4058302 - DNA, 23 bp, Homo sapiens
attactgggccttagtgggccag

SEQ ID NO: 4058303 - DNA, 13 bp, Homo sapiens
attactgtcaata

SEQ ID NO: 4058304 - DNA, 15 bp, Homo sapiens
attactgtcaataaa

SEQ ID NO: 4058305 - DNA, 20 bp, Homo sapiens
attactgttgcatttacttt

SEQ ID NO: 4058306 - DNA, 16 bp, Homo sapiens
attagaaaaaaattac

SEQ ID NO: 4058307 - DNA, 22 bp, Homo sapiens
attagaaaaaaattactaattt

SEQ ID NO: 4058308 - DNA, 17 bp, Homo sapiens
attagaaaaattcctaa

SEQ ID NO: 4058309 - DNA, 19 bp, Homo sapiens
attagaaaatgttatttaa

SEQ ID NO: 4058310 - DNA, 16 bp, Homo sapiens
attagaaatagacagt

SEQ ID NO: 4058311 - DNA, 15 bp, Homo sapiens
attagaagacaacag

SEQ ID NO: 4058312 - DNA, 22 bp, Homo sapiens
attagaatagtgttctgcaaaa

SEQ ID NO: 4058313 - DNA, 21 bp, Homo sapiens
attagaattagtgccagaatt

SEQ ID NO: 4058314 - DNA, 16 bp, Homo sapiens
attagatggcttattt

SEQ ID NO: 4058315 - DNA, 16 bp, Homo sapiens
attagcaaggctgggt

SEQ ID NO: 4058316 - DNA, 15 bp, Homo sapiens
attagccaggatcat

SEQ ID NO: 4058317 - DNA, 15 bp, Homo sapiens
attagccaggtaatg

SEQ ID NO: 4058318 - DNA, 18 bp, Homo sapiens
attagccgggcatggtgg

SEQ ID NO: 4058319 - DNA, 16 bp, Homo sapiens
attagctgtgtgaaat

SEQ ID NO: 4058320 - DNA, 21 bp, Homo sapiens
attagctttgtgtttggttta

SEQ ID NO: 4058321 - DNA, 23 bp, Homo sapiens
attaggaatgggataagaaggtg

SEQ ID NO: 4058322 - DNA, 16 bp, Homo sapiens
attaggcatggttttg

SEQ ID NO: 4058323 - DNA, 18 bp, Homo sapiens
attagggagaaaattcaa

SEQ ID NO: 4058324 - DNA, 20 bp, Homo sapiens
attagggagaaaattcaatt

SEQ ID NO: 4058325 - DNA, 22 bp, Homo sapiens
attaggggttgctaagaagcga

SEQ ID NO: 4058326 - DNA, 13 bp, Homo sapiens
attaggtattttg

SEQ ID NO: 4058327 - DNA, 16 bp, Homo sapiens
attagtaaatgcttat

SEQ ID NO: 4058328 - DNA, 16 bp, Homo sapiens
attagtaaatgtcttt

SEQ ID NO: 4058329 - DNA, 23 bp, Homo sapiens
attagtaaatgtctttgtaagtc

SEQ ID NO: 4058330 - DNA, 23 bp, Homo sapiens
attagtatttatttaatgttatg

SEQ ID NO: 4058331 - DNA, 15 bp, Homo sapiens
attagtctgaaactg

SEQ ID NO: 4058332 - DNA, 22 bp, Homo sapiens
attagtgccagaattttaggaa

SEQ ID NO: 4058333 - DNA, 13 bp, Homo sapiens
attagtggatttt

SEQ ID NO: 4058334 - DNA, 23 bp, Homo sapiens
attataaaaagccactagactct

SEQ ID NO: 4058335 - DNA, 17 bp, Homo sapiens
attataaactcattttg

SEQ ID NO: 4058336 - DNA, 15 bp, Homo sapiens
attataaatgaaatt

SEQ ID NO: 4058337 - DNA, 13 bp, Homo sapiens
attataaatgtta

SEQ ID NO: 4058338 - DNA, 15 bp, Homo sapiens
attataaatgttagt

SEQ ID NO: 4058339 - DNA, 19 bp, Homo sapiens
attataaatgttagttcta

SEQ ID NO: 4058340 - DNA, 20 bp, Homo sapiens
attataaatgttagttctag

SEQ ID NO: 4058341 - DNA, 15 bp, Homo sapiens
attataacttaaaaa

SEQ ID NO: 4058342 - DNA, 17 bp, Homo sapiens
attataagcattgaaat

SEQ ID NO: 4058343 - DNA, 18 bp, Homo sapiens
attataatcaccagggcc

SEQ ID NO: 4058344 - DNA, 19 bp, Homo sapiens
attataatcctcaagagaa

SEQ ID NO: 4058345 - DNA, 20 bp, Homo sapiens
attatagacaacgatgaatt

SEQ ID NO: 4058346 - DNA, 21 bp, Homo sapiens
attataggtaatcaatgaata

SEQ ID NO: 4058347 - DNA, 15 bp, Homo sapiens
attatagtttcaagc

SEQ ID NO: 4058348 - DNA, 23 bp, Homo sapiens
attatatcattggaacaactgat

SEQ ID NO: 4058349 - DNA, 16 bp, Homo sapiens
attatatctaattatt

SEQ ID NO: 4058350 - DNA, 18 bp, Homo sapiens
attatatctgtggtcttc

SEQ ID NO: 4058351 - DNA, 22 bp, Homo sapiens
attatatgtggactaaatatct

SEQ ID NO: 4058352 - DNA, 18 bp, Homo sapiens
attatatgttcagattat

SEQ ID NO: 4058353 - DNA, 15 bp, Homo sapiens
attatcataagaatt

SEQ ID NO: 4058354 - DNA, 17 bp, Homo sapiens
attatccatattgagtc

SEQ ID NO: 4058355 - DNA, 19 bp, Homo sapiens
attatcgggaacagtgttt

SEQ ID NO: 4058356 - DNA, 17 bp, Homo sapiens
attatcgggagcagtgt

SEQ ID NO: 4058357 - DNA, 19 bp, Homo sapiens
attatcgggagcagtgtct

SEQ ID NO: 4058358 - DNA, 17 bp, Homo sapiens
attatctaaagtgtgtt

SEQ ID NO: 4058359 - DNA, 23 bp, Homo sapiens
attatctaaagtgtgttgttgct

SEQ ID NO: 4058360 - DNA, 19 bp, Homo sapiens
attatctatacatatcttt

SEQ ID NO: 4058361 - DNA, 22 bp, Homo sapiens
attatcttgggatagttcccaa

SEQ ID NO: 4058362 - DNA, 14 bp, Homo sapiens
attatgaaatttca

SEQ ID NO: 4058363 - DNA, 16 bp, Homo sapiens
attatgaaatttcact

SEQ ID NO: 4058364 - DNA, 13 bp, Homo sapiens
attatgaagaatt

SEQ ID NO: 4058365 - DNA, 14 bp, Homo sapiens
attatgacagttat

SEQ ID NO: 4058366 - DNA, 17 bp, Homo sapiens
attatggaagattttaa

SEQ ID NO: 4058367 - DNA, 20 bp, Homo sapiens
attatggaagattttaaatt

SEQ ID NO: 4058368 - DNA, 15 bp, Homo sapiens
attatgggtcctgca

SEQ ID NO: 4058369 - DNA, 19 bp, Homo sapiens
attatgtgacattttacat

SEQ ID NO: 4058370 - DNA, 16 bp, Homo sapiens
attatgttttttaaaa

SEQ ID NO: 4058371 - DNA, 20 bp, Homo sapiens
attattaaagtctaaacaaa

SEQ ID NO: 4058372 - DNA, 14 bp, Homo sapiens
attattaactacat

SEQ ID NO: 4058373 - DNA, 12 bp, Homo sapiens
attattagaaat

SEQ ID NO: 4058374 - DNA, 15 bp, Homo sapiens
attattataaaaggg

SEQ ID NO: 4058375 - DNA, 16 bp, Homo sapiens
attattatcgctttat

SEQ ID NO: 4058376 - DNA, 14 bp, Homo sapiens
attattatctttaa

SEQ ID NO: 4058377 - DNA, 17 bp, Homo sapiens
attattattaaaaatat

SEQ ID NO: 4058378 - DNA, 15 bp, Homo sapiens
attattatttgtgtt

SEQ ID NO: 4058379 - DNA, 14 bp, Homo sapiens
attattcatttaaa

SEQ ID NO: 4058380 - DNA, 21 bp, Homo sapiens
attattcatttaaaatgatta

SEQ ID NO: 4058381 - DNA, 15 bp, Homo sapiens
attattcatttagtg

SEQ ID NO: 4058382 - DNA, 18 bp, Homo sapiens
attattctcttttatctg

SEQ ID NO: 4058383 - DNA, 12 bp, Homo sapiens
attattgacact

SEQ ID NO: 4058384 - DNA, 18 bp, Homo sapiens
attattgacactgaactt

SEQ ID NO: 4058385 - DNA, 14 bp, Homo sapiens
attattggaattaa

SEQ ID NO: 4058386 - DNA, 13 bp, Homo sapiens
attattgtaagtt

SEQ ID NO: 4058387 - DNA, 20 bp, Homo sapiens
attattgtaagttgtacaaa

SEQ ID NO: 4058388 - DNA, 22 bp, Homo sapiens
attattgtaagttgtacaaatg

SEQ ID NO: 4058389 - DNA, 20 bp, Homo sapiens
attatttaaataaaatcacc

SEQ ID NO: 4058390 - DNA, 14 bp, Homo sapiens
attatttaataaca

SEQ ID NO: 4058391 - DNA, 15 bp, Homo sapiens
attatttaataacat

SEQ ID NO: 4058392 - DNA, 20 bp, Homo sapiens
attatttatttctggtaact

SEQ ID NO: 4058393 - DNA, 22 bp, Homo sapiens
attatttgtgttttaatttaaa

SEQ ID NO: 4058394 - DNA, 22 bp, Homo sapiens
attcgtgagctggggactcagg

SEQ ID NO: 4058395 - DNA, 20 bp, Homo sapiens
attcgtgcatttttggatca

SEQ ID NO: 4058396 - DNA, 17 bp, Homo sapiens
attcgtggcatgttttg

SEQ ID NO: 4058397 - DNA, 23 bp, Homo sapiens
attctaaagagcacttactgtaa

SEQ ID NO: 4058398 - DNA, 15 bp, Homo sapiens
attctaaatgaatgt

SEQ ID NO: 4058399 - DNA, 18 bp, Homo sapiens
attctaagccagttttca

SEQ ID NO: 4058400 - DNA, 20 bp, Homo sapiens
attctaagccagttttcatt

SEQ ID NO: 4058401 - DNA, 22 bp, Homo sapiens
attctaagccagttttcatttt

SEQ ID NO: 4058402 - DNA, 21 bp, Homo sapiens
attctaagttatttactttta

SEQ ID NO: 4058403 - DNA, 20 bp, Homo sapiens
attctacagaataatccagt

SEQ ID NO: 4058404 - DNA, 17 bp, Homo sapiens
attctactttaagcact

SEQ ID NO: 4058405 - DNA, 13 bp, Homo sapiens
attctactttgag

SEQ ID NO: 4058406 - DNA, 16 bp, Homo sapiens
attctactttgagtgc

SEQ ID NO: 4058407 - DNA, 18 bp, Homo sapiens
attctagctaatgtaata

SEQ ID NO: 4058408 - DNA, 17 bp, Homo sapiens
attctaggacctgtgtc

SEQ ID NO: 4058409 - DNA, 17 bp, Homo sapiens
attctagttcagagcca

SEQ ID NO: 4058410 - DNA, 17 bp, Homo sapiens
attctagttttgtcaaa

SEQ ID NO: 4058411 - DNA, 13 bp, Homo sapiens
attctatatgaat

SEQ ID NO: 4058412 - DNA, 17 bp, Homo sapiens
attctatatgaatttaa

SEQ ID NO: 4058413 - DNA, 23 bp, Homo sapiens
attctatatgaatttaaatataa

SEQ ID NO: 4058414 - DNA, 19 bp, Homo sapiens
attctatccccaatcagct

SEQ ID NO: 4058415 - DNA, 21 bp, Homo sapiens
attctatccccaatcagctcc

SEQ ID NO: 4058416 - DNA, 22 bp, Homo sapiens
attctatccccaatcagctcct

SEQ ID NO: 4058417 - DNA, 15 bp, Homo sapiens
attctatcgttatta

SEQ ID NO: 4058418 - DNA, 14 bp, Homo sapiens
attctatgttaaat

SEQ ID NO: 4058419 - DNA, 14 bp, Homo sapiens
attctattaacttt

SEQ ID NO: 4058420 - DNA, 18 bp, Homo sapiens
attctattacattttcag

SEQ ID NO: 4058421 - DNA, 20 bp, Homo sapiens
attctattgccttctttgaa

SEQ ID NO: 4058422 - DNA, 18 bp, Homo sapiens
attctattgtattatttg

SEQ ID NO: 4058423 - DNA, 22 bp, Homo sapiens
attctatttatatgtacatgag

SEQ ID NO: 4058424 - DNA, 16 bp, Homo sapiens
attctattttagaata

SEQ ID NO: 4058425 - DNA, 14 bp, Homo sapiens
attctcaaagcagg

SEQ ID NO: 4058426 - DNA, 19 bp, Homo sapiens
attctcaaagtttcctaat

SEQ ID NO: 4058427 - DNA, 15 bp, Homo sapiens
attctcaccagctgt

SEQ ID NO: 4058428 - DNA, 18 bp, Homo sapiens
attctcaccagctgtgtc

SEQ ID NO: 4058429 - DNA, 18 bp, Homo sapiens
attctcagaatctcaaat

SEQ ID NO: 4058430 - DNA, 20 bp, Homo sapiens
attctcagaatctcaaataa

SEQ ID NO: 4058431 - DNA, 17 bp, Homo sapiens
attctcagagcatgtgt

SEQ ID NO: 4058432 - DNA, 16 bp, Homo sapiens
attctcataattccta

SEQ ID NO: 4058433 - DNA, 18 bp, Homo sapiens
attctcattgcagaataa

SEQ ID NO: 4058434 - DNA, 16 bp, Homo sapiens
attctccacagcaacc

SEQ ID NO: 4058435 - DNA, 22 bp, Homo sapiens
attctcccaggtaccagctgcg

SEQ ID NO: 4058436 - DNA, 15 bp, Homo sapiens
attctcctgcctcag

SEQ ID NO: 4058437 - DNA, 14 bp, Homo sapiens
attctcctgtgcta

SEQ ID NO: 4058438 - DNA, 13 bp, Homo sapiens
attctctgcaatt

SEQ ID NO: 4058439 - DNA, 16 bp, Homo sapiens
attctctgcaatttgt

SEQ ID NO: 4058440 - DNA, 23 bp, Homo sapiens
attctctgcaatttgtttaaaga

SEQ ID NO: 4058441 - DNA, 15 bp, Homo sapiens
attctcttatccaac

SEQ ID NO: 4058442 - DNA, 16 bp, Homo sapiens
attctcttttatctgt

SEQ ID NO: 4058443 - DNA, 13 bp, Homo sapiens
attctgaatgtac

SEQ ID NO: 4058444 - DNA, 15 bp, Homo sapiens
attctgaggccctgc

SEQ ID NO: 4058445 - DNA, 20 bp, Homo sapiens
attctgattcttctaaatta

SEQ ID NO: 4058446 - DNA, 13 bp, Homo sapiens
attctgcagcatg

SEQ ID NO: 4058447 - DNA, 22 bp, Homo sapiens
attctgcagcatgacctgtgac

SEQ ID NO: 4058448 - DNA, 17 bp, Homo sapiens
attctgccctccttaat

SEQ ID NO: 4058449 - DNA, 14 bp, Homo sapiens
attctgcctctctg

SEQ ID NO: 4058450 - DNA, 19 bp, Homo sapiens
attctgggaggcaagaaaa

SEQ ID NO: 4058451 - DNA, 21 bp, Homo sapiens
attctgggctcctggaaccaa

SEQ ID NO: 4058452 - DNA, 23 bp, Homo sapiens
attctgtgtatcttttttataac

SEQ ID NO: 4058453 - DNA, 23 bp, Homo sapiens
attctgtgtgttttcataataaa

SEQ ID NO: 4058454 - DNA, 14 bp, Homo sapiens
attctgtgttgcat

SEQ ID NO: 4058455 - DNA, 20 bp, Homo sapiens
attctgtttattcttccaga

SEQ ID NO: 4058456 - DNA, 12 bp, Homo sapiens
attctgttttgc

SEQ ID NO: 4058457 - DNA, 13 bp, Homo sapiens
attctgttttgca

SEQ ID NO: 4058458 - DNA, 20 bp, Homo sapiens
attcttaaaattcaagaaaa

SEQ ID NO: 4058459 - DNA, 15 bp, Homo sapiens
attcttatacacatt

SEQ ID NO: 4058460 - DNA, 14 bp, Homo sapiens
attcttattaattc

SEQ ID NO: 4058461 - DNA, 17 bp, Homo sapiens
attcttcacctgttatg

SEQ ID NO: 4058462 - DNA, 21 bp, Homo sapiens
attcttccaagctgagagtct

SEQ ID NO: 4058463 - DNA, 22 bp, Homo sapiens
attcttccaagctgagagtcta

SEQ ID NO: 4058464 - DNA, 15 bp, Homo sapiens
attcttccagaatgc

SEQ ID NO: 4058465 - DNA, 16 bp, Homo sapiens
attcttctctgttgtc

SEQ ID NO: 4058466 - DNA, 14 bp, Homo sapiens
attcttctgtattt

SEQ ID NO: 4058467 - DNA, 16 bp, Homo sapiens
attcttctgtatttct

SEQ ID NO: 4058468 - DNA, 18 bp, Homo sapiens
attcttctgtatttctag

SEQ ID NO: 4058469 - DNA, 13 bp, Homo sapiens
attcttctgtcct

SEQ ID NO: 4058470 - DNA, 15 bp, Homo sapiens
attcttctgtcctga

SEQ ID NO: 4058471 - DNA, 16 bp, Homo sapiens
attcttgaaagctgtg

SEQ ID NO: 4058472 - DNA, 21 bp, Homo sapiens
attcttggaccatgccagatt

SEQ ID NO: 4058473 - DNA, 12 bp, Homo sapiens
attcttgtgctt

SEQ ID NO: 4058474 - DNA, 18 bp, Homo sapiens
attcttgtgcttttcctg

SEQ ID NO: 4058475 - DNA, 17 bp, Homo sapiens
attctttatcttgacat

SEQ ID NO: 4058476 - DNA, 21 bp, Homo sapiens
attctttccattatgattctt

SEQ ID NO: 4058477 - DNA, 22 bp, Homo sapiens
attctttccattatgattcttt

SEQ ID NO: 4058478 - DNA, 17 bp, Homo sapiens
attctttggttgtgaat

SEQ ID NO: 4058479 - DNA, 14 bp, Homo sapiens
attcttttgtttcc

SEQ ID NO: 4058480 - DNA, 17 bp, Homo sapiens
attgaaaaactctttat

SEQ ID NO: 4058481 - DNA, 15 bp, Homo sapiens
attgaaaatcttgtg

SEQ ID NO: 4058482 - DNA, 20 bp, Homo sapiens
attgaaactagttattttat

SEQ ID NO: 4058483 - DNA, 18 bp, Homo sapiens
attgaacacaaactgtaa

SEQ ID NO: 4058484 - DNA, 15 bp, Homo sapiens
attgaaccagctcat

SEQ ID NO: 4058485 - DNA, 18 bp, Homo sapiens
attgaaccagctcatctc

SEQ ID NO: 4058486 - DNA, 14 bp, Homo sapiens
attgaacttttgta

SEQ ID NO: 4058487 - DNA, 17 bp, Homo sapiens
attgaacttttgtactg

SEQ ID NO: 4058488 - DNA, 18 bp, Homo sapiens
attgaacttttgtactga

SEQ ID NO: 4058489 - DNA, 19 bp, Homo sapiens
attgaacttttgtactgaa

SEQ ID NO: 4058490 - DNA, 13 bp, Homo sapiens
attgaagacaatt

SEQ ID NO: 4058491 - DNA, 19 bp, Homo sapiens
attgaagagagatatatct

SEQ ID NO: 4058492 - DNA, 18 bp, Homo sapiens
attgaagccgactctggc

SEQ ID NO: 4058493 - DNA, 20 bp, Homo sapiens
attgaaggaagccaaattta

SEQ ID NO: 4058494 - DNA, 21 bp, Homo sapiens
attgaaggaagccaaatttat

SEQ ID NO: 4058495 - DNA, 16 bp, Homo sapiens
attgaagtaatgaatt

SEQ ID NO: 4058496 - DNA, 20 bp, Homo sapiens
attggcacctaatccaggca

SEQ ID NO: 4058497 - DNA, 21 bp, Homo sapiens
attggccacctgtagccatct

SEQ ID NO: 4058498 - DNA, 17 bp, Homo sapiens
attgggcacagtccaga

SEQ ID NO: 4058499 - DNA, 18 bp, Homo sapiens
attgggtgggtaaattca

SEQ ID NO: 4058500 - DNA, 21 bp, Homo sapiens
attggtaaaactcactgtgat

SEQ ID NO: 4058501 - DNA, 17 bp, Homo sapiens
attggtggttctcagca

SEQ ID NO: 4058502 - DNA, 14 bp, Homo sapiens
attggtttctcttc

SEQ ID NO: 4058503 - DNA, 16 bp, Homo sapiens
attggtttctcttctc

SEQ ID NO: 4058504 - DNA, 18 bp, Homo sapiens
attgtaacctgcattttt

SEQ ID NO: 4058505 - DNA, 19 bp, Homo sapiens
attgtaagttgtacaaatg

SEQ ID NO: 4058506 - DNA, 16 bp, Homo sapiens
attgtaatctgaataa

SEQ ID NO: 4058507 - DNA, 13 bp, Homo sapiens
attgtaatctttc

SEQ ID NO: 4058508 - DNA, 13 bp, Homo sapiens
attgtaatgttac

SEQ ID NO: 4058509 - DNA, 23 bp, Homo sapiens
attgtacatttatttattactgt

SEQ ID NO: 4058510 - DNA, 18 bp, Homo sapiens
attgtagggctttagctt

SEQ ID NO: 4058511 - DNA, 15 bp, Homo sapiens
attgtaggtgcaagc

SEQ ID NO: 4058512 - DNA, 14 bp, Homo sapiens
attgtagttaatga

SEQ ID NO: 4058513 - DNA, 20 bp, Homo sapiens
attgtataagcatgctttct

SEQ ID NO: 4058514 - DNA, 17 bp, Homo sapiens
attgtatattgtgtttg

SEQ ID NO: 4058515 - DNA, 19 bp, Homo sapiens
attgtatctagtgcagctg

SEQ ID NO: 4058516 - DNA, 16 bp, Homo sapiens
attgtattgctgctgt

SEQ ID NO: 4058517 - DNA, 16 bp, Homo sapiens
attgtcacctctgtta

SEQ ID NO: 4058518 - DNA, 23 bp, Homo sapiens
attgtcacctctgttaaggttga

SEQ ID NO: 4058519 - DNA, 19 bp, Homo sapiens
attgtcacctgcttctctg

SEQ ID NO: 4058520 - DNA, 15 bp, Homo sapiens
attgtcattaaaggt

SEQ ID NO: 4058521 - DNA, 13 bp, Homo sapiens
attgtccagagct

SEQ ID NO: 4058522 - DNA, 23 bp, Homo sapiens
attgtccagagctgcttccccgt

SEQ ID NO: 4058523 - DNA, 17 bp, Homo sapiens
attgtctaaaatgtcag

SEQ ID NO: 4058524 - DNA, 13 bp, Homo sapiens
attgtctatttat

SEQ ID NO: 4058525 - DNA, 14 bp, Homo sapiens
attgtctcaacgcc

SEQ ID NO: 4058526 - DNA, 15 bp, Homo sapiens
attgtctcccttcca

SEQ ID NO: 4058527 - DNA, 16 bp, Homo sapiens
attgtctgaacttgca

SEQ ID NO: 4058528 - DNA, 17 bp, Homo sapiens
attgtcttgcaacttca

SEQ ID NO: 4058529 - DNA, 14 bp, Homo sapiens
attgtgaagtacat

SEQ ID NO: 4058530 - DNA, 16 bp, Homo sapiens
attgtgagccaccacg

SEQ ID NO: 4058531 - DNA, 15 bp, Homo sapiens
attgtgattggcctg

SEQ ID NO: 4058532 - DNA, 18 bp, Homo sapiens
attgtggtgtgagcttca

SEQ ID NO: 4058533 - DNA, 17 bp, Homo sapiens
attgtgtaaaaaatgga

SEQ ID NO: 4058534 - DNA, 19 bp, Homo sapiens
attgtgtattatgttgttc

SEQ ID NO: 4058535 - DNA, 17 bp, Homo sapiens
attgtgttgtcttcagc

SEQ ID NO: 4058536 - DNA, 17 bp, Homo sapiens
attgtgttgtgaatgtt

SEQ ID NO: 4058537 - DNA, 13 bp, Homo sapiens
attgtgtttgtgt

SEQ ID NO: 4058538 - DNA, 20 bp, Homo sapiens
attgttacattatgtggaaa

SEQ ID NO: 4058539 - DNA, 16 bp, Homo sapiens
attgttagaaaatgac

SEQ ID NO: 4058540 - DNA, 20 bp, Homo sapiens
attgttagaaaatgacttat

SEQ ID NO: 4058541 - DNA, 21 bp, Homo sapiens
attgttagaaaatgacttatt

SEQ ID NO: 4058542 - DNA, 18 bp, Homo sapiens
attgttagcttccttaag

SEQ ID NO: 4058543 - DNA, 12 bp, Homo sapiens
attgttagttta

SEQ ID NO: 4058544 - DNA, 20 bp, Homo sapiens
attgttccaagacattgtca

SEQ ID NO: 4058545 - DNA, 22 bp, Homo sapiens
attgttccaagacattgtcaat

SEQ ID NO: 4058546 - DNA, 24 bp, Homo sapiens
attgttccagcagttttcaagtca

SEQ ID NO: 4058547 - DNA, 16 bp, Homo sapiens
attgttcccagtgaca

SEQ ID NO: 4058548 - DNA, 21 bp, Homo sapiens
attgttcccagtgacacttca

SEQ ID NO: 4058549 - DNA, 18 bp, Homo sapiens
attgttcttattctggca

SEQ ID NO: 4058550 - DNA, 18 bp, Homo sapiens
attgttgaacatacttca

SEQ ID NO: 4058551 - DNA, 17 bp, Homo sapiens
attgttgaatctatttc

SEQ ID NO: 4058552 - DNA, 18 bp, Homo sapiens
attgttgacaactgtgac

SEQ ID NO: 4058553 - DNA, 20 bp, Homo sapiens
attgttgacaactgtgactg

SEQ ID NO: 4058554 - DNA, 21 bp, Homo sapiens
attgttgaggtggtctgaatg

SEQ ID NO: 4058555 - DNA, 22 bp, Homo sapiens
attgttgaggtggtctgaatgt

SEQ ID NO: 4058556 - DNA, 21 bp, Homo sapiens
attgttgatgggcacttgaga

SEQ ID NO: 4058557 - DNA, 18 bp, Homo sapiens
attgttggcgctgaggtg

SEQ ID NO: 4058558 - DNA, 16 bp, Homo sapiens
attgttggctatttga

SEQ ID NO: 4058559 - DNA, 15 bp, Homo sapiens
attgttgtataattt

SEQ ID NO: 4058560 - DNA, 14 bp, Homo sapiens
attgtttaaaattc

SEQ ID NO: 4058561 - DNA, 18 bp, Homo sapiens
attgtttaaaattcagtt

SEQ ID NO: 4058562 - DNA, 20 bp, Homo sapiens
attgtttacgtttgatacaa

SEQ ID NO: 4058563 - DNA, 13 bp, Homo sapiens
attgtttatgtaa

SEQ ID NO: 4058564 - DNA, 18 bp, Homo sapiens
attgtttatttatcagtg

SEQ ID NO: 4058565 - DNA, 21 bp, Homo sapiens
attgtttatttatcagtgaca

SEQ ID NO: 4058566 - DNA, 20 bp, Homo sapiens
attgtttcctcttccaaagt

SEQ ID NO: 4058567 - DNA, 17 bp, Homo sapiens
attgtttctgcattcat

SEQ ID NO: 4058568 - DNA, 16 bp, Homo sapiens
attgtttgcttattgt

SEQ ID NO: 4058569 - DNA, 22 bp, Homo sapiens
attgtttgcttattgttccaag

SEQ ID NO: 4058570 - DNA, 18 bp, Homo sapiens
attgttttaatctgaaat

SEQ ID NO: 4058571 - DNA, 17 bp, Homo sapiens
attgttttcagtgtaca

SEQ ID NO: 4058572 - DNA, 18 bp, Homo sapiens
attgttttctatttatgc

SEQ ID NO: 4058573 - DNA, 12 bp, Homo sapiens
attgttttctgt

SEQ ID NO: 4058574 - DNA, 17 bp, Homo sapiens
attgttttctgtaaata

SEQ ID NO: 4058575 - DNA, 15 bp, Homo sapiens
attgtttttgtattt

SEQ ID NO: 4058576 - DNA, 20 bp, Homo sapiens
atttaaaaacaaaaggcaat

SEQ ID NO: 4058577 - DNA, 23 bp, Homo sapiens
atttaaaaagtgagaaagaaagt

SEQ ID NO: 4058578 - DNA, 13 bp, Homo sapiens
atttaaaaatatt

SEQ ID NO: 4058579 - DNA, 14 bp, Homo sapiens
atttaaaaatattt

SEQ ID NO: 4058580 - DNA, 19 bp, Homo sapiens
atttaaaaatatttcagat

SEQ ID NO: 4058581 - DNA, 18 bp, Homo sapiens
atttaaaaatatttttgg

SEQ ID NO: 4058582 - DNA, 13 bp, Homo sapiens
atttaaaatgatt

SEQ ID NO: 4058583 - DNA, 14 bp, Homo sapiens
atttaaaatgatta

SEQ ID NO: 4058584 - DNA, 16 bp, Homo sapiens
atttaaaatgattaga

SEQ ID NO: 4058585 - DNA, 15 bp, Homo sapiens
atttaaaattccatt

SEQ ID NO: 4058586 - DNA, 16 bp, Homo sapiens
atttaaaattccatta

SEQ ID NO: 4058587 - DNA, 19 bp, Homo sapiens
atttaaaattccattatct

SEQ ID NO: 4058588 - DNA, 21 bp, Homo sapiens
atttaaaattccattatctta

SEQ ID NO: 4058589 - DNA, 22 bp, Homo sapiens
atttaaaattccattatcttat

SEQ ID NO: 4058590 - DNA, 17 bp, Homo sapiens
atttaaaattgctatgt

SEQ ID NO: 4058591 - DNA, 19 bp, Homo sapiens
atttaaacatttgttcctg

SEQ ID NO: 4058592 - DNA, 11 bp, Homo sapiens
atttaaacctt

SEQ ID NO: 4058593 - DNA, 12 bp, Homo sapiens
atttaaagcatt

SEQ ID NO: 4058594 - DNA, 16 bp, Homo sapiens
atttaaagcattgctt

SEQ ID NO: 4058595 - DNA, 22 bp, Homo sapiens
atttaaaggcttaggcatgttc

SEQ ID NO: 4058596 - DNA, 20 bp, Homo sapiens
atttaaagggtgtacttata

SEQ ID NO: 4058597 - DNA, 18 bp, Homo sapiens
atttaaatataattctgt

SEQ ID NO: 4058598 - DNA, 22 bp, Homo sapiens
atttatgtttgcacttgtgatt

SEQ ID NO: 4058599 - DNA, 17 bp, Homo sapiens
atttattaaataaaatc

SEQ ID NO: 4058600 - DNA, 15 bp, Homo sapiens
atttattaagatgga

SEQ ID NO: 4058601 - DNA, 23 bp, Homo sapiens
atttattaatatttaacattatt

SEQ ID NO: 4058602 - DNA, 14 bp, Homo sapiens
atttattattttca

SEQ ID NO: 4058603 - DNA, 22 bp, Homo sapiens
atttattgcagaggatgttcat

SEQ ID NO: 4058604 - DNA, 17 bp, Homo sapiens
atttattgtttatgtaa

SEQ ID NO: 4058605 - DNA, 19 bp, Homo sapiens
atttattgtttatgtaaat

SEQ ID NO: 4058606 - DNA, 15 bp, Homo sapiens
atttatttaaagcat

SEQ ID NO: 4058607 - DNA, 12 bp, Homo sapiens
atttatttaaat

SEQ ID NO: 4058608 - DNA, 13 bp, Homo sapiens
atttatttaattt

SEQ ID NO: 4058609 - DNA, 24 bp, Homo sapiens
atttatttactgagcttctctgtg

SEQ ID NO: 4058610 - DNA, 17 bp, Homo sapiens
atttatttattaagatg

SEQ ID NO: 4058611 - DNA, 15 bp, Homo sapiens
atttatttattactg

SEQ ID NO: 4058612 - DNA, 14 bp, Homo sapiens
atttatttatttaa

SEQ ID NO: 4058613 - DNA, 22 bp, Homo sapiens
atttatttccactaaaaatatt

SEQ ID NO: 4058614 - DNA, 17 bp, Homo sapiens
atttatttcctccctct

SEQ ID NO: 4058615 - DNA, 22 bp, Homo sapiens
atttatttctagttctttcctc

SEQ ID NO: 4058616 - DNA, 14 bp, Homo sapiens
atttattttgtaat

SEQ ID NO: 4058617 - DNA, 16 bp, Homo sapiens
atttattttgtaatta

SEQ ID NO: 4058618 - DNA, 14 bp, Homo sapiens
atttattttttaca

SEQ ID NO: 4058619 - DNA, 15 bp, Homo sapiens
atttcaaaaatataa

SEQ ID NO: 4058620 - DNA, 17 bp, Homo sapiens
atttcaaaaatataact

SEQ ID NO: 4058621 - DNA, 19 bp, Homo sapiens
atttcaaaaatataactta

SEQ ID NO: 4058622 - DNA, 13 bp, Homo sapiens
atttcaaaatata

SEQ ID NO: 4058623 - DNA, 21 bp, Homo sapiens
atttcaaaatgctttttatta

SEQ ID NO: 4058624 - DNA, 23 bp, Homo sapiens
atttcaaacagtctcccttccta

SEQ ID NO: 4058625 - DNA, 19 bp, Homo sapiens
atttcaaaccattgctctt

SEQ ID NO: 4058626 - DNA, 18 bp, Homo sapiens
atttcaagcagctgaaga

SEQ ID NO: 4058627 - DNA, 21 bp, Homo sapiens
atttcaagcagctgaagaaaa

SEQ ID NO: 4058628 - DNA, 20 bp, Homo sapiens
atttcacaacagatcaattt

SEQ ID NO: 4058629 - DNA, 15 bp, Homo sapiens
atttcacaagctatt

SEQ ID NO: 4058630 - DNA, 18 bp, Homo sapiens
atttcactatcttcttca

SEQ ID NO: 4058631 - DNA, 20 bp, Homo sapiens
atttcactatcttcttcaaa

SEQ ID NO: 4058632 - DNA, 13 bp, Homo sapiens
atttcactgtctt

SEQ ID NO: 4058633 - DNA, 16 bp, Homo sapiens
atttcacttttgttct

SEQ ID NO: 4058634 - DNA, 18 bp, Homo sapiens
atttcagactcccattcc

SEQ ID NO: 4058635 - DNA, 19 bp, Homo sapiens
atttcaggatactctgtca

SEQ ID NO: 4058636 - DNA, 20 bp, Homo sapiens
atttcagtaaacctgtctga

SEQ ID NO: 4058637 - DNA, 17 bp, Homo sapiens
atttcagtatcatctcc

SEQ ID NO: 4058638 - DNA, 14 bp, Homo sapiens
atttcagtggcttc

SEQ ID NO: 4058639 - DNA, 21 bp, Homo sapiens
atttcagtgtagttaatttat

SEQ ID NO: 4058640 - DNA, 21 bp, Homo sapiens
atttcagtgttacctgtgtgc

SEQ ID NO: 4058641 - DNA, 21 bp, Homo sapiens
atttcatacctcagaatgtaa

SEQ ID NO: 4058642 - DNA, 16 bp, Homo sapiens
atttcatagttcagaa

SEQ ID NO: 4058643 - DNA, 14 bp, Homo sapiens
atttcatcattgtt

SEQ ID NO: 4058644 - DNA, 17 bp, Homo sapiens
atttcatcattgtttct

SEQ ID NO: 4058645 - DNA, 22 bp, Homo sapiens
atttcatcctttcacttctttc

SEQ ID NO: 4058646 - DNA, 18 bp, Homo sapiens
atttcattccattgccta

SEQ ID NO: 4058647 - DNA, 21 bp, Homo sapiens
atttcattcgggccccacctg

SEQ ID NO: 4058648 - DNA, 22 bp, Homo sapiens
atttccaacaccacagacacac

SEQ ID NO: 4058649 - DNA, 22 bp, Homo sapiens
atttccactgtaattaaaacta

SEQ ID NO: 4058650 - DNA, 13 bp, Homo sapiens
atttccagtacct

SEQ ID NO: 4058651 - DNA, 15 bp, Homo sapiens
atttccattccagaa

SEQ ID NO: 4058652 - DNA, 16 bp, Homo sapiens
atttccatttcttcct

SEQ ID NO: 4058653 - DNA, 17 bp, Homo sapiens
atttccatttcttcctc

SEQ ID NO: 4058654 - DNA, 18 bp, Homo sapiens
atttccatttcttcctca

SEQ ID NO: 4058655 - DNA, 20 bp, Homo sapiens
atttccccaggggaaaatga

SEQ ID NO: 4058656 - DNA, 18 bp, Homo sapiens
atttcccctcttctgcta

SEQ ID NO: 4058657 - DNA, 18 bp, Homo sapiens
atttccctaaaatacatt

SEQ ID NO: 4058658 - DNA, 11 bp, Homo sapiens
atttccctgca

SEQ ID NO: 4058659 - DNA, 15 bp, Homo sapiens
atttcctgacttgag

SEQ ID NO: 4058660 - DNA, 16 bp, Homo sapiens
atttcctgacttgagt

SEQ ID NO: 4058661 - DNA, 18 bp, Homo sapiens
atttccttaaactgtgtg

SEQ ID NO: 4058662 - DNA, 11 bp, Homo sapiens
atttccttcca

SEQ ID NO: 4058663 - DNA, 12 bp, Homo sapiens
atttccttggag

SEQ ID NO: 4058664 - DNA, 13 bp, Homo sapiens
atttccttggagg

SEQ ID NO: 4058665 - DNA, 20 bp, Homo sapiens
atttccttggattttcctga

SEQ ID NO: 4058666 - DNA, 14 bp, Homo sapiens
atttcctttatgtg

SEQ ID NO: 4058667 - DNA, 16 bp, Homo sapiens
atttcctttatgtgaa

SEQ ID NO: 4058668 - DNA, 18 bp, Homo sapiens
atttcctttatgtgaatt

SEQ ID NO: 4058669 - DNA, 20 bp, Homo sapiens
atttcctttatgtgaatttt

SEQ ID NO: 4058670 - DNA, 20 bp, Homo sapiens
atttcctttttgacactgaa

SEQ ID NO: 4058671 - DNA, 17 bp, Homo sapiens
atttcggattttttcca

SEQ ID NO: 4058672 - DNA, 20 bp, Homo sapiens
atttcggattttttccaaaa

SEQ ID NO: 4058673 - DNA, 20 bp, Homo sapiens
atttctaaaaaacagaggcc

SEQ ID NO: 4058674 - DNA, 21 bp, Homo sapiens
atttctaaaaaacagaggcca

SEQ ID NO: 4058675 - DNA, 18 bp, Homo sapiens
atttctaatccttttcct

SEQ ID NO: 4058676 - DNA, 20 bp, Homo sapiens
atttctaatccttttcctta

SEQ ID NO: 4058677 - DNA, 15 bp, Homo sapiens
atttctactgtgact

SEQ ID NO: 4058678 - DNA, 17 bp, Homo sapiens
atttctactgtgactga

SEQ ID NO: 4058679 - DNA, 20 bp, Homo sapiens
atttctagtccaaaattaca

SEQ ID NO: 4058680 - DNA, 20 bp, Homo sapiens
atttctatcagtacttttat

SEQ ID NO: 4058681 - DNA, 11 bp, Homo sapiens
atttctattaa

SEQ ID NO: 4058682 - DNA, 14 bp, Homo sapiens
atttctcactagtg

SEQ ID NO: 4058683 - DNA, 19 bp, Homo sapiens
atttctcataattttgcaa

SEQ ID NO: 4058684 - DNA, 16 bp, Homo sapiens
atttctccagttggga

SEQ ID NO: 4058685 - DNA, 15 bp, Homo sapiens
atttctccatacgca

SEQ ID NO: 4058686 - DNA, 12 bp, Homo sapiens
atttctcctccc

SEQ ID NO: 4058687 - DNA, 17 bp, Homo sapiens
atttctcctcccttcct

SEQ ID NO: 4058688 - DNA, 12 bp, Homo sapiens
atttctcctttt

SEQ ID NO: 4058689 - DNA, 23 bp, Homo sapiens
atttctgagagtgaaaccatgac

SEQ ID NO: 4058690 - DNA, 22 bp, Homo sapiens
atttctgcatatgttgaatact

SEQ ID NO: 4058691 - DNA, 23 bp, Homo sapiens
atttctgcatatgttgaatactt

SEQ ID NO: 4058692 - DNA, 14 bp, Homo sapiens
atttctgctctgga

SEQ ID NO: 4058693 - DNA, 18 bp, Homo sapiens
atttctgggtcttttgct

SEQ ID NO: 4058694 - DNA, 14 bp, Homo sapiens
atttctgtttctca

SEQ ID NO: 4058695 - DNA, 15 bp, Homo sapiens
atttctgtttctcat

SEQ ID NO: 4058696 - DNA, 23 bp, Homo sapiens
atttcttaaataatgcttcagat

SEQ ID NO: 4058697 - DNA, 20 bp, Homo sapiens
atttcttcagtcagaaaact

SEQ ID NO: 4058698 - DNA, 22 bp, Homo sapiens
atttcttccctgctttgcatct

SEQ ID NO: 4058699 - DNA, 16 bp, Homo sapiens
atttcttcctcagctg

SEQ ID NO: 4058700 - DNA, 18 bp, Homo sapiens
attttaatcaagttgaat

SEQ ID NO: 4058701 - DNA, 13 bp, Homo sapiens
attttaatcctgt

SEQ ID NO: 4058702 - DNA, 14 bp, Homo sapiens
attttaatcctgta

SEQ ID NO: 4058703 - DNA, 12 bp, Homo sapiens
attttaatgtga

SEQ ID NO: 4058704 - DNA, 19 bp, Homo sapiens
attttacacattagatttt

SEQ ID NO: 4058705 - DNA, 22 bp, Homo sapiens
attttacagctcattaaacttt

SEQ ID NO: 4058706 - DNA, 20 bp, Homo sapiens
attttaccaagagtaacttt

SEQ ID NO: 4058707 - DNA, 21 bp, Homo sapiens
attttaccaagagtaacttta

SEQ ID NO: 4058708 - DNA, 13 bp, Homo sapiens
attttacttccat

SEQ ID NO: 4058709 - DNA, 14 bp, Homo sapiens
attttacttccatt

SEQ ID NO: 4058710 - DNA, 17 bp, Homo sapiens
attttacttccattata

SEQ ID NO: 4058711 - DNA, 16 bp, Homo sapiens
attttagaataaattc

SEQ ID NO: 4058712 - DNA, 23 bp, Homo sapiens
attttagctctattgatactctt

SEQ ID NO: 4058713 - DNA, 15 bp, Homo sapiens
attttaggaacttca

SEQ ID NO: 4058714 - DNA, 16 bp, Homo sapiens
attttagtattcattc

SEQ ID NO: 4058715 - DNA, 14 bp, Homo sapiens
attttagtccaaat

SEQ ID NO: 4058716 - DNA, 18 bp, Homo sapiens
attttataaggacttcct

SEQ ID NO: 4058717 - DNA, 14 bp, Homo sapiens
attttataatcaat

SEQ ID NO: 4058718 - DNA, 19 bp, Homo sapiens
attttataatcaatgaatt

SEQ ID NO: 4058719 - DNA, 12 bp, Homo sapiens
attttataattt

SEQ ID NO: 4058720 - DNA, 22 bp, Homo sapiens
attttatagctcagtttatcca

SEQ ID NO: 4058721 - DNA, 17 bp, Homo sapiens
attttatattcagtgaa

SEQ ID NO: 4058722 - DNA, 15 bp, Homo sapiens
attttatcattaatt

SEQ ID NO: 4058723 - DNA, 15 bp, Homo sapiens
attttatgagacagg

SEQ ID NO: 4058724 - DNA, 18 bp, Homo sapiens
attttatgatcagtgttg

SEQ ID NO: 4058725 - DNA, 15 bp, Homo sapiens
attttattgtataaa

SEQ ID NO: 4058726 - DNA, 17 bp, Homo sapiens
attttatttagacaaga

SEQ ID NO: 4058727 - DNA, 22 bp, Homo sapiens
attttatttagacaagagatgg

SEQ ID NO: 4058728 - DNA, 17 bp, Homo sapiens
attttatttatttaatt

SEQ ID NO: 4058729 - DNA, 16 bp, Homo sapiens
attttatttccatcat

SEQ ID NO: 4058730 - DNA, 18 bp, Homo sapiens
attttcaaattgtatcta

SEQ ID NO: 4058731 - DNA, 16 bp, Homo sapiens
attttcaactgctttg

SEQ ID NO: 4058732 - DNA, 16 bp, Homo sapiens
attttcaccccaccct

SEQ ID NO: 4058733 - DNA, 21 bp, Homo sapiens
attttcacctgtttttaagct

SEQ ID NO: 4058734 - DNA, 17 bp, Homo sapiens
attttcagaaaatatta

SEQ ID NO: 4058735 - DNA, 22 bp, Homo sapiens
attttcagtagggctacaaaac

SEQ ID NO: 4058736 - DNA, 17 bp, Homo sapiens
attttcatgtatatgtg

SEQ ID NO: 4058737 - DNA, 12 bp, Homo sapiens
attttcattaaa

SEQ ID NO: 4058738 - DNA, 19 bp, Homo sapiens
attttcattaaacttgaag

SEQ ID NO: 4058739 - DNA, 19 bp, Homo sapiens
attttccacgcagttcttt

SEQ ID NO: 4058740 - DNA, 23 bp, Homo sapiens
attttccacgcagttctttccat

SEQ ID NO: 4058741 - DNA, 17 bp, Homo sapiens
attttccagggcaatca

SEQ ID NO: 4058742 - DNA, 22 bp, Homo sapiens
attttccagggcaatcaatgtt

SEQ ID NO: 4058743 - DNA, 21 bp, Homo sapiens
attttccatttttatttcaaa

SEQ ID NO: 4058744 - DNA, 15 bp, Homo sapiens
attttcccatcatcc

SEQ ID NO: 4058745 - DNA, 21 bp, Homo sapiens
attttcccccactactgcagc

SEQ ID NO: 4058746 - DNA, 14 bp, Homo sapiens
attttccccccact

SEQ ID NO: 4058747 - DNA, 17 bp, Homo sapiens
attttcccctatcattt

SEQ ID NO: 4058748 - DNA, 18 bp, Homo sapiens
attttcctcctctgccta

SEQ ID NO: 4058749 - DNA, 15 bp, Homo sapiens
attttcctgttcagt

SEQ ID NO: 4058750 - DNA, 20 bp, Homo sapiens
attttcctgttcagtgagat

SEQ ID NO: 4058751 - DNA, 14 bp, Homo sapiens
attttctacagtgg

SEQ ID NO: 4058752 - DNA, 19 bp, Homo sapiens
attttctcaaaagcattta

SEQ ID NO: 4058753 - DNA, 15 bp, Homo sapiens
attttctcaatctcc

SEQ ID NO: 4058754 - DNA, 21 bp, Homo sapiens
attttctccctttatgtatct

SEQ ID NO: 4058755 - DNA, 18 bp, Homo sapiens
attttctgacatgcattg

SEQ ID NO: 4058756 - DNA, 13 bp, Homo sapiens
attttctggattc

SEQ ID NO: 4058757 - DNA, 21 bp, Homo sapiens
attttcttacccaatttccca

SEQ ID NO: 4058758 - DNA, 19 bp, Homo sapiens
attttcttattgcgctgct

SEQ ID NO: 4058759 - DNA, 21 bp, Homo sapiens
attttcttccaagcaaaggtg

SEQ ID NO: 4058760 - DNA, 15 bp, Homo sapiens
attttctttgaaatt

SEQ ID NO: 4058761 - DNA, 20 bp, Homo sapiens
attttgaaaagcttcttaat

SEQ ID NO: 4058762 - DNA, 13 bp, Homo sapiens
attttgaagaata

SEQ ID NO: 4058763 - DNA, 14 bp, Homo sapiens
attttgaagaatat

SEQ ID NO: 4058764 - DNA, 16 bp, Homo sapiens
attttgaagaatattt

SEQ ID NO: 4058765 - DNA, 18 bp, Homo sapiens
attttgaagaatatttaa

SEQ ID NO: 4058766 - DNA, 17 bp, Homo sapiens
attttgaagtttacatt

SEQ ID NO: 4058767 - DNA, 19 bp, Homo sapiens
attttgacttaatgtgatt

SEQ ID NO: 4058768 - DNA, 14 bp, Homo sapiens
attttgagaaactg

SEQ ID NO: 4058769 - DNA, 13 bp, Homo sapiens
attttgagtgact

SEQ ID NO: 4058770 - DNA, 14 bp, Homo sapiens
attttgagttgcca

SEQ ID NO: 4058771 - DNA, 17 bp, Homo sapiens
attttgataataaattg

SEQ ID NO: 4058772 - DNA, 19 bp, Homo sapiens
attttgcaaaatttccagt

SEQ ID NO: 4058773 - DNA, 14 bp, Homo sapiens
attttgcaaatata

SEQ ID NO: 4058774 - DNA, 19 bp, Homo sapiens
attttgcaaatataaacat

SEQ ID NO: 4058775 - DNA, 14 bp, Homo sapiens
attttgcattcaaa

SEQ ID NO: 4058776 - DNA, 15 bp, Homo sapiens
attttgcattcaaat

SEQ ID NO: 4058777 - DNA, 23 bp, Homo sapiens
attttgctaagtaaatctcttct

SEQ ID NO: 4058778 - DNA, 19 bp, Homo sapiens
attttgctattgtaaatat

SEQ ID NO: 4058779 - DNA, 19 bp, Homo sapiens
attttgctggaattcctaa

SEQ ID NO: 4058780 - DNA, 12 bp, Homo sapiens
attttggaaact

SEQ ID NO: 4058781 - DNA, 20 bp, Homo sapiens
attttggaagattttcagtc

SEQ ID NO: 4058782 - DNA, 14 bp, Homo sapiens
attttggaatttgc

SEQ ID NO: 4058783 - DNA, 20 bp, Homo sapiens
attttggagagtttcctgaa

SEQ ID NO: 4058784 - DNA, 22 bp, Homo sapiens
attttggagagtttcctgaaac

SEQ ID NO: 4058785 - DNA, 12 bp, Homo sapiens
attttggatata

SEQ ID NO: 4058786 - DNA, 21 bp, Homo sapiens
attttgggacaattgttttaa

SEQ ID NO: 4058787 - DNA, 11 bp, Homo sapiens
attttggggtc

SEQ ID NO: 4058788 - DNA, 13 bp, Homo sapiens
attttggggtctc

SEQ ID NO: 4058789 - DNA, 22 bp, Homo sapiens
attttggtaaaatacttcttga

SEQ ID NO: 4058790 - DNA, 21 bp, Homo sapiens
attttggtgagaaatgggact

SEQ ID NO: 4058791 - DNA, 17 bp, Homo sapiens
attttggtgtctttctc

SEQ ID NO: 4058792 - DNA, 15 bp, Homo sapiens
attttgtaattatga

SEQ ID NO: 4058793 - DNA, 15 bp, Homo sapiens
attttgtagatgtga

SEQ ID NO: 4058794 - DNA, 20 bp, Homo sapiens
attttgtctgcttagtatct

SEQ ID NO: 4058795 - DNA, 13 bp, Homo sapiens
attttgtgaatgg

SEQ ID NO: 4058796 - DNA, 15 bp, Homo sapiens
attttgtgaatggat

SEQ ID NO: 4058797 - DNA, 16 bp, Homo sapiens
attttgtgatgatgct

SEQ ID NO: 4058798 - DNA, 22 bp, Homo sapiens
attttgtgatgatgctgtgaca

SEQ ID NO: 4058799 - DNA, 20 bp, Homo sapiens
attttgtgtaaatttctcaa

SEQ ID NO: 4058800 - DNA, 16 bp, Homo sapiens
attttgtttcttttaa

SEQ ID NO: 4058801 - DNA, 16 bp, Homo sapiens
attttgttttgttgga

SEQ ID NO: 4058802 - DNA, 20 bp, Homo sapiens
attttgtttttattttcaag

SEQ ID NO: 4058803 - DNA, 18 bp, Homo sapiens
caaaagattgctgaaaaa

SEQ ID NO: 4058804 - DNA, 23 bp, Homo sapiens
caaaagattggagctgaagacct

SEQ ID NO: 4058805 - DNA, 23 bp, Homo sapiens
caaaagcaagactgttgctcaaa

SEQ ID NO: 4058806 - DNA, 14 bp, Homo sapiens
caaaagcacccttg

SEQ ID NO: 4058807 - DNA, 20 bp, Homo sapiens
caaaagcagtaaatttgcta

SEQ ID NO: 4058808 - DNA, 13 bp, Homo sapiens
caaaagccttgtg

SEQ ID NO: 4058809 - DNA, 14 bp, Homo sapiens
caaaagccttgtgt

SEQ ID NO: 4058810 - DNA, 19 bp, Homo sapiens
caaaagccttgtgtatatt

SEQ ID NO: 4058811 - DNA, 22 bp, Homo sapiens
caaaagccttgtgtatatttgt

SEQ ID NO: 4058812 - DNA, 23 bp, Homo sapiens
caaaagccttgtgtatatttgta

SEQ ID NO: 4058813 - DNA, 21 bp, Homo sapiens
caaaagcgccctcactattct

SEQ ID NO: 4058814 - DNA, 13 bp, Homo sapiens
caaaagcttccct

SEQ ID NO: 4058815 - DNA, 13 bp, Homo sapiens
caaaaggaagtct

SEQ ID NO: 4058816 - DNA, 22 bp, Homo sapiens
caaaaggcagctcacccctggg

SEQ ID NO: 4058817 - DNA, 23 bp, Homo sapiens
caaaaggcctcttgtaaagactg

SEQ ID NO: 4058818 - DNA, 14 bp, Homo sapiens
caaaagggaaaaga

SEQ ID NO: 4058819 - DNA, 17 bp, Homo sapiens
caaaagtaaatgggagg

SEQ ID NO: 4058820 - DNA, 16 bp, Homo sapiens
caaaagtccctccctg

SEQ ID NO: 4058821 - DNA, 14 bp, Homo sapiens
caaaagtctatttt

SEQ ID NO: 4058822 - DNA, 19 bp, Homo sapiens
caaaagtctgtctttcctg

SEQ ID NO: 4058823 - DNA, 19 bp, Homo sapiens
caaaataaaaagtgacaca

SEQ ID NO: 4058824 - DNA, 11 bp, Homo sapiens
caaaataattc

SEQ ID NO: 4058825 - DNA, 18 bp, Homo sapiens
caaaataattttaagaaa

SEQ ID NO: 4058826 - DNA, 13 bp, Homo sapiens
caaaatagagaat

SEQ ID NO: 4058827 - DNA, 21 bp, Homo sapiens
caaaatattttttgcaagtta

SEQ ID NO: 4058828 - DNA, 16 bp, Homo sapiens
caaaatcattttaatg

SEQ ID NO: 4058829 - DNA, 14 bp, Homo sapiens
caaaatccaaaact

SEQ ID NO: 4058830 - DNA, 21 bp, Homo sapiens
caaaatccaaaacttctcttg

SEQ ID NO: 4058831 - DNA, 21 bp, Homo sapiens
caaaatcgatgcagtgcttcc

SEQ ID NO: 4058832 - DNA, 18 bp, Homo sapiens
caaaatctgaactctcaa

SEQ ID NO: 4058833 - DNA, 13 bp, Homo sapiens
caaaatctgtcca

SEQ ID NO: 4058834 - DNA, 17 bp, Homo sapiens
caaaatctgttctaaca

SEQ ID NO: 4058835 - DNA, 14 bp, Homo sapiens
caaaatggaacgct

SEQ ID NO: 4058836 - DNA, 18 bp, Homo sapiens
caaaatgtctcagttttc

SEQ ID NO: 4058837 - DNA, 10 bp, Homo sapiens
caaaatgtga

SEQ ID NO: 4058838 - DNA, 16 bp, Homo sapiens
caaaatgtgtatttct

SEQ ID NO: 4058839 - DNA, 20 bp, Homo sapiens
caaaattaccaaaaatcttg

SEQ ID NO: 4058840 - DNA, 20 bp, Homo sapiens
caaaattcttatttttccta

SEQ ID NO: 4058841 - DNA, 16 bp, Homo sapiens
caaaattgcaaatctt

SEQ ID NO: 4058842 - DNA, 22 bp, Homo sapiens
caaaattgcaaatcttgaaatt

SEQ ID NO: 4058843 - DNA, 15 bp, Homo sapiens
caaaattgcaatttc

SEQ ID NO: 4058844 - DNA, 18 bp, Homo sapiens
caaaatttccagtacctt

SEQ ID NO: 4058845 - DNA, 12 bp, Homo sapiens
caaaatttgaaa

SEQ ID NO: 4058846 - DNA, 11 bp, Homo sapiens
caaaatttgtt

SEQ ID NO: 4058847 - DNA, 13 bp, Homo sapiens
caaaatttgtttg

SEQ ID NO: 4058848 - DNA, 20 bp, Homo sapiens
caaaattttagtccaaataa

SEQ ID NO: 4058849 - DNA, 21 bp, Homo sapiens
caaaattttatagctcagttt

SEQ ID NO: 4058850 - DNA, 19 bp, Homo sapiens
caaaattttattttgtgct

SEQ ID NO: 4058851 - DNA, 17 bp, Homo sapiens
caaaattttctcatttt

SEQ ID NO: 4058852 - DNA, 16 bp, Homo sapiens
caaacaaaaaggttct

SEQ ID NO: 4058853 - DNA, 21 bp, Homo sapiens
caaacaaaaaggttctcaggt

SEQ ID NO: 4058854 - DNA, 14 bp, Homo sapiens
caaacaaatatgca

SEQ ID NO: 4058855 - DNA, 13 bp, Homo sapiens
caaacacacacac

SEQ ID NO: 4058856 - DNA, 14 bp, Homo sapiens
caaacaccttccag

SEQ ID NO: 4058857 - DNA, 18 bp, Homo sapiens
caaacactgaggcagcct

SEQ ID NO: 4058858 - DNA, 16 bp, Homo sapiens
caaacagaacagggtc

SEQ ID NO: 4058859 - DNA, 14 bp, Homo sapiens
caaacagtaggttg

SEQ ID NO: 4058860 - DNA, 12 bp, Homo sapiens
caaacagtgcca

SEQ ID NO: 4058861 - DNA, 15 bp, Homo sapiens
caaacagtgccaaat

SEQ ID NO: 4058862 - DNA, 20 bp, Homo sapiens
caaacatagcccctgccccg

SEQ ID NO: 4058863 - DNA, 22 bp, Homo sapiens
caaacatcagacctgtcttcca

SEQ ID NO: 4058864 - DNA, 19 bp, Homo sapiens
caaacatgaggttctctct

SEQ ID NO: 4058865 - DNA, 14 bp, Homo sapiens
caaaccaaataaaa

SEQ ID NO: 4058866 - DNA, 13 bp, Homo sapiens
caaaccaacatct

SEQ ID NO: 4058867 - DNA, 19 bp, Homo sapiens
caaaccaacatctttgcga

SEQ ID NO: 4058868 - DNA, 22 bp, Homo sapiens
caaaccaagtcggaacagcaga

SEQ ID NO: 4058869 - DNA, 22 bp, Homo sapiens
caaaccaatggtgatcctctat

SEQ ID NO: 4058870 - DNA, 23 bp, Homo sapiens
caaaccccctccttacgctttgt

SEQ ID NO: 4058871 - DNA, 15 bp, Homo sapiens
caaaccctagccttg

SEQ ID NO: 4058872 - DNA, 20 bp, Homo sapiens
caaaccctagccttgcttgt

SEQ ID NO: 4058873 - DNA, 22 bp, Homo sapiens
caaacccttgctttcctgggcc

SEQ ID NO: 4058874 - DNA, 15 bp, Homo sapiens
caaacctgggacccc

SEQ ID NO: 4058875 - DNA, 20 bp, Homo sapiens
caaacctttattttagaatt

SEQ ID NO: 4058876 - DNA, 12 bp, Homo sapiens
caaacctttccc

SEQ ID NO: 4058877 - DNA, 13 bp, Homo sapiens
caaacctttcccc

SEQ ID NO: 4058878 - DNA, 16 bp, Homo sapiens
caaacgacagaggagc

SEQ ID NO: 4058879 - DNA, 22 bp, Homo sapiens
caaacgccctttcctcctcagg

SEQ ID NO: 4058880 - DNA, 17 bp, Homo sapiens
caaacgcctagattgct

SEQ ID NO: 4058881 - DNA, 19 bp, Homo sapiens
caaactcactgctcaagaa

SEQ ID NO: 4058882 - DNA, 11 bp, Homo sapiens
caaactcatct

SEQ ID NO: 4058883 - DNA, 21 bp, Homo sapiens
caaactggggcctccagaact

SEQ ID NO: 4058884 - DNA, 16 bp, Homo sapiens
caaactggtattctgt

SEQ ID NO: 4058885 - DNA, 20 bp, Homo sapiens
caaactgtaaataaaaagaa

SEQ ID NO: 4058886 - DNA, 21 bp, Homo sapiens
caaactgtaaataaaaagaaa

SEQ ID NO: 4058887 - DNA, 20 bp, Homo sapiens
caaactgtccctcccttgct

SEQ ID NO: 4058888 - DNA, 21 bp, Homo sapiens
caaacttaatgttcttatgca

SEQ ID NO: 4058889 - DNA, 15 bp, Homo sapiens
caaacttactatttt

SEQ ID NO: 4058890 - DNA, 13 bp, Homo sapiens
caaacttgcttta

SEQ ID NO: 4058891 - DNA, 17 bp, Homo sapiens
caaacttttttatatct

SEQ ID NO: 4058892 - DNA, 19 bp, Homo sapiens
caaacttttttatatcttt

SEQ ID NO: 4058893 - DNA, 19 bp, Homo sapiens
caaagaacttgatttgcat

SEQ ID NO: 4058894 - DNA, 23 bp, Homo sapiens
caaagaggcagttgcccagcctc

SEQ ID NO: 4058895 - DNA, 13 bp, Homo sapiens
caaagaggctgcc

SEQ ID NO: 4058896 - DNA, 14 bp, Homo sapiens
caaagagggcttcc

SEQ ID NO: 4058897 - DNA, 16 bp, Homo sapiens
caaagagggcttcctc

SEQ ID NO: 4058898 - DNA, 14 bp, Homo sapiens
caaagagtagaatt

SEQ ID NO: 4058899 - DNA, 22 bp, Homo sapiens
caaagagtgggctgcatctggg

SEQ ID NO: 4058900 - DNA, 19 bp, Homo sapiens
caaagataatttatttcaa

SEQ ID NO: 4058901 - DNA, 13 bp, Homo sapiens
caaagatcaaaat

SEQ ID NO: 4058902 - DNA, 12 bp, Homo sapiens
caaagcaaagaa

SEQ ID NO: 4058903 - DNA, 13 bp, Homo sapiens
caaagcaaagaaa

SEQ ID NO: 4058904 - DNA, 12 bp, Homo sapiens
caaagcaccagc

SEQ ID NO: 4058905 - DNA, 19 bp, Homo sapiens
caaagcagacagctccacc

SEQ ID NO: 4058906 - DNA, 18 bp, Homo sapiens
caagaagacatggagact

SEQ ID NO: 4058907 - DNA, 15 bp, Homo sapiens
caagaataaaggcag

SEQ ID NO: 4058908 - DNA, 17 bp, Homo sapiens
caagaataaaggcagct

SEQ ID NO: 4058909 - DNA, 13 bp, Homo sapiens
caagaatacttga

SEQ ID NO: 4058910 - DNA, 13 bp, Homo sapiens
caagaatggatca

SEQ ID NO: 4058911 - DNA, 23 bp, Homo sapiens
caagaatttcttggtaagaagcc

SEQ ID NO: 4058912 - DNA, 14 bp, Homo sapiens
caagacaaaccaag

SEQ ID NO: 4058913 - DNA, 18 bp, Homo sapiens
caagacagaagctgaagt

SEQ ID NO: 4058914 - DNA, 18 bp, Homo sapiens
caagacagagacgcagga

SEQ ID NO: 4058915 - DNA, 21 bp, Homo sapiens
caagacagagacgcaggaatg

SEQ ID NO: 4058916 - DNA, 16 bp, Homo sapiens
caagacagatgcccca

SEQ ID NO: 4058917 - DNA, 14 bp, Homo sapiens
caagacattgtcaa

SEQ ID NO: 4058918 - DNA, 14 bp, Homo sapiens
caagacccccagca

SEQ ID NO: 4058919 - DNA, 16 bp, Homo sapiens
caagacccccagcact

SEQ ID NO: 4058920 - DNA, 17 bp, Homo sapiens
caagactgttgctcaaa

SEQ ID NO: 4058921 - DNA, 22 bp, Homo sapiens
caagactttagcttttccttcc

SEQ ID NO: 4058922 - DNA, 15 bp, Homo sapiens
caagagaagggctta

SEQ ID NO: 4058923 - DNA, 12 bp, Homo sapiens
caagagaagggg

SEQ ID NO: 4058924 - DNA, 17 bp, Homo sapiens
caagagcagagtctggg

SEQ ID NO: 4058925 - DNA, 17 bp, Homo sapiens
caagagcagcctgtggc

SEQ ID NO: 4058926 - DNA, 18 bp, Homo sapiens
caagagcagcctgtggca

SEQ ID NO: 4058927 - DNA, 19 bp, Homo sapiens
caagagcccagcagggcct

SEQ ID NO: 4058928 - DNA, 22 bp, Homo sapiens
caagagcccccttgacaccggg

SEQ ID NO: 4058929 - DNA, 22 bp, Homo sapiens
caagaggccacttagggaaaga

SEQ ID NO: 4058930 - DNA, 13 bp, Homo sapiens
caagagggcactg

SEQ ID NO: 4058931 - DNA, 15 bp, Homo sapiens
caagagggcactggt

SEQ ID NO: 4058932 - DNA, 19 bp, Homo sapiens
caagagggcactggtggcc

SEQ ID NO: 4058933 - DNA, 20 bp, Homo sapiens
caagaggtttggctcctgcc

SEQ ID NO: 4058934 - DNA, 22 bp, Homo sapiens
caagaggtttggctcctgccca

SEQ ID NO: 4058935 - DNA, 23 bp, Homo sapiens
caagaggtttggctcctgcccac

SEQ ID NO: 4058936 - DNA, 16 bp, Homo sapiens
caagagtaactttact

SEQ ID NO: 4058937 - DNA, 16 bp, Homo sapiens
caagatcaattccctc

SEQ ID NO: 4058938 - DNA, 18 bp, Homo sapiens
caagatcaattccctctc

SEQ ID NO: 4058939 - DNA, 21 bp, Homo sapiens
caagatcaattccctctctca

SEQ ID NO: 4058940 - DNA, 13 bp, Homo sapiens
caagatccatttg

SEQ ID NO: 4058941 - DNA, 18 bp, Homo sapiens
caagatccatttgccttt

SEQ ID NO: 4058942 - DNA, 16 bp, Homo sapiens
caagatcttgtctcca

SEQ ID NO: 4058943 - DNA, 21 bp, Homo sapiens
caagatcttgtctccactaaa

SEQ ID NO: 4058944 - DNA, 13 bp, Homo sapiens
caagatctttcag

SEQ ID NO: 4058945 - DNA, 14 bp, Homo sapiens
caagatctttcagg

SEQ ID NO: 4058946 - DNA, 15 bp, Homo sapiens
caagatctttcagga

SEQ ID NO: 4058947 - DNA, 16 bp, Homo sapiens
caagatgaaataattt

SEQ ID NO: 4058948 - DNA, 16 bp, Homo sapiens
caagatgactggggtg

SEQ ID NO: 4058949 - DNA, 13 bp, Homo sapiens
caagatgcttggt

SEQ ID NO: 4058950 - DNA, 19 bp, Homo sapiens
caagatggaatttatcaaa

SEQ ID NO: 4058951 - DNA, 23 bp, Homo sapiens
caagatggcgccaccgcactcca

SEQ ID NO: 4058952 - DNA, 21 bp, Homo sapiens
caagattttagggcttttatt

SEQ ID NO: 4058953 - DNA, 22 bp, Homo sapiens
caagattttagggcttttattt

SEQ ID NO: 4058954 - DNA, 15 bp, Homo sapiens
caagatttttttcct

SEQ ID NO: 4058955 - DNA, 18 bp, Homo sapiens
caagcaacacagaggaat

SEQ ID NO: 4058956 - DNA, 22 bp, Homo sapiens
caagcaacatttgtatggattt

SEQ ID NO: 4058957 - DNA, 14 bp, Homo sapiens
caagcaatcctcct

SEQ ID NO: 4058958 - DNA, 20 bp, Homo sapiens
caagcaatcctcctgcctca

SEQ ID NO: 4058959 - DNA, 16 bp, Homo sapiens
caagcacagagcctgg

SEQ ID NO: 4058960 - DNA, 18 bp, Homo sapiens
caagcacagagcctggcc

SEQ ID NO: 4058961 - DNA, 21 bp, Homo sapiens
caagcacagagcctggcccca

SEQ ID NO: 4058962 - DNA, 17 bp, Homo sapiens
caagcacatctgcattt

SEQ ID NO: 4058963 - DNA, 18 bp, Homo sapiens
caagcactgctaggcgag

SEQ ID NO: 4058964 - DNA, 21 bp, Homo sapiens
caagcactttaatggcctgga

SEQ ID NO: 4058965 - DNA, 17 bp, Homo sapiens
caagcaggaattatgtc

SEQ ID NO: 4058966 - DNA, 13 bp, Homo sapiens
caagcaggcactg

SEQ ID NO: 4058967 - DNA, 14 bp, Homo sapiens
caagcaggcactgt

SEQ ID NO: 4058968 - DNA, 23 bp, Homo sapiens
caagcattgcttcagaatgaatt

SEQ ID NO: 4058969 - DNA, 23 bp, Homo sapiens
caagccaaagtggcatgttttgt

SEQ ID NO: 4058970 - DNA, 15 bp, Homo sapiens
caagccaacttgtaa

SEQ ID NO: 4058971 - DNA, 21 bp, Homo sapiens
caagccaacttgtaaatacac

SEQ ID NO: 4058972 - DNA, 19 bp, Homo sapiens
caagccacaagtcttccag

SEQ ID NO: 4058973 - DNA, 15 bp, Homo sapiens
caagccagacctagc

SEQ ID NO: 4058974 - DNA, 12 bp, Homo sapiens
caagccagcaag

SEQ ID NO: 4058975 - DNA, 13 bp, Homo sapiens
caagccagggatg

SEQ ID NO: 4058976 - DNA, 21 bp, Homo sapiens
caagccatgtataaatgtgat

SEQ ID NO: 4058977 - DNA, 22 bp, Homo sapiens
caagcccaggtgccagcctgag

SEQ ID NO: 4058978 - DNA, 13 bp, Homo sapiens
caagccccagcag

SEQ ID NO: 4058979 - DNA, 21 bp, Homo sapiens
caagccccagcagccctcaac

SEQ ID NO: 4058980 - DNA, 17 bp, Homo sapiens
caagccctacagagctg

SEQ ID NO: 4058981 - DNA, 21 bp, Homo sapiens
caagccctccccatcccatgt

SEQ ID NO: 4058982 - DNA, 18 bp, Homo sapiens
caagccgtggcttcccgc

SEQ ID NO: 4058983 - DNA, 14 bp, Homo sapiens
caagcctgtctgag

SEQ ID NO: 4058984 - DNA, 17 bp, Homo sapiens
caagctagtgtttctag

SEQ ID NO: 4058985 - DNA, 21 bp, Homo sapiens
caagctatctaaagtttgtta

SEQ ID NO: 4058986 - DNA, 14 bp, Homo sapiens
caagctgagtttcc

SEQ ID NO: 4058987 - DNA, 15 bp, Homo sapiens
caagctgagtttcct

SEQ ID NO: 4058988 - DNA, 18 bp, Homo sapiens
caagctgcctctgggcca

SEQ ID NO: 4058989 - DNA, 21 bp, Homo sapiens
caagctgctctgagccacagt

SEQ ID NO: 4058990 - DNA, 22 bp, Homo sapiens
caagctgctctgagccacagtg

SEQ ID NO: 4058991 - DNA, 13 bp, Homo sapiens
caagctggaagca

SEQ ID NO: 4058992 - DNA, 11 bp, Homo sapiens
caagctggcct

SEQ ID NO: 4058993 - DNA, 13 bp, Homo sapiens
caagctggcctct

SEQ ID NO: 4058994 - DNA, 20 bp, Homo sapiens
caagctgttatttcttccct

SEQ ID NO: 4058995 - DNA, 23 bp, Homo sapiens
caagctgttatttcttccctgct

SEQ ID NO: 4058996 - DNA, 18 bp, Homo sapiens
caagcttaatagccctcc

SEQ ID NO: 4058997 - DNA, 19 bp, Homo sapiens
caagcttaatagccctccc

SEQ ID NO: 4058998 - DNA, 17 bp, Homo sapiens
caaggaaagccccagca

SEQ ID NO: 4058999 - DNA, 19 bp, Homo sapiens
caaggaaaggggagaaggg

SEQ ID NO: 4059000 - DNA, 16 bp, Homo sapiens
caaggaagatatacat

SEQ ID NO: 4059001 - DNA, 13 bp, Homo sapiens
caaggaagcagcc

SEQ ID NO: 4059002 - DNA, 13 bp, Homo sapiens
caaggaaggaaag

SEQ ID NO: 4059003 - DNA, 16 bp, Homo sapiens
caaggaaggaaagaaa

SEQ ID NO: 4059004 - DNA, 17 bp, Homo sapiens
caaggaaggaaagaaag

SEQ ID NO: 4059005 - DNA, 14 bp, Homo sapiens
caaggaataaatga

SEQ ID NO: 4059006 - DNA, 19 bp, Homo sapiens
caaggaatgcctgtgccaa

SEQ ID NO: 4059007 - DNA, 12 bp, Homo sapiens
caaggacattgc

SEQ ID NO: 4059008 - DNA, 17 bp, Homo sapiens
caaggacattgccccaa

SEQ ID NO: 4059009 - DNA, 22 bp, Homo sapiens
caagttcacacctgcagattct

SEQ ID NO: 4059010 - DNA, 15 bp, Homo sapiens
caagttcgtctgttg

SEQ ID NO: 4059011 - DNA, 16 bp, Homo sapiens
caagttctagagaaga

SEQ ID NO: 4059012 - DNA, 19 bp, Homo sapiens
caagttctagagaagaggc

SEQ ID NO: 4059013 - DNA, 21 bp, Homo sapiens
caagttctagagaagaggctg

SEQ ID NO: 4059014 - DNA, 14 bp, Homo sapiens
caagttcttcacct

SEQ ID NO: 4059015 - DNA, 19 bp, Homo sapiens
caagttgagatttttaaga

SEQ ID NO: 4059016 - DNA, 22 bp, Homo sapiens
caagttgagatttttaagaact

SEQ ID NO: 4059017 - DNA, 16 bp, Homo sapiens
caagttgtaaaaatga

SEQ ID NO: 4059018 - DNA, 12 bp, Homo sapiens
caagttgtaaat

SEQ ID NO: 4059019 - DNA, 16 bp, Homo sapiens
caagttgttattgttg

SEQ ID NO: 4059020 - DNA, 18 bp, Homo sapiens
caagttgttattgttgaa

SEQ ID NO: 4059021 - DNA, 20 bp, Homo sapiens
caagttgttattgttgaaca

SEQ ID NO: 4059022 - DNA, 23 bp, Homo sapiens
caagtttctagctagaaatatga

SEQ ID NO: 4059023 - DNA, 13 bp, Homo sapiens
caagttttgtgta

SEQ ID NO: 4059024 - DNA, 13 bp, Homo sapiens
caataaaaagttc

SEQ ID NO: 4059025 - DNA, 19 bp, Homo sapiens
caataaaaagttcagagtt

SEQ ID NO: 4059026 - DNA, 14 bp, Homo sapiens
caataaaacattaa

SEQ ID NO: 4059027 - DNA, 15 bp, Homo sapiens
caataaaatgtgatt

SEQ ID NO: 4059028 - DNA, 18 bp, Homo sapiens
caataaaatttctaagag

SEQ ID NO: 4059029 - DNA, 11 bp, Homo sapiens
caataaactat

SEQ ID NO: 4059030 - DNA, 18 bp, Homo sapiens
caataaacttagaggaaa

SEQ ID NO: 4059031 - DNA, 20 bp, Homo sapiens
caataaacttagaggaaaat

SEQ ID NO: 4059032 - DNA, 15 bp, Homo sapiens
caataaagcactgag

SEQ ID NO: 4059033 - DNA, 16 bp, Homo sapiens
caataaagcactgagc

SEQ ID NO: 4059034 - DNA, 14 bp, Homo sapiens
caataaagcattta

SEQ ID NO: 4059035 - DNA, 14 bp, Homo sapiens
caataaatccacac

SEQ ID NO: 4059036 - DNA, 14 bp, Homo sapiens
caataaatctttca

SEQ ID NO: 4059037 - DNA, 15 bp, Homo sapiens
caataaatgtattca

SEQ ID NO: 4059038 - DNA, 13 bp, Homo sapiens
caataacactgtc

SEQ ID NO: 4059039 - DNA, 12 bp, Homo sapiens
caataacttcta

SEQ ID NO: 4059040 - DNA, 22 bp, Homo sapiens
caataacttctatattttaata

SEQ ID NO: 4059041 - DNA, 23 bp, Homo sapiens
caataacttctatattttaatag

SEQ ID NO: 4059042 - DNA, 13 bp, Homo sapiens
caataacttctga

SEQ ID NO: 4059043 - DNA, 21 bp, Homo sapiens
caataagtacttatctttatt

SEQ ID NO: 4059044 - DNA, 23 bp, Homo sapiens
caataagtgtgtggtagaaacaa

SEQ ID NO: 4059045 - DNA, 21 bp, Homo sapiens
caataagtttgaacctttttt

SEQ ID NO: 4059046 - DNA, 21 bp, Homo sapiens
caataatattgttgtataatt

SEQ ID NO: 4059047 - DNA, 22 bp, Homo sapiens
caataatattgttgtataattt

SEQ ID NO: 4059048 - DNA, 19 bp, Homo sapiens
caatacactagttgtttct

SEQ ID NO: 4059049 - DNA, 18 bp, Homo sapiens
caatacagataacattag

SEQ ID NO: 4059050 - DNA, 16 bp, Homo sapiens
caatacgcctttaaag

SEQ ID NO: 4059051 - DNA, 15 bp, Homo sapiens
caatagagactgtag

SEQ ID NO: 4059052 - DNA, 18 bp, Homo sapiens
caatagctttaccctcag

SEQ ID NO: 4059053 - DNA, 21 bp, Homo sapiens
caatagctttaccctcaggca

SEQ ID NO: 4059054 - DNA, 19 bp, Homo sapiens
caatatccctcttgtaagt

SEQ ID NO: 4059055 - DNA, 21 bp, Homo sapiens
caatatgtatgctttttacct

SEQ ID NO: 4059056 - DNA, 18 bp, Homo sapiens
caatatgtgtttacttta

SEQ ID NO: 4059057 - DNA, 22 bp, Homo sapiens
caatattaaatacagacactaa

SEQ ID NO: 4059058 - DNA, 24 bp, Homo sapiens
caatattaacctaatcaccatgta

SEQ ID NO: 4059059 - DNA, 21 bp, Homo sapiens
caatattatactaagaaaaga

SEQ ID NO: 4059060 - DNA, 22 bp, Homo sapiens
caatattatactaagaaaagat

SEQ ID NO: 4059061 - DNA, 16 bp, Homo sapiens
caatattgtctccctt

SEQ ID NO: 4059062 - DNA, 14 bp, Homo sapiens
caatatttatggat

SEQ ID NO: 4059063 - DNA, 19 bp, Homo sapiens
caatatttgaattttaaat

SEQ ID NO: 4059064 - DNA, 20 bp, Homo sapiens
caatattttctttaatgctt

SEQ ID NO: 4059065 - DNA, 14 bp, Homo sapiens
caatatttttagat

SEQ ID NO: 4059066 - DNA, 22 bp, Homo sapiens
caatatttttatatcatgcaaa

SEQ ID NO: 4059067 - DNA, 17 bp, Homo sapiens
caatcaaataagtattt

SEQ ID NO: 4059068 - DNA, 14 bp, Homo sapiens
caatcaaatctgct

SEQ ID NO: 4059069 - DNA, 18 bp, Homo sapiens
caatcaaggttataattt

SEQ ID NO: 4059070 - DNA, 19 bp, Homo sapiens
caatcaaggttataatttt

SEQ ID NO: 4059071 - DNA, 21 bp, Homo sapiens
caatcagtagcttaagaaaaa

SEQ ID NO: 4059072 - DNA, 19 bp, Homo sapiens
caatcagtatgtattcttt

SEQ ID NO: 4059073 - DNA, 15 bp, Homo sapiens
caatcattgctgaaa

SEQ ID NO: 4059074 - DNA, 18 bp, Homo sapiens
caatcatttctcactgtg

SEQ ID NO: 4059075 - DNA, 22 bp, Homo sapiens
caatcccagggctggctctgca

SEQ ID NO: 4059076 - DNA, 13 bp, Homo sapiens
caatccccatcag

SEQ ID NO: 4059077 - DNA, 20 bp, Homo sapiens
caatccctttattaccccct

SEQ ID NO: 4059078 - DNA, 22 bp, Homo sapiens
caatcctaacacattatcggga

SEQ ID NO: 4059079 - DNA, 19 bp, Homo sapiens
caatcctaatttctcctcc

SEQ ID NO: 4059080 - DNA, 16 bp, Homo sapiens
caatcctcctgcctca

SEQ ID NO: 4059081 - DNA, 17 bp, Homo sapiens
caatcctcctgcctcag

SEQ ID NO: 4059082 - DNA, 20 bp, Homo sapiens
caatcctgggcaatcagaca

SEQ ID NO: 4059083 - DNA, 19 bp, Homo sapiens
caatccttccctgctcttg

SEQ ID NO: 4059084 - DNA, 15 bp, Homo sapiens
caatcgcaaatcaaa

SEQ ID NO: 4059085 - DNA, 24 bp, Homo sapiens
caatctgattcagcatcactaaac

SEQ ID NO: 4059086 - DNA, 21 bp, Homo sapiens
caatctgcacactccaggcct

SEQ ID NO: 4059087 - DNA, 18 bp, Homo sapiens
caatctggcccttacaca

SEQ ID NO: 4059088 - DNA, 20 bp, Homo sapiens
caatctggcccttacacact

SEQ ID NO: 4059089 - DNA, 21 bp, Homo sapiens
caatctggcccttacacactc

SEQ ID NO: 4059090 - DNA, 22 bp, Homo sapiens
caatctggcccttacacactca

SEQ ID NO: 4059091 - DNA, 13 bp, Homo sapiens
caatcttgctttg

SEQ ID NO: 4059092 - DNA, 19 bp, Homo sapiens
caatcttgttttaagcaaa

SEQ ID NO: 4059093 - DNA, 16 bp, Homo sapiens
caatgaaaactctttg

SEQ ID NO: 4059094 - DNA, 14 bp, Homo sapiens
caatgaagccagct

SEQ ID NO: 4059095 - DNA, 21 bp, Homo sapiens
caatgagactctagggtccag

SEQ ID NO: 4059096 - DNA, 18 bp, Homo sapiens
caatgaggtctgaaatgg

SEQ ID NO: 4059097 - DNA, 21 bp, Homo sapiens
caatgatgaatgagaatctac

SEQ ID NO: 4059098 - DNA, 22 bp, Homo sapiens
caatgatgattaaacacctgac

SEQ ID NO: 4059099 - DNA, 13 bp, Homo sapiens
caatgatggtcac

SEQ ID NO: 4059100 - DNA, 22 bp, Homo sapiens
caatgattgttaatttacagct

SEQ ID NO: 4059101 - DNA, 16 bp, Homo sapiens
caatgcacatggtgca

SEQ ID NO: 4059102 - DNA, 13 bp, Homo sapiens
caatgcagaactc

SEQ ID NO: 4059103 - DNA, 13 bp, Homo sapiens
caatgcagcaagg

SEQ ID NO: 4059104 - DNA, 15 bp, Homo sapiens
caatgcccagcaggg

SEQ ID NO: 4059105 - DNA, 21 bp, Homo sapiens
caatgctgatttggtgaccaa

SEQ ID NO: 4059106 - DNA, 16 bp, Homo sapiens
caatgcttaaactaaa

SEQ ID NO: 4059107 - DNA, 21 bp, Homo sapiens
caatgcttttatatggcccag

SEQ ID NO: 4059108 - DNA, 21 bp, Homo sapiens
caatggcctaaaactggcctg

SEQ ID NO: 4059109 - DNA, 16 bp, Homo sapiens
caatggctaattccca

SEQ ID NO: 4059110 - DNA, 18 bp, Homo sapiens
caatggctaattcccaga

SEQ ID NO: 4059111 - DNA, 23 bp, Homo sapiens
cacacagcagccccccagcacta

SEQ ID NO: 4059112 - DNA, 18 bp, Homo sapiens
cacacagctactctcccc

SEQ ID NO: 4059113 - DNA, 12 bp, Homo sapiens
cacacagctgcc

SEQ ID NO: 4059114 - DNA, 12 bp, Homo sapiens
cacacagggcag

SEQ ID NO: 4059115 - DNA, 19 bp, Homo sapiens
cacacaggtggggactggg

SEQ ID NO: 4059116 - DNA, 22 bp, Homo sapiens
cacacaggtggggactgggcac

SEQ ID NO: 4059117 - DNA, 23 bp, Homo sapiens
cacacattcccccaccagctgca

SEQ ID NO: 4059118 - DNA, 14 bp, Homo sapiens
cacacatttcactg

SEQ ID NO: 4059119 - DNA, 19 bp, Homo sapiens
cacacatttcactgtctgt

SEQ ID NO: 4059120 - DNA, 13 bp, Homo sapiens
cacaccaggctgt

SEQ ID NO: 4059121 - DNA, 20 bp, Homo sapiens
cacaccaggctgtgggcctc

SEQ ID NO: 4059122 - DNA, 14 bp, Homo sapiens
cacacccactccct

SEQ ID NO: 4059123 - DNA, 20 bp, Homo sapiens
cacaccccagcccaccctgc

SEQ ID NO: 4059124 - DNA, 18 bp, Homo sapiens
cacacccctgtcccaccc

SEQ ID NO: 4059125 - DNA, 13 bp, Homo sapiens
cacacctcagttc

SEQ ID NO: 4059126 - DNA, 20 bp, Homo sapiens
cacacctcagttcccttggc

SEQ ID NO: 4059127 - DNA, 15 bp, Homo sapiens
cacacctccgagaca

SEQ ID NO: 4059128 - DNA, 17 bp, Homo sapiens
cacacctccgagacagt

SEQ ID NO: 4059129 - DNA, 20 bp, Homo sapiens
cacacctccgagacagtcca

SEQ ID NO: 4059130 - DNA, 21 bp, Homo sapiens
cacacctccgagacagtccag

SEQ ID NO: 4059131 - DNA, 12 bp, Homo sapiens
cacacctctgcc

SEQ ID NO: 4059132 - DNA, 13 bp, Homo sapiens
cacacctctgcca

SEQ ID NO: 4059133 - DNA, 17 bp, Homo sapiens
cacacctgaacttgcct

SEQ ID NO: 4059134 - DNA, 14 bp, Homo sapiens
cacaccttccaggg

SEQ ID NO: 4059135 - DNA, 15 bp, Homo sapiens
cacaccttccagggc

SEQ ID NO: 4059136 - DNA, 17 bp, Homo sapiens
cacaccttccagggccc

SEQ ID NO: 4059137 - DNA, 23 bp, Homo sapiens
cacaccttttattgacacagaaa

SEQ ID NO: 4059138 - DNA, 13 bp, Homo sapiens
cacacgcacgcac

SEQ ID NO: 4059139 - DNA, 14 bp, Homo sapiens
cacacgcacgcaca

SEQ ID NO: 4059140 - DNA, 17 bp, Homo sapiens
cacacgcacgcacacac

SEQ ID NO: 4059141 - DNA, 15 bp, Homo sapiens
cacacgcactggtgc

SEQ ID NO: 4059142 - DNA, 21 bp, Homo sapiens
cacacggactcccgggccacg

SEQ ID NO: 4059143 - DNA, 17 bp, Homo sapiens
cacacgtacttaaatga

SEQ ID NO: 4059144 - DNA, 21 bp, Homo sapiens
cacactaacctgggttccctt

SEQ ID NO: 4059145 - DNA, 18 bp, Homo sapiens
cacactagcctctccagg

SEQ ID NO: 4059146 - DNA, 13 bp, Homo sapiens
cacactcaggcct

SEQ ID NO: 4059147 - DNA, 18 bp, Homo sapiens
cacactcaggcctgtgcc

SEQ ID NO: 4059148 - DNA, 14 bp, Homo sapiens
cacactccaggcct

SEQ ID NO: 4059149 - DNA, 20 bp, Homo sapiens
cacactccatctcctgctca

SEQ ID NO: 4059150 - DNA, 23 bp, Homo sapiens
cacactcccaaggttggagccca

SEQ ID NO: 4059151 - DNA, 12 bp, Homo sapiens
cacactccctgc

SEQ ID NO: 4059152 - DNA, 18 bp, Homo sapiens
cacactccctgcttgcag

SEQ ID NO: 4059153 - DNA, 23 bp, Homo sapiens
cacactccctgcttgcaggaggc

SEQ ID NO: 4059154 - DNA, 23 bp, Homo sapiens
cacactgcctcccatccttccct

SEQ ID NO: 4059155 - DNA, 22 bp, Homo sapiens
cacactggtacttagagtttct

SEQ ID NO: 4059156 - DNA, 20 bp, Homo sapiens
cacactgtcatgcttcatca

SEQ ID NO: 4059157 - DNA, 20 bp, Homo sapiens
cacacttcaggctcttctcc

SEQ ID NO: 4059158 - DNA, 21 bp, Homo sapiens
cacacttcaggctcttctcct

SEQ ID NO: 4059159 - DNA, 22 bp, Homo sapiens
cacacttcaggctcttctcctt

SEQ ID NO: 4059160 - DNA, 17 bp, Homo sapiens
cacacttgagaggatga

SEQ ID NO: 4059161 - DNA, 22 bp, Homo sapiens
cacacttgtcggctccagtccc

SEQ ID NO: 4059162 - DNA, 13 bp, Homo sapiens
cacacttgtgtgt

SEQ ID NO: 4059163 - DNA, 19 bp, Homo sapiens
cacacttgtgtgtgggctg

SEQ ID NO: 4059164 - DNA, 23 bp, Homo sapiens
cacacttgtgtgtgggctgtgag

SEQ ID NO: 4059165 - DNA, 15 bp, Homo sapiens
cacacttgttccagc

SEQ ID NO: 4059166 - DNA, 16 bp, Homo sapiens
cacactttttatttaa

SEQ ID NO: 4059167 - DNA, 18 bp, Homo sapiens
cacagaaacacaatattt

SEQ ID NO: 4059168 - DNA, 21 bp, Homo sapiens
cacagaaacacaatattttgt

SEQ ID NO: 4059169 - DNA, 17 bp, Homo sapiens
cacagaaatcagaggag

SEQ ID NO: 4059170 - DNA, 17 bp, Homo sapiens
cacagaaatgctgctgg

SEQ ID NO: 4059171 - DNA, 21 bp, Homo sapiens
cacagaaatgctgctggccaa

SEQ ID NO: 4059172 - DNA, 22 bp, Homo sapiens
cacagaaatgctgctggccaaa

SEQ ID NO: 4059173 - DNA, 21 bp, Homo sapiens
cacagaaccttcaacccagtg

SEQ ID NO: 4059174 - DNA, 15 bp, Homo sapiens
cacagaagcctagga

SEQ ID NO: 4059175 - DNA, 19 bp, Homo sapiens
cacagacacaatatgtatg

SEQ ID NO: 4059176 - DNA, 12 bp, Homo sapiens
cacagacacaca

SEQ ID NO: 4059177 - DNA, 14 bp, Homo sapiens
cacagacagatccc

SEQ ID NO: 4059178 - DNA, 15 bp, Homo sapiens
cacagacagatccca

SEQ ID NO: 4059179 - DNA, 21 bp, Homo sapiens
cacagacccaggacccccgag

SEQ ID NO: 4059180 - DNA, 22 bp, Homo sapiens
cacagagagggagagcagagaa

SEQ ID NO: 4059181 - DNA, 19 bp, Homo sapiens
cacagagcctggccccagg

SEQ ID NO: 4059182 - DNA, 21 bp, Homo sapiens
cacagaggcagcccgcacacc

SEQ ID NO: 4059183 - DNA, 22 bp, Homo sapiens
cacagagtggtctttctggaga

SEQ ID NO: 4059184 - DNA, 14 bp, Homo sapiens
cacagatatttcca

SEQ ID NO: 4059185 - DNA, 17 bp, Homo sapiens
cacagatggatttgcct

SEQ ID NO: 4059186 - DNA, 19 bp, Homo sapiens
cacagatggatttgcctgt

SEQ ID NO: 4059187 - DNA, 14 bp, Homo sapiens
cacagcaaccccag

SEQ ID NO: 4059188 - DNA, 18 bp, Homo sapiens
cacagcaaccccaggctg

SEQ ID NO: 4059189 - DNA, 19 bp, Homo sapiens
cacagcaagtacagcggct

SEQ ID NO: 4059190 - DNA, 20 bp, Homo sapiens
cacagcagccccccagcact

SEQ ID NO: 4059191 - DNA, 16 bp, Homo sapiens
cacagcagctgaacag

SEQ ID NO: 4059192 - DNA, 19 bp, Homo sapiens
cacagcagcttcaccagag

SEQ ID NO: 4059193 - DNA, 21 bp, Homo sapiens
cacagcagcttcaccagagca

SEQ ID NO: 4059194 - DNA, 13 bp, Homo sapiens
cacagcaggtcct

SEQ ID NO: 4059195 - DNA, 12 bp, Homo sapiens
cacagcagtgag

SEQ ID NO: 4059196 - DNA, 13 bp, Homo sapiens
cacagcagtgagt

SEQ ID NO: 4059197 - DNA, 23 bp, Homo sapiens
cacagcagtgtgaatagcctggc

SEQ ID NO: 4059198 - DNA, 23 bp, Homo sapiens
cacagcatcattttgcattcaaa

SEQ ID NO: 4059199 - DNA, 13 bp, Homo sapiens
cacagccagagga

SEQ ID NO: 4059200 - DNA, 21 bp, Homo sapiens
cacagcctataggccaatgca

SEQ ID NO: 4059201 - DNA, 13 bp, Homo sapiens
cacagcctccagg

SEQ ID NO: 4059202 - DNA, 14 bp, Homo sapiens
cacagcctcctctg

SEQ ID NO: 4059203 - DNA, 20 bp, Homo sapiens
cacagcctcctctgtctgcc

SEQ ID NO: 4059204 - DNA, 13 bp, Homo sapiens
cacagcctggact

SEQ ID NO: 4059205 - DNA, 17 bp, Homo sapiens
cacagcggaggagacca

SEQ ID NO: 4059206 - DNA, 23 bp, Homo sapiens
cacagcggagtctgtcctgtgac

SEQ ID NO: 4059207 - DNA, 14 bp, Homo sapiens
cacagcggcccctg

SEQ ID NO: 4059208 - DNA, 16 bp, Homo sapiens
cacagcggcccctgca

SEQ ID NO: 4059209 - DNA, 22 bp, Homo sapiens
cacagcgtccctggcgcaggtg

SEQ ID NO: 4059210 - DNA, 15 bp, Homo sapiens
cacagctacctgaga

SEQ ID NO: 4059211 - DNA, 16 bp, Homo sapiens
cacagctacctgagac

SEQ ID NO: 4059212 - DNA, 13 bp, Homo sapiens
cacagctcccttc

SEQ ID NO: 4059213 - DNA, 17 bp, Homo sapiens
cacatttctgatcagag

SEQ ID NO: 4059214 - DNA, 18 bp, Homo sapiens
cacatttctgatcagagg

SEQ ID NO: 4059215 - DNA, 16 bp, Homo sapiens
cacatttggaatactt

SEQ ID NO: 4059216 - DNA, 17 bp, Homo sapiens
cacatttggaatacttt

SEQ ID NO: 4059217 - DNA, 11 bp, Homo sapiens
cacatttgtac

SEQ ID NO: 4059218 - DNA, 20 bp, Homo sapiens
caccaaaaaaatccagaaac

SEQ ID NO: 4059219 - DNA, 18 bp, Homo sapiens
caccaagcacagcagcct

SEQ ID NO: 4059220 - DNA, 14 bp, Homo sapiens
caccaagcagtggc

SEQ ID NO: 4059221 - DNA, 22 bp, Homo sapiens
caccaagttggaacatccttgg

SEQ ID NO: 4059222 - DNA, 16 bp, Homo sapiens
caccaatgcccagcag

SEQ ID NO: 4059223 - DNA, 16 bp, Homo sapiens
caccacagacacacac

SEQ ID NO: 4059224 - DNA, 15 bp, Homo sapiens
caccacatctgccag

SEQ ID NO: 4059225 - DNA, 13 bp, Homo sapiens
caccacctctgtg

SEQ ID NO: 4059226 - DNA, 13 bp, Homo sapiens
caccacctgcctc

SEQ ID NO: 4059227 - DNA, 20 bp, Homo sapiens
caccacggcgtttttttaca

SEQ ID NO: 4059228 - DNA, 13 bp, Homo sapiens
caccactgcactc

SEQ ID NO: 4059229 - DNA, 15 bp, Homo sapiens
caccagacacccagg

SEQ ID NO: 4059230 - DNA, 17 bp, Homo sapiens
caccagacacccaggac

SEQ ID NO: 4059231 - DNA, 18 bp, Homo sapiens
caccagacacccaggact

SEQ ID NO: 4059232 - DNA, 16 bp, Homo sapiens
caccagacatcaccct

SEQ ID NO: 4059233 - DNA, 20 bp, Homo sapiens
caccagacatcaccctttgc

SEQ ID NO: 4059234 - DNA, 18 bp, Homo sapiens
caccagagcaacctctca

SEQ ID NO: 4059235 - DNA, 20 bp, Homo sapiens
caccagagcaacctctcact

SEQ ID NO: 4059236 - DNA, 12 bp, Homo sapiens
caccagagcaga

SEQ ID NO: 4059237 - DNA, 20 bp, Homo sapiens
caccagagcagatgcagaga

SEQ ID NO: 4059238 - DNA, 23 bp, Homo sapiens
caccagaggccgaaggtgcctca

SEQ ID NO: 4059239 - DNA, 15 bp, Homo sapiens
caccagatgtgacag

SEQ ID NO: 4059240 - DNA, 11 bp, Homo sapiens
caccagccagc

SEQ ID NO: 4059241 - DNA, 20 bp, Homo sapiens
caccagcccccgccccagag

SEQ ID NO: 4059242 - DNA, 22 bp, Homo sapiens
caccagcccccgccccagagtg

SEQ ID NO: 4059243 - DNA, 17 bp, Homo sapiens
caccagcccggcctgct

SEQ ID NO: 4059244 - DNA, 15 bp, Homo sapiens
caccagccgccccag

SEQ ID NO: 4059245 - DNA, 19 bp, Homo sapiens
caccagccgccccagcccc

SEQ ID NO: 4059246 - DNA, 23 bp, Homo sapiens
caccagctcgtttttcagcaccc

SEQ ID NO: 4059247 - DNA, 12 bp, Homo sapiens
caccagctgcag

SEQ ID NO: 4059248 - DNA, 14 bp, Homo sapiens
caccagctgtgtcc

SEQ ID NO: 4059249 - DNA, 11 bp, Homo sapiens
caccaggaagg

SEQ ID NO: 4059250 - DNA, 16 bp, Homo sapiens
caccaggagaaccact

SEQ ID NO: 4059251 - DNA, 21 bp, Homo sapiens
caccaggatggcccttcccac

SEQ ID NO: 4059252 - DNA, 13 bp, Homo sapiens
caccaggccgggc

SEQ ID NO: 4059253 - DNA, 14 bp, Homo sapiens
caccaggccgggct

SEQ ID NO: 4059254 - DNA, 15 bp, Homo sapiens
caccaggctgtgggc

SEQ ID NO: 4059255 - DNA, 22 bp, Homo sapiens
caccagggccaaaagcttccct

SEQ ID NO: 4059256 - DNA, 14 bp, Homo sapiens
caccagtgacctgg

SEQ ID NO: 4059257 - DNA, 17 bp, Homo sapiens
caccagtggcctcgtgg

SEQ ID NO: 4059258 - DNA, 14 bp, Homo sapiens
caccagtgtcccct

SEQ ID NO: 4059259 - DNA, 18 bp, Homo sapiens
caccagtgtcccctccac

SEQ ID NO: 4059260 - DNA, 14 bp, Homo sapiens
caccataacctctg

SEQ ID NO: 4059261 - DNA, 15 bp, Homo sapiens
caccataacctctgg

SEQ ID NO: 4059262 - DNA, 23 bp, Homo sapiens
caccatacgagcacctccagcct

SEQ ID NO: 4059263 - DNA, 21 bp, Homo sapiens
caccatattggccagtctggt

SEQ ID NO: 4059264 - DNA, 11 bp, Homo sapiens
caccatccctg

SEQ ID NO: 4059265 - DNA, 18 bp, Homo sapiens
caccatctgattaaaaca

SEQ ID NO: 4059266 - DNA, 16 bp, Homo sapiens
caccatggccagccaa

SEQ ID NO: 4059267 - DNA, 21 bp, Homo sapiens
cacccaaatcacatctcacct

SEQ ID NO: 4059268 - DNA, 23 bp, Homo sapiens
cacccaaatcacatctcacctcc

SEQ ID NO: 4059269 - DNA, 16 bp, Homo sapiens
cacccaagcccaaact

SEQ ID NO: 4059270 - DNA, 16 bp, Homo sapiens
cacccacccctgcaca

SEQ ID NO: 4059271 - DNA, 14 bp, Homo sapiens
cacccaccctgtgc

SEQ ID NO: 4059272 - DNA, 15 bp, Homo sapiens
cacccacctcttgtg

SEQ ID NO: 4059273 - DNA, 10 bp, Homo sapiens
cacccagccc

SEQ ID NO: 4059274 - DNA, 14 bp, Homo sapiens
cacccagcccctgg

SEQ ID NO: 4059275 - DNA, 11 bp, Homo sapiens
cacccagcctg

SEQ ID NO: 4059276 - DNA, 15 bp, Homo sapiens
cacccagctccaggg

SEQ ID NO: 4059277 - DNA, 11 bp, Homo sapiens
cacccaggagg

SEQ ID NO: 4059278 - DNA, 21 bp, Homo sapiens
cacccagggaactaggaaggc

SEQ ID NO: 4059279 - DNA, 21 bp, Homo sapiens
cacccaggggaaggccctgag

SEQ ID NO: 4059280 - DNA, 23 bp, Homo sapiens
cacccaggggaaggccctgaggc

SEQ ID NO: 4059281 - DNA, 17 bp, Homo sapiens
cacccataatcctttct

SEQ ID NO: 4059282 - DNA, 13 bp, Homo sapiens
cacccatgggctc

SEQ ID NO: 4059283 - DNA, 13 bp, Homo sapiens
cacccatgtgcca

SEQ ID NO: 4059284 - DNA, 15 bp, Homo sapiens
caccccaccctccct

SEQ ID NO: 4059285 - DNA, 20 bp, Homo sapiens
caccccaccctccctggagt

SEQ ID NO: 4059286 - DNA, 16 bp, Homo sapiens
caccccacctccactc

SEQ ID NO: 4059287 - DNA, 18 bp, Homo sapiens
caccccagcccaccctgc

SEQ ID NO: 4059288 - DNA, 13 bp, Homo sapiens
caccccagcctcg

SEQ ID NO: 4059289 - DNA, 12 bp, Homo sapiens
caccccatccca

SEQ ID NO: 4059290 - DNA, 12 bp, Homo sapiens
caccccatcctc

SEQ ID NO: 4059291 - DNA, 12 bp, Homo sapiens
cacccccagctc

SEQ ID NO: 4059292 - DNA, 14 bp, Homo sapiens
cacccccagctcaa

SEQ ID NO: 4059293 - DNA, 18 bp, Homo sapiens
caccccccacacacacta

SEQ ID NO: 4059294 - DNA, 21 bp, Homo sapiens
caccccctcaagccccagcag

SEQ ID NO: 4059295 - DNA, 13 bp, Homo sapiens
caccccctgccct

SEQ ID NO: 4059296 - DNA, 17 bp, Homo sapiens
caccccctgccctgcac

SEQ ID NO: 4059297 - DNA, 22 bp, Homo sapiens
caccccctgctccaccagcagc

SEQ ID NO: 4059298 - DNA, 14 bp, Homo sapiens
cacccccttccccc

SEQ ID NO: 4059299 - DNA, 13 bp, Homo sapiens
cacccccttctct

SEQ ID NO: 4059300 - DNA, 12 bp, Homo sapiens
caccccctttcc

SEQ ID NO: 4059301 - DNA, 14 bp, Homo sapiens
caccccctttcctg

SEQ ID NO: 4059302 - DNA, 15 bp, Homo sapiens
caccccggcctcagg

SEQ ID NO: 4059303 - DNA, 19 bp, Homo sapiens
caccccggggaccctgtga

SEQ ID NO: 4059304 - DNA, 14 bp, Homo sapiens
cacccctaaagaga

SEQ ID NO: 4059305 - DNA, 22 bp, Homo sapiens
cacccctaatgagggtgtgaga

SEQ ID NO: 4059306 - DNA, 13 bp, Homo sapiens
cacccctacacac

SEQ ID NO: 4059307 - DNA, 16 bp, Homo sapiens
cacccctacacacaca

SEQ ID NO: 4059308 - DNA, 12 bp, Homo sapiens
cacccctcactc

SEQ ID NO: 4059309 - DNA, 14 bp, Homo sapiens
cacccctcactccc

SEQ ID NO: 4059310 - DNA, 20 bp, Homo sapiens
cacccctcactccccaggga

SEQ ID NO: 4059311 - DNA, 19 bp, Homo sapiens
cacccctgcccccagcccc

SEQ ID NO: 4059312 - DNA, 20 bp, Homo sapiens
cacccctggaagagcccagt

SEQ ID NO: 4059313 - DNA, 13 bp, Homo sapiens
cacccctgggcag

SEQ ID NO: 4059314 - DNA, 14 bp, Homo sapiens
cacccctgggcagg

SEQ ID NO: 4059315 - DNA, 18 bp, Homo sapiens
cacccctgggcaggcggt

SEQ ID NO: 4059316 - DNA, 14 bp, Homo sapiens
cacccctgggccag

SEQ ID NO: 4059317 - DNA, 15 bp, Homo sapiens
cacctctgttaaggt

SEQ ID NO: 4059318 - DNA, 21 bp, Homo sapiens
cacctctgttaaggttgaact

SEQ ID NO: 4059319 - DNA, 14 bp, Homo sapiens
cacctcttcacccc

SEQ ID NO: 4059320 - DNA, 18 bp, Homo sapiens
cacctgacagcccctccc

SEQ ID NO: 4059321 - DNA, 11 bp, Homo sapiens
cacctgcacac

SEQ ID NO: 4059322 - DNA, 14 bp, Homo sapiens
cacctgcacactcc

SEQ ID NO: 4059323 - DNA, 21 bp, Homo sapiens
cacctgcacactccatctcct

SEQ ID NO: 4059324 - DNA, 11 bp, Homo sapiens
cacctgcagct

SEQ ID NO: 4059325 - DNA, 14 bp, Homo sapiens
cacctgcctcagga

SEQ ID NO: 4059326 - DNA, 21 bp, Homo sapiens
cacctgcctctaatctgagct

SEQ ID NO: 4059327 - DNA, 16 bp, Homo sapiens
cacctgccttggcctc

SEQ ID NO: 4059328 - DNA, 13 bp, Homo sapiens
cacctgctccaga

SEQ ID NO: 4059329 - DNA, 12 bp, Homo sapiens
cacctgctctgc

SEQ ID NO: 4059330 - DNA, 13 bp, Homo sapiens
cacctgctctgct

SEQ ID NO: 4059331 - DNA, 13 bp, Homo sapiens
cacctgcttctga

SEQ ID NO: 4059332 - DNA, 14 bp, Homo sapiens
cacctgcttctgaa

SEQ ID NO: 4059333 - DNA, 16 bp, Homo sapiens
cacctggcaaaggacc

SEQ ID NO: 4059334 - DNA, 18 bp, Homo sapiens
cacctggctgagcagttc

SEQ ID NO: 4059335 - DNA, 20 bp, Homo sapiens
cacctggctgaggttcctct

SEQ ID NO: 4059336 - DNA, 15 bp, Homo sapiens
cacctgtagcagcca

SEQ ID NO: 4059337 - DNA, 20 bp, Homo sapiens
cacctgtccccaccctccac

SEQ ID NO: 4059338 - DNA, 17 bp, Homo sapiens
cacctgtctcagcctcc

SEQ ID NO: 4059339 - DNA, 18 bp, Homo sapiens
cacctgtctcagcctccc

SEQ ID NO: 4059340 - DNA, 14 bp, Homo sapiens
cacctgtctgctcc

SEQ ID NO: 4059341 - DNA, 13 bp, Homo sapiens
cacctgtgctgga

SEQ ID NO: 4059342 - DNA, 20 bp, Homo sapiens
cacctgtgctggagccctgt

SEQ ID NO: 4059343 - DNA, 16 bp, Homo sapiens
cacctgttatgtatga

SEQ ID NO: 4059344 - DNA, 23 bp, Homo sapiens
cacctgttcacagaaaaagcatg

SEQ ID NO: 4059345 - DNA, 19 bp, Homo sapiens
cacctgtttttaagctgtt

SEQ ID NO: 4059346 - DNA, 14 bp, Homo sapiens
caccttcaggcccc

SEQ ID NO: 4059347 - DNA, 19 bp, Homo sapiens
caccttcagtttttgtgtt

SEQ ID NO: 4059348 - DNA, 16 bp, Homo sapiens
caccttccagctcctg

SEQ ID NO: 4059349 - DNA, 13 bp, Homo sapiens
caccttcctcact

SEQ ID NO: 4059350 - DNA, 20 bp, Homo sapiens
caccttcctcacttccatac

SEQ ID NO: 4059351 - DNA, 17 bp, Homo sapiens
caccttctgtccccagc

SEQ ID NO: 4059352 - DNA, 17 bp, Homo sapiens
caccttggctctgccag

SEQ ID NO: 4059353 - DNA, 20 bp, Homo sapiens
caccttggctctgccagtgg

SEQ ID NO: 4059354 - DNA, 16 bp, Homo sapiens
caccttggctgggaag

SEQ ID NO: 4059355 - DNA, 17 bp, Homo sapiens
caccttgggctggggga

SEQ ID NO: 4059356 - DNA, 16 bp, Homo sapiens
caccttttctgtggct

SEQ ID NO: 4059357 - DNA, 20 bp, Homo sapiens
caccttttgggaatgtttta

SEQ ID NO: 4059358 - DNA, 19 bp, Homo sapiens
cacgaagccttaagccata

SEQ ID NO: 4059359 - DNA, 18 bp, Homo sapiens
cacgaatttgctggggaa

SEQ ID NO: 4059360 - DNA, 18 bp, Homo sapiens
cacgaccggggccagcac

SEQ ID NO: 4059361 - DNA, 15 bp, Homo sapiens
cacgagagcgcagca

SEQ ID NO: 4059362 - DNA, 22 bp, Homo sapiens
cacgaggaatctgtgggtctgg

SEQ ID NO: 4059363 - DNA, 23 bp, Homo sapiens
cacgaggaatctgtgggtctggg

SEQ ID NO: 4059364 - DNA, 21 bp, Homo sapiens
cacgagggctggctggcctca

SEQ ID NO: 4059365 - DNA, 22 bp, Homo sapiens
cacgagggctggctggcctcac

SEQ ID NO: 4059366 - DNA, 18 bp, Homo sapiens
cacgagtcagtcgccttt

SEQ ID NO: 4059367 - DNA, 16 bp, Homo sapiens
cacgattggagaatac

SEQ ID NO: 4059368 - DNA, 13 bp, Homo sapiens
cacgattggccac

SEQ ID NO: 4059369 - DNA, 17 bp, Homo sapiens
cacgattggccacctgt

SEQ ID NO: 4059370 - DNA, 15 bp, Homo sapiens
cacgcaacttgaaat

SEQ ID NO: 4059371 - DNA, 23 bp, Homo sapiens
cacgcacaaacacacacactatg

SEQ ID NO: 4059372 - DNA, 12 bp, Homo sapiens
cacgcacacaca

SEQ ID NO: 4059373 - DNA, 16 bp, Homo sapiens
cacgcacctgcctcag

SEQ ID NO: 4059374 - DNA, 13 bp, Homo sapiens
cacgcacgcacac

SEQ ID NO: 4059375 - DNA, 15 bp, Homo sapiens
cacgcacgcacacac

SEQ ID NO: 4059376 - DNA, 15 bp, Homo sapiens
cacgcactgggccac

SEQ ID NO: 4059377 - DNA, 20 bp, Homo sapiens
cacgcactgggccacggagg

SEQ ID NO: 4059378 - DNA, 16 bp, Homo sapiens
cacgcaggaactccca

SEQ ID NO: 4059379 - DNA, 20 bp, Homo sapiens
cacgcaggaactcccagcaa

SEQ ID NO: 4059380 - DNA, 13 bp, Homo sapiens
cacgcaggaccag

SEQ ID NO: 4059381 - DNA, 16 bp, Homo sapiens
cacgcaggctgagtcc

SEQ ID NO: 4059382 - DNA, 13 bp, Homo sapiens
cacgcagttcttt

SEQ ID NO: 4059383 - DNA, 21 bp, Homo sapiens
cacgccgggaaccaagcagga

SEQ ID NO: 4059384 - DNA, 15 bp, Homo sapiens
cacgcctcctggcca

SEQ ID NO: 4059385 - DNA, 17 bp, Homo sapiens
cacgcctcctggccaga

SEQ ID NO: 4059386 - DNA, 17 bp, Homo sapiens
cacgcctgtaatcccag

SEQ ID NO: 4059387 - DNA, 19 bp, Homo sapiens
cacgcctgtaatcccagca

SEQ ID NO: 4059388 - DNA, 20 bp, Homo sapiens
cacgcctgtaatcccagcac

SEQ ID NO: 4059389 - DNA, 21 bp, Homo sapiens
cacgcctgtaatcccagcact

SEQ ID NO: 4059390 - DNA, 22 bp, Homo sapiens
cacgcctgtaatcccagcactt

SEQ ID NO: 4059391 - DNA, 17 bp, Homo sapiens
cacgctcacccagtcac

SEQ ID NO: 4059392 - DNA, 16 bp, Homo sapiens
cacgctggggctctct

SEQ ID NO: 4059393 - DNA, 20 bp, Homo sapiens
cacgctggggctctctgaga

SEQ ID NO: 4059394 - DNA, 13 bp, Homo sapiens
cacgctgtcctct

SEQ ID NO: 4059395 - DNA, 22 bp, Homo sapiens
cacgctgtcctctcgagcccag

SEQ ID NO: 4059396 - DNA, 20 bp, Homo sapiens
cacgctgtggccctggaggg

SEQ ID NO: 4059397 - DNA, 15 bp, Homo sapiens
cacgctttgctgcta

SEQ ID NO: 4059398 - DNA, 19 bp, Homo sapiens
cacgcttttaattctcatt

SEQ ID NO: 4059399 - DNA, 21 bp, Homo sapiens
cacgcttttaattctcatttg

SEQ ID NO: 4059400 - DNA, 18 bp, Homo sapiens
cacggaggagggatgctg

SEQ ID NO: 4059401 - DNA, 22 bp, Homo sapiens
cacggaggagggatgctgctcc

SEQ ID NO: 4059402 - DNA, 16 bp, Homo sapiens
cacggccacccgcccc

SEQ ID NO: 4059403 - DNA, 14 bp, Homo sapiens
cacggcctcctttc

SEQ ID NO: 4059404 - DNA, 15 bp, Homo sapiens
cacggcgttgtacct

SEQ ID NO: 4059405 - DNA, 17 bp, Homo sapiens
cacggcgtttttttaca

SEQ ID NO: 4059406 - DNA, 13 bp, Homo sapiens
cacggctgagcct

SEQ ID NO: 4059407 - DNA, 20 bp, Homo sapiens
cacggctgcctgacactgag

SEQ ID NO: 4059408 - DNA, 23 bp, Homo sapiens
cacggctgcctgacactgagccc

SEQ ID NO: 4059409 - DNA, 16 bp, Homo sapiens
cacgtacttaaatgaa

SEQ ID NO: 4059410 - DNA, 14 bp, Homo sapiens
cacgtcccagcatc

SEQ ID NO: 4059411 - DNA, 20 bp, Homo sapiens
cacgtcccagcatccctgga

SEQ ID NO: 4059412 - DNA, 19 bp, Homo sapiens
cacgtcttcttgctgcagc

SEQ ID NO: 4059413 - DNA, 16 bp, Homo sapiens
cacgtgcaaggactcc

SEQ ID NO: 4059414 - DNA, 15 bp, Homo sapiens
cacgttcataaccaa

SEQ ID NO: 4059415 - DNA, 20 bp, Homo sapiens
cactaaagccagcctgacct

SEQ ID NO: 4059416 - DNA, 13 bp, Homo sapiens
cactaaagcttca

SEQ ID NO: 4059417 - DNA, 19 bp, Homo sapiens
cactaagagggcagactgt

SEQ ID NO: 4059418 - DNA, 17 bp, Homo sapiens
cactacataaactgact

SEQ ID NO: 4059419 - DNA, 21 bp, Homo sapiens
cactacatgcagcccatgccc

SEQ ID NO: 4059420 - DNA, 19 bp, Homo sapiens
cactgcagcctcatactcc

SEQ ID NO: 4059421 - DNA, 18 bp, Homo sapiens
cactgcagtcttatttcc

SEQ ID NO: 4059422 - DNA, 12 bp, Homo sapiens
cactgccaggcc

SEQ ID NO: 4059423 - DNA, 14 bp, Homo sapiens
cactgccaggccag

SEQ ID NO: 4059424 - DNA, 19 bp, Homo sapiens
cactgccaggccagcctcc

SEQ ID NO: 4059425 - DNA, 21 bp, Homo sapiens
cactgccaggccagcctccga

SEQ ID NO: 4059426 - DNA, 17 bp, Homo sapiens
cactgccatctgatgcc

SEQ ID NO: 4059427 - DNA, 18 bp, Homo sapiens
cactgcccatggacaggc

SEQ ID NO: 4059428 - DNA, 21 bp, Homo sapiens
cactgccctgttcatgtgcct

SEQ ID NO: 4059429 - DNA, 18 bp, Homo sapiens
cactgcccttttcaggaa

SEQ ID NO: 4059430 - DNA, 13 bp, Homo sapiens
cactgcctgcacc

SEQ ID NO: 4059431 - DNA, 21 bp, Homo sapiens
cactgctaggcgagtgccagg

SEQ ID NO: 4059432 - DNA, 22 bp, Homo sapiens
cactgctaggcgagtgccagga

SEQ ID NO: 4059433 - DNA, 15 bp, Homo sapiens
cactgctggctgcct

SEQ ID NO: 4059434 - DNA, 14 bp, Homo sapiens
cactgctggtgcca

SEQ ID NO: 4059435 - DNA, 18 bp, Homo sapiens
cactgctggtgccagggt

SEQ ID NO: 4059436 - DNA, 22 bp, Homo sapiens
cactgctggtgccagggtgggt

SEQ ID NO: 4059437 - DNA, 16 bp, Homo sapiens
cactgctgtacccaga

SEQ ID NO: 4059438 - DNA, 23 bp, Homo sapiens
cactgcttgatgaagcaaggaag

SEQ ID NO: 4059439 - DNA, 16 bp, Homo sapiens
cactggaaaggggaga

SEQ ID NO: 4059440 - DNA, 19 bp, Homo sapiens
cactggaaaggggagagcc

SEQ ID NO: 4059441 - DNA, 24 bp, Homo sapiens
cactggaaaggggagagcctgctg

SEQ ID NO: 4059442 - DNA, 14 bp, Homo sapiens
cactggaaggaaca

SEQ ID NO: 4059443 - DNA, 12 bp, Homo sapiens
cactggagcatg

SEQ ID NO: 4059444 - DNA, 18 bp, Homo sapiens
cactggaggttgaagcca

SEQ ID NO: 4059445 - DNA, 18 bp, Homo sapiens
cactggagtgcagggagg

SEQ ID NO: 4059446 - DNA, 13 bp, Homo sapiens
cactggcccctca

SEQ ID NO: 4059447 - DNA, 11 bp, Homo sapiens
cactggctggc

SEQ ID NO: 4059448 - DNA, 18 bp, Homo sapiens
cactggctggcctgagca

SEQ ID NO: 4059449 - DNA, 14 bp, Homo sapiens
cactggctggctcc

SEQ ID NO: 4059450 - DNA, 19 bp, Homo sapiens
cactggctggctcctaggg

SEQ ID NO: 4059451 - DNA, 18 bp, Homo sapiens
cactgggccacggaggag

SEQ ID NO: 4059452 - DNA, 15 bp, Homo sapiens
cactgggccagccct

SEQ ID NO: 4059453 - DNA, 18 bp, Homo sapiens
cactggggactttattta

SEQ ID NO: 4059454 - DNA, 16 bp, Homo sapiens
cactggggcctacagc

SEQ ID NO: 4059455 - DNA, 20 bp, Homo sapiens
cactgggggaacagatgcta

SEQ ID NO: 4059456 - DNA, 15 bp, Homo sapiens
cactgggtggggtga

SEQ ID NO: 4059457 - DNA, 19 bp, Homo sapiens
cactgggtggggtgaggac

SEQ ID NO: 4059458 - DNA, 23 bp, Homo sapiens
cactgggtgttgatcttacaaga

SEQ ID NO: 4059459 - DNA, 21 bp, Homo sapiens
cactggtacttagagtttctg

SEQ ID NO: 4059460 - DNA, 22 bp, Homo sapiens
cactggtgactgcgatcttcag

SEQ ID NO: 4059461 - DNA, 20 bp, Homo sapiens
cactggtgccaaaaccaggc

SEQ ID NO: 4059462 - DNA, 21 bp, Homo sapiens
cactggtggcccgacagcctg

SEQ ID NO: 4059463 - DNA, 23 bp, Homo sapiens
cactggtggcccgacagcctggc

SEQ ID NO: 4059464 - DNA, 18 bp, Homo sapiens
cactggtttgttccctgt

SEQ ID NO: 4059465 - DNA, 18 bp, Homo sapiens
cactgtaaaatgaaatta

SEQ ID NO: 4059466 - DNA, 13 bp, Homo sapiens
cactgtataaata

SEQ ID NO: 4059467 - DNA, 22 bp, Homo sapiens
cactgtatttttttattcgcca

SEQ ID NO: 4059468 - DNA, 19 bp, Homo sapiens
cactgtcactgtttctctg

SEQ ID NO: 4059469 - DNA, 22 bp, Homo sapiens
cactgtcactgtttctctgctg

SEQ ID NO: 4059470 - DNA, 16 bp, Homo sapiens
cactgtcactttgctc

SEQ ID NO: 4059471 - DNA, 19 bp, Homo sapiens
cactgtccccctacccacc

SEQ ID NO: 4059472 - DNA, 13 bp, Homo sapiens
cactgtccctctt

SEQ ID NO: 4059473 - DNA, 18 bp, Homo sapiens
cactgtcccttgcctcaa

SEQ ID NO: 4059474 - DNA, 13 bp, Homo sapiens
cactgtctgtctg

SEQ ID NO: 4059475 - DNA, 20 bp, Homo sapiens
cactgtgaagacccagcagg

SEQ ID NO: 4059476 - DNA, 14 bp, Homo sapiens
cactgtgaccccca

SEQ ID NO: 4059477 - DNA, 20 bp, Homo sapiens
cactgtgacccccagctccg

SEQ ID NO: 4059478 - DNA, 17 bp, Homo sapiens
cactgtgcactgccctg

SEQ ID NO: 4059479 - DNA, 17 bp, Homo sapiens
cactgtgcccagcccgg

SEQ ID NO: 4059480 - DNA, 22 bp, Homo sapiens
cactgtgcccagcccggacctt

SEQ ID NO: 4059481 - DNA, 22 bp, Homo sapiens
cactgtgcgtcttggtgtaatt

SEQ ID NO: 4059482 - DNA, 23 bp, Homo sapiens
cactgtggccagtaaaatactat

SEQ ID NO: 4059483 - DNA, 15 bp, Homo sapiens
cactgttatcaaaac

SEQ ID NO: 4059484 - DNA, 12 bp, Homo sapiens
cactgtttctct

SEQ ID NO: 4059485 - DNA, 23 bp, Homo sapiens
cacttaaccaagacaaaaagcca

SEQ ID NO: 4059486 - DNA, 21 bp, Homo sapiens
cacttaagttagcctccacca

SEQ ID NO: 4059487 - DNA, 16 bp, Homo sapiens
cacttacactttatgc

SEQ ID NO: 4059488 - DNA, 19 bp, Homo sapiens
cacttactggtccttacca

SEQ ID NO: 4059489 - DNA, 21 bp, Homo sapiens
cacttagctggagatgtctct

SEQ ID NO: 4059490 - DNA, 12 bp, Homo sapiens
cacttagtcctt

SEQ ID NO: 4059491 - DNA, 12 bp, Homo sapiens
cacttatttcac

SEQ ID NO: 4059492 - DNA, 21 bp, Homo sapiens
cacttatttcactatcttctt

SEQ ID NO: 4059493 - DNA, 15 bp, Homo sapiens
cacttcaatgcacat

SEQ ID NO: 4059494 - DNA, 16 bp, Homo sapiens
cacttcaggctcttct

SEQ ID NO: 4059495 - DNA, 16 bp, Homo sapiens
cacttccctacatgga

SEQ ID NO: 4059496 - DNA, 17 bp, Homo sapiens
cacttccgtcacatccc

SEQ ID NO: 4059497 - DNA, 17 bp, Homo sapiens
cacttcctacaagagca

SEQ ID NO: 4059498 - DNA, 15 bp, Homo sapiens
cacttcctgctacag

SEQ ID NO: 4059499 - DNA, 16 bp, Homo sapiens
cacttcctgctacagg

SEQ ID NO: 4059500 - DNA, 17 bp, Homo sapiens
cacttcctgctacagga

SEQ ID NO: 4059501 - DNA, 21 bp, Homo sapiens
cacttcgcgtgccctcgctgc

SEQ ID NO: 4059502 - DNA, 16 bp, Homo sapiens
cacttctccccagaaa

SEQ ID NO: 4059503 - DNA, 12 bp, Homo sapiens
cacttcttcctt

SEQ ID NO: 4059504 - DNA, 14 bp, Homo sapiens
cacttcttctgtcc

SEQ ID NO: 4059505 - DNA, 20 bp, Homo sapiens
cacttcttctgtccaagcag

SEQ ID NO: 4059506 - DNA, 21 bp, Homo sapiens
cacttctttcccttcctccat

SEQ ID NO: 4059507 - DNA, 12 bp, Homo sapiens
cacttgaaagat

SEQ ID NO: 4059508 - DNA, 16 bp, Homo sapiens
cacttgacctcatctc

SEQ ID NO: 4059509 - DNA, 11 bp, Homo sapiens
cacttgagttt

SEQ ID NO: 4059510 - DNA, 23 bp, Homo sapiens
cacttgatgatacaatgaacact

SEQ ID NO: 4059511 - DNA, 15 bp, Homo sapiens
cacttgctggggctc

SEQ ID NO: 4059512 - DNA, 20 bp, Homo sapiens
cacttgggggttcaggcccg

SEQ ID NO: 4059513 - DNA, 14 bp, Homo sapiens
cacttgtagagcag

SEQ ID NO: 4059514 - DNA, 14 bp, Homo sapiens
cacttgtaggataa

SEQ ID NO: 4059515 - DNA, 23 bp, Homo sapiens
cacttgtaggataagtgaaatgg

SEQ ID NO: 4059516 - DNA, 15 bp, Homo sapiens
cacttgtgtgtgggc

SEQ ID NO: 4059517 - DNA, 17 bp, Homo sapiens
cacttgtgtgtgggctg

SEQ ID NO: 4059518 - DNA, 22 bp, Homo sapiens
cacttgtgtgtgggctgtgagt

SEQ ID NO: 4059519 - DNA, 13 bp, Homo sapiens
cacttgttccagc

SEQ ID NO: 4059520 - DNA, 16 bp, Homo sapiens
cacttgttccagctct

SEQ ID NO: 4059521 - DNA, 20 bp, Homo sapiens
cactttaatggcctggaggg

SEQ ID NO: 4059522 - DNA, 17 bp, Homo sapiens
cagaatctcaaataact

SEQ ID NO: 4059523 - DNA, 18 bp, Homo sapiens
cagaatctcaaataacta

SEQ ID NO: 4059524 - DNA, 17 bp, Homo sapiens
cagaatcttgactttct

SEQ ID NO: 4059525 - DNA, 19 bp, Homo sapiens
cagaatggtgatcactcca

SEQ ID NO: 4059526 - DNA, 15 bp, Homo sapiens
cagaattccttttct

SEQ ID NO: 4059527 - DNA, 17 bp, Homo sapiens
cagaattttaatgtgaa

SEQ ID NO: 4059528 - DNA, 18 bp, Homo sapiens
cagaattttaatgtgaag

SEQ ID NO: 4059529 - DNA, 19 bp, Homo sapiens
cagaattttaatgtgaaga

SEQ ID NO: 4059530 - DNA, 23 bp, Homo sapiens
cagaattttaatgtgaagacatt

SEQ ID NO: 4059531 - DNA, 16 bp, Homo sapiens
cagaattttggaagat

SEQ ID NO: 4059532 - DNA, 19 bp, Homo sapiens
cagacaaaaaaatttaaaa

SEQ ID NO: 4059533 - DNA, 21 bp, Homo sapiens
cagacaaaacaatccccatca

SEQ ID NO: 4059534 - DNA, 22 bp, Homo sapiens
cagacaaaacaatccccatcag

SEQ ID NO: 4059535 - DNA, 13 bp, Homo sapiens
cagacaacagaag

SEQ ID NO: 4059536 - DNA, 14 bp, Homo sapiens
cagacaacagaagt

SEQ ID NO: 4059537 - DNA, 16 bp, Homo sapiens
cagacaacagaagtca

SEQ ID NO: 4059538 - DNA, 22 bp, Homo sapiens
cagacaacagaagtcatgaagc

SEQ ID NO: 4059539 - DNA, 23 bp, Homo sapiens
cagacaagcaacaggttttataa

SEQ ID NO: 4059540 - DNA, 19 bp, Homo sapiens
cagacaagctgttgaccag

SEQ ID NO: 4059541 - DNA, 15 bp, Homo sapiens
cagacaaggttctgc

SEQ ID NO: 4059542 - DNA, 16 bp, Homo sapiens
cagacacaatatgtat

SEQ ID NO: 4059543 - DNA, 17 bp, Homo sapiens
cagacacaatatgtatg

SEQ ID NO: 4059544 - DNA, 19 bp, Homo sapiens
cagacacaatatgtatgct

SEQ ID NO: 4059545 - DNA, 13 bp, Homo sapiens
cagacacacacac

SEQ ID NO: 4059546 - DNA, 16 bp, Homo sapiens
cagacacacacacgca

SEQ ID NO: 4059547 - DNA, 21 bp, Homo sapiens
cagacaccctcaacctcttct

SEQ ID NO: 4059548 - DNA, 18 bp, Homo sapiens
cagacacgccttcccctc

SEQ ID NO: 4059549 - DNA, 19 bp, Homo sapiens
cagacacgctcgcgggcag

SEQ ID NO: 4059550 - DNA, 20 bp, Homo sapiens
cagacacgctcgcgggcagc

SEQ ID NO: 4059551 - DNA, 18 bp, Homo sapiens
cagacacttaactcaatt

SEQ ID NO: 4059552 - DNA, 14 bp, Homo sapiens
cagacagaaactgg

SEQ ID NO: 4059553 - DNA, 20 bp, Homo sapiens
cagacagaacttgaatgtgt

SEQ ID NO: 4059554 - DNA, 13 bp, Homo sapiens
cagacagaagtct

SEQ ID NO: 4059555 - DNA, 18 bp, Homo sapiens
cagacagaagtctcctca

SEQ ID NO: 4059556 - DNA, 16 bp, Homo sapiens
cagacagacacacaca

SEQ ID NO: 4059557 - DNA, 13 bp, Homo sapiens
cagacagatccca

SEQ ID NO: 4059558 - DNA, 19 bp, Homo sapiens
cagacagcaggcagcgcca

SEQ ID NO: 4059559 - DNA, 19 bp, Homo sapiens
cagacagccgtttgttcta

SEQ ID NO: 4059560 - DNA, 20 bp, Homo sapiens
cagacaggccatgtgagcca

SEQ ID NO: 4059561 - DNA, 21 bp, Homo sapiens
cagacaggccatgtgagccac

SEQ ID NO: 4059562 - DNA, 15 bp, Homo sapiens
cagacaggccccgtg

SEQ ID NO: 4059563 - DNA, 18 bp, Homo sapiens
cagacatatgggatattc

SEQ ID NO: 4059564 - DNA, 17 bp, Homo sapiens
cagacatctctgcaccc

SEQ ID NO: 4059565 - DNA, 18 bp, Homo sapiens
cagacatgccacaaggac

SEQ ID NO: 4059566 - DNA, 12 bp, Homo sapiens
cagacatgtttt

SEQ ID NO: 4059567 - DNA, 22 bp, Homo sapiens
cagacatgttttccgtgaaaac

SEQ ID NO: 4059568 - DNA, 14 bp, Homo sapiens
cagacattggcacc

SEQ ID NO: 4059569 - DNA, 16 bp, Homo sapiens
cagaccacattgcttt

SEQ ID NO: 4059570 - DNA, 19 bp, Homo sapiens
cagaccaccccgcctgccc

SEQ ID NO: 4059571 - DNA, 16 bp, Homo sapiens
cagaccacctgcttct

SEQ ID NO: 4059572 - DNA, 18 bp, Homo sapiens
cagaccacctgcttctga

SEQ ID NO: 4059573 - DNA, 14 bp, Homo sapiens
cagaccacttgcca

SEQ ID NO: 4059574 - DNA, 17 bp, Homo sapiens
cagaccagagctgtctg

SEQ ID NO: 4059575 - DNA, 17 bp, Homo sapiens
cagaccagtgaccccag

SEQ ID NO: 4059576 - DNA, 22 bp, Homo sapiens
cagaccatgaagtaaattatgt

SEQ ID NO: 4059577 - DNA, 13 bp, Homo sapiens
cagaccccagggc

SEQ ID NO: 4059578 - DNA, 17 bp, Homo sapiens
cagacccctctggccag

SEQ ID NO: 4059579 - DNA, 12 bp, Homo sapiens
cagacccctgcc

SEQ ID NO: 4059580 - DNA, 13 bp, Homo sapiens
cagacccctggct

SEQ ID NO: 4059581 - DNA, 14 bp, Homo sapiens
cagacccctggctt

SEQ ID NO: 4059582 - DNA, 22 bp, Homo sapiens
cagacccctggcttttcactgc

SEQ ID NO: 4059583 - DNA, 22 bp, Homo sapiens
cagacccctttgagagacgcca

SEQ ID NO: 4059584 - DNA, 14 bp, Homo sapiens
cagaccctggagga

SEQ ID NO: 4059585 - DNA, 22 bp, Homo sapiens
cagacccttcttgcctgctggg

SEQ ID NO: 4059586 - DNA, 23 bp, Homo sapiens
cagacccttcttgcctgctgggc

SEQ ID NO: 4059587 - DNA, 17 bp, Homo sapiens
cagacctagcaggctgt

SEQ ID NO: 4059588 - DNA, 20 bp, Homo sapiens
cagacctagcaggctgttcc

SEQ ID NO: 4059589 - DNA, 14 bp, Homo sapiens
cagacctgtcttcc

SEQ ID NO: 4059590 - DNA, 16 bp, Homo sapiens
cagacctgtcttccaa

SEQ ID NO: 4059591 - DNA, 19 bp, Homo sapiens
cagacctgtcttccaagga

SEQ ID NO: 4059592 - DNA, 23 bp, Homo sapiens
cagacgccggggacagaggcctg

SEQ ID NO: 4059593 - DNA, 14 bp, Homo sapiens
cagacggcggccag

SEQ ID NO: 4059594 - DNA, 17 bp, Homo sapiens
cagacggcggccaggca

SEQ ID NO: 4059595 - DNA, 18 bp, Homo sapiens
cagacggcggccaggcac

SEQ ID NO: 4059596 - DNA, 18 bp, Homo sapiens
cagacgggcacagacacg

SEQ ID NO: 4059597 - DNA, 16 bp, Homo sapiens
cagacgttgcctgaga

SEQ ID NO: 4059598 - DNA, 20 bp, Homo sapiens
cagactaaaggatccagaga

SEQ ID NO: 4059599 - DNA, 16 bp, Homo sapiens
cagactacacaggatg

SEQ ID NO: 4059600 - DNA, 19 bp, Homo sapiens
cagactactattttctttt

SEQ ID NO: 4059601 - DNA, 16 bp, Homo sapiens
cagactcagtttgtca

SEQ ID NO: 4059602 - DNA, 22 bp, Homo sapiens
cagactccatctcttctgcaag

SEQ ID NO: 4059603 - DNA, 18 bp, Homo sapiens
cagactcccattcctgaa

SEQ ID NO: 4059604 - DNA, 18 bp, Homo sapiens
cagactccgccctcctcg

SEQ ID NO: 4059605 - DNA, 18 bp, Homo sapiens
cagactctgagctgctca

SEQ ID NO: 4059606 - DNA, 24 bp, Homo sapiens
cagactgttagaaaatggacactg

SEQ ID NO: 4059607 - DNA, 14 bp, Homo sapiens
cagacttaccagga

SEQ ID NO: 4059608 - DNA, 20 bp, Homo sapiens
cagacttcccagctaggaag

SEQ ID NO: 4059609 - DNA, 13 bp, Homo sapiens
cagacttgagaac

SEQ ID NO: 4059610 - DNA, 18 bp, Homo sapiens
cagacttgcccaggtcac

SEQ ID NO: 4059611 - DNA, 15 bp, Homo sapiens
cagactttaaagaat

SEQ ID NO: 4059612 - DNA, 20 bp, Homo sapiens
cagagaaaaatgctccccac

SEQ ID NO: 4059613 - DNA, 23 bp, Homo sapiens
cagagaaaaatgctccccacagc

SEQ ID NO: 4059614 - DNA, 19 bp, Homo sapiens
cagagaaacttaagcaaag

SEQ ID NO: 4059615 - DNA, 20 bp, Homo sapiens
cagagaaacttaagcaaagg

SEQ ID NO: 4059616 - DNA, 22 bp, Homo sapiens
cagagaaagaagagacaggagg

SEQ ID NO: 4059617 - DNA, 18 bp, Homo sapiens
cagagaaaggggagccca

SEQ ID NO: 4059618 - DNA, 11 bp, Homo sapiens
cagagaacagc

SEQ ID NO: 4059619 - DNA, 14 bp, Homo sapiens
cagagaagctggac

SEQ ID NO: 4059620 - DNA, 18 bp, Homo sapiens
cagagaagctggacttct

SEQ ID NO: 4059621 - DNA, 22 bp, Homo sapiens
cagagaaggaaaagactgaatc

SEQ ID NO: 4059622 - DNA, 11 bp, Homo sapiens
cagagaatata

SEQ ID NO: 4059623 - DNA, 22 bp, Homo sapiens
cagagacaggaagtcttcaggg

SEQ ID NO: 4059624 - DNA, 17 bp, Homo sapiens
cagattttgctgtatat

SEQ ID NO: 4059625 - DNA, 11 bp, Homo sapiens
cagcaaaccat

SEQ ID NO: 4059626 - DNA, 16 bp, Homo sapiens
cagcaacacaagctgg

SEQ ID NO: 4059627 - DNA, 17 bp, Homo sapiens
cagcaacacaagctgga

SEQ ID NO: 4059628 - DNA, 12 bp, Homo sapiens
cagcaaccccag

SEQ ID NO: 4059629 - DNA, 13 bp, Homo sapiens
cagcaaccccagg

SEQ ID NO: 4059630 - DNA, 18 bp, Homo sapiens
cagcaacgcccctccaaa

SEQ ID NO: 4059631 - DNA, 17 bp, Homo sapiens
cagcaacgcttgtagaa

SEQ ID NO: 4059632 - DNA, 18 bp, Homo sapiens
cagcaacgcttgtagaac

SEQ ID NO: 4059633 - DNA, 15 bp, Homo sapiens
cagcaacttgtcttt

SEQ ID NO: 4059634 - DNA, 18 bp, Homo sapiens
cagcaacttgtctttttc

SEQ ID NO: 4059635 - DNA, 19 bp, Homo sapiens
cagcaacttgtctttttct

SEQ ID NO: 4059636 - DNA, 20 bp, Homo sapiens
cagcaacttgtctttttctg

SEQ ID NO: 4059637 - DNA, 21 bp, Homo sapiens
cagcaagccctacagagctgt

SEQ ID NO: 4059638 - DNA, 20 bp, Homo sapiens
cagcaagcgggagcccgtgg

SEQ ID NO: 4059639 - DNA, 14 bp, Homo sapiens
cagcaaggcaggtt

SEQ ID NO: 4059640 - DNA, 12 bp, Homo sapiens
cagcaaggccct

SEQ ID NO: 4059641 - DNA, 15 bp, Homo sapiens
cagcaaggtcttgct

SEQ ID NO: 4059642 - DNA, 18 bp, Homo sapiens
cagcaaggtcttgctctc

SEQ ID NO: 4059643 - DNA, 19 bp, Homo sapiens
cagcaagtacagcggctcc

SEQ ID NO: 4059644 - DNA, 23 bp, Homo sapiens
cagcaagtacagcggctcccctc

SEQ ID NO: 4059645 - DNA, 18 bp, Homo sapiens
cagcaatgacatctcagg

SEQ ID NO: 4059646 - DNA, 21 bp, Homo sapiens
cagcaatgacatctcaggggc

SEQ ID NO: 4059647 - DNA, 20 bp, Homo sapiens
cagcaatgatgtccagaaga

SEQ ID NO: 4059648 - DNA, 13 bp, Homo sapiens
cagcacaaggcca

SEQ ID NO: 4059649 - DNA, 15 bp, Homo sapiens
cagcacacagggcag

SEQ ID NO: 4059650 - DNA, 12 bp, Homo sapiens
cagcacagagcg

SEQ ID NO: 4059651 - DNA, 13 bp, Homo sapiens
cagcacagccaac

SEQ ID NO: 4059652 - DNA, 14 bp, Homo sapiens
cagcacagcctggg

SEQ ID NO: 4059653 - DNA, 17 bp, Homo sapiens
cagcacagcttagattt

SEQ ID NO: 4059654 - DNA, 19 bp, Homo sapiens
cagcaccaccctccttccc

SEQ ID NO: 4059655 - DNA, 13 bp, Homo sapiens
cagcacccccacc

SEQ ID NO: 4059656 - DNA, 15 bp, Homo sapiens
cagcacccccaccca

SEQ ID NO: 4059657 - DNA, 11 bp, Homo sapiens
cagcaccctcc

SEQ ID NO: 4059658 - DNA, 12 bp, Homo sapiens
cagcaccctccc

SEQ ID NO: 4059659 - DNA, 19 bp, Homo sapiens
cagcaccctcccccgcagc

SEQ ID NO: 4059660 - DNA, 18 bp, Homo sapiens
cagcaccctctcctgggg

SEQ ID NO: 4059661 - DNA, 23 bp, Homo sapiens
cagcacctgtaagaaacagagca

SEQ ID NO: 4059662 - DNA, 16 bp, Homo sapiens
cagcacgtctcagaga

SEQ ID NO: 4059663 - DNA, 22 bp, Homo sapiens
cagcactaaggccgtgtctctg

SEQ ID NO: 4059664 - DNA, 15 bp, Homo sapiens
cagcactactgggtg

SEQ ID NO: 4059665 - DNA, 21 bp, Homo sapiens
cagcactctctaaatcttcct

SEQ ID NO: 4059666 - DNA, 22 bp, Homo sapiens
cagcactctctaaatcttcctt

SEQ ID NO: 4059667 - DNA, 14 bp, Homo sapiens
cagcactgtccctt

SEQ ID NO: 4059668 - DNA, 16 bp, Homo sapiens
cagcactgtcccttgc

SEQ ID NO: 4059669 - DNA, 14 bp, Homo sapiens
cagcactgtctcag

SEQ ID NO: 4059670 - DNA, 12 bp, Homo sapiens
cagcacttccat

SEQ ID NO: 4059671 - DNA, 15 bp, Homo sapiens
cagcactttgggagg

SEQ ID NO: 4059672 - DNA, 18 bp, Homo sapiens
cagcactttgggaggcct

SEQ ID NO: 4059673 - DNA, 19 bp, Homo sapiens
cagcactttgggaggctga

SEQ ID NO: 4059674 - DNA, 15 bp, Homo sapiens
cagcagaagcctcca

SEQ ID NO: 4059675 - DNA, 23 bp, Homo sapiens
cagcagaagcctccaagcacaga

SEQ ID NO: 4059676 - DNA, 23 bp, Homo sapiens
cagcagaattgaccgacagcttt

SEQ ID NO: 4059677 - DNA, 13 bp, Homo sapiens
cagcagacacaca

SEQ ID NO: 4059678 - DNA, 23 bp, Homo sapiens
cagcagacacacatgggcagccc

SEQ ID NO: 4059679 - DNA, 16 bp, Homo sapiens
cagcagaggcaggctg

SEQ ID NO: 4059680 - DNA, 23 bp, Homo sapiens
cagcagagggggagtagccaagc

SEQ ID NO: 4059681 - DNA, 18 bp, Homo sapiens
cagcagcaccaaccacag

SEQ ID NO: 4059682 - DNA, 19 bp, Homo sapiens
cagcagcaccaaccacagc

SEQ ID NO: 4059683 - DNA, 16 bp, Homo sapiens
cagcagccccccagca

SEQ ID NO: 4059684 - DNA, 22 bp, Homo sapiens
cagcagccctcaacaggcccag

SEQ ID NO: 4059685 - DNA, 21 bp, Homo sapiens
cagcagccgccttaagctgat

SEQ ID NO: 4059686 - DNA, 17 bp, Homo sapiens
cagcagcttttaataca

SEQ ID NO: 4059687 - DNA, 13 bp, Homo sapiens
cagcaggaagcca

SEQ ID NO: 4059688 - DNA, 21 bp, Homo sapiens
cagcaggagtggtgcagacag

SEQ ID NO: 4059689 - DNA, 22 bp, Homo sapiens
cagcaggagtggtgcagacaga

SEQ ID NO: 4059690 - DNA, 11 bp, Homo sapiens
cagcagggcag

SEQ ID NO: 4059691 - DNA, 21 bp, Homo sapiens
cagcagggcatcttggaaaag

SEQ ID NO: 4059692 - DNA, 22 bp, Homo sapiens
cagcaggtcctccatcccaaca

SEQ ID NO: 4059693 - DNA, 21 bp, Homo sapiens
cagcagtcccagtattctcag

SEQ ID NO: 4059694 - DNA, 17 bp, Homo sapiens
cagcagtcttatgcttc

SEQ ID NO: 4059695 - DNA, 22 bp, Homo sapiens
cagcagtcttatgcttccagaa

SEQ ID NO: 4059696 - DNA, 19 bp, Homo sapiens
cagcagtgatctcagggca

SEQ ID NO: 4059697 - DNA, 21 bp, Homo sapiens
cagcagtgtgaatagcctggc

SEQ ID NO: 4059698 - DNA, 22 bp, Homo sapiens
cagcagtgtgaatagcctggcc

SEQ ID NO: 4059699 - DNA, 17 bp, Homo sapiens
cagcagtgtggagaccc

SEQ ID NO: 4059700 - DNA, 18 bp, Homo sapiens
cagcagtgtggagaccct

SEQ ID NO: 4059701 - DNA, 12 bp, Homo sapiens
cagcagtgttcc

SEQ ID NO: 4059702 - DNA, 22 bp, Homo sapiens
cagcagtgttccccatctgggt

SEQ ID NO: 4059703 - DNA, 14 bp, Homo sapiens
cagcagtgttctca

SEQ ID NO: 4059704 - DNA, 17 bp, Homo sapiens
cagcagtgttctcacag

SEQ ID NO: 4059705 - DNA, 19 bp, Homo sapiens
cagcagtgttctcacagtg

SEQ ID NO: 4059706 - DNA, 15 bp, Homo sapiens
cagcagtgttgctca

SEQ ID NO: 4059707 - DNA, 16 bp, Homo sapiens
cagcagtgttgctcag

SEQ ID NO: 4059708 - DNA, 21 bp, Homo sapiens
cagcagtgttgctcagctcct

SEQ ID NO: 4059709 - DNA, 12 bp, Homo sapiens
cagcatatttat

SEQ ID NO: 4059710 - DNA, 14 bp, Homo sapiens
cagcatatttatag

SEQ ID NO: 4059711 - DNA, 13 bp, Homo sapiens
cagcatcactccc

SEQ ID NO: 4059712 - DNA, 23 bp, Homo sapiens
cagcatcattttgcattcaaatt

SEQ ID NO: 4059713 - DNA, 12 bp, Homo sapiens
cagcatccctgg

SEQ ID NO: 4059714 - DNA, 16 bp, Homo sapiens
cagcatccctggagca

SEQ ID NO: 4059715 - DNA, 19 bp, Homo sapiens
cagcatccctggagcagga

SEQ ID NO: 4059716 - DNA, 16 bp, Homo sapiens
cagcatcccttcccac

SEQ ID NO: 4059717 - DNA, 20 bp, Homo sapiens
cagcatcgggagcacccaga

SEQ ID NO: 4059718 - DNA, 22 bp, Homo sapiens
cagcatcgggagcacccagagc

SEQ ID NO: 4059719 - DNA, 24 bp, Homo sapiens
cagcatcgggagcacccagagcac

SEQ ID NO: 4059720 - DNA, 13 bp, Homo sapiens
cagcatctggctg

SEQ ID NO: 4059721 - DNA, 14 bp, Homo sapiens
cagcatctggctgt

SEQ ID NO: 4059722 - DNA, 15 bp, Homo sapiens
cagcatctggctgtc

SEQ ID NO: 4059723 - DNA, 22 bp, Homo sapiens
cagcatctggctgtctagaatg

SEQ ID NO: 4059724 - DNA, 18 bp, Homo sapiens
cagcatgaggtgttgtgc

SEQ ID NO: 4059725 - DNA, 22 bp, Homo sapiens
cagcatgaggtgttgtgcattt

SEQ ID NO: 4059726 - DNA, 13 bp, Homo sapiens
cagcccttgggca

SEQ ID NO: 4059727 - DNA, 15 bp, Homo sapiens
cagcccttgggcagt

SEQ ID NO: 4059728 - DNA, 14 bp, Homo sapiens
cagccgagccgggc

SEQ ID NO: 4059729 - DNA, 18 bp, Homo sapiens
cagccgccagctgggagc

SEQ ID NO: 4059730 - DNA, 19 bp, Homo sapiens
cagccgccattgccaccag

SEQ ID NO: 4059731 - DNA, 21 bp, Homo sapiens
cagccgccattgccaccagga

SEQ ID NO: 4059732 - DNA, 22 bp, Homo sapiens
cagccgccattgccaccaggag

SEQ ID NO: 4059733 - DNA, 13 bp, Homo sapiens
cagccgccccagc

SEQ ID NO: 4059734 - DNA, 18 bp, Homo sapiens
cagccgccccagcccctt

SEQ ID NO: 4059735 - DNA, 15 bp, Homo sapiens
cagccgccctgggct

SEQ ID NO: 4059736 - DNA, 14 bp, Homo sapiens
cagccgcttctgac

SEQ ID NO: 4059737 - DNA, 18 bp, Homo sapiens
cagccgcttctgactgct

SEQ ID NO: 4059738 - DNA, 17 bp, Homo sapiens
cagccggcacagggtct

SEQ ID NO: 4059739 - DNA, 18 bp, Homo sapiens
cagccggcacagggtctg

SEQ ID NO: 4059740 - DNA, 15 bp, Homo sapiens
cagccgtccttctaa

SEQ ID NO: 4059741 - DNA, 16 bp, Homo sapiens
cagccgtcgtctccct

SEQ ID NO: 4059742 - DNA, 16 bp, Homo sapiens
cagccgtgatgctcag

SEQ ID NO: 4059743 - DNA, 14 bp, Homo sapiens
cagccgtgccttca

SEQ ID NO: 4059744 - DNA, 20 bp, Homo sapiens
cagcctaaagtacagcctgg

SEQ ID NO: 4059745 - DNA, 21 bp, Homo sapiens
cagcctaaagtacagcctgga

SEQ ID NO: 4059746 - DNA, 21 bp, Homo sapiens
cagcctatgggggctctcgga

SEQ ID NO: 4059747 - DNA, 15 bp, Homo sapiens
cagcctcagagtggt

SEQ ID NO: 4059748 - DNA, 21 bp, Homo sapiens
cagcctcatactcctgggctc

SEQ ID NO: 4059749 - DNA, 20 bp, Homo sapiens
cagcctccaacacaaggctc

SEQ ID NO: 4059750 - DNA, 20 bp, Homo sapiens
cagcctcccaattagcttgg

SEQ ID NO: 4059751 - DNA, 14 bp, Homo sapiens
cagcctcccacccc

SEQ ID NO: 4059752 - DNA, 14 bp, Homo sapiens
cagcctcccatcca

SEQ ID NO: 4059753 - DNA, 19 bp, Homo sapiens
cagcctcccatccagggcc

SEQ ID NO: 4059754 - DNA, 23 bp, Homo sapiens
cagcctcccatccagggccccca

SEQ ID NO: 4059755 - DNA, 16 bp, Homo sapiens
cagcctccccacccag

SEQ ID NO: 4059756 - DNA, 16 bp, Homo sapiens
cagcctccctgaagcc

SEQ ID NO: 4059757 - DNA, 18 bp, Homo sapiens
cagcctccctgaagcctt

SEQ ID NO: 4059758 - DNA, 12 bp, Homo sapiens
cagcctccctgt

SEQ ID NO: 4059759 - DNA, 15 bp, Homo sapiens
cagcctccctgtctc

SEQ ID NO: 4059760 - DNA, 20 bp, Homo sapiens
cagcctccgagagggagaga

SEQ ID NO: 4059761 - DNA, 21 bp, Homo sapiens
cagcctcctctggacggcagg

SEQ ID NO: 4059762 - DNA, 23 bp, Homo sapiens
cagcctcctctggacggcaggct

SEQ ID NO: 4059763 - DNA, 17 bp, Homo sapiens
cagcctcctctgtctgc

SEQ ID NO: 4059764 - DNA, 23 bp, Homo sapiens
cagcctcctctgtctgcccttca

SEQ ID NO: 4059765 - DNA, 15 bp, Homo sapiens
cagcctcctgagcct

SEQ ID NO: 4059766 - DNA, 18 bp, Homo sapiens
cagcctcctgagcctgtg

SEQ ID NO: 4059767 - DNA, 19 bp, Homo sapiens
cagcctcgcaggcctccct

SEQ ID NO: 4059768 - DNA, 21 bp, Homo sapiens
cagcctcgcaggcctccctgc

SEQ ID NO: 4059769 - DNA, 14 bp, Homo sapiens
cagcctcgcctgtc

SEQ ID NO: 4059770 - DNA, 12 bp, Homo sapiens
cagcctctggac

SEQ ID NO: 4059771 - DNA, 18 bp, Homo sapiens
cagcctctggacagccag

SEQ ID NO: 4059772 - DNA, 13 bp, Homo sapiens
cagcctcttactt

SEQ ID NO: 4059773 - DNA, 18 bp, Homo sapiens
cagcctcttggccccaga

SEQ ID NO: 4059774 - DNA, 18 bp, Homo sapiens
cagcctgaacagaagctc

SEQ ID NO: 4059775 - DNA, 16 bp, Homo sapiens
cagcctgacctgagac

SEQ ID NO: 4059776 - DNA, 22 bp, Homo sapiens
cagcctgacctgagactgtcgg

SEQ ID NO: 4059777 - DNA, 14 bp, Homo sapiens
cagcctgagtctcc

SEQ ID NO: 4059778 - DNA, 19 bp, Homo sapiens
cagcctgagtctcctgtgc

SEQ ID NO: 4059779 - DNA, 15 bp, Homo sapiens
cagcctgcccctaga

SEQ ID NO: 4059780 - DNA, 17 bp, Homo sapiens
cagcctgcccctagaca

SEQ ID NO: 4059781 - DNA, 23 bp, Homo sapiens
cagcctgctctagtgggacagcc

SEQ ID NO: 4059782 - DNA, 15 bp, Homo sapiens
cagcctgctgagagc

SEQ ID NO: 4059783 - DNA, 20 bp, Homo sapiens
cagcctgctgagagccccca

SEQ ID NO: 4059784 - DNA, 22 bp, Homo sapiens
cagcctgctgagagcccccacc

SEQ ID NO: 4059785 - DNA, 15 bp, Homo sapiens
cagcctgctgcccag

SEQ ID NO: 4059786 - DNA, 20 bp, Homo sapiens
cagcctggaaacctgtctga

SEQ ID NO: 4059787 - DNA, 20 bp, Homo sapiens
cagcctggcacagggcagtg

SEQ ID NO: 4059788 - DNA, 13 bp, Homo sapiens
cagcctggccaga

SEQ ID NO: 4059789 - DNA, 17 bp, Homo sapiens
cagcctggccagacaca

SEQ ID NO: 4059790 - DNA, 16 bp, Homo sapiens
cagcctggcctgcccg

SEQ ID NO: 4059791 - DNA, 22 bp, Homo sapiens
cagcctggcctgcccgtgccct

SEQ ID NO: 4059792 - DNA, 17 bp, Homo sapiens
cagcctggctggtcctc

SEQ ID NO: 4059793 - DNA, 20 bp, Homo sapiens
cagcctggctggtcctccca

SEQ ID NO: 4059794 - DNA, 19 bp, Homo sapiens
cagcctgggagcccagagg

SEQ ID NO: 4059795 - DNA, 20 bp, Homo sapiens
cagcctgggataggggcaga

SEQ ID NO: 4059796 - DNA, 17 bp, Homo sapiens
cagcctgggcagccagg

SEQ ID NO: 4059797 - DNA, 18 bp, Homo sapiens
cagcctgggcagccaggc

SEQ ID NO: 4059798 - DNA, 19 bp, Homo sapiens
cagcctgggcagccaggct

SEQ ID NO: 4059799 - DNA, 21 bp, Homo sapiens
cagcctgggcagccaggctgc

SEQ ID NO: 4059800 - DNA, 20 bp, Homo sapiens
cagcctgggccatctcttag

SEQ ID NO: 4059801 - DNA, 17 bp, Homo sapiens
cagcctggggctggcct

SEQ ID NO: 4059802 - DNA, 21 bp, Homo sapiens
cagcctggggctggcctccca

SEQ ID NO: 4059803 - DNA, 20 bp, Homo sapiens
cagcctggtcaacatggtga

SEQ ID NO: 4059804 - DNA, 21 bp, Homo sapiens
cagccttagctgccagtgctg

SEQ ID NO: 4059805 - DNA, 14 bp, Homo sapiens
cagccttgccagag

SEQ ID NO: 4059806 - DNA, 17 bp, Homo sapiens
cagccttggtgccacca

SEQ ID NO: 4059807 - DNA, 18 bp, Homo sapiens
cagcctttttgtttcaat

SEQ ID NO: 4059808 - DNA, 18 bp, Homo sapiens
cagcgaagtagcttgctc

SEQ ID NO: 4059809 - DNA, 14 bp, Homo sapiens
cagcgccagcctgt

SEQ ID NO: 4059810 - DNA, 12 bp, Homo sapiens
cagcgccaggct

SEQ ID NO: 4059811 - DNA, 14 bp, Homo sapiens
cagcgcccctgctg

SEQ ID NO: 4059812 - DNA, 15 bp, Homo sapiens
cagcgcccctgctgt

SEQ ID NO: 4059813 - DNA, 16 bp, Homo sapiens
cagcgcccctgctgtc

SEQ ID NO: 4059814 - DNA, 14 bp, Homo sapiens
cagcgcggccagcg

SEQ ID NO: 4059815 - DNA, 20 bp, Homo sapiens
cagcgcggccagcgtcccag

SEQ ID NO: 4059816 - DNA, 15 bp, Homo sapiens
cagcggaggagacca

SEQ ID NO: 4059817 - DNA, 21 bp, Homo sapiens
cagcggaggagaccagctcag

SEQ ID NO: 4059818 - DNA, 15 bp, Homo sapiens
cagcggcccctgcat

SEQ ID NO: 4059819 - DNA, 16 bp, Homo sapiens
cagcggcccctgcatc

SEQ ID NO: 4059820 - DNA, 16 bp, Homo sapiens
cagcggctcccctctg

SEQ ID NO: 4059821 - DNA, 12 bp, Homo sapiens
cagcgggcacag

SEQ ID NO: 4059822 - DNA, 14 bp, Homo sapiens
cagcgggcacaggg

SEQ ID NO: 4059823 - DNA, 15 bp, Homo sapiens
cagcgggcacagggc

SEQ ID NO: 4059824 - DNA, 16 bp, Homo sapiens
cagcgggcacagggca

SEQ ID NO: 4059825 - DNA, 15 bp, Homo sapiens
cagcggtttggggag

SEQ ID NO: 4059826 - DNA, 14 bp, Homo sapiens
cagcgtaaaatggt

SEQ ID NO: 4059827 - DNA, 15 bp, Homo sapiens
cagcgtaaaatggtg

SEQ ID NO: 4059828 - DNA, 12 bp, Homo sapiens
cagctaagaaaa

SEQ ID NO: 4059829 - DNA, 22 bp, Homo sapiens
cagctggggccagaggctggga

SEQ ID NO: 4059830 - DNA, 14 bp, Homo sapiens
cagctgggtcaggc

SEQ ID NO: 4059831 - DNA, 19 bp, Homo sapiens
cagctggttactcagggtt

SEQ ID NO: 4059832 - DNA, 22 bp, Homo sapiens
cagctggttactcagggttcat

SEQ ID NO: 4059833 - DNA, 20 bp, Homo sapiens
cagctgtaagaagagactgg

SEQ ID NO: 4059834 - DNA, 22 bp, Homo sapiens
cagctgtaagaagagactggga

SEQ ID NO: 4059835 - DNA, 16 bp, Homo sapiens
cagctgtctgtggctt

SEQ ID NO: 4059836 - DNA, 20 bp, Homo sapiens
cagctgtgtccttcgggggc

SEQ ID NO: 4059837 - DNA, 23 bp, Homo sapiens
cagctgtgtgacatttggagagg

SEQ ID NO: 4059838 - DNA, 23 bp, Homo sapiens
cagctgttgcagatgaaatgttc

SEQ ID NO: 4059839 - DNA, 21 bp, Homo sapiens
cagctgttgtctcttctcctt

SEQ ID NO: 4059840 - DNA, 21 bp, Homo sapiens
cagctgtttctcatgaagcta

SEQ ID NO: 4059841 - DNA, 17 bp, Homo sapiens
cagcttaaatcctagca

SEQ ID NO: 4059842 - DNA, 22 bp, Homo sapiens
cagcttatctcttttatatttg

SEQ ID NO: 4059843 - DNA, 15 bp, Homo sapiens
cagcttcaagtgcct

SEQ ID NO: 4059844 - DNA, 16 bp, Homo sapiens
cagcttcaccctgtca

SEQ ID NO: 4059845 - DNA, 17 bp, Homo sapiens
cagcttcaccctgtcaa

SEQ ID NO: 4059846 - DNA, 16 bp, Homo sapiens
cagcttcacttctgac

SEQ ID NO: 4059847 - DNA, 22 bp, Homo sapiens
cagcttcacttctgactcttcc

SEQ ID NO: 4059848 - DNA, 14 bp, Homo sapiens
cagcttcaggcacc

SEQ ID NO: 4059849 - DNA, 15 bp, Homo sapiens
cagcttcaggcacca

SEQ ID NO: 4059850 - DNA, 21 bp, Homo sapiens
cagcttcaggcaccagcatcc

SEQ ID NO: 4059851 - DNA, 22 bp, Homo sapiens
cagcttcaggcaccagcatcca

SEQ ID NO: 4059852 - DNA, 14 bp, Homo sapiens
cagcttcctaccca

SEQ ID NO: 4059853 - DNA, 16 bp, Homo sapiens
cagcttcctcacaccc

SEQ ID NO: 4059854 - DNA, 21 bp, Homo sapiens
cagcttcctcacacccctgtc

SEQ ID NO: 4059855 - DNA, 23 bp, Homo sapiens
cagcttcggagggcccctgcgtg

SEQ ID NO: 4059856 - DNA, 12 bp, Homo sapiens
cagcttctccag

SEQ ID NO: 4059857 - DNA, 14 bp, Homo sapiens
cagcttctccaggc

SEQ ID NO: 4059858 - DNA, 15 bp, Homo sapiens
cagcttctccaggct

SEQ ID NO: 4059859 - DNA, 16 bp, Homo sapiens
cagcttctctctccag

SEQ ID NO: 4059860 - DNA, 19 bp, Homo sapiens
cagcttctctctccagggt

SEQ ID NO: 4059861 - DNA, 15 bp, Homo sapiens
cagcttcttcctagg

SEQ ID NO: 4059862 - DNA, 12 bp, Homo sapiens
cagcttgagttt

SEQ ID NO: 4059863 - DNA, 18 bp, Homo sapiens
cagctttaaactcaggga

SEQ ID NO: 4059864 - DNA, 20 bp, Homo sapiens
cagctttaaactcagggaca

SEQ ID NO: 4059865 - DNA, 19 bp, Homo sapiens
cagctttcttgctcccttc

SEQ ID NO: 4059866 - DNA, 17 bp, Homo sapiens
cagctttgatccctgac

SEQ ID NO: 4059867 - DNA, 12 bp, Homo sapiens
cagcttttgcaa

SEQ ID NO: 4059868 - DNA, 11 bp, Homo sapiens
caggaaagagc

SEQ ID NO: 4059869 - DNA, 21 bp, Homo sapiens
caggaaagagcagtcagagtc

SEQ ID NO: 4059870 - DNA, 14 bp, Homo sapiens
caggaaagccctcc

SEQ ID NO: 4059871 - DNA, 22 bp, Homo sapiens
caggaaagtggcacctgtctgc

SEQ ID NO: 4059872 - DNA, 18 bp, Homo sapiens
caggaaagtgttattttt

SEQ ID NO: 4059873 - DNA, 15 bp, Homo sapiens
caggaaatatatatg

SEQ ID NO: 4059874 - DNA, 23 bp, Homo sapiens
caggaaatatatatgtgtgtgta

SEQ ID NO: 4059875 - DNA, 18 bp, Homo sapiens
caggaacagaaggatgaa

SEQ ID NO: 4059876 - DNA, 14 bp, Homo sapiens
caggaacagctatg

SEQ ID NO: 4059877 - DNA, 19 bp, Homo sapiens
caggaacagtggctgggtg

SEQ ID NO: 4059878 - DNA, 14 bp, Homo sapiens
caggaactcccagc

SEQ ID NO: 4059879 - DNA, 16 bp, Homo sapiens
caggaactcccagcaa

SEQ ID NO: 4059880 - DNA, 15 bp, Homo sapiens
caggaagcaggggtg

SEQ ID NO: 4059881 - DNA, 13 bp, Homo sapiens
caggaagccagag

SEQ ID NO: 4059882 - DNA, 17 bp, Homo sapiens
caggaagccagagcccc

SEQ ID NO: 4059883 - DNA, 17 bp, Homo sapiens
caggaagccaggctgag

SEQ ID NO: 4059884 - DNA, 13 bp, Homo sapiens
caggaagcctgca

SEQ ID NO: 4059885 - DNA, 16 bp, Homo sapiens
caggaagctctcttaa

SEQ ID NO: 4059886 - DNA, 18 bp, Homo sapiens
caggaaggacaggaagct

SEQ ID NO: 4059887 - DNA, 20 bp, Homo sapiens
caggaaggacaggaagctgg

SEQ ID NO: 4059888 - DNA, 16 bp, Homo sapiens
caggaaggagagcctg

SEQ ID NO: 4059889 - DNA, 22 bp, Homo sapiens
caggaaggtagcccagcactgt

SEQ ID NO: 4059890 - DNA, 15 bp, Homo sapiens
caggaagtacttcca

SEQ ID NO: 4059891 - DNA, 19 bp, Homo sapiens
caggaagtacttccacctc

SEQ ID NO: 4059892 - DNA, 17 bp, Homo sapiens
caggaatgtgtggcctg

SEQ ID NO: 4059893 - DNA, 21 bp, Homo sapiens
caggaatgtgtggcctgcaca

SEQ ID NO: 4059894 - DNA, 23 bp, Homo sapiens
caggaatgtgtggcctgcacagt

SEQ ID NO: 4059895 - DNA, 13 bp, Homo sapiens
caggaattatgtc

SEQ ID NO: 4059896 - DNA, 17 bp, Homo sapiens
caggaatttcccaggac

SEQ ID NO: 4059897 - DNA, 16 bp, Homo sapiens
caggacaccagtccag

SEQ ID NO: 4059898 - DNA, 12 bp, Homo sapiens
caggacagagtt

SEQ ID NO: 4059899 - DNA, 19 bp, Homo sapiens
caggacagagttcacagga

SEQ ID NO: 4059900 - DNA, 20 bp, Homo sapiens
caggacagagttcacaggag

SEQ ID NO: 4059901 - DNA, 13 bp, Homo sapiens
caggacagatgcc

SEQ ID NO: 4059902 - DNA, 17 bp, Homo sapiens
caggacagatgccacac

SEQ ID NO: 4059903 - DNA, 22 bp, Homo sapiens
caggacatgcggtagccagcac

SEQ ID NO: 4059904 - DNA, 23 bp, Homo sapiens
caggacatgcggtagccagcaca

SEQ ID NO: 4059905 - DNA, 15 bp, Homo sapiens
caggacattaaaaat

SEQ ID NO: 4059906 - DNA, 17 bp, Homo sapiens
caggaccagctcaggac

SEQ ID NO: 4059907 - DNA, 19 bp, Homo sapiens
caggaccagctcaggacag

SEQ ID NO: 4059908 - DNA, 15 bp, Homo sapiens
caggacccccgaggg

SEQ ID NO: 4059909 - DNA, 15 bp, Homo sapiens
caggaccctgaaggg

SEQ ID NO: 4059910 - DNA, 16 bp, Homo sapiens
caggaccctgaagggg

SEQ ID NO: 4059911 - DNA, 20 bp, Homo sapiens
caggacctctgtaggcagca

SEQ ID NO: 4059912 - DNA, 14 bp, Homo sapiens
caggacctggcatc

SEQ ID NO: 4059913 - DNA, 15 bp, Homo sapiens
caggacctggcatca

SEQ ID NO: 4059914 - DNA, 14 bp, Homo sapiens
caggacgcttctga

SEQ ID NO: 4059915 - DNA, 15 bp, Homo sapiens
caggacgcttctgaa

SEQ ID NO: 4059916 - DNA, 16 bp, Homo sapiens
caggacgcttctgaat

SEQ ID NO: 4059917 - DNA, 13 bp, Homo sapiens
caggacggctcct

SEQ ID NO: 4059918 - DNA, 20 bp, Homo sapiens
caggactatatttgggcctg

SEQ ID NO: 4059919 - DNA, 18 bp, Homo sapiens
caggactccaggcccaag

SEQ ID NO: 4059920 - DNA, 14 bp, Homo sapiens
caggactccctcct

SEQ ID NO: 4059921 - DNA, 15 bp, Homo sapiens
caggactccctcctc

SEQ ID NO: 4059922 - DNA, 19 bp, Homo sapiens
caggactccctcctcacct

SEQ ID NO: 4059923 - DNA, 20 bp, Homo sapiens
caggactccctcctcacctc

SEQ ID NO: 4059924 - DNA, 22 bp, Homo sapiens
caggactccctcctcacctctg

SEQ ID NO: 4059925 - DNA, 23 bp, Homo sapiens
caggactccctcctcacctctgg

SEQ ID NO: 4059926 - DNA, 14 bp, Homo sapiens
caggactgtgactc

SEQ ID NO: 4059927 - DNA, 11 bp, Homo sapiens
caggagaacca

SEQ ID NO: 4059928 - DNA, 12 bp, Homo sapiens
caggagacatcc

SEQ ID NO: 4059929 - DNA, 22 bp, Homo sapiens
caggagagaggctctggggcag

SEQ ID NO: 4059930 - DNA, 18 bp, Homo sapiens
caggagaggatggcccag

SEQ ID NO: 4059931 - DNA, 20 bp, Homo sapiens
caggagatggagggcttggc

SEQ ID NO: 4059932 - DNA, 16 bp, Homo sapiens
caggcataggcctggg

SEQ ID NO: 4059933 - DNA, 17 bp, Homo sapiens
caggcataggcctgggt

SEQ ID NO: 4059934 - DNA, 19 bp, Homo sapiens
caggcataggcctgggtgc

SEQ ID NO: 4059935 - DNA, 15 bp, Homo sapiens
caggcatctacacag

SEQ ID NO: 4059936 - DNA, 20 bp, Homo sapiens
caggcatctacacagcctgg

SEQ ID NO: 4059937 - DNA, 20 bp, Homo sapiens
caggcatgaaattcttccta

SEQ ID NO: 4059938 - DNA, 22 bp, Homo sapiens
caggcatgtcccatgtgagctg

SEQ ID NO: 4059939 - DNA, 15 bp, Homo sapiens
caggcattgaggaag

SEQ ID NO: 4059940 - DNA, 20 bp, Homo sapiens
caggcattgaggaagagtct

SEQ ID NO: 4059941 - DNA, 19 bp, Homo sapiens
caggccaaggccttctcct

SEQ ID NO: 4059942 - DNA, 13 bp, Homo sapiens
caggccaccagga

SEQ ID NO: 4059943 - DNA, 16 bp, Homo sapiens
caggccaccctgtgca

SEQ ID NO: 4059944 - DNA, 17 bp, Homo sapiens
caggccagcccagccag

SEQ ID NO: 4059945 - DNA, 18 bp, Homo sapiens
caggccagcccagccagg

SEQ ID NO: 4059946 - DNA, 11 bp, Homo sapiens
caggccagcct

SEQ ID NO: 4059947 - DNA, 16 bp, Homo sapiens
caggccaggccaccag

SEQ ID NO: 4059948 - DNA, 12 bp, Homo sapiens
caggccagtgtc

SEQ ID NO: 4059949 - DNA, 11 bp, Homo sapiens
caggcccagcg

SEQ ID NO: 4059950 - DNA, 17 bp, Homo sapiens
caggcccagcgcggcca

SEQ ID NO: 4059951 - DNA, 18 bp, Homo sapiens
caggcccagcgcggccag

SEQ ID NO: 4059952 - DNA, 19 bp, Homo sapiens
caggcccagcgcggccagc

SEQ ID NO: 4059953 - DNA, 20 bp, Homo sapiens
caggcccagcgcggccagcg

SEQ ID NO: 4059954 - DNA, 21 bp, Homo sapiens
caggcccagcgcggccagcgt

SEQ ID NO: 4059955 - DNA, 16 bp, Homo sapiens
caggcccaggcctcac

SEQ ID NO: 4059956 - DNA, 17 bp, Homo sapiens
caggcccaggcctcacc

SEQ ID NO: 4059957 - DNA, 13 bp, Homo sapiens
caggcccagggag

SEQ ID NO: 4059958 - DNA, 16 bp, Homo sapiens
caggcccagggaggga

SEQ ID NO: 4059959 - DNA, 17 bp, Homo sapiens
caggcccatgccaaggc

SEQ ID NO: 4059960 - DNA, 14 bp, Homo sapiens
caggccccagacag

SEQ ID NO: 4059961 - DNA, 15 bp, Homo sapiens
caggccccctgcatc

SEQ ID NO: 4059962 - DNA, 16 bp, Homo sapiens
caggccccctgcatct

SEQ ID NO: 4059963 - DNA, 21 bp, Homo sapiens
caggccccgtgaggcaatggg

SEQ ID NO: 4059964 - DNA, 22 bp, Homo sapiens
caggccctccctgttccccaga

SEQ ID NO: 4059965 - DNA, 23 bp, Homo sapiens
caggccctccctgttccccagag

SEQ ID NO: 4059966 - DNA, 14 bp, Homo sapiens
caggccctcctctc

SEQ ID NO: 4059967 - DNA, 18 bp, Homo sapiens
caggccctgactcctctg

SEQ ID NO: 4059968 - DNA, 20 bp, Homo sapiens
caggccctgactcctctggc

SEQ ID NO: 4059969 - DNA, 14 bp, Homo sapiens
caggccctgagagt

SEQ ID NO: 4059970 - DNA, 14 bp, Homo sapiens
caggccctgctcct

SEQ ID NO: 4059971 - DNA, 15 bp, Homo sapiens
caggccctgctcctg

SEQ ID NO: 4059972 - DNA, 11 bp, Homo sapiens
caggccctggc

SEQ ID NO: 4059973 - DNA, 22 bp, Homo sapiens
caggccctggctgagggcagct

SEQ ID NO: 4059974 - DNA, 19 bp, Homo sapiens
caggcccttcctctccact

SEQ ID NO: 4059975 - DNA, 19 bp, Homo sapiens
caggccctttgaagcctca

SEQ ID NO: 4059976 - DNA, 21 bp, Homo sapiens
caggccctttgaagcctcagc

SEQ ID NO: 4059977 - DNA, 13 bp, Homo sapiens
caggccggcccag

SEQ ID NO: 4059978 - DNA, 15 bp, Homo sapiens
caggccggcccagat

SEQ ID NO: 4059979 - DNA, 17 bp, Homo sapiens
caggccgggcagagcac

SEQ ID NO: 4059980 - DNA, 21 bp, Homo sapiens
caggccgggcttgggccctgc

SEQ ID NO: 4059981 - DNA, 22 bp, Homo sapiens
caggccgggcttgggccctgca

SEQ ID NO: 4059982 - DNA, 18 bp, Homo sapiens
caggcctaagacatgtga

SEQ ID NO: 4059983 - DNA, 18 bp, Homo sapiens
caggcctacagccacatc

SEQ ID NO: 4059984 - DNA, 19 bp, Homo sapiens
caggcctacagccacatcc

SEQ ID NO: 4059985 - DNA, 15 bp, Homo sapiens
caggcctcaccacct

SEQ ID NO: 4059986 - DNA, 16 bp, Homo sapiens
caggcctcaccacctg

SEQ ID NO: 4059987 - DNA, 12 bp, Homo sapiens
caggcctccctc

SEQ ID NO: 4059988 - DNA, 14 bp, Homo sapiens
caggcctctgctgc

SEQ ID NO: 4059989 - DNA, 13 bp, Homo sapiens
caggcctgcctcc

SEQ ID NO: 4059990 - DNA, 17 bp, Homo sapiens
caggcctggcaagtggg

SEQ ID NO: 4059991 - DNA, 18 bp, Homo sapiens
caggcctgggtctgtgtc

SEQ ID NO: 4059992 - DNA, 12 bp, Homo sapiens
caggcctgggtt

SEQ ID NO: 4059993 - DNA, 12 bp, Homo sapiens
caggcctgtgcc

SEQ ID NO: 4059994 - DNA, 18 bp, Homo sapiens
caggcctgtgcccactcc

SEQ ID NO: 4059995 - DNA, 12 bp, Homo sapiens
caggcctgtggc

SEQ ID NO: 4059996 - DNA, 16 bp, Homo sapiens
caggcctgtggcccca

SEQ ID NO: 4059997 - DNA, 12 bp, Homo sapiens
caggcctgtgtg

SEQ ID NO: 4059998 - DNA, 17 bp, Homo sapiens
caggcggggtgctgtgg

SEQ ID NO: 4059999 - DNA, 19 bp, Homo sapiens
caggcggggtgctgtggtg

SEQ ID NO: 4060000 - DNA, 21 bp, Homo sapiens
caggctaaatgcaccaagaaa

SEQ ID NO: 4060001 - DNA, 20 bp, Homo sapiens
caggctcactgccaggccag

SEQ ID NO: 4060002 - DNA, 23 bp, Homo sapiens
caggctcactgccaggccagcct

SEQ ID NO: 4060003 - DNA, 15 bp, Homo sapiens
caggctctctgggct

SEQ ID NO: 4060004 - DNA, 12 bp, Homo sapiens
caggctcttagc

SEQ ID NO: 4060005 - DNA, 22 bp, Homo sapiens
caggctcttagcagcttccaga

SEQ ID NO: 4060006 - DNA, 23 bp, Homo sapiens
caggctctttggggtcagccagg

SEQ ID NO: 4060007 - DNA, 14 bp, Homo sapiens
caggctgaccacag

SEQ ID NO: 4060008 - DNA, 21 bp, Homo sapiens
caggctgaccacagcacagcc

SEQ ID NO: 4060009 - DNA, 11 bp, Homo sapiens
caggctgaggt

SEQ ID NO: 4060010 - DNA, 19 bp, Homo sapiens
caggctgagtgagccacag

SEQ ID NO: 4060011 - DNA, 20 bp, Homo sapiens
caggctgcagaggcacctca

SEQ ID NO: 4060012 - DNA, 21 bp, Homo sapiens
caggctgccaaggccagagtg

SEQ ID NO: 4060013 - DNA, 22 bp, Homo sapiens
caggctgccaaggccagagtgg

SEQ ID NO: 4060014 - DNA, 15 bp, Homo sapiens
caggctgcttgggat

SEQ ID NO: 4060015 - DNA, 20 bp, Homo sapiens
caggctggctccagatgcag

SEQ ID NO: 4060016 - DNA, 12 bp, Homo sapiens
caggctgggaac

SEQ ID NO: 4060017 - DNA, 14 bp, Homo sapiens
caggctgggacgga

SEQ ID NO: 4060018 - DNA, 18 bp, Homo sapiens
caggctgggcagccccag

SEQ ID NO: 4060019 - DNA, 19 bp, Homo sapiens
caggctgggcagccccaga

SEQ ID NO: 4060020 - DNA, 11 bp, Homo sapiens
caggctgggcc

SEQ ID NO: 4060021 - DNA, 20 bp, Homo sapiens
caggctgggccatgtccaaa

SEQ ID NO: 4060022 - DNA, 17 bp, Homo sapiens
caggctgtgggcctcaa

SEQ ID NO: 4060023 - DNA, 19 bp, Homo sapiens
caggctgtgggtagatgtg

SEQ ID NO: 4060024 - DNA, 22 bp, Homo sapiens
caggctgtgggtagatgtgcaa

SEQ ID NO: 4060025 - DNA, 16 bp, Homo sapiens
caggctgttctccagg

SEQ ID NO: 4060026 - DNA, 20 bp, Homo sapiens
caggctgttctccaggcttc

SEQ ID NO: 4060027 - DNA, 13 bp, Homo sapiens
caggcttcacagt

SEQ ID NO: 4060028 - DNA, 19 bp, Homo sapiens
cagggaaccctgcttgcac

SEQ ID NO: 4060029 - DNA, 22 bp, Homo sapiens
cagggaaccctgcttgcacttt

SEQ ID NO: 4060030 - DNA, 19 bp, Homo sapiens
cagggaactaggaaggcac

SEQ ID NO: 4060031 - DNA, 15 bp, Homo sapiens
cagggaaggcctgac

SEQ ID NO: 4060032 - DNA, 16 bp, Homo sapiens
cagggaagggcttggc

SEQ ID NO: 4060033 - DNA, 15 bp, Homo sapiens
cagggaatccagctc

SEQ ID NO: 4060034 - DNA, 17 bp, Homo sapiens
cagggaatccagctccc

SEQ ID NO: 4060035 - DNA, 14 bp, Homo sapiens
cagggtacctcaag

SEQ ID NO: 4060036 - DNA, 23 bp, Homo sapiens
cagggtagataacctgtacttca

SEQ ID NO: 4060037 - DNA, 18 bp, Homo sapiens
cagggtcatgtttgcagg

SEQ ID NO: 4060038 - DNA, 19 bp, Homo sapiens
cagggtctgtgtgaatgtg

SEQ ID NO: 4060039 - DNA, 21 bp, Homo sapiens
cagggtcttccctacctcagg

SEQ ID NO: 4060040 - DNA, 22 bp, Homo sapiens
cagggtcttccctacctcaggc

SEQ ID NO: 4060041 - DNA, 14 bp, Homo sapiens
cagggtcttgctct

SEQ ID NO: 4060042 - DNA, 20 bp, Homo sapiens
cagggtcttgctctgtcccc

SEQ ID NO: 4060043 - DNA, 23 bp, Homo sapiens
cagggtcttgctctgtcccccag

SEQ ID NO: 4060044 - DNA, 14 bp, Homo sapiens
cagggtgagagctg

SEQ ID NO: 4060045 - DNA, 21 bp, Homo sapiens
cagggtgagagctgctctgga

SEQ ID NO: 4060046 - DNA, 13 bp, Homo sapiens
cagggtgcagagg

SEQ ID NO: 4060047 - DNA, 22 bp, Homo sapiens
cagggtgcccagaacttccctg

SEQ ID NO: 4060048 - DNA, 18 bp, Homo sapiens
cagggtgggcagcctatg

SEQ ID NO: 4060049 - DNA, 20 bp, Homo sapiens
cagggtgggcagcctatggg

SEQ ID NO: 4060050 - DNA, 20 bp, Homo sapiens
cagggtggggggtgacagtg

SEQ ID NO: 4060051 - DNA, 20 bp, Homo sapiens
cagggtgggtgtccatgtgc

SEQ ID NO: 4060052 - DNA, 23 bp, Homo sapiens
cagggtgtctgccccctcctgag

SEQ ID NO: 4060053 - DNA, 13 bp, Homo sapiens
cagggtgtgtgct

SEQ ID NO: 4060054 - DNA, 18 bp, Homo sapiens
cagggttcaaaatgtctg

SEQ ID NO: 4060055 - DNA, 15 bp, Homo sapiens
cagggttcatctgtc

SEQ ID NO: 4060056 - DNA, 23 bp, Homo sapiens
cagggttctcttagcaactcaga

SEQ ID NO: 4060057 - DNA, 21 bp, Homo sapiens
cagggttgatcacactctggg

SEQ ID NO: 4060058 - DNA, 16 bp, Homo sapiens
cagggttgggcccaga

SEQ ID NO: 4060059 - DNA, 18 bp, Homo sapiens
cagggttggtgtgctgag

SEQ ID NO: 4060060 - DNA, 17 bp, Homo sapiens
cagggtttacccagtgg

SEQ ID NO: 4060061 - DNA, 15 bp, Homo sapiens
caggtaatgagggac

SEQ ID NO: 4060062 - DNA, 18 bp, Homo sapiens
caggtaccacccttcaga

SEQ ID NO: 4060063 - DNA, 21 bp, Homo sapiens
caggtaccagctgcgcttgct

SEQ ID NO: 4060064 - DNA, 14 bp, Homo sapiens
caggtaccagttct

SEQ ID NO: 4060065 - DNA, 21 bp, Homo sapiens
caggtagaacgccagggaccc

SEQ ID NO: 4060066 - DNA, 22 bp, Homo sapiens
caggtagaaggttgacacagtt

SEQ ID NO: 4060067 - DNA, 23 bp, Homo sapiens
caggtatggaagggtttgtggct

SEQ ID NO: 4060068 - DNA, 16 bp, Homo sapiens
caggtatggctctgca

SEQ ID NO: 4060069 - DNA, 13 bp, Homo sapiens
caggtcaataaac

SEQ ID NO: 4060070 - DNA, 16 bp, Homo sapiens
caggtcaataaactta

SEQ ID NO: 4060071 - DNA, 21 bp, Homo sapiens
caggtcaataaacttagagga

SEQ ID NO: 4060072 - DNA, 14 bp, Homo sapiens
caggtcaccaagca

SEQ ID NO: 4060073 - DNA, 16 bp, Homo sapiens
caggtcagggacttgg

SEQ ID NO: 4060074 - DNA, 20 bp, Homo sapiens
caggtcccagccccttttcc

SEQ ID NO: 4060075 - DNA, 22 bp, Homo sapiens
caggtcctgcccatgtgtcccc

SEQ ID NO: 4060076 - DNA, 15 bp, Homo sapiens
caggtcctgctcagc

SEQ ID NO: 4060077 - DNA, 17 bp, Homo sapiens
caggtcctgctcagcag

SEQ ID NO: 4060078 - DNA, 16 bp, Homo sapiens
caggtcgggcgcagga

SEQ ID NO: 4060079 - DNA, 22 bp, Homo sapiens
caggtctcccacgtgggagaca

SEQ ID NO: 4060080 - DNA, 18 bp, Homo sapiens
caggtgaaggaggctcca

SEQ ID NO: 4060081 - DNA, 17 bp, Homo sapiens
caggtgacatgtgaaac

SEQ ID NO: 4060082 - DNA, 13 bp, Homo sapiens
caggtgagaaact

SEQ ID NO: 4060083 - DNA, 19 bp, Homo sapiens
caggtgagaagtgagggag

SEQ ID NO: 4060084 - DNA, 21 bp, Homo sapiens
caggtgaggtctgttcctttt

SEQ ID NO: 4060085 - DNA, 16 bp, Homo sapiens
caggtgccagcctgag

SEQ ID NO: 4060086 - DNA, 18 bp, Homo sapiens
caggtgccagggcccacc

SEQ ID NO: 4060087 - DNA, 20 bp, Homo sapiens
caggtgccagggcccacccc

SEQ ID NO: 4060088 - DNA, 15 bp, Homo sapiens
caggtgcctggacat

SEQ ID NO: 4060089 - DNA, 14 bp, Homo sapiens
caggtgctcaatgg

SEQ ID NO: 4060090 - DNA, 16 bp, Homo sapiens
caggtgctcattgtaa

SEQ ID NO: 4060091 - DNA, 21 bp, Homo sapiens
caggtgctgacttcatctccc

SEQ ID NO: 4060092 - DNA, 14 bp, Homo sapiens
caggtgctggtccc

SEQ ID NO: 4060093 - DNA, 14 bp, Homo sapiens
caggtgctgtccat

SEQ ID NO: 4060094 - DNA, 15 bp, Homo sapiens
caggtggagggcaca

SEQ ID NO: 4060095 - DNA, 18 bp, Homo sapiens
caggtggagggcacagcc

SEQ ID NO: 4060096 - DNA, 23 bp, Homo sapiens
caggtggagggcacagccctccg

SEQ ID NO: 4060097 - DNA, 17 bp, Homo sapiens
caggtggatgaggagac

SEQ ID NO: 4060098 - DNA, 17 bp, Homo sapiens
caggtggcaggaccagg

SEQ ID NO: 4060099 - DNA, 18 bp, Homo sapiens
caggtggcaggaccagga

SEQ ID NO: 4060100 - DNA, 21 bp, Homo sapiens
caggtggcaggaccaggacta

SEQ ID NO: 4060101 - DNA, 16 bp, Homo sapiens
caggtggccactccag

SEQ ID NO: 4060102 - DNA, 10 bp, Homo sapiens
caggtgggca

SEQ ID NO: 4060103 - DNA, 15 bp, Homo sapiens
caggtgggcactgga

SEQ ID NO: 4060104 - DNA, 22 bp, Homo sapiens
caggtgggctggacttctacct

SEQ ID NO: 4060105 - DNA, 15 bp, Homo sapiens
caggtggggactggg

SEQ ID NO: 4060106 - DNA, 19 bp, Homo sapiens
caggtgggtgctgccctgt

SEQ ID NO: 4060107 - DNA, 20 bp, Homo sapiens
caggtggttgtcttattgca

SEQ ID NO: 4060108 - DNA, 20 bp, Homo sapiens
caggtgtcaggatagtcaca

SEQ ID NO: 4060109 - DNA, 20 bp, Homo sapiens
caggtgtgagggcagtgcaa

SEQ ID NO: 4060110 - DNA, 12 bp, Homo sapiens
caggtgtgcctg

SEQ ID NO: 4060111 - DNA, 20 bp, Homo sapiens
caggtgtggggacacagcag

SEQ ID NO: 4060112 - DNA, 13 bp, Homo sapiens
caggtgttgccaa

SEQ ID NO: 4060113 - DNA, 15 bp, Homo sapiens
caggtgtttggcacc

SEQ ID NO: 4060114 - DNA, 22 bp, Homo sapiens
caggtgtttggcacccaaatca

SEQ ID NO: 4060115 - DNA, 13 bp, Homo sapiens
caggttaacctgc

SEQ ID NO: 4060116 - DNA, 17 bp, Homo sapiens
caggttatactcctcct

SEQ ID NO: 4060117 - DNA, 19 bp, Homo sapiens
caggttatcgaaataacaa

SEQ ID NO: 4060118 - DNA, 20 bp, Homo sapiens
caggttatcgaaataacaat

SEQ ID NO: 4060119 - DNA, 14 bp, Homo sapiens
caggttcccaagct

SEQ ID NO: 4060120 - DNA, 12 bp, Homo sapiens
caggttcttcag

SEQ ID NO: 4060121 - DNA, 21 bp, Homo sapiens
caggttggaaggggccttgct

SEQ ID NO: 4060122 - DNA, 21 bp, Homo sapiens
caggttggatgggagtgggca

SEQ ID NO: 4060123 - DNA, 19 bp, Homo sapiens
caggttggcaaacgggctt

SEQ ID NO: 4060124 - DNA, 18 bp, Homo sapiens
caggttgggctagagaaa

SEQ ID NO: 4060125 - DNA, 15 bp, Homo sapiens
cagtaaatttgctag

SEQ ID NO: 4060126 - DNA, 19 bp, Homo sapiens
cagtaacgcgtcttcctga

SEQ ID NO: 4060127 - DNA, 20 bp, Homo sapiens
cagtaacgcgtcttcctgag

SEQ ID NO: 4060128 - DNA, 10 bp, Homo sapiens
cagtaactgt

SEQ ID NO: 4060129 - DNA, 19 bp, Homo sapiens
cagtaagtttcccctctgg

SEQ ID NO: 4060130 - DNA, 12 bp, Homo sapiens
cagtaataactc

SEQ ID NO: 4060131 - DNA, 13 bp, Homo sapiens
cagtaataactct

SEQ ID NO: 4060132 - DNA, 13 bp, Homo sapiens
cagtaatatttat

SEQ ID NO: 4060133 - DNA, 19 bp, Homo sapiens
cagtacccatggggctagg

SEQ ID NO: 4060134 - DNA, 16 bp, Homo sapiens
cagtaccctccattgg

SEQ ID NO: 4060135 - DNA, 19 bp, Homo sapiens
cagtaccctctcagctcca

SEQ ID NO: 4060136 - DNA, 21 bp, Homo sapiens
cagtacctctgtatagaaatc

SEQ ID NO: 4060137 - DNA, 23 bp, Homo sapiens
cagtgatgtaccatgaaacaaag

SEQ ID NO: 4060138 - DNA, 21 bp, Homo sapiens
cagtgcagacaggccatgtga

SEQ ID NO: 4060139 - DNA, 15 bp, Homo sapiens
cagtgcagccactgg

SEQ ID NO: 4060140 - DNA, 16 bp, Homo sapiens
cagtgcagccactggc

SEQ ID NO: 4060141 - DNA, 17 bp, Homo sapiens
cagtgcatctcagccca

SEQ ID NO: 4060142 - DNA, 18 bp, Homo sapiens
cagtgcatctcagcccac

SEQ ID NO: 4060143 - DNA, 16 bp, Homo sapiens
cagtgccaaatgctgg

SEQ ID NO: 4060144 - DNA, 17 bp, Homo sapiens
cagtgccaaatgctggg

SEQ ID NO: 4060145 - DNA, 18 bp, Homo sapiens
cagtgccaaatgctgggg

SEQ ID NO: 4060146 - DNA, 10 bp, Homo sapiens
cagtgccaac

SEQ ID NO: 4060147 - DNA, 17 bp, Homo sapiens
cagtgccagcaatgaca

SEQ ID NO: 4060148 - DNA, 20 bp, Homo sapiens
cagtgccatgtaaatcccca

SEQ ID NO: 4060149 - DNA, 10 bp, Homo sapiens
cagtgccatt

SEQ ID NO: 4060150 - DNA, 18 bp, Homo sapiens
cagtgccattccactcca

SEQ ID NO: 4060151 - DNA, 13 bp, Homo sapiens
cagtgccccaggg

SEQ ID NO: 4060152 - DNA, 18 bp, Homo sapiens
cagtgccccagggagtcc

SEQ ID NO: 4060153 - DNA, 21 bp, Homo sapiens
cagtgcccccactgaccagaa

SEQ ID NO: 4060154 - DNA, 13 bp, Homo sapiens
cagtgccttctct

SEQ ID NO: 4060155 - DNA, 12 bp, Homo sapiens
cagtgccttgct

SEQ ID NO: 4060156 - DNA, 13 bp, Homo sapiens
cagtgccttgctc

SEQ ID NO: 4060157 - DNA, 16 bp, Homo sapiens
cagtgctcaccagccc

SEQ ID NO: 4060158 - DNA, 22 bp, Homo sapiens
cagtgctcaccagccctgcagc

SEQ ID NO: 4060159 - DNA, 12 bp, Homo sapiens
cagtgctgtgtg

SEQ ID NO: 4060160 - DNA, 17 bp, Homo sapiens
cagtggagcccaggagt

SEQ ID NO: 4060161 - DNA, 15 bp, Homo sapiens
cagtggaggtttgtc

SEQ ID NO: 4060162 - DNA, 19 bp, Homo sapiens
cagtggagtgcaaaaggct

SEQ ID NO: 4060163 - DNA, 21 bp, Homo sapiens
cagtggagtgcaaaaggcttg

SEQ ID NO: 4060164 - DNA, 18 bp, Homo sapiens
cagtggcagacaaacaga

SEQ ID NO: 4060165 - DNA, 20 bp, Homo sapiens
cagtggcgggtgatggccag

SEQ ID NO: 4060166 - DNA, 17 bp, Homo sapiens
cagtggctgggtgggcc

SEQ ID NO: 4060167 - DNA, 20 bp, Homo sapiens
cagtggctgggtgggcccag

SEQ ID NO: 4060168 - DNA, 22 bp, Homo sapiens
cagtggctgggtgggcccagaa

SEQ ID NO: 4060169 - DNA, 19 bp, Homo sapiens
cagtggctggtccagggct

SEQ ID NO: 4060170 - DNA, 20 bp, Homo sapiens
cagtggctggtccagggcta

SEQ ID NO: 4060171 - DNA, 19 bp, Homo sapiens
cagtggcttcatctgtcaa

SEQ ID NO: 4060172 - DNA, 11 bp, Homo sapiens
cagtggcttcc

SEQ ID NO: 4060173 - DNA, 18 bp, Homo sapiens
cagtggcttcccagctct

SEQ ID NO: 4060174 - DNA, 16 bp, Homo sapiens
cagtgggacagggcat

SEQ ID NO: 4060175 - DNA, 19 bp, Homo sapiens
cagtgggacagggcatggc

SEQ ID NO: 4060176 - DNA, 16 bp, Homo sapiens
cagtgggaccacatgc

SEQ ID NO: 4060177 - DNA, 17 bp, Homo sapiens
cagtgggaccacatgcc

SEQ ID NO: 4060178 - DNA, 23 bp, Homo sapiens
cagtgggaccacatgccactgcc

SEQ ID NO: 4060179 - DNA, 13 bp, Homo sapiens
cagtgggagccct

SEQ ID NO: 4060180 - DNA, 14 bp, Homo sapiens
cagtgggagccctg

SEQ ID NO: 4060181 - DNA, 17 bp, Homo sapiens
cagtgggagccctgacc

SEQ ID NO: 4060182 - DNA, 17 bp, Homo sapiens
cagtgggatgggacagg

SEQ ID NO: 4060183 - DNA, 14 bp, Homo sapiens
cagtgggcgggcca

SEQ ID NO: 4060184 - DNA, 19 bp, Homo sapiens
cagtgggcgggccatgagg

SEQ ID NO: 4060185 - DNA, 23 bp, Homo sapiens
cagtgggcgttgggagcctagct

SEQ ID NO: 4060186 - DNA, 17 bp, Homo sapiens
cagtggggcctgtggaa

SEQ ID NO: 4060187 - DNA, 20 bp, Homo sapiens
cagtggtaagctctggcttt

SEQ ID NO: 4060188 - DNA, 14 bp, Homo sapiens
cagtggtgaagaaa

SEQ ID NO: 4060189 - DNA, 17 bp, Homo sapiens
cagtggtgaagaaaact

SEQ ID NO: 4060190 - DNA, 20 bp, Homo sapiens
cagtgtacatagtgtaatgt

SEQ ID NO: 4060191 - DNA, 17 bp, Homo sapiens
cagtgtagttaatttat

SEQ ID NO: 4060192 - DNA, 19 bp, Homo sapiens
cagtgtatcaggtcaggga

SEQ ID NO: 4060193 - DNA, 17 bp, Homo sapiens
cagtgtcacctctctca

SEQ ID NO: 4060194 - DNA, 20 bp, Homo sapiens
cagtgtcacctctctcagag

SEQ ID NO: 4060195 - DNA, 21 bp, Homo sapiens
cagtgtcacctctctcagagc

SEQ ID NO: 4060196 - DNA, 18 bp, Homo sapiens
cagtgtcctcttgctcaa

SEQ ID NO: 4060197 - DNA, 14 bp, Homo sapiens
cagtgtctcggagg

SEQ ID NO: 4060198 - DNA, 22 bp, Homo sapiens
cagtgtctgtatcggagacagt

SEQ ID NO: 4060199 - DNA, 15 bp, Homo sapiens
cagtgtctgtgccat

SEQ ID NO: 4060200 - DNA, 21 bp, Homo sapiens
cagtgtctgtgccatggattt

SEQ ID NO: 4060201 - DNA, 22 bp, Homo sapiens
cagtgtgcacgagtgggaagga

SEQ ID NO: 4060202 - DNA, 18 bp, Homo sapiens
cagtgtggagaccctgcc

SEQ ID NO: 4060203 - DNA, 22 bp, Homo sapiens
cagtgtggagaccctgccacag

SEQ ID NO: 4060204 - DNA, 13 bp, Homo sapiens
cagtgtggagtgg

SEQ ID NO: 4060205 - DNA, 14 bp, Homo sapiens
cagtgtgtctaaat

SEQ ID NO: 4060206 - DNA, 23 bp, Homo sapiens
cagtgtgtctaaatttgaatgtt

SEQ ID NO: 4060207 - DNA, 20 bp, Homo sapiens
cagtgtgtgaactgctttca

SEQ ID NO: 4060208 - DNA, 22 bp, Homo sapiens
cagtgtgtgtgtgtggtccatg

SEQ ID NO: 4060209 - DNA, 14 bp, Homo sapiens
cagtgttacctgtg

SEQ ID NO: 4060210 - DNA, 18 bp, Homo sapiens
cagtgttacctgtgtgct

SEQ ID NO: 4060211 - DNA, 19 bp, Homo sapiens
cagtgttagagaaatcctt

SEQ ID NO: 4060212 - DNA, 16 bp, Homo sapiens
cagtgttctcacagtg

SEQ ID NO: 4060213 - DNA, 17 bp, Homo sapiens
cagtgttgctcagctcc

SEQ ID NO: 4060214 - DNA, 23 bp, Homo sapiens
cagtgttgttgctctaggaagac

SEQ ID NO: 4060215 - DNA, 14 bp, Homo sapiens
cagtgttgtttgta

SEQ ID NO: 4060216 - DNA, 16 bp, Homo sapiens
cagtgttgtttgtaaa

SEQ ID NO: 4060217 - DNA, 17 bp, Homo sapiens
cagtgttgtttgtaaat

SEQ ID NO: 4060218 - DNA, 19 bp, Homo sapiens
cagtgttgtttgtaaataa

SEQ ID NO: 4060219 - DNA, 20 bp, Homo sapiens
cagtgttgtttgtaaataag

SEQ ID NO: 4060220 - DNA, 15 bp, Homo sapiens
cagtgtttcccataa

SEQ ID NO: 4060221 - DNA, 20 bp, Homo sapiens
cagtgtttcccataattttc

SEQ ID NO: 4060222 - DNA, 13 bp, Homo sapiens
cagtgtttgtgtg

SEQ ID NO: 4060223 - DNA, 20 bp, Homo sapiens
cagtgttttggactccatct

SEQ ID NO: 4060224 - DNA, 21 bp, Homo sapiens
cagttaactattgcatttata

SEQ ID NO: 4060225 - DNA, 24 bp, Homo sapiens
cagttaactattgcatttatatgt

SEQ ID NO: 4060226 - DNA, 16 bp, Homo sapiens
cagttaactttcagaa

SEQ ID NO: 4060227 - DNA, 16 bp, Homo sapiens
cagttaattcaatgtg

SEQ ID NO: 4060228 - DNA, 22 bp, Homo sapiens
cagttaccacacatctatgata

SEQ ID NO: 4060229 - DNA, 21 bp, Homo sapiens
cagttacccactcggtcccag

SEQ ID NO: 4060230 - DNA, 13 bp, Homo sapiens
cagttagactagt

SEQ ID NO: 4060231 - DNA, 20 bp, Homo sapiens
cagttagttgtgaaagaaag

SEQ ID NO: 4060232 - DNA, 18 bp, Homo sapiens
cagttatgtgaatgatct

SEQ ID NO: 4060233 - DNA, 19 bp, Homo sapiens
cagttattttggatatatt

SEQ ID NO: 4060234 - DNA, 21 bp, Homo sapiens
cagttattttggatatattat

SEQ ID NO: 4060235 - DNA, 16 bp, Homo sapiens
cagttcaacctggtgg

SEQ ID NO: 4060236 - DNA, 23 bp, Homo sapiens
cagttcaacctggtggcaccaga

SEQ ID NO: 4060237 - DNA, 19 bp, Homo sapiens
cagttcaatctcccgctgc

SEQ ID NO: 4060238 - DNA, 22 bp, Homo sapiens
cagttcaatctcccgctgctgc

SEQ ID NO: 4060239 - DNA, 13 bp, Homo sapiens
catacaggtgctc

SEQ ID NO: 4060240 - DNA, 21 bp, Homo sapiens
catacatcagttattcattct

SEQ ID NO: 4060241 - DNA, 17 bp, Homo sapiens
catacatttataatgtt

SEQ ID NO: 4060242 - DNA, 22 bp, Homo sapiens
cataccccactgggcacacgca

SEQ ID NO: 4060243 - DNA, 18 bp, Homo sapiens
catactactgaaacagat

SEQ ID NO: 4060244 - DNA, 20 bp, Homo sapiens
catactactgaaacagattt

SEQ ID NO: 4060245 - DNA, 20 bp, Homo sapiens
catactcagcctgctgccca

SEQ ID NO: 4060246 - DNA, 15 bp, Homo sapiens
catactgagggacca

SEQ ID NO: 4060247 - DNA, 13 bp, Homo sapiens
catactggcagga

SEQ ID NO: 4060248 - DNA, 16 bp, Homo sapiens
catacttatctctctg

SEQ ID NO: 4060249 - DNA, 18 bp, Homo sapiens
catacttatctctctgtg

SEQ ID NO: 4060250 - DNA, 20 bp, Homo sapiens
catacttatctctctgtgct

SEQ ID NO: 4060251 - DNA, 17 bp, Homo sapiens
catacttgaagggccag

SEQ ID NO: 4060252 - DNA, 20 bp, Homo sapiens
catacttgaagggccagagc

SEQ ID NO: 4060253 - DNA, 15 bp, Homo sapiens
catagaccctgaggc

SEQ ID NO: 4060254 - DNA, 12 bp, Homo sapiens
catagaggcttc

SEQ ID NO: 4060255 - DNA, 23 bp, Homo sapiens
catagatgtccctttcttggcca

SEQ ID NO: 4060256 - DNA, 16 bp, Homo sapiens
catagatgttttggta

SEQ ID NO: 4060257 - DNA, 15 bp, Homo sapiens
catagcaacaggaaa

SEQ ID NO: 4060258 - DNA, 18 bp, Homo sapiens
catagcagattttaattt

SEQ ID NO: 4060259 - DNA, 14 bp, Homo sapiens
catagcataggaca

SEQ ID NO: 4060260 - DNA, 11 bp, Homo sapiens
catagcattaa

SEQ ID NO: 4060261 - DNA, 16 bp, Homo sapiens
catagcccctgccccg

SEQ ID NO: 4060262 - DNA, 16 bp, Homo sapiens
catagcgaaataaaaa

SEQ ID NO: 4060263 - DNA, 14 bp, Homo sapiens
catagctccttgga

SEQ ID NO: 4060264 - DNA, 20 bp, Homo sapiens
catagctccttggagcaggc

SEQ ID NO: 4060265 - DNA, 12 bp, Homo sapiens
cataggaaaagt

SEQ ID NO: 4060266 - DNA, 18 bp, Homo sapiens
cataggaaaagtacattt

SEQ ID NO: 4060267 - DNA, 22 bp, Homo sapiens
cataggaaaagtacatttaata

SEQ ID NO: 4060268 - DNA, 17 bp, Homo sapiens
cataggacatactgcat

SEQ ID NO: 4060269 - DNA, 20 bp, Homo sapiens
cataggacatactgcatgta

SEQ ID NO: 4060270 - DNA, 14 bp, Homo sapiens
cataggcctgggtg

SEQ ID NO: 4060271 - DNA, 17 bp, Homo sapiens
cataggcctgggtgctg

SEQ ID NO: 4060272 - DNA, 15 bp, Homo sapiens
cataggtaagctgtg

SEQ ID NO: 4060273 - DNA, 16 bp, Homo sapiens
catagtaccaatcatt

SEQ ID NO: 4060274 - DNA, 22 bp, Homo sapiens
catagtaccaatcattttaatt

SEQ ID NO: 4060275 - DNA, 20 bp, Homo sapiens
catagtaccatttatacaaa

SEQ ID NO: 4060276 - DNA, 17 bp, Homo sapiens
catagtagtttttacag

SEQ ID NO: 4060277 - DNA, 18 bp, Homo sapiens
catagtgatggttcccct

SEQ ID NO: 4060278 - DNA, 19 bp, Homo sapiens
catagtgatggttcccctg

SEQ ID NO: 4060279 - DNA, 11 bp, Homo sapiens
catagtgctgg

SEQ ID NO: 4060280 - DNA, 13 bp, Homo sapiens
catagtgctggga

SEQ ID NO: 4060281 - DNA, 18 bp, Homo sapiens
catagttatgtgattttc

SEQ ID NO: 4060282 - DNA, 20 bp, Homo sapiens
catataaatgaatctggtgt

SEQ ID NO: 4060283 - DNA, 15 bp, Homo sapiens
catataatgttgtta

SEQ ID NO: 4060284 - DNA, 18 bp, Homo sapiens
catatactgttcttcatt

SEQ ID NO: 4060285 - DNA, 18 bp, Homo sapiens
catataggtgatgtttgc

SEQ ID NO: 4060286 - DNA, 18 bp, Homo sapiens
catatatgaccagaagcc

SEQ ID NO: 4060287 - DNA, 13 bp, Homo sapiens
catatatttattg

SEQ ID NO: 4060288 - DNA, 16 bp, Homo sapiens
catatcatgctaaaat

SEQ ID NO: 4060289 - DNA, 20 bp, Homo sapiens
catatcatgctaaaattcta

SEQ ID NO: 4060290 - DNA, 16 bp, Homo sapiens
catatccaagatcaat

SEQ ID NO: 4060291 - DNA, 15 bp, Homo sapiens
catatcctgagccat

SEQ ID NO: 4060292 - DNA, 22 bp, Homo sapiens
catatcttctatatctgaagag

SEQ ID NO: 4060293 - DNA, 15 bp, Homo sapiens
catatctttattaat

SEQ ID NO: 4060294 - DNA, 15 bp, Homo sapiens
catatgacttgatct

SEQ ID NO: 4060295 - DNA, 22 bp, Homo sapiens
catatgagccgtgaactgtgca

SEQ ID NO: 4060296 - DNA, 14 bp, Homo sapiens
catatgagtgtgga

SEQ ID NO: 4060297 - DNA, 17 bp, Homo sapiens
catatgagtgtggaagc

SEQ ID NO: 4060298 - DNA, 15 bp, Homo sapiens
catatgatctgtttt

SEQ ID NO: 4060299 - DNA, 21 bp, Homo sapiens
catatgggatattcccaagcc

SEQ ID NO: 4060300 - DNA, 16 bp, Homo sapiens
catatgtacataaatt

SEQ ID NO: 4060301 - DNA, 15 bp, Homo sapiens
catatgtaccatgta

SEQ ID NO: 4060302 - DNA, 16 bp, Homo sapiens
catatgttgaatactt

SEQ ID NO: 4060303 - DNA, 17 bp, Homo sapiens
catatgttgaatacttt

SEQ ID NO: 4060304 - DNA, 18 bp, Homo sapiens
catatgttgaatactttt

SEQ ID NO: 4060305 - DNA, 16 bp, Homo sapiens
catatgttgctcagtc

SEQ ID NO: 4060306 - DNA, 16 bp, Homo sapiens
catattactgttgcat

SEQ ID NO: 4060307 - DNA, 19 bp, Homo sapiens
catattactgttgcattta

SEQ ID NO: 4060308 - DNA, 23 bp, Homo sapiens
catattactgttgcatttacttt

SEQ ID NO: 4060309 - DNA, 16 bp, Homo sapiens
catattccatatttat

SEQ ID NO: 4060310 - DNA, 17 bp, Homo sapiens
catattctaaaaccatt

SEQ ID NO: 4060311 - DNA, 13 bp, Homo sapiens
catattctattgt

SEQ ID NO: 4060312 - DNA, 15 bp, Homo sapiens
catattcttgtgctt

SEQ ID NO: 4060313 - DNA, 13 bp, Homo sapiens
catattgatgaaa

SEQ ID NO: 4060314 - DNA, 16 bp, Homo sapiens
catattgctgagagaa

SEQ ID NO: 4060315 - DNA, 12 bp, Homo sapiens
catattgtttga

SEQ ID NO: 4060316 - DNA, 16 bp, Homo sapiens
catatttactacctta

SEQ ID NO: 4060317 - DNA, 16 bp, Homo sapiens
catatttacttcttat

SEQ ID NO: 4060318 - DNA, 22 bp, Homo sapiens
catatttatagcaatccatgtt

SEQ ID NO: 4060319 - DNA, 12 bp, Homo sapiens
catatttatcca

SEQ ID NO: 4060320 - DNA, 22 bp, Homo sapiens
catatttatccaaaatgtgtat

SEQ ID NO: 4060321 - DNA, 12 bp, Homo sapiens
catatttggaag

SEQ ID NO: 4060322 - DNA, 14 bp, Homo sapiens
catcaacatcttgg

SEQ ID NO: 4060323 - DNA, 19 bp, Homo sapiens
catcaatatccctcttgta

SEQ ID NO: 4060324 - DNA, 21 bp, Homo sapiens
catcaatatccctcttgtaag

SEQ ID NO: 4060325 - DNA, 14 bp, Homo sapiens
catcaatgttcatt

SEQ ID NO: 4060326 - DNA, 16 bp, Homo sapiens
catcaatgttcattgt

SEQ ID NO: 4060327 - DNA, 19 bp, Homo sapiens
catcacagggttgggccca

SEQ ID NO: 4060328 - DNA, 15 bp, Homo sapiens
catcaccctttgcct

SEQ ID NO: 4060329 - DNA, 16 bp, Homo sapiens
catcaccctttgcctt

SEQ ID NO: 4060330 - DNA, 21 bp, Homo sapiens
catcaccctttgccttagcag

SEQ ID NO: 4060331 - DNA, 23 bp, Homo sapiens
catcacctcaccaaggatcggac

SEQ ID NO: 4060332 - DNA, 19 bp, Homo sapiens
catcacgtaccccactggg

SEQ ID NO: 4060333 - DNA, 22 bp, Homo sapiens
catcactaaaccgataatgcat

SEQ ID NO: 4060334 - DNA, 20 bp, Homo sapiens
catcactgcttgatgaagca

SEQ ID NO: 4060335 - DNA, 15 bp, Homo sapiens
catcagacctgtctt

SEQ ID NO: 4060336 - DNA, 19 bp, Homo sapiens
catcagacctgtcttccaa

SEQ ID NO: 4060337 - DNA, 19 bp, Homo sapiens
catcagatggaaatatttt

SEQ ID NO: 4060338 - DNA, 17 bp, Homo sapiens
catcagctgtaagaaga

SEQ ID NO: 4060339 - DNA, 19 bp, Homo sapiens
catcaggaaggaaatgaca

SEQ ID NO: 4060340 - DNA, 13 bp, Homo sapiens
catcaggatgaac

SEQ ID NO: 4060341 - DNA, 17 bp, Homo sapiens
catcaggatgaacccag

SEQ ID NO: 4060342 - DNA, 21 bp, Homo sapiens
catcctttcacttctttccct

SEQ ID NO: 4060343 - DNA, 18 bp, Homo sapiens
catcctttgcagggcagc

SEQ ID NO: 4060344 - DNA, 15 bp, Homo sapiens
catcctttgttctga

SEQ ID NO: 4060345 - DNA, 19 bp, Homo sapiens
catcctttgttctgagcat

SEQ ID NO: 4060346 - DNA, 18 bp, Homo sapiens
catcgatatgtatatcat

SEQ ID NO: 4060347 - DNA, 21 bp, Homo sapiens
catcgcaggagtctctgccac

SEQ ID NO: 4060348 - DNA, 21 bp, Homo sapiens
catcggacaagacccccagca

SEQ ID NO: 4060349 - DNA, 20 bp, Homo sapiens
catcggaggctgggcccctg

SEQ ID NO: 4060350 - DNA, 23 bp, Homo sapiens
catcggaggctgggcccctggga

SEQ ID NO: 4060351 - DNA, 21 bp, Homo sapiens
catcggtgaaactaacagata

SEQ ID NO: 4060352 - DNA, 21 bp, Homo sapiens
catcgtataacacaatatgaa

SEQ ID NO: 4060353 - DNA, 19 bp, Homo sapiens
catctaatgcttgtttatg

SEQ ID NO: 4060354 - DNA, 20 bp, Homo sapiens
catctaccttttctggcaaa

SEQ ID NO: 4060355 - DNA, 16 bp, Homo sapiens
catctacttaataaat

SEQ ID NO: 4060356 - DNA, 17 bp, Homo sapiens
catctaggtaattttta

SEQ ID NO: 4060357 - DNA, 20 bp, Homo sapiens
catctatctcatctatctca

SEQ ID NO: 4060358 - DNA, 14 bp, Homo sapiens
catctattttggat

SEQ ID NO: 4060359 - DNA, 19 bp, Homo sapiens
catctcactggatgcaaag

SEQ ID NO: 4060360 - DNA, 18 bp, Homo sapiens
catctcagaccctttagc

SEQ ID NO: 4060361 - DNA, 20 bp, Homo sapiens
catctcagcctaccatgaga

SEQ ID NO: 4060362 - DNA, 14 bp, Homo sapiens
catctcagcctcct

SEQ ID NO: 4060363 - DNA, 17 bp, Homo sapiens
catctcagcctcctgag

SEQ ID NO: 4060364 - DNA, 13 bp, Homo sapiens
catctcaggagat

SEQ ID NO: 4060365 - DNA, 16 bp, Homo sapiens
catctcaggggccaga

SEQ ID NO: 4060366 - DNA, 19 bp, Homo sapiens
catctcaggggccagagga

SEQ ID NO: 4060367 - DNA, 22 bp, Homo sapiens
catctcatgcccctggctggga

SEQ ID NO: 4060368 - DNA, 23 bp, Homo sapiens
catctcatgtatcatctggatag

SEQ ID NO: 4060369 - DNA, 18 bp, Homo sapiens
catctccaaggatcctct

SEQ ID NO: 4060370 - DNA, 22 bp, Homo sapiens
catctccagggagcaagacaga

SEQ ID NO: 4060371 - DNA, 20 bp, Homo sapiens
catctccatcatatgcctga

SEQ ID NO: 4060372 - DNA, 21 bp, Homo sapiens
catctcccaccctgtacctca

SEQ ID NO: 4060373 - DNA, 21 bp, Homo sapiens
catctccctgcctggccccca

SEQ ID NO: 4060374 - DNA, 17 bp, Homo sapiens
catctcctgctcaccac

SEQ ID NO: 4060375 - DNA, 20 bp, Homo sapiens
catctcctgctcaccacctg

SEQ ID NO: 4060376 - DNA, 16 bp, Homo sapiens
catctccttagaaaag

SEQ ID NO: 4060377 - DNA, 12 bp, Homo sapiens
catctctcccca

SEQ ID NO: 4060378 - DNA, 18 bp, Homo sapiens
catctctctgcccaaccc

SEQ ID NO: 4060379 - DNA, 20 bp, Homo sapiens
catctctctggggccctggg

SEQ ID NO: 4060380 - DNA, 21 bp, Homo sapiens
catctctctggggccctgggc

SEQ ID NO: 4060381 - DNA, 13 bp, Homo sapiens
catctctgcttgg

SEQ ID NO: 4060382 - DNA, 12 bp, Homo sapiens
catctcttcccc

SEQ ID NO: 4060383 - DNA, 15 bp, Homo sapiens
catctgaagagcaga

SEQ ID NO: 4060384 - DNA, 15 bp, Homo sapiens
catctgagcaagagc

SEQ ID NO: 4060385 - DNA, 18 bp, Homo sapiens
catctgatgccgtgatcc

SEQ ID NO: 4060386 - DNA, 15 bp, Homo sapiens
catctgattaaaaca

SEQ ID NO: 4060387 - DNA, 17 bp, Homo sapiens
catctgcaatatgaatt

SEQ ID NO: 4060388 - DNA, 19 bp, Homo sapiens
catctgcaccccttctctc

SEQ ID NO: 4060389 - DNA, 23 bp, Homo sapiens
catctgcaccccttctctcctcc

SEQ ID NO: 4060390 - DNA, 20 bp, Homo sapiens
catctgccttaaaaccaaag

SEQ ID NO: 4060391 - DNA, 18 bp, Homo sapiens
catctgcgtgacaataaa

SEQ ID NO: 4060392 - DNA, 22 bp, Homo sapiens
catctgcgtgacaataaaacat

SEQ ID NO: 4060393 - DNA, 21 bp, Homo sapiens
catctggaatctggagaccag

SEQ ID NO: 4060394 - DNA, 18 bp, Homo sapiens
catctggataggagcctg

SEQ ID NO: 4060395 - DNA, 21 bp, Homo sapiens
catctggataggagcctgctg

SEQ ID NO: 4060396 - DNA, 21 bp, Homo sapiens
catctggctgtctagaatgtg

SEQ ID NO: 4060397 - DNA, 22 bp, Homo sapiens
catctggctgtttagcagaact

SEQ ID NO: 4060398 - DNA, 17 bp, Homo sapiens
catctgggctcctccag

SEQ ID NO: 4060399 - DNA, 20 bp, Homo sapiens
catctgggctcctccagggt

SEQ ID NO: 4060400 - DNA, 15 bp, Homo sapiens
catctgggtccttgc

SEQ ID NO: 4060401 - DNA, 22 bp, Homo sapiens
catctggttgaactctggtggc

SEQ ID NO: 4060402 - DNA, 12 bp, Homo sapiens
catctgtccagc

SEQ ID NO: 4060403 - DNA, 14 bp, Homo sapiens
catctgtccatggc

SEQ ID NO: 4060404 - DNA, 19 bp, Homo sapiens
catctgtccatggcctttc

SEQ ID NO: 4060405 - DNA, 17 bp, Homo sapiens
catctgtgcactgccca

SEQ ID NO: 4060406 - DNA, 18 bp, Homo sapiens
catctgtgcagggctggt

SEQ ID NO: 4060407 - DNA, 14 bp, Homo sapiens
catcttagtgcctg

SEQ ID NO: 4060408 - DNA, 15 bp, Homo sapiens
catcttcactgcaat

SEQ ID NO: 4060409 - DNA, 22 bp, Homo sapiens
catcttccctagagggttcctg

SEQ ID NO: 4060410 - DNA, 13 bp, Homo sapiens
catcttcctgtgt

SEQ ID NO: 4060411 - DNA, 14 bp, Homo sapiens
catcttcctgtgtc

SEQ ID NO: 4060412 - DNA, 15 bp, Homo sapiens
catcttcctgtgtcc

SEQ ID NO: 4060413 - DNA, 17 bp, Homo sapiens
catcttcctgtgtcctg

SEQ ID NO: 4060414 - DNA, 21 bp, Homo sapiens
catcttctaaacccaatccaa

SEQ ID NO: 4060415 - DNA, 14 bp, Homo sapiens
catcttcttcccag

SEQ ID NO: 4060416 - DNA, 15 bp, Homo sapiens
catcttcttcccagt

SEQ ID NO: 4060417 - DNA, 20 bp, Homo sapiens
catcttgacagagcctgccc

SEQ ID NO: 4060418 - DNA, 13 bp, Homo sapiens
catcttgctggct

SEQ ID NO: 4060419 - DNA, 14 bp, Homo sapiens
catcttgctggcta

SEQ ID NO: 4060420 - DNA, 19 bp, Homo sapiens
catctttaaacagtatttc

SEQ ID NO: 4060421 - DNA, 10 bp, Homo sapiens
catctttaag

SEQ ID NO: 4060422 - DNA, 16 bp, Homo sapiens
catctttatctgttct

SEQ ID NO: 4060423 - DNA, 15 bp, Homo sapiens
catctttgccttggg

SEQ ID NO: 4060424 - DNA, 21 bp, Homo sapiens
catcttttgaggcttctgttc

SEQ ID NO: 4060425 - DNA, 21 bp, Homo sapiens
catctttttaacctgcaaaat

SEQ ID NO: 4060426 - DNA, 15 bp, Homo sapiens
catgaaaaagcagct

SEQ ID NO: 4060427 - DNA, 16 bp, Homo sapiens
catgaaaacgttttat

SEQ ID NO: 4060428 - DNA, 13 bp, Homo sapiens
catgaaaatttta

SEQ ID NO: 4060429 - DNA, 17 bp, Homo sapiens
catgaaaattttaaaaa

SEQ ID NO: 4060430 - DNA, 13 bp, Homo sapiens
catgaaacaaagc

SEQ ID NO: 4060431 - DNA, 13 bp, Homo sapiens
catgaaaggcatc

SEQ ID NO: 4060432 - DNA, 15 bp, Homo sapiens
catgaaatatgcatc

SEQ ID NO: 4060433 - DNA, 18 bp, Homo sapiens
catgaacacccttagaaa

SEQ ID NO: 4060434 - DNA, 18 bp, Homo sapiens
catgaagaatagaaacaa

SEQ ID NO: 4060435 - DNA, 18 bp, Homo sapiens
catgaagagaagcaattt

SEQ ID NO: 4060436 - DNA, 13 bp, Homo sapiens
catgaagagcttg

SEQ ID NO: 4060437 - DNA, 17 bp, Homo sapiens
catgaagtaaattatgt

SEQ ID NO: 4060438 - DNA, 18 bp, Homo sapiens
catgaattcccttttaat

SEQ ID NO: 4060439 - DNA, 12 bp, Homo sapiens
catgacagaggc

SEQ ID NO: 4060440 - DNA, 14 bp, Homo sapiens
catgacagaggctg

SEQ ID NO: 4060441 - DNA, 14 bp, Homo sapiens
catgacagcctgca

SEQ ID NO: 4060442 - DNA, 18 bp, Homo sapiens
catgacatatgacttgat

SEQ ID NO: 4060443 - DNA, 14 bp, Homo sapiens
catgaccagtaaag

SEQ ID NO: 4060444 - DNA, 21 bp, Homo sapiens
catgctgttgcatttagaact

SEQ ID NO: 4060445 - DNA, 14 bp, Homo sapiens
catgcttcatcatt

SEQ ID NO: 4060446 - DNA, 19 bp, Homo sapiens
catgcttcccagagggagc

SEQ ID NO: 4060447 - DNA, 21 bp, Homo sapiens
catgcttcccagagggagcag

SEQ ID NO: 4060448 - DNA, 15 bp, Homo sapiens
catggaaaaatggtt

SEQ ID NO: 4060449 - DNA, 16 bp, Homo sapiens
catggaaaaatggttg

SEQ ID NO: 4060450 - DNA, 19 bp, Homo sapiens
catggaacttttctgtaat

SEQ ID NO: 4060451 - DNA, 18 bp, Homo sapiens
catggaatggacatcctg

SEQ ID NO: 4060452 - DNA, 23 bp, Homo sapiens
catggacaccccttatccaggac

SEQ ID NO: 4060453 - DNA, 14 bp, Homo sapiens
catggacactccag

SEQ ID NO: 4060454 - DNA, 16 bp, Homo sapiens
catggacaggctggct

SEQ ID NO: 4060455 - DNA, 18 bp, Homo sapiens
catggactgttgccacca

SEQ ID NO: 4060456 - DNA, 12 bp, Homo sapiens
catggacttgta

SEQ ID NO: 4060457 - DNA, 14 bp, Homo sapiens
catggagccagctc

SEQ ID NO: 4060458 - DNA, 17 bp, Homo sapiens
catggagccagctccct

SEQ ID NO: 4060459 - DNA, 15 bp, Homo sapiens
catggagccccctct

SEQ ID NO: 4060460 - DNA, 12 bp, Homo sapiens
catggagctgtc

SEQ ID NO: 4060461 - DNA, 14 bp, Homo sapiens
catggagtgtgtat

SEQ ID NO: 4060462 - DNA, 22 bp, Homo sapiens
catggagtgtgtattgttccca

SEQ ID NO: 4060463 - DNA, 19 bp, Homo sapiens
catggatgggggaactcag

SEQ ID NO: 4060464 - DNA, 23 bp, Homo sapiens
catggattttggataaatcattt

SEQ ID NO: 4060465 - DNA, 14 bp, Homo sapiens
catggatttttaca

SEQ ID NO: 4060466 - DNA, 21 bp, Homo sapiens
catggcagaataatctttggg

SEQ ID NO: 4060467 - DNA, 22 bp, Homo sapiens
catggcagaataatctttgggt

SEQ ID NO: 4060468 - DNA, 17 bp, Homo sapiens
catggcagctgtttctc

SEQ ID NO: 4060469 - DNA, 15 bp, Homo sapiens
catggcccccagggg

SEQ ID NO: 4060470 - DNA, 22 bp, Homo sapiens
catggcccccaggggcaggact

SEQ ID NO: 4060471 - DNA, 13 bp, Homo sapiens
catggcccctctg

SEQ ID NO: 4060472 - DNA, 12 bp, Homo sapiens
catggccctggg

SEQ ID NO: 4060473 - DNA, 16 bp, Homo sapiens
catggccctgtcccag

SEQ ID NO: 4060474 - DNA, 20 bp, Homo sapiens
catggcctattatattaaaa

SEQ ID NO: 4060475 - DNA, 19 bp, Homo sapiens
catggccttatgaggcagg

SEQ ID NO: 4060476 - DNA, 17 bp, Homo sapiens
catggctgtgtttgcag

SEQ ID NO: 4060477 - DNA, 13 bp, Homo sapiens
catggcttctgaa

SEQ ID NO: 4060478 - DNA, 23 bp, Homo sapiens
catgggaaactgttgtgggcgct

SEQ ID NO: 4060479 - DNA, 17 bp, Homo sapiens
catgggatatgtggtgt

SEQ ID NO: 4060480 - DNA, 21 bp, Homo sapiens
catgggcttcactgtataaat

SEQ ID NO: 4060481 - DNA, 17 bp, Homo sapiens
catggggccctcccaga

SEQ ID NO: 4060482 - DNA, 15 bp, Homo sapiens
catggggtttttatt

SEQ ID NO: 4060483 - DNA, 23 bp, Homo sapiens
catggggtttttattatttttac

SEQ ID NO: 4060484 - DNA, 19 bp, Homo sapiens
catgggtgaagggagagcc

SEQ ID NO: 4060485 - DNA, 14 bp, Homo sapiens
catggtcacacact

SEQ ID NO: 4060486 - DNA, 13 bp, Homo sapiens
catggtccctgcc

SEQ ID NO: 4060487 - DNA, 14 bp, Homo sapiens
catggtccctgcct

SEQ ID NO: 4060488 - DNA, 15 bp, Homo sapiens
catggtccctgcctt

SEQ ID NO: 4060489 - DNA, 17 bp, Homo sapiens
catggtccctgccttag

SEQ ID NO: 4060490 - DNA, 19 bp, Homo sapiens
catggtgaaaccccgtctc

SEQ ID NO: 4060491 - DNA, 16 bp, Homo sapiens
catggtgccccaggac

SEQ ID NO: 4060492 - DNA, 19 bp, Homo sapiens
catggtgccccaggaccag

SEQ ID NO: 4060493 - DNA, 13 bp, Homo sapiens
catggtgcctgag

SEQ ID NO: 4060494 - DNA, 14 bp, Homo sapiens
catggtgcctgaga

SEQ ID NO: 4060495 - DNA, 15 bp, Homo sapiens
catggtgcctgagag

SEQ ID NO: 4060496 - DNA, 22 bp, Homo sapiens
catggtgcctgagaggcaggca

SEQ ID NO: 4060497 - DNA, 22 bp, Homo sapiens
catggtggacccagcgggcagg

SEQ ID NO: 4060498 - DNA, 21 bp, Homo sapiens
catggtggatatggtgcagag

SEQ ID NO: 4060499 - DNA, 19 bp, Homo sapiens
catggtgggttcaggggac

SEQ ID NO: 4060500 - DNA, 15 bp, Homo sapiens
catggtgtaataaga

SEQ ID NO: 4060501 - DNA, 18 bp, Homo sapiens
catggtgtaataagacat

SEQ ID NO: 4060502 - DNA, 21 bp, Homo sapiens
catggtgtggggggctggggg

SEQ ID NO: 4060503 - DNA, 19 bp, Homo sapiens
catggttaaggtaaagtaa

SEQ ID NO: 4060504 - DNA, 16 bp, Homo sapiens
catggttgagaaatga

SEQ ID NO: 4060505 - DNA, 15 bp, Homo sapiens
catgtaaaacagaaa

SEQ ID NO: 4060506 - DNA, 17 bp, Homo sapiens
catgtaaaacagaaaaa

SEQ ID NO: 4060507 - DNA, 16 bp, Homo sapiens
catgtaaaagcggaaa

SEQ ID NO: 4060508 - DNA, 16 bp, Homo sapiens
catgtaaactatttgt

SEQ ID NO: 4060509 - DNA, 17 bp, Homo sapiens
catgtaaccggcatgtt

SEQ ID NO: 4060510 - DNA, 18 bp, Homo sapiens
catgtaaccggcatgttt

SEQ ID NO: 4060511 - DNA, 18 bp, Homo sapiens
catgtaattaagtactat

SEQ ID NO: 4060512 - DNA, 21 bp, Homo sapiens
catgtaattaagtactatgta

SEQ ID NO: 4060513 - DNA, 22 bp, Homo sapiens
catgtactgtagtttttcttca

SEQ ID NO: 4060514 - DNA, 17 bp, Homo sapiens
catgtagactgtgccag

SEQ ID NO: 4060515 - DNA, 19 bp, Homo sapiens
catgtagagaaaagcacac

SEQ ID NO: 4060516 - DNA, 17 bp, Homo sapiens
catgtagccccctggcc

SEQ ID NO: 4060517 - DNA, 20 bp, Homo sapiens
catgtagccccctggcctct

SEQ ID NO: 4060518 - DNA, 22 bp, Homo sapiens
catgtagccccctggcctctgt

SEQ ID NO: 4060519 - DNA, 16 bp, Homo sapiens
catgtagcttcttctg

SEQ ID NO: 4060520 - DNA, 17 bp, Homo sapiens
catgtagcttcttctga

SEQ ID NO: 4060521 - DNA, 14 bp, Homo sapiens
catgtatgttatga

SEQ ID NO: 4060522 - DNA, 18 bp, Homo sapiens
catgtatgttatgatatt

SEQ ID NO: 4060523 - DNA, 21 bp, Homo sapiens
catgtattgcacattgtaaaa

SEQ ID NO: 4060524 - DNA, 20 bp, Homo sapiens
catgtatttatctctattta

SEQ ID NO: 4060525 - DNA, 18 bp, Homo sapiens
catgtatttattcctctg

SEQ ID NO: 4060526 - DNA, 23 bp, Homo sapiens
catgtatttattcctctgtccta

SEQ ID NO: 4060527 - DNA, 13 bp, Homo sapiens
catgtattttgtt

SEQ ID NO: 4060528 - DNA, 22 bp, Homo sapiens
catgtcaacttctggctcctca

SEQ ID NO: 4060529 - DNA, 19 bp, Homo sapiens
catgtcaccggtcagtgcc

SEQ ID NO: 4060530 - DNA, 16 bp, Homo sapiens
catgtcaggcctgtgt

SEQ ID NO: 4060531 - DNA, 12 bp, Homo sapiens
catgtccaaaga

SEQ ID NO: 4060532 - DNA, 14 bp, Homo sapiens
catgtccaaagagg

SEQ ID NO: 4060533 - DNA, 16 bp, Homo sapiens
catgtccaaagaggct

SEQ ID NO: 4060534 - DNA, 17 bp, Homo sapiens
catgtccaaagaggctg

SEQ ID NO: 4060535 - DNA, 20 bp, Homo sapiens
catgtccaaagaggctgccc

SEQ ID NO: 4060536 - DNA, 15 bp, Homo sapiens
catgtccaagttctt

SEQ ID NO: 4060537 - DNA, 19 bp, Homo sapiens
catgtccatacactttgtt

SEQ ID NO: 4060538 - DNA, 22 bp, Homo sapiens
catgtccatacactttgttgca

SEQ ID NO: 4060539 - DNA, 18 bp, Homo sapiens
catgtcctgctggcttcc

SEQ ID NO: 4060540 - DNA, 20 bp, Homo sapiens
catgtcctgctggcttccag

SEQ ID NO: 4060541 - DNA, 21 bp, Homo sapiens
catgtcctgctggcttccagc

SEQ ID NO: 4060542 - DNA, 21 bp, Homo sapiens
catgtcctttgcgcctgtgac

SEQ ID NO: 4060543 - DNA, 22 bp, Homo sapiens
catgtcgctagccagtgctcca

SEQ ID NO: 4060544 - DNA, 22 bp, Homo sapiens
catgtctataatcccagcactt

SEQ ID NO: 4060545 - DNA, 17 bp, Homo sapiens
catgtctgcagtgtgcc

SEQ ID NO: 4060546 - DNA, 16 bp, Homo sapiens
cattccagtcaggctc

SEQ ID NO: 4060547 - DNA, 17 bp, Homo sapiens
cattccatcccttcctg

SEQ ID NO: 4060548 - DNA, 13 bp, Homo sapiens
cattccattgcct

SEQ ID NO: 4060549 - DNA, 16 bp, Homo sapiens
cattccattgcctagc

SEQ ID NO: 4060550 - DNA, 13 bp, Homo sapiens
cattccccatggg

SEQ ID NO: 4060551 - DNA, 19 bp, Homo sapiens
cattcccccaccagctgca

SEQ ID NO: 4060552 - DNA, 16 bp, Homo sapiens
cattcccgaggtcagc

SEQ ID NO: 4060553 - DNA, 19 bp, Homo sapiens
cattccctcgtctttccca

SEQ ID NO: 4060554 - DNA, 21 bp, Homo sapiens
cattccctctcatctcaggta

SEQ ID NO: 4060555 - DNA, 20 bp, Homo sapiens
cattccctctcctgcccaga

SEQ ID NO: 4060556 - DNA, 19 bp, Homo sapiens
cattccctgaatctgtgcc

SEQ ID NO: 4060557 - DNA, 20 bp, Homo sapiens
cattcctgaagaaccagtcc

SEQ ID NO: 4060558 - DNA, 21 bp, Homo sapiens
cattccttctggcctctgctg

SEQ ID NO: 4060559 - DNA, 15 bp, Homo sapiens
cattccttctttgat

SEQ ID NO: 4060560 - DNA, 23 bp, Homo sapiens
cattccttctttgataatgttaa

SEQ ID NO: 4060561 - DNA, 17 bp, Homo sapiens
cattccttgcgcctcag

SEQ ID NO: 4060562 - DNA, 19 bp, Homo sapiens
cattccttgcgcctcagcc

SEQ ID NO: 4060563 - DNA, 20 bp, Homo sapiens
cattccttgcgcctcagccc

SEQ ID NO: 4060564 - DNA, 18 bp, Homo sapiens
cattcgacataccccact

SEQ ID NO: 4060565 - DNA, 20 bp, Homo sapiens
cattctacagaataatccag

SEQ ID NO: 4060566 - DNA, 21 bp, Homo sapiens
cattctacagaataatccagt

SEQ ID NO: 4060567 - DNA, 14 bp, Homo sapiens
cattctacctgagg

SEQ ID NO: 4060568 - DNA, 15 bp, Homo sapiens
cattctactgaaaag

SEQ ID NO: 4060569 - DNA, 14 bp, Homo sapiens
cattctaggatgtg

SEQ ID NO: 4060570 - DNA, 16 bp, Homo sapiens
cattctaggatgtgga

SEQ ID NO: 4060571 - DNA, 14 bp, Homo sapiens
cattctagttcaga

SEQ ID NO: 4060572 - DNA, 17 bp, Homo sapiens
cattctatcaagcccag

SEQ ID NO: 4060573 - DNA, 18 bp, Homo sapiens
cattctatcaagcccagg

SEQ ID NO: 4060574 - DNA, 17 bp, Homo sapiens
cattctatcgttattat

SEQ ID NO: 4060575 - DNA, 16 bp, Homo sapiens
cattctattgccttct

SEQ ID NO: 4060576 - DNA, 20 bp, Homo sapiens
cattctattgccttctttga

SEQ ID NO: 4060577 - DNA, 21 bp, Homo sapiens
cattctattgccttctttgaa

SEQ ID NO: 4060578 - DNA, 16 bp, Homo sapiens
cattctattttagaat

SEQ ID NO: 4060579 - DNA, 14 bp, Homo sapiens
cattctcaagggac

SEQ ID NO: 4060580 - DNA, 22 bp, Homo sapiens
cattctcaagggacgtcctcca

SEQ ID NO: 4060581 - DNA, 14 bp, Homo sapiens
cattctcactccta

SEQ ID NO: 4060582 - DNA, 17 bp, Homo sapiens
cattctcactcctacct

SEQ ID NO: 4060583 - DNA, 16 bp, Homo sapiens
cattctcataattcct

SEQ ID NO: 4060584 - DNA, 13 bp, Homo sapiens
cattctcattgca

SEQ ID NO: 4060585 - DNA, 15 bp, Homo sapiens
cattctcccaggtac

SEQ ID NO: 4060586 - DNA, 21 bp, Homo sapiens
cattctcccaggtaccagctg

SEQ ID NO: 4060587 - DNA, 15 bp, Homo sapiens
cattctccccagtgt

SEQ ID NO: 4060588 - DNA, 15 bp, Homo sapiens
cattctcctgcctgt

SEQ ID NO: 4060589 - DNA, 15 bp, Homo sapiens
cattctgcattgcta

SEQ ID NO: 4060590 - DNA, 20 bp, Homo sapiens
cattctggaggggagagctt

SEQ ID NO: 4060591 - DNA, 11 bp, Homo sapiens
cattctgtcct

SEQ ID NO: 4060592 - DNA, 17 bp, Homo sapiens
cattctgtgatcattta

SEQ ID NO: 4060593 - DNA, 18 bp, Homo sapiens
cattctgttttcccccag

SEQ ID NO: 4060594 - DNA, 21 bp, Homo sapiens
cattctgttttcccccagcaa

SEQ ID NO: 4060595 - DNA, 22 bp, Homo sapiens
cattctgttttcccccagcaac

SEQ ID NO: 4060596 - DNA, 16 bp, Homo sapiens
cattcttctctgttgt

SEQ ID NO: 4060597 - DNA, 21 bp, Homo sapiens
cattcttctctgttgtcgtaa

SEQ ID NO: 4060598 - DNA, 16 bp, Homo sapiens
cattcttggcccagga

SEQ ID NO: 4060599 - DNA, 19 bp, Homo sapiens
cattcttgtcacaataaat

SEQ ID NO: 4060600 - DNA, 23 bp, Homo sapiens
cattcttgttttctttctttaaa

SEQ ID NO: 4060601 - DNA, 11 bp, Homo sapiens
cattgaaagag

SEQ ID NO: 4060602 - DNA, 22 bp, Homo sapiens
cattgaaagagaaccagtttca

SEQ ID NO: 4060603 - DNA, 19 bp, Homo sapiens
cattgaaatgagcacctcc

SEQ ID NO: 4060604 - DNA, 18 bp, Homo sapiens
cattgaaattctgagaaa

SEQ ID NO: 4060605 - DNA, 15 bp, Homo sapiens
cattgaacacaaact

SEQ ID NO: 4060606 - DNA, 16 bp, Homo sapiens
cattgaacacaaactg

SEQ ID NO: 4060607 - DNA, 18 bp, Homo sapiens
cattgaagccgactctgg

SEQ ID NO: 4060608 - DNA, 20 bp, Homo sapiens
cattgaatgcgctttattgc

SEQ ID NO: 4060609 - DNA, 14 bp, Homo sapiens
cattgacaccagaa

SEQ ID NO: 4060610 - DNA, 18 bp, Homo sapiens
cattgaccaagaactgca

SEQ ID NO: 4060611 - DNA, 16 bp, Homo sapiens
cattgaccgcaactca

SEQ ID NO: 4060612 - DNA, 15 bp, Homo sapiens
cattgacctatttcc

SEQ ID NO: 4060613 - DNA, 21 bp, Homo sapiens
cattgacctatttccagaaat

SEQ ID NO: 4060614 - DNA, 22 bp, Homo sapiens
cattgacctctcagggcctggc

SEQ ID NO: 4060615 - DNA, 20 bp, Homo sapiens
cattgactttcagtaaacat

SEQ ID NO: 4060616 - DNA, 22 bp, Homo sapiens
cattgactttcagtaaacataa

SEQ ID NO: 4060617 - DNA, 15 bp, Homo sapiens
cattgaggaaatatt

SEQ ID NO: 4060618 - DNA, 17 bp, Homo sapiens
cattgaggaagagtctt

SEQ ID NO: 4060619 - DNA, 23 bp, Homo sapiens
cattgaggatggaaactggactc

SEQ ID NO: 4060620 - DNA, 20 bp, Homo sapiens
cattgatcctagtgtcttta

SEQ ID NO: 4060621 - DNA, 18 bp, Homo sapiens
cattgcactctagcctgg

SEQ ID NO: 4060622 - DNA, 17 bp, Homo sapiens
cattgccaccaggagaa

SEQ ID NO: 4060623 - DNA, 22 bp, Homo sapiens
cattgccccaaatggattcctg

SEQ ID NO: 4060624 - DNA, 17 bp, Homo sapiens
cattgccgctgtataaa

SEQ ID NO: 4060625 - DNA, 22 bp, Homo sapiens
cattgccgctgtataaagcatg

SEQ ID NO: 4060626 - DNA, 22 bp, Homo sapiens
cattgcctaactactagttttt

SEQ ID NO: 4060627 - DNA, 21 bp, Homo sapiens
cattgcctgactaaaatgttt

SEQ ID NO: 4060628 - DNA, 16 bp, Homo sapiens
cattgcggccccagga

SEQ ID NO: 4060629 - DNA, 19 bp, Homo sapiens
cattgcggccccaggaggg

SEQ ID NO: 4060630 - DNA, 14 bp, Homo sapiens
cattgctgagcctc

SEQ ID NO: 4060631 - DNA, 16 bp, Homo sapiens
cattgctgagcctctg

SEQ ID NO: 4060632 - DNA, 14 bp, Homo sapiens
cattgctgttatgt

SEQ ID NO: 4060633 - DNA, 20 bp, Homo sapiens
cattgctgttatgtctgttt

SEQ ID NO: 4060634 - DNA, 21 bp, Homo sapiens
cattgctgttgtccctctgct

SEQ ID NO: 4060635 - DNA, 18 bp, Homo sapiens
cattgcttttattttgaa

SEQ ID NO: 4060636 - DNA, 16 bp, Homo sapiens
cattggaatgttctca

SEQ ID NO: 4060637 - DNA, 18 bp, Homo sapiens
cattggaatgttctcaga

SEQ ID NO: 4060638 - DNA, 23 bp, Homo sapiens
cattggcaagatgaaataatttt

SEQ ID NO: 4060639 - DNA, 21 bp, Homo sapiens
cattggcacctaatccaggca

SEQ ID NO: 4060640 - DNA, 18 bp, Homo sapiens
cattggctatttaaaact

SEQ ID NO: 4060641 - DNA, 19 bp, Homo sapiens
cattggctatttaaaactt

SEQ ID NO: 4060642 - DNA, 18 bp, Homo sapiens
cattgggcacagtccaga

SEQ ID NO: 4060643 - DNA, 19 bp, Homo sapiens
cattggggggccgggcagg

SEQ ID NO: 4060644 - DNA, 17 bp, Homo sapiens
cattggttggaagctac

SEQ ID NO: 4060645 - DNA, 16 bp, Homo sapiens
cattgtaatgttactg

SEQ ID NO: 4060646 - DNA, 21 bp, Homo sapiens
cattgtaatgttactgatcat

SEQ ID NO: 4060647 - DNA, 15 bp, Homo sapiens
cattgtactacctgt

SEQ ID NO: 4060648 - DNA, 20 bp, Homo sapiens
ccaacccccgccacctcagg

SEQ ID NO: 4060649 - DNA, 19 bp, Homo sapiens
ccaaccctaggttccctgt

SEQ ID NO: 4060650 - DNA, 14 bp, Homo sapiens
ccaaccctcagagc

SEQ ID NO: 4060651 - DNA, 20 bp, Homo sapiens
ccaacctcagggctcccagg

SEQ ID NO: 4060652 - DNA, 14 bp, Homo sapiens
ccaacctcctgacc

SEQ ID NO: 4060653 - DNA, 12 bp, Homo sapiens
ccaacctgctga

SEQ ID NO: 4060654 - DNA, 21 bp, Homo sapiens
ccaaccttcacatctgtcacg

SEQ ID NO: 4060655 - DNA, 13 bp, Homo sapiens
ccaacctttaaaa

SEQ ID NO: 4060656 - DNA, 21 bp, Homo sapiens
ccaacggccctgcagccagct

SEQ ID NO: 4060657 - DNA, 17 bp, Homo sapiens
ccaactagctgggacta

SEQ ID NO: 4060658 - DNA, 12 bp, Homo sapiens
ccaactgcccta

SEQ ID NO: 4060659 - DNA, 21 bp, Homo sapiens
ccaactgccctaagcccccag

SEQ ID NO: 4060660 - DNA, 16 bp, Homo sapiens
ccaactgggcccaaga

SEQ ID NO: 4060661 - DNA, 21 bp, Homo sapiens
ccaacttcatttgatgctaaa

SEQ ID NO: 4060662 - DNA, 13 bp, Homo sapiens
ccaacttcccagt

SEQ ID NO: 4060663 - DNA, 16 bp, Homo sapiens
ccaacttcttcctgtg

SEQ ID NO: 4060664 - DNA, 23 bp, Homo sapiens
ccaacttgtattaaagacagagg

SEQ ID NO: 4060665 - DNA, 18 bp, Homo sapiens
ccaagaaaatgaagggat

SEQ ID NO: 4060666 - DNA, 19 bp, Homo sapiens
ccaagacagatgccccaga

SEQ ID NO: 4060667 - DNA, 21 bp, Homo sapiens
ccaagacagatgccccagagc

SEQ ID NO: 4060668 - DNA, 24 bp, Homo sapiens
ccaagacagatgccccagagctgt

SEQ ID NO: 4060669 - DNA, 12 bp, Homo sapiens
ccaagacattgt

SEQ ID NO: 4060670 - DNA, 17 bp, Homo sapiens
ccaagacattgtcaata

SEQ ID NO: 4060671 - DNA, 20 bp, Homo sapiens
ccaagagcagagtctgggcc

SEQ ID NO: 4060672 - DNA, 21 bp, Homo sapiens
ccaagagcagagtctgggcct

SEQ ID NO: 4060673 - DNA, 23 bp, Homo sapiens
ccaagagcagagtctgggcctct

SEQ ID NO: 4060674 - DNA, 22 bp, Homo sapiens
ccaagaggtttggctcctgccc

SEQ ID NO: 4060675 - DNA, 23 bp, Homo sapiens
ccaagaggtttggctcctgccca

SEQ ID NO: 4060676 - DNA, 15 bp, Homo sapiens
ccaagagtaacttta

SEQ ID NO: 4060677 - DNA, 14 bp, Homo sapiens
ccaagcacagcagc

SEQ ID NO: 4060678 - DNA, 15 bp, Homo sapiens
ccaagcacagcagcc

SEQ ID NO: 4060679 - DNA, 18 bp, Homo sapiens
ccaagcacagcagcctgg

SEQ ID NO: 4060680 - DNA, 20 bp, Homo sapiens
ccaagcaggacgaaaaagag

SEQ ID NO: 4060681 - DNA, 14 bp, Homo sapiens
ccaagcaggagacg

SEQ ID NO: 4060682 - DNA, 13 bp, Homo sapiens
ccaagcccaaact

SEQ ID NO: 4060683 - DNA, 14 bp, Homo sapiens
ccaagccgtggctt

SEQ ID NO: 4060684 - DNA, 16 bp, Homo sapiens
ccaagccgtggcttcc

SEQ ID NO: 4060685 - DNA, 17 bp, Homo sapiens
ccaagccgtggcttccc

SEQ ID NO: 4060686 - DNA, 17 bp, Homo sapiens
ccaagccttaaactgta

SEQ ID NO: 4060687 - DNA, 15 bp, Homo sapiens
ccaagctatctaaag

SEQ ID NO: 4060688 - DNA, 17 bp, Homo sapiens
ccaagctattcaattct

SEQ ID NO: 4060689 - DNA, 17 bp, Homo sapiens
ccaagctgagtttccta

SEQ ID NO: 4060690 - DNA, 18 bp, Homo sapiens
ccaagctgagtttcctat

SEQ ID NO: 4060691 - DNA, 12 bp, Homo sapiens
ccaagcttccct

SEQ ID NO: 4060692 - DNA, 23 bp, Homo sapiens
ccaagctttcttctacaaccaga

SEQ ID NO: 4060693 - DNA, 22 bp, Homo sapiens
ccaaggactgagcaccctctgg

SEQ ID NO: 4060694 - DNA, 22 bp, Homo sapiens
ccaaggagaccaagtcctggct

SEQ ID NO: 4060695 - DNA, 11 bp, Homo sapiens
ccaaggatccc

SEQ ID NO: 4060696 - DNA, 18 bp, Homo sapiens
ccaaggatcggactctgc

SEQ ID NO: 4060697 - DNA, 19 bp, Homo sapiens
ccaaggccccctgcctgcc

SEQ ID NO: 4060698 - DNA, 21 bp, Homo sapiens
ccaaggcggcccctcccgccc

SEQ ID NO: 4060699 - DNA, 21 bp, Homo sapiens
ccaaggggtgggcctgtgaat

SEQ ID NO: 4060700 - DNA, 23 bp, Homo sapiens
ccaagggtatccaagttggactg

SEQ ID NO: 4060701 - DNA, 15 bp, Homo sapiens
ccaagggttgagagc

SEQ ID NO: 4060702 - DNA, 18 bp, Homo sapiens
ccaagggttgagagccag

SEQ ID NO: 4060703 - DNA, 19 bp, Homo sapiens
ccaagggttgagagccagt

SEQ ID NO: 4060704 - DNA, 23 bp, Homo sapiens
ccaaggtcccctccacatcccag

SEQ ID NO: 4060705 - DNA, 16 bp, Homo sapiens
ccaaggtcctctcagt

SEQ ID NO: 4060706 - DNA, 17 bp, Homo sapiens
ccaagtcacacagctag

SEQ ID NO: 4060707 - DNA, 14 bp, Homo sapiens
ccaagtctcagtgg

SEQ ID NO: 4060708 - DNA, 17 bp, Homo sapiens
ccaagtgcactttctaa

SEQ ID NO: 4060709 - DNA, 19 bp, Homo sapiens
ccaagtgccccctcacctc

SEQ ID NO: 4060710 - DNA, 21 bp, Homo sapiens
ccaagtgccccctcacctctc

SEQ ID NO: 4060711 - DNA, 19 bp, Homo sapiens
ccaagtggggatggggcct

SEQ ID NO: 4060712 - DNA, 16 bp, Homo sapiens
ccaagtggggtgctgg

SEQ ID NO: 4060713 - DNA, 14 bp, Homo sapiens
ccaagtggtcagga

SEQ ID NO: 4060714 - DNA, 22 bp, Homo sapiens
ccaagttataaatcaatgtcac

SEQ ID NO: 4060715 - DNA, 19 bp, Homo sapiens
ccaagttccgtcagtccaa

SEQ ID NO: 4060716 - DNA, 14 bp, Homo sapiens
ccaataaaaagttc

SEQ ID NO: 4060717 - DNA, 16 bp, Homo sapiens
ccaataaaaagttcag

SEQ ID NO: 4060718 - DNA, 13 bp, Homo sapiens
ccaataaaccagg

SEQ ID NO: 4060719 - DNA, 11 bp, Homo sapiens
ccaataaccaa

SEQ ID NO: 4060720 - DNA, 18 bp, Homo sapiens
ccaatattaaatctgctg

SEQ ID NO: 4060721 - DNA, 20 bp, Homo sapiens
ccaatattttctttaatgct

SEQ ID NO: 4060722 - DNA, 22 bp, Homo sapiens
ccaatattttctttaatgcttt

SEQ ID NO: 4060723 - DNA, 12 bp, Homo sapiens
ccaatcatttta

SEQ ID NO: 4060724 - DNA, 22 bp, Homo sapiens
ccaatcattttaattattattc

SEQ ID NO: 4060725 - DNA, 18 bp, Homo sapiens
ccaatcccgtgaaagaat

SEQ ID NO: 4060726 - DNA, 15 bp, Homo sapiens
ccaatccctgatccc

SEQ ID NO: 4060727 - DNA, 17 bp, Homo sapiens
ccaatcctcactgggtg

SEQ ID NO: 4060728 - DNA, 15 bp, Homo sapiens
ccaatctgcacactc

SEQ ID NO: 4060729 - DNA, 23 bp, Homo sapiens
ccaatctggcccttacacactca

SEQ ID NO: 4060730 - DNA, 24 bp, Homo sapiens
ccaatcttgctttgtgtatctcat

SEQ ID NO: 4060731 - DNA, 23 bp, Homo sapiens
ccaatgaaatacacaagtaaaca

SEQ ID NO: 4060732 - DNA, 17 bp, Homo sapiens
ccaatgacttccctgct

SEQ ID NO: 4060733 - DNA, 15 bp, Homo sapiens
ccaatgatggtcacc

SEQ ID NO: 4060734 - DNA, 18 bp, Homo sapiens
ccaatgccccactggcag

SEQ ID NO: 4060735 - DNA, 19 bp, Homo sapiens
ccaatggtgatcctctatt

SEQ ID NO: 4060736 - DNA, 12 bp, Homo sapiens
ccaatgttttcc

SEQ ID NO: 4060737 - DNA, 18 bp, Homo sapiens
ccaatgttttccacccat

SEQ ID NO: 4060738 - DNA, 17 bp, Homo sapiens
ccaattaggaagtgtaa

SEQ ID NO: 4060739 - DNA, 22 bp, Homo sapiens
ccaattatatgagacgtttttg

SEQ ID NO: 4060740 - DNA, 18 bp, Homo sapiens
ccaattattgttacacat

SEQ ID NO: 4060741 - DNA, 13 bp, Homo sapiens
ccaattggaggaa

SEQ ID NO: 4060742 - DNA, 16 bp, Homo sapiens
ccaatttcagactccc

SEQ ID NO: 4060743 - DNA, 20 bp, Homo sapiens
ccaatttcggattttttcca

SEQ ID NO: 4060744 - DNA, 21 bp, Homo sapiens
ccaatttcggattttttccaa

SEQ ID NO: 4060745 - DNA, 22 bp, Homo sapiens
ccaatttcggattttttccaaa

SEQ ID NO: 4060746 - DNA, 23 bp, Homo sapiens
ccaatttcggattttttccaaaa

SEQ ID NO: 4060747 - DNA, 24 bp, Homo sapiens
ccacaaggaataaatgagagggaa

SEQ ID NO: 4060748 - DNA, 17 bp, Homo sapiens
ccacaaggacttcctgt

SEQ ID NO: 4060749 - DNA, 14 bp, Homo sapiens
ccacaagggctctc

SEQ ID NO: 4060750 - DNA, 18 bp, Homo sapiens
ccagacccctggcttttc

SEQ ID NO: 4060751 - DNA, 24 bp, Homo sapiens
ccagacccctggcttttcactgct

SEQ ID NO: 4060752 - DNA, 18 bp, Homo sapiens
ccagacccttcttgcctg

SEQ ID NO: 4060753 - DNA, 18 bp, Homo sapiens
ccagacctgatcctggag

SEQ ID NO: 4060754 - DNA, 23 bp, Homo sapiens
ccagacctgatcctggaggccca

SEQ ID NO: 4060755 - DNA, 15 bp, Homo sapiens
ccagaccttaataaa

SEQ ID NO: 4060756 - DNA, 18 bp, Homo sapiens
ccagacgctgccgctgcc

SEQ ID NO: 4060757 - DNA, 22 bp, Homo sapiens
ccagacgtcaggccctgactcc

SEQ ID NO: 4060758 - DNA, 19 bp, Homo sapiens
ccagactaaaggatccaga

SEQ ID NO: 4060759 - DNA, 23 bp, Homo sapiens
ccagactaaaggatccagagagc

SEQ ID NO: 4060760 - DNA, 12 bp, Homo sapiens
ccagactacagg

SEQ ID NO: 4060761 - DNA, 16 bp, Homo sapiens
ccagactacttgggag

SEQ ID NO: 4060762 - DNA, 14 bp, Homo sapiens
ccagacttccttga

SEQ ID NO: 4060763 - DNA, 18 bp, Homo sapiens
ccagagaaacccagggag

SEQ ID NO: 4060764 - DNA, 16 bp, Homo sapiens
ccagagaaaggggagc

SEQ ID NO: 4060765 - DNA, 15 bp, Homo sapiens
ccagagagaggatgt

SEQ ID NO: 4060766 - DNA, 16 bp, Homo sapiens
ccagagaggcactcag

SEQ ID NO: 4060767 - DNA, 15 bp, Homo sapiens
ccagagagtggctcc

SEQ ID NO: 4060768 - DNA, 13 bp, Homo sapiens
ccagagatccaaa

SEQ ID NO: 4060769 - DNA, 20 bp, Homo sapiens
ccagagatccaaaagaagcc

SEQ ID NO: 4060770 - DNA, 19 bp, Homo sapiens
ccagagcaaccagaaggag

SEQ ID NO: 4060771 - DNA, 15 bp, Homo sapiens
ccagagcaacctctc

SEQ ID NO: 4060772 - DNA, 19 bp, Homo sapiens
ccagagcaacctctcactc

SEQ ID NO: 4060773 - DNA, 14 bp, Homo sapiens
ccagagcagatgca

SEQ ID NO: 4060774 - DNA, 20 bp, Homo sapiens
ccagagcagatgcagagagc

SEQ ID NO: 4060775 - DNA, 19 bp, Homo sapiens
ccagagcattccagtcagg

SEQ ID NO: 4060776 - DNA, 21 bp, Homo sapiens
ccagagcatttccaacaccac

SEQ ID NO: 4060777 - DNA, 22 bp, Homo sapiens
ccagagcatttccaacaccaca

SEQ ID NO: 4060778 - DNA, 23 bp, Homo sapiens
ccagagcatttccaacaccacag

SEQ ID NO: 4060779 - DNA, 15 bp, Homo sapiens
ccagagccacctgga

SEQ ID NO: 4060780 - DNA, 11 bp, Homo sapiens
ccagagccaga

SEQ ID NO: 4060781 - DNA, 16 bp, Homo sapiens
ccagagccagatgcag

SEQ ID NO: 4060782 - DNA, 21 bp, Homo sapiens
ccagagccagatgcaggacag

SEQ ID NO: 4060783 - DNA, 23 bp, Homo sapiens
ccagagccaggggggtgaggagc

SEQ ID NO: 4060784 - DNA, 14 bp, Homo sapiens
ccagagccccccac

SEQ ID NO: 4060785 - DNA, 16 bp, Homo sapiens
ccagagccccccacaa

SEQ ID NO: 4060786 - DNA, 21 bp, Homo sapiens
ccagagctgggaggcatggcc

SEQ ID NO: 4060787 - DNA, 20 bp, Homo sapiens
ccagagctgggtggggacag

SEQ ID NO: 4060788 - DNA, 19 bp, Homo sapiens
ccagagctgtttatggcct

SEQ ID NO: 4060789 - DNA, 24 bp, Homo sapiens
ccagagctgtttatggcctcagct

SEQ ID NO: 4060790 - DNA, 21 bp, Homo sapiens
ccagaggaactgtccagagag

SEQ ID NO: 4060791 - DNA, 22 bp, Homo sapiens
ccagaggaactgtccagagagc

SEQ ID NO: 4060792 - DNA, 21 bp, Homo sapiens
ccagaggaataacttagcttg

SEQ ID NO: 4060793 - DNA, 13 bp, Homo sapiens
ccagaggagggca

SEQ ID NO: 4060794 - DNA, 15 bp, Homo sapiens
ccagaggagggcaga

SEQ ID NO: 4060795 - DNA, 18 bp, Homo sapiens
ccagaggccgaaggtgcc

SEQ ID NO: 4060796 - DNA, 13 bp, Homo sapiens
ccagaggctggga

SEQ ID NO: 4060797 - DNA, 14 bp, Homo sapiens
ccagaggctgggag

SEQ ID NO: 4060798 - DNA, 17 bp, Homo sapiens
ccagaggctgggagtcc

SEQ ID NO: 4060799 - DNA, 22 bp, Homo sapiens
ccagagggagcaggccggaacc

SEQ ID NO: 4060800 - DNA, 20 bp, Homo sapiens
ccagagggtgtggctttcca

SEQ ID NO: 4060801 - DNA, 17 bp, Homo sapiens
ccagaggtaacagaaca

SEQ ID NO: 4060802 - DNA, 22 bp, Homo sapiens
ccagaggtaacagaacagcttc

SEQ ID NO: 4060803 - DNA, 23 bp, Homo sapiens
ccagaggtaacagaacagcttca

SEQ ID NO: 4060804 - DNA, 21 bp, Homo sapiens
tctggctgagctgaacccatt

SEQ ID NO: 4060805 - DNA, 14 bp, Homo sapiens
tctggctgtctaga

SEQ ID NO: 4060806 - DNA, 19 bp, Homo sapiens
tctggctgtctagaatgtg

SEQ ID NO: 4060807 - DNA, 14 bp, Homo sapiens
tctggctgtttagc

SEQ ID NO: 4060808 - DNA, 18 bp, Homo sapiens
tctggctgtttagcagaa

SEQ ID NO: 4060809 - DNA, 21 bp, Homo sapiens
tctggctttcccaggagatgg

SEQ ID NO: 4060810 - DNA, 16 bp, Homo sapiens
tctgggacctcagttt

SEQ ID NO: 4060811 - DNA, 21 bp, Homo sapiens
tctgggagcagaaacagccat

SEQ ID NO: 4060812 - DNA, 14 bp, Homo sapiens
tctgggagctggag

SEQ ID NO: 4060813 - DNA, 17 bp, Homo sapiens
tctgggaggcaagaaaa

SEQ ID NO: 4060814 - DNA, 15 bp, Homo sapiens
tctgggagtcacaca

SEQ ID NO: 4060815 - DNA, 18 bp, Homo sapiens
tctgggataagtaagttt

SEQ ID NO: 4060816 - DNA, 17 bp, Homo sapiens
tctgggcattttcctcc

SEQ ID NO: 4060817 - DNA, 22 bp, Homo sapiens
tctgggcattttcctcctctgc

SEQ ID NO: 4060818 - DNA, 21 bp, Homo sapiens
tctgggccattctccacagca

SEQ ID NO: 4060819 - DNA, 12 bp, Homo sapiens
tctgggcctctg

SEQ ID NO: 4060820 - DNA, 12 bp, Homo sapiens
tctgggcctgac

SEQ ID NO: 4060821 - DNA, 21 bp, Homo sapiens
tctgggctcctggaaccaatc

SEQ ID NO: 4060822 - DNA, 17 bp, Homo sapiens
tctgggctgctacccag

SEQ ID NO: 4060823 - DNA, 22 bp, Homo sapiens
tctgggctgtaacgtggcactg

SEQ ID NO: 4060824 - DNA, 19 bp, Homo sapiens
tctgggcttggggcttcct

SEQ ID NO: 4060825 - DNA, 21 bp, Homo sapiens
tctggggaccccaacctcaga

SEQ ID NO: 4060826 - DNA, 15 bp, Homo sapiens
tctggggcagatccc

SEQ ID NO: 4060827 - DNA, 17 bp, Homo sapiens
tctggggcagcccccat

SEQ ID NO: 4060828 - DNA, 17 bp, Homo sapiens
tctggggcaggctgggc

SEQ ID NO: 4060829 - DNA, 16 bp, Homo sapiens
tctggggccctgggcc

SEQ ID NO: 4060830 - DNA, 19 bp, Homo sapiens
tctggggccctgggcctca

SEQ ID NO: 4060831 - DNA, 16 bp, Homo sapiens
tctgggtatctttcca

SEQ ID NO: 4060832 - DNA, 22 bp, Homo sapiens
tctgggtctgattttctcactg

SEQ ID NO: 4060833 - DNA, 14 bp, Homo sapiens
tctgggtttctaga

SEQ ID NO: 4060834 - DNA, 16 bp, Homo sapiens
tctgggtttgagaaat

SEQ ID NO: 4060835 - DNA, 18 bp, Homo sapiens
tctggtagatagaaataa

SEQ ID NO: 4060836 - DNA, 16 bp, Homo sapiens
tctggtgtgtggtgag

SEQ ID NO: 4060837 - DNA, 22 bp, Homo sapiens
tctggttgtttctgttccaaat

SEQ ID NO: 4060838 - DNA, 16 bp, Homo sapiens
tctggtttctcattct

SEQ ID NO: 4060839 - DNA, 18 bp, Homo sapiens
tctggtttggcatggtga

SEQ ID NO: 4060840 - DNA, 19 bp, Homo sapiens
tctgtaaaaacactgaaaa

SEQ ID NO: 4060841 - DNA, 13 bp, Homo sapiens
tctgtaaataacc

SEQ ID NO: 4060842 - DNA, 14 bp, Homo sapiens
tctgtagctcctca

SEQ ID NO: 4060843 - DNA, 15 bp, Homo sapiens
tctgtagggctggac

SEQ ID NO: 4060844 - DNA, 17 bp, Homo sapiens
tctgtagggctggacct

SEQ ID NO: 4060845 - DNA, 19 bp, Homo sapiens
tctgtagtcatttactaaa

SEQ ID NO: 4060846 - DNA, 14 bp, Homo sapiens
tctgtataaatgtc

SEQ ID NO: 4060847 - DNA, 17 bp, Homo sapiens
tctgtataaatgtctat

SEQ ID NO: 4060848 - DNA, 18 bp, Homo sapiens
tctgtatcggagacagtg

SEQ ID NO: 4060849 - DNA, 13 bp, Homo sapiens
tctgtatttcctt

SEQ ID NO: 4060850 - DNA, 13 bp, Homo sapiens
tctgtcaccaaat

SEQ ID NO: 4060851 - DNA, 22 bp, Homo sapiens
tctgtcagccagccgccctggg

SEQ ID NO: 4060852 - DNA, 17 bp, Homo sapiens
tctgtcagtcacagcca

SEQ ID NO: 4060853 - DNA, 13 bp, Homo sapiens
tctgtcatttgtt

SEQ ID NO: 4060854 - DNA, 18 bp, Homo sapiens
tctgtccaactgagaagt

SEQ ID NO: 4060855 - DNA, 16 bp, Homo sapiens
tctgtccatggccttt

SEQ ID NO: 4060856 - DNA, 15 bp, Homo sapiens
tctgtcccaccccta

SEQ ID NO: 4060857 - DNA, 23 bp, Homo sapiens
tctgtcccactacatctgggact

SEQ ID NO: 4060858 - DNA, 22 bp, Homo sapiens
tctgtccccagccctgtcctgg

SEQ ID NO: 4060859 - DNA, 15 bp, Homo sapiens
tctgtcccccaggct

SEQ ID NO: 4060860 - DNA, 23 bp, Homo sapiens
tctgtccctgagagtgtctctga

SEQ ID NO: 4060861 - DNA, 16 bp, Homo sapiens
tctgtcccttgctgta

SEQ ID NO: 4060862 - DNA, 17 bp, Homo sapiens
tctgtcccttgctgtat

SEQ ID NO: 4060863 - DNA, 13 bp, Homo sapiens
tctgtcctcagcc

SEQ ID NO: 4060864 - DNA, 14 bp, Homo sapiens
tctgtcctcagcct

SEQ ID NO: 4060865 - DNA, 15 bp, Homo sapiens
tctgtcctcagcctt

SEQ ID NO: 4060866 - DNA, 19 bp, Homo sapiens
tctgtcctcagccttgcca

SEQ ID NO: 4060867 - DNA, 13 bp, Homo sapiens
tctgtcctgggca

SEQ ID NO: 4060868 - DNA, 14 bp, Homo sapiens
tctgtccttcagat

SEQ ID NO: 4060869 - DNA, 17 bp, Homo sapiens
tctgtctcatcctcctg

SEQ ID NO: 4060870 - DNA, 22 bp, Homo sapiens
tctgtctcccagttatgaatca

SEQ ID NO: 4060871 - DNA, 13 bp, Homo sapiens
tctgtctgccctt

SEQ ID NO: 4060872 - DNA, 22 bp, Homo sapiens
tctgtctgctggtcacttcttc

SEQ ID NO: 4060873 - DNA, 14 bp, Homo sapiens
tctgtctgctttgg

SEQ ID NO: 4060874 - DNA, 12 bp, Homo sapiens
tctgtctggcac

SEQ ID NO: 4060875 - DNA, 14 bp, Homo sapiens
tctgtcttaaatga

SEQ ID NO: 4060876 - DNA, 22 bp, Homo sapiens
tctgtcttaaatgagaagtact

SEQ ID NO: 4060877 - DNA, 14 bp, Homo sapiens
tctgtctttcctga

SEQ ID NO: 4060878 - DNA, 16 bp, Homo sapiens
tctgtgaaagtacatt

SEQ ID NO: 4060879 - DNA, 17 bp, Homo sapiens
tctgtgaacagagagac

SEQ ID NO: 4060880 - DNA, 17 bp, Homo sapiens
tctgtgaacgatttaga

SEQ ID NO: 4060881 - DNA, 19 bp, Homo sapiens
tctgtgaagaggaacagtg

SEQ ID NO: 4060882 - DNA, 20 bp, Homo sapiens
tctgtgaagaggaacagtgt

SEQ ID NO: 4060883 - DNA, 16 bp, Homo sapiens
tctgtgaatacaatta

SEQ ID NO: 4060884 - DNA, 22 bp, Homo sapiens
tctgtgaatacaattaaaggtc

SEQ ID NO: 4060885 - DNA, 23 bp, Homo sapiens
tctgtgagaggcagctatctgca

SEQ ID NO: 4060886 - DNA, 16 bp, Homo sapiens
tctgtgaggtgctgat

SEQ ID NO: 4060887 - DNA, 22 bp, Homo sapiens
tctgtgatcaccctctcggcct

SEQ ID NO: 4060888 - DNA, 15 bp, Homo sapiens
tctgtgatcttttaa

SEQ ID NO: 4060889 - DNA, 19 bp, Homo sapiens
tctgtgcagggctggtttg

SEQ ID NO: 4060890 - DNA, 16 bp, Homo sapiens
tctgtgccagaaacag

SEQ ID NO: 4060891 - DNA, 15 bp, Homo sapiens
tctgtgccatggatt

SEQ ID NO: 4060892 - DNA, 16 bp, Homo sapiens
tctgtgccatggattt

SEQ ID NO: 4060893 - DNA, 17 bp, Homo sapiens
tctgtgccccatgcctg

SEQ ID NO: 4060894 - DNA, 21 bp, Homo sapiens
tctgtggcttcccatgtcttt

SEQ ID NO: 4060895 - DNA, 12 bp, Homo sapiens
tctgtgggcccc

SEQ ID NO: 4060896 - DNA, 17 bp, Homo sapiens
tctgtgggcccctcaac

SEQ ID NO: 4060897 - DNA, 15 bp, Homo sapiens
tcttggtagagattc

SEQ ID NO: 4060898 - DNA, 13 bp, Homo sapiens
tcttggtcagctt

SEQ ID NO: 4060899 - DNA, 20 bp, Homo sapiens
tcttggtgccttttgtgtga

SEQ ID NO: 4060900 - DNA, 22 bp, Homo sapiens
tcttggtgccttttgtgtgatg

SEQ ID NO: 4060901 - DNA, 23 bp, Homo sapiens
tcttggtgccttttgtgtgatgc

SEQ ID NO: 4060902 - DNA, 13 bp, Homo sapiens
tcttggtgctctg

SEQ ID NO: 4060903 - DNA, 22 bp, Homo sapiens
tcttggtttctctctacagtgc

SEQ ID NO: 4060904 - DNA, 13 bp, Homo sapiens
tcttgtaaagact

SEQ ID NO: 4060905 - DNA, 16 bp, Homo sapiens
tcttgtagtagtctca

SEQ ID NO: 4060906 - DNA, 16 bp, Homo sapiens
tcttgtattaaactct

SEQ ID NO: 4060907 - DNA, 23 bp, Homo sapiens
tcttgtcccctcttgacccatct

SEQ ID NO: 4060908 - DNA, 20 bp, Homo sapiens
tcttgtccctttccctacct

SEQ ID NO: 4060909 - DNA, 16 bp, Homo sapiens
tcttgtcctcttctgc

SEQ ID NO: 4060910 - DNA, 12 bp, Homo sapiens
tcttgtctttat

SEQ ID NO: 4060911 - DNA, 20 bp, Homo sapiens
tcttgtgcaaggtggccttt

SEQ ID NO: 4060912 - DNA, 17 bp, Homo sapiens
tcttgtggtgtaaagct

SEQ ID NO: 4060913 - DNA, 15 bp, Homo sapiens
tcttgtttccttgtt

SEQ ID NO: 4060914 - DNA, 17 bp, Homo sapiens
tcttgttttaagcaaat

SEQ ID NO: 4060915 - DNA, 22 bp, Homo sapiens
tcttgttttaagcaaatgcatt

SEQ ID NO: 4060916 - DNA, 22 bp, Homo sapiens
tcttgttttgtcttgaaagtgg

SEQ ID NO: 4060917 - DNA, 15 bp, Homo sapiens
tcttgtttttattaa

SEQ ID NO: 4060918 - DNA, 20 bp, Homo sapiens
tcttgtttttattaatttat

SEQ ID NO: 4060919 - DNA, 21 bp, Homo sapiens
tcttgtttttattaatttata

SEQ ID NO: 4060920 - DNA, 19 bp, Homo sapiens
tctttaaaaagcagtcctc

SEQ ID NO: 4060921 - DNA, 17 bp, Homo sapiens
tctttaaaagagagaga

SEQ ID NO: 4060922 - DNA, 18 bp, Homo sapiens
tctttaaaaggaaagaaa

SEQ ID NO: 4060923 - DNA, 21 bp, Homo sapiens
tctttaaaatttaagtatctt

SEQ ID NO: 4060924 - DNA, 18 bp, Homo sapiens
tctttaaagtcaggtcca

SEQ ID NO: 4060925 - DNA, 13 bp, Homo sapiens
tctttaaatactt

SEQ ID NO: 4060926 - DNA, 15 bp, Homo sapiens
tctttaactcataaa

SEQ ID NO: 4060927 - DNA, 14 bp, Homo sapiens
tctttaagaaagta

SEQ ID NO: 4060928 - DNA, 23 bp, Homo sapiens
tctttaagccatagaccctgagg

SEQ ID NO: 4060929 - DNA, 22 bp, Homo sapiens
tctttaagggcatgccttgtgc

SEQ ID NO: 4060930 - DNA, 11 bp, Homo sapiens
tctttaatgct

SEQ ID NO: 4060931 - DNA, 13 bp, Homo sapiens
tctttaatgcttt

SEQ ID NO: 4060932 - DNA, 16 bp, Homo sapiens
tctttaatgcttttat

SEQ ID NO: 4060933 - DNA, 13 bp, Homo sapiens
tctttaattctgt

SEQ ID NO: 4060934 - DNA, 21 bp, Homo sapiens
tctttacaagcaggcactgta

SEQ ID NO: 4060935 - DNA, 13 bp, Homo sapiens
tctttacctgaga

SEQ ID NO: 4060936 - DNA, 19 bp, Homo sapiens
tctttacctgtatacagtg

SEQ ID NO: 4060937 - DNA, 16 bp, Homo sapiens
tctttactcccaagac

SEQ ID NO: 4060938 - DNA, 15 bp, Homo sapiens
tctttagaaaaggca

SEQ ID NO: 4060939 - DNA, 15 bp, Homo sapiens
tctttagtgccggct

SEQ ID NO: 4060940 - DNA, 14 bp, Homo sapiens
tctttatacagctg

SEQ ID NO: 4060941 - DNA, 15 bp, Homo sapiens
tctttatacagctgt

SEQ ID NO: 4060942 - DNA, 16 bp, Homo sapiens
tctttatacagctgta

SEQ ID NO: 4060943 - DNA, 16 bp, Homo sapiens
tctttattaatcacta

SEQ ID NO: 4060944 - DNA, 23 bp, Homo sapiens
tctttattttaacctttgataga

SEQ ID NO: 4060945 - DNA, 15 bp, Homo sapiens
tctttcacagctcct

SEQ ID NO: 4060946 - DNA, 22 bp, Homo sapiens
tctttcacattgtttgctgcta

SEQ ID NO: 4060947 - DNA, 16 bp, Homo sapiens
tctttcacttgaaaga

SEQ ID NO: 4060948 - DNA, 22 bp, Homo sapiens
tctttcagattttttgaaccat

SEQ ID NO: 4060949 - DNA, 16 bp, Homo sapiens
tctttccataataaaa

SEQ ID NO: 4060950 - DNA, 20 bp, Homo sapiens
tctttccatcaactcccaac

SEQ ID NO: 4060951 - DNA, 14 bp, Homo sapiens
tctttccctgcgag

SEQ ID NO: 4060952 - DNA, 16 bp, Homo sapiens
tctttcctgaaccatg

SEQ ID NO: 4060953 - DNA, 14 bp, Homo sapiens
tctttcgtcaccct

SEQ ID NO: 4060954 - DNA, 15 bp, Homo sapiens
tctttctacagagat

SEQ ID NO: 4060955 - DNA, 22 bp, Homo sapiens
tctttctacatgactgggcctc

SEQ ID NO: 4060956 - DNA, 15 bp, Homo sapiens
tctttctagtggtct

SEQ ID NO: 4060957 - DNA, 17 bp, Homo sapiens
tctttctagtggtcttt

SEQ ID NO: 4060958 - DNA, 21 bp, Homo sapiens
tctttctagtggtctttgtaa

SEQ ID NO: 4060959 - DNA, 18 bp, Homo sapiens
tctttctccttagtcttc

SEQ ID NO: 4060960 - DNA, 21 bp, Homo sapiens
tctttctccttgaatatcttt

SEQ ID NO: 4060961 - DNA, 12 bp, Homo sapiens
tctttctctcag

SEQ ID NO: 4060962 - DNA, 21 bp, Homo sapiens
tctttctctcagccttacatt

SEQ ID NO: 4060963 - DNA, 13 bp, Homo sapiens
tctttctctgcca

SEQ ID NO: 4060964 - DNA, 16 bp, Homo sapiens
tctttctctgccagtg

SEQ ID NO: 4060965 - DNA, 23 bp, Homo sapiens
tctttctggcctgccttcgttaa

SEQ ID NO: 4060966 - DNA, 22 bp, Homo sapiens
tctttcttgggatagtgttctg

SEQ ID NO: 4060967 - DNA, 21 bp, Homo sapiens
tctttctttacctgagaccag

SEQ ID NO: 4060968 - DNA, 21 bp, Homo sapiens
tctttgaaatagtctgtgtga

SEQ ID NO: 4060969 - DNA, 16 bp, Homo sapiens
tctttgataatgttaa

SEQ ID NO: 4060970 - DNA, 13 bp, Homo sapiens
tctttgcagggct

SEQ ID NO: 4060971 - DNA, 15 bp, Homo sapiens
tctttgccctttact

SEQ ID NO: 4060972 - DNA, 11 bp, Homo sapiens
tctttgcctct

SEQ ID NO: 4060973 - DNA, 15 bp, Homo sapiens
tctttgcctctgcag

SEQ ID NO: 4060974 - DNA, 20 bp, Homo sapiens
tctttgcctctgcagtctca

SEQ ID NO: 4060975 - DNA, 18 bp, Homo sapiens
tctttggaaggagtgaga

SEQ ID NO: 4060976 - DNA, 20 bp, Homo sapiens
tctttgggccagacatgcca

SEQ ID NO: 4060977 - DNA, 21 bp, Homo sapiens
tctttggggtcagccagggcc

SEQ ID NO: 4060978 - DNA, 14 bp, Homo sapiens
tctttgtaagagtg

SEQ ID NO: 4060979 - DNA, 18 bp, Homo sapiens
tctttgtaagagtgtaga

SEQ ID NO: 4060980 - DNA, 22 bp, Homo sapiens
tctttgtaagagtgtagaagca

SEQ ID NO: 4060981 - DNA, 12 bp, Homo sapiens
tctttgtatctt

SEQ ID NO: 4060982 - DNA, 15 bp, Homo sapiens
tctttgtgcctttgg

SEQ ID NO: 4060983 - DNA, 23 bp, Homo sapiens
tctttgtgtttgcttggtgctgg

SEQ ID NO: 4060984 - DNA, 15 bp, Homo sapiens
tctttgttataccat

SEQ ID NO: 4060985 - DNA, 21 bp, Homo sapiens
tctttgttatcaaacttcagc

SEQ ID NO: 4060986 - DNA, 18 bp, Homo sapiens
tcttttaaaaattcaaat

SEQ ID NO: 4060987 - DNA, 19 bp, Homo sapiens
tcttttaaaaattcaaatg

SEQ ID NO: 4060988 - DNA, 18 bp, Homo sapiens
tcttttaaagtgttactt

SEQ ID NO: 4060989 - DNA, 20 bp, Homo sapiens
tcttttaattgtttcagaat

SEQ ID NO: 4060990 - DNA, 12 bp, Homo sapiens
tcttttacaact

SEQ ID NO: 4060991 - DNA, 18 bp, Homo sapiens
tcttttagttttagttgc

SEQ ID NO: 4060992 - DNA, 13 bp, Homo sapiens
tcttttatatttg

SEQ ID NO: 4060993 - DNA, 14 bp, Homo sapiens
tcttttatcctggg

SEQ ID NO: 4060994 - DNA, 12 bp, Homo sapiens
tcttttatctgt

SEQ ID NO: 4060995 - DNA, 19 bp, Homo sapiens
tcttttcagaagcaagcca

SEQ ID NO: 4060996 - DNA, 21 bp, Homo sapiens
tcttttcagaagcaagccaga

SEQ ID NO: 4060997 - DNA, 22 bp, Homo sapiens
tcttttcagaagcaagccagac

SEQ ID NO: 4060998 - DNA, 18 bp, Homo sapiens
tcttttcccctttcctgt

SEQ ID NO: 4060999 - DNA, 13 bp, Homo sapiens
tcttttcctggtg

SEQ ID NO: 4061000 - DNA, 15 bp, Homo sapiens
tgaagttacatgcat

SEQ ID NO: 4061001 - DNA, 18 bp, Homo sapiens
tgaagttacatgcataaa

SEQ ID NO: 4061002 - DNA, 22 bp, Homo sapiens
tgaagttacatgcataaaaggg

SEQ ID NO: 4061003 - DNA, 13 bp, Homo sapiens
tgaagttgaacat

SEQ ID NO: 4061004 - DNA, 19 bp, Homo sapiens
tgaagtttaaaacagtatt

SEQ ID NO: 4061005 - DNA, 20 bp, Homo sapiens
tgaagtttacattgtaaata

SEQ ID NO: 4061006 - DNA, 15 bp, Homo sapiens
tgaagtttacatttt

SEQ ID NO: 4061007 - DNA, 16 bp, Homo sapiens
tgaagtttacattttt

SEQ ID NO: 4061008 - DNA, 13 bp, Homo sapiens
tgaagtttcacat

SEQ ID NO: 4061009 - DNA, 15 bp, Homo sapiens
tgaagttttacattg

SEQ ID NO: 4061010 - DNA, 17 bp, Homo sapiens
tgaagttttacattgtt

SEQ ID NO: 4061011 - DNA, 14 bp, Homo sapiens
tgaataaaaatgca

SEQ ID NO: 4061012 - DNA, 17 bp, Homo sapiens
tgaataaactgaatatt

SEQ ID NO: 4061013 - DNA, 18 bp, Homo sapiens
tgaataaagaatgccatt

SEQ ID NO: 4061014 - DNA, 23 bp, Homo sapiens
tgaataaagaatgccatttctca

SEQ ID NO: 4061015 - DNA, 14 bp, Homo sapiens
tgaataaagacacc

SEQ ID NO: 4061016 - DNA, 16 bp, Homo sapiens
tgaataaagacaccta

SEQ ID NO: 4061017 - DNA, 17 bp, Homo sapiens
tgaataaagtgtaacaa

SEQ ID NO: 4061018 - DNA, 13 bp, Homo sapiens
tgaataaatgtct

SEQ ID NO: 4061019 - DNA, 14 bp, Homo sapiens
tgaatagcctggcc

SEQ ID NO: 4061020 - DNA, 15 bp, Homo sapiens
tgaatagcctggcca

SEQ ID NO: 4061021 - DNA, 21 bp, Homo sapiens
tgaatatacagcaggtgctca

SEQ ID NO: 4061022 - DNA, 22 bp, Homo sapiens
tgaatatatttaagcaacatct

SEQ ID NO: 4061023 - DNA, 14 bp, Homo sapiens
tgaatatctattaa

SEQ ID NO: 4061024 - DNA, 18 bp, Homo sapiens
tgaatatctattaatata

SEQ ID NO: 4061025 - DNA, 12 bp, Homo sapiens
tgaatatggaca

SEQ ID NO: 4061026 - DNA, 22 bp, Homo sapiens
tgaatatggacaagaggtacag

SEQ ID NO: 4061027 - DNA, 17 bp, Homo sapiens
tgaatattgaagtttca

SEQ ID NO: 4061028 - DNA, 17 bp, Homo sapiens
tgaatatttataacagc

SEQ ID NO: 4061029 - DNA, 20 bp, Homo sapiens
tgaatattttggaaactgct

SEQ ID NO: 4061030 - DNA, 13 bp, Homo sapiens
tgaatcaatcctg

SEQ ID NO: 4061031 - DNA, 15 bp, Homo sapiens
tgaatcaatgaaaaa

SEQ ID NO: 4061032 - DNA, 12 bp, Homo sapiens
tgaatcacctgg

SEQ ID NO: 4061033 - DNA, 15 bp, Homo sapiens
tgaatcacctggctg

SEQ ID NO: 4061034 - DNA, 21 bp, Homo sapiens
tgaatcagtataaacaaagtt

SEQ ID NO: 4061035 - DNA, 17 bp, Homo sapiens
tgaatccaaaagaaaaa

SEQ ID NO: 4061036 - DNA, 21 bp, Homo sapiens
tgaatccaaaagaaaaacagc

SEQ ID NO: 4061037 - DNA, 15 bp, Homo sapiens
tgaatcctaagggct

SEQ ID NO: 4061038 - DNA, 14 bp, Homo sapiens
tgaatctaaggata

SEQ ID NO: 4061039 - DNA, 16 bp, Homo sapiens
tgaatctgctcacttt

SEQ ID NO: 4061040 - DNA, 19 bp, Homo sapiens
tgaatctttccaataaacc

SEQ ID NO: 4061041 - DNA, 21 bp, Homo sapiens
tgaatgaaaaatttaagcatt

SEQ ID NO: 4061042 - DNA, 11 bp, Homo sapiens
tgaatgaaaac

SEQ ID NO: 4061043 - DNA, 14 bp, Homo sapiens
tgaatgaaagatta

SEQ ID NO: 4061044 - DNA, 14 bp, Homo sapiens
tgaatgaaatatca

SEQ ID NO: 4061045 - DNA, 11 bp, Homo sapiens
tgaatgaacac

SEQ ID NO: 4061046 - DNA, 18 bp, Homo sapiens
tgaatgatctctctgaat

SEQ ID NO: 4061047 - DNA, 14 bp, Homo sapiens
tgaatgccgtggat

SEQ ID NO: 4061048 - DNA, 17 bp, Homo sapiens
tgaatgcctcaatgtga

SEQ ID NO: 4061049 - DNA, 17 bp, Homo sapiens
tgaatgcgctttattgc

SEQ ID NO: 4061050 - DNA, 11 bp, Homo sapiens
tgaatgctgcc

SEQ ID NO: 4061051 - DNA, 22 bp, Homo sapiens
tgaatgctgccagtgtggagtg

SEQ ID NO: 4061052 - DNA, 20 bp, Homo sapiens
tgaatggattggattattta

SEQ ID NO: 4061053 - DNA, 22 bp, Homo sapiens
tgaatggattggattatttaat

SEQ ID NO: 4061054 - DNA, 19 bp, Homo sapiens
tgaatgtagcagccccggg

SEQ ID NO: 4061055 - DNA, 20 bp, Homo sapiens
tgaatgtatgtaatgtgtgg

SEQ ID NO: 4061056 - DNA, 17 bp, Homo sapiens
tgaatgtatttatttgg

SEQ ID NO: 4061057 - DNA, 18 bp, Homo sapiens
tgaatgtggcttgagaaa

SEQ ID NO: 4061058 - DNA, 15 bp, Homo sapiens
tgaatgtgggcactg

SEQ ID NO: 4061059 - DNA, 16 bp, Homo sapiens
tgaatgtggtctcagg

SEQ ID NO: 4061060 - DNA, 17 bp, Homo sapiens
tgaatgtggttacttcc

SEQ ID NO: 4061061 - DNA, 14 bp, Homo sapiens
tgaatgtgtcacta

SEQ ID NO: 4061062 - DNA, 12 bp, Homo sapiens
tgaatgtgtcag

SEQ ID NO: 4061063 - DNA, 16 bp, Homo sapiens
tgaatgttctgacatt

SEQ ID NO: 4061064 - DNA, 17 bp, Homo sapiens
tgaatgttctgacatta

SEQ ID NO: 4061065 - DNA, 18 bp, Homo sapiens
tgaatgttctgacattaa

SEQ ID NO: 4061066 - DNA, 19 bp, Homo sapiens
tgaatgtttacactctttg

SEQ ID NO: 4061067 - DNA, 18 bp, Homo sapiens
tgaatgttttatttatca

SEQ ID NO: 4061068 - DNA, 18 bp, Homo sapiens
tgaattaaaacttcttaa

SEQ ID NO: 4061069 - DNA, 23 bp, Homo sapiens
tgaattaatcatctataaagaag

SEQ ID NO: 4061070 - DNA, 15 bp, Homo sapiens
tgaattatatgttca

SEQ ID NO: 4061071 - DNA, 15 bp, Homo sapiens
tgaattatctataca

SEQ ID NO: 4061072 - DNA, 17 bp, Homo sapiens
tgaattcaagaaaggaa

SEQ ID NO: 4061073 - DNA, 12 bp, Homo sapiens
tgaattcagatt

SEQ ID NO: 4061074 - DNA, 19 bp, Homo sapiens
tgaattgtttttattgttt

SEQ ID NO: 4061075 - DNA, 15 bp, Homo sapiens
tgaatttaaatataa

SEQ ID NO: 4061076 - DNA, 16 bp, Homo sapiens
tgaatttaaatataat

SEQ ID NO: 4061077 - DNA, 19 bp, Homo sapiens
tgaatttaaatataattct

SEQ ID NO: 4061078 - DNA, 13 bp, Homo sapiens
tgaatttcactgt

SEQ ID NO: 4061079 - DNA, 23 bp, Homo sapiens
tgaatttctgacctcaagtgatt

SEQ ID NO: 4061080 - DNA, 23 bp, Homo sapiens
tgaatttcttgatttttcagggt

SEQ ID NO: 4061081 - DNA, 13 bp, Homo sapiens
tgaatttgaatga

SEQ ID NO: 4061082 - DNA, 18 bp, Homo sapiens
tgaatttgaatgaaaaat

SEQ ID NO: 4061083 - DNA, 17 bp, Homo sapiens
tgaattttaaatctaaa

SEQ ID NO: 4061084 - DNA, 15 bp, Homo sapiens
tgaattttccacgca

SEQ ID NO: 4061085 - DNA, 21 bp, Homo sapiens
tgaattttgtttttattttca

SEQ ID NO: 4061086 - DNA, 13 bp, Homo sapiens
tgaatttttaagc

SEQ ID NO: 4061087 - DNA, 23 bp, Homo sapiens
tgaatttttatatatatatctgt

SEQ ID NO: 4061088 - DNA, 16 bp, Homo sapiens
tgaatttttttgtaat

SEQ ID NO: 4061089 - DNA, 13 bp, Homo sapiens
tgacaaaagtaaa

SEQ ID NO: 4061090 - DNA, 14 bp, Homo sapiens
tgacaaaagtaaat

SEQ ID NO: 4061091 - DNA, 16 bp, Homo sapiens
tgacaaaagtaaatgg

SEQ ID NO: 4061092 - DNA, 20 bp, Homo sapiens
tgacaaaagtaaatgggagg

SEQ ID NO: 4061093 - DNA, 10 bp, Homo sapiens
tgacaaaatt

SEQ ID NO: 4061094 - DNA, 17 bp, Homo sapiens
tgacaacctagaatgtc

SEQ ID NO: 4061095 - DNA, 23 bp, Homo sapiens
tgacaagatggtccatttgttcc

SEQ ID NO: 4061096 - DNA, 22 bp, Homo sapiens
tgacaagctcctggtcttgaga

SEQ ID NO: 4061097 - DNA, 20 bp, Homo sapiens
tgacaagtcattttaacttt

SEQ ID NO: 4061098 - DNA, 16 bp, Homo sapiens
tgacaagtgaagaaca

SEQ ID NO: 4061099 - DNA, 13 bp, Homo sapiens
tgacaataaaaca

SEQ ID NO: 4061100 - DNA, 16 bp, Homo sapiens
tgacaataaaacatta

SEQ ID NO: 4061101 - DNA, 14 bp, Homo sapiens
tgacaataaatgtg

SEQ ID NO: 4061102 - DNA, 20 bp, Homo sapiens
tgacaataatattgttgtat

SEQ ID NO: 4061103 - DNA, 16 bp, Homo sapiens
tgaggaggcctccatc

SEQ ID NO: 4061104 - DNA, 20 bp, Homo sapiens
tgaggaggggagcgtctggg

SEQ ID NO: 4061105 - DNA, 20 bp, Homo sapiens
tgaggattattataaaaggg

SEQ ID NO: 4061106 - DNA, 15 bp, Homo sapiens
tgaggcaagtgtggg

SEQ ID NO: 4061107 - DNA, 22 bp, Homo sapiens
tgaggccaaacgttttgaacta

SEQ ID NO: 4061108 - DNA, 12 bp, Homo sapiens
tgaggccacact

SEQ ID NO: 4061109 - DNA, 19 bp, Homo sapiens
tgaggccacactcagcaca

SEQ ID NO: 4061110 - DNA, 23 bp, Homo sapiens
tgaggccacactcagcacaaggc

SEQ ID NO: 4061111 - DNA, 14 bp, Homo sapiens
tgaggccagagtca

SEQ ID NO: 4061112 - DNA, 13 bp, Homo sapiens
tgaggccaggagt

SEQ ID NO: 4061113 - DNA, 20 bp, Homo sapiens
tgaggccatctcaggagatg

SEQ ID NO: 4061114 - DNA, 22 bp, Homo sapiens
tgaggcctccagcttcaggcag

SEQ ID NO: 4061115 - DNA, 18 bp, Homo sapiens
tgaggcctgccctcaggg

SEQ ID NO: 4061116 - DNA, 21 bp, Homo sapiens
tgaggcctgccctcagggatc

SEQ ID NO: 4061117 - DNA, 11 bp, Homo sapiens
tgaggcctgga

SEQ ID NO: 4061118 - DNA, 12 bp, Homo sapiens
tgaggcctggac

SEQ ID NO: 4061119 - DNA, 17 bp, Homo sapiens
tgaggcctggactttcc

SEQ ID NO: 4061120 - DNA, 16 bp, Homo sapiens
tgaggcggaggctgtg

SEQ ID NO: 4061121 - DNA, 18 bp, Homo sapiens
tgaggcggaggctgtgct

SEQ ID NO: 4061122 - DNA, 15 bp, Homo sapiens
tgaggctggcacagg

SEQ ID NO: 4061123 - DNA, 19 bp, Homo sapiens
tgaggctgggggagagccg

SEQ ID NO: 4061124 - DNA, 13 bp, Homo sapiens
tgaggcttagaga

SEQ ID NO: 4061125 - DNA, 17 bp, Homo sapiens
tgaggcttagagagagg

SEQ ID NO: 4061126 - DNA, 13 bp, Homo sapiens
tgaggctttggat

SEQ ID NO: 4061127 - DNA, 18 bp, Homo sapiens
tgaggctttggatttgac

SEQ ID NO: 4061128 - DNA, 23 bp, Homo sapiens
tgaggctttggatttgacattgc

SEQ ID NO: 4061129 - DNA, 17 bp, Homo sapiens
tgaggctttgtgttgta

SEQ ID NO: 4061130 - DNA, 18 bp, Homo sapiens
tgaggctttgtgttgtaa

SEQ ID NO: 4061131 - DNA, 20 bp, Homo sapiens
tgagggacatatcagtgacc

SEQ ID NO: 4061132 - DNA, 13 bp, Homo sapiens
tgagggacatgct

SEQ ID NO: 4061133 - DNA, 18 bp, Homo sapiens
tgagggcagactggggca

SEQ ID NO: 4061134 - DNA, 18 bp, Homo sapiens
tgagggccaagaaagagt

SEQ ID NO: 4061135 - DNA, 16 bp, Homo sapiens
tgagggcccagccagg

SEQ ID NO: 4061136 - DNA, 17 bp, Homo sapiens
tgagggcccagccagga

SEQ ID NO: 4061137 - DNA, 19 bp, Homo sapiens
tgagggcccagccaggagc

SEQ ID NO: 4061138 - DNA, 21 bp, Homo sapiens
tgagggcccagccaggagcag

SEQ ID NO: 4061139 - DNA, 22 bp, Homo sapiens
tgagggcccagccaggagcaga

SEQ ID NO: 4061140 - DNA, 18 bp, Homo sapiens
tgagggcctgctggaggc

SEQ ID NO: 4061141 - DNA, 19 bp, Homo sapiens
tgagggcctgctggaggcc

SEQ ID NO: 4061142 - DNA, 18 bp, Homo sapiens
tgagggctgccagcagcc

SEQ ID NO: 4061143 - DNA, 20 bp, Homo sapiens
tgagggctgccagcagcccc

SEQ ID NO: 4061144 - DNA, 18 bp, Homo sapiens
tgaggggagccaggaggg

SEQ ID NO: 4061145 - DNA, 19 bp, Homo sapiens
tgaggggccctggccagga

SEQ ID NO: 4061146 - DNA, 15 bp, Homo sapiens
tgaggggctttctct

SEQ ID NO: 4061147 - DNA, 14 bp, Homo sapiens
tgaggggggctggc

SEQ ID NO: 4061148 - DNA, 15 bp, Homo sapiens
tgagggtccccacct

SEQ ID NO: 4061149 - DNA, 19 bp, Homo sapiens
tgagggtcttcttacatgc

SEQ ID NO: 4061150 - DNA, 21 bp, Homo sapiens
tgagggtgcttgttccctctc

SEQ ID NO: 4061151 - DNA, 14 bp, Homo sapiens
tgagggtggagact

SEQ ID NO: 4061152 - DNA, 15 bp, Homo sapiens
tgaggtaagtttttt

SEQ ID NO: 4061153 - DNA, 22 bp, Homo sapiens
tgaggtagaccaggatttctaa

SEQ ID NO: 4061154 - DNA, 16 bp, Homo sapiens
tgaggtcaggagttcc

SEQ ID NO: 4061155 - DNA, 18 bp, Homo sapiens
tgaggtcagggagtgctg

SEQ ID NO: 4061156 - DNA, 13 bp, Homo sapiens
tgaggtcccaggc

SEQ ID NO: 4061157 - DNA, 12 bp, Homo sapiens
tgaggtccctgt

SEQ ID NO: 4061158 - DNA, 23 bp, Homo sapiens
tgaggtccctgtgtgtaggctgg

SEQ ID NO: 4061159 - DNA, 16 bp, Homo sapiens
tgaggtctgttccttt

SEQ ID NO: 4061160 - DNA, 21 bp, Homo sapiens
tgaggtcttttgacatgtgga

SEQ ID NO: 4061161 - DNA, 17 bp, Homo sapiens
tgaggtgaaagggagct

SEQ ID NO: 4061162 - DNA, 15 bp, Homo sapiens
tgaggtgcctgtccc

SEQ ID NO: 4061163 - DNA, 18 bp, Homo sapiens
tgaggtggcatggtccat

SEQ ID NO: 4061164 - DNA, 18 bp, Homo sapiens
tgaggtgggaggtggaag

SEQ ID NO: 4061165 - DNA, 21 bp, Homo sapiens
tgaggtgggaggtggaagaag

SEQ ID NO: 4061166 - DNA, 17 bp, Homo sapiens
tgaggtggtctgaatgt

SEQ ID NO: 4061167 - DNA, 14 bp, Homo sapiens
tgaggttcctctgc

SEQ ID NO: 4061168 - DNA, 17 bp, Homo sapiens
tgaggttcctctgcctg

SEQ ID NO: 4061169 - DNA, 18 bp, Homo sapiens
tgaggttcctctgcctgc

SEQ ID NO: 4061170 - DNA, 19 bp, Homo sapiens
tgaggttctgagaccagtg

SEQ ID NO: 4061171 - DNA, 15 bp, Homo sapiens
tgaggttgcttacta

SEQ ID NO: 4061172 - DNA, 20 bp, Homo sapiens
tgagtaaatattgaggcttt

SEQ ID NO: 4061173 - DNA, 17 bp, Homo sapiens
tgagtaacatttgctgt

SEQ ID NO: 4061174 - DNA, 16 bp, Homo sapiens
tgagtaagagctggtg

SEQ ID NO: 4061175 - DNA, 21 bp, Homo sapiens
tgagtaatcaatacagacaag

SEQ ID NO: 4061176 - DNA, 15 bp, Homo sapiens
tgagtaatggtgtag

SEQ ID NO: 4061177 - DNA, 19 bp, Homo sapiens
tgagtaatggtgtagaaca

SEQ ID NO: 4061178 - DNA, 17 bp, Homo sapiens
tgagtaccaggggctgg

SEQ ID NO: 4061179 - DNA, 18 bp, Homo sapiens
tgagtcaatgtgcagtgt

SEQ ID NO: 4061180 - DNA, 14 bp, Homo sapiens
tgagtcacctgctc

SEQ ID NO: 4061181 - DNA, 17 bp, Homo sapiens
tgagtcacctgctccag

SEQ ID NO: 4061182 - DNA, 21 bp, Homo sapiens
tgagtcagatgggtctgatat

SEQ ID NO: 4061183 - DNA, 20 bp, Homo sapiens
tgagtcatctgttagggcct

SEQ ID NO: 4061184 - DNA, 16 bp, Homo sapiens
tgagtcatttaaatgt

SEQ ID NO: 4061185 - DNA, 20 bp, Homo sapiens
tgagtccattctcccaggta

SEQ ID NO: 4061186 - DNA, 14 bp, Homo sapiens
tgagtcctccagaa

SEQ ID NO: 4061187 - DNA, 16 bp, Homo sapiens
tgagtcctccagaact

SEQ ID NO: 4061188 - DNA, 15 bp, Homo sapiens
tgagtctcctctctg

SEQ ID NO: 4061189 - DNA, 16 bp, Homo sapiens
tgagtctcctctctga

SEQ ID NO: 4061190 - DNA, 17 bp, Homo sapiens
tgagtctcctctctgag

SEQ ID NO: 4061191 - DNA, 18 bp, Homo sapiens
tgagtctcctctctgaga

SEQ ID NO: 4061192 - DNA, 15 bp, Homo sapiens
tgagtctcttcagaa

SEQ ID NO: 4061193 - DNA, 13 bp, Homo sapiens
tgagtctggactt

SEQ ID NO: 4061194 - DNA, 23 bp, Homo sapiens
tgagtgaaaatttttacattcat

SEQ ID NO: 4061195 - DNA, 23 bp, Homo sapiens
tgagtgacacaagcactttaatg

SEQ ID NO: 4061196 - DNA, 15 bp, Homo sapiens
tgagtgagccacaga

SEQ ID NO: 4061197 - DNA, 18 bp, Homo sapiens
tgagtgagccacagacca

SEQ ID NO: 4061198 - DNA, 19 bp, Homo sapiens
tgagtgccttttgcagaag

SEQ ID NO: 4061199 - DNA, 19 bp, Homo sapiens
tgagtgcgggctgaggcca

SEQ ID NO: 4061200 - DNA, 21 bp, Homo sapiens
tgagtgcgggctgaggccaga

SEQ ID NO: 4061201 - DNA, 22 bp, Homo sapiens
tgagtgcgggctgaggccagag

SEQ ID NO: 4061202 - DNA, 20 bp, Homo sapiens
tgagtggccagccagtgcca

SEQ ID NO: 4061203 - DNA, 12 bp, Homo sapiens
tgagtggcctgc

SEQ ID NO: 4061204 - DNA, 12 bp, Homo sapiens
tgagtgggagaa

SEQ ID NO: 4061205 - DNA, 19 bp, Homo sapiens
tgatcttctgggagcagga

SEQ ID NO: 4061206 - DNA, 14 bp, Homo sapiens
tgatcttcttcatc

SEQ ID NO: 4061207 - DNA, 18 bp, Homo sapiens
tgatcttgcattcatttt

SEQ ID NO: 4061208 - DNA, 21 bp, Homo sapiens
tgatcttggcttactgcagcc

SEQ ID NO: 4061209 - DNA, 19 bp, Homo sapiens
tgatcttttaaagtgttac

SEQ ID NO: 4061210 - DNA, 18 bp, Homo sapiens
tgatgaaatctgctagaa

SEQ ID NO: 4061211 - DNA, 18 bp, Homo sapiens
tgatgaactcttaatcaa

SEQ ID NO: 4061212 - DNA, 20 bp, Homo sapiens
tgatgacacccaccctgtgc

SEQ ID NO: 4061213 - DNA, 14 bp, Homo sapiens
tgatgaccaaagtc

SEQ ID NO: 4061214 - DNA, 16 bp, Homo sapiens
tgatgagaatttctaa

SEQ ID NO: 4061215 - DNA, 19 bp, Homo sapiens
tgatgataacacttaaaat

SEQ ID NO: 4061216 - DNA, 18 bp, Homo sapiens
tgatgatccagaacagtg

SEQ ID NO: 4061217 - DNA, 17 bp, Homo sapiens
tgatgatgctgtgacaa

SEQ ID NO: 4061218 - DNA, 20 bp, Homo sapiens
tgatgattaaacacctgaca

SEQ ID NO: 4061219 - DNA, 15 bp, Homo sapiens
tgatgatttggggga

SEQ ID NO: 4061220 - DNA, 17 bp, Homo sapiens
tgatgattttcatttca

SEQ ID NO: 4061221 - DNA, 21 bp, Homo sapiens
tgatgattttcatttcatgaa

SEQ ID NO: 4061222 - DNA, 16 bp, Homo sapiens
tgatgattttcctttt

SEQ ID NO: 4061223 - DNA, 18 bp, Homo sapiens
tgatgattttgcaaaatg

SEQ ID NO: 4061224 - DNA, 23 bp, Homo sapiens
tgatgcgccttgctgatggcttg

SEQ ID NO: 4061225 - DNA, 15 bp, Homo sapiens
tgatgctcaggcttg

SEQ ID NO: 4061226 - DNA, 21 bp, Homo sapiens
tgatgctgagattcttcaggc

SEQ ID NO: 4061227 - DNA, 15 bp, Homo sapiens
tgatgctggagaggt

SEQ ID NO: 4061228 - DNA, 13 bp, Homo sapiens
tgatgctgtattc

SEQ ID NO: 4061229 - DNA, 14 bp, Homo sapiens
tgatgctgtgacaa

SEQ ID NO: 4061230 - DNA, 18 bp, Homo sapiens
tgatggaaatatttattt

SEQ ID NO: 4061231 - DNA, 14 bp, Homo sapiens
tgatggaaccttaa

SEQ ID NO: 4061232 - DNA, 23 bp, Homo sapiens
tgatggaccagtggtttccagtc

SEQ ID NO: 4061233 - DNA, 20 bp, Homo sapiens
tgatggaccttctagaatta

SEQ ID NO: 4061234 - DNA, 18 bp, Homo sapiens
tgatggcagaactcccac

SEQ ID NO: 4061235 - DNA, 14 bp, Homo sapiens
tgatggccagcccc

SEQ ID NO: 4061236 - DNA, 15 bp, Homo sapiens
tgatggccagcccct

SEQ ID NO: 4061237 - DNA, 16 bp, Homo sapiens
tgatgggaaaatattt

SEQ ID NO: 4061238 - DNA, 19 bp, Homo sapiens
tgatgggaaaatatttcct

SEQ ID NO: 4061239 - DNA, 20 bp, Homo sapiens
tgatgggaaaatatttcctg

SEQ ID NO: 4061240 - DNA, 16 bp, Homo sapiens
tgatgggcacttgaga

SEQ ID NO: 4061241 - DNA, 17 bp, Homo sapiens
tgatggggctcagatgg

SEQ ID NO: 4061242 - DNA, 16 bp, Homo sapiens
tgatgggggccaggac

SEQ ID NO: 4061243 - DNA, 14 bp, Homo sapiens
tgatggttcccctg

SEQ ID NO: 4061244 - DNA, 17 bp, Homo sapiens
tgatgtaatctctctgc

SEQ ID NO: 4061245 - DNA, 20 bp, Homo sapiens
tgatgtacataactcctgtc

SEQ ID NO: 4061246 - DNA, 20 bp, Homo sapiens
tgatgtaccatgaaacaaag

SEQ ID NO: 4061247 - DNA, 12 bp, Homo sapiens
tgatgtatattt

SEQ ID NO: 4061248 - DNA, 18 bp, Homo sapiens
tgatgtcttttcttggca

SEQ ID NO: 4061249 - DNA, 23 bp, Homo sapiens
tgatgtcttttcttggcaaaagc

SEQ ID NO: 4061250 - DNA, 13 bp, Homo sapiens
tgatgtgactttt

SEQ ID NO: 4061251 - DNA, 21 bp, Homo sapiens
tgatgtgccattttaaaaaaa

SEQ ID NO: 4061252 - DNA, 15 bp, Homo sapiens
tgatgtggtgcctga

SEQ ID NO: 4061253 - DNA, 13 bp, Homo sapiens
tgatgttggaaga

SEQ ID NO: 4061254 - DNA, 18 bp, Homo sapiens
tgatgtttgtggcctcag

SEQ ID NO: 4061255 - DNA, 23 bp, Homo sapiens
tgattaaaatgcttcctcccagc

SEQ ID NO: 4061256 - DNA, 14 bp, Homo sapiens
tgattaacaaatat

SEQ ID NO: 4061257 - DNA, 15 bp, Homo sapiens
tgattaacaaatatg

SEQ ID NO: 4061258 - DNA, 17 bp, Homo sapiens
tgattaagattttacaa

SEQ ID NO: 4061259 - DNA, 11 bp, Homo sapiens
tgattaatcaa

SEQ ID NO: 4061260 - DNA, 12 bp, Homo sapiens
tgattaatcaaa

SEQ ID NO: 4061261 - DNA, 15 bp, Homo sapiens
tgattactgtcaata

SEQ ID NO: 4061262 - DNA, 21 bp, Homo sapiens
tgattagaaggcaagtttcta

SEQ ID NO: 4061263 - DNA, 13 bp, Homo sapiens
tgattagcaagtt

SEQ ID NO: 4061264 - DNA, 18 bp, Homo sapiens
tgattagctttgtgtttg

SEQ ID NO: 4061265 - DNA, 13 bp, Homo sapiens
tgattattttctt

SEQ ID NO: 4061266 - DNA, 19 bp, Homo sapiens
tgattcagaaaatgttctg

SEQ ID NO: 4061267 - DNA, 20 bp, Homo sapiens
tgattcagaaaatgttctgt

SEQ ID NO: 4061268 - DNA, 21 bp, Homo sapiens
tgattcagaaaatgttctgtt

SEQ ID NO: 4061269 - DNA, 14 bp, Homo sapiens
tgattcagaaattg

SEQ ID NO: 4061270 - DNA, 19 bp, Homo sapiens
tgattcatagtaacttctt

SEQ ID NO: 4061271 - DNA, 15 bp, Homo sapiens
tgattcattttcctg

SEQ ID NO: 4061272 - DNA, 16 bp, Homo sapiens
tgattcattttcctgt

SEQ ID NO: 4061273 - DNA, 14 bp, Homo sapiens
tgattcccgggctt

SEQ ID NO: 4061274 - DNA, 23 bp, Homo sapiens
tgattcctaagccacttgaaatg

SEQ ID NO: 4061275 - DNA, 12 bp, Homo sapiens
tgattcctggtt

SEQ ID NO: 4061276 - DNA, 22 bp, Homo sapiens
tgattctgcagtaaatctttta

SEQ ID NO: 4061277 - DNA, 19 bp, Homo sapiens
tgattctttgttacaggca

SEQ ID NO: 4061278 - DNA, 14 bp, Homo sapiens
tgattgaaccagct

SEQ ID NO: 4061279 - DNA, 19 bp, Homo sapiens
tgattgacacacagcactc

SEQ ID NO: 4061280 - DNA, 12 bp, Homo sapiens
tgattgcacaga

SEQ ID NO: 4061281 - DNA, 15 bp, Homo sapiens
tgattggattattca

SEQ ID NO: 4061282 - DNA, 16 bp, Homo sapiens
tgattggattattcat

SEQ ID NO: 4061283 - DNA, 21 bp, Homo sapiens
tgattggattattcatttaaa

SEQ ID NO: 4061284 - DNA, 19 bp, Homo sapiens
tgattggtgcaacccttac

SEQ ID NO: 4061285 - DNA, 17 bp, Homo sapiens
tgattggtttctcttct

SEQ ID NO: 4061286 - DNA, 16 bp, Homo sapiens
tgattgtataagcatg

SEQ ID NO: 4061287 - DNA, 14 bp, Homo sapiens
tgattgtcagctac

SEQ ID NO: 4061288 - DNA, 14 bp, Homo sapiens
tgattgtggaatgg

SEQ ID NO: 4061289 - DNA, 18 bp, Homo sapiens
tgattgtggaatggagat

SEQ ID NO: 4061290 - DNA, 13 bp, Homo sapiens
tgatttaataaaa

SEQ ID NO: 4061291 - DNA, 15 bp, Homo sapiens
tgatttaataaaata

SEQ ID NO: 4061292 - DNA, 19 bp, Homo sapiens
tgatttaataaaataattc

SEQ ID NO: 4061293 - DNA, 23 bp, Homo sapiens
tgatttaataaaataattctaaa

SEQ ID NO: 4061294 - DNA, 14 bp, Homo sapiens
tgatttaatatgga

SEQ ID NO: 4061295 - DNA, 15 bp, Homo sapiens
tgatttaatatggat

SEQ ID NO: 4061296 - DNA, 20 bp, Homo sapiens
tgatttacagcaagtagata

SEQ ID NO: 4061297 - DNA, 15 bp, Homo sapiens
tgatttataaacaga

SEQ ID NO: 4061298 - DNA, 16 bp, Homo sapiens
tgatttcacaacagat

SEQ ID NO: 4061299 - DNA, 11 bp, Homo sapiens
tgatttcagga

SEQ ID NO: 4061300 - DNA, 18 bp, Homo sapiens
tgatttcaggatactctg

SEQ ID NO: 4061301 - DNA, 15 bp, Homo sapiens
tgatttcattaatac

SEQ ID NO: 4061302 - DNA, 22 bp, Homo sapiens
tgatttccgtgaactctggtgc

SEQ ID NO: 4061303 - DNA, 14 bp, Homo sapiens
tgatttccttgaat

SEQ ID NO: 4061304 - DNA, 16 bp, Homo sapiens
tgatttccttgaatgt

SEQ ID NO: 4061305 - DNA, 17 bp, Homo sapiens
tgatttccttgaatgtg

SEQ ID NO: 4061306 - DNA, 17 bp, Homo sapiens
tgatttctagaaagcct

SEQ ID NO: 4061307 - DNA, 21 bp, Homo sapiens
tgatttctttaaaagaatgac

SEQ ID NO: 4061308 - DNA, 17 bp, Homo sapiens
tgccaaatgctggggca

SEQ ID NO: 4061309 - DNA, 18 bp, Homo sapiens
tgccaacaccacagaaat

SEQ ID NO: 4061310 - DNA, 13 bp, Homo sapiens
tgccaactcctca

SEQ ID NO: 4061311 - DNA, 23 bp, Homo sapiens
tgccaagtggggatggggcctcc

SEQ ID NO: 4061312 - DNA, 23 bp, Homo sapiens
tgccaataaaagttttctccaac

SEQ ID NO: 4061313 - DNA, 14 bp, Homo sapiens
tgccaataaccaag

SEQ ID NO: 4061314 - DNA, 19 bp, Homo sapiens
tgccaatattaaatctgct

SEQ ID NO: 4061315 - DNA, 16 bp, Homo sapiens
tgccaatctcaacacc

SEQ ID NO: 4061316 - DNA, 18 bp, Homo sapiens
tgccaatgatgtgaccct

SEQ ID NO: 4061317 - DNA, 21 bp, Homo sapiens
tgccaattattgttacacatt

SEQ ID NO: 4061318 - DNA, 15 bp, Homo sapiens
tgccacaaggacttc

SEQ ID NO: 4061319 - DNA, 23 bp, Homo sapiens
tgccacaatgcagttctgagcac

SEQ ID NO: 4061320 - DNA, 12 bp, Homo sapiens
tgccacacccag

SEQ ID NO: 4061321 - DNA, 15 bp, Homo sapiens
tgccacacttcaggc

SEQ ID NO: 4061322 - DNA, 16 bp, Homo sapiens
tgccacacttcaggct

SEQ ID NO: 4061323 - DNA, 22 bp, Homo sapiens
tgccacacttcaggctcttctc

SEQ ID NO: 4061324 - DNA, 15 bp, Homo sapiens
tgccacagccagagg

SEQ ID NO: 4061325 - DNA, 17 bp, Homo sapiens
tgccacagcttttgcaa

SEQ ID NO: 4061326 - DNA, 13 bp, Homo sapiens
tgccacatacagg

SEQ ID NO: 4061327 - DNA, 14 bp, Homo sapiens
tgccacatttctga

SEQ ID NO: 4061328 - DNA, 15 bp, Homo sapiens
tgccacatttctgat

SEQ ID NO: 4061329 - DNA, 18 bp, Homo sapiens
tgccacatttctgatcag

SEQ ID NO: 4061330 - DNA, 20 bp, Homo sapiens
tgccacatttctgatcagag

SEQ ID NO: 4061331 - DNA, 22 bp, Homo sapiens
tgccacatttctgatcagaggt

SEQ ID NO: 4061332 - DNA, 15 bp, Homo sapiens
tgccaccacctctgt

SEQ ID NO: 4061333 - DNA, 13 bp, Homo sapiens
tgccaccagcccc

SEQ ID NO: 4061334 - DNA, 23 bp, Homo sapiens
tgccaccagcccccgccccagag

SEQ ID NO: 4061335 - DNA, 17 bp, Homo sapiens
tgccaccaggagaacca

SEQ ID NO: 4061336 - DNA, 16 bp, Homo sapiens
tgccaccccaccctcc

SEQ ID NO: 4061337 - DNA, 17 bp, Homo sapiens
tgccaccccaccctccc

SEQ ID NO: 4061338 - DNA, 20 bp, Homo sapiens
tgccaccccaccctccctgg

SEQ ID NO: 4061339 - DNA, 14 bp, Homo sapiens
tgccacctccctga

SEQ ID NO: 4061340 - DNA, 12 bp, Homo sapiens
tgccacctggca

SEQ ID NO: 4061341 - DNA, 19 bp, Homo sapiens
tgccacgctttgctgctac

SEQ ID NO: 4061342 - DNA, 19 bp, Homo sapiens
tgccacgtggtcactgtgc

SEQ ID NO: 4061343 - DNA, 16 bp, Homo sapiens
tgccacgttccacagt

SEQ ID NO: 4061344 - DNA, 17 bp, Homo sapiens
tgccactcctccctccg

SEQ ID NO: 4061345 - DNA, 17 bp, Homo sapiens
tgccactgcccgagctg

SEQ ID NO: 4061346 - DNA, 21 bp, Homo sapiens
tgccactgcccgagctggtgc

SEQ ID NO: 4061347 - DNA, 13 bp, Homo sapiens
tgccactttccaa

SEQ ID NO: 4061348 - DNA, 14 bp, Homo sapiens
tgccagagatccaa

SEQ ID NO: 4061349 - DNA, 14 bp, Homo sapiens
tgccagaggggaag

SEQ ID NO: 4061350 - DNA, 17 bp, Homo sapiens
tgccagattctgcctct

SEQ ID NO: 4061351 - DNA, 22 bp, Homo sapiens
tgccagcacagagcgtccttcc

SEQ ID NO: 4061352 - DNA, 17 bp, Homo sapiens
tgccagccccacacagc

SEQ ID NO: 4061353 - DNA, 23 bp, Homo sapiens
tgccagccttgagccctggctgt

SEQ ID NO: 4061354 - DNA, 19 bp, Homo sapiens
tgccagctacttcctcctc

SEQ ID NO: 4061355 - DNA, 21 bp, Homo sapiens
tgccagcttctctctccaggg

SEQ ID NO: 4061356 - DNA, 20 bp, Homo sapiens
tgccagcttttcctcccttg

SEQ ID NO: 4061357 - DNA, 22 bp, Homo sapiens
tgccaggaacctgtcctaagga

SEQ ID NO: 4061358 - DNA, 12 bp, Homo sapiens
tgccaggactcc

SEQ ID NO: 4061359 - DNA, 15 bp, Homo sapiens
tgccaggcaggggtg

SEQ ID NO: 4061360 - DNA, 14 bp, Homo sapiens
tgccaggccagcct

SEQ ID NO: 4061361 - DNA, 17 bp, Homo sapiens
tgccaggccagcctccg

SEQ ID NO: 4061362 - DNA, 17 bp, Homo sapiens
tgccagggcaatgatga

SEQ ID NO: 4061363 - DNA, 22 bp, Homo sapiens
tgccagggcaatgatgaatgag

SEQ ID NO: 4061364 - DNA, 14 bp, Homo sapiens
tgccagggcccacc

SEQ ID NO: 4061365 - DNA, 15 bp, Homo sapiens
tgccagggcccaccc

SEQ ID NO: 4061366 - DNA, 19 bp, Homo sapiens
tgccagggcccaccccagc

SEQ ID NO: 4061367 - DNA, 23 bp, Homo sapiens
tgccagtaacacaggccaccctg

SEQ ID NO: 4061368 - DNA, 18 bp, Homo sapiens
tgccagtaacgcgtcttc

SEQ ID NO: 4061369 - DNA, 21 bp, Homo sapiens
tgccagtaacgcgtcttcctg

SEQ ID NO: 4061370 - DNA, 23 bp, Homo sapiens
tgccagtaacgcgtcttcctgag

SEQ ID NO: 4061371 - DNA, 16 bp, Homo sapiens
tgccagtgacagacag

SEQ ID NO: 4061372 - DNA, 14 bp, Homo sapiens
tgccagtgcagcca

SEQ ID NO: 4061373 - DNA, 16 bp, Homo sapiens
tgccagtgcagccact

SEQ ID NO: 4061374 - DNA, 17 bp, Homo sapiens
tgccagtggatcccctg

SEQ ID NO: 4061375 - DNA, 21 bp, Homo sapiens
tgccagtggatcccctgcggt

SEQ ID NO: 4061376 - DNA, 14 bp, Homo sapiens
tgccagttcctgta

SEQ ID NO: 4061377 - DNA, 13 bp, Homo sapiens
tgccataattcta

SEQ ID NO: 4061378 - DNA, 23 bp, Homo sapiens
tgccatacatcagttattcattc

SEQ ID NO: 4061379 - DNA, 15 bp, Homo sapiens
tgccatcatgcctga

SEQ ID NO: 4061380 - DNA, 22 bp, Homo sapiens
tgccatctgcgtgacaataaaa

SEQ ID NO: 4061381 - DNA, 14 bp, Homo sapiens
tgccatctgtacat

SEQ ID NO: 4061382 - DNA, 17 bp, Homo sapiens
tgccatgatctgtattt

SEQ ID NO: 4061383 - DNA, 22 bp, Homo sapiens
tgccatgggcttcactgtataa

SEQ ID NO: 4061384 - DNA, 23 bp, Homo sapiens
tgccatgggcttcactgtataaa

SEQ ID NO: 4061385 - DNA, 21 bp, Homo sapiens
tgccatgttgcccctttctct

SEQ ID NO: 4061386 - DNA, 18 bp, Homo sapiens
tgccattccactccactc

SEQ ID NO: 4061387 - DNA, 14 bp, Homo sapiens
tgccatttcccttc

SEQ ID NO: 4061388 - DNA, 21 bp, Homo sapiens
tgcccaagcccaggccaccct

SEQ ID NO: 4061389 - DNA, 17 bp, Homo sapiens
tgcccaagggcctccca

SEQ ID NO: 4061390 - DNA, 21 bp, Homo sapiens
tgcccaagggcctcccaccag

SEQ ID NO: 4061391 - DNA, 16 bp, Homo sapiens
tgcccaagtcacacag

SEQ ID NO: 4061392 - DNA, 17 bp, Homo sapiens
tgcccaagtcacacagc

SEQ ID NO: 4061393 - DNA, 21 bp, Homo sapiens
tgcccaatgagactctagggt

SEQ ID NO: 4061394 - DNA, 15 bp, Homo sapiens
tgcccaattggagga

SEQ ID NO: 4061395 - DNA, 21 bp, Homo sapiens
tgcccaattggaggaaagcaa

SEQ ID NO: 4061396 - DNA, 16 bp, Homo sapiens
tgcccacatcccaggc

SEQ ID NO: 4061397 - DNA, 13 bp, Homo sapiens
tgcccaccccctg

SEQ ID NO: 4061398 - DNA, 19 bp, Homo sapiens
tgcccaccccctgccctgc

SEQ ID NO: 4061399 - DNA, 18 bp, Homo sapiens
tgcccacccctcactccc

SEQ ID NO: 4061400 - DNA, 15 bp, Homo sapiens
tgcccacctgcccat

SEQ ID NO: 4061401 - DNA, 19 bp, Homo sapiens
tgcccacctgcccatcaca

SEQ ID NO: 4061402 - DNA, 16 bp, Homo sapiens
tgcccactccctatct

SEQ ID NO: 4061403 - DNA, 14 bp, Homo sapiens
tgcccactcctgct

SEQ ID NO: 4061404 - DNA, 16 bp, Homo sapiens
tgcccactgctggtgc

SEQ ID NO: 4061405 - DNA, 16 bp, Homo sapiens
tgcccagaacttccct

SEQ ID NO: 4061406 - DNA, 19 bp, Homo sapiens
tgcccagacccctctggcc

SEQ ID NO: 4061407 - DNA, 17 bp, Homo sapiens
tgcccagatcagccaga

SEQ ID NO: 4061408 - DNA, 14 bp, Homo sapiens
tgcccagcctgggg

SEQ ID NO: 4061409 - DNA, 23 bp, Homo sapiens
tgcccagcctggggcaaacctag

SEQ ID NO: 4061410 - DNA, 16 bp, Homo sapiens
tgccgctgccgctgca

SEQ ID NO: 4061411 - DNA, 18 bp, Homo sapiens
tgccggatacaaactggt

SEQ ID NO: 4061412 - DNA, 17 bp, Homo sapiens
tgccggctgtggagcaa

SEQ ID NO: 4061413 - DNA, 23 bp, Homo sapiens
tgccgggctgagggcctgctgga

SEQ ID NO: 4061414 - DNA, 21 bp, Homo sapiens
tgccggtcttgacagctcagt

SEQ ID NO: 4061415 - DNA, 20 bp, Homo sapiens
tgccgtgggcctgtcgtgcc

SEQ ID NO: 4061416 - DNA, 16 bp, Homo sapiens
tgccgtgtgagtgtga

SEQ ID NO: 4061417 - DNA, 22 bp, Homo sapiens
tgccgtgtgagtgtgacagggc

SEQ ID NO: 4061418 - DNA, 22 bp, Homo sapiens
tgcctacaaccatccctgccac

SEQ ID NO: 4061419 - DNA, 22 bp, Homo sapiens
tgcctacagaacttcagaaaga

SEQ ID NO: 4061420 - DNA, 23 bp, Homo sapiens
tgcctacagaacttcagaaagac

SEQ ID NO: 4061421 - DNA, 16 bp, Homo sapiens
tgcctagacttcccaa

SEQ ID NO: 4061422 - DNA, 16 bp, Homo sapiens
tgcctagcaagctggc

SEQ ID NO: 4061423 - DNA, 18 bp, Homo sapiens
tgcctagcaagctggcct

SEQ ID NO: 4061424 - DNA, 14 bp, Homo sapiens
tgcctagcagagtg

SEQ ID NO: 4061425 - DNA, 14 bp, Homo sapiens
tgcctatttgtgtg

SEQ ID NO: 4061426 - DNA, 15 bp, Homo sapiens
tgcctcaatgccagt

SEQ ID NO: 4061427 - DNA, 16 bp, Homo sapiens
tgcctcaatgccagta

SEQ ID NO: 4061428 - DNA, 19 bp, Homo sapiens
tgcctcaatgtgaccaggg

SEQ ID NO: 4061429 - DNA, 20 bp, Homo sapiens
tgcctcagactccgccctcc

SEQ ID NO: 4061430 - DNA, 14 bp, Homo sapiens
tgcctcagcctccg

SEQ ID NO: 4061431 - DNA, 14 bp, Homo sapiens
tgcctcagccttcc

SEQ ID NO: 4061432 - DNA, 16 bp, Homo sapiens
tgcctccaccctcctc

SEQ ID NO: 4061433 - DNA, 19 bp, Homo sapiens
tgcctcccaaggtcctctc

SEQ ID NO: 4061434 - DNA, 17 bp, Homo sapiens
tgcctccccatttccca

SEQ ID NO: 4061435 - DNA, 20 bp, Homo sapiens
tgcctcctgggaagatgagg

SEQ ID NO: 4061436 - DNA, 17 bp, Homo sapiens
tgcctcgctcaccgctg

SEQ ID NO: 4061437 - DNA, 22 bp, Homo sapiens
tgcctcgctcaccgctggccct

SEQ ID NO: 4061438 - DNA, 20 bp, Homo sapiens
tgcctctaccagttggcaga

SEQ ID NO: 4061439 - DNA, 13 bp, Homo sapiens
tgcctctcccgca

SEQ ID NO: 4061440 - DNA, 20 bp, Homo sapiens
tgcctctgcggggcagggcc

SEQ ID NO: 4061441 - DNA, 13 bp, Homo sapiens
tgcctcttctttg

SEQ ID NO: 4061442 - DNA, 19 bp, Homo sapiens
tgcctcttctttgtgcctt

SEQ ID NO: 4061443 - DNA, 19 bp, Homo sapiens
tgcctgaaacagccatgtc

SEQ ID NO: 4061444 - DNA, 20 bp, Homo sapiens
tgcctgaaacagccatgtcc

SEQ ID NO: 4061445 - DNA, 18 bp, Homo sapiens
tgcctgacactgagcccc

SEQ ID NO: 4061446 - DNA, 22 bp, Homo sapiens
tgcctgacactgagccccacct

SEQ ID NO: 4061447 - DNA, 16 bp, Homo sapiens
tgcctgactaaaatgt

SEQ ID NO: 4061448 - DNA, 11 bp, Homo sapiens
tgcctgagctg

SEQ ID NO: 4061449 - DNA, 14 bp, Homo sapiens
tgcctgagggcagt

SEQ ID NO: 4061450 - DNA, 16 bp, Homo sapiens
tgcctgaggggcagcc

SEQ ID NO: 4061451 - DNA, 14 bp, Homo sapiens
tgcctgagggtgga

SEQ ID NO: 4061452 - DNA, 15 bp, Homo sapiens
tgcctgagtttccag

SEQ ID NO: 4061453 - DNA, 22 bp, Homo sapiens
tgcctgcactgagagggcaagg

SEQ ID NO: 4061454 - DNA, 18 bp, Homo sapiens
tgcctgcagagagaagcc

SEQ ID NO: 4061455 - DNA, 14 bp, Homo sapiens
tgcctgcagcaggc

SEQ ID NO: 4061456 - DNA, 17 bp, Homo sapiens
tgcctgcagcaggcagc

SEQ ID NO: 4061457 - DNA, 19 bp, Homo sapiens
tgcctgccagctgcactga

SEQ ID NO: 4061458 - DNA, 14 bp, Homo sapiens
tgcctgccccacac

SEQ ID NO: 4061459 - DNA, 18 bp, Homo sapiens
tgcctgcccccctcatct

SEQ ID NO: 4061460 - DNA, 17 bp, Homo sapiens
tgcctgccccgccccca

SEQ ID NO: 4061461 - DNA, 10 bp, Homo sapiens
tgcctgccct

SEQ ID NO: 4061462 - DNA, 13 bp, Homo sapiens
tgcctgccctttg

SEQ ID NO: 4061463 - DNA, 21 bp, Homo sapiens
tgcctgccctttgtcctcctg

SEQ ID NO: 4061464 - DNA, 15 bp, Homo sapiens
tgcctgcgcctgctg

SEQ ID NO: 4061465 - DNA, 12 bp, Homo sapiens
tgcctgctgggc

SEQ ID NO: 4061466 - DNA, 21 bp, Homo sapiens
tgcctggacatttgccttgct

SEQ ID NO: 4061467 - DNA, 17 bp, Homo sapiens
tgcctggagagggtctc

SEQ ID NO: 4061468 - DNA, 21 bp, Homo sapiens
tgcctggagtgcccaccctgg

SEQ ID NO: 4061469 - DNA, 15 bp, Homo sapiens
tgcctggagtgctgt

SEQ ID NO: 4061470 - DNA, 23 bp, Homo sapiens
tgcctggatcccctctgtctaca

SEQ ID NO: 4061471 - DNA, 14 bp, Homo sapiens
tgcctggccaggca

SEQ ID NO: 4061472 - DNA, 16 bp, Homo sapiens
tgcctggccaggcaga

SEQ ID NO: 4061473 - DNA, 20 bp, Homo sapiens
tgcctggccaggcagatctg

SEQ ID NO: 4061474 - DNA, 16 bp, Homo sapiens
tgcctggccccagcct

SEQ ID NO: 4061475 - DNA, 17 bp, Homo sapiens
tgcctggccccagcctg

SEQ ID NO: 4061476 - DNA, 21 bp, Homo sapiens
tgcctggcccctcgcctgtgg

SEQ ID NO: 4061477 - DNA, 14 bp, Homo sapiens
tgcctggcctctgc

SEQ ID NO: 4061478 - DNA, 15 bp, Homo sapiens
tgcctggcctctgcc

SEQ ID NO: 4061479 - DNA, 16 bp, Homo sapiens
tgcctggcctctgcct

SEQ ID NO: 4061480 - DNA, 15 bp, Homo sapiens
tgcctggctaacttt

SEQ ID NO: 4061481 - DNA, 14 bp, Homo sapiens
tgcctgggggagtt

SEQ ID NO: 4061482 - DNA, 20 bp, Homo sapiens
tgcctgggggagttttcctc

SEQ ID NO: 4061483 - DNA, 12 bp, Homo sapiens
tgcctggggtct

SEQ ID NO: 4061484 - DNA, 13 bp, Homo sapiens
tgcctgtaaacat

SEQ ID NO: 4061485 - DNA, 14 bp, Homo sapiens
tgcctgtctgcccc

SEQ ID NO: 4061486 - DNA, 16 bp, Homo sapiens
tgcctgtctggctcag

SEQ ID NO: 4061487 - DNA, 14 bp, Homo sapiens
tgcctgtgccaccc

SEQ ID NO: 4061488 - DNA, 20 bp, Homo sapiens
tgcctgtgccacccaccagg

SEQ ID NO: 4061489 - DNA, 22 bp, Homo sapiens
tgcctgtggaagagtgtgtgtg

SEQ ID NO: 4061490 - DNA, 15 bp, Homo sapiens
tgccttaaaaccaaa

SEQ ID NO: 4061491 - DNA, 20 bp, Homo sapiens
tgccttaaaaccaaagaggg

SEQ ID NO: 4061492 - DNA, 19 bp, Homo sapiens
tgccttaaacactcacctt

SEQ ID NO: 4061493 - DNA, 17 bp, Homo sapiens
tgccttaaacctacctc

SEQ ID NO: 4061494 - DNA, 17 bp, Homo sapiens
tgccttaggcctacctg

SEQ ID NO: 4061495 - DNA, 16 bp, Homo sapiens
tgccttagtctcagtt

SEQ ID NO: 4061496 - DNA, 23 bp, Homo sapiens
tgccttcagctgttgcagatgaa

SEQ ID NO: 4061497 - DNA, 17 bp, Homo sapiens
tgccttcaggcttctgt

SEQ ID NO: 4061498 - DNA, 24 bp, Homo sapiens
tgccttcatggaactcagctgtct

SEQ ID NO: 4061499 - DNA, 13 bp, Homo sapiens
tgccttccataat

SEQ ID NO: 4061500 - DNA, 16 bp, Homo sapiens
tgccttccctagcttt

SEQ ID NO: 4061501 - DNA, 21 bp, Homo sapiens
tgccttcctttctccaggacc

SEQ ID NO: 4061502 - DNA, 19 bp, Homo sapiens
tgccttctcctctctgggc

SEQ ID NO: 4061503 - DNA, 21 bp, Homo sapiens
tgccttctccttccccaggat

SEQ ID NO: 4061504 - DNA, 23 bp, Homo sapiens
tgccttctccttccccaggatgg

SEQ ID NO: 4061505 - DNA, 24 bp, Homo sapiens
tgccttctccttccccaggatgga

SEQ ID NO: 4061506 - DNA, 20 bp, Homo sapiens
tgccttctgaaatgtgaccc

SEQ ID NO: 4061507 - DNA, 13 bp, Homo sapiens
tgccttcttcacc

SEQ ID NO: 4061508 - DNA, 13 bp, Homo sapiens
tgccttctttcca

SEQ ID NO: 4061509 - DNA, 12 bp, Homo sapiens
tgccttctttga

SEQ ID NO: 4061510 - DNA, 13 bp, Homo sapiens
tgccttctttgaa

SEQ ID NO: 4061511 - DNA, 15 bp, Homo sapiens
tgccttctttgaaga

SEQ ID NO: 4061512 - DNA, 16 bp, Homo sapiens
tgccttcttttgatta

SEQ ID NO: 4061513 - DNA, 18 bp, Homo sapiens
tgctcaaatctattcaga

SEQ ID NO: 4061514 - DNA, 19 bp, Homo sapiens
tgctcaaatctattcagac

SEQ ID NO: 4061515 - DNA, 20 bp, Homo sapiens
tgctcaactctacccctgct

SEQ ID NO: 4061516 - DNA, 23 bp, Homo sapiens
tgctcaactctacccctgctccc

SEQ ID NO: 4061517 - DNA, 18 bp, Homo sapiens
tgctcaataaacacttgt

SEQ ID NO: 4061518 - DNA, 19 bp, Homo sapiens
tgctcaatggagaatataa

SEQ ID NO: 4061519 - DNA, 17 bp, Homo sapiens
tgctcacaacttagtgt

SEQ ID NO: 4061520 - DNA, 15 bp, Homo sapiens
tgctcaccacctgcc

SEQ ID NO: 4061521 - DNA, 17 bp, Homo sapiens
tgctcaccagccctgca

SEQ ID NO: 4061522 - DNA, 12 bp, Homo sapiens
tgctcacctcta

SEQ ID NO: 4061523 - DNA, 17 bp, Homo sapiens
tgctcagaacttgctgc

SEQ ID NO: 4061524 - DNA, 21 bp, Homo sapiens
tgctcagcaattcagacccct

SEQ ID NO: 4061525 - DNA, 14 bp, Homo sapiens
tgctcagccaagct

SEQ ID NO: 4061526 - DNA, 17 bp, Homo sapiens
tgctcagccctgactgg

SEQ ID NO: 4061527 - DNA, 17 bp, Homo sapiens
tgctcagctctgggcca

SEQ ID NO: 4061528 - DNA, 18 bp, Homo sapiens
tgctcagctctgggccat

SEQ ID NO: 4061529 - DNA, 16 bp, Homo sapiens
tgctcagtctcccttt

SEQ ID NO: 4061530 - DNA, 12 bp, Homo sapiens
tgctcatttaag

SEQ ID NO: 4061531 - DNA, 19 bp, Homo sapiens
tgctcattttctggtttgg

SEQ ID NO: 4061532 - DNA, 21 bp, Homo sapiens
tgctcattttctggtttggca

SEQ ID NO: 4061533 - DNA, 23 bp, Homo sapiens
tgctccacccttggcctgtctca

SEQ ID NO: 4061534 - DNA, 18 bp, Homo sapiens
tgctccacgaagccttaa

SEQ ID NO: 4061535 - DNA, 20 bp, Homo sapiens
tgctccagaagatgccagct

SEQ ID NO: 4061536 - DNA, 17 bp, Homo sapiens
tgctccagctctggcat

SEQ ID NO: 4061537 - DNA, 13 bp, Homo sapiens
tgctccaggcctg

SEQ ID NO: 4061538 - DNA, 18 bp, Homo sapiens
tgctccataccttttctc

SEQ ID NO: 4061539 - DNA, 14 bp, Homo sapiens
tgctcccagcagcc

SEQ ID NO: 4061540 - DNA, 20 bp, Homo sapiens
tgctcccagcagccctaagg

SEQ ID NO: 4061541 - DNA, 21 bp, Homo sapiens
tgctcccagcagccctaagga

SEQ ID NO: 4061542 - DNA, 14 bp, Homo sapiens
tgctccccacagcg

SEQ ID NO: 4061543 - DNA, 22 bp, Homo sapiens
tgctccccacagcgtccctggc

SEQ ID NO: 4061544 - DNA, 16 bp, Homo sapiens
tgctccccagccctgg

SEQ ID NO: 4061545 - DNA, 13 bp, Homo sapiens
tgctccccctttt

SEQ ID NO: 4061546 - DNA, 18 bp, Homo sapiens
tgctcccctgtgccagcc

SEQ ID NO: 4061547 - DNA, 16 bp, Homo sapiens
tgctccccttcccctt

SEQ ID NO: 4061548 - DNA, 19 bp, Homo sapiens
tgctccctaccccagggcc

SEQ ID NO: 4061549 - DNA, 13 bp, Homo sapiens
tgctccctcagcc

SEQ ID NO: 4061550 - DNA, 20 bp, Homo sapiens
tgctccctcagcctcagagg

SEQ ID NO: 4061551 - DNA, 20 bp, Homo sapiens
tgctccctgctttggctgag

SEQ ID NO: 4061552 - DNA, 23 bp, Homo sapiens
tgctccctgtgtccacctgtggg

SEQ ID NO: 4061553 - DNA, 16 bp, Homo sapiens
tgctcccttcagcccc

SEQ ID NO: 4061554 - DNA, 13 bp, Homo sapiens
tgctccgcccgct

SEQ ID NO: 4061555 - DNA, 23 bp, Homo sapiens
tgctccgcccgctcctgccgcag

SEQ ID NO: 4061556 - DNA, 23 bp, Homo sapiens
tgctccgctgctccttggcttac

SEQ ID NO: 4061557 - DNA, 16 bp, Homo sapiens
tgctcctcacctgtct

SEQ ID NO: 4061558 - DNA, 11 bp, Homo sapiens
tgctcctcctg

SEQ ID NO: 4061559 - DNA, 18 bp, Homo sapiens
tgctcctcttgattcctg

SEQ ID NO: 4061560 - DNA, 16 bp, Homo sapiens
tgctcctgcttttctg

SEQ ID NO: 4061561 - DNA, 20 bp, Homo sapiens
tgctcctgcttttctgtcct

SEQ ID NO: 4061562 - DNA, 22 bp, Homo sapiens
tgctcctgcttttctgtcctgg

SEQ ID NO: 4061563 - DNA, 16 bp, Homo sapiens
tgctccttcccttgct

SEQ ID NO: 4061564 - DNA, 15 bp, Homo sapiens
tgctccttggcttac

SEQ ID NO: 4061565 - DNA, 22 bp, Homo sapiens
tgctccttggcttacctgacct

SEQ ID NO: 4061566 - DNA, 16 bp, Homo sapiens
tgctcgccccagcagg

SEQ ID NO: 4061567 - DNA, 23 bp, Homo sapiens
tgctctacccatgagcctgcccg

SEQ ID NO: 4061568 - DNA, 19 bp, Homo sapiens
tgctctaggaagacatttt

SEQ ID NO: 4061569 - DNA, 16 bp, Homo sapiens
tgctctagtgggacag

SEQ ID NO: 4061570 - DNA, 15 bp, Homo sapiens
tgctctcaattaaag

SEQ ID NO: 4061571 - DNA, 20 bp, Homo sapiens
tgctctccaagtctcagtgg

SEQ ID NO: 4061572 - DNA, 11 bp, Homo sapiens
tgctctcctca

SEQ ID NO: 4061573 - DNA, 17 bp, Homo sapiens
tgctctctcaaattgtc

SEQ ID NO: 4061574 - DNA, 18 bp, Homo sapiens
tgctctgacgtagaaaga

SEQ ID NO: 4061575 - DNA, 23 bp, Homo sapiens
tgctctgagagcaaactggcttg

SEQ ID NO: 4061576 - DNA, 16 bp, Homo sapiens
tgctctgagccacagt

SEQ ID NO: 4061577 - DNA, 10 bp, Homo sapiens
tgctctgctg

SEQ ID NO: 4061578 - DNA, 19 bp, Homo sapiens
tgctctggaaaatgtgacc

SEQ ID NO: 4061579 - DNA, 19 bp, Homo sapiens
tgctctggttgtttctgtt

SEQ ID NO: 4061580 - DNA, 21 bp, Homo sapiens
tgctctggttgtttctgttcc

SEQ ID NO: 4061581 - DNA, 12 bp, Homo sapiens
tgctctgtcccc

SEQ ID NO: 4061582 - DNA, 18 bp, Homo sapiens
tgctctgtcccccaggct

SEQ ID NO: 4061583 - DNA, 18 bp, Homo sapiens
tgctctgtgttcccagag

SEQ ID NO: 4061584 - DNA, 22 bp, Homo sapiens
tgctctgtgttcccagaggcag

SEQ ID NO: 4061585 - DNA, 13 bp, Homo sapiens
tgctctgttccca

SEQ ID NO: 4061586 - DNA, 16 bp, Homo sapiens
tgctcttgcagttgct

SEQ ID NO: 4061587 - DNA, 14 bp, Homo sapiens
tgctcttgtcccac

SEQ ID NO: 4061588 - DNA, 16 bp, Homo sapiens
tgctcttgtcccacgt

SEQ ID NO: 4061589 - DNA, 15 bp, Homo sapiens
tgctcttgtttttat

SEQ ID NO: 4061590 - DNA, 18 bp, Homo sapiens
tgctcttgtttttattaa

SEQ ID NO: 4061591 - DNA, 20 bp, Homo sapiens
tgctctttcccacccagcct

SEQ ID NO: 4061592 - DNA, 21 bp, Homo sapiens
tgctctttcccacccagcctg

SEQ ID NO: 4061593 - DNA, 16 bp, Homo sapiens
tgctcttttaagcagt

SEQ ID NO: 4061594 - DNA, 23 bp, Homo sapiens
tgctcttttaagcagtctcactg

SEQ ID NO: 4061595 - DNA, 15 bp, Homo sapiens
tgctcttttcctggt

SEQ ID NO: 4061596 - DNA, 14 bp, Homo sapiens
tgctcttttttctc

SEQ ID NO: 4061597 - DNA, 14 bp, Homo sapiens
tgctgaaaatggta

SEQ ID NO: 4061598 - DNA, 15 bp, Homo sapiens
tgctgaacacacaca

SEQ ID NO: 4061599 - DNA, 14 bp, Homo sapiens
tgctgaacagtgga

SEQ ID NO: 4061600 - DNA, 16 bp, Homo sapiens
tgctgaactccttgtt

SEQ ID NO: 4061601 - DNA, 17 bp, Homo sapiens
tgctgaactccttgtta

SEQ ID NO: 4061602 - DNA, 17 bp, Homo sapiens
tgctgaatgcagggaat

SEQ ID NO: 4061603 - DNA, 22 bp, Homo sapiens
tgctgaatggttttcaaaataa

SEQ ID NO: 4061604 - DNA, 18 bp, Homo sapiens
tgctgacattcacctgcc

SEQ ID NO: 4061605 - DNA, 16 bp, Homo sapiens
tgctgaccaattgtgc

SEQ ID NO: 4061606 - DNA, 18 bp, Homo sapiens
tgctgaccaattgtgctg

SEQ ID NO: 4061607 - DNA, 22 bp, Homo sapiens
tgctgacggccagggagaagct

SEQ ID NO: 4061608 - DNA, 23 bp, Homo sapiens
tgctgagagaaatatggaactta

SEQ ID NO: 4061609 - DNA, 12 bp, Homo sapiens
tgctgagcctct

SEQ ID NO: 4061610 - DNA, 14 bp, Homo sapiens
tgctgagcctctgc

SEQ ID NO: 4061611 - DNA, 16 bp, Homo sapiens
tgctgaggccagggct

SEQ ID NO: 4061612 - DNA, 17 bp, Homo sapiens
tgctgaggcctccagct

SEQ ID NO: 4061613 - DNA, 12 bp, Homo sapiens
tgctgagggtgt

SEQ ID NO: 4061614 - DNA, 22 bp, Homo sapiens
tgctgagggtgtttcttcctgc

SEQ ID NO: 4061615 - DNA, 17 bp, Homo sapiens
tgctgagtcatctgtta

SEQ ID NO: 4061616 - DNA, 19 bp, Homo sapiens
tgctgagtcatctgttagg

SEQ ID NO: 4061617 - DNA, 19 bp, Homo sapiens
tgctgagtggcgcaaggcc

SEQ ID NO: 4061618 - DNA, 15 bp, Homo sapiens
tgctgagttggcctg

SEQ ID NO: 4061619 - DNA, 23 bp, Homo sapiens
tgctgatgacccccccagcttca

SEQ ID NO: 4061620 - DNA, 20 bp, Homo sapiens
tgctgatgattttgcaaaat

SEQ ID NO: 4061621 - DNA, 20 bp, Homo sapiens
tgctgcatagctctatttta

SEQ ID NO: 4061622 - DNA, 15 bp, Homo sapiens
tgctgccacacttca

SEQ ID NO: 4061623 - DNA, 16 bp, Homo sapiens
tgctgccacacttcag

SEQ ID NO: 4061624 - DNA, 17 bp, Homo sapiens
tgctgccagtaccagcc

SEQ ID NO: 4061625 - DNA, 21 bp, Homo sapiens
tgctgccatgacagaggctgc

SEQ ID NO: 4061626 - DNA, 21 bp, Homo sapiens
tgctgccatttgatttttcta

SEQ ID NO: 4061627 - DNA, 12 bp, Homo sapiens
tgctgccccagc

SEQ ID NO: 4061628 - DNA, 13 bp, Homo sapiens
tgctgccccagct

SEQ ID NO: 4061629 - DNA, 13 bp, Homo sapiens
tgctgcccctgca

SEQ ID NO: 4061630 - DNA, 14 bp, Homo sapiens
tgctgcccctgcag

SEQ ID NO: 4061631 - DNA, 14 bp, Homo sapiens
tgctgccctgtgta

SEQ ID NO: 4061632 - DNA, 16 bp, Homo sapiens
tgctgcctgctgagat

SEQ ID NO: 4061633 - DNA, 18 bp, Homo sapiens
tgctgcgcaccaatgccc

SEQ ID NO: 4061634 - DNA, 16 bp, Homo sapiens
tgctgcgcccttacct

SEQ ID NO: 4061635 - DNA, 17 bp, Homo sapiens
tgctgctccgcccgctc

SEQ ID NO: 4061636 - DNA, 17 bp, Homo sapiens
tgctgctgcctctttcc

SEQ ID NO: 4061637 - DNA, 12 bp, Homo sapiens
tgctgctggcca

SEQ ID NO: 4061638 - DNA, 13 bp, Homo sapiens
tgctgctggccaa

SEQ ID NO: 4061639 - DNA, 14 bp, Homo sapiens
tgctgctggccaaa

SEQ ID NO: 4061640 - DNA, 21 bp, Homo sapiens
tgctgctggccaaatagcaaa

SEQ ID NO: 4061641 - DNA, 12 bp, Homo sapiens
tgctgctgtctt

SEQ ID NO: 4061642 - DNA, 14 bp, Homo sapiens
tgctgctgtgtttt

SEQ ID NO: 4061643 - DNA, 20 bp, Homo sapiens
tgctggacggggactgggga

SEQ ID NO: 4061644 - DNA, 21 bp, Homo sapiens
tgctggactggaggcccctgg

SEQ ID NO: 4061645 - DNA, 13 bp, Homo sapiens
tgctggagaggtt

SEQ ID NO: 4061646 - DNA, 17 bp, Homo sapiens
tgctggataaaatgagg

SEQ ID NO: 4061647 - DNA, 22 bp, Homo sapiens
tgctggatattttcaaattgta

SEQ ID NO: 4061648 - DNA, 14 bp, Homo sapiens
tgctggccagcacc

SEQ ID NO: 4061649 - DNA, 12 bp, Homo sapiens
tgctggcccagg

SEQ ID NO: 4061650 - DNA, 13 bp, Homo sapiens
tgctggcccaggg

SEQ ID NO: 4061651 - DNA, 14 bp, Homo sapiens
tgctggcccagggc

SEQ ID NO: 4061652 - DNA, 16 bp, Homo sapiens
tgctggcccagggccc

SEQ ID NO: 4061653 - DNA, 19 bp, Homo sapiens
tgctggcccagggcccaga

SEQ ID NO: 4061654 - DNA, 23 bp, Homo sapiens
tgctggcccagggcccagagccc

SEQ ID NO: 4061655 - DNA, 12 bp, Homo sapiens
tgctggcctgga

SEQ ID NO: 4061656 - DNA, 15 bp, Homo sapiens
tgctggcctggatct

SEQ ID NO: 4061657 - DNA, 13 bp, Homo sapiens
tgctggctcttct

SEQ ID NO: 4061658 - DNA, 13 bp, Homo sapiens
tgctggctgcctt

SEQ ID NO: 4061659 - DNA, 16 bp, Homo sapiens
tgctggcttccagctt

SEQ ID NO: 4061660 - DNA, 17 bp, Homo sapiens
tgctgggaccagagcca

SEQ ID NO: 4061661 - DNA, 18 bp, Homo sapiens
tgctgggaccagagccag

SEQ ID NO: 4061662 - DNA, 17 bp, Homo sapiens
tgctgggagttctagaa

SEQ ID NO: 4061663 - DNA, 14 bp, Homo sapiens
tgctgggccactgg

SEQ ID NO: 4061664 - DNA, 22 bp, Homo sapiens
tgctgggctccccccagtggga

SEQ ID NO: 4061665 - DNA, 12 bp, Homo sapiens
tgctgggctggg

SEQ ID NO: 4061666 - DNA, 16 bp, Homo sapiens
tgctgggctgggccct

SEQ ID NO: 4061667 - DNA, 12 bp, Homo sapiens
tgctggggcagg

SEQ ID NO: 4061668 - DNA, 21 bp, Homo sapiens
tgctgggggaatgagcccaga

SEQ ID NO: 4061669 - DNA, 23 bp, Homo sapiens
tgctgggggaatgagcccagaga

SEQ ID NO: 4061670 - DNA, 19 bp, Homo sapiens
tgctggggtcaaggcagta

SEQ ID NO: 4061671 - DNA, 17 bp, Homo sapiens
tgctggtaacagtggct

SEQ ID NO: 4061672 - DNA, 15 bp, Homo sapiens
tgctggtgccagggt

SEQ ID NO: 4061673 - DNA, 22 bp, Homo sapiens
tgctggtttatttgttgttttc

SEQ ID NO: 4061674 - DNA, 15 bp, Homo sapiens
tgctgtacccagatg

SEQ ID NO: 4061675 - DNA, 21 bp, Homo sapiens
tgctgtacccagatgcctaca

SEQ ID NO: 4061676 - DNA, 16 bp, Homo sapiens
tgctgtagatgacaac

SEQ ID NO: 4061677 - DNA, 16 bp, Homo sapiens
tgctgtataagttatt

SEQ ID NO: 4061678 - DNA, 20 bp, Homo sapiens
tgctgtatgctgatcatcgc

SEQ ID NO: 4061679 - DNA, 13 bp, Homo sapiens
tgctgtcattgct

SEQ ID NO: 4061680 - DNA, 24 bp, Homo sapiens
tgctgtcattgcttcttctgaggc

SEQ ID NO: 4061681 - DNA, 12 bp, Homo sapiens
tgctgtccctcc

SEQ ID NO: 4061682 - DNA, 13 bp, Homo sapiens
tgctgtccctccc

SEQ ID NO: 4061683 - DNA, 17 bp, Homo sapiens
tgctgtccctccccctt

SEQ ID NO: 4061684 - DNA, 21 bp, Homo sapiens
tgctgtcgttgttgtggaagc

SEQ ID NO: 4061685 - DNA, 21 bp, Homo sapiens
tgctgtcttccccaccgcagt

SEQ ID NO: 4061686 - DNA, 18 bp, Homo sapiens
tgctgtgaaccctggggc

SEQ ID NO: 4061687 - DNA, 19 bp, Homo sapiens
tgctgtgaggctgtcctgt

SEQ ID NO: 4061688 - DNA, 17 bp, Homo sapiens
tgctgtgagggagggga

SEQ ID NO: 4061689 - DNA, 18 bp, Homo sapiens
tgctgtgcgtggaaaaag

SEQ ID NO: 4061690 - DNA, 21 bp, Homo sapiens
tgctgtgcgtggaaaaagacg

SEQ ID NO: 4061691 - DNA, 16 bp, Homo sapiens
tgctgtgctgtgttta

SEQ ID NO: 4061692 - DNA, 22 bp, Homo sapiens
tgctgtggaactacattactgt

SEQ ID NO: 4061693 - DNA, 14 bp, Homo sapiens
tgctgtggccaggg

SEQ ID NO: 4061694 - DNA, 10 bp, Homo sapiens
tgctgtgggc

SEQ ID NO: 4061695 - DNA, 11 bp, Homo sapiens
tgctgtgggca

SEQ ID NO: 4061696 - DNA, 14 bp, Homo sapiens
tgctgtgggcagca

SEQ ID NO: 4061697 - DNA, 18 bp, Homo sapiens
tgctgtgggcagcaccct

SEQ ID NO: 4061698 - DNA, 16 bp, Homo sapiens
tgctgtggtggggaga

SEQ ID NO: 4061699 - DNA, 20 bp, Homo sapiens
tgctgtggtggggagaggca

SEQ ID NO: 4061700 - DNA, 20 bp, Homo sapiens
tgctgttactgttaaccatt

SEQ ID NO: 4061701 - DNA, 21 bp, Homo sapiens
tgctgttcactggacacttca

SEQ ID NO: 4061702 - DNA, 16 bp, Homo sapiens
tgctgtttgtagtgaa

SEQ ID NO: 4061703 - DNA, 21 bp, Homo sapiens
tgctgtttgtagtgaaataat

SEQ ID NO: 4061704 - DNA, 19 bp, Homo sapiens
tgcttaaaaatcattgatt

SEQ ID NO: 4061705 - DNA, 14 bp, Homo sapiens
tgcttaaaataagc

SEQ ID NO: 4061706 - DNA, 13 bp, Homo sapiens
tgcttaaactaaa

SEQ ID NO: 4061707 - DNA, 13 bp, Homo sapiens
tgcttaaatttct

SEQ ID NO: 4061708 - DNA, 17 bp, Homo sapiens
tgcttaattcaaataat

SEQ ID NO: 4061709 - DNA, 18 bp, Homo sapiens
tgcttaattcaaataata

SEQ ID NO: 4061710 - DNA, 20 bp, Homo sapiens
tgcttaattcaaataataat

SEQ ID NO: 4061711 - DNA, 15 bp, Homo sapiens
tgcttacacatctca

SEQ ID NO: 4061712 - DNA, 20 bp, Homo sapiens
tgcttacacatctcagaccc

SEQ ID NO: 4061713 - DNA, 14 bp, Homo sapiens
tgcttacttatgcc

SEQ ID NO: 4061714 - DNA, 16 bp, Homo sapiens
tgcttagagactatca

SEQ ID NO: 4061715 - DNA, 20 bp, Homo sapiens
tgcttatgaatatttataac

SEQ ID NO: 4061716 - DNA, 15 bp, Homo sapiens
tgcttattgttccaa

SEQ ID NO: 4061717 - DNA, 17 bp, Homo sapiens
tgcttattgttccaaga
